United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 57

SEQ ID NO: 2397887 - DNA, 18 bp, Homo sapiens
ccggagccggcactgcat

SEQ ID NO: 2397888 - DNA, 13 bp, Homo sapiens
ccggcactgcatg

SEQ ID NO: 2397889 - DNA, 21 bp, Homo sapiens
ccgggaccattgacctcagct

SEQ ID NO: 2397890 - DNA, 23 bp, Homo sapiens
ccgggaggtggagcttgcaatga

SEQ ID NO: 2397891 - DNA, 22 bp, Homo sapiens
ccgggcatggtggcatgtgcct

SEQ ID NO: 2397892 - DNA, 15 bp, Homo sapiens
ccggggcctggactg

SEQ ID NO: 2397893 - DNA, 15 bp, Homo sapiens
ccggtcccagcctgg

SEQ ID NO: 2397894 - DNA, 16 bp, Homo sapiens
ccggtcccagcctggg

SEQ ID NO: 2397895 - DNA, 14 bp, Homo sapiens
ccgtgaggccaaga

SEQ ID NO: 2397896 - DNA, 12 bp, Homo sapiens
ccgtgcagctgg

SEQ ID NO: 2397897 - DNA, 16 bp, Homo sapiens
ctgggacctgatttat

SEQ ID NO: 2397898 - DNA, 20 bp, Homo sapiens
ctgggatttgaactgagccg

SEQ ID NO: 2397899 - DNA, 18 bp, Homo sapiens
ctgggcacccacctccac

SEQ ID NO: 2397900 - DNA, 20 bp, Homo sapiens
ctgggcacccacctccaccc

SEQ ID NO: 2397901 - DNA, 21 bp, Homo sapiens
ctgggctccctttaagccaag

SEQ ID NO: 2397902 - DNA, 16 bp, Homo sapiens
ctgggctcctctgcat

SEQ ID NO: 2397903 - DNA, 21 bp, Homo sapiens
ctggggatcccgtgctggaag

SEQ ID NO: 2397904 - DNA, 14 bp, Homo sapiens
ctgggtgacagagc

SEQ ID NO: 2397905 - DNA, 15 bp, Homo sapiens
ctggtaattgtacaa

SEQ ID NO: 2397906 - DNA, 21 bp, Homo sapiens
ctggtaccttcccccagcttt

SEQ ID NO: 2397907 - DNA, 13 bp, Homo sapiens
ctggtctccccca

SEQ ID NO: 2397908 - DNA, 17 bp, Homo sapiens
ctggtgaggacaaggta

SEQ ID NO: 2397909 - DNA, 11 bp, Homo sapiens
ctggtgggagg

SEQ ID NO: 2397910 - DNA, 19 bp, Homo sapiens
ctggtgtcttgagaccagc

SEQ ID NO: 2397911 - DNA, 19 bp, Homo sapiens
ctgtaaaatgggtatattg

SEQ ID NO: 2397912 - DNA, 14 bp, Homo sapiens
ctgtaatcccagca

SEQ ID NO: 2397913 - DNA, 13 bp, Homo sapiens
ctgtaatggttgg

SEQ ID NO: 2397914 - DNA, 14 bp, Homo sapiens
ctgtattcccagct

SEQ ID NO: 2397915 - DNA, 16 bp, Homo sapiens
ctgtccattgccacgg

SEQ ID NO: 2397916 - DNA, 18 bp, Homo sapiens
ctgtccattgccacggcc

SEQ ID NO: 2397917 - DNA, 18 bp, Homo sapiens
ctgtcccaccaactctgc

SEQ ID NO: 2397918 - DNA, 19 bp, Homo sapiens
ctgtcggtgtttggaggct

SEQ ID NO: 2397919 - DNA, 22 bp, Homo sapiens
ctgtcggtgtttggaggctgct

SEQ ID NO: 2397920 - DNA, 22 bp, Homo sapiens
ctgtctaagcagttttgtaaat

SEQ ID NO: 2397921 - DNA, 13 bp, Homo sapiens
ctgtgacctgctc

SEQ ID NO: 2397922 - DNA, 18 bp, Homo sapiens
ctgtgacctgctcctgcc

SEQ ID NO: 2397923 - DNA, 19 bp, Homo sapiens
ctgtgacctgctcctgccc

SEQ ID NO: 2397924 - DNA, 21 bp, Homo sapiens
ctgtgacctgctcctgcccac

SEQ ID NO: 2397925 - DNA, 22 bp, Homo sapiens
ctgtgactcctcccttccccac

SEQ ID NO: 2397926 - DNA, 13 bp, Homo sapiens
ctgtgcacagccc

SEQ ID NO: 2397927 - DNA, 16 bp, Homo sapiens
ctgtggccttggccct

SEQ ID NO: 2397928 - DNA, 15 bp, Homo sapiens
ctgtgggtggggaag

SEQ ID NO: 2397929 - DNA, 16 bp, Homo sapiens
ctgtgtgaccttgggc

SEQ ID NO: 2397930 - DNA, 12 bp, Homo sapiens
ctgtgtggccct

SEQ ID NO: 2397931 - DNA, 13 bp, Homo sapiens
ctgtgtggccctg

SEQ ID NO: 2397932 - DNA, 14 bp, Homo sapiens
ctgtgtggccctgg

SEQ ID NO: 2397933 - DNA, 21 bp, Homo sapiens
ctgtgtggccctggacacagc

SEQ ID NO: 2397934 - DNA, 22 bp, Homo sapiens
cttaaacagttgcacagcatct

SEQ ID NO: 2397935 - DNA, 20 bp, Homo sapiens
cttaacacctgatctggccc

SEQ ID NO: 2397936 - DNA, 19 bp, Homo sapiens
cttacaccgtgaggccaag

SEQ ID NO: 2397937 - DNA, 18 bp, Homo sapiens
cttagatctgagccctcc

SEQ ID NO: 2397938 - DNA, 20 bp, Homo sapiens
cttagatctgagccctccct

SEQ ID NO: 2397939 - DNA, 21 bp, Homo sapiens
cttagatctgagccctccctc

SEQ ID NO: 2397940 - DNA, 19 bp, Homo sapiens
cttagcattttctgcatct

SEQ ID NO: 2397941 - DNA, 14 bp, Homo sapiens
cttatcctgttttc

SEQ ID NO: 2397942 - DNA, 13 bp, Homo sapiens
cttattggccact

SEQ ID NO: 2397943 - DNA, 16 bp, Homo sapiens
cttattggccactggg

SEQ ID NO: 2397944 - DNA, 17 bp, Homo sapiens
cttccccactctgctcc

SEQ ID NO: 2397945 - DNA, 19 bp, Homo sapiens
cttccccactctgctccca

SEQ ID NO: 2397946 - DNA, 22 bp, Homo sapiens
cttccccactctgctcccagcc

SEQ ID NO: 2397947 - DNA, 15 bp, Homo sapiens
cttcccccagctttc

SEQ ID NO: 2397948 - DNA, 17 bp, Homo sapiens
cttcccccagctttcca

SEQ ID NO: 2397949 - DNA, 16 bp, Homo sapiens
cttccctacccttcct

SEQ ID NO: 2397950 - DNA, 15 bp, Homo sapiens
cttcctgccaagcca

SEQ ID NO: 2397951 - DNA, 12 bp, Homo sapiens
cttcctgcccag

SEQ ID NO: 2397952 - DNA, 13 bp, Homo sapiens
cttcctgggcagt

SEQ ID NO: 2397953 - DNA, 17 bp, Homo sapiens
cttcctgggcagttggg

SEQ ID NO: 2397954 - DNA, 14 bp, Homo sapiens
cttcctttactgtt

SEQ ID NO: 2397955 - DNA, 18 bp, Homo sapiens
cttctctgggcccagaga

SEQ ID NO: 2397956 - DNA, 22 bp, Homo sapiens
cttgacattccttgtcaccagc

SEQ ID NO: 2397957 - DNA, 14 bp, Homo sapiens
cttgacctttccag

SEQ ID NO: 2397958 - DNA, 22 bp, Homo sapiens
cttgagaccagcctgccaggcc

SEQ ID NO: 2397959 - DNA, 17 bp, Homo sapiens
cttgagaccctcttctc

SEQ ID NO: 2397960 - DNA, 23 bp, Homo sapiens
cttgagaccctcttctctgggcc

SEQ ID NO: 2397961 - DNA, 15 bp, Homo sapiens
cttgagatgtgggta

SEQ ID NO: 2397962 - DNA, 16 bp, Homo sapiens
cttgcaatgagccaag

SEQ ID NO: 2397963 - DNA, 16 bp, Homo sapiens
cttgcattccagagtt

SEQ ID NO: 2397964 - DNA, 23 bp, Homo sapiens
cttgcattccagagttaaaatgt

SEQ ID NO: 2397965 - DNA, 16 bp, Homo sapiens
cttgcccgccagcctc

SEQ ID NO: 2397966 - DNA, 23 bp, Homo sapiens
cttgcccgccagcctcagtgcca

SEQ ID NO: 2397967 - DNA, 11 bp, Homo sapiens
cttgctgtgtg

SEQ ID NO: 2397968 - DNA, 16 bp, Homo sapiens
cttggggacaccccag

SEQ ID NO: 2397969 - DNA, 18 bp, Homo sapiens
cttgtcttctagtttaga

SEQ ID NO: 2397970 - DNA, 17 bp, Homo sapiens
cttgtggaccccgcctg

SEQ ID NO: 2397971 - DNA, 15 bp, Homo sapiens
ctttcactggggatc

SEQ ID NO: 2397972 - DNA, 16 bp, Homo sapiens
ctttcccttcccctgt

SEQ ID NO: 2397973 - DNA, 19 bp, Homo sapiens
ctttctttggtaggtaaat

SEQ ID NO: 2397974 - DNA, 12 bp, Homo sapiens
ctttgccagcca

SEQ ID NO: 2397975 - DNA, 15 bp, Homo sapiens
ctttggtaggtaaat

SEQ ID NO: 2397976 - DNA, 18 bp, Homo sapiens
ctttgttgtctacattaa

SEQ ID NO: 2397977 - DNA, 19 bp, Homo sapiens
cttttaaagactacctggg

SEQ ID NO: 2397978 - DNA, 21 bp, Homo sapiens
cttttagttcctgtgcacagc

SEQ ID NO: 2397979 - DNA, 18 bp, Homo sapiens
cttttctggctggggatg

SEQ ID NO: 2397980 - DNA, 12 bp, Homo sapiens
gaaaaataaaga

SEQ ID NO: 2397981 - DNA, 19 bp, Homo sapiens
gaaaagcagacgcagcagc

SEQ ID NO: 2397982 - DNA, 23 bp, Homo sapiens
gaaaataccacctcgagatgggt

SEQ ID NO: 2397983 - DNA, 19 bp, Homo sapiens
gaaacaaataatcacattg

SEQ ID NO: 2397984 - DNA, 17 bp, Homo sapiens
gaaaccatcctctccct

SEQ ID NO: 2397985 - DNA, 22 bp, Homo sapiens
gaaaccatcctctcccttctta

SEQ ID NO: 2397986 - DNA, 22 bp, Homo sapiens
gaaaggctcaatttggtgctca

SEQ ID NO: 2397987 - DNA, 21 bp, Homo sapiens
gaaataaaatcaccctgactg

SEQ ID NO: 2397988 - DNA, 22 bp, Homo sapiens
gaaatcattattgagtcaccat

SEQ ID NO: 2397989 - DNA, 22 bp, Homo sapiens
gaaattgattaaggctttcttt

SEQ ID NO: 2397990 - DNA, 23 bp, Homo sapiens
gaacccttaaacagttgcacagc

SEQ ID NO: 2397991 - DNA, 21 bp, Homo sapiens
gaactaaacgtcaccaaggtg

SEQ ID NO: 2397992 - DNA, 11 bp, Homo sapiens
gaactgagccg

SEQ ID NO: 2397993 - DNA, 19 bp, Homo sapiens
gaaggaggagggcgcccat

SEQ ID NO: 2397994 - DNA, 21 bp, Homo sapiens
gaagtggcataggagtgtgtt

SEQ ID NO: 2397995 - DNA, 15 bp, Homo sapiens
gaataaatacccatt

SEQ ID NO: 2397996 - DNA, 13 bp, Homo sapiens
gaatcccctgggg

SEQ ID NO: 2397997 - DNA, 14 bp, Homo sapiens
gaatcccctgggga

SEQ ID NO: 2397998 - DNA, 21 bp, Homo sapiens
gacaaggcatgtagggggagc

SEQ ID NO: 2397999 - DNA, 19 bp, Homo sapiens
gacacagcccaccctctgt

SEQ ID NO: 2398000 - DNA, 23 bp, Homo sapiens
gacagaaatgacaacaaggccct

SEQ ID NO: 2398001 - DNA, 17 bp, Homo sapiens
gaccagcctgccaggcc

SEQ ID NO: 2398002 - DNA, 18 bp, Homo sapiens
gaccagcctgccaggccc

SEQ ID NO: 2398003 - DNA, 16 bp, Homo sapiens
gaccaggccaatccct

SEQ ID NO: 2398004 - DNA, 14 bp, Homo sapiens
gaccatcctggccc

SEQ ID NO: 2398005 - DNA, 18 bp, Homo sapiens
gaccattgacctcagctg

SEQ ID NO: 2398006 - DNA, 12 bp, Homo sapiens
gaccctccccca

SEQ ID NO: 2398007 - DNA, 15 bp, Homo sapiens
gaccctcttctctgg

SEQ ID NO: 2398008 - DNA, 15 bp, Homo sapiens
gaccctgcctgagcc

SEQ ID NO: 2398009 - DNA, 16 bp, Homo sapiens
gaccctgcctgagccc

SEQ ID NO: 2398010 - DNA, 17 bp, Homo sapiens
gaccctgcctgagccca

SEQ ID NO: 2398011 - DNA, 20 bp, Homo sapiens
gacctgatttattgaaattt

SEQ ID NO: 2398012 - DNA, 21 bp, Homo sapiens
gacctgatttattgaaatttt

SEQ ID NO: 2398013 - DNA, 14 bp, Homo sapiens
ggcccgcccctcgc

SEQ ID NO: 2398014 - DNA, 13 bp, Homo sapiens
ggccctgaccccc

SEQ ID NO: 2398015 - DNA, 17 bp, Homo sapiens
ggccctggacacagccc

SEQ ID NO: 2398016 - DNA, 21 bp, Homo sapiens
ggccctggacacagcccaccc

SEQ ID NO: 2398017 - DNA, 23 bp, Homo sapiens
ggccctggacacagcccaccctc

SEQ ID NO: 2398018 - DNA, 19 bp, Homo sapiens
ggccgcaagtccccagccc

SEQ ID NO: 2398019 - DNA, 17 bp, Homo sapiens
ggccggtaggctgctgg

SEQ ID NO: 2398020 - DNA, 15 bp, Homo sapiens
ggcctccctcgggct

SEQ ID NO: 2398021 - DNA, 19 bp, Homo sapiens
ggcctgagcgcagcgcctc

SEQ ID NO: 2398022 - DNA, 13 bp, Homo sapiens
ggcctggactgca

SEQ ID NO: 2398023 - DNA, 12 bp, Homo sapiens
ggcctgggctgt

SEQ ID NO: 2398024 - DNA, 14 bp, Homo sapiens
ggcctgggctgttg

SEQ ID NO: 2398025 - DNA, 22 bp, Homo sapiens
ggccttgcccgccagcctcagt

SEQ ID NO: 2398026 - DNA, 13 bp, Homo sapiens
ggccttggccctg

SEQ ID NO: 2398027 - DNA, 16 bp, Homo sapiens
ggcgccccatgggccc

SEQ ID NO: 2398028 - DNA, 19 bp, Homo sapiens
ggcggcccacgccagctgg

SEQ ID NO: 2398029 - DNA, 13 bp, Homo sapiens
ggcggggcccctg

SEQ ID NO: 2398030 - DNA, 22 bp, Homo sapiens
ggctcactacatgggccagccc

SEQ ID NO: 2398031 - DNA, 23 bp, Homo sapiens
ggctcagatggggcctgggctgt

SEQ ID NO: 2398032 - DNA, 22 bp, Homo sapiens
ggctcatgcctgtaatcccagc

SEQ ID NO: 2398033 - DNA, 22 bp, Homo sapiens
ggctcctctgcatcttgctctg

SEQ ID NO: 2398034 - DNA, 13 bp, Homo sapiens
ggctctggccacc

SEQ ID NO: 2398035 - DNA, 15 bp, Homo sapiens
ggctctggccaccct

SEQ ID NO: 2398036 - DNA, 18 bp, Homo sapiens
ggctctggccaccctggc

SEQ ID NO: 2398037 - DNA, 18 bp, Homo sapiens
ggctgcgtccctgctcag

SEQ ID NO: 2398038 - DNA, 16 bp, Homo sapiens
ggctggtgtcttgaga

SEQ ID NO: 2398039 - DNA, 19 bp, Homo sapiens
ggctgttgtgtctggagcc

SEQ ID NO: 2398040 - DNA, 20 bp, Homo sapiens
ggcttgtacatttttaaatt

SEQ ID NO: 2398041 - DNA, 21 bp, Homo sapiens
ggcttgtacatttttaaattc

SEQ ID NO: 2398042 - DNA, 23 bp, Homo sapiens
ggcttgtacatttttaaattctt

SEQ ID NO: 2398043 - DNA, 14 bp, Homo sapiens
gggaccaggccaat

SEQ ID NO: 2398044 - DNA, 16 bp, Homo sapiens
gggaccattgacctca

SEQ ID NO: 2398045 - DNA, 12 bp, Homo sapiens
gggaggactccg

SEQ ID NO: 2398046 - DNA, 15 bp, Homo sapiens
gggaggcccggggcc

SEQ ID NO: 2398047 - DNA, 15 bp, Homo sapiens
gggatgcccctggcc

SEQ ID NO: 2398048 - DNA, 24 bp, Homo sapiens
gggatgcccctggccctgcctcac

SEQ ID NO: 2398049 - DNA, 15 bp, Homo sapiens
gggatttgctcctgg

SEQ ID NO: 2398050 - DNA, 22 bp, Homo sapiens
gggcaagtcccttgacctttcc

SEQ ID NO: 2398051 - DNA, 19 bp, Homo sapiens
gggcacctcatggactcca

SEQ ID NO: 2398052 - DNA, 21 bp, Homo sapiens
gggcagtgggacccatagatc

SEQ ID NO: 2398053 - DNA, 21 bp, Homo sapiens
gggcatccaccttcctgccca

SEQ ID NO: 2398054 - DNA, 18 bp, Homo sapiens
gggcatctcaatggcatg

SEQ ID NO: 2398055 - DNA, 23 bp, Homo sapiens
gggcccctgctccgaggggctca

SEQ ID NO: 2398056 - DNA, 21 bp, Homo sapiens
gggccctcagcgtctccccat

SEQ ID NO: 2398057 - DNA, 24 bp, Homo sapiens
gggcccttcctcgcacagggcatg

SEQ ID NO: 2398058 - DNA, 22 bp, Homo sapiens
gggcggcccacgccagctggcc

SEQ ID NO: 2398059 - DNA, 19 bp, Homo sapiens
gggctcagatggggcctgg

SEQ ID NO: 2398060 - DNA, 23 bp, Homo sapiens
gggctcctctgcatcttgctctg

SEQ ID NO: 2398061 - DNA, 17 bp, Homo sapiens
gggctctggccaccctg

SEQ ID NO: 2398062 - DNA, 19 bp, Homo sapiens
gggctctggccaccctggc

SEQ ID NO: 2398063 - DNA, 16 bp, Homo sapiens
gggctgcgtccctgct

SEQ ID NO: 2398064 - DNA, 22 bp, Homo sapiens
gggctgcgtccctgctcagccc

SEQ ID NO: 2398065 - DNA, 23 bp, Homo sapiens
gggctgcgtccctgctcagccca

SEQ ID NO: 2398066 - DNA, 14 bp, Homo sapiens
gggctggagaccag

SEQ ID NO: 2398067 - DNA, 20 bp, Homo sapiens
gggctgttgtgtctggagcc

SEQ ID NO: 2398068 - DNA, 12 bp, Homo sapiens
gggcttcctggg

SEQ ID NO: 2398069 - DNA, 12 bp, Homo sapiens
gggggagtggag

SEQ ID NO: 2398070 - DNA, 15 bp, Homo sapiens
gggggatgcccctgg

SEQ ID NO: 2398071 - DNA, 18 bp, Homo sapiens
gggggatgcccctggccc

SEQ ID NO: 2398072 - DNA, 14 bp, Homo sapiens
ggggtgcttgctgt

SEQ ID NO: 2398073 - DNA, 22 bp, Homo sapiens
gggtagaagcaaaggcaggagg

SEQ ID NO: 2398074 - DNA, 22 bp, Homo sapiens
gggtagtgaattggcttccttg

SEQ ID NO: 2398075 - DNA, 12 bp, Homo sapiens
ggtaattgtaca

SEQ ID NO: 2398076 - DNA, 18 bp, Homo sapiens
ggtaccttcccccagctt

SEQ ID NO: 2398077 - DNA, 22 bp, Homo sapiens
ggtaccttcccccagctttcca

SEQ ID NO: 2398078 - DNA, 17 bp, Homo sapiens
ggtaggctgctggcgcc

SEQ ID NO: 2398079 - DNA, 18 bp, Homo sapiens
ggtaggctgctggcgcct

SEQ ID NO: 2398080 - DNA, 13 bp, Homo sapiens
ggtaggtaaatct

SEQ ID NO: 2398081 - DNA, 22 bp, Homo sapiens
ggtcaggagttcgagagcagcc

SEQ ID NO: 2398082 - DNA, 24 bp, Homo sapiens
ggtcaggagttcgagagcagcctg

SEQ ID NO: 2398083 - DNA, 19 bp, Homo sapiens
ggtcatggtctgagtgggg

SEQ ID NO: 2398084 - DNA, 13 bp, Homo sapiens
ggtcccagcctgg

SEQ ID NO: 2398085 - DNA, 15 bp, Homo sapiens
ggtcccagcctgggc

SEQ ID NO: 2398086 - DNA, 22 bp, Homo sapiens
ggtcccagcctgggctcctctg

SEQ ID NO: 2398087 - DNA, 16 bp, Homo sapiens
ggtcctcctggcctga

SEQ ID NO: 2398088 - DNA, 13 bp, Homo sapiens
ggtgcttgctgtg

SEQ ID NO: 2398089 - DNA, 16 bp, Homo sapiens
ggtgcttgctgtgtga

SEQ ID NO: 2398090 - DNA, 19 bp, Homo sapiens
ggtggcatgtgcctgtatt

SEQ ID NO: 2398091 - DNA, 13 bp, Homo sapiens
ggtgggaggcccg

SEQ ID NO: 2398092 - DNA, 16 bp, Homo sapiens
ggtggggtgcttgctg

SEQ ID NO: 2398093 - DNA, 13 bp, Homo sapiens
ggtgtcttgagac

SEQ ID NO: 2398094 - DNA, 14 bp, Homo sapiens
ggtgtttcctctaa

SEQ ID NO: 2398095 - DNA, 18 bp, Homo sapiens
ggttgggaccaggccaat

SEQ ID NO: 2398096 - DNA, 12 bp, Homo sapiens
ggttttcatcta

SEQ ID NO: 2398097 - DNA, 12 bp, Homo sapiens
gtaaatgtactg

SEQ ID NO: 2398098 - DNA, 22 bp, Homo sapiens
gtaaatgtactggtaattgtac

SEQ ID NO: 2398099 - DNA, 17 bp, Homo sapiens
gtaagctgctctgaggt

SEQ ID NO: 2398100 - DNA, 16 bp, Homo sapiens
gtaatggttgggacca

SEQ ID NO: 2398101 - DNA, 23 bp, Homo sapiens
gtaatggttgggaccaggccaat

SEQ ID NO: 2398102 - DNA, 16 bp, Homo sapiens
gtacatgtacatagta

SEQ ID NO: 2398103 - DNA, 12 bp, Homo sapiens
gtaggctgctgg

SEQ ID NO: 2398104 - DNA, 13 bp, Homo sapiens
gtaggctgctggc

SEQ ID NO: 2398105 - DNA, 13 bp, Homo sapiens
gtattcccagcta

SEQ ID NO: 2398106 - DNA, 21 bp, Homo sapiens
gtatttttgattaacaatgta

SEQ ID NO: 2398107 - DNA, 15 bp, Homo sapiens
gtcaagattcagcta

SEQ ID NO: 2398108 - DNA, 16 bp, Homo sapiens
gtcaagattcagctag

SEQ ID NO: 2398109 - DNA, 19 bp, Homo sapiens
gtcaagattcagctagtgg

SEQ ID NO: 2398110 - DNA, 15 bp, Homo sapiens
gtcacatagctggga

SEQ ID NO: 2398111 - DNA, 14 bp, Homo sapiens
gtcaccagcaacat

SEQ ID NO: 2398112 - DNA, 21 bp, Homo sapiens
gtcaccccaactctgtggggc

SEQ ID NO: 2398113 - DNA, 20 bp, Homo sapiens
gtcagcccctcatcagcctt

SEQ ID NO: 2398114 - DNA, 18 bp, Homo sapiens
gtcatcatgaactggctt

SEQ ID NO: 2398115 - DNA, 12 bp, Homo sapiens
gtcatctgctcc

SEQ ID NO: 2398116 - DNA, 16 bp, Homo sapiens
gtcatggtcaggggtg

SEQ ID NO: 2398117 - DNA, 16 bp, Homo sapiens
gtcccaccaactctgc

SEQ ID NO: 2398118 - DNA, 17 bp, Homo sapiens
gtcccaccaactctgca

SEQ ID NO: 2398119 - DNA, 19 bp, Homo sapiens
gtcccaccaactctgcact

SEQ ID NO: 2398120 - DNA, 22 bp, Homo sapiens
gtcccagagcttattggccact

SEQ ID NO: 2398121 - DNA, 17 bp, Homo sapiens
gtcccagcctgggctcc

SEQ ID NO: 2398122 - DNA, 12 bp, Homo sapiens
gtccccagcccc

SEQ ID NO: 2398123 - DNA, 15 bp, Homo sapiens
gtccctcctgttgcc

SEQ ID NO: 2398124 - DNA, 23 bp, Homo sapiens
gtccctgctcagcccatcccctg

SEQ ID NO: 2398125 - DNA, 13 bp, Homo sapiens
gtcctcctggcct

SEQ ID NO: 2398126 - DNA, 14 bp, Homo sapiens
gtcctcctggcctg

SEQ ID NO: 2398127 - DNA, 18 bp, Homo sapiens
gtcctgattcgaggtcct

SEQ ID NO: 2398128 - DNA, 15 bp, Homo sapiens
gtcctggtgaggaca

SEQ ID NO: 2398129 - DNA, 21 bp, Homo sapiens
tggccccgggctctggccacc

SEQ ID NO: 2398130 - DNA, 21 bp, Homo sapiens
tggcccctccagaccctgcct

SEQ ID NO: 2398131 - DNA, 22 bp, Homo sapiens
tggcccgcccctcgctgctgct

SEQ ID NO: 2398132 - DNA, 20 bp, Homo sapiens
tggccgatggggcccacatt

SEQ ID NO: 2398133 - DNA, 17 bp, Homo sapiens
tggccggtaggctgctg

SEQ ID NO: 2398134 - DNA, 19 bp, Homo sapiens
tggcctgaggacccggcgc

SEQ ID NO: 2398135 - DNA, 13 bp, Homo sapiens
tggccttgcccgc

SEQ ID NO: 2398136 - DNA, 21 bp, Homo sapiens
tggccttgcccgccagcctca

SEQ ID NO: 2398137 - DNA, 14 bp, Homo sapiens
tggcggggcccctg

SEQ ID NO: 2398138 - DNA, 14 bp, Homo sapiens
tggctacagtacca

SEQ ID NO: 2398139 - DNA, 14 bp, Homo sapiens
tggctcatgcctgt

SEQ ID NO: 2398140 - DNA, 16 bp, Homo sapiens
tggcttctccttggct

SEQ ID NO: 2398141 - DNA, 13 bp, Homo sapiens
tggcttgtacatt

SEQ ID NO: 2398142 - DNA, 17 bp, Homo sapiens
tggcttttctggctggg

SEQ ID NO: 2398143 - DNA, 14 bp, Homo sapiens
tgggaagctgaggc

SEQ ID NO: 2398144 - DNA, 15 bp, Homo sapiens
tgggaagctgaggca

SEQ ID NO: 2398145 - DNA, 20 bp, Homo sapiens
tgggacccctcccaacctca

SEQ ID NO: 2398146 - DNA, 21 bp, Homo sapiens
tgggacccctcccaacctcaa

SEQ ID NO: 2398147 - DNA, 15 bp, Homo sapiens
tgggaggcccggggc

SEQ ID NO: 2398148 - DNA, 15 bp, Homo sapiens
tgggatttgctcctg

SEQ ID NO: 2398149 - DNA, 15 bp, Homo sapiens
tgggcacccacctcc

SEQ ID NO: 2398150 - DNA, 15 bp, Homo sapiens
tgggccagcccttgc

SEQ ID NO: 2398151 - DNA, 22 bp, Homo sapiens
tgggccctcagcgtctccccat

SEQ ID NO: 2398152 - DNA, 11 bp, Homo sapiens
tgggctccctt

SEQ ID NO: 2398153 - DNA, 15 bp, Homo sapiens
tgggctcctctgcat

SEQ ID NO: 2398154 - DNA, 14 bp, Homo sapiens
tggggacaccccag

SEQ ID NO: 2398155 - DNA, 22 bp, Homo sapiens
tggggcatccaccttcctgccc

SEQ ID NO: 2398156 - DNA, 13 bp, Homo sapiens
tggggcctgggct

SEQ ID NO: 2398157 - DNA, 15 bp, Homo sapiens
tggggcctgggctgt

SEQ ID NO: 2398158 - DNA, 19 bp, Homo sapiens
tggggcggcccacgccagc

SEQ ID NO: 2398159 - DNA, 20 bp, Homo sapiens
tggggcggcccacgccagct

SEQ ID NO: 2398160 - DNA, 13 bp, Homo sapiens
tggggcttcctgg

SEQ ID NO: 2398161 - DNA, 21 bp, Homo sapiens
tggggcttcctgggcagttgg

SEQ ID NO: 2398162 - DNA, 13 bp, Homo sapiens
tgggggaggccca

SEQ ID NO: 2398163 - DNA, 14 bp, Homo sapiens
tggggtgcttgctg

SEQ ID NO: 2398164 - DNA, 22 bp, Homo sapiens
tgggtacctgtaattagtttaa

SEQ ID NO: 2398165 - DNA, 18 bp, Homo sapiens
tgggtctcactcctgagt

SEQ ID NO: 2398166 - DNA, 21 bp, Homo sapiens
tggtaccttcccccagctttc

SEQ ID NO: 2398167 - DNA, 16 bp, Homo sapiens
tggtggcatgtgcctg

SEQ ID NO: 2398168 - DNA, 23 bp, Homo sapiens
tggtgtcatctgctccttcctgt

SEQ ID NO: 2398169 - DNA, 14 bp, Homo sapiens
tggtgtcttgagac

SEQ ID NO: 2398170 - DNA, 23 bp, Homo sapiens
tggtgtcttgagaccagcctgcc

SEQ ID NO: 2398171 - DNA, 18 bp, Homo sapiens
tggttgggaccaggccaa

SEQ ID NO: 2398172 - DNA, 19 bp, Homo sapiens
tggttgggaccaggccaat

SEQ ID NO: 2398173 - DNA, 20 bp, Homo sapiens
tgtacatttttaaattctta

SEQ ID NO: 2398174 - DNA, 16 bp, Homo sapiens
tgtactggtaattgta

SEQ ID NO: 2398175 - DNA, 14 bp, Homo sapiens
tgtattcccagcta

SEQ ID NO: 2398176 - DNA, 16 bp, Homo sapiens
tgtattttaataacat

SEQ ID NO: 2398177 - DNA, 15 bp, Homo sapiens
tgtcatctgctcctt

SEQ ID NO: 2398178 - DNA, 20 bp, Homo sapiens
tgtccattgccacggccatg

SEQ ID NO: 2398179 - DNA, 23 bp, Homo sapiens
tgtcccaccaactctgcactcca

SEQ ID NO: 2398180 - DNA, 20 bp, Homo sapiens
tgtccccctcacccccacct

SEQ ID NO: 2398181 - DNA, 15 bp, Homo sapiens
tgtcccctgtcccac

SEQ ID NO: 2398182 - DNA, 21 bp, Homo sapiens
tgtctaagcagttttgtaaat

SEQ ID NO: 2398183 - DNA, 22 bp, Homo sapiens
tgtctaagcagttttgtaaatg

SEQ ID NO: 2398184 - DNA, 23 bp, Homo sapiens
tgtctaagcagttttgtaaatgt

SEQ ID NO: 2398185 - DNA, 14 bp, Homo sapiens
tgtctggagcctgc

SEQ ID NO: 2398186 - DNA, 18 bp, Homo sapiens
tgtctggagcctgcaggc

SEQ ID NO: 2398187 - DNA, 16 bp, Homo sapiens
tgtcttctagtttaga

SEQ ID NO: 2398188 - DNA, 17 bp, Homo sapiens
tgtgactcctcccttcc

SEQ ID NO: 2398189 - DNA, 22 bp, Homo sapiens
tgtgactcctcccttccccact

SEQ ID NO: 2398190 - DNA, 18 bp, Homo sapiens
tgtgcctacctggccgca

SEQ ID NO: 2398191 - DNA, 19 bp, Homo sapiens
tgtgcctgtattcccagct

SEQ ID NO: 2398192 - DNA, 20 bp, Homo sapiens
tgtgcctgtattcccagcta

SEQ ID NO: 2398193 - DNA, 14 bp, Homo sapiens
tgtggagtagagtt

SEQ ID NO: 2398194 - DNA, 21 bp, Homo sapiens
tgtggccttgcccgccagcct

SEQ ID NO: 2398195 - DNA, 13 bp, Homo sapiens
tgtggccttggcc

SEQ ID NO: 2398196 - DNA, 15 bp, Homo sapiens
tgtggccttggccct

SEQ ID NO: 2398197 - DNA, 13 bp, Homo sapiens
tgtgggtggggaa

SEQ ID NO: 2398198 - DNA, 15 bp, Homo sapiens
tgtgtccatttctgc

SEQ ID NO: 2398199 - DNA, 13 bp, Homo sapiens
tgtgtggccctgg

SEQ ID NO: 2398200 - DNA, 16 bp, Homo sapiens
tgttccatgcctggcc

SEQ ID NO: 2398201 - DNA, 19 bp, Homo sapiens
tgttccatgcctggccctt

SEQ ID NO: 2398202 - DNA, 20 bp, Homo sapiens
tgttctatagcagtcatcat

SEQ ID NO: 2398203 - DNA, 23 bp, Homo sapiens
tgttgagagggggatgcccctgg

SEQ ID NO: 2398204 - DNA, 13 bp, Homo sapiens
tgttgatcccagt

SEQ ID NO: 2398205 - DNA, 15 bp, Homo sapiens
tgtttactgtaaatt

SEQ ID NO: 2398206 - DNA, 17 bp, Homo sapiens
tgtttggaggctgctgc

SEQ ID NO: 2398207 - DNA, 14 bp, Homo sapiens
ttaaaaacattttc

SEQ ID NO: 2398208 - DNA, 22 bp, Homo sapiens
ttaaaatgtttactgtaaattt

SEQ ID NO: 2398209 - DNA, 21 bp, Homo sapiens
ttaaacagttgcacagcatct

SEQ ID NO: 2398210 - DNA, 23 bp, Homo sapiens
ttaaacagttgcacagcatctca

SEQ ID NO: 2398211 - DNA, 16 bp, Homo sapiens
ttaaagactacctggg

SEQ ID NO: 2398212 - DNA, 20 bp, Homo sapiens
ttaacacctgatctggccca

SEQ ID NO: 2398213 - DNA, 12 bp, Homo sapiens
ttaagccaagag

SEQ ID NO: 2398214 - DNA, 20 bp, Homo sapiens
ttaatgaaggtcataagttt

SEQ ID NO: 2398215 - DNA, 18 bp, Homo sapiens
ttacaccgtgaggccaag

SEQ ID NO: 2398216 - DNA, 23 bp, Homo sapiens
ttactctggagcaacctactgtc

SEQ ID NO: 2398217 - DNA, 13 bp, Homo sapiens
ttactgtaaattt

SEQ ID NO: 2398218 - DNA, 15 bp, Homo sapiens
ttagttcctgtgcac

SEQ ID NO: 2398219 - DNA, 17 bp, Homo sapiens
ttatattgttcacttct

SEQ ID NO: 2398220 - DNA, 23 bp, Homo sapiens
ttcaaggtccgagctctgtcctc

SEQ ID NO: 2398221 - DNA, 19 bp, Homo sapiens
ttcaccctgtaatggttgg

SEQ ID NO: 2398222 - DNA, 22 bp, Homo sapiens
ttcaggcagaaccggtcccagc

SEQ ID NO: 2398223 - DNA, 16 bp, Homo sapiens
ttcatggacagctgag

SEQ ID NO: 2398224 - DNA, 18 bp, Homo sapiens
ttcatggcaagtggggct

SEQ ID NO: 2398225 - DNA, 20 bp, Homo sapiens
ttcatggcaagtggggctgg

SEQ ID NO: 2398226 - DNA, 18 bp, Homo sapiens
ttcatgtgcttgtgccta

SEQ ID NO: 2398227 - DNA, 14 bp, Homo sapiens
ttccaagaagacca

SEQ ID NO: 2398228 - DNA, 13 bp, Homo sapiens
ttccacatcccca

SEQ ID NO: 2398229 - DNA, 14 bp, Homo sapiens
ttccatgcctggcc

SEQ ID NO: 2398230 - DNA, 20 bp, Homo sapiens
ttccatgcctggcccttgcc

SEQ ID NO: 2398231 - DNA, 17 bp, Homo sapiens
ttccatgtcaagattca

SEQ ID NO: 2398232 - DNA, 16 bp, Homo sapiens
ttcccagcacaggcag

SEQ ID NO: 2398233 - DNA, 17 bp, Homo sapiens
ttcccagcacaggcagg

SEQ ID NO: 2398234 - DNA, 19 bp, Homo sapiens
ttccccactctgctcccag

SEQ ID NO: 2398235 - DNA, 14 bp, Homo sapiens
ttccccagctcaga

SEQ ID NO: 2398236 - DNA, 20 bp, Homo sapiens
ttccctaattctgccttaaa

SEQ ID NO: 2398237 - DNA, 15 bp, Homo sapiens
ttccctacccttcct

SEQ ID NO: 2398238 - DNA, 18 bp, Homo sapiens
ttccctacccttcctgcc

SEQ ID NO: 2398239 - DNA, 19 bp, Homo sapiens
ttccctgcatatgcttctg

SEQ ID NO: 2398240 - DNA, 13 bp, Homo sapiens
ttcctcagctgcc

SEQ ID NO: 2398241 - DNA, 18 bp, Homo sapiens
ttcctcccattcaagatt

SEQ ID NO: 2398242 - DNA, 13 bp, Homo sapiens
ttcctcctcagcc

SEQ ID NO: 2398243 - DNA, 14 bp, Homo sapiens
ttcctctcctagcc

SEQ ID NO: 2398244 - DNA, 15 bp, Homo sapiens
ttcctgggcagttgg

SEQ ID NO: 2398245 - DNA, 11 bp, Homo sapiens
aacccttcctg

SEQ ID NO: 2398246 - DNA, 12 bp, Homo sapiens
aacccttcctgc

SEQ ID NO: 2398247 - DNA, 18 bp, Homo sapiens
aaccggtcccagcctggg

SEQ ID NO: 2398248 - DNA, 23 bp, Homo sapiens
aacctacgagggaggaacacctg

SEQ ID NO: 2398249 - DNA, 18 bp, Homo sapiens
aacctcaatgccctgcca

SEQ ID NO: 2398250 - DNA, 20 bp, Homo sapiens
aactccacagggactgttct

SEQ ID NO: 2398251 - DNA, 20 bp, Homo sapiens
aactctgcactccatggcca

SEQ ID NO: 2398252 - DNA, 22 bp, Homo sapiens
aactctgcactccatggccacc

SEQ ID NO: 2398253 - DNA, 10 bp, Homo sapiens
aactgagccg

SEQ ID NO: 2398254 - DNA, 22 bp, Homo sapiens
aactgagccgtgcagctgggat

SEQ ID NO: 2398255 - DNA, 15 bp, Homo sapiens
aactggcttgtacat

SEQ ID NO: 2398256 - DNA, 17 bp, Homo sapiens
aactgtactgttttctg

SEQ ID NO: 2398257 - DNA, 23 bp, Homo sapiens
aacttagcattttctgcatctcc

SEQ ID NO: 2398258 - DNA, 22 bp, Homo sapiens
aagaaagtgagcagtgttagct

SEQ ID NO: 2398259 - DNA, 18 bp, Homo sapiens
aagaagtggggcagcagc

SEQ ID NO: 2398260 - DNA, 20 bp, Homo sapiens
aagcactcgagaccatcctg

SEQ ID NO: 2398261 - DNA, 19 bp, Homo sapiens
aagcagcaaataaacaact

SEQ ID NO: 2398262 - DNA, 14 bp, Homo sapiens
aagcagttttgtaa

SEQ ID NO: 2398263 - DNA, 14 bp, Homo sapiens
aaggacctccccct

SEQ ID NO: 2398264 - DNA, 10 bp, Homo sapiens
aaggtcagga

SEQ ID NO: 2398265 - DNA, 17 bp, Homo sapiens
aagtagagatgaagtta

SEQ ID NO: 2398266 - DNA, 22 bp, Homo sapiens
aagtatttttgattaacaatgt

SEQ ID NO: 2398267 - DNA, 18 bp, Homo sapiens
aagtcatcatgaactggc

SEQ ID NO: 2398268 - DNA, 20 bp, Homo sapiens
aagtccccagcccctcaacc

SEQ ID NO: 2398269 - DNA, 15 bp, Homo sapiens
aataacatatctaaa

SEQ ID NO: 2398270 - DNA, 18 bp, Homo sapiens
cacgcccctccccagccc

SEQ ID NO: 2398271 - DNA, 11 bp, Homo sapiens
cacggccaccc

SEQ ID NO: 2398272 - DNA, 14 bp, Homo sapiens
cacggccaccctcc

SEQ ID NO: 2398273 - DNA, 20 bp, Homo sapiens
cacggccatgagggctggag

SEQ ID NO: 2398274 - DNA, 23 bp, Homo sapiens
cacggccatgagggctggagacc

SEQ ID NO: 2398275 - DNA, 20 bp, Homo sapiens
cacgtgagagaatctgcctg

SEQ ID NO: 2398276 - DNA, 17 bp, Homo sapiens
cacgtgcagcacctgtc

SEQ ID NO: 2398277 - DNA, 18 bp, Homo sapiens
cacgtgcagcacctgtca

SEQ ID NO: 2398278 - DNA, 22 bp, Homo sapiens
cacgtgcagcacctgtcacctt

SEQ ID NO: 2398279 - DNA, 14 bp, Homo sapiens
cactaataaagtgc

SEQ ID NO: 2398280 - DNA, 21 bp, Homo sapiens
cactacatgggccagcccttg

SEQ ID NO: 2398281 - DNA, 13 bp, Homo sapiens
cactactcagcat

SEQ ID NO: 2398282 - DNA, 14 bp, Homo sapiens
cactcactccagcc

SEQ ID NO: 2398283 - DNA, 17 bp, Homo sapiens
cactccatggccacccc

SEQ ID NO: 2398284 - DNA, 23 bp, Homo sapiens
cactccatggccaccccgtgcca

SEQ ID NO: 2398285 - DNA, 16 bp, Homo sapiens
cactcgagaccatcct

SEQ ID NO: 2398286 - DNA, 21 bp, Homo sapiens
cactcgagaccatcctggccc

SEQ ID NO: 2398287 - DNA, 16 bp, Homo sapiens
cactctgctcccagcc

SEQ ID NO: 2398288 - DNA, 17 bp, Homo sapiens
cactgagtgaggagtgg

SEQ ID NO: 2398289 - DNA, 14 bp, Homo sapiens
cactgcactccagc

SEQ ID NO: 2398290 - DNA, 19 bp, Homo sapiens
cactgcactccagcctggg

SEQ ID NO: 2398291 - DNA, 20 bp, Homo sapiens
cactgcactccagcctgggt

SEQ ID NO: 2398292 - DNA, 21 bp, Homo sapiens
cactgggtctcactcctgagt

SEQ ID NO: 2398293 - DNA, 16 bp, Homo sapiens
cactgtgacctgctcc

SEQ ID NO: 2398294 - DNA, 17 bp, Homo sapiens
cacttgaatccattgaa

SEQ ID NO: 2398295 - DNA, 19 bp, Homo sapiens
cactttcccttcccctgtg

SEQ ID NO: 2398296 - DNA, 19 bp, Homo sapiens
cagaaccggtcccagcctg

SEQ ID NO: 2398297 - DNA, 23 bp, Homo sapiens
cagaaccggtcccagcctgggct

SEQ ID NO: 2398298 - DNA, 12 bp, Homo sapiens
cagaagacaagg

SEQ ID NO: 2398299 - DNA, 15 bp, Homo sapiens
cagaaggaaggagga

SEQ ID NO: 2398300 - DNA, 14 bp, Homo sapiens
cagaatcccctggg

SEQ ID NO: 2398301 - DNA, 16 bp, Homo sapiens
cagaccctgcctgagc

SEQ ID NO: 2398302 - DNA, 19 bp, Homo sapiens
cagaccctgcctgagccca

SEQ ID NO: 2398303 - DNA, 14 bp, Homo sapiens
cagacgcagcagct

SEQ ID NO: 2398304 - DNA, 16 bp, Homo sapiens
cagagagaggcgtcct

SEQ ID NO: 2398305 - DNA, 20 bp, Homo sapiens
cagagagaggcgtcctggtg

SEQ ID NO: 2398306 - DNA, 18 bp, Homo sapiens
cagagccccgccccaccc

SEQ ID NO: 2398307 - DNA, 21 bp, Homo sapiens
cagagcttattggccactggg

SEQ ID NO: 2398308 - DNA, 17 bp, Homo sapiens
cagagtgccctggggca

SEQ ID NO: 2398309 - DNA, 19 bp, Homo sapiens
cagagtgccctggggcatc

SEQ ID NO: 2398310 - DNA, 14 bp, Homo sapiens
cagagttaaaatgt

SEQ ID NO: 2398311 - DNA, 19 bp, Homo sapiens
cagagttaaaatgtttact

SEQ ID NO: 2398312 - DNA, 18 bp, Homo sapiens
cagataaggctttaggat

SEQ ID NO: 2398313 - DNA, 14 bp, Homo sapiens
cagcacctgtcacc

SEQ ID NO: 2398314 - DNA, 13 bp, Homo sapiens
cagcatctcagct

SEQ ID NO: 2398315 - DNA, 12 bp, Homo sapiens
cagcatggcccg

SEQ ID NO: 2398316 - DNA, 22 bp, Homo sapiens
cagccacccctcctctagctct

SEQ ID NO: 2398317 - DNA, 23 bp, Homo sapiens
cagccacccctcctctagctctg

SEQ ID NO: 2398318 - DNA, 20 bp, Homo sapiens
cagccatgcccacgcccctc

SEQ ID NO: 2398319 - DNA, 16 bp, Homo sapiens
cagcccaccctctgtg

SEQ ID NO: 2398320 - DNA, 18 bp, Homo sapiens
cagcccatcccctgcctc

SEQ ID NO: 2398321 - DNA, 19 bp, Homo sapiens
cagcccatcccctgcctct

SEQ ID NO: 2398322 - DNA, 17 bp, Homo sapiens
cagcccccacccatgcc

SEQ ID NO: 2398323 - DNA, 18 bp, Homo sapiens
cagcccccacccatgcca

SEQ ID NO: 2398324 - DNA, 20 bp, Homo sapiens
cagcccccacccatgccagc

SEQ ID NO: 2398325 - DNA, 14 bp, Homo sapiens
cagcccttgctcta

SEQ ID NO: 2398326 - DNA, 14 bp, Homo sapiens
cagcctctctgcta

SEQ ID NO: 2398327 - DNA, 12 bp, Homo sapiens
cagcctgccagg

SEQ ID NO: 2398328 - DNA, 18 bp, Homo sapiens
cagcctgccaggccctcc

SEQ ID NO: 2398329 - DNA, 20 bp, Homo sapiens
cagcctgccaggccctccag

SEQ ID NO: 2398330 - DNA, 19 bp, Homo sapiens
cagcctggccaacatggca

SEQ ID NO: 2398331 - DNA, 17 bp, Homo sapiens
cagcctgggctcctctg

SEQ ID NO: 2398332 - DNA, 16 bp, Homo sapiens
cagcgccagggctcag

SEQ ID NO: 2398333 - DNA, 23 bp, Homo sapiens
cagcgcctccaccctgccctgct

SEQ ID NO: 2398334 - DNA, 14 bp, Homo sapiens
cagcgtctccccat

SEQ ID NO: 2398335 - DNA, 17 bp, Homo sapiens
cagcgtctccccatgct

SEQ ID NO: 2398336 - DNA, 23 bp, Homo sapiens
cagcgtctccccatgctgggctc

SEQ ID NO: 2398337 - DNA, 24 bp, Homo sapiens
cagcgtctccccatgctgggctca

SEQ ID NO: 2398338 - DNA, 17 bp, Homo sapiens
cagctacattcctcagc

SEQ ID NO: 2398339 - DNA, 18 bp, Homo sapiens
cagctacattcctcagct

SEQ ID NO: 2398340 - DNA, 21 bp, Homo sapiens
cagctgccaagcactcgagac

SEQ ID NO: 2398341 - DNA, 23 bp, Homo sapiens
cagctgccaagcactcgagacca

SEQ ID NO: 2398342 - DNA, 15 bp, Homo sapiens
cagctggcccagtgg

SEQ ID NO: 2398343 - DNA, 16 bp, Homo sapiens
cagctgggacccctcc

SEQ ID NO: 2398344 - DNA, 16 bp, Homo sapiens
cagctttccatctgag

SEQ ID NO: 2398345 - DNA, 18 bp, Homo sapiens
cagctttccatctgagga

SEQ ID NO: 2398346 - DNA, 18 bp, Homo sapiens
caggaggatcccctgagg

SEQ ID NO: 2398347 - DNA, 16 bp, Homo sapiens
caggaggtgggtgagc

SEQ ID NO: 2398348 - DNA, 13 bp, Homo sapiens
caggatcctcctg

SEQ ID NO: 2398349 - DNA, 18 bp, Homo sapiens
caggatggttactgagga

SEQ ID NO: 2398350 - DNA, 21 bp, Homo sapiens
caggatggttactgaggacca

SEQ ID NO: 2398351 - DNA, 22 bp, Homo sapiens
caggcagaaccggtcccagcct

SEQ ID NO: 2398352 - DNA, 18 bp, Homo sapiens
caggccaatcccttctcc

SEQ ID NO: 2398353 - DNA, 18 bp, Homo sapiens
caggcctccctcgggctg

SEQ ID NO: 2398354 - DNA, 12 bp, Homo sapiens
caggccttctga

SEQ ID NO: 2398355 - DNA, 16 bp, Homo sapiens
cagggcatgcctggcc

SEQ ID NO: 2398356 - DNA, 17 bp, Homo sapiens
cagggcatgcctggcct

SEQ ID NO: 2398357 - DNA, 23 bp, Homo sapiens
cagggcatgcctggcctgaggac

SEQ ID NO: 2398358 - DNA, 21 bp, Homo sapiens
cagggctcagatggggcctgg

SEQ ID NO: 2398359 - DNA, 12 bp, Homo sapiens
cagggctgtggg

SEQ ID NO: 2398360 - DNA, 16 bp, Homo sapiens
caggggacgtggcgct

SEQ ID NO: 2398361 - DNA, 21 bp, Homo sapiens
cagggtaagctgctctgaggt

SEQ ID NO: 2398362 - DNA, 20 bp, Homo sapiens
cagtcatgcgtccactttcc

SEQ ID NO: 2398363 - DNA, 21 bp, Homo sapiens
cagtcatgcgtccactttccc

SEQ ID NO: 2398364 - DNA, 16 bp, Homo sapiens
cagtgtacatgtacat

SEQ ID NO: 2398365 - DNA, 21 bp, Homo sapiens
cagtgtacatgtacatagtaa

SEQ ID NO: 2398366 - DNA, 13 bp, Homo sapiens
cagtgttagctta

SEQ ID NO: 2398367 - DNA, 14 bp, Homo sapiens
cagtgttagcttag

SEQ ID NO: 2398368 - DNA, 12 bp, Homo sapiens
cagttacacatg

SEQ ID NO: 2398369 - DNA, 13 bp, Homo sapiens
cagttgcacagca

SEQ ID NO: 2398370 - DNA, 15 bp, Homo sapiens
cagttgcacagcatc

SEQ ID NO: 2398371 - DNA, 18 bp, Homo sapiens
cagttgcacagcatctca

SEQ ID NO: 2398372 - DNA, 22 bp, Homo sapiens
cagttgcacagcatctcagctc

SEQ ID NO: 2398373 - DNA, 15 bp, Homo sapiens
cagttgcagtgctgc

SEQ ID NO: 2398374 - DNA, 21 bp, Homo sapiens
cagttggggctgttcatggca

SEQ ID NO: 2398375 - DNA, 19 bp, Homo sapiens
cagttttgtaaatgtactg

SEQ ID NO: 2398376 - DNA, 24 bp, Homo sapiens
cagttttgtaaatgtactggtaat

SEQ ID NO: 2398377 - DNA, 22 bp, Homo sapiens
cataactaatacagctgagcta

SEQ ID NO: 2398378 - DNA, 18 bp, Homo sapiens
catacattcttcaagatc

SEQ ID NO: 2398379 - DNA, 18 bp, Homo sapiens
acctcagctgcacattcc

SEQ ID NO: 2398380 - DNA, 23 bp, Homo sapiens
acctcagctgcacattcctggcc

SEQ ID NO: 2398381 - DNA, 20 bp, Homo sapiens
acctgaaggacctccccctg

SEQ ID NO: 2398382 - DNA, 19 bp, Homo sapiens
acctgccaggcctccctcg

SEQ ID NO: 2398383 - DNA, 24 bp, Homo sapiens
acctgccaggcctccctcgggctg

SEQ ID NO: 2398384 - DNA, 14 bp, Homo sapiens
acctgctcctgccc

SEQ ID NO: 2398385 - DNA, 15 bp, Homo sapiens
acctgctcctgccca

SEQ ID NO: 2398386 - DNA, 20 bp, Homo sapiens
acctggccggtaggctgctg

SEQ ID NO: 2398387 - DNA, 21 bp, Homo sapiens
accttcccccagctttccatc

SEQ ID NO: 2398388 - DNA, 13 bp, Homo sapiens
accttcctgccca

SEQ ID NO: 2398389 - DNA, 12 bp, Homo sapiens
accttctatcct

SEQ ID NO: 2398390 - DNA, 17 bp, Homo sapiens
accttctatcctctgta

SEQ ID NO: 2398391 - DNA, 17 bp, Homo sapiens
accttgagaccctcttc

SEQ ID NO: 2398392 - DNA, 22 bp, Homo sapiens
accttgagaccctcttctctgg

SEQ ID NO: 2398393 - DNA, 18 bp, Homo sapiens
acgagggaggaacacctg

SEQ ID NO: 2398394 - DNA, 22 bp, Homo sapiens
acgcagcagctgggacccctcc

SEQ ID NO: 2398395 - DNA, 11 bp, Homo sapiens
acgccagctgg

SEQ ID NO: 2398396 - DNA, 13 bp, Homo sapiens
acgccagctggcc

SEQ ID NO: 2398397 - DNA, 17 bp, Homo sapiens
acgccagctggcccagt

SEQ ID NO: 2398398 - DNA, 24 bp, Homo sapiens
agccttttcagcaggttccagtgc

SEQ ID NO: 2398399 - DNA, 13 bp, Homo sapiens
agcgcagcgcctc

SEQ ID NO: 2398400 - DNA, 22 bp, Homo sapiens
agcgcctccaccctgccctgct

SEQ ID NO: 2398401 - DNA, 12 bp, Homo sapiens
agcgggtggggt

SEQ ID NO: 2398402 - DNA, 12 bp, Homo sapiens
agctacattcct

SEQ ID NO: 2398403 - DNA, 17 bp, Homo sapiens
agctacattcctcagct

SEQ ID NO: 2398404 - DNA, 18 bp, Homo sapiens
agctacattcctcagctg

SEQ ID NO: 2398405 - DNA, 15 bp, Homo sapiens
agctcagagccccgc

SEQ ID NO: 2398406 - DNA, 15 bp, Homo sapiens
agctctgtcctctgt

SEQ ID NO: 2398407 - DNA, 17 bp, Homo sapiens
agctgaggccccagggc

SEQ ID NO: 2398408 - DNA, 13 bp, Homo sapiens
agctgagtcacct

SEQ ID NO: 2398409 - DNA, 14 bp, Homo sapiens
agctgcacattcct

SEQ ID NO: 2398410 - DNA, 19 bp, Homo sapiens
agctgcacattcctggccc

SEQ ID NO: 2398411 - DNA, 14 bp, Homo sapiens
agctgccaagcact

SEQ ID NO: 2398412 - DNA, 22 bp, Homo sapiens
agctgggatttgaactgagccg

SEQ ID NO: 2398413 - DNA, 16 bp, Homo sapiens
atgaaacaaataatca

SEQ ID NO: 2398414 - DNA, 16 bp, Homo sapiens
atgaaccctgccccac

SEQ ID NO: 2398415 - DNA, 17 bp, Homo sapiens
atgaactggcttgtaca

SEQ ID NO: 2398416 - DNA, 18 bp, Homo sapiens
atgaactggcttgtacat

SEQ ID NO: 2398417 - DNA, 20 bp, Homo sapiens
atgacagaaatgacaacaag

SEQ ID NO: 2398418 - DNA, 21 bp, Homo sapiens
atgacttggggacaccccaga

SEQ ID NO: 2398419 - DNA, 14 bp, Homo sapiens
atgaggctgaggca

SEQ ID NO: 2398420 - DNA, 14 bp, Homo sapiens
atgagggtgtttcc

SEQ ID NO: 2398421 - DNA, 20 bp, Homo sapiens
atgagggtgtttcctctaaa

SEQ ID NO: 2398422 - DNA, 23 bp, Homo sapiens
atgatagaactgtactgttttct

SEQ ID NO: 2398423 - DNA, 16 bp, Homo sapiens
atgcccacgcccctcc

SEQ ID NO: 2398424 - DNA, 18 bp, Homo sapiens
atgcccctggccctgcct

SEQ ID NO: 2398425 - DNA, 13 bp, Homo sapiens
atgccctgccatt

SEQ ID NO: 2398426 - DNA, 23 bp, Homo sapiens
atgcctggcccttgccggggcct

SEQ ID NO: 2398427 - DNA, 19 bp, Homo sapiens
atgcctggcctgaggaccc

SEQ ID NO: 2398428 - DNA, 20 bp, Homo sapiens
atgcctgtaatcccagcact

SEQ ID NO: 2398429 - DNA, 15 bp, Homo sapiens
atgcgtccactttcc

SEQ ID NO: 2398430 - DNA, 20 bp, Homo sapiens
atgcttatattgttcacttc

SEQ ID NO: 2398431 - DNA, 14 bp, Homo sapiens
atggcaagtggggc

SEQ ID NO: 2398432 - DNA, 17 bp, Homo sapiens
atggcaagtggggctgg

SEQ ID NO: 2398433 - DNA, 18 bp, Homo sapiens
atggccaccccgtgccac

SEQ ID NO: 2398434 - DNA, 18 bp, Homo sapiens
atgggagagcaacaagta

SEQ ID NO: 2398435 - DNA, 15 bp, Homo sapiens
atgggcacctcatgg

SEQ ID NO: 2398436 - DNA, 12 bp, Homo sapiens
atgggccagccc

SEQ ID NO: 2398437 - DNA, 15 bp, Homo sapiens
atgggccagcccttg

SEQ ID NO: 2398438 - DNA, 12 bp, Homo sapiens
atgggccctcag

SEQ ID NO: 2398439 - DNA, 14 bp, Homo sapiens
atgggccctcagcg

SEQ ID NO: 2398440 - DNA, 14 bp, Homo sapiens
atgggggaggccca

SEQ ID NO: 2398441 - DNA, 16 bp, Homo sapiens
atggtctgagtggggc

SEQ ID NO: 2398442 - DNA, 17 bp, Homo sapiens
atggtggcatgtgcctg

SEQ ID NO: 2398443 - DNA, 13 bp, Homo sapiens
atggttggaacta

SEQ ID NO: 2398444 - DNA, 23 bp, Homo sapiens
atggttgggaccaggccaatccc

SEQ ID NO: 2398445 - DNA, 19 bp, Homo sapiens
atgtacatagtaaagtatt

SEQ ID NO: 2398446 - DNA, 21 bp, Homo sapiens
atgtacatagtaaagtatttt

SEQ ID NO: 2398447 - DNA, 16 bp, Homo sapiens
atgtattttaataaca

SEQ ID NO: 2398448 - DNA, 23 bp, Homo sapiens
atgtccccctcacccccacctca

SEQ ID NO: 2398449 - DNA, 14 bp, Homo sapiens
atgtcccctgtccc

SEQ ID NO: 2398450 - DNA, 15 bp, Homo sapiens
atgtcccctgtccca

SEQ ID NO: 2398451 - DNA, 15 bp, Homo sapiens
atgtgcttgtgccta

SEQ ID NO: 2398452 - DNA, 23 bp, Homo sapiens
atgtgcttgtgcctacctggccg

SEQ ID NO: 2398453 - DNA, 15 bp, Homo sapiens
atgttccatgcctgg

SEQ ID NO: 2398454 - DNA, 13 bp, Homo sapiens
atgtttactgtaa

SEQ ID NO: 2398455 - DNA, 15 bp, Homo sapiens
atgtttactgtaaat

SEQ ID NO: 2398456 - DNA, 18 bp, Homo sapiens
attagataaatgtccatt

SEQ ID NO: 2398457 - DNA, 15 bp, Homo sapiens
attatgattagcttt

SEQ ID NO: 2398458 - DNA, 13 bp, Homo sapiens
attcaagattccc

SEQ ID NO: 2398459 - DNA, 16 bp, Homo sapiens
attcctcagctgccaa

SEQ ID NO: 2398460 - DNA, 20 bp, Homo sapiens
attcctctcctagccctcct

SEQ ID NO: 2398461 - DNA, 12 bp, Homo sapiens
attcctggcccc

SEQ ID NO: 2398462 - DNA, 21 bp, Homo sapiens
attccttgtcaccagcaacat

SEQ ID NO: 2398463 - DNA, 18 bp, Homo sapiens
attgaattgggggagtca

SEQ ID NO: 2398464 - DNA, 15 bp, Homo sapiens
attgacctcagctgc

SEQ ID NO: 2398465 - DNA, 16 bp, Homo sapiens
attgacctcagctgca

SEQ ID NO: 2398466 - DNA, 19 bp, Homo sapiens
attgacctcagctgcacat

SEQ ID NO: 2398467 - DNA, 15 bp, Homo sapiens
attgacgaactggct

SEQ ID NO: 2398468 - DNA, 14 bp, Homo sapiens
attgatgatccatt

SEQ ID NO: 2398469 - DNA, 13 bp, Homo sapiens
attggccactggg

SEQ ID NO: 2398470 - DNA, 19 bp, Homo sapiens
attgggggagtcatggtca

SEQ ID NO: 2398471 - DNA, 15 bp, Homo sapiens
attgtgcattctaga

SEQ ID NO: 2398472 - DNA, 16 bp, Homo sapiens
atttgtcattcctctc

SEQ ID NO: 2398473 - DNA, 13 bp, Homo sapiens
attttaataacat

SEQ ID NO: 2398474 - DNA, 16 bp, Homo sapiens
attttctgcatctcca

SEQ ID NO: 2398475 - DNA, 19 bp, Homo sapiens
attttctgcatctccactt

SEQ ID NO: 2398476 - DNA, 20 bp, Homo sapiens
atttttgattaacaatgtat

SEQ ID NO: 2398477 - DNA, 20 bp, Homo sapiens
atttttttttttttcctgtc

SEQ ID NO: 2398478 - DNA, 21 bp, Homo sapiens
caacctactgtctaagcagtt

SEQ ID NO: 2398479 - DNA, 20 bp, Homo sapiens
caacgctggagccgcttccc

SEQ ID NO: 2398480 - DNA, 14 bp, Homo sapiens
caactatggctgtt

SEQ ID NO: 2398481 - DNA, 16 bp, Homo sapiens
caactatggctgttga

SEQ ID NO: 2398482 - DNA, 23 bp, Homo sapiens
caactctgcactccatggccacc

SEQ ID NO: 2398483 - DNA, 12 bp, Homo sapiens
caagagagcctc

SEQ ID NO: 2398484 - DNA, 13 bp, Homo sapiens
caagattcagcta

SEQ ID NO: 2398485 - DNA, 21 bp, Homo sapiens
caagcactcgagaccatcctg

SEQ ID NO: 2398486 - DNA, 22 bp, Homo sapiens
caagcactcgagaccatcctgg

SEQ ID NO: 2398487 - DNA, 15 bp, Homo sapiens
caagctgggctccct

SEQ ID NO: 2398488 - DNA, 16 bp, Homo sapiens
caagctgggctccctt

SEQ ID NO: 2398489 - DNA, 14 bp, Homo sapiens
caaggatgatccag

SEQ ID NO: 2398490 - DNA, 17 bp, Homo sapiens
caaggccctttaacttg

SEQ ID NO: 2398491 - DNA, 21 bp, Homo sapiens
caaggcgagtttccccactaa

SEQ ID NO: 2398492 - DNA, 15 bp, Homo sapiens
caaggtccgagctct

SEQ ID NO: 2398493 - DNA, 21 bp, Homo sapiens
caagtccccagcccctcaacc

SEQ ID NO: 2398494 - DNA, 14 bp, Homo sapiens
caagtcccttgacc

SEQ ID NO: 2398495 - DNA, 16 bp, Homo sapiens
caagtcccttgacctt

SEQ ID NO: 2398496 - DNA, 18 bp, Homo sapiens
caatcccttctccactta

SEQ ID NO: 2398497 - DNA, 21 bp, Homo sapiens
caatgaggtggctcatgcctg

SEQ ID NO: 2398498 - DNA, 16 bp, Homo sapiens
caatgccctgccatta

SEQ ID NO: 2398499 - DNA, 12 bp, Homo sapiens
caatgtatttta

SEQ ID NO: 2398500 - DNA, 17 bp, Homo sapiens
caatgtccccctcaccc

SEQ ID NO: 2398501 - DNA, 15 bp, Homo sapiens
cacaggcaggggtag

SEQ ID NO: 2398502 - DNA, 15 bp, Homo sapiens
cacagggcatgcctg

SEQ ID NO: 2398503 - DNA, 18 bp, Homo sapiens
cacagggcatgcctggcc

SEQ ID NO: 2398504 - DNA, 24 bp, Homo sapiens
cacagggcatgcctggcctgagga

SEQ ID NO: 2398505 - DNA, 17 bp, Homo sapiens
cacatagctgggatttg

SEQ ID NO: 2398506 - DNA, 21 bp, Homo sapiens
cacattcctggccccgggctc

SEQ ID NO: 2398507 - DNA, 13 bp, Homo sapiens
caccaaactagta

SEQ ID NO: 2398508 - DNA, 15 bp, Homo sapiens
caccaactctgcact

SEQ ID NO: 2398509 - DNA, 19 bp, Homo sapiens
caccaactctgcactccat

SEQ ID NO: 2398510 - DNA, 23 bp, Homo sapiens
caccattccacatccccaccttc

SEQ ID NO: 2398511 - DNA, 15 bp, Homo sapiens
caccccgtgccaccc

SEQ ID NO: 2398512 - DNA, 11 bp, Homo sapiens
caccctccttc

SEQ ID NO: 2398513 - DNA, 12 bp, Homo sapiens
caccctgccctg

SEQ ID NO: 2398514 - DNA, 15 bp, Homo sapiens
caccctgccctgctg

SEQ ID NO: 2398515 - DNA, 17 bp, Homo sapiens
caccctggcccgcccct

SEQ ID NO: 2398516 - DNA, 19 bp, Homo sapiens
caccctggcccgcccctcg

SEQ ID NO: 2398517 - DNA, 19 bp, Homo sapiens
cacctcatggactccagga

SEQ ID NO: 2398518 - DNA, 23 bp, Homo sapiens
cacctccacccccgccacggcca

SEQ ID NO: 2398519 - DNA, 14 bp, Homo sapiens
catagatcttctga

SEQ ID NO: 2398520 - DNA, 12 bp, Homo sapiens
catagcctttcc

SEQ ID NO: 2398521 - DNA, 14 bp, Homo sapiens
ccagggctgtgggt

SEQ ID NO: 2398522 - DNA, 13 bp, Homo sapiens
ccttcctgcccag

SEQ ID NO: 2398523 - DNA, 14 bp, Homo sapiens
ccttgagaccctct

SEQ ID NO: 2398524 - DNA, 16 bp, Homo sapiens
ccttgcccgccagcct

SEQ ID NO: 2398525 - DNA, 14 bp, Homo sapiens
ccttggccctgacc

SEQ ID NO: 2398526 - DNA, 16 bp, Homo sapiens
ccttggccctgacccc

SEQ ID NO: 2398527 - DNA, 18 bp, Homo sapiens
cctttgccagccacccct

SEQ ID NO: 2398528 - DNA, 16 bp, Homo sapiens
ccttttagttcctgtg

SEQ ID NO: 2398529 - DNA, 22 bp, Homo sapiens
ccttttagttcctgtgcacagc

SEQ ID NO: 2398530 - DNA, 16 bp, Homo sapiens
cgagaccatcctggcc

SEQ ID NO: 2398531 - DNA, 17 bp, Homo sapiens
cgagaccatcctggccc

SEQ ID NO: 2398532 - DNA, 23 bp, Homo sapiens
gcccacgcccctccccagccccc

SEQ ID NO: 2398533 - DNA, 22 bp, Homo sapiens
gcccacgtgcagcacctgtcac

SEQ ID NO: 2398534 - DNA, 21 bp, Homo sapiens
gcccagagagaggcgtcctgg

SEQ ID NO: 2398535 - DNA, 22 bp, Homo sapiens
gcccagagagaggcgtcctggt

SEQ ID NO: 2398536 - DNA, 16 bp, Homo sapiens
gcccagtaactgccct

SEQ ID NO: 2398537 - DNA, 17 bp, Homo sapiens
gcccagtaactgccctt

SEQ ID NO: 2398538 - DNA, 17 bp, Homo sapiens
gcccattcgtctgtccc

SEQ ID NO: 2398539 - DNA, 21 bp, Homo sapiens
gcccattcgtctgtcccagag

SEQ ID NO: 2398540 - DNA, 15 bp, Homo sapiens
gccccatgggccctc

SEQ ID NO: 2398541 - DNA, 17 bp, Homo sapiens
gccccatgggccctcag

SEQ ID NO: 2398542 - DNA, 18 bp, Homo sapiens
gccccatgggccctcagc

SEQ ID NO: 2398543 - DNA, 16 bp, Homo sapiens
gccccctggatgtccc

SEQ ID NO: 2398544 - DNA, 18 bp, Homo sapiens
gccccgggctctggccac

SEQ ID NO: 2398545 - DNA, 19 bp, Homo sapiens
gccccgggctctggccacc

SEQ ID NO: 2398546 - DNA, 21 bp, Homo sapiens
gccccgggctctggccaccct

SEQ ID NO: 2398547 - DNA, 17 bp, Homo sapiens
gcccctccagaccctgc

SEQ ID NO: 2398548 - DNA, 16 bp, Homo sapiens
gcccctccccagcccc

SEQ ID NO: 2398549 - DNA, 20 bp, Homo sapiens
gcccctcctaccccggctgc

SEQ ID NO: 2398550 - DNA, 16 bp, Homo sapiens
gcccctcgctgctgct

SEQ ID NO: 2398551 - DNA, 18 bp, Homo sapiens
gcccctggccctgcctca

SEQ ID NO: 2398552 - DNA, 19 bp, Homo sapiens
gcccctggccctgcctcac

SEQ ID NO: 2398553 - DNA, 15 bp, Homo sapiens
gcccgccagcctcag

SEQ ID NO: 2398554 - DNA, 23 bp, Homo sapiens
gccctcagcgtctccccatgctg

SEQ ID NO: 2398555 - DNA, 19 bp, Homo sapiens
gccctccctcttcccagca

SEQ ID NO: 2398556 - DNA, 12 bp, Homo sapiens
gccctgccatta

SEQ ID NO: 2398557 - DNA, 11 bp, Homo sapiens
gccctgcctca

SEQ ID NO: 2398558 - DNA, 16 bp, Homo sapiens
gccctgctgagcacag

SEQ ID NO: 2398559 - DNA, 22 bp, Homo sapiens
gccctggacacagcccaccctc

SEQ ID NO: 2398560 - DNA, 18 bp, Homo sapiens
gccctgggcacccacctc

SEQ ID NO: 2398561 - DNA, 20 bp, Homo sapiens
gccctgggcacccacctcca

SEQ ID NO: 2398562 - DNA, 22 bp, Homo sapiens
gccctggggcatccaccttcct

SEQ ID NO: 2398563 - DNA, 16 bp, Homo sapiens
gccgatggggcccaca

SEQ ID NO: 2398564 - DNA, 16 bp, Homo sapiens
gccgcaagtccccagc

SEQ ID NO: 2398565 - DNA, 14 bp, Homo sapiens
gccgcttccccagc

SEQ ID NO: 2398566 - DNA, 17 bp, Homo sapiens
gccgcttccccagctca

SEQ ID NO: 2398567 - DNA, 13 bp, Homo sapiens
gccggcactgcat

SEQ ID NO: 2398568 - DNA, 13 bp, Homo sapiens
gccggggcctgga

SEQ ID NO: 2398569 - DNA, 14 bp, Homo sapiens
gccggtaggctgct

SEQ ID NO: 2398570 - DNA, 17 bp, Homo sapiens
gccggtaggctgctggc

SEQ ID NO: 2398571 - DNA, 13 bp, Homo sapiens
gcctacctggccg

SEQ ID NO: 2398572 - DNA, 15 bp, Homo sapiens
gcctcactgtgacct

SEQ ID NO: 2398573 - DNA, 23 bp, Homo sapiens
gcctcactgtgacctgctcctgc

SEQ ID NO: 2398574 - DNA, 17 bp, Homo sapiens
gcctccaccctgccctg

SEQ ID NO: 2398575 - DNA, 18 bp, Homo sapiens
gcctccaccctgccctgc

SEQ ID NO: 2398576 - DNA, 14 bp, Homo sapiens
gcctctatccctgg

SEQ ID NO: 2398577 - DNA, 16 bp, Homo sapiens
gcctctatccctggcc

SEQ ID NO: 2398578 - DNA, 17 bp, Homo sapiens
gcctctatccctggcca

SEQ ID NO: 2398579 - DNA, 20 bp, Homo sapiens
gcctctatccctggccacct

SEQ ID NO: 2398580 - DNA, 23 bp, Homo sapiens
gcctctatccctggccacctgcc

SEQ ID NO: 2398581 - DNA, 14 bp, Homo sapiens
gcctgccaggccct

SEQ ID NO: 2398582 - DNA, 18 bp, Homo sapiens
gcctgccaggccctccag

SEQ ID NO: 2398583 - DNA, 21 bp, Homo sapiens
gcctgccaggccctccagcag

SEQ ID NO: 2398584 - DNA, 23 bp, Homo sapiens
gcctgccaggccctccagcagga

SEQ ID NO: 2398585 - DNA, 20 bp, Homo sapiens
gcctggactgcacaggcagc

SEQ ID NO: 2398586 - DNA, 18 bp, Homo sapiens
gcctggccaacatggcaa

SEQ ID NO: 2398587 - DNA, 11 bp, Homo sapiens
gcctggccctt

SEQ ID NO: 2398588 - DNA, 15 bp, Homo sapiens
gcctggcttttctgg

SEQ ID NO: 2398589 - DNA, 16 bp, Homo sapiens
gcctggcttttctggc

SEQ ID NO: 2398590 - DNA, 16 bp, Homo sapiens
gcctgggctcctctgc

SEQ ID NO: 2398591 - DNA, 19 bp, Homo sapiens
gcctgggctcctctgcatc

SEQ ID NO: 2398592 - DNA, 17 bp, Homo sapiens
gccttgcccgccagcct

SEQ ID NO: 2398593 - DNA, 21 bp, Homo sapiens
gccttggccctgacccccatc

SEQ ID NO: 2398594 - DNA, 19 bp, Homo sapiens
gcgcagcgcctccaccctg

SEQ ID NO: 2398595 - DNA, 19 bp, Homo sapiens
gcgccactgcactccagcc

SEQ ID NO: 2398596 - DNA, 14 bp, Homo sapiens
gcgcctccaccctg

SEQ ID NO: 2398597 - DNA, 13 bp, Homo sapiens
gcggcccacgcca

SEQ ID NO: 2398598 - DNA, 18 bp, Homo sapiens
gcggcccacgccagctgg

SEQ ID NO: 2398599 - DNA, 19 bp, Homo sapiens
gcggcccacgccagctggc

SEQ ID NO: 2398600 - DNA, 22 bp, Homo sapiens
gcggcccacgccagctggccca

SEQ ID NO: 2398601 - DNA, 12 bp, Homo sapiens
gcggggcccctg

SEQ ID NO: 2398602 - DNA, 19 bp, Homo sapiens
gcggggcccctgctccgag

SEQ ID NO: 2398603 - DNA, 14 bp, Homo sapiens
gcgtccctgctcag

SEQ ID NO: 2398604 - DNA, 13 bp, Homo sapiens
gctacattcctca

SEQ ID NO: 2398605 - DNA, 17 bp, Homo sapiens
gctacattcctcagctg

SEQ ID NO: 2398606 - DNA, 20 bp, Homo sapiens
gctacattcctcagctgcca

SEQ ID NO: 2398607 - DNA, 19 bp, Homo sapiens
gctaggctgtggagtagag

SEQ ID NO: 2398608 - DNA, 17 bp, Homo sapiens
gctcaatttggtgctca

SEQ ID NO: 2398609 - DNA, 17 bp, Homo sapiens
gctcacgtgtccttaac

SEQ ID NO: 2398610 - DNA, 21 bp, Homo sapiens
gctcactacatgggccagccc

SEQ ID NO: 2398611 - DNA, 12 bp, Homo sapiens
gctcagagcccc

SEQ ID NO: 2398612 - DNA, 14 bp, Homo sapiens
gctcagagccccgc

SEQ ID NO: 2398613 - DNA, 21 bp, Homo sapiens
gctcagagccccgccccaccc

SEQ ID NO: 2398614 - DNA, 18 bp, Homo sapiens
gctcagatggggcctggg

SEQ ID NO: 2398615 - DNA, 18 bp, Homo sapiens
gctcagggtaagctgctc

SEQ ID NO: 2398616 - DNA, 13 bp, Homo sapiens
gctccctttaagc

SEQ ID NO: 2398617 - DNA, 18 bp, Homo sapiens
gctcctgcccacgtgcag

SEQ ID NO: 2398618 - DNA, 15 bp, Homo sapiens
gctctacctggccgg

SEQ ID NO: 2398619 - DNA, 15 bp, Homo sapiens
gctctgagggtctga

SEQ ID NO: 2398620 - DNA, 14 bp, Homo sapiens
gctctggccaccct

SEQ ID NO: 2398621 - DNA, 20 bp, Homo sapiens
gggctcactacatgggccag

SEQ ID NO: 2398622 - DNA, 23 bp, Homo sapiens
gggctcagatggggcctgggctg

SEQ ID NO: 2398623 - DNA, 18 bp, Homo sapiens
gggctcatgttcaggcag

SEQ ID NO: 2398624 - DNA, 13 bp, Homo sapiens
gggctctggccac

SEQ ID NO: 2398625 - DNA, 15 bp, Homo sapiens
gggctggagaccaga

SEQ ID NO: 2398626 - DNA, 17 bp, Homo sapiens
gggctgtgggtggggaa

SEQ ID NO: 2398627 - DNA, 19 bp, Homo sapiens
gggctgttcatggcaagtg

SEQ ID NO: 2398628 - DNA, 21 bp, Homo sapiens
gggctgttgtgtctggagcct

SEQ ID NO: 2398629 - DNA, 14 bp, Homo sapiens
ggggacaccccaga

SEQ ID NO: 2398630 - DNA, 23 bp, Homo sapiens
ggggacaccccagaatcccctgg

SEQ ID NO: 2398631 - DNA, 14 bp, Homo sapiens
ggggatgcccctgg

SEQ ID NO: 2398632 - DNA, 16 bp, Homo sapiens
ggggcagcagcagtgg

SEQ ID NO: 2398633 - DNA, 22 bp, Homo sapiens
ggggcccttcctcgcacagggc

SEQ ID NO: 2398634 - DNA, 14 bp, Homo sapiens
ggggcctgggctgt

SEQ ID NO: 2398635 - DNA, 20 bp, Homo sapiens
ggggctgcgtccctgctcag

SEQ ID NO: 2398636 - DNA, 22 bp, Homo sapiens
ggggctgttcatggcaagtggg

SEQ ID NO: 2398637 - DNA, 16 bp, Homo sapiens
gggtctgaaaagggca

SEQ ID NO: 2398638 - DNA, 16 bp, Homo sapiens
ggtaaatctagagttt

SEQ ID NO: 2398639 - DNA, 15 bp, Homo sapiens
ggtaagctgctctga

SEQ ID NO: 2398640 - DNA, 14 bp, Homo sapiens
ggtaattgtacaat

SEQ ID NO: 2398641 - DNA, 21 bp, Homo sapiens
ggtagtgaattggcttccttg

SEQ ID NO: 2398642 - DNA, 14 bp, Homo sapiens
ggtcccagcctggg

SEQ ID NO: 2398643 - DNA, 12 bp, Homo sapiens
ggtcctcctggc

SEQ ID NO: 2398644 - DNA, 14 bp, Homo sapiens
ggtcctcctggcct

SEQ ID NO: 2398645 - DNA, 20 bp, Homo sapiens
ggtctgagtggggcttcctg

SEQ ID NO: 2398646 - DNA, 14 bp, Homo sapiens
ggtgggggctgcgt

SEQ ID NO: 2398647 - DNA, 15 bp, Homo sapiens
ggtgtttcctctaaa

SEQ ID NO: 2398648 - DNA, 19 bp, Homo sapiens
ggtgtttggaggctgctgc

SEQ ID NO: 2398649 - DNA, 21 bp, Homo sapiens
ggttttactgctttttctctg

SEQ ID NO: 2398650 - DNA, 23 bp, Homo sapiens
gtaaatgtactggtaattgtaca

SEQ ID NO: 2398651 - DNA, 12 bp, Homo sapiens
gtaatggttggg

SEQ ID NO: 2398652 - DNA, 12 bp, Homo sapiens
gtaattgtacaa

SEQ ID NO: 2398653 - DNA, 16 bp, Homo sapiens
gtaattgtacaatact

SEQ ID NO: 2398654 - DNA, 22 bp, Homo sapiens
ctgggccagtgagccagaaatt

SEQ ID NO: 2398655 - DNA, 22 bp, Homo sapiens
ctgggctcactacatgggccag

SEQ ID NO: 2398656 - DNA, 12 bp, Homo sapiens
ctgggctccctt

SEQ ID NO: 2398657 - DNA, 13 bp, Homo sapiens
ctgggctcctctg

SEQ ID NO: 2398658 - DNA, 22 bp, Homo sapiens
ctgggctgttgtgtctggagcc

SEQ ID NO: 2398659 - DNA, 17 bp, Homo sapiens
ctggtaattgtacaata

SEQ ID NO: 2398660 - DNA, 14 bp, Homo sapiens
ctggtctcccccag

SEQ ID NO: 2398661 - DNA, 21 bp, Homo sapiens
ctggtgtcttgagaccagcct

SEQ ID NO: 2398662 - DNA, 23 bp, Homo sapiens
ctggtgtcttgagaccagcctgc

SEQ ID NO: 2398663 - DNA, 23 bp, Homo sapiens
ctgtaatggttgggaccaggcca

SEQ ID NO: 2398664 - DNA, 12 bp, Homo sapiens
ctgtcagtcatg

SEQ ID NO: 2398665 - DNA, 17 bp, Homo sapiens
ctgtccattgccacggc

SEQ ID NO: 2398666 - DNA, 21 bp, Homo sapiens
ctgtccattgccacggccatg

SEQ ID NO: 2398667 - DNA, 20 bp, Homo sapiens
ctgtcccaccaactctgcac

SEQ ID NO: 2398668 - DNA, 13 bp, Homo sapiens
ctgtcccagagct

SEQ ID NO: 2398669 - DNA, 20 bp, Homo sapiens
ctgtcggtgtttggaggctg

SEQ ID NO: 2398670 - DNA, 24 bp, Homo sapiens
ctgtctcgggggggttttcatcta

SEQ ID NO: 2398671 - DNA, 14 bp, Homo sapiens
ctgtgacctgctcc

SEQ ID NO: 2398672 - DNA, 15 bp, Homo sapiens
ctgtgactcctccct

SEQ ID NO: 2398673 - DNA, 12 bp, Homo sapiens
ctgtgcacagcc

SEQ ID NO: 2398674 - DNA, 19 bp, Homo sapiens
ctgtggccttggccctgac

SEQ ID NO: 2398675 - DNA, 20 bp, Homo sapiens
ctgtggccttggccctgacc

SEQ ID NO: 2398676 - DNA, 20 bp, Homo sapiens
ctgtggggtgcatcggtctc

SEQ ID NO: 2398677 - DNA, 12 bp, Homo sapiens
ctgtgggtgggg

SEQ ID NO: 2398678 - DNA, 22 bp, Homo sapiens
ctgtgtggccctggacacagcc

SEQ ID NO: 2398679 - DNA, 21 bp, Homo sapiens
ctgttgtgtctggagcctgca

SEQ ID NO: 2398680 - DNA, 18 bp, Homo sapiens
cttaaacagttgcacagc

SEQ ID NO: 2398681 - DNA, 19 bp, Homo sapiens
cttaaacagttgcacagca

SEQ ID NO: 2398682 - DNA, 15 bp, Homo sapiens
cttactataatggtt

SEQ ID NO: 2398683 - DNA, 18 bp, Homo sapiens
cttactataatggttgga

SEQ ID NO: 2398684 - DNA, 16 bp, Homo sapiens
cttatattgttcactt

SEQ ID NO: 2398685 - DNA, 19 bp, Homo sapiens
cttatctatgatgtttctt

SEQ ID NO: 2398686 - DNA, 15 bp, Homo sapiens
cttcaagggtaatct

SEQ ID NO: 2398687 - DNA, 18 bp, Homo sapiens
cttcaccctgtaatggtt

SEQ ID NO: 2398688 - DNA, 18 bp, Homo sapiens
cttccccactctgctccc

SEQ ID NO: 2398689 - DNA, 21 bp, Homo sapiens
cttccccactctgctcccagc

SEQ ID NO: 2398690 - DNA, 22 bp, Homo sapiens
cttccccagctcagagccccgc

SEQ ID NO: 2398691 - DNA, 18 bp, Homo sapiens
cttcccccagctttccat

SEQ ID NO: 2398692 - DNA, 15 bp, Homo sapiens
cttccctacccttcc

SEQ ID NO: 2398693 - DNA, 20 bp, Homo sapiens
cttccctacccttcctgcca

SEQ ID NO: 2398694 - DNA, 14 bp, Homo sapiens
cttcctcgcacagg

SEQ ID NO: 2398695 - DNA, 20 bp, Homo sapiens
cttcctcgcacagggcatgc

SEQ ID NO: 2398696 - DNA, 23 bp, Homo sapiens
cttcctcgcacagggcatgcctg

SEQ ID NO: 2398697 - DNA, 12 bp, Homo sapiens
cttcctgggcag

SEQ ID NO: 2398698 - DNA, 14 bp, Homo sapiens
cttcctgtggcctc

SEQ ID NO: 2398699 - DNA, 13 bp, Homo sapiens
cttctagtttaga

SEQ ID NO: 2398700 - DNA, 15 bp, Homo sapiens
cttctgaaatgaaac

SEQ ID NO: 2398701 - DNA, 17 bp, Homo sapiens
cttgaatccattgaaag

SEQ ID NO: 2398702 - DNA, 16 bp, Homo sapiens
cttgagaccagcctgc

SEQ ID NO: 2398703 - DNA, 22 bp, Homo sapiens
cttgcattccagagttaaaatg

SEQ ID NO: 2398704 - DNA, 17 bp, Homo sapiens
cttgccggggcctggac

SEQ ID NO: 2398705 - DNA, 15 bp, Homo sapiens
cttgctctacctggc

SEQ ID NO: 2398706 - DNA, 20 bp, Homo sapiens
cttggcagttgcagtgctgc

SEQ ID NO: 2398707 - DNA, 10 bp, Homo sapiens
cttggccctg

SEQ ID NO: 2398708 - DNA, 22 bp, Homo sapiens
cttgggataggactgagtggta

SEQ ID NO: 2398709 - DNA, 18 bp, Homo sapiens
ctttccctaattctgcct

SEQ ID NO: 2398710 - DNA, 20 bp, Homo sapiens
ctttccctgcatatgcttct

SEQ ID NO: 2398711 - DNA, 13 bp, Homo sapiens
ctttcccttcccc

SEQ ID NO: 2398712 - DNA, 21 bp, Homo sapiens
ctttctttggtaggtaaatct

SEQ ID NO: 2398713 - DNA, 16 bp, Homo sapiens
ctttgtcactgtttca

SEQ ID NO: 2398714 - DNA, 16 bp, Homo sapiens
ctttgttgtctacatt

SEQ ID NO: 2398715 - DNA, 22 bp, Homo sapiens
cttttagttcctgtgcacagcc

SEQ ID NO: 2398716 - DNA, 19 bp, Homo sapiens
ctttttccccgattttcca

SEQ ID NO: 2398717 - DNA, 17 bp, Homo sapiens
gaaacaaataatcacat

SEQ ID NO: 2398718 - DNA, 21 bp, Homo sapiens
gaaccaggccttctgatttca

SEQ ID NO: 2398719 - DNA, 16 bp, Homo sapiens
gaaccctgccccactc

SEQ ID NO: 2398720 - DNA, 14 bp, Homo sapiens
gaaccggtcccagc

SEQ ID NO: 2398721 - DNA, 20 bp, Homo sapiens
gaaccggtcccagcctgggc

SEQ ID NO: 2398722 - DNA, 23 bp, Homo sapiens
gaaccggtcccagcctgggctcc

SEQ ID NO: 2398723 - DNA, 15 bp, Homo sapiens
gaactggctacagta

SEQ ID NO: 2398724 - DNA, 15 bp, Homo sapiens
gaactggcttgtaca

SEQ ID NO: 2398725 - DNA, 14 bp, Homo sapiens
gaactgtactgttt

SEQ ID NO: 2398726 - DNA, 15 bp, Homo sapiens
gaactgtactgtttt

SEQ ID NO: 2398727 - DNA, 23 bp, Homo sapiens
gaactgtactgttttctgggcca

SEQ ID NO: 2398728 - DNA, 22 bp, Homo sapiens
gaagagaaaccatcctctccct

SEQ ID NO: 2398729 - DNA, 19 bp, Homo sapiens
gaaggacctccccctgtgt

SEQ ID NO: 2398730 - DNA, 23 bp, Homo sapiens
gaaggacctccccctgtgtggcc

SEQ ID NO: 2398731 - DNA, 16 bp, Homo sapiens
gaaggtcataagtttc

SEQ ID NO: 2398732 - DNA, 19 bp, Homo sapiens
gaatctgcctgtggccttg

SEQ ID NO: 2398733 - DNA, 16 bp, Homo sapiens
gaatgggggaggccca

SEQ ID NO: 2398734 - DNA, 22 bp, Homo sapiens
gacaattagataaatgtccatt

SEQ ID NO: 2398735 - DNA, 15 bp, Homo sapiens
gacaccacccagagc

SEQ ID NO: 2398736 - DNA, 13 bp, Homo sapiens
gacagagtgccct

SEQ ID NO: 2398737 - DNA, 14 bp, Homo sapiens
gacagagtgccctg

SEQ ID NO: 2398738 - DNA, 19 bp, Homo sapiens
gacagagtgccctggggca

SEQ ID NO: 2398739 - DNA, 17 bp, Homo sapiens
gacattccttgtcacca

SEQ ID NO: 2398740 - DNA, 14 bp, Homo sapiens
gaccagcctgccag

SEQ ID NO: 2398741 - DNA, 16 bp, Homo sapiens
gaccagcctgccaggc

SEQ ID NO: 2398742 - DNA, 19 bp, Homo sapiens
gaccagcctgccaggccct

SEQ ID NO: 2398743 - DNA, 21 bp, Homo sapiens
gaccagcctgccaggccctcc

SEQ ID NO: 2398744 - DNA, 14 bp, Homo sapiens
gaccaggccaatcc

SEQ ID NO: 2398745 - DNA, 17 bp, Homo sapiens
gaccaggccaatccctt

SEQ ID NO: 2398746 - DNA, 15 bp, Homo sapiens
gaccatcctggcccc

SEQ ID NO: 2398747 - DNA, 21 bp, Homo sapiens
gaccatcctggcccctccaga

SEQ ID NO: 2398748 - DNA, 20 bp, Homo sapiens
gaccattgacctcagctgca

SEQ ID NO: 2398749 - DNA, 18 bp, Homo sapiens
gacccatagatcttctga

SEQ ID NO: 2398750 - DNA, 16 bp, Homo sapiens
agcagttttgtaaatg

SEQ ID NO: 2398751 - DNA, 24 bp, Homo sapiens
agcagttttgtaaatgtactggta

SEQ ID NO: 2398752 - DNA, 15 bp, Homo sapiens
agcattttctgcatc

SEQ ID NO: 2398753 - DNA, 19 bp, Homo sapiens
agcattttctgcatctcca

SEQ ID NO: 2398754 - DNA, 20 bp, Homo sapiens
agcattttctgcatctccac

SEQ ID NO: 2398755 - DNA, 22 bp, Homo sapiens
agccaacaaccaccaccacaat

SEQ ID NO: 2398756 - DNA, 19 bp, Homo sapiens
agccaagattgcgccactg

SEQ ID NO: 2398757 - DNA, 13 bp, Homo sapiens
agccagaaattga

SEQ ID NO: 2398758 - DNA, 19 bp, Homo sapiens
agccagcccgtgtgtataa

SEQ ID NO: 2398759 - DNA, 20 bp, Homo sapiens
agccagggactaagcagccc

SEQ ID NO: 2398760 - DNA, 19 bp, Homo sapiens
agccatgcccacgcccctc

SEQ ID NO: 2398761 - DNA, 17 bp, Homo sapiens
agcccagctacattcct

SEQ ID NO: 2398762 - DNA, 22 bp, Homo sapiens
agcccagctacattcctcagct

SEQ ID NO: 2398763 - DNA, 16 bp, Homo sapiens
agcccaggagctgagt

SEQ ID NO: 2398764 - DNA, 23 bp, Homo sapiens
agcccaggagctgagtcacctcc

SEQ ID NO: 2398765 - DNA, 17 bp, Homo sapiens
agcccccacccatgcca

SEQ ID NO: 2398766 - DNA, 22 bp, Homo sapiens
agcccctaagtcaacttagcat

SEQ ID NO: 2398767 - DNA, 17 bp, Homo sapiens
agcccctcatcagcctt

SEQ ID NO: 2398768 - DNA, 14 bp, Homo sapiens
agccctccctcttc

SEQ ID NO: 2398769 - DNA, 15 bp, Homo sapiens
agccctccctcttcc

SEQ ID NO: 2398770 - DNA, 16 bp, Homo sapiens
agccctccctcttccc

SEQ ID NO: 2398771 - DNA, 20 bp, Homo sapiens
agccctccctcttcccagca

SEQ ID NO: 2398772 - DNA, 17 bp, Homo sapiens
agccgcttccccagctc

SEQ ID NO: 2398773 - DNA, 15 bp, Homo sapiens
agccggcactgcatg

SEQ ID NO: 2398774 - DNA, 20 bp, Homo sapiens
agcctaacccccagcccctc

SEQ ID NO: 2398775 - DNA, 21 bp, Homo sapiens
agcctaacccccagcccctcc

SEQ ID NO: 2398776 - DNA, 13 bp, Homo sapiens
agcctgcaggcag

SEQ ID NO: 2398777 - DNA, 16 bp, Homo sapiens
agcctgcaggcaggtg

SEQ ID NO: 2398778 - DNA, 14 bp, Homo sapiens
agcctgccaggccc

SEQ ID NO: 2398779 - DNA, 15 bp, Homo sapiens
agcctgccaggccct

SEQ ID NO: 2398780 - DNA, 16 bp, Homo sapiens
agcctgccaggccctc

SEQ ID NO: 2398781 - DNA, 19 bp, Homo sapiens
agcctgggctcctctgcat

SEQ ID NO: 2398782 - DNA, 14 bp, Homo sapiens
agccttttcagcag

SEQ ID NO: 2398783 - DNA, 17 bp, Homo sapiens
agcgcagcgcctccacc

SEQ ID NO: 2398784 - DNA, 20 bp, Homo sapiens
agcgcagcgcctccaccctg

SEQ ID NO: 2398785 - DNA, 15 bp, Homo sapiens
agcgcctccaccctg

SEQ ID NO: 2398786 - DNA, 19 bp, Homo sapiens
agcgcctccaccctgccct

SEQ ID NO: 2398787 - DNA, 11 bp, Homo sapiens
agcgggtgggg

SEQ ID NO: 2398788 - DNA, 15 bp, Homo sapiens
agcgtctccccatgc

SEQ ID NO: 2398789 - DNA, 20 bp, Homo sapiens
agctacattcctcagctgcc

SEQ ID NO: 2398790 - DNA, 21 bp, Homo sapiens
agctacattcctcagctgcca

SEQ ID NO: 2398791 - DNA, 24 bp, Homo sapiens
agctacattcctcagctgccaagc

SEQ ID NO: 2398792 - DNA, 17 bp, Homo sapiens
agctcatcttcactgca

SEQ ID NO: 2398793 - DNA, 16 bp, Homo sapiens
agctctgtcctctgtc

SEQ ID NO: 2398794 - DNA, 11 bp, Homo sapiens
agctgaggccc

SEQ ID NO: 2398795 - DNA, 14 bp, Homo sapiens
agctgaggccccag

SEQ ID NO: 2398796 - DNA, 22 bp, Homo sapiens
agctgcacattcctggccccgg

SEQ ID NO: 2398797 - DNA, 14 bp, Homo sapiens
agctgctctgaggt

SEQ ID NO: 2398798 - DNA, 15 bp, Homo sapiens
agcttattggccact

SEQ ID NO: 2398799 - DNA, 17 bp, Homo sapiens
agctttccatctgagga

SEQ ID NO: 2398800 - DNA, 22 bp, Homo sapiens
agctttgtcactgtttcactac

SEQ ID NO: 2398801 - DNA, 13 bp, Homo sapiens
aggaacacctgat

SEQ ID NO: 2398802 - DNA, 21 bp, Homo sapiens
aggacctccccctgtgtggcc

SEQ ID NO: 2398803 - DNA, 22 bp, Homo sapiens
aggacctccccctgtgtggccc

SEQ ID NO: 2398804 - DNA, 20 bp, Homo sapiens
aggaggacagagtgccctgg

SEQ ID NO: 2398805 - DNA, 19 bp, Homo sapiens
aggagggggagtggagggg

SEQ ID NO: 2398806 - DNA, 18 bp, Homo sapiens
aggagtggacgctgtcca

SEQ ID NO: 2398807 - DNA, 15 bp, Homo sapiens
aggatcctcctggag

SEQ ID NO: 2398808 - DNA, 21 bp, Homo sapiens
aggcagaaccggtcccagcct

SEQ ID NO: 2398809 - DNA, 16 bp, Homo sapiens
aggcagcaaggtcatg

SEQ ID NO: 2398810 - DNA, 17 bp, Homo sapiens
aggcaggaggtgggtga

SEQ ID NO: 2398811 - DNA, 21 bp, Homo sapiens
aggcaggagtgctgccctctc

SEQ ID NO: 2398812 - DNA, 19 bp, Homo sapiens
aggcaggtgggggctgcgt

SEQ ID NO: 2398813 - DNA, 16 bp, Homo sapiens
aggccaatcccttctc

SEQ ID NO: 2398814 - DNA, 22 bp, Homo sapiens
aggcccaatgaggtggctcatg

SEQ ID NO: 2398815 - DNA, 19 bp, Homo sapiens
aggcccggggcccttcctc

SEQ ID NO: 2398816 - DNA, 20 bp, Homo sapiens
atcctggcccctccagaccc

SEQ ID NO: 2398817 - DNA, 16 bp, Homo sapiens
atctagagtttataca

SEQ ID NO: 2398818 - DNA, 15 bp, Homo sapiens
atctatgatgtttct

SEQ ID NO: 2398819 - DNA, 18 bp, Homo sapiens
atctcgagccccctggat

SEQ ID NO: 2398820 - DNA, 15 bp, Homo sapiens
atctgctccttcctg

SEQ ID NO: 2398821 - DNA, 16 bp, Homo sapiens
atctgctccttcctgt

SEQ ID NO: 2398822 - DNA, 16 bp, Homo sapiens
atctggcccaagctgg

SEQ ID NO: 2398823 - DNA, 19 bp, Homo sapiens
atctggcccaagctgggct

SEQ ID NO: 2398824 - DNA, 19 bp, Homo sapiens
atcttccctacccttcctg

SEQ ID NO: 2398825 - DNA, 14 bp, Homo sapiens
atcttgggtttcta

SEQ ID NO: 2398826 - DNA, 17 bp, Homo sapiens
atgaagaccaaatgata

SEQ ID NO: 2398827 - DNA, 16 bp, Homo sapiens
atgatagaactgtact

SEQ ID NO: 2398828 - DNA, 15 bp, Homo sapiens
atgatccagggattg

SEQ ID NO: 2398829 - DNA, 19 bp, Homo sapiens
atgatgtttcttttgcaat

SEQ ID NO: 2398830 - DNA, 18 bp, Homo sapiens
atgcaaaagaagtggcat

SEQ ID NO: 2398831 - DNA, 12 bp, Homo sapiens
atgcccctggcc

SEQ ID NO: 2398832 - DNA, 13 bp, Homo sapiens
atgcccctggccc

SEQ ID NO: 2398833 - DNA, 19 bp, Homo sapiens
atgcccctggccctgcctc

SEQ ID NO: 2398834 - DNA, 21 bp, Homo sapiens
atgcccctggccctgcctcac

SEQ ID NO: 2398835 - DNA, 16 bp, Homo sapiens
atgcctgtaatcccag

SEQ ID NO: 2398836 - DNA, 22 bp, Homo sapiens
atggaaacaagatgaaattcca

SEQ ID NO: 2398837 - DNA, 22 bp, Homo sapiens
atggccaccccgtgccacccgt

SEQ ID NO: 2398838 - DNA, 21 bp, Homo sapiens
atggccgatggggcccacatt

SEQ ID NO: 2398839 - DNA, 13 bp, Homo sapiens
atgggtgctgaac

SEQ ID NO: 2398840 - DNA, 23 bp, Homo sapiens
atggtctgagtggggcttcctgg

SEQ ID NO: 2398841 - DNA, 20 bp, Homo sapiens
atgtagtatgctatgattaa

SEQ ID NO: 2398842 - DNA, 16 bp, Homo sapiens
atgtcccctgtcccac

SEQ ID NO: 2398843 - DNA, 18 bp, Homo sapiens
atgtgcctgtattcccag

SEQ ID NO: 2398844 - DNA, 20 bp, Homo sapiens
atgtgcctgtattcccagct

SEQ ID NO: 2398845 - DNA, 21 bp, Homo sapiens
atgtgcctgtattcccagcta

SEQ ID NO: 2398846 - DNA, 23 bp, Homo sapiens
atgtgcctgtattcccagctact

SEQ ID NO: 2398847 - DNA, 19 bp, Homo sapiens
atgtgcttgtgcctacctg

SEQ ID NO: 2398848 - DNA, 22 bp, Homo sapiens
atgtgcttgtgcctacctggcc

SEQ ID NO: 2398849 - DNA, 13 bp, Homo sapiens
atgttccatgcct

SEQ ID NO: 2398850 - DNA, 16 bp, Homo sapiens
atgtttactgtaaatt

SEQ ID NO: 2398851 - DNA, 19 bp, Homo sapiens
atgtttactgtaaattttt

SEQ ID NO: 2398852 - DNA, 15 bp, Homo sapiens
attagccgggcatgg

SEQ ID NO: 2398853 - DNA, 12 bp, Homo sapiens
attcaagattcc

SEQ ID NO: 2398854 - DNA, 16 bp, Homo sapiens
attcatgtgcttgtgc

SEQ ID NO: 2398855 - DNA, 19 bp, Homo sapiens
attcatgtgcttgtgccta

SEQ ID NO: 2398856 - DNA, 22 bp, Homo sapiens
attccagagttaaaatgtttac

SEQ ID NO: 2398857 - DNA, 17 bp, Homo sapiens
attccttgtcaccagca

SEQ ID NO: 2398858 - DNA, 22 bp, Homo sapiens
attctacagaaagaaaaatgca

SEQ ID NO: 2398859 - DNA, 20 bp, Homo sapiens
attgacctcagctgcacatt

SEQ ID NO: 2398860 - DNA, 16 bp, Homo sapiens
attgacgaactggcta

SEQ ID NO: 2398861 - DNA, 20 bp, Homo sapiens
attggccactgggtctcact

SEQ ID NO: 2398862 - DNA, 13 bp, Homo sapiens
attgtgctagtgc

SEQ ID NO: 2398863 - DNA, 14 bp, Homo sapiens
atttattccttcca

SEQ ID NO: 2398864 - DNA, 14 bp, Homo sapiens
atttattgaaattt

SEQ ID NO: 2398865 - DNA, 20 bp, Homo sapiens
atttattgaaatttttctct

SEQ ID NO: 2398866 - DNA, 17 bp, Homo sapiens
atttcaaggtccgagct

SEQ ID NO: 2398867 - DNA, 23 bp, Homo sapiens
atttcaaggtccgagctctgtcc

SEQ ID NO: 2398868 - DNA, 22 bp, Homo sapiens
atttctccaagaaagccaacaa

SEQ ID NO: 2398869 - DNA, 14 bp, Homo sapiens
atttgacatttagt

SEQ ID NO: 2398870 - DNA, 17 bp, Homo sapiens
atttgcatacattcttc

SEQ ID NO: 2398871 - DNA, 14 bp, Homo sapiens
atttgctcctgggt

SEQ ID NO: 2398872 - DNA, 20 bp, Homo sapiens
attttccagagctaggctgt

SEQ ID NO: 2398873 - DNA, 19 bp, Homo sapiens
atttttaaattcttactct

SEQ ID NO: 2398874 - DNA, 20 bp, Homo sapiens
atttttatcagttacacatg

SEQ ID NO: 2398875 - DNA, 20 bp, Homo sapiens
atttttctctttaaaaacat

SEQ ID NO: 2398876 - DNA, 15 bp, Homo sapiens
attttttgaactttg

SEQ ID NO: 2398877 - DNA, 15 bp, Homo sapiens
caaaaattagccggg

SEQ ID NO: 2398878 - DNA, 17 bp, Homo sapiens
caaactgtatcttcctt

SEQ ID NO: 2398879 - DNA, 21 bp, Homo sapiens
caaataaacaactatggctgt

SEQ ID NO: 2398880 - DNA, 14 bp, Homo sapiens
caccctccttcccg

SEQ ID NO: 2398881 - DNA, 16 bp, Homo sapiens
caccctgactgtgggg

SEQ ID NO: 2398882 - DNA, 17 bp, Homo sapiens
caccctgccctgctgag

SEQ ID NO: 2398883 - DNA, 15 bp, Homo sapiens
caccgtgaggccaag

SEQ ID NO: 2398884 - DNA, 16 bp, Homo sapiens
cacctcaaggtcagga

SEQ ID NO: 2398885 - DNA, 19 bp, Homo sapiens
cacctccacccccgccacg

SEQ ID NO: 2398886 - DNA, 24 bp, Homo sapiens
cacctccacccccgccacggccac

SEQ ID NO: 2398887 - DNA, 14 bp, Homo sapiens
cacctcctccactc

SEQ ID NO: 2398888 - DNA, 14 bp, Homo sapiens
cacctgatctggcc

SEQ ID NO: 2398889 - DNA, 15 bp, Homo sapiens
cacctgccaggcctc

SEQ ID NO: 2398890 - DNA, 19 bp, Homo sapiens
cacctgccaggcctccctc

SEQ ID NO: 2398891 - DNA, 15 bp, Homo sapiens
caccttcctgcccag

SEQ ID NO: 2398892 - DNA, 17 bp, Homo sapiens
cacggccaccctccttc

SEQ ID NO: 2398893 - DNA, 18 bp, Homo sapiens
cacggccatgagggctgg

SEQ ID NO: 2398894 - DNA, 19 bp, Homo sapiens
cacggccatgagggctgga

SEQ ID NO: 2398895 - DNA, 20 bp, Homo sapiens
cacgtgcagcacctgtcacc

SEQ ID NO: 2398896 - DNA, 20 bp, Homo sapiens
cacgtgtccttaacacctga

SEQ ID NO: 2398897 - DNA, 19 bp, Homo sapiens
cactacatgggccagccct

SEQ ID NO: 2398898 - DNA, 23 bp, Homo sapiens
cactacatgggccagcccttgct

SEQ ID NO: 2398899 - DNA, 13 bp, Homo sapiens
cactcactccagc

SEQ ID NO: 2398900 - DNA, 15 bp, Homo sapiens
cactccagcctgggt

SEQ ID NO: 2398901 - DNA, 14 bp, Homo sapiens
cactccatggccac

SEQ ID NO: 2398902 - DNA, 18 bp, Homo sapiens
cactcctgtcagcccctc

SEQ ID NO: 2398903 - DNA, 19 bp, Homo sapiens
cactcgagaccatcctggc

SEQ ID NO: 2398904 - DNA, 22 bp, Homo sapiens
cactcgagaccatcctggcccc

SEQ ID NO: 2398905 - DNA, 17 bp, Homo sapiens
cactctgctcccagccc

SEQ ID NO: 2398906 - DNA, 15 bp, Homo sapiens
cactgcactccagcc

SEQ ID NO: 2398907 - DNA, 17 bp, Homo sapiens
cactgcactccagcctg

SEQ ID NO: 2398908 - DNA, 19 bp, Homo sapiens
cactggggatcccgtgctg

SEQ ID NO: 2398909 - DNA, 18 bp, Homo sapiens
cactgggtctcactcctg

SEQ ID NO: 2398910 - DNA, 19 bp, Homo sapiens
cactgggtctcactcctga

SEQ ID NO: 2398911 - DNA, 18 bp, Homo sapiens
cacttactataatggttg

SEQ ID NO: 2398912 - DNA, 13 bp, Homo sapiens
cacttgacattcc

SEQ ID NO: 2398913 - DNA, 19 bp, Homo sapiens
cagaaatgacaacaaggcc

SEQ ID NO: 2398914 - DNA, 21 bp, Homo sapiens
cagaaatgacaacaaggccct

SEQ ID NO: 2398915 - DNA, 18 bp, Homo sapiens
cagaaccggtcccagcct

SEQ ID NO: 2398916 - DNA, 19 bp, Homo sapiens
cagaagagaaaccatcctc

SEQ ID NO: 2398917 - DNA, 15 bp, Homo sapiens
cagaatcccctgggg

SEQ ID NO: 2398918 - DNA, 14 bp, Homo sapiens
cagacattgtgcta

SEQ ID NO: 2398919 - DNA, 20 bp, Homo sapiens
cagaccaaggcgagtttccc

SEQ ID NO: 2398920 - DNA, 12 bp, Homo sapiens
cagaccctgcct

SEQ ID NO: 2398921 - DNA, 18 bp, Homo sapiens
cagaccctgcctgagccc

SEQ ID NO: 2398922 - DNA, 15 bp, Homo sapiens
cagacgcagcagctg

SEQ ID NO: 2398923 - DNA, 20 bp, Homo sapiens
cagacgcagcagctgggacc

SEQ ID NO: 2398924 - DNA, 21 bp, Homo sapiens
cagagagaggcgtcctggtga

SEQ ID NO: 2398925 - DNA, 20 bp, Homo sapiens
cagagcaagactccgtctca

SEQ ID NO: 2398926 - DNA, 17 bp, Homo sapiens
cagagccccgccccacc

SEQ ID NO: 2398927 - DNA, 15 bp, Homo sapiens
cagagctaggctgtg

SEQ ID NO: 2398928 - DNA, 18 bp, Homo sapiens
cagagcttattggccact

SEQ ID NO: 2398929 - DNA, 19 bp, Homo sapiens
cagagcttattggccactg

SEQ ID NO: 2398930 - DNA, 16 bp, Homo sapiens
cagagttaaaatgttt

SEQ ID NO: 2398931 - DNA, 20 bp, Homo sapiens
cagagttaaaatgtttactg

SEQ ID NO: 2398932 - DNA, 23 bp, Homo sapiens
cagagttaaaatgtttactgtaa

SEQ ID NO: 2398933 - DNA, 19 bp, Homo sapiens
cagcaaggtcatggtctga

SEQ ID NO: 2398934 - DNA, 15 bp, Homo sapiens
cagcactttgggaag

SEQ ID NO: 2398935 - DNA, 17 bp, Homo sapiens
cagcactttgggaagct

SEQ ID NO: 2398936 - DNA, 14 bp, Homo sapiens
cagcagctgggacc

SEQ ID NO: 2398937 - DNA, 15 bp, Homo sapiens
cagcagctgggaccc

SEQ ID NO: 2398938 - DNA, 23 bp, Homo sapiens
cagcaggaggacagagtgccctg

SEQ ID NO: 2398939 - DNA, 15 bp, Homo sapiens
cagcccaccctctgt

SEQ ID NO: 2398940 - DNA, 22 bp, Homo sapiens
aaaaccttccatgtcaagattc

SEQ ID NO: 2398941 - DNA, 16 bp, Homo sapiens
aaaatgtttactgtaa

SEQ ID NO: 2398942 - DNA, 17 bp, Homo sapiens
aaacaaataatcacatt

SEQ ID NO: 2398943 - DNA, 18 bp, Homo sapiens
aaacaactatggctgttg

SEQ ID NO: 2398944 - DNA, 15 bp, Homo sapiens
aaaccatcctctccc

SEQ ID NO: 2398945 - DNA, 15 bp, Homo sapiens
aaactagtaactagt

SEQ ID NO: 2398946 - DNA, 12 bp, Homo sapiens
aaactccacagg

SEQ ID NO: 2398947 - DNA, 13 bp, Homo sapiens
aaagaaaaatgca

SEQ ID NO: 2398948 - DNA, 22 bp, Homo sapiens
aaagtttttatggaagggtaaa

SEQ ID NO: 2398949 - DNA, 21 bp, Homo sapiens
aaatgaaacaaataatcacat

SEQ ID NO: 2398950 - DNA, 15 bp, Homo sapiens
aaatgcaaaagaagt

SEQ ID NO: 2398951 - DNA, 15 bp, Homo sapiens
aaatgcattattgac

SEQ ID NO: 2398952 - DNA, 14 bp, Homo sapiens
aaatgtactggtaa

SEQ ID NO: 2398953 - DNA, 21 bp, Homo sapiens
aaatgtactggtaattgtaca

SEQ ID NO: 2398954 - DNA, 22 bp, Homo sapiens
aaatgtactggtaattgtacaa

SEQ ID NO: 2398955 - DNA, 14 bp, Homo sapiens
aaatgtttactgta

SEQ ID NO: 2398956 - DNA, 16 bp, Homo sapiens
aacaactatggctgtt

SEQ ID NO: 2398957 - DNA, 14 bp, Homo sapiens
aacagcatggcccg

SEQ ID NO: 2398958 - DNA, 20 bp, Homo sapiens
aacaggagttcagcggagct

SEQ ID NO: 2398959 - DNA, 20 bp, Homo sapiens
aacagttgcacagcatctca

SEQ ID NO: 2398960 - DNA, 22 bp, Homo sapiens
aacagttgcacagcatctcagc

SEQ ID NO: 2398961 - DNA, 17 bp, Homo sapiens
aacatatctaaagtcat

SEQ ID NO: 2398962 - DNA, 15 bp, Homo sapiens
aaccatcctctccct

SEQ ID NO: 2398963 - DNA, 20 bp, Homo sapiens
aaccctgccccactcctgtc

SEQ ID NO: 2398964 - DNA, 23 bp, Homo sapiens
aacccttaaacagttgcacagca

SEQ ID NO: 2398965 - DNA, 17 bp, Homo sapiens
aaccggtcccagcctgg

SEQ ID NO: 2398966 - DNA, 14 bp, Homo sapiens
aacctactgtctaa

SEQ ID NO: 2398967 - DNA, 19 bp, Homo sapiens
aactagtggggcttaatga

SEQ ID NO: 2398968 - DNA, 14 bp, Homo sapiens
aactggctacagta

SEQ ID NO: 2398969 - DNA, 14 bp, Homo sapiens
aactggcttgtaca

SEQ ID NO: 2398970 - DNA, 16 bp, Homo sapiens
aactggcttgtacatt

SEQ ID NO: 2398971 - DNA, 17 bp, Homo sapiens
aactggcttgtacattt

SEQ ID NO: 2398972 - DNA, 21 bp, Homo sapiens
aacttagcattttctgcatct

SEQ ID NO: 2398973 - DNA, 23 bp, Homo sapiens
aagaccaaatgatagaactgtac

SEQ ID NO: 2398974 - DNA, 19 bp, Homo sapiens
aagacttagatctgagccc

SEQ ID NO: 2398975 - DNA, 21 bp, Homo sapiens
aagacttagatctgagccctc

SEQ ID NO: 2398976 - DNA, 15 bp, Homo sapiens
aagattcagctagtg

SEQ ID NO: 2398977 - DNA, 17 bp, Homo sapiens
aagcagttttgtaaatg

SEQ ID NO: 2398978 - DNA, 18 bp, Homo sapiens
aagcagttttgtaaatgt

SEQ ID NO: 2398979 - DNA, 15 bp, Homo sapiens
aaggtcataagtttc

SEQ ID NO: 2398980 - DNA, 21 bp, Homo sapiens
aagtccccagcccctcaaccc

SEQ ID NO: 2398981 - DNA, 19 bp, Homo sapiens
aagtgactgaaaatggcat

SEQ ID NO: 2398982 - DNA, 20 bp, Homo sapiens
aagtggggcagcagcagtgg

SEQ ID NO: 2398983 - DNA, 20 bp, Homo sapiens
aataccacctcgagatgggt

SEQ ID NO: 2398984 - DNA, 12 bp, Homo sapiens
aatacccacatt

SEQ ID NO: 2398985 - DNA, 19 bp, Homo sapiens
aatcaccctgactgtgggg

SEQ ID NO: 2398986 - DNA, 22 bp, Homo sapiens
aatctagagtttatacagtgta

SEQ ID NO: 2398987 - DNA, 22 bp, Homo sapiens
aatgcattattgacgaactggc

SEQ ID NO: 2398988 - DNA, 13 bp, Homo sapiens
aatgggggaggcc

SEQ ID NO: 2398989 - DNA, 14 bp, Homo sapiens
aatgggggaggccc

SEQ ID NO: 2398990 - DNA, 21 bp, Homo sapiens
aatggttgggaccaggccaat

SEQ ID NO: 2398991 - DNA, 18 bp, Homo sapiens
aatgtactggtaattgta

SEQ ID NO: 2398992 - DNA, 13 bp, Homo sapiens
aatgtattttaat

SEQ ID NO: 2398993 - DNA, 16 bp, Homo sapiens
aatgtttactgtaaat

SEQ ID NO: 2398994 - DNA, 15 bp, Homo sapiens
aattggcttccttga

SEQ ID NO: 2398995 - DNA, 14 bp, Homo sapiens
aattttttgaactt

SEQ ID NO: 2398996 - DNA, 15 bp, Homo sapiens
aattttttgaacttt

SEQ ID NO: 2398997 - DNA, 12 bp, Homo sapiens
acaaataatcac

SEQ ID NO: 2398998 - DNA, 13 bp, Homo sapiens
acaatgtatttta

SEQ ID NO: 2398999 - DNA, 20 bp, Homo sapiens
acaatgtattttaataacat

SEQ ID NO: 2399000 - DNA, 21 bp, Homo sapiens
acaattagataaatgtccatt

SEQ ID NO: 2399001 - DNA, 21 bp, Homo sapiens
acaccacccagagcaccctct

SEQ ID NO: 2399002 - DNA, 14 bp, Homo sapiens
acagcatctcagct

SEQ ID NO: 2399003 - DNA, 14 bp, Homo sapiens
cagcccctcaaccc

SEQ ID NO: 2399004 - DNA, 16 bp, Homo sapiens
cagcccttgctctacc

SEQ ID NO: 2399005 - DNA, 22 bp, Homo sapiens
cagcctaacccccagcccctcc

SEQ ID NO: 2399006 - DNA, 22 bp, Homo sapiens
cagcctatatttcctcttctgt

SEQ ID NO: 2399007 - DNA, 16 bp, Homo sapiens
cagcctcagtgccact

SEQ ID NO: 2399008 - DNA, 20 bp, Homo sapiens
cagcctccctttgccagcca

SEQ ID NO: 2399009 - DNA, 12 bp, Homo sapiens
cagcctcctctg

SEQ ID NO: 2399010 - DNA, 12 bp, Homo sapiens
cagcctctctgc

SEQ ID NO: 2399011 - DNA, 19 bp, Homo sapiens
cagcctgccaggccctcca

SEQ ID NO: 2399012 - DNA, 15 bp, Homo sapiens
cagcctgggctcctc

SEQ ID NO: 2399013 - DNA, 21 bp, Homo sapiens
cagcgccagggctcagatggg

SEQ ID NO: 2399014 - DNA, 14 bp, Homo sapiens
cagcgcctccaccc

SEQ ID NO: 2399015 - DNA, 15 bp, Homo sapiens
cagcgcctccaccct

SEQ ID NO: 2399016 - DNA, 17 bp, Homo sapiens
cagcgcctccaccctgc

SEQ ID NO: 2399017 - DNA, 18 bp, Homo sapiens
cagcgcctccaccctgcc

SEQ ID NO: 2399018 - DNA, 21 bp, Homo sapiens
cagcgcctccaccctgccctg

SEQ ID NO: 2399019 - DNA, 21 bp, Homo sapiens
cagcgtctccccatgctgggc

SEQ ID NO: 2399020 - DNA, 22 bp, Homo sapiens
cagcgtctccccatgctgggct

SEQ ID NO: 2399021 - DNA, 12 bp, Homo sapiens
cagctacattcc

SEQ ID NO: 2399022 - DNA, 14 bp, Homo sapiens
cagctacattcctc

SEQ ID NO: 2399023 - DNA, 19 bp, Homo sapiens
cagctacattcctcagctg

SEQ ID NO: 2399024 - DNA, 20 bp, Homo sapiens
cagctacattcctcagctgc

SEQ ID NO: 2399025 - DNA, 21 bp, Homo sapiens
cagctacattcctcagctgcc

SEQ ID NO: 2399026 - DNA, 22 bp, Homo sapiens
cagctacattcctcagctgcca

SEQ ID NO: 2399027 - DNA, 22 bp, Homo sapiens
cagctcagagccccgccccacc

SEQ ID NO: 2399028 - DNA, 11 bp, Homo sapiens
cagctgagcac

SEQ ID NO: 2399029 - DNA, 20 bp, Homo sapiens
cagctgcacattcctggccc

SEQ ID NO: 2399030 - DNA, 12 bp, Homo sapiens
cagctgccaagc

SEQ ID NO: 2399031 - DNA, 18 bp, Homo sapiens
caggagctgagtcacctc

SEQ ID NO: 2399032 - DNA, 19 bp, Homo sapiens
caggagctgagtcacctcc

SEQ ID NO: 2399033 - DNA, 22 bp, Homo sapiens
caggaggacagagtgccctggg

SEQ ID NO: 2399034 - DNA, 20 bp, Homo sapiens
caggaggatcccctgaggtc

SEQ ID NO: 2399035 - DNA, 21 bp, Homo sapiens
caggagtgctgccctctccca

SEQ ID NO: 2399036 - DNA, 17 bp, Homo sapiens
caggagttcgagagcag

SEQ ID NO: 2399037 - DNA, 20 bp, Homo sapiens
caggagttcgagagcagcct

SEQ ID NO: 2399038 - DNA, 22 bp, Homo sapiens
caggagttcgagagcagcctgg

SEQ ID NO: 2399039 - DNA, 23 bp, Homo sapiens
caggagttcgagagcagcctggc

SEQ ID NO: 2399040 - DNA, 24 bp, Homo sapiens
caggagttcgagagcagcctggcc

SEQ ID NO: 2399041 - DNA, 15 bp, Homo sapiens
caggatcctcctgga

SEQ ID NO: 2399042 - DNA, 19 bp, Homo sapiens
caggatgagaacacactga

SEQ ID NO: 2399043 - DNA, 19 bp, Homo sapiens
caggcagcaaggtcatggt

SEQ ID NO: 2399044 - DNA, 13 bp, Homo sapiens
cagggcatgcctg

SEQ ID NO: 2399045 - DNA, 19 bp, Homo sapiens
cagggctgtgggtggggaa

SEQ ID NO: 2399046 - DNA, 15 bp, Homo sapiens
caggggtgagacctg

SEQ ID NO: 2399047 - DNA, 13 bp, Homo sapiens
caggtgggggctg

SEQ ID NO: 2399048 - DNA, 22 bp, Homo sapiens
caggtgggggctgcgtccctgc

SEQ ID NO: 2399049 - DNA, 16 bp, Homo sapiens
cagtaactgccctttc

SEQ ID NO: 2399050 - DNA, 21 bp, Homo sapiens
cagtaagggatattagataat

SEQ ID NO: 2399051 - DNA, 18 bp, Homo sapiens
cagtgagccagaaattga

SEQ ID NO: 2399052 - DNA, 22 bp, Homo sapiens
cagtgagccagaaattgattaa

SEQ ID NO: 2399053 - DNA, 20 bp, Homo sapiens
cagtgccacttgacattcct

SEQ ID NO: 2399054 - DNA, 21 bp, Homo sapiens
cagtgccacttgacattcctt

SEQ ID NO: 2399055 - DNA, 18 bp, Homo sapiens
cagtgccaggaaccctta

SEQ ID NO: 2399056 - DNA, 13 bp, Homo sapiens
cagtgtacatgta

SEQ ID NO: 2399057 - DNA, 17 bp, Homo sapiens
cagtgtacatgtacata

SEQ ID NO: 2399058 - DNA, 19 bp, Homo sapiens
cagttactgatgctcctga

SEQ ID NO: 2399059 - DNA, 16 bp, Homo sapiens
cagttgcacagcatct

SEQ ID NO: 2399060 - DNA, 21 bp, Homo sapiens
cagttgcacagcatctcagct

SEQ ID NO: 2399061 - DNA, 17 bp, Homo sapiens
cataactaatacagctg

SEQ ID NO: 2399062 - DNA, 16 bp, Homo sapiens
catagccttatgagtt

SEQ ID NO: 2399063 - DNA, 20 bp, Homo sapiens
catagctgggatttgaactg

SEQ ID NO: 2399064 - DNA, 15 bp, Homo sapiens
cataggagtgtgtta

SEQ ID NO: 2399065 - DNA, 15 bp, Homo sapiens
catatctaaagtcat

SEQ ID NO: 2399066 - DNA, 15 bp, Homo sapiens
catatgcttctgatg

SEQ ID NO: 2399067 - DNA, 18 bp, Homo sapiens
catatgttccatgcctgg

SEQ ID NO: 2399068 - DNA, 14 bp, Homo sapiens
catcatgaactggc

SEQ ID NO: 2399069 - DNA, 23 bp, Homo sapiens
catcatgaactggcttgtacatt

SEQ ID NO: 2399070 - DNA, 20 bp, Homo sapiens
catccaccttcctgcccagg

SEQ ID NO: 2399071 - DNA, 21 bp, Homo sapiens
catccaccttcctgcccaggg

SEQ ID NO: 2399072 - DNA, 23 bp, Homo sapiens
catccaccttcctgcccagggga

SEQ ID NO: 2399073 - DNA, 17 bp, Homo sapiens
catccatcttccctacc

SEQ ID NO: 2399074 - DNA, 12 bp, Homo sapiens
catcccctgcct

SEQ ID NO: 2399075 - DNA, 14 bp, Homo sapiens
catcctggcccctc

SEQ ID NO: 2399076 - DNA, 15 bp, Homo sapiens
catcctggcccctcc

SEQ ID NO: 2399077 - DNA, 17 bp, Homo sapiens
catcctggcccctccag

SEQ ID NO: 2399078 - DNA, 13 bp, Homo sapiens
catctgcagcctc

SEQ ID NO: 2399079 - DNA, 18 bp, Homo sapiens
catctgcagcctcctctg

SEQ ID NO: 2399080 - DNA, 21 bp, Homo sapiens
catcttccctacccttcctgc

SEQ ID NO: 2399081 - DNA, 17 bp, Homo sapiens
catcttgctctgtggcc

SEQ ID NO: 2399082 - DNA, 22 bp, Homo sapiens
catgaaagaaataaacaggagt

SEQ ID NO: 2399083 - DNA, 19 bp, Homo sapiens
catgaaccctgccccactc

SEQ ID NO: 2399084 - DNA, 13 bp, Homo sapiens
catgaactggctt

SEQ ID NO: 2399085 - DNA, 14 bp, Homo sapiens
catgcctggcctga

SEQ ID NO: 2399086 - DNA, 13 bp, Homo sapiens
catggacagctga

SEQ ID NO: 2399087 - DNA, 15 bp, Homo sapiens
catggacagctgagc

SEQ ID NO: 2399088 - DNA, 23 bp, Homo sapiens
catggactccaggatcctcctgg

SEQ ID NO: 2399089 - DNA, 13 bp, Homo sapiens
catggcaagtggg

SEQ ID NO: 2399090 - DNA, 17 bp, Homo sapiens
catggcaagtggggctg

SEQ ID NO: 2399091 - DNA, 16 bp, Homo sapiens
catgggccagcccttg

SEQ ID NO: 2399092 - DNA, 12 bp, Homo sapiens
catgggccctca

SEQ ID NO: 2399093 - DNA, 15 bp, Homo sapiens
catgggccctcagcg

SEQ ID NO: 2399094 - DNA, 19 bp, Homo sapiens
catggtcaggggtgagacc

SEQ ID NO: 2399095 - DNA, 17 bp, Homo sapiens
catgtacatagtaaagt

SEQ ID NO: 2399096 - DNA, 20 bp, Homo sapiens
catgtacatagtaaagtatt

SEQ ID NO: 2399097 - DNA, 14 bp, Homo sapiens
catgtcaagattca

SEQ ID NO: 2399098 - DNA, 16 bp, Homo sapiens
catgtgcttgtgccta

SEQ ID NO: 2399099 - DNA, 13 bp, Homo sapiens
cattaaatccgca

SEQ ID NO: 2399100 - DNA, 15 bp, Homo sapiens
cattattgagtcacc

SEQ ID NO: 2399101 - DNA, 21 bp, Homo sapiens
cattctagagtgcatatattt

SEQ ID NO: 2399102 - DNA, 13 bp, Homo sapiens
cattgacctcagc

SEQ ID NO: 2399103 - DNA, 23 bp, Homo sapiens
cattgacctcagctgcacattcc

SEQ ID NO: 2399104 - DNA, 20 bp, Homo sapiens
catttcctttgttgtctaca

SEQ ID NO: 2399105 - DNA, 13 bp, Homo sapiens
catttgtaggtag

SEQ ID NO: 2399106 - DNA, 14 bp, Homo sapiens
cattttctgcatct

SEQ ID NO: 2399107 - DNA, 16 bp, Homo sapiens
cattttctgcatctcc

SEQ ID NO: 2399108 - DNA, 19 bp, Homo sapiens
ccaacctcaatgccctgcc

SEQ ID NO: 2399109 - DNA, 15 bp, Homo sapiens
ccaactctgcactcc

SEQ ID NO: 2399110 - DNA, 21 bp, Homo sapiens
ccaagcactcgagaccatcct

SEQ ID NO: 2399111 - DNA, 13 bp, Homo sapiens
ccacaaagggtag

SEQ ID NO: 2399112 - DNA, 14 bp, Homo sapiens
ccacaaagggtagc

SEQ ID NO: 2399113 - DNA, 20 bp, Homo sapiens
ccacaatgacagaaatgaca

SEQ ID NO: 2399114 - DNA, 17 bp, Homo sapiens
ccacatccccaccttcc

SEQ ID NO: 2399115 - DNA, 15 bp, Homo sapiens
ccaccaactctgcac

SEQ ID NO: 2399116 - DNA, 20 bp, Homo sapiens
ccaccaactctgcactccat

SEQ ID NO: 2399117 - DNA, 17 bp, Homo sapiens
ccaccattccacatccc

SEQ ID NO: 2399118 - DNA, 18 bp, Homo sapiens
ccacccccgccacggcca

SEQ ID NO: 2399119 - DNA, 17 bp, Homo sapiens
cgttcctcctcagcctc

SEQ ID NO: 2399120 - DNA, 22 bp, Homo sapiens
ctaaagtcatcatgaactggct

SEQ ID NO: 2399121 - DNA, 23 bp, Homo sapiens
ctaaagtcatcatgaactggctt

SEQ ID NO: 2399122 - DNA, 19 bp, Homo sapiens
ctaagcagttttgtaaatg

SEQ ID NO: 2399123 - DNA, 19 bp, Homo sapiens
ctacataactaatacagct

SEQ ID NO: 2399124 - DNA, 15 bp, Homo sapiens
ctacatgggccagcc

SEQ ID NO: 2399125 - DNA, 17 bp, Homo sapiens
ctacatgggccagccct

SEQ ID NO: 2399126 - DNA, 20 bp, Homo sapiens
ctacatgggccagcccttgc

SEQ ID NO: 2399127 - DNA, 13 bp, Homo sapiens
ctacattcctcag

SEQ ID NO: 2399128 - DNA, 16 bp, Homo sapiens
ctacattcctcagctg

SEQ ID NO: 2399129 - DNA, 19 bp, Homo sapiens
ctacattcctcagctgcca

SEQ ID NO: 2399130 - DNA, 22 bp, Homo sapiens
ctacattcctcagctgccaagc

SEQ ID NO: 2399131 - DNA, 15 bp, Homo sapiens
ctacccgagcccagc

SEQ ID NO: 2399132 - DNA, 20 bp, Homo sapiens
ctacccgagcccagctacat

SEQ ID NO: 2399133 - DNA, 11 bp, Homo sapiens
ctacccttcct

SEQ ID NO: 2399134 - DNA, 12 bp, Homo sapiens
ctacccttcctg

SEQ ID NO: 2399135 - DNA, 22 bp, Homo sapiens
ctacctggccggtaggctgctg

SEQ ID NO: 2399136 - DNA, 23 bp, Homo sapiens
ctacctgggacctgatttattga

SEQ ID NO: 2399137 - DNA, 21 bp, Homo sapiens
ctacgagggaggaacacctga

SEQ ID NO: 2399138 - DNA, 23 bp, Homo sapiens
ctactgtctaagcagttttgtaa

SEQ ID NO: 2399139 - DNA, 23 bp, Homo sapiens
ctagaaataaaatcaccctgact

SEQ ID NO: 2399140 - DNA, 18 bp, Homo sapiens
ctagaccctcccccacca

SEQ ID NO: 2399141 - DNA, 15 bp, Homo sapiens
ctagagtttatacag

SEQ ID NO: 2399142 - DNA, 19 bp, Homo sapiens
ctagagtttatacagtgta

SEQ ID NO: 2399143 - DNA, 22 bp, Homo sapiens
ctagagtttatacagtgtacat

SEQ ID NO: 2399144 - DNA, 21 bp, Homo sapiens
ctagcagaagacaaggcatgt

SEQ ID NO: 2399145 - DNA, 14 bp, Homo sapiens
ctagccctcctgag

SEQ ID NO: 2399146 - DNA, 13 bp, Homo sapiens
ctatccctggcca

SEQ ID NO: 2399147 - DNA, 14 bp, Homo sapiens
ctatccctggccac

SEQ ID NO: 2399148 - DNA, 18 bp, Homo sapiens
ctcaaccctccgttcctc

SEQ ID NO: 2399149 - DNA, 19 bp, Homo sapiens
ctcaatgtccccctcaccc

SEQ ID NO: 2399150 - DNA, 16 bp, Homo sapiens
ctcaatttggtgctca

SEQ ID NO: 2399151 - DNA, 18 bp, Homo sapiens
ctcactacatgggccagc

SEQ ID NO: 2399152 - DNA, 13 bp, Homo sapiens
ctcactcctgagt

SEQ ID NO: 2399153 - DNA, 15 bp, Homo sapiens
ctcagagccccgccc

SEQ ID NO: 2399154 - DNA, 14 bp, Homo sapiens
ctcagatggggcct

SEQ ID NO: 2399155 - DNA, 15 bp, Homo sapiens
ctcagatggggcctg

SEQ ID NO: 2399156 - DNA, 19 bp, Homo sapiens
ctcagatggggcctgggct

SEQ ID NO: 2399157 - DNA, 14 bp, Homo sapiens
ctcagcccatcccc

SEQ ID NO: 2399158 - DNA, 19 bp, Homo sapiens
ctcagcccatcccctgcct

SEQ ID NO: 2399159 - DNA, 19 bp, Homo sapiens
ctcagcgtctccccatgct

SEQ ID NO: 2399160 - DNA, 20 bp, Homo sapiens
ctcagctgcacattcctggc

SEQ ID NO: 2399161 - DNA, 21 bp, Homo sapiens
ctcagctgcacattcctggcc

SEQ ID NO: 2399162 - DNA, 12 bp, Homo sapiens
ctcagctgccaa

SEQ ID NO: 2399163 - DNA, 17 bp, Homo sapiens
ctcagctgccaagcact

SEQ ID NO: 2399164 - DNA, 17 bp, Homo sapiens
ctcagggtaagctgctc

SEQ ID NO: 2399165 - DNA, 17 bp, Homo sapiens
ctcatgaggctgaggca

SEQ ID NO: 2399166 - DNA, 23 bp, Homo sapiens
ctcatgcctgtaatcccagcact

SEQ ID NO: 2399167 - DNA, 15 bp, Homo sapiens
ctccacagggactgt

SEQ ID NO: 2399168 - DNA, 12 bp, Homo sapiens
ctccaccctgcc

SEQ ID NO: 2399169 - DNA, 19 bp, Homo sapiens
ctccaccctgccctgctga

SEQ ID NO: 2399170 - DNA, 17 bp, Homo sapiens
ctccactcactccagcc

SEQ ID NO: 2399171 - DNA, 22 bp, Homo sapiens
ctccacttactataatggttgg

SEQ ID NO: 2399172 - DNA, 17 bp, Homo sapiens
ctccaggatcctcctgg

SEQ ID NO: 2399173 - DNA, 22 bp, Homo sapiens
ctccaggatcctcctggagcag

SEQ ID NO: 2399174 - DNA, 15 bp, Homo sapiens
ctccatggccacccc

SEQ ID NO: 2399175 - DNA, 16 bp, Homo sapiens
ctccatggccaccccg

SEQ ID NO: 2399176 - DNA, 12 bp, Homo sapiens
ctcccaacctca

SEQ ID NO: 2399177 - DNA, 16 bp, Homo sapiens
ctcccaacctcaatgc

SEQ ID NO: 2399178 - DNA, 22 bp, Homo sapiens
ctcccaacctcaatgccctgcc

SEQ ID NO: 2399179 - DNA, 14 bp, Homo sapiens
ctccccatgctggg

SEQ ID NO: 2399180 - DNA, 13 bp, Homo sapiens
ctccccctgtgtg

SEQ ID NO: 2399181 - DNA, 17 bp, Homo sapiens
ctccgttcctcctcagc

SEQ ID NO: 2399182 - DNA, 19 bp, Homo sapiens
ctccgttcctcctcagcct

SEQ ID NO: 2399183 - DNA, 14 bp, Homo sapiens
ctcctagccctcct

SEQ ID NO: 2399184 - DNA, 15 bp, Homo sapiens
ctcctccccggagcc

SEQ ID NO: 2399185 - DNA, 14 bp, Homo sapiens
ctcctcccttcccc

SEQ ID NO: 2399186 - DNA, 17 bp, Homo sapiens
ctcctcccttccccact

SEQ ID NO: 2399187 - DNA, 15 bp, Homo sapiens
ctcctgcccacgtgc

SEQ ID NO: 2399188 - DNA, 16 bp, Homo sapiens
ctcctgcccacgtgca

SEQ ID NO: 2399189 - DNA, 19 bp, Homo sapiens
ctcctggagcagcagctga

SEQ ID NO: 2399190 - DNA, 13 bp, Homo sapiens
ctcctggcctgag

SEQ ID NO: 2399191 - DNA, 14 bp, Homo sapiens
ctcctggcctgagc

SEQ ID NO: 2399192 - DNA, 22 bp, Homo sapiens
ctccttcccgccgcccgacccc

SEQ ID NO: 2399193 - DNA, 18 bp, Homo sapiens
ctccttcctgtggcctca

SEQ ID NO: 2399194 - DNA, 16 bp, Homo sapiens
ctcgcacagggcatgc

SEQ ID NO: 2399195 - DNA, 12 bp, Homo sapiens
ctcgctgctgct

SEQ ID NO: 2399196 - DNA, 16 bp, Homo sapiens
ctcgctgctgctacta

SEQ ID NO: 2399197 - DNA, 13 bp, Homo sapiens
ctcggcatggccg

SEQ ID NO: 2399198 - DNA, 15 bp, Homo sapiens
ctcgtccctcctccc

SEQ ID NO: 2399199 - DNA, 13 bp, Homo sapiens
ctctacctggccg

SEQ ID NO: 2399200 - DNA, 14 bp, Homo sapiens
ctctacctggccgg

SEQ ID NO: 2399201 - DNA, 14 bp, Homo sapiens
ctctgagggtctga

SEQ ID NO: 2399202 - DNA, 14 bp, Homo sapiens
ctctgcactccatg

SEQ ID NO: 2399203 - DNA, 20 bp, Homo sapiens
ctctgcactccatggccacc

SEQ ID NO: 2399204 - DNA, 16 bp, Homo sapiens
ctctgctcccagcccc

SEQ ID NO: 2399205 - DNA, 13 bp, Homo sapiens
ctctgcttccagt

SEQ ID NO: 2399206 - DNA, 12 bp, Homo sapiens
ctctggccaccc

SEQ ID NO: 2399207 - DNA, 16 bp, Homo sapiens
ctctggccaccctggc

SEQ ID NO: 2399208 - DNA, 17 bp, Homo sapiens
ctctggccaccctggcc

SEQ ID NO: 2399209 - DNA, 23 bp, Homo sapiens
ctctggttgtgggcttggaccac

SEQ ID NO: 2399210 - DNA, 15 bp, Homo sapiens
ctcttctctgggccc

SEQ ID NO: 2399211 - DNA, 22 bp, Homo sapiens
ctgaaatgaaacaaataatcac

SEQ ID NO: 2399212 - DNA, 23 bp, Homo sapiens
ctgacccccatcgctctgagcat

SEQ ID NO: 2399213 - DNA, 17 bp, Homo sapiens
ctgagagatggaaggcg

SEQ ID NO: 2399214 - DNA, 21 bp, Homo sapiens
ctgagcacagacggaggaagc

SEQ ID NO: 2399215 - DNA, 21 bp, Homo sapiens
ctgagcatatgttccatgcct

SEQ ID NO: 2399216 - DNA, 16 bp, Homo sapiens
ctgagctatgtagtat

SEQ ID NO: 2399217 - DNA, 23 bp, Homo sapiens
ctgagtcacctcctccactcact

SEQ ID NO: 2399218 - DNA, 17 bp, Homo sapiens
ctgagtggcggggcccc

SEQ ID NO: 2399219 - DNA, 17 bp, Homo sapiens
ctgagtggggcttcctg

SEQ ID NO: 2399220 - DNA, 21 bp, Homo sapiens
ctgagtggggcttcctgggca

SEQ ID NO: 2399221 - DNA, 23 bp, Homo sapiens
ctgatctggcccaagctgggctc

SEQ ID NO: 2399222 - DNA, 17 bp, Homo sapiens
ctgcacaggcagcaagg

SEQ ID NO: 2399223 - DNA, 13 bp, Homo sapiens
ctgcacattcctg

SEQ ID NO: 2399224 - DNA, 15 bp, Homo sapiens
ctgcacattcctggc

SEQ ID NO: 2399225 - DNA, 11 bp, Homo sapiens
ctgcactccat

SEQ ID NO: 2399226 - DNA, 19 bp, Homo sapiens
ctgcactccatggccaccc

SEQ ID NO: 2399227 - DNA, 21 bp, Homo sapiens
ctgcactccatggccaccccg

SEQ ID NO: 2399228 - DNA, 19 bp, Homo sapiens
ctgcaggcaggtgggggct

SEQ ID NO: 2399229 - DNA, 16 bp, Homo sapiens
ctgcatcttgctctgt

SEQ ID NO: 2399230 - DNA, 19 bp, Homo sapiens
ctgccaagcactcgagacc

SEQ ID NO: 2399231 - DNA, 16 bp, Homo sapiens
ctgccaggccctccag

SEQ ID NO: 2399232 - DNA, 20 bp, Homo sapiens
ctgccaggccctccagcagg

SEQ ID NO: 2399233 - DNA, 17 bp, Homo sapiens
ctgccaggcctccctcg

SEQ ID NO: 2399234 - DNA, 22 bp, Homo sapiens
ctgccaggcctccctcgggctg

SEQ ID NO: 2399235 - DNA, 13 bp, Homo sapiens
ctgccctctccca

SEQ ID NO: 2399236 - DNA, 22 bp, Homo sapiens
gcgctttcattttttgacctca

SEQ ID NO: 2399237 - DNA, 18 bp, Homo sapiens
gcgtccactttcccttcc

SEQ ID NO: 2399238 - DNA, 22 bp, Homo sapiens
gcgtccactttcccttcccctg

SEQ ID NO: 2399239 - DNA, 15 bp, Homo sapiens
gcgtccctgctcagc

SEQ ID NO: 2399240 - DNA, 20 bp, Homo sapiens
gcgtctccccatgctgggct

SEQ ID NO: 2399241 - DNA, 14 bp, Homo sapiens
gctacagtaccatg

SEQ ID NO: 2399242 - DNA, 16 bp, Homo sapiens
gctacattcctcagct

SEQ ID NO: 2399243 - DNA, 19 bp, Homo sapiens
gctacattcctcagctgcc

SEQ ID NO: 2399244 - DNA, 21 bp, Homo sapiens
gctactacccgagcccagcta

SEQ ID NO: 2399245 - DNA, 20 bp, Homo sapiens
gctactcatgaggctgaggc

SEQ ID NO: 2399246 - DNA, 17 bp, Homo sapiens
gctcactacatgggcca

SEQ ID NO: 2399247 - DNA, 23 bp, Homo sapiens
gctcactacatgggccagccctt

SEQ ID NO: 2399248 - DNA, 22 bp, Homo sapiens
gctcagatggggcctgggctgt

SEQ ID NO: 2399249 - DNA, 20 bp, Homo sapiens
gctcagcccatcccctgcct

SEQ ID NO: 2399250 - DNA, 13 bp, Homo sapiens
gctcccagcccct

SEQ ID NO: 2399251 - DNA, 15 bp, Homo sapiens
gctccgaggggctca

SEQ ID NO: 2399252 - DNA, 17 bp, Homo sapiens
gctccgaggggctcatg

SEQ ID NO: 2399253 - DNA, 20 bp, Homo sapiens
gctcctctgcatcttgctct

SEQ ID NO: 2399254 - DNA, 12 bp, Homo sapiens
gctcctgcccac

SEQ ID NO: 2399255 - DNA, 22 bp, Homo sapiens
gctcctgcccacgtgcagcacc

SEQ ID NO: 2399256 - DNA, 23 bp, Homo sapiens
gctcctgggttccctaggcccta

SEQ ID NO: 2399257 - DNA, 12 bp, Homo sapiens
gctccttcctgt

SEQ ID NO: 2399258 - DNA, 19 bp, Homo sapiens
gctccttcctgtggcctca

SEQ ID NO: 2399259 - DNA, 22 bp, Homo sapiens
gctccttcctgtggcctcatcc

SEQ ID NO: 2399260 - DNA, 15 bp, Homo sapiens
gctctgtggccttgg

SEQ ID NO: 2399261 - DNA, 20 bp, Homo sapiens
gctctgtggccttggccctg

SEQ ID NO: 2399262 - DNA, 22 bp, Homo sapiens
gctgaggccccagggctgtggg

SEQ ID NO: 2399263 - DNA, 17 bp, Homo sapiens
gctgagtcacctcctcc

SEQ ID NO: 2399264 - DNA, 18 bp, Homo sapiens
gctgagtcacctcctcca

SEQ ID NO: 2399265 - DNA, 13 bp, Homo sapiens
gctgcacattcct

SEQ ID NO: 2399266 - DNA, 17 bp, Homo sapiens
gctgcacattcctggcc

SEQ ID NO: 2399267 - DNA, 16 bp, Homo sapiens
gctgccctctcccatg

SEQ ID NO: 2399268 - DNA, 13 bp, Homo sapiens
gctgcgtccctgc

SEQ ID NO: 2399269 - DNA, 20 bp, Homo sapiens
gctgcgtccctgctcagccc

SEQ ID NO: 2399270 - DNA, 18 bp, Homo sapiens
gctggaagacttagatct

SEQ ID NO: 2399271 - DNA, 13 bp, Homo sapiens
gctggagaccaga

SEQ ID NO: 2399272 - DNA, 24 bp, Homo sapiens
gctggagaccagaacagcatggcc

SEQ ID NO: 2399273 - DNA, 22 bp, Homo sapiens
gctggagccgcttccccagctc

SEQ ID NO: 2399274 - DNA, 13 bp, Homo sapiens
gctgggctccctt

SEQ ID NO: 2399275 - DNA, 19 bp, Homo sapiens
gctgtggagtagagtttgt

SEQ ID NO: 2399276 - DNA, 13 bp, Homo sapiens
gctgtgggtgggg

SEQ ID NO: 2399277 - DNA, 21 bp, Homo sapiens
gctgttcatggcaagtggggc

SEQ ID NO: 2399278 - DNA, 15 bp, Homo sapiens
gcttattggccactg

SEQ ID NO: 2399279 - DNA, 14 bp, Homo sapiens
gcttccccagctca

SEQ ID NO: 2399280 - DNA, 15 bp, Homo sapiens
gcttccccagctcag

SEQ ID NO: 2399281 - DNA, 12 bp, Homo sapiens
gcttgctgtgtg

SEQ ID NO: 2399282 - DNA, 16 bp, Homo sapiens
gctttccatctgagga

SEQ ID NO: 2399283 - DNA, 17 bp, Homo sapiens
gctttccatctgaggac

SEQ ID NO: 2399284 - DNA, 16 bp, Homo sapiens
ggaacacctgatctta

SEQ ID NO: 2399285 - DNA, 22 bp, Homo sapiens
ggaacacctgatcttacagaaa

SEQ ID NO: 2399286 - DNA, 23 bp, Homo sapiens
ggaacacctgatcttacagaaaa

SEQ ID NO: 2399287 - DNA, 17 bp, Homo sapiens
ggaacggatcagatgtc

SEQ ID NO: 2399288 - DNA, 23 bp, Homo sapiens
ggacaagggggaggaaaggggcg

SEQ ID NO: 2399289 - DNA, 14 bp, Homo sapiens
ggacacagcccacc

SEQ ID NO: 2399290 - DNA, 11 bp, Homo sapiens
ggacaccaccc

SEQ ID NO: 2399291 - DNA, 23 bp, Homo sapiens
ggacaccacccagagcaccctct

SEQ ID NO: 2399292 - DNA, 21 bp, Homo sapiens
ggaccattgacctcagctgca

SEQ ID NO: 2399293 - DNA, 19 bp, Homo sapiens
ggacccatagatcttctga

SEQ ID NO: 2399294 - DNA, 13 bp, Homo sapiens
ggacctccccctg

SEQ ID NO: 2399295 - DNA, 23 bp, Homo sapiens
ggacctgatttattgaaattttt

SEQ ID NO: 2399296 - DNA, 20 bp, Homo sapiens
ggactccaggatcctcctgg

SEQ ID NO: 2399297 - DNA, 16 bp, Homo sapiens
ggagaacccttcctgc

SEQ ID NO: 2399298 - DNA, 22 bp, Homo sapiens
ggagaatggcgtgaacccggga

SEQ ID NO: 2399299 - DNA, 19 bp, Homo sapiens
ggagaccagaacagcatgg

SEQ ID NO: 2399300 - DNA, 17 bp, Homo sapiens
ggagccattctgtccca

SEQ ID NO: 2399301 - DNA, 16 bp, Homo sapiens
ggagctgagtcacctc

SEQ ID NO: 2399302 - DNA, 19 bp, Homo sapiens
ggaggacagagtgccctgg

SEQ ID NO: 2399303 - DNA, 17 bp, Homo sapiens
ggaggcccaatgaggtg

SEQ ID NO: 2399304 - DNA, 13 bp, Homo sapiens
ggaggctgctgcc

SEQ ID NO: 2399305 - DNA, 15 bp, Homo sapiens
ggaggctgctgcccc

SEQ ID NO: 2399306 - DNA, 14 bp, Homo sapiens
ggagtcatggtcag

SEQ ID NO: 2399307 - DNA, 19 bp, Homo sapiens
ggagttcgagagcagcctg

SEQ ID NO: 2399308 - DNA, 22 bp, Homo sapiens
ggagttcgagagcagcctggcc

SEQ ID NO: 2399309 - DNA, 19 bp, Homo sapiens
ggataggactgagtggtag

SEQ ID NO: 2399310 - DNA, 14 bp, Homo sapiens
ggatcccctgaggt

SEQ ID NO: 2399311 - DNA, 22 bp, Homo sapiens
ggatgacttggggacaccccag

SEQ ID NO: 2399312 - DNA, 14 bp, Homo sapiens
ggatgcccctggcc

SEQ ID NO: 2399313 - DNA, 18 bp, Homo sapiens
ggatgcccctggccctgc

SEQ ID NO: 2399314 - DNA, 21 bp, Homo sapiens
ggatgcccctggccctgcctc

SEQ ID NO: 2399315 - DNA, 15 bp, Homo sapiens
ggcaaggatgatcca

SEQ ID NO: 2399316 - DNA, 16 bp, Homo sapiens
ggcagaaccggtccca

SEQ ID NO: 2399317 - DNA, 20 bp, Homo sapiens
ggcagacattgtgctagtgc

SEQ ID NO: 2399318 - DNA, 15 bp, Homo sapiens
ggcagcaaggtcatg

SEQ ID NO: 2399319 - DNA, 17 bp, Homo sapiens
ggcagcaaggtcatggt

SEQ ID NO: 2399320 - DNA, 15 bp, Homo sapiens
ggcaggaggtgggtg

SEQ ID NO: 2399321 - DNA, 16 bp, Homo sapiens
ggcaggaggtgggtga

SEQ ID NO: 2399322 - DNA, 22 bp, Homo sapiens
ggcagttggggcggcccacgcc

SEQ ID NO: 2399323 - DNA, 16 bp, Homo sapiens
ggcatagcctttccct

SEQ ID NO: 2399324 - DNA, 20 bp, Homo sapiens
ggcatggtggcatgtgcctg

SEQ ID NO: 2399325 - DNA, 12 bp, Homo sapiens
ggcatgtgcctg

SEQ ID NO: 2399326 - DNA, 15 bp, Homo sapiens
ggccaccctccttcc

SEQ ID NO: 2399327 - DNA, 20 bp, Homo sapiens
ggccacctgccaggcctccc

SEQ ID NO: 2399328 - DNA, 22 bp, Homo sapiens
ggccactgggtctcactcctga

SEQ ID NO: 2399329 - DNA, 23 bp, Homo sapiens
ggccagaggcccattagttgaga

SEQ ID NO: 2399330 - DNA, 13 bp, Homo sapiens
ggccagcccttgc

SEQ ID NO: 2399331 - DNA, 13 bp, Homo sapiens
ggcccaagctggg

SEQ ID NO: 2399332 - DNA, 21 bp, Homo sapiens
ggcccaatgaggtggctcatg

SEQ ID NO: 2399333 - DNA, 18 bp, Homo sapiens
ggcccacgccagctggcc

SEQ ID NO: 2399334 - DNA, 21 bp, Homo sapiens
ggcccacgccagctggcccag

SEQ ID NO: 2399335 - DNA, 21 bp, Homo sapiens
ggcccgcccctcgctgctgct

SEQ ID NO: 2399336 - DNA, 18 bp, Homo sapiens
ggcccggggcccttcctc

SEQ ID NO: 2399337 - DNA, 12 bp, Homo sapiens
ggccctgacccc

SEQ ID NO: 2399338 - DNA, 22 bp, Homo sapiens
ggccctgcctcactgtgacctg

SEQ ID NO: 2399339 - DNA, 23 bp, Homo sapiens
ggccctgcctcactgtgacctgc

SEQ ID NO: 2399340 - DNA, 22 bp, Homo sapiens
ggccctggacacagcccaccct

SEQ ID NO: 2399341 - DNA, 11 bp, Homo sapiens
ggcccttcctc

SEQ ID NO: 2399342 - DNA, 23 bp, Homo sapiens
ggcccttcctcgcacagggcatg

SEQ ID NO: 2399343 - DNA, 15 bp, Homo sapiens
ggccggtaggctgct

SEQ ID NO: 2399344 - DNA, 16 bp, Homo sapiens
ggccggtaggctgctg

SEQ ID NO: 2399345 - DNA, 18 bp, Homo sapiens
ggccggtaggctgctggc

SEQ ID NO: 2399346 - DNA, 20 bp, Homo sapiens
ggcctccctcgggctggtgt

SEQ ID NO: 2399347 - DNA, 14 bp, Homo sapiens
ggcctgagcgcagc

SEQ ID NO: 2399348 - DNA, 22 bp, Homo sapiens
ggcctgagcgcagcgcctccac

SEQ ID NO: 2399349 - DNA, 21 bp, Homo sapiens
ggcctggactgcacaggcagc

SEQ ID NO: 2399350 - DNA, 16 bp, Homo sapiens
ggcggcccacgccagc

SEQ ID NO: 2399351 - DNA, 22 bp, Homo sapiens
ggcggcccacgccagctggccc

SEQ ID NO: 2399352 - DNA, 23 bp, Homo sapiens
tccttaacacctgatctggccca

SEQ ID NO: 2399353 - DNA, 15 bp, Homo sapiens
tccttcctgtggcct

SEQ ID NO: 2399354 - DNA, 14 bp, Homo sapiens
tccttgtcaccagc

SEQ ID NO: 2399355 - DNA, 19 bp, Homo sapiens
tcgagaccatcctggcccc

SEQ ID NO: 2399356 - DNA, 23 bp, Homo sapiens
tcgagaccatcctggcccctcca

SEQ ID NO: 2399357 - DNA, 15 bp, Homo sapiens
tcgagagcagcctgg

SEQ ID NO: 2399358 - DNA, 15 bp, Homo sapiens
tcgagccccctggat

SEQ ID NO: 2399359 - DNA, 19 bp, Homo sapiens
tcgaggtcctcctggcctg

SEQ ID NO: 2399360 - DNA, 21 bp, Homo sapiens
tcgcacagggcatgcctggcc

SEQ ID NO: 2399361 - DNA, 13 bp, Homo sapiens
tcgtctgtcccag

SEQ ID NO: 2399362 - DNA, 20 bp, Homo sapiens
tctaaagtcatcatgaactg

SEQ ID NO: 2399363 - DNA, 23 bp, Homo sapiens
tctaagcagttttgtaaatgtac

SEQ ID NO: 2399364 - DNA, 20 bp, Homo sapiens
tctacagaaagaaaaatgca

SEQ ID NO: 2399365 - DNA, 22 bp, Homo sapiens
tctacctggccggtaggctgct

SEQ ID NO: 2399366 - DNA, 21 bp, Homo sapiens
tctagaaataaaatcaccctg

SEQ ID NO: 2399367 - DNA, 22 bp, Homo sapiens
tctagagtttatacagtgtaca

SEQ ID NO: 2399368 - DNA, 18 bp, Homo sapiens
tctatagcagtcatcatt

SEQ ID NO: 2399369 - DNA, 14 bp, Homo sapiens
tctatccctggcca

SEQ ID NO: 2399370 - DNA, 16 bp, Homo sapiens
tctatccctggccacc

SEQ ID NO: 2399371 - DNA, 19 bp, Homo sapiens
tctatgagggtgtttcctc

SEQ ID NO: 2399372 - DNA, 13 bp, Homo sapiens
tctatgatgtttc

SEQ ID NO: 2399373 - DNA, 16 bp, Homo sapiens
tctatttcataccatg

SEQ ID NO: 2399374 - DNA, 17 bp, Homo sapiens
tctcaatggcatgggtg

SEQ ID NO: 2399375 - DNA, 23 bp, Homo sapiens
tctcagccagcccgtgtgtataa

SEQ ID NO: 2399376 - DNA, 13 bp, Homo sapiens
tctcctagccctc

SEQ ID NO: 2399377 - DNA, 15 bp, Homo sapiens
tctcgagccccctgg

SEQ ID NO: 2399378 - DNA, 18 bp, Homo sapiens
tctctcgttaattttcct

SEQ ID NO: 2399379 - DNA, 23 bp, Homo sapiens
tctctttttccccgattttccag

SEQ ID NO: 2399380 - DNA, 14 bp, Homo sapiens
tctgaataaatacc

SEQ ID NO: 2399381 - DNA, 22 bp, Homo sapiens
tctgagcatatgttccatgcct

SEQ ID NO: 2399382 - DNA, 15 bp, Homo sapiens
tctgaggtaaaggtc

SEQ ID NO: 2399383 - DNA, 21 bp, Homo sapiens
tctgcactccatggccacccc

SEQ ID NO: 2399384 - DNA, 14 bp, Homo sapiens
tctgctcccagccc

SEQ ID NO: 2399385 - DNA, 13 bp, Homo sapiens
tctgctccttcct

SEQ ID NO: 2399386 - DNA, 21 bp, Homo sapiens
tctggagcaacctactgtcta

SEQ ID NO: 2399387 - DNA, 13 bp, Homo sapiens
tctggccaccctg

SEQ ID NO: 2399388 - DNA, 17 bp, Homo sapiens
tctggccaccctggccc

SEQ ID NO: 2399389 - DNA, 22 bp, Homo sapiens
tctggcccaagctgggctccct

SEQ ID NO: 2399390 - DNA, 15 bp, Homo sapiens
tctgtggccttggcc

SEQ ID NO: 2399391 - DNA, 16 bp, Homo sapiens
tcttcaagatcccatt

SEQ ID NO: 2399392 - DNA, 22 bp, Homo sapiens
tcttcaccctgtaatggttggg

SEQ ID NO: 2399393 - DNA, 14 bp, Homo sapiens
tcttctagtttaga

SEQ ID NO: 2399394 - DNA, 19 bp, Homo sapiens
tcttctctgggcccagaga

SEQ ID NO: 2399395 - DNA, 22 bp, Homo sapiens
tcttctgaaatgaaacaaataa

SEQ ID NO: 2399396 - DNA, 13 bp, Homo sapiens
tcttgtggacccc

SEQ ID NO: 2399397 - DNA, 15 bp, Homo sapiens
tctttaaaaacattt

SEQ ID NO: 2399398 - DNA, 15 bp, Homo sapiens
tctttggtaggtaaa

SEQ ID NO: 2399399 - DNA, 18 bp, Homo sapiens
tctttggtaggtaaatct

SEQ ID NO: 2399400 - DNA, 13 bp, Homo sapiens
tcttttaaagact

SEQ ID NO: 2399401 - DNA, 19 bp, Homo sapiens
tgaaacaaataatcacatt

SEQ ID NO: 2399402 - DNA, 22 bp, Homo sapiens
tgaaacaaataatcacattgac

SEQ ID NO: 2399403 - DNA, 20 bp, Homo sapiens
tgaaagaaataaacaggagt

SEQ ID NO: 2399404 - DNA, 15 bp, Homo sapiens
tgaaccctgccccac

SEQ ID NO: 2399405 - DNA, 16 bp, Homo sapiens
tgaactggcttgtaca

SEQ ID NO: 2399406 - DNA, 16 bp, Homo sapiens
tgaagttaaaggtatt

SEQ ID NO: 2399407 - DNA, 17 bp, Homo sapiens
tgaatccattgaaagtg

SEQ ID NO: 2399408 - DNA, 15 bp, Homo sapiens
tgaatgggggaggcc

SEQ ID NO: 2399409 - DNA, 15 bp, Homo sapiens
tgaattggcttcctt

SEQ ID NO: 2399410 - DNA, 17 bp, Homo sapiens
tgaattggcttccttga

SEQ ID NO: 2399411 - DNA, 17 bp, Homo sapiens
tgacattccttgtcacc

SEQ ID NO: 2399412 - DNA, 13 bp, Homo sapiens
tgacctcagctgc

SEQ ID NO: 2399413 - DNA, 14 bp, Homo sapiens
tgacctcagctgca

SEQ ID NO: 2399414 - DNA, 16 bp, Homo sapiens
tgacctcagctgcaca

SEQ ID NO: 2399415 - DNA, 14 bp, Homo sapiens
tgacctgctcctgc

SEQ ID NO: 2399416 - DNA, 15 bp, Homo sapiens
tgacctgctcctgcc

SEQ ID NO: 2399417 - DNA, 14 bp, Homo sapiens
tgacctttccagcc

SEQ ID NO: 2399418 - DNA, 13 bp, Homo sapiens
tgacgaactggct

SEQ ID NO: 2399419 - DNA, 14 bp, Homo sapiens
tgagaccagcctgc

SEQ ID NO: 2399420 - DNA, 16 bp, Homo sapiens
tgagaccagcctgcca

SEQ ID NO: 2399421 - DNA, 17 bp, Homo sapiens
tgagaccagcctgccag

SEQ ID NO: 2399422 - DNA, 18 bp, Homo sapiens
tgagaccagcctgccagg

SEQ ID NO: 2399423 - DNA, 22 bp, Homo sapiens
tgagaccagcctgccaggccct

SEQ ID NO: 2399424 - DNA, 23 bp, Homo sapiens
tgagaccagcctgccaggccctc

SEQ ID NO: 2399425 - DNA, 22 bp, Homo sapiens
tgagaccctcttctctgggccc

SEQ ID NO: 2399426 - DNA, 23 bp, Homo sapiens
tgagacctgaaggacctccccct

SEQ ID NO: 2399427 - DNA, 21 bp, Homo sapiens
tgagagggggatgcccctggc

SEQ ID NO: 2399428 - DNA, 16 bp, Homo sapiens
tgagcagtgttagctt

SEQ ID NO: 2399429 - DNA, 18 bp, Homo sapiens
tgagccctccctcttccc

SEQ ID NO: 2399430 - DNA, 23 bp, Homo sapiens
tgagccctccctcttcccagcac

SEQ ID NO: 2399431 - DNA, 22 bp, Homo sapiens
tgaggcaggaggatcccctgag

SEQ ID NO: 2399432 - DNA, 17 bp, Homo sapiens
tgaggctgaggcaggag

SEQ ID NO: 2399433 - DNA, 14 bp, Homo sapiens
tgagggtgtttcct

SEQ ID NO: 2399434 - DNA, 18 bp, Homo sapiens
tgagtggcggggcccctg

SEQ ID NO: 2399435 - DNA, 19 bp, Homo sapiens
tgagtggggcttcctgggc

SEQ ID NO: 2399436 - DNA, 15 bp, Homo sapiens
tgagttagctttctt

SEQ ID NO: 2399437 - DNA, 18 bp, Homo sapiens
tgataataaagtgactga

SEQ ID NO: 2399438 - DNA, 22 bp, Homo sapiens
tgatagaactgtactgttttct

SEQ ID NO: 2399439 - DNA, 19 bp, Homo sapiens
tgatctggcccaagctggg

SEQ ID NO: 2399440 - DNA, 16 bp, Homo sapiens
tgatcttacagaaaat

SEQ ID NO: 2399441 - DNA, 18 bp, Homo sapiens
tgatgataatacccacat

SEQ ID NO: 2399442 - DNA, 13 bp, Homo sapiens
tgatgatccatta

SEQ ID NO: 2399443 - DNA, 16 bp, Homo sapiens
tgattaacaatgtatt

SEQ ID NO: 2399444 - DNA, 19 bp, Homo sapiens
tgattaacaatgtatttta

SEQ ID NO: 2399445 - DNA, 22 bp, Homo sapiens
tgattaacaatgtattttaata

SEQ ID NO: 2399446 - DNA, 23 bp, Homo sapiens
tgattaacaatgtattttaataa

SEQ ID NO: 2399447 - DNA, 20 bp, Homo sapiens
tgattcatgtgcttgtgcct

SEQ ID NO: 2399448 - DNA, 21 bp, Homo sapiens
tgattcatgtgcttgtgccta

SEQ ID NO: 2399449 - DNA, 22 bp, Homo sapiens
tgattcgaggtcctcctggcct

SEQ ID NO: 2399450 - DNA, 15 bp, Homo sapiens
tgatttattgaaatt

SEQ ID NO: 2399451 - DNA, 20 bp, Homo sapiens
tgatttcaaggtccgagctc

SEQ ID NO: 2399452 - DNA, 14 bp, Homo sapiens
tgcacagcatctca

SEQ ID NO: 2399453 - DNA, 15 bp, Homo sapiens
tgcacagcatctcag

SEQ ID NO: 2399454 - DNA, 12 bp, Homo sapiens
tgcacaggcagc

SEQ ID NO: 2399455 - DNA, 13 bp, Homo sapiens
tgcacaggcagca

SEQ ID NO: 2399456 - DNA, 17 bp, Homo sapiens
tgcacagtccctcctgt

SEQ ID NO: 2399457 - DNA, 11 bp, Homo sapiens
tgcacattcct

SEQ ID NO: 2399458 - DNA, 15 bp, Homo sapiens
tgcacattcctggcc

SEQ ID NO: 2399459 - DNA, 17 bp, Homo sapiens
tgcacattcctggcccc

SEQ ID NO: 2399460 - DNA, 14 bp, Homo sapiens
tgcactccatggcc

SEQ ID NO: 2399461 - DNA, 20 bp, Homo sapiens
tgcactccatggccaccccg

SEQ ID NO: 2399462 - DNA, 20 bp, Homo sapiens
tgcagctgacttttctgacc

SEQ ID NO: 2399463 - DNA, 20 bp, Homo sapiens
tgcaggcaggtgggggctgc

SEQ ID NO: 2399464 - DNA, 20 bp, Homo sapiens
tgcatacattcttcaagatc

SEQ ID NO: 2399465 - DNA, 13 bp, Homo sapiens
tgcatatgcttct

SEQ ID NO: 2399466 - DNA, 14 bp, Homo sapiens
tgcatatgcttctg

SEQ ID NO: 2399467 - DNA, 23 bp, Homo sapiens
tgcatctccacttggcattagct

SEQ ID NO: 2399468 - DNA, 20 bp, Homo sapiens
accctgccccactcctgtca

SEQ ID NO: 2399469 - DNA, 15 bp, Homo sapiens
accctgccctgctga

SEQ ID NO: 2399470 - DNA, 23 bp, Homo sapiens
accctgcctgagcccaggagctg

SEQ ID NO: 2399471 - DNA, 18 bp, Homo sapiens
accctggcccgcccctcg

SEQ ID NO: 2399472 - DNA, 21 bp, Homo sapiens
accctggcccgcccctcgctg

SEQ ID NO: 2399473 - DNA, 22 bp, Homo sapiens
accctggcccgcccctcgctgc

SEQ ID NO: 2399474 - DNA, 17 bp, Homo sapiens
accggtcccagcctggg

SEQ ID NO: 2399475 - DNA, 17 bp, Homo sapiens
accgtgaggccaagatc

SEQ ID NO: 2399476 - DNA, 17 bp, Homo sapiens
acctcaatgccctgcca

SEQ ID NO: 2399477 - DNA, 14 bp, Homo sapiens
acctccccctgtgt

SEQ ID NO: 2399478 - DNA, 12 bp, Homo sapiens
acctcctccact

SEQ ID NO: 2399479 - DNA, 18 bp, Homo sapiens
acctcctccactcactcc

SEQ ID NO: 2399480 - DNA, 15 bp, Homo sapiens
acctgatctggccca

SEQ ID NO: 2399481 - DNA, 21 bp, Homo sapiens
acctgatctggcccaagctgg

SEQ ID NO: 2399482 - DNA, 16 bp, Homo sapiens
acctgctcctgcccac

SEQ ID NO: 2399483 - DNA, 16 bp, Homo sapiens
acctgtaattagttta

SEQ ID NO: 2399484 - DNA, 16 bp, Homo sapiens
accttcccccagcttt

SEQ ID NO: 2399485 - DNA, 13 bp, Homo sapiens
accttctatcctc

SEQ ID NO: 2399486 - DNA, 18 bp, Homo sapiens
accttgagaccctcttct

SEQ ID NO: 2399487 - DNA, 23 bp, Homo sapiens
accttgagaccctcttctctggg

SEQ ID NO: 2399488 - DNA, 17 bp, Homo sapiens
acgaactggctacagta

SEQ ID NO: 2399489 - DNA, 12 bp, Homo sapiens
acgccagctggc

SEQ ID NO: 2399490 - DNA, 12 bp, Homo sapiens
acggccaccctc

SEQ ID NO: 2399491 - DNA, 20 bp, Homo sapiens
acggccaccctccttcccgc

SEQ ID NO: 2399492 - DNA, 21 bp, Homo sapiens
acgtacccaaggtcacatagc

SEQ ID NO: 2399493 - DNA, 20 bp, Homo sapiens
acgtcaccaaggtggcttct

SEQ ID NO: 2399494 - DNA, 17 bp, Homo sapiens
acgtgcagcacctgtca

SEQ ID NO: 2399495 - DNA, 16 bp, Homo sapiens
acgtggcgctgtcggt

SEQ ID NO: 2399496 - DNA, 13 bp, Homo sapiens
actatggctgttg

SEQ ID NO: 2399497 - DNA, 16 bp, Homo sapiens
actcactccagcccaa

SEQ ID NO: 2399498 - DNA, 11 bp, Homo sapiens
actcagcatgg

SEQ ID NO: 2399499 - DNA, 11 bp, Homo sapiens
actccagcctg

SEQ ID NO: 2399500 - DNA, 14 bp, Homo sapiens
actccagcctgggt

SEQ ID NO: 2399501 - DNA, 18 bp, Homo sapiens
actccaggatcctcctgg

SEQ ID NO: 2399502 - DNA, 14 bp, Homo sapiens
actccatggccacc

SEQ ID NO: 2399503 - DNA, 15 bp, Homo sapiens
actccatggccaccc

SEQ ID NO: 2399504 - DNA, 16 bp, Homo sapiens
actccatggccacccc

SEQ ID NO: 2399505 - DNA, 22 bp, Homo sapiens
actccatggccaccccgtgcca

SEQ ID NO: 2399506 - DNA, 13 bp, Homo sapiens
actcctcccttcc

SEQ ID NO: 2399507 - DNA, 11 bp, Homo sapiens
actctgcactc

SEQ ID NO: 2399508 - DNA, 19 bp, Homo sapiens
actctgcactccatggcca

SEQ ID NO: 2399509 - DNA, 20 bp, Homo sapiens
actctgcactccatggccac

SEQ ID NO: 2399510 - DNA, 22 bp, Homo sapiens
actctgcactccatggccaccc

SEQ ID NO: 2399511 - DNA, 18 bp, Homo sapiens
actgagccgtgcagctgg

SEQ ID NO: 2399512 - DNA, 16 bp, Homo sapiens
actgcactccagcctg

SEQ ID NO: 2399513 - DNA, 13 bp, Homo sapiens
actggcttgtaca

SEQ ID NO: 2399514 - DNA, 15 bp, Homo sapiens
actgggtctcactcc

SEQ ID NO: 2399515 - DNA, 20 bp, Homo sapiens
actggtaattgtacaatact

SEQ ID NO: 2399516 - DNA, 13 bp, Homo sapiens
actgtaaattttt

SEQ ID NO: 2399517 - DNA, 13 bp, Homo sapiens
actgtatcttcct

SEQ ID NO: 2399518 - DNA, 17 bp, Homo sapiens
actgtgacctgctcctg

SEQ ID NO: 2399519 - DNA, 21 bp, Homo sapiens
actgtgacctgctcctgccca

SEQ ID NO: 2399520 - DNA, 22 bp, Homo sapiens
actgttggctaagaagaaatgc

SEQ ID NO: 2399521 - DNA, 18 bp, Homo sapiens
actgtttatatcttcacc

SEQ ID NO: 2399522 - DNA, 16 bp, Homo sapiens
acttactataatggtt

SEQ ID NO: 2399523 - DNA, 18 bp, Homo sapiens
acttactataatggttgg

SEQ ID NO: 2399524 - DNA, 17 bp, Homo sapiens
acttagatctgagccct

SEQ ID NO: 2399525 - DNA, 20 bp, Homo sapiens
acttgcattccagagttaaa

SEQ ID NO: 2399526 - DNA, 13 bp, Homo sapiens
agaaaaataaaga

SEQ ID NO: 2399527 - DNA, 16 bp, Homo sapiens
agaaagtgagcagtgt

SEQ ID NO: 2399528 - DNA, 22 bp, Homo sapiens
agaagtggcataggagtgtgtt

SEQ ID NO: 2399529 - DNA, 19 bp, Homo sapiens
agaagttcatgggcacctc

SEQ ID NO: 2399530 - DNA, 16 bp, Homo sapiens
agaccagcctgccagg

SEQ ID NO: 2399531 - DNA, 18 bp, Homo sapiens
agaccagcctgccaggcc

SEQ ID NO: 2399532 - DNA, 17 bp, Homo sapiens
agaccatcctggcccct

SEQ ID NO: 2399533 - DNA, 21 bp, Homo sapiens
agaccatcctggcccctccag

SEQ ID NO: 2399534 - DNA, 16 bp, Homo sapiens
agaccctcccccacca

SEQ ID NO: 2399535 - DNA, 13 bp, Homo sapiens
agaccctcttctc

SEQ ID NO: 2399536 - DNA, 14 bp, Homo sapiens
agaccctcttctct

SEQ ID NO: 2399537 - DNA, 15 bp, Homo sapiens
agaccctcttctctg

SEQ ID NO: 2399538 - DNA, 11 bp, Homo sapiens
agaccctgcct

SEQ ID NO: 2399539 - DNA, 13 bp, Homo sapiens
agaccctgcctga

SEQ ID NO: 2399540 - DNA, 13 bp, Homo sapiens
agacttagatctg

SEQ ID NO: 2399541 - DNA, 18 bp, Homo sapiens
agacttagatctgagccc

SEQ ID NO: 2399542 - DNA, 22 bp, Homo sapiens
agagaaaccatcctctcccttc

SEQ ID NO: 2399543 - DNA, 13 bp, Homo sapiens
agagaatctgcct

SEQ ID NO: 2399544 - DNA, 17 bp, Homo sapiens
agagacatccttcattt

SEQ ID NO: 2399545 - DNA, 11 bp, Homo sapiens
agaggctctga

SEQ ID NO: 2399546 - DNA, 20 bp, Homo sapiens
agagggggatgcccctggcc

SEQ ID NO: 2399547 - DNA, 12 bp, Homo sapiens
agagtgccctgg

SEQ ID NO: 2399548 - DNA, 13 bp, Homo sapiens
agagtgccctggg

SEQ ID NO: 2399549 - DNA, 15 bp, Homo sapiens
agagtgccctggggc

SEQ ID NO: 2399550 - DNA, 23 bp, Homo sapiens
agagtgccctggggcatccacct

SEQ ID NO: 2399551 - DNA, 22 bp, Homo sapiens
agagttaaaatgtttactgtaa

SEQ ID NO: 2399552 - DNA, 15 bp, Homo sapiens
agatatatttctcca

SEQ ID NO: 2399553 - DNA, 12 bp, Homo sapiens
agatctgagccc

SEQ ID NO: 2399554 - DNA, 15 bp, Homo sapiens
agatcttctgaaatg

SEQ ID NO: 2399555 - DNA, 19 bp, Homo sapiens
agatgggagagcaacaagt

SEQ ID NO: 2399556 - DNA, 20 bp, Homo sapiens
agatgggagagcaacaagta

SEQ ID NO: 2399557 - DNA, 15 bp, Homo sapiens
agatggggcctgggc

SEQ ID NO: 2399558 - DNA, 16 bp, Homo sapiens
agatggggcctgggct

SEQ ID NO: 2399559 - DNA, 17 bp, Homo sapiens
agatggggcctgggctg

SEQ ID NO: 2399560 - DNA, 18 bp, Homo sapiens
agatggggcctgggctgt

SEQ ID NO: 2399561 - DNA, 23 bp, Homo sapiens
agcaacaagtagagatgaagtta

SEQ ID NO: 2399562 - DNA, 19 bp, Homo sapiens
agcaacctactgtctaagc

SEQ ID NO: 2399563 - DNA, 18 bp, Homo sapiens
agcaaggtcatggtctga

SEQ ID NO: 2399564 - DNA, 20 bp, Homo sapiens
agcactcgagaccatcctgg

SEQ ID NO: 2399565 - DNA, 15 bp, Homo sapiens
agcactttgggaagc

SEQ ID NO: 2399566 - DNA, 23 bp, Homo sapiens
agcagacgcagcagctgggaccc

SEQ ID NO: 2399567 - DNA, 16 bp, Homo sapiens
agcagcagctgaggcc

SEQ ID NO: 2399568 - DNA, 21 bp, Homo sapiens
agcagctgggacccctcccaa

SEQ ID NO: 2399569 - DNA, 17 bp, Homo sapiens
agcagttttgtaaatgt

SEQ ID NO: 2399570 - DNA, 18 bp, Homo sapiens
agcagttttgtaaatgta

SEQ ID NO: 2399571 - DNA, 18 bp, Homo sapiens
agcattttctgcatctcc

SEQ ID NO: 2399572 - DNA, 20 bp, Homo sapiens
agccaagattgcgccactgc

SEQ ID NO: 2399573 - DNA, 23 bp, Homo sapiens
agccacccctcctctagctctgg

SEQ ID NO: 2399574 - DNA, 20 bp, Homo sapiens
agccatgcccacgcccctcc

SEQ ID NO: 2399575 - DNA, 15 bp, Homo sapiens
agccattctgtccca

SEQ ID NO: 2399576 - DNA, 16 bp, Homo sapiens
agccattctgtcccag

SEQ ID NO: 2399577 - DNA, 16 bp, Homo sapiens
agcccaccctctgtga

SEQ ID NO: 2399578 - DNA, 19 bp, Homo sapiens
agcccaccctctgtgagcc

SEQ ID NO: 2399579 - DNA, 16 bp, Homo sapiens
agcccagctacattcc

SEQ ID NO: 2399580 - DNA, 18 bp, Homo sapiens
agcccagctacattcctc

SEQ ID NO: 2399581 - DNA, 19 bp, Homo sapiens
agcccagctacattcctca

SEQ ID NO: 2399582 - DNA, 20 bp, Homo sapiens
agcccagctacattcctcag

SEQ ID NO: 2399583 - DNA, 23 bp, Homo sapiens
agcccagctacattcctcagctg

SEQ ID NO: 2399584 - DNA, 12 bp, Homo sapiens
agcccaggagct

SEQ ID NO: 2399585 - DNA, 20 bp, Homo sapiens
cactacatgggccagccctt

SEQ ID NO: 2399586 - DNA, 13 bp, Homo sapiens
cactccagcctgg

SEQ ID NO: 2399587 - DNA, 15 bp, Homo sapiens
cactccatggccacc

SEQ ID NO: 2399588 - DNA, 16 bp, Homo sapiens
cactccatggccaccc

SEQ ID NO: 2399589 - DNA, 17 bp, Homo sapiens
cactcgagaccatcctg

SEQ ID NO: 2399590 - DNA, 22 bp, Homo sapiens
cactctgctcccagcccctacc

SEQ ID NO: 2399591 - DNA, 22 bp, Homo sapiens
cactgagtgaggagtggacgct

SEQ ID NO: 2399592 - DNA, 23 bp, Homo sapiens
cactgagtgaggagtggacgctg

SEQ ID NO: 2399593 - DNA, 21 bp, Homo sapiens
cactgcactccagcctgggtg

SEQ ID NO: 2399594 - DNA, 11 bp, Homo sapiens
cactgcatgtt

SEQ ID NO: 2399595 - DNA, 20 bp, Homo sapiens
cactggggatcccgtgctgg

SEQ ID NO: 2399596 - DNA, 20 bp, Homo sapiens
cactgggtctcactcctgag

SEQ ID NO: 2399597 - DNA, 14 bp, Homo sapiens
cactgtgacctgct

SEQ ID NO: 2399598 - DNA, 18 bp, Homo sapiens
cactgtgacctgctcctg

SEQ ID NO: 2399599 - DNA, 21 bp, Homo sapiens
cactgtgacctgctcctgccc

SEQ ID NO: 2399600 - DNA, 22 bp, Homo sapiens
cactgtgacctgctcctgccca

SEQ ID NO: 2399601 - DNA, 23 bp, Homo sapiens
cactgtgacctgctcctgcccac

SEQ ID NO: 2399602 - DNA, 15 bp, Homo sapiens
cactttcactgggga

SEQ ID NO: 2399603 - DNA, 13 bp, Homo sapiens
cagaacagcatgg

SEQ ID NO: 2399604 - DNA, 17 bp, Homo sapiens
cagaaccggtcccagcc

SEQ ID NO: 2399605 - DNA, 20 bp, Homo sapiens
cagaaccggtcccagcctgg

SEQ ID NO: 2399606 - DNA, 21 bp, Homo sapiens
cagaaccggtcccagcctggg

SEQ ID NO: 2399607 - DNA, 22 bp, Homo sapiens
cagaaccggtcccagcctgggc

SEQ ID NO: 2399608 - DNA, 13 bp, Homo sapiens
cagaatcccctgg

SEQ ID NO: 2399609 - DNA, 17 bp, Homo sapiens
cagaatcccctggggag

SEQ ID NO: 2399610 - DNA, 13 bp, Homo sapiens
cagaccctgcctg

SEQ ID NO: 2399611 - DNA, 17 bp, Homo sapiens
cagaccctgcctgagcc

SEQ ID NO: 2399612 - DNA, 13 bp, Homo sapiens
cagagcaccctct

SEQ ID NO: 2399613 - DNA, 17 bp, Homo sapiens
cagagctaggctgtgga

SEQ ID NO: 2399614 - DNA, 20 bp, Homo sapiens
cagagcttattggccactgg

SEQ ID NO: 2399615 - DNA, 20 bp, Homo sapiens
cagaggcccattagttgaga

SEQ ID NO: 2399616 - DNA, 14 bp, Homo sapiens
cagagtgccctggg

SEQ ID NO: 2399617 - DNA, 12 bp, Homo sapiens
cagagttaaaat

SEQ ID NO: 2399618 - DNA, 12 bp, Homo sapiens
cagataaggctt

SEQ ID NO: 2399619 - DNA, 14 bp, Homo sapiens
cagatggggcctgg

SEQ ID NO: 2399620 - DNA, 16 bp, Homo sapiens
cagatggggcctgggc

SEQ ID NO: 2399621 - DNA, 14 bp, Homo sapiens
cagcaaggtcatgg

SEQ ID NO: 2399622 - DNA, 20 bp, Homo sapiens
cagcagctgaggccccaggg

SEQ ID NO: 2399623 - DNA, 22 bp, Homo sapiens
cagcagctgggacccctcccaa

SEQ ID NO: 2399624 - DNA, 16 bp, Homo sapiens
cagccacccctcctct

SEQ ID NO: 2399625 - DNA, 17 bp, Homo sapiens
cagccatgcccacgccc

SEQ ID NO: 2399626 - DNA, 20 bp, Homo sapiens
cagcccatcccctgcctcta

SEQ ID NO: 2399627 - DNA, 23 bp, Homo sapiens
cagcccctaccttgagaccctct

SEQ ID NO: 2399628 - DNA, 20 bp, Homo sapiens
cagcccctcaaccctccgtt

SEQ ID NO: 2399629 - DNA, 23 bp, Homo sapiens
cagcccctcatcagccttttcag

SEQ ID NO: 2399630 - DNA, 17 bp, Homo sapiens
cagcccttgctctacct

SEQ ID NO: 2399631 - DNA, 21 bp, Homo sapiens
cagcccttgctctacctggcc

SEQ ID NO: 2399632 - DNA, 17 bp, Homo sapiens
cagcctatatttcctct

SEQ ID NO: 2399633 - DNA, 19 bp, Homo sapiens
cagcctcagtgccacttga

SEQ ID NO: 2399634 - DNA, 15 bp, Homo sapiens
cagcctccctttgcc

SEQ ID NO: 2399635 - DNA, 15 bp, Homo sapiens
cagcctctctgctat

SEQ ID NO: 2399636 - DNA, 13 bp, Homo sapiens
cagcctgccaggc

SEQ ID NO: 2399637 - DNA, 14 bp, Homo sapiens
cagcctgggctcct

SEQ ID NO: 2399638 - DNA, 15 bp, Homo sapiens
cagccttttcagcag

SEQ ID NO: 2399639 - DNA, 20 bp, Homo sapiens
cagcgcctccaccctgccct

SEQ ID NO: 2399640 - DNA, 14 bp, Homo sapiens
cagcggagctagca

SEQ ID NO: 2399641 - DNA, 13 bp, Homo sapiens
cagcgtctcccca

SEQ ID NO: 2399642 - DNA, 15 bp, Homo sapiens
cagctacattcctca

SEQ ID NO: 2399643 - DNA, 16 bp, Homo sapiens
cagctacattcctcag

SEQ ID NO: 2399644 - DNA, 15 bp, Homo sapiens
cagctgaggccccag

SEQ ID NO: 2399645 - DNA, 14 bp, Homo sapiens
cagctgcacattcc

SEQ ID NO: 2399646 - DNA, 16 bp, Homo sapiens
cagctgcacattcctg

SEQ ID NO: 2399647 - DNA, 21 bp, Homo sapiens
cagctgcacattcctggcccc

SEQ ID NO: 2399648 - DNA, 13 bp, Homo sapiens
cagctgccaagca

SEQ ID NO: 2399649 - DNA, 15 bp, Homo sapiens
cagctgggacccctc

SEQ ID NO: 2399650 - DNA, 23 bp, Homo sapiens
cagctgggacccctcccaacctc

SEQ ID NO: 2399651 - DNA, 14 bp, Homo sapiens
caggagctgagtca

SEQ ID NO: 2399652 - DNA, 16 bp, Homo sapiens
caggaggacagagtgc

SEQ ID NO: 2399653 - DNA, 19 bp, Homo sapiens
caggaggacagagtgccct

SEQ ID NO: 2399654 - DNA, 19 bp, Homo sapiens
caggaggatcccctgaggt

SEQ ID NO: 2399655 - DNA, 16 bp, Homo sapiens
caggagttcagcggag

SEQ ID NO: 2399656 - DNA, 19 bp, Homo sapiens
caggagttcgagagcagcc

SEQ ID NO: 2399657 - DNA, 21 bp, Homo sapiens
caggagttcgagagcagcctg

SEQ ID NO: 2399658 - DNA, 17 bp, Homo sapiens
caggatggttactgagg

SEQ ID NO: 2399659 - DNA, 19 bp, Homo sapiens
caggcagaaccggtcccag

SEQ ID NO: 2399660 - DNA, 16 bp, Homo sapiens
caggcaggtgggggct

SEQ ID NO: 2399661 - DNA, 16 bp, Homo sapiens
caggccaatcccttct

SEQ ID NO: 2399662 - DNA, 17 bp, Homo sapiens
caggccctagaccctcc

SEQ ID NO: 2399663 - DNA, 21 bp, Homo sapiens
caggccctagaccctccccca

SEQ ID NO: 2399664 - DNA, 12 bp, Homo sapiens
caggccctccag

SEQ ID NO: 2399665 - DNA, 16 bp, Homo sapiens
caggccctccagcagg

SEQ ID NO: 2399666 - DNA, 13 bp, Homo sapiens
caggcctccctcg

SEQ ID NO: 2399667 - DNA, 15 bp, Homo sapiens
caggcctccctcggg

SEQ ID NO: 2399668 - DNA, 22 bp, Homo sapiens
caggccttctgatttcaaggtc

SEQ ID NO: 2399669 - DNA, 14 bp, Homo sapiens
cagggcatgcctgg

SEQ ID NO: 2399670 - DNA, 15 bp, Homo sapiens
cagggcatgcctggc

SEQ ID NO: 2399671 - DNA, 18 bp, Homo sapiens
cagggcatgcctggcctg

SEQ ID NO: 2399672 - DNA, 18 bp, Homo sapiens
cagggctcagatggggcc

SEQ ID NO: 2399673 - DNA, 17 bp, Homo sapiens
cagggctgtgggtgggg

SEQ ID NO: 2399674 - DNA, 18 bp, Homo sapiens
caggtgggggctgcgtcc

SEQ ID NO: 2399675 - DNA, 15 bp, Homo sapiens
cagtagttcacttta

SEQ ID NO: 2399676 - DNA, 12 bp, Homo sapiens
cagtccctcctg

SEQ ID NO: 2399677 - DNA, 13 bp, Homo sapiens
cagtccctcctgt

SEQ ID NO: 2399678 - DNA, 23 bp, Homo sapiens
cagtgggtagtgaattggcttcc

SEQ ID NO: 2399679 - DNA, 15 bp, Homo sapiens
cagtgtacatgtaca

SEQ ID NO: 2399680 - DNA, 19 bp, Homo sapiens
cagttggggcggcccacgc

SEQ ID NO: 2399681 - DNA, 14 bp, Homo sapiens
cagttttgtaaatg

SEQ ID NO: 2399682 - DNA, 16 bp, Homo sapiens
cagttttgtaaatgta

SEQ ID NO: 2399683 - DNA, 18 bp, Homo sapiens
cagttttgtaaatgtact

SEQ ID NO: 2399684 - DNA, 21 bp, Homo sapiens
catacattcttcaagatccca

SEQ ID NO: 2399685 - DNA, 18 bp, Homo sapiens
cataccatggaggaaggc

SEQ ID NO: 2399686 - DNA, 19 bp, Homo sapiens
catactttgttaggaaggg

SEQ ID NO: 2399687 - DNA, 13 bp, Homo sapiens
catagatcttctg

SEQ ID NO: 2399688 - DNA, 17 bp, Homo sapiens
catagtaaagtattttt

SEQ ID NO: 2399689 - DNA, 19 bp, Homo sapiens
catatgttccatgcctggc

SEQ ID NO: 2399690 - DNA, 11 bp, Homo sapiens
catcagccttt

SEQ ID NO: 2399691 - DNA, 16 bp, Homo sapiens
catcatgaactggctt

SEQ ID NO: 2399692 - DNA, 22 bp, Homo sapiens
catcatgaactggcttgtacat

SEQ ID NO: 2399693 - DNA, 15 bp, Homo sapiens
catccaccttcctgc

SEQ ID NO: 2399694 - DNA, 15 bp, Homo sapiens
catccccaccttcca

SEQ ID NO: 2399695 - DNA, 13 bp, Homo sapiens
catcccctgcctc

SEQ ID NO: 2399696 - DNA, 12 bp, Homo sapiens
catcctggcccc

SEQ ID NO: 2399697 - DNA, 18 bp, Homo sapiens
catctcgagccccctgga

SEQ ID NO: 2399698 - DNA, 17 bp, Homo sapiens
catctgctccttcctgt

SEQ ID NO: 2399699 - DNA, 20 bp, Homo sapiens
catcttccctacccttcctg

SEQ ID NO: 2399700 - DNA, 15 bp, Homo sapiens
catcttgctctgtgg

SEQ ID NO: 2399701 - DNA, 18 bp, Homo sapiens
catcttgctctgtggcct

SEQ ID NO: 2399702 - DNA, 17 bp, Homo sapiens
cgagctctgtcctctgt

SEQ ID NO: 2399703 - DNA, 17 bp, Homo sapiens
cgagggaggaacacctg

SEQ ID NO: 2399704 - DNA, 14 bp, Homo sapiens
cgaggtcctcctgg

SEQ ID NO: 2399705 - DNA, 15 bp, Homo sapiens
cgatggggcccacat

SEQ ID NO: 2399706 - DNA, 16 bp, Homo sapiens
cgcacagggcatgcct

SEQ ID NO: 2399707 - DNA, 20 bp, Homo sapiens
cgcagcagctgggacccctc

SEQ ID NO: 2399708 - DNA, 15 bp, Homo sapiens
cgccacggccaccct

SEQ ID NO: 2399709 - DNA, 16 bp, Homo sapiens
cgccacggccaccctc

SEQ ID NO: 2399710 - DNA, 18 bp, Homo sapiens
cgccacggccaccctcct

SEQ ID NO: 2399711 - DNA, 19 bp, Homo sapiens
cgccactgcactccagcct

SEQ ID NO: 2399712 - DNA, 22 bp, Homo sapiens
cgccactgcactccagcctggg

SEQ ID NO: 2399713 - DNA, 13 bp, Homo sapiens
cgccagctggccc

SEQ ID NO: 2399714 - DNA, 20 bp, Homo sapiens
cgccagctggcccagtgggt

SEQ ID NO: 2399715 - DNA, 17 bp, Homo sapiens
cgcccattcgtctgtcc

SEQ ID NO: 2399716 - DNA, 22 bp, Homo sapiens
cgcccattcgtctgtcccagag

SEQ ID NO: 2399717 - DNA, 23 bp, Homo sapiens
cgcccattcgtctgtcccagagc

SEQ ID NO: 2399718 - DNA, 18 bp, Homo sapiens
cgccccaccccgtcctga

SEQ ID NO: 2399719 - DNA, 13 bp, Homo sapiens
cgcccctccccag

SEQ ID NO: 2399720 - DNA, 14 bp, Homo sapiens
cgcccctccccagc

SEQ ID NO: 2399721 - DNA, 20 bp, Homo sapiens
cgcccctcgctgctgctact

SEQ ID NO: 2399722 - DNA, 18 bp, Homo sapiens
cgcctccaccctgccctg

SEQ ID NO: 2399723 - DNA, 22 bp, Homo sapiens
cgctgagtggcggggcccctgc

SEQ ID NO: 2399724 - DNA, 12 bp, Homo sapiens
cggcactgcatg

SEQ ID NO: 2399725 - DNA, 14 bp, Homo sapiens
cggcccacgccagc

SEQ ID NO: 2399726 - DNA, 15 bp, Homo sapiens
cggcccacgccagct

SEQ ID NO: 2399727 - DNA, 21 bp, Homo sapiens
cggctgcttggcagttgcagt

SEQ ID NO: 2399728 - DNA, 21 bp, Homo sapiens
cgggcatggtggcatgtgcct

SEQ ID NO: 2399729 - DNA, 17 bp, Homo sapiens
cgggctctggccaccct

SEQ ID NO: 2399730 - DNA, 17 bp, Homo sapiens
cgggtggggtgcttgct

SEQ ID NO: 2399731 - DNA, 15 bp, Homo sapiens
cggtaggctgctggc

SEQ ID NO: 2399732 - DNA, 13 bp, Homo sapiens
cggtcccagcctg

SEQ ID NO: 2399733 - DNA, 16 bp, Homo sapiens
cggtcccagcctgggc

SEQ ID NO: 2399734 - DNA, 16 bp, Homo sapiens
cggtgtttggaggctg

SEQ ID NO: 2399735 - DNA, 17 bp, Homo sapiens
cggtgtttggaggctgc

SEQ ID NO: 2399736 - DNA, 18 bp, Homo sapiens
cggtgtttggaggctgct

SEQ ID NO: 2399737 - DNA, 14 bp, Homo sapiens
cgtacccaaggtca

SEQ ID NO: 2399738 - DNA, 13 bp, Homo sapiens
cgtcaccaaggtg

SEQ ID NO: 2399739 - DNA, 15 bp, Homo sapiens
cgtccctgctcagcc

SEQ ID NO: 2399740 - DNA, 19 bp, Homo sapiens
cgtctccccatgctgggct

SEQ ID NO: 2399741 - DNA, 17 bp, Homo sapiens
cgtgagagaatctgcct

SEQ ID NO: 2399742 - DNA, 12 bp, Homo sapiens
cgtgcagcacct

SEQ ID NO: 2399743 - DNA, 23 bp, Homo sapiens
cgtgccacccgtaggcagcctct

SEQ ID NO: 2399744 - DNA, 16 bp, Homo sapiens
cgttcctcctcagcct

SEQ ID NO: 2399745 - DNA, 23 bp, Homo sapiens
ctaaaaccttccatgtcaagatt

SEQ ID NO: 2399746 - DNA, 18 bp, Homo sapiens
ctaagcagcccagaagcc

SEQ ID NO: 2399747 - DNA, 17 bp, Homo sapiens
ctaagcagttttgtaaa

SEQ ID NO: 2399748 - DNA, 18 bp, Homo sapiens
ctaagcagttttgtaaat

SEQ ID NO: 2399749 - DNA, 19 bp, Homo sapiens
ctaaggacatttggtttta

SEQ ID NO: 2399750 - DNA, 15 bp, Homo sapiens
ctaataaagtgccgg

SEQ ID NO: 2399751 - DNA, 18 bp, Homo sapiens
ctacatgggccagccctt

SEQ ID NO: 2399752 - DNA, 10 bp, Homo sapiens
ctacattcct

SEQ ID NO: 2399753 - DNA, 15 bp, Homo sapiens
ctacattcctcagct

SEQ ID NO: 2399754 - DNA, 13 bp, Homo sapiens
ctacccgagccca

SEQ ID NO: 2399755 - DNA, 16 bp, Homo sapiens
ctacccgagcccagct

SEQ ID NO: 2399756 - DNA, 19 bp, Homo sapiens
ctacccttcctgccaagcc

SEQ ID NO: 2399757 - DNA, 11 bp, Homo sapiens
ctacctggccg

SEQ ID NO: 2399758 - DNA, 23 bp, Homo sapiens
ctacctggccggtaggctgctgg

SEQ ID NO: 2399759 - DNA, 12 bp, Homo sapiens
ctacctgggacc

SEQ ID NO: 2399760 - DNA, 20 bp, Homo sapiens
ctacgagggaggaacacctg

SEQ ID NO: 2399761 - DNA, 18 bp, Homo sapiens
ctactacccgagcccagc

SEQ ID NO: 2399762 - DNA, 11 bp, Homo sapiens
ctactcagcat

SEQ ID NO: 2399763 - DNA, 19 bp, Homo sapiens
ctactgtctaagcagtttt

SEQ ID NO: 2399764 - DNA, 22 bp, Homo sapiens
ctagaaataaaatcaccctgac

SEQ ID NO: 2399765 - DNA, 17 bp, Homo sapiens
ctagagtttatacagtg

SEQ ID NO: 2399766 - DNA, 23 bp, Homo sapiens
ctagagtttatacagtgtacatg

SEQ ID NO: 2399767 - DNA, 15 bp, Homo sapiens
ctagtcggtcaccaa

SEQ ID NO: 2399768 - DNA, 20 bp, Homo sapiens
ctatattgctgaatgcaaga

SEQ ID NO: 2399769 - DNA, 15 bp, Homo sapiens
ctatgagggtgtttc

SEQ ID NO: 2399770 - DNA, 17 bp, Homo sapiens
ctatgagggtgtttcct

SEQ ID NO: 2399771 - DNA, 20 bp, Homo sapiens
ctatgatgtttcttttgcaa

SEQ ID NO: 2399772 - DNA, 14 bp, Homo sapiens
ctcaatgccctgcc

SEQ ID NO: 2399773 - DNA, 15 bp, Homo sapiens
ctcaatgccctgcca

SEQ ID NO: 2399774 - DNA, 18 bp, Homo sapiens
ctcaatgccctgccatta

SEQ ID NO: 2399775 - DNA, 21 bp, Homo sapiens
ctcaatgtccccctcaccccc

SEQ ID NO: 2399776 - DNA, 13 bp, Homo sapiens
ctcacccccacct

SEQ ID NO: 2399777 - DNA, 16 bp, Homo sapiens
ctcactacatgggcca

SEQ ID NO: 2399778 - DNA, 19 bp, Homo sapiens
ctcactacatgggccagcc

SEQ ID NO: 2399779 - DNA, 20 bp, Homo sapiens
ctcactacatgggccagccc

SEQ ID NO: 2399780 - DNA, 13 bp, Homo sapiens
ctcactccagccc

SEQ ID NO: 2399781 - DNA, 15 bp, Homo sapiens
ctcagaaggcaggag

SEQ ID NO: 2399782 - DNA, 21 bp, Homo sapiens
ctcagatggggcctgggctgt

SEQ ID NO: 2399783 - DNA, 23 bp, Homo sapiens
ctcagccagcccgtgtgtataat

SEQ ID NO: 2399784 - DNA, 15 bp, Homo sapiens
ctcagcccatcccct

SEQ ID NO: 2399785 - DNA, 17 bp, Homo sapiens
ctcagcccatcccctgc

SEQ ID NO: 2399786 - DNA, 20 bp, Homo sapiens
ctcagcccatcccctgcctc

SEQ ID NO: 2399787 - DNA, 17 bp, Homo sapiens
ctcagcctccctttgcc

SEQ ID NO: 2399788 - DNA, 21 bp, Homo sapiens
ctcagcgtctccccatgctgg

SEQ ID NO: 2399789 - DNA, 18 bp, Homo sapiens
ctcagctgcacattcctg

SEQ ID NO: 2399790 - DNA, 14 bp, Homo sapiens
ctcagctgccaagc

SEQ ID NO: 2399791 - DNA, 16 bp, Homo sapiens
ctcagctgccaagcac

SEQ ID NO: 2399792 - DNA, 13 bp, Homo sapiens
ctcagtgccactt

SEQ ID NO: 2399793 - DNA, 20 bp, Homo sapiens
ctcagtgccacttgacattc

SEQ ID NO: 2399794 - DNA, 23 bp, Homo sapiens
ctcagtgccacttgacattcctt

SEQ ID NO: 2399795 - DNA, 20 bp, Homo sapiens
ctcagtgcttatgtcatagc

SEQ ID NO: 2399796 - DNA, 17 bp, Homo sapiens
ctcatcagccttttcag

SEQ ID NO: 2399797 - DNA, 14 bp, Homo sapiens
ctcatggactccag

SEQ ID NO: 2399798 - DNA, 18 bp, Homo sapiens
ctccacccccgccacggc

SEQ ID NO: 2399799 - DNA, 19 bp, Homo sapiens
ctccacccccgccacggcc

SEQ ID NO: 2399800 - DNA, 23 bp, Homo sapiens
ctccacccccgccacggccaccc

SEQ ID NO: 2399801 - DNA, 19 bp, Homo sapiens
ctccactcactccagccca

SEQ ID NO: 2399802 - DNA, 17 bp, Homo sapiens
ctccacttggcattagc

SEQ ID NO: 2399803 - DNA, 15 bp, Homo sapiens
ctccagaccctgcct

SEQ ID NO: 2399804 - DNA, 19 bp, Homo sapiens
ctccagaccctgcctgagc

SEQ ID NO: 2399805 - DNA, 13 bp, Homo sapiens
ctccagcaggagg

SEQ ID NO: 2399806 - DNA, 21 bp, Homo sapiens
ctccaggatcctcctggagca

SEQ ID NO: 2399807 - DNA, 23 bp, Homo sapiens
ctcccaacctcaatgccctgcca

SEQ ID NO: 2399808 - DNA, 24 bp, Homo sapiens
ctcccaacctcaatgccctgccat

SEQ ID NO: 2399809 - DNA, 22 bp, Homo sapiens
ctcccatggtgcccgtgcctct

SEQ ID NO: 2399810 - DNA, 14 bp, Homo sapiens
ctccccagccccca

SEQ ID NO: 2399811 - DNA, 17 bp, Homo sapiens
ctccccatgctgggctc

SEQ ID NO: 2399812 - DNA, 11 bp, Homo sapiens
ctcccccacca

SEQ ID NO: 2399813 - DNA, 18 bp, Homo sapiens
ctcccccaccattccaca

SEQ ID NO: 2399814 - DNA, 14 bp, Homo sapiens
ctccctcttcccag

SEQ ID NO: 2399815 - DNA, 15 bp, Homo sapiens
ctccctcttcccagc

SEQ ID NO: 2399816 - DNA, 16 bp, Homo sapiens
ctccctcttcccagca

SEQ ID NO: 2399817 - DNA, 18 bp, Homo sapiens
ctccctttgccagccacc

SEQ ID NO: 2399818 - DNA, 19 bp, Homo sapiens
ctccctttgccagccaccc

SEQ ID NO: 2399819 - DNA, 14 bp, Homo sapiens
gacctgctcctgcc

SEQ ID NO: 2399820 - DNA, 16 bp, Homo sapiens
gacctgctcctgccca

SEQ ID NO: 2399821 - DNA, 22 bp, Homo sapiens
gacgcagcagctgggacccctc

SEQ ID NO: 2399822 - DNA, 19 bp, Homo sapiens
gacgctgtccattgccacg

SEQ ID NO: 2399823 - DNA, 18 bp, Homo sapiens
gactaagcagcccagaag

SEQ ID NO: 2399824 - DNA, 11 bp, Homo sapiens
gactcctccct

SEQ ID NO: 2399825 - DNA, 18 bp, Homo sapiens
gactcctcccttccccac

SEQ ID NO: 2399826 - DNA, 22 bp, Homo sapiens
gactcctcccttccccactctg

SEQ ID NO: 2399827 - DNA, 14 bp, Homo sapiens
gactgcacaggcag

SEQ ID NO: 2399828 - DNA, 17 bp, Homo sapiens
gacttagatctgagccc

SEQ ID NO: 2399829 - DNA, 16 bp, Homo sapiens
gagaacacactgagtg

SEQ ID NO: 2399830 - DNA, 14 bp, Homo sapiens
gagaacccttcctg

SEQ ID NO: 2399831 - DNA, 15 bp, Homo sapiens
gagaacccttcctgc

SEQ ID NO: 2399832 - DNA, 20 bp, Homo sapiens
gagaatggcgtgaacccggg

SEQ ID NO: 2399833 - DNA, 20 bp, Homo sapiens
gagaccagaacagcatggcc

SEQ ID NO: 2399834 - DNA, 13 bp, Homo sapiens
gagaccagcctgc

SEQ ID NO: 2399835 - DNA, 16 bp, Homo sapiens
gagaccagcctgccag

SEQ ID NO: 2399836 - DNA, 17 bp, Homo sapiens
gagaccatcctggcccc

SEQ ID NO: 2399837 - DNA, 23 bp, Homo sapiens
gagaccatcctggcccctccaga

SEQ ID NO: 2399838 - DNA, 18 bp, Homo sapiens
gagaccctcttctctggg

SEQ ID NO: 2399839 - DNA, 16 bp, Homo sapiens
gagagaggcgtcctgg

SEQ ID NO: 2399840 - DNA, 19 bp, Homo sapiens
gagagaggcgtcctggtga

SEQ ID NO: 2399841 - DNA, 19 bp, Homo sapiens
gagagcaacaagtagagat

SEQ ID NO: 2399842 - DNA, 13 bp, Homo sapiens
gagagcagcctgg

SEQ ID NO: 2399843 - DNA, 14 bp, Homo sapiens
gagagcagcctggc

SEQ ID NO: 2399844 - DNA, 23 bp, Homo sapiens
gagagggggatgcccctggccct

SEQ ID NO: 2399845 - DNA, 14 bp, Homo sapiens
gagcaacctactgt

SEQ ID NO: 2399846 - DNA, 18 bp, Homo sapiens
gagcaacctactgtctaa

SEQ ID NO: 2399847 - DNA, 21 bp, Homo sapiens
gagcacagacggaggaagccg

SEQ ID NO: 2399848 - DNA, 17 bp, Homo sapiens
gagcagcagctgaggcc

SEQ ID NO: 2399849 - DNA, 13 bp, Homo sapiens
gagcagcctggcc

SEQ ID NO: 2399850 - DNA, 17 bp, Homo sapiens
gagccattctgtcccag

SEQ ID NO: 2399851 - DNA, 14 bp, Homo sapiens
gagcccagctacat

SEQ ID NO: 2399852 - DNA, 19 bp, Homo sapiens
gagcccagctacattcctc

SEQ ID NO: 2399853 - DNA, 12 bp, Homo sapiens
gagccccctgga

SEQ ID NO: 2399854 - DNA, 18 bp, Homo sapiens
gagccccgccccaccccg

SEQ ID NO: 2399855 - DNA, 22 bp, Homo sapiens
gagccccgccccaccccgtcct

SEQ ID NO: 2399856 - DNA, 20 bp, Homo sapiens
gagccctccctcttcccagc

SEQ ID NO: 2399857 - DNA, 13 bp, Homo sapiens
gagcctgcaggca

SEQ ID NO: 2399858 - DNA, 21 bp, Homo sapiens
gagcgcagcgcctccaccctg

SEQ ID NO: 2399859 - DNA, 19 bp, Homo sapiens
gagctagcagaagacaagg

SEQ ID NO: 2399860 - DNA, 11 bp, Homo sapiens
gagctctgtcc

SEQ ID NO: 2399861 - DNA, 16 bp, Homo sapiens
gagctgagtcacctcc

SEQ ID NO: 2399862 - DNA, 17 bp, Homo sapiens
gagctgagtcacctcct

SEQ ID NO: 2399863 - DNA, 15 bp, Homo sapiens
gagcttattggccac

SEQ ID NO: 2399864 - DNA, 16 bp, Homo sapiens
gaggacagagtgccct

SEQ ID NO: 2399865 - DNA, 19 bp, Homo sapiens
gaggacagagtgccctggg

SEQ ID NO: 2399866 - DNA, 18 bp, Homo sapiens
gaggactccgggaccatt

SEQ ID NO: 2399867 - DNA, 23 bp, Homo sapiens
gaggactccgggaccattgacct

SEQ ID NO: 2399868 - DNA, 19 bp, Homo sapiens
gaggagtggacgctgtcca

SEQ ID NO: 2399869 - DNA, 21 bp, Homo sapiens
gaggcccaatgaggtggctca

SEQ ID NO: 2399870 - DNA, 10 bp, Homo sapiens
gaggctgctg

SEQ ID NO: 2399871 - DNA, 14 bp, Homo sapiens
gaggctgctgcccc

SEQ ID NO: 2399872 - DNA, 19 bp, Homo sapiens
gaggctgctgccccctggc

SEQ ID NO: 2399873 - DNA, 20 bp, Homo sapiens
gaggctgctgccccctggct

SEQ ID NO: 2399874 - DNA, 21 bp, Homo sapiens
gaggctgctgccccctggctt

SEQ ID NO: 2399875 - DNA, 17 bp, Homo sapiens
gagggctggagaccaga

SEQ ID NO: 2399876 - DNA, 21 bp, Homo sapiens
gagggggatgcccctggccct

SEQ ID NO: 2399877 - DNA, 13 bp, Homo sapiens
gagggtgtttcct

SEQ ID NO: 2399878 - DNA, 17 bp, Homo sapiens
gagggtgtttcctctaa

SEQ ID NO: 2399879 - DNA, 13 bp, Homo sapiens
gagtcatggtcag

SEQ ID NO: 2399880 - DNA, 23 bp, Homo sapiens
gagtgaggagtggacgctgtcca

SEQ ID NO: 2399881 - DNA, 21 bp, Homo sapiens
gagtggacgctgtccattgcc

SEQ ID NO: 2399882 - DNA, 17 bp, Homo sapiens
gagttaaaatgtttact

SEQ ID NO: 2399883 - DNA, 20 bp, Homo sapiens
gagttcgagagcagcctggc

SEQ ID NO: 2399884 - DNA, 16 bp, Homo sapiens
gagtttatacagtgta

SEQ ID NO: 2399885 - DNA, 19 bp, Homo sapiens
gagtttatacagtgtacat

SEQ ID NO: 2399886 - DNA, 13 bp, Homo sapiens
gatagaactgtac

SEQ ID NO: 2399887 - DNA, 15 bp, Homo sapiens
gatagaactgtactg

SEQ ID NO: 2399888 - DNA, 23 bp, Homo sapiens
gatctgagccctccctcttccca

SEQ ID NO: 2399889 - DNA, 17 bp, Homo sapiens
gatctggcccaagctgg

SEQ ID NO: 2399890 - DNA, 18 bp, Homo sapiens
gatctggcccaagctggg

SEQ ID NO: 2399891 - DNA, 20 bp, Homo sapiens
gatctggcccaagctgggct

SEQ ID NO: 2399892 - DNA, 18 bp, Homo sapiens
gatcttctgaaatgaaac

SEQ ID NO: 2399893 - DNA, 21 bp, Homo sapiens
gatgacttggggacaccccag

SEQ ID NO: 2399894 - DNA, 22 bp, Homo sapiens
gatgcagtgccaggaaccctta

SEQ ID NO: 2399895 - DNA, 15 bp, Homo sapiens
gatgcccctggccct

SEQ ID NO: 2399896 - DNA, 17 bp, Homo sapiens
gatgtcccctgtcccac

SEQ ID NO: 2399897 - DNA, 22 bp, Homo sapiens
gatgtcccctgtcccaccaact

SEQ ID NO: 2399898 - DNA, 13 bp, Homo sapiens
gattcatgtgctt

SEQ ID NO: 2399899 - DNA, 22 bp, Homo sapiens
gattcgaggtcctcctggcctg

SEQ ID NO: 2399900 - DNA, 14 bp, Homo sapiens
gattgcgccactgc

SEQ ID NO: 2399901 - DNA, 23 bp, Homo sapiens
gattgcgccactgcactccagcc

SEQ ID NO: 2399902 - DNA, 14 bp, Homo sapiens
gatttattgaaatt

SEQ ID NO: 2399903 - DNA, 13 bp, Homo sapiens
gatttgaactgag

SEQ ID NO: 2399904 - DNA, 16 bp, Homo sapiens
gatttgaactgagccg

SEQ ID NO: 2399905 - DNA, 21 bp, Homo sapiens
gatttttttttttttcctgtc

SEQ ID NO: 2399906 - DNA, 16 bp, Homo sapiens
gcaaggtcatggtctg

SEQ ID NO: 2399907 - DNA, 18 bp, Homo sapiens
gcacagacggaggaagcc

SEQ ID NO: 2399908 - DNA, 12 bp, Homo sapiens
gcacagggcatg

SEQ ID NO: 2399909 - DNA, 15 bp, Homo sapiens
gcacagggcatgcct

SEQ ID NO: 2399910 - DNA, 17 bp, Homo sapiens
gcacagggcatgcctgg

SEQ ID NO: 2399911 - DNA, 18 bp, Homo sapiens
gcacagggcatgcctggc

SEQ ID NO: 2399912 - DNA, 21 bp, Homo sapiens
gcacagggcatgcctggcctg

SEQ ID NO: 2399913 - DNA, 13 bp, Homo sapiens
gcacattcctggc

SEQ ID NO: 2399914 - DNA, 15 bp, Homo sapiens
gcacattcctggccc

SEQ ID NO: 2399915 - DNA, 16 bp, Homo sapiens
gcacattcctggcccc

SEQ ID NO: 2399916 - DNA, 17 bp, Homo sapiens
gcacattcctggccccg

SEQ ID NO: 2399917 - DNA, 15 bp, Homo sapiens
gcactccagcctggg

SEQ ID NO: 2399918 - DNA, 16 bp, Homo sapiens
gcactccagcctgggt

SEQ ID NO: 2399919 - DNA, 15 bp, Homo sapiens
gcactccatggccac

SEQ ID NO: 2399920 - DNA, 16 bp, Homo sapiens
gcactccatggccacc

SEQ ID NO: 2399921 - DNA, 18 bp, Homo sapiens
gcagaaccggtcccagcc

SEQ ID NO: 2399922 - DNA, 19 bp, Homo sapiens
gcagaaccggtcccagcct

SEQ ID NO: 2399923 - DNA, 20 bp, Homo sapiens
gcagaaccggtcccagcctg

SEQ ID NO: 2399924 - DNA, 21 bp, Homo sapiens
gcagacgcagcagctgggacc

SEQ ID NO: 2399925 - DNA, 17 bp, Homo sapiens
gcagcacctgtcacctt

SEQ ID NO: 2399926 - DNA, 16 bp, Homo sapiens
gcagcagctgaggccc

SEQ ID NO: 2399927 - DNA, 15 bp, Homo sapiens
gcagcagctgggacc

SEQ ID NO: 2399928 - DNA, 22 bp, Homo sapiens
gcagcagctgggacccctccca

SEQ ID NO: 2399929 - DNA, 23 bp, Homo sapiens
gcagcagctgggacccctcccaa

SEQ ID NO: 2399930 - DNA, 21 bp, Homo sapiens
gcagcgcctccaccctgccct

SEQ ID NO: 2399931 - DNA, 15 bp, Homo sapiens
gcagctgaggcccca

SEQ ID NO: 2399932 - DNA, 19 bp, Homo sapiens
gcagctgaggccccagggc

SEQ ID NO: 2399933 - DNA, 19 bp, Homo sapiens
gcagctgggacccctccca

SEQ ID NO: 2399934 - DNA, 20 bp, Homo sapiens
gcagctgggacccctcccaa

SEQ ID NO: 2399935 - DNA, 19 bp, Homo sapiens
gtcggtgtttggaggctgc

SEQ ID NO: 2399936 - DNA, 21 bp, Homo sapiens
gtctaagcagttttgtaaatg

SEQ ID NO: 2399937 - DNA, 23 bp, Homo sapiens
gtctaagcagttttgtaaatgta

SEQ ID NO: 2399938 - DNA, 12 bp, Homo sapiens
gtctccccatgc

SEQ ID NO: 2399939 - DNA, 19 bp, Homo sapiens
gtctggagcctgcaggcag

SEQ ID NO: 2399940 - DNA, 17 bp, Homo sapiens
gtgacctgctcctgccc

SEQ ID NO: 2399941 - DNA, 14 bp, Homo sapiens
gtgagcgggtgggg

SEQ ID NO: 2399942 - DNA, 23 bp, Homo sapiens
gtgaggacaaggtacaggcaagg

SEQ ID NO: 2399943 - DNA, 11 bp, Homo sapiens
gtgaggccaag

SEQ ID NO: 2399944 - DNA, 14 bp, Homo sapiens
gtgcacagccccta

SEQ ID NO: 2399945 - DNA, 17 bp, Homo sapiens
gtgcctgtattcccagc

SEQ ID NO: 2399946 - DNA, 16 bp, Homo sapiens
gtgctcacgtgtcctt

SEQ ID NO: 2399947 - DNA, 14 bp, Homo sapiens
gtgcttgctgtgtg

SEQ ID NO: 2399948 - DNA, 18 bp, Homo sapiens
gtgcttgtgcctacctgg

SEQ ID NO: 2399949 - DNA, 17 bp, Homo sapiens
gtggagcttgcaatgag

SEQ ID NO: 2399950 - DNA, 23 bp, Homo sapiens
gtggcgctgtcggtgtttggagg

SEQ ID NO: 2399951 - DNA, 16 bp, Homo sapiens
gtggcggggcccctgc

SEQ ID NO: 2399952 - DNA, 19 bp, Homo sapiens
gtggcggggcccctgctcc

SEQ ID NO: 2399953 - DNA, 22 bp, Homo sapiens
gtggcggggcccctgctccgag

SEQ ID NO: 2399954 - DNA, 14 bp, Homo sapiens
gtggctcatgcctg

SEQ ID NO: 2399955 - DNA, 16 bp, Homo sapiens
gtggcttctccttggc

SEQ ID NO: 2399956 - DNA, 18 bp, Homo sapiens
gtgggaggcccggggccc

SEQ ID NO: 2399957 - DNA, 17 bp, Homo sapiens
gtggggagtcagtcatg

SEQ ID NO: 2399958 - DNA, 15 bp, Homo sapiens
gtgggtggggaagga

SEQ ID NO: 2399959 - DNA, 15 bp, Homo sapiens
gtgtcatctgctcct

SEQ ID NO: 2399960 - DNA, 15 bp, Homo sapiens
gtgtctggagcctgc

SEQ ID NO: 2399961 - DNA, 11 bp, Homo sapiens
gtgtggccctg

SEQ ID NO: 2399962 - DNA, 21 bp, Homo sapiens
gtgttatgggtgctgaactct

SEQ ID NO: 2399963 - DNA, 24 bp, Homo sapiens
gtgttgagagggggatgcccctgg

SEQ ID NO: 2399964 - DNA, 19 bp, Homo sapiens
gttaaaatgtttactgtaa

SEQ ID NO: 2399965 - DNA, 13 bp, Homo sapiens
gttactgaggacc

SEQ ID NO: 2399966 - DNA, 19 bp, Homo sapiens
gttactgaggaccaaagat

SEQ ID NO: 2399967 - DNA, 16 bp, Homo sapiens
gttccatgcctggccc

SEQ ID NO: 2399968 - DNA, 15 bp, Homo sapiens
gttcctgtgcacagc

SEQ ID NO: 2399969 - DNA, 18 bp, Homo sapiens
gttcgagagcagcctggc

SEQ ID NO: 2399970 - DNA, 20 bp, Homo sapiens
gttgggaccaggccaatccc

SEQ ID NO: 2399971 - DNA, 14 bp, Homo sapiens
gttgtctacattaa

SEQ ID NO: 2399972 - DNA, 14 bp, Homo sapiens
gttgtgtctggagc

SEQ ID NO: 2399973 - DNA, 17 bp, Homo sapiens
gttgtgtctggagcctg

SEQ ID NO: 2399974 - DNA, 14 bp, Homo sapiens
gtttactgtaaatt

SEQ ID NO: 2399975 - DNA, 16 bp, Homo sapiens
gtttatacagtgtaca

SEQ ID NO: 2399976 - DNA, 20 bp, Homo sapiens
gtttatacagtgtacatgta

SEQ ID NO: 2399977 - DNA, 16 bp, Homo sapiens
gtttggaggctgctgc

SEQ ID NO: 2399978 - DNA, 19 bp, Homo sapiens
gtttggaggctgctgcccc

SEQ ID NO: 2399979 - DNA, 20 bp, Homo sapiens
gttttaattttttgaacttt

SEQ ID NO: 2399980 - DNA, 15 bp, Homo sapiens
gttttgtaaatgtac

SEQ ID NO: 2399981 - DNA, 23 bp, Homo sapiens
gtttttcaggtatatacctccat

SEQ ID NO: 2399982 - DNA, 17 bp, Homo sapiens
taaaatgtttactgtaa

SEQ ID NO: 2399983 - DNA, 19 bp, Homo sapiens
taaacagttgcacagcatc

SEQ ID NO: 2399984 - DNA, 14 bp, Homo sapiens
taaaccattgtgca

SEQ ID NO: 2399985 - DNA, 22 bp, Homo sapiens
taaatactggtaccttccccca

SEQ ID NO: 2399986 - DNA, 16 bp, Homo sapiens
taaatctagagtttat

SEQ ID NO: 2399987 - DNA, 17 bp, Homo sapiens
taaatctagagtttata

SEQ ID NO: 2399988 - DNA, 12 bp, Homo sapiens
taaatgtactgg

SEQ ID NO: 2399989 - DNA, 15 bp, Homo sapiens
taaatgtccattctt

SEQ ID NO: 2399990 - DNA, 20 bp, Homo sapiens
taactaatacagctgagcta

SEQ ID NO: 2399991 - DNA, 15 bp, Homo sapiens
taactgccctttccc

SEQ ID NO: 2399992 - DNA, 20 bp, Homo sapiens
taacttgtcttctagtttag

SEQ ID NO: 2399993 - DNA, 13 bp, Homo sapiens
taattctgcctta

SEQ ID NO: 2399994 - DNA, 16 bp, Homo sapiens
taattttttgaacttt

SEQ ID NO: 2399995 - DNA, 17 bp, Homo sapiens
tacaccgtgaggccaag

SEQ ID NO: 2399996 - DNA, 21 bp, Homo sapiens
tacaccgtgaggccaagatcc

SEQ ID NO: 2399997 - DNA, 15 bp, Homo sapiens
tacagctgagctatg

SEQ ID NO: 2399998 - DNA, 15 bp, Homo sapiens
tacagtgtacatgta

SEQ ID NO: 2399999 - DNA, 23 bp, Homo sapiens
tacatgggccagcccttgctcta

SEQ ID NO: 2400000 - DNA, 10 bp, Homo sapiens
tacattcctc

SEQ ID NO: 2400001 - DNA, 16 bp, Homo sapiens
tacattcttcaagatc

SEQ ID NO: 2400002 - DNA, 17 bp, Homo sapiens
tacattcttcaagatcc

SEQ ID NO: 2400003 - DNA, 21 bp, Homo sapiens
tacattcttcaagatcccatt

SEQ ID NO: 2400004 - DNA, 16 bp, Homo sapiens
tacatttttaaattct

SEQ ID NO: 2400005 - DNA, 14 bp, Homo sapiens
tacccgagcccagc

SEQ ID NO: 2400006 - DNA, 19 bp, Homo sapiens
tacccgagcccagctacat

SEQ ID NO: 2400007 - DNA, 16 bp, Homo sapiens
taccttgagaccctct

SEQ ID NO: 2400008 - DNA, 18 bp, Homo sapiens
taccttgagaccctcttc

SEQ ID NO: 2400009 - DNA, 21 bp, Homo sapiens
tacgagggaggaacacctgat

SEQ ID NO: 2400010 - DNA, 18 bp, Homo sapiens
tactcatgaggctgaggc

SEQ ID NO: 2400011 - DNA, 19 bp, Homo sapiens
tactcatgaggctgaggca

SEQ ID NO: 2400012 - DNA, 20 bp, Homo sapiens
tactgctttttctctgcttc

SEQ ID NO: 2400013 - DNA, 17 bp, Homo sapiens
tactggtaattgtacaa

SEQ ID NO: 2400014 - DNA, 15 bp, Homo sapiens
tactggtaccttccc

SEQ ID NO: 2400015 - DNA, 13 bp, Homo sapiens
tactgtaaatttt

SEQ ID NO: 2400016 - DNA, 21 bp, Homo sapiens
tactgtctaagcagttttgta

SEQ ID NO: 2400017 - DNA, 22 bp, Homo sapiens
tactgtctaagcagttttgtaa

SEQ ID NO: 2400018 - DNA, 16 bp, Homo sapiens
tactttgataattaag

SEQ ID NO: 2400019 - DNA, 13 bp, Homo sapiens
tagaactgtactg

SEQ ID NO: 2400020 - DNA, 14 bp, Homo sapiens
tagaactgtactgt

SEQ ID NO: 2400021 - DNA, 17 bp, Homo sapiens
tagaccctcccccacca

SEQ ID NO: 2400022 - DNA, 23 bp, Homo sapiens
tagagtttatacagtgtacatgt

SEQ ID NO: 2400023 - DNA, 14 bp, Homo sapiens
tagatcttctgaaa

SEQ ID NO: 2400024 - DNA, 19 bp, Homo sapiens
tagcattttctgcatctcc

SEQ ID NO: 2400025 - DNA, 13 bp, Homo sapiens
tagccctcctgag

SEQ ID NO: 2400026 - DNA, 14 bp, Homo sapiens
tagccgggcatggt

SEQ ID NO: 2400027 - DNA, 22 bp, Homo sapiens
tagcctttccctaattctgcct

SEQ ID NO: 2400028 - DNA, 16 bp, Homo sapiens
tagctgggatttgaac

SEQ ID NO: 2400029 - DNA, 23 bp, Homo sapiens
tagctgggatttgaactgagccg

SEQ ID NO: 2400030 - DNA, 15 bp, Homo sapiens
taggctgctggcgcc

SEQ ID NO: 2400031 - DNA, 12 bp, Homo sapiens
taggtaaatcta

SEQ ID NO: 2400032 - DNA, 15 bp, Homo sapiens
tagtaaagtattttt

SEQ ID NO: 2400033 - DNA, 14 bp, Homo sapiens
tagtcggtcaccaa

SEQ ID NO: 2400034 - DNA, 22 bp, Homo sapiens
tagtgactaaaccattgtgcat

SEQ ID NO: 2400035 - DNA, 17 bp, Homo sapiens
tataatggttggaacta

SEQ ID NO: 2400036 - DNA, 14 bp, Homo sapiens
tatacagtgtacat

SEQ ID NO: 2400037 - DNA, 16 bp, Homo sapiens
tatccctggccacctg

SEQ ID NO: 2400038 - DNA, 18 bp, Homo sapiens
tatgagggtgtttcctct

SEQ ID NO: 2400039 - DNA, 21 bp, Homo sapiens
tatgattagctttgtcactgt

SEQ ID NO: 2400040 - DNA, 17 bp, Homo sapiens
tatgttccatgcctggc

SEQ ID NO: 2400041 - DNA, 20 bp, Homo sapiens
tatgttccatgcctggccct

SEQ ID NO: 2400042 - DNA, 11 bp, Homo sapiens
tattggccact

SEQ ID NO: 2400043 - DNA, 21 bp, Homo sapiens
tatttttatcagttacacatg

SEQ ID NO: 2400044 - DNA, 16 bp, Homo sapiens
tcacatcccatgtaga

SEQ ID NO: 2400045 - DNA, 14 bp, Homo sapiens
tcaccaaactagta

SEQ ID NO: 2400046 - DNA, 14 bp, Homo sapiens
tcacctcctccact

SEQ ID NO: 2400047 - DNA, 15 bp, Homo sapiens
tcactacatgggcca

SEQ ID NO: 2400048 - DNA, 21 bp, Homo sapiens
tcactacatgggccagccctt

SEQ ID NO: 2400049 - DNA, 15 bp, Homo sapiens
tcactactcagcatg

SEQ ID NO: 2400050 - DNA, 22 bp, Homo sapiens
tcactgtgacctgctcctgccc

SEQ ID NO: 2400051 - DNA, 14 bp, Homo sapiens
tcagatggggcctg

SEQ ID NO: 2400052 - DNA, 14 bp, Homo sapiens
ttcctgtgcacagc

SEQ ID NO: 2400053 - DNA, 15 bp, Homo sapiens
ttcctgtgcacagcc

SEQ ID NO: 2400054 - DNA, 13 bp, Homo sapiens
ttcctgtggcctc

SEQ ID NO: 2400055 - DNA, 13 bp, Homo sapiens
ttccttgtcacca

SEQ ID NO: 2400056 - DNA, 16 bp, Homo sapiens
ttcgaggtcctcctgg

SEQ ID NO: 2400057 - DNA, 17 bp, Homo sapiens
ttctagcaccttatcta

SEQ ID NO: 2400058 - DNA, 16 bp, Homo sapiens
ttctccaagaaagcca

SEQ ID NO: 2400059 - DNA, 21 bp, Homo sapiens
ttctctgattatgtgccctgg

SEQ ID NO: 2400060 - DNA, 19 bp, Homo sapiens
ttctgagatgggagagcaa

SEQ ID NO: 2400061 - DNA, 16 bp, Homo sapiens
ttctgcatctccactt

SEQ ID NO: 2400062 - DNA, 11 bp, Homo sapiens
ttctgtcccag

SEQ ID NO: 2400063 - DNA, 17 bp, Homo sapiens
ttcttcaagatcccatt

SEQ ID NO: 2400064 - DNA, 16 bp, Homo sapiens
ttgaactttgggtacc

SEQ ID NO: 2400065 - DNA, 11 bp, Homo sapiens
ttgacattcct

SEQ ID NO: 2400066 - DNA, 15 bp, Homo sapiens
ttgacgaactggcta

SEQ ID NO: 2400067 - DNA, 23 bp, Homo sapiens
ttgagaccagcctgccaggccct

SEQ ID NO: 2400068 - DNA, 19 bp, Homo sapiens
ttgatgataatacccacat

SEQ ID NO: 2400069 - DNA, 22 bp, Homo sapiens
ttgattaacaatgtattttaat

SEQ ID NO: 2400070 - DNA, 21 bp, Homo sapiens
ttgattcatgtgcttgtgcct

SEQ ID NO: 2400071 - DNA, 19 bp, Homo sapiens
ttgcacagcatctcagctc

SEQ ID NO: 2400072 - DNA, 18 bp, Homo sapiens
ttgcacagtccctcctgt

SEQ ID NO: 2400073 - DNA, 19 bp, Homo sapiens
ttgccacactttcactggg

SEQ ID NO: 2400074 - DNA, 15 bp, Homo sapiens
ttgcccgccagcctc

SEQ ID NO: 2400075 - DNA, 10 bp, Homo sapiens
ttgctcctgg

SEQ ID NO: 2400076 - DNA, 13 bp, Homo sapiens
ttgctctgtggcc

SEQ ID NO: 2400077 - DNA, 22 bp, Homo sapiens
ttgctctgtggccttggccctg

SEQ ID NO: 2400078 - DNA, 15 bp, Homo sapiens
ttggaggctgctgcc

SEQ ID NO: 2400079 - DNA, 23 bp, Homo sapiens
ttggccacaagaataagcagcaa

SEQ ID NO: 2400080 - DNA, 13 bp, Homo sapiens
ttggtaggtaaat

SEQ ID NO: 2400081 - DNA, 15 bp, Homo sapiens
ttggtaggtaaatct

SEQ ID NO: 2400082 - DNA, 23 bp, Homo sapiens
ttgtaaatgtactggtaattgta

SEQ ID NO: 2400083 - DNA, 23 bp, Homo sapiens
ttgtacatttttaaattcttact

SEQ ID NO: 2400084 - DNA, 17 bp, Homo sapiens
ttgtcttctagtttaga

SEQ ID NO: 2400085 - DNA, 14 bp, Homo sapiens
ttgtctttgaacgt

SEQ ID NO: 2400086 - DNA, 14 bp, Homo sapiens
ttgttgtctacatt

SEQ ID NO: 2400087 - DNA, 19 bp, Homo sapiens
tttaataacatatctaaag

SEQ ID NO: 2400088 - DNA, 22 bp, Homo sapiens
tttacatttattccttccaaga

SEQ ID NO: 2400089 - DNA, 23 bp, Homo sapiens
tttagtgactaaaccattgtgca

SEQ ID NO: 2400090 - DNA, 19 bp, Homo sapiens
tttatacagtgtacatgta

SEQ ID NO: 2400091 - DNA, 21 bp, Homo sapiens
tttatggcagacattgtgcta

SEQ ID NO: 2400092 - DNA, 16 bp, Homo sapiens
tttcactactcagcat

SEQ ID NO: 2400093 - DNA, 12 bp, Homo sapiens
tttcctcttctg

SEQ ID NO: 2400094 - DNA, 15 bp, Homo sapiens
tttctgcatctccac

SEQ ID NO: 2400095 - DNA, 15 bp, Homo sapiens
tttctggctggggat

SEQ ID NO: 2400096 - DNA, 16 bp, Homo sapiens
tttctggctggggatg

SEQ ID NO: 2400097 - DNA, 16 bp, Homo sapiens
tttgattaacaatgta

SEQ ID NO: 2400098 - DNA, 20 bp, Homo sapiens
tttgattaacaatgtatttt

SEQ ID NO: 2400099 - DNA, 17 bp, Homo sapiens
tttgcatacattcttca

SEQ ID NO: 2400100 - DNA, 22 bp, Homo sapiens
tttgttgcacagtccctcctgt

SEQ ID NO: 2400101 - DNA, 20 bp, Homo sapiens
ttttagttcctgtgcacagc

SEQ ID NO: 2400102 - DNA, 18 bp, Homo sapiens
ttttccccgattttccag

SEQ ID NO: 2400103 - DNA, 22 bp, Homo sapiens
ttttgcaattggaataatcact

SEQ ID NO: 2400104 - DNA, 13 bp, Homo sapiens
ttttgtaaatgta

SEQ ID NO: 2400105 - DNA, 11 bp, Homo sapiens
tttttcctgtc

SEQ ID NO: 2400106 - DNA, 18 bp, Homo sapiens
tttttgattaacaatgta

SEQ ID NO: 2400107 - DNA, 21 bp, Homo sapiens
gagagggggatgcccctggcc

SEQ ID NO: 2400108 - DNA, 22 bp, Homo sapiens
gagagggggatgcccctggccc

SEQ ID NO: 2400109 - DNA, 14 bp, Homo sapiens
gagcagcagctgag

SEQ ID NO: 2400110 - DNA, 11 bp, Homo sapiens
gagcagcctgg

SEQ ID NO: 2400111 - DNA, 12 bp, Homo sapiens
gagcagcctggc

SEQ ID NO: 2400112 - DNA, 21 bp, Homo sapiens
gagcatatgttccatgcctgg

SEQ ID NO: 2400113 - DNA, 23 bp, Homo sapiens
gagcatatgttccatgcctggcc

SEQ ID NO: 2400114 - DNA, 24 bp, Homo sapiens
gagcccaggagctgagtcacctcc

SEQ ID NO: 2400115 - DNA, 13 bp, Homo sapiens
gagccctccctct

SEQ ID NO: 2400116 - DNA, 18 bp, Homo sapiens
gagccgcttccccagctc

SEQ ID NO: 2400117 - DNA, 22 bp, Homo sapiens
gagcctgcaggcaggtgggggc

SEQ ID NO: 2400118 - DNA, 14 bp, Homo sapiens
gagctaggctgtgg

SEQ ID NO: 2400119 - DNA, 14 bp, Homo sapiens
gagctgagtcacct

SEQ ID NO: 2400120 - DNA, 15 bp, Homo sapiens
gagctgagtcacctc

SEQ ID NO: 2400121 - DNA, 21 bp, Homo sapiens
gagctgagtcacctcctccac

SEQ ID NO: 2400122 - DNA, 19 bp, Homo sapiens
gagcttattggccactggg

SEQ ID NO: 2400123 - DNA, 19 bp, Homo sapiens
gagcttgcaatgagccaag

SEQ ID NO: 2400124 - DNA, 13 bp, Homo sapiens
gaggaacacctga

SEQ ID NO: 2400125 - DNA, 14 bp, Homo sapiens
gaggacaaggtaca

SEQ ID NO: 2400126 - DNA, 21 bp, Homo sapiens
gaggacagagtgccctggggc

SEQ ID NO: 2400127 - DNA, 16 bp, Homo sapiens
gaggaccaaagataca

SEQ ID NO: 2400128 - DNA, 17 bp, Homo sapiens
gaggacccggcgctgag

SEQ ID NO: 2400129 - DNA, 19 bp, Homo sapiens
gaggacccggcgctgagtg

SEQ ID NO: 2400130 - DNA, 15 bp, Homo sapiens
gaggatcccctgagg

SEQ ID NO: 2400131 - DNA, 20 bp, Homo sapiens
gaggcaggaggatcccctga

SEQ ID NO: 2400132 - DNA, 16 bp, Homo sapiens
gaggccaagatcccct

SEQ ID NO: 2400133 - DNA, 19 bp, Homo sapiens
gaggcccattagttgagaa

SEQ ID NO: 2400134 - DNA, 18 bp, Homo sapiens
gagggaggaacacctgat

SEQ ID NO: 2400135 - DNA, 18 bp, Homo sapiens
gagggcgcccattcgtct

SEQ ID NO: 2400136 - DNA, 12 bp, Homo sapiens
gagtcacctcct

SEQ ID NO: 2400137 - DNA, 13 bp, Homo sapiens
gagtcacctcctc

SEQ ID NO: 2400138 - DNA, 15 bp, Homo sapiens
gagtcacctcctcca

SEQ ID NO: 2400139 - DNA, 14 bp, Homo sapiens
gagtgccctggggc

SEQ ID NO: 2400140 - DNA, 16 bp, Homo sapiens
gagtggacgctgtcca

SEQ ID NO: 2400141 - DNA, 13 bp, Homo sapiens
gagtggcggggcc

SEQ ID NO: 2400142 - DNA, 22 bp, Homo sapiens
gagtggcggggcccctgctccg

SEQ ID NO: 2400143 - DNA, 16 bp, Homo sapiens
gagtggggcttcctgg

SEQ ID NO: 2400144 - DNA, 21 bp, Homo sapiens
gagttaaaatgtttactgtaa

SEQ ID NO: 2400145 - DNA, 18 bp, Homo sapiens
gagtttatacagtgtaca

SEQ ID NO: 2400146 - DNA, 19 bp, Homo sapiens
gggccagcccttgctctac

SEQ ID NO: 2400147 - DNA, 22 bp, Homo sapiens
gggcccagagagaggcgtcctg

SEQ ID NO: 2400148 - DNA, 21 bp, Homo sapiens
gggccccggatgacttgggga

SEQ ID NO: 2400149 - DNA, 22 bp, Homo sapiens
gggcccttcctcgcacagggca

SEQ ID NO: 2400150 - DNA, 15 bp, Homo sapiens
gggcctgggctgttg

SEQ ID NO: 2400151 - DNA, 23 bp, Homo sapiens
gggcgcccattcgtctgtcccag

SEQ ID NO: 2400152 - DNA, 20 bp, Homo sapiens
gggctccctttaagccaaga

SEQ ID NO: 2400153 - DNA, 14 bp, Homo sapiens
gggctctggccacc

SEQ ID NO: 2400154 - DNA, 14 bp, Homo sapiens
gggctgcgtccctg

SEQ ID NO: 2400155 - DNA, 23 bp, Homo sapiens
gggctgttgtgtctggagcctgc

SEQ ID NO: 2400156 - DNA, 11 bp, Homo sapiens
gggcttcctgg

SEQ ID NO: 2400157 - DNA, 17 bp, Homo sapiens
ggggagaacccttcctg

SEQ ID NO: 2400158 - DNA, 18 bp, Homo sapiens
ggggagaacccttcctgc

SEQ ID NO: 2400159 - DNA, 17 bp, Homo sapiens
ggggatgcccctggccc

SEQ ID NO: 2400160 - DNA, 21 bp, Homo sapiens
ggggatgcccctggccctgcc

SEQ ID NO: 2400161 - DNA, 15 bp, Homo sapiens
ggggcatagcctttc

SEQ ID NO: 2400162 - DNA, 23 bp, Homo sapiens
ggggcatccaccttcctgcccag

SEQ ID NO: 2400163 - DNA, 13 bp, Homo sapiens
ggggcccctgctc

SEQ ID NO: 2400164 - DNA, 13 bp, Homo sapiens
ggggcctggactg

SEQ ID NO: 2400165 - DNA, 17 bp, Homo sapiens
ggggctgcgtccctgct

SEQ ID NO: 2400166 - DNA, 23 bp, Homo sapiens
ggggctgcgtccctgctcagccc

SEQ ID NO: 2400167 - DNA, 17 bp, Homo sapiens
gggggaggcccaatgag

SEQ ID NO: 2400168 - DNA, 22 bp, Homo sapiens
gggggtttgttgcacagtccct

SEQ ID NO: 2400169 - DNA, 12 bp, Homo sapiens
gggtgacagagc

SEQ ID NO: 2400170 - DNA, 13 bp, Homo sapiens
gggttttcatcta

SEQ ID NO: 2400171 - DNA, 13 bp, Homo sapiens
ggtaggctgctgg

SEQ ID NO: 2400172 - DNA, 14 bp, Homo sapiens
ggtaggtaaatcta

SEQ ID NO: 2400173 - DNA, 21 bp, Homo sapiens
ggtatcctcctaaagacctcc

SEQ ID NO: 2400174 - DNA, 18 bp, Homo sapiens
taagcagttttgtaaatg

SEQ ID NO: 2400175 - DNA, 21 bp, Homo sapiens
taagcagttttgtaaatgtac

SEQ ID NO: 2400176 - DNA, 15 bp, Homo sapiens
taatacagctgagct

SEQ ID NO: 2400177 - DNA, 23 bp, Homo sapiens
taatggttgggaccaggccaatc

SEQ ID NO: 2400178 - DNA, 17 bp, Homo sapiens
taattttcctttgtcat

SEQ ID NO: 2400179 - DNA, 17 bp, Homo sapiens
tacatagtaaagtattt

SEQ ID NO: 2400180 - DNA, 14 bp, Homo sapiens
tacattcctcagct

SEQ ID NO: 2400181 - DNA, 17 bp, Homo sapiens
tacattcctcagctgcc

SEQ ID NO: 2400182 - DNA, 17 bp, Homo sapiens
tacatttttaaattctt

SEQ ID NO: 2400183 - DNA, 21 bp, Homo sapiens
tacccgagcccagctacattc

SEQ ID NO: 2400184 - DNA, 22 bp, Homo sapiens
tacctggccgcaagtccccagc

SEQ ID NO: 2400185 - DNA, 22 bp, Homo sapiens
tacctggccggtaggctgctgg

SEQ ID NO: 2400186 - DNA, 14 bp, Homo sapiens
taccttcccccagc

SEQ ID NO: 2400187 - DNA, 18 bp, Homo sapiens
taccttcccccagctttc

SEQ ID NO: 2400188 - DNA, 20 bp, Homo sapiens
taccttgagaccctcttctc

SEQ ID NO: 2400189 - DNA, 21 bp, Homo sapiens
taccttgagaccctcttctct

SEQ ID NO: 2400190 - DNA, 22 bp, Homo sapiens
taccttgagaccctcttctctg

SEQ ID NO: 2400191 - DNA, 19 bp, Homo sapiens
tacgagggaggaacacctg

SEQ ID NO: 2400192 - DNA, 22 bp, Homo sapiens
tactctggagcaacctactgtc

SEQ ID NO: 2400193 - DNA, 11 bp, Homo sapiens
tactgtaaatt

SEQ ID NO: 2400194 - DNA, 12 bp, Homo sapiens
tactgtaaattt

SEQ ID NO: 2400195 - DNA, 16 bp, Homo sapiens
tactgtctaagcagtt

SEQ ID NO: 2400196 - DNA, 18 bp, Homo sapiens
tagaccctcccccaccat

SEQ ID NO: 2400197 - DNA, 15 bp, Homo sapiens
tagagtttatacagt

SEQ ID NO: 2400198 - DNA, 18 bp, Homo sapiens
tagagtttatacagtgta

SEQ ID NO: 2400199 - DNA, 19 bp, Homo sapiens
tagagtttgtataggtaac

SEQ ID NO: 2400200 - DNA, 13 bp, Homo sapiens
tagatctgagccc

SEQ ID NO: 2400201 - DNA, 18 bp, Homo sapiens
tagatctgagccctccct

SEQ ID NO: 2400202 - DNA, 13 bp, Homo sapiens
tagatcttctgaa

SEQ ID NO: 2400203 - DNA, 11 bp, Homo sapiens
tagcctttccc

SEQ ID NO: 2400204 - DNA, 23 bp, Homo sapiens
tagcctttccctaattctgcctt

SEQ ID NO: 2400205 - DNA, 16 bp, Homo sapiens
tagctctggtgggagg

SEQ ID NO: 2400206 - DNA, 19 bp, Homo sapiens
tagctgggatttgaactga

SEQ ID NO: 2400207 - DNA, 13 bp, Homo sapiens
taggctgctggcg

SEQ ID NO: 2400208 - DNA, 16 bp, Homo sapiens
taggctgctggcgcct

SEQ ID NO: 2400209 - DNA, 23 bp, Homo sapiens
taggtaaatctagagtttataca

SEQ ID NO: 2400210 - DNA, 19 bp, Homo sapiens
tagtgaattggcttccttg

SEQ ID NO: 2400211 - DNA, 20 bp, Homo sapiens
tagtgaattggcttccttga

SEQ ID NO: 2400212 - DNA, 12 bp, Homo sapiens
tataatggttgg

SEQ ID NO: 2400213 - DNA, 16 bp, Homo sapiens
tatacagtgtacatgt

SEQ ID NO: 2400214 - DNA, 13 bp, Homo sapiens
tatatttctccaa

SEQ ID NO: 2400215 - DNA, 14 bp, Homo sapiens
tatattttgcctgt

SEQ ID NO: 2400216 - DNA, 17 bp, Homo sapiens
tatccctggccacctgc

SEQ ID NO: 2400217 - DNA, 19 bp, Homo sapiens
tatccctggccacctgcca

SEQ ID NO: 2400218 - DNA, 21 bp, Homo sapiens
tatccctggccacctgccagg

SEQ ID NO: 2400219 - DNA, 15 bp, Homo sapiens
tatgagggtgtttcc

SEQ ID NO: 2400220 - DNA, 14 bp, Homo sapiens
tattcccagctact

SEQ ID NO: 2400221 - DNA, 23 bp, Homo sapiens
tattgacgaactggctacagtac

SEQ ID NO: 2400222 - DNA, 14 bp, Homo sapiens
tattggccactggg

SEQ ID NO: 2400223 - DNA, 19 bp, Homo sapiens
tatttgtcattcctctcct

SEQ ID NO: 2400224 - DNA, 20 bp, Homo sapiens
tcaagaaatcattattgagt

SEQ ID NO: 2400225 - DNA, 13 bp, Homo sapiens
tcaagattcagct

SEQ ID NO: 2400226 - DNA, 13 bp, Homo sapiens
tcaagggtaatct

SEQ ID NO: 2400227 - DNA, 12 bp, Homo sapiens
tcaatgccctgc

SEQ ID NO: 2400228 - DNA, 14 bp, Homo sapiens
tcacatagctggga

SEQ ID NO: 2400229 - DNA, 17 bp, Homo sapiens
tcaccaaggtggcttct

SEQ ID NO: 2400230 - DNA, 15 bp, Homo sapiens
tcaccagcaacatct

SEQ ID NO: 2400231 - DNA, 20 bp, Homo sapiens
tcacctcctccactcactcc

SEQ ID NO: 2400232 - DNA, 18 bp, Homo sapiens
tcactacatgggccagcc

SEQ ID NO: 2400233 - DNA, 13 bp, Homo sapiens
tcactgagaaagg

SEQ ID NO: 2400234 - DNA, 18 bp, Homo sapiens
tcactgcaacctccgcct

SEQ ID NO: 2400235 - DNA, 17 bp, Homo sapiens
tcactgtgacctgctcc

SEQ ID NO: 2400236 - DNA, 18 bp, Homo sapiens
tcactgtgacctgctcct

SEQ ID NO: 2400237 - DNA, 21 bp, Homo sapiens
tcactgtttcactactcagca

SEQ ID NO: 2400238 - DNA, 21 bp, Homo sapiens
tcacttgaatccattgaaagt

SEQ ID NO: 2400239 - DNA, 23 bp, Homo sapiens
tcagatggggcctgggctgttgt

SEQ ID NO: 2400240 - DNA, 18 bp, Homo sapiens
tcagcccatcccctgcct

SEQ ID NO: 2400241 - DNA, 19 bp, Homo sapiens
tcagcccatcccctgcctc

SEQ ID NO: 2400242 - DNA, 21 bp, Homo sapiens
tcagcccatcccctgcctcta

SEQ ID NO: 2400243 - DNA, 17 bp, Homo sapiens
tcagcgtctccccatgc

SEQ ID NO: 2400244 - DNA, 15 bp, Homo sapiens
tcagctgcacattcc

SEQ ID NO: 2400245 - DNA, 22 bp, Homo sapiens
tcagctgcacattcctggcccc

SEQ ID NO: 2400246 - DNA, 22 bp, Homo sapiens
tcaggcagaaccggtcccagcc

SEQ ID NO: 2400247 - DNA, 16 bp, Homo sapiens
tcaggggtgagacctg

SEQ ID NO: 2400248 - DNA, 15 bp, Homo sapiens
tcagtgccacttgac

SEQ ID NO: 2400249 - DNA, 20 bp, Homo sapiens
tcagtgccacttgacattcc

SEQ ID NO: 2400250 - DNA, 20 bp, Homo sapiens
tcatcagccttttcagcagg

SEQ ID NO: 2400251 - DNA, 23 bp, Homo sapiens
tcatcatgaactggcttgtacat

SEQ ID NO: 2400252 - DNA, 20 bp, Homo sapiens
tcatctatgagggtgtttcc

SEQ ID NO: 2400253 - DNA, 22 bp, Homo sapiens
tcatctatgagggtgtttcctc

SEQ ID NO: 2400254 - DNA, 16 bp, Homo sapiens
tcatctgctccttcct

SEQ ID NO: 2400255 - DNA, 17 bp, Homo sapiens
tcatctgctccttcctg

SEQ ID NO: 2400256 - DNA, 13 bp, Homo sapiens
tcatcttcactgc

SEQ ID NO: 2400257 - DNA, 21 bp, Homo sapiens
tcatgaactggcttgtacatt

SEQ ID NO: 2400258 - DNA, 16 bp, Homo sapiens
tcatgaggctgaggca

SEQ ID NO: 2400259 - DNA, 21 bp, Homo sapiens
tcatgcctgtaatcccagcac

SEQ ID NO: 2400260 - DNA, 15 bp, Homo sapiens
tcatgttcaggcaga

SEQ ID NO: 2400261 - DNA, 15 bp, Homo sapiens
tcattattgagtcac

SEQ ID NO: 2400262 - DNA, 16 bp, Homo sapiens
tcattattgagtcacc

SEQ ID NO: 2400263 - DNA, 22 bp, Homo sapiens
tcatttcctttgttgtctacat

SEQ ID NO: 2400264 - DNA, 16 bp, Homo sapiens
tcattttggtttgttt

SEQ ID NO: 2400265 - DNA, 20 bp, Homo sapiens
tggccgcgtcacttctctga

SEQ ID NO: 2400266 - DNA, 19 bp, Homo sapiens
tggccggtaggctgctggc

SEQ ID NO: 2400267 - DNA, 22 bp, Homo sapiens
tggcctcatccaaactgtatct

SEQ ID NO: 2400268 - DNA, 23 bp, Homo sapiens
tggcctgagcgcagcgcctccac

SEQ ID NO: 2400269 - DNA, 17 bp, Homo sapiens
tggcctgaggacccggc

SEQ ID NO: 2400270 - DNA, 12 bp, Homo sapiens
tggcgccccatg

SEQ ID NO: 2400271 - DNA, 12 bp, Homo sapiens
tggcttgtacat

SEQ ID NO: 2400272 - DNA, 20 bp, Homo sapiens
tgggacccatagatcttctg

SEQ ID NO: 2400273 - DNA, 22 bp, Homo sapiens
tgggacccctcccaacctcaat

SEQ ID NO: 2400274 - DNA, 16 bp, Homo sapiens
tgggatttgctcctgg

SEQ ID NO: 2400275 - DNA, 16 bp, Homo sapiens
tgggcaagtcccttga

SEQ ID NO: 2400276 - DNA, 19 bp, Homo sapiens
tgggcaagtcccttgacct

SEQ ID NO: 2400277 - DNA, 24 bp, Homo sapiens
tgggcagttggggcggcccacgcc

SEQ ID NO: 2400278 - DNA, 16 bp, Homo sapiens
tgggccagcccttgct

SEQ ID NO: 2400279 - DNA, 23 bp, Homo sapiens
tgggccagcccttgctctacctg

SEQ ID NO: 2400280 - DNA, 21 bp, Homo sapiens
tgggctccctttaagccaaga

SEQ ID NO: 2400281 - DNA, 17 bp, Homo sapiens
tgggctgttgtgtctgg

SEQ ID NO: 2400282 - DNA, 18 bp, Homo sapiens
tggggagaacccttcctg

SEQ ID NO: 2400283 - DNA, 14 bp, Homo sapiens
tggggcctgggctg

SEQ ID NO: 2400284 - DNA, 23 bp, Homo sapiens
aaaagcagacgcagcagctggga

SEQ ID NO: 2400285 - DNA, 12 bp, Homo sapiens
aaaatgtttact

SEQ ID NO: 2400286 - DNA, 16 bp, Homo sapiens
aaacagttgcacagca

SEQ ID NO: 2400287 - DNA, 17 bp, Homo sapiens
aaacagttgcacagcat

SEQ ID NO: 2400288 - DNA, 18 bp, Homo sapiens
aaacagttgcacagcatc

SEQ ID NO: 2400289 - DNA, 19 bp, Homo sapiens
aaacagttgcacagcatct

SEQ ID NO: 2400290 - DNA, 21 bp, Homo sapiens
aaacagttgcacagcatctca

SEQ ID NO: 2400291 - DNA, 17 bp, Homo sapiens
aaactccacagggactg

SEQ ID NO: 2400292 - DNA, 16 bp, Homo sapiens
aaactgtatcttcctt

SEQ ID NO: 2400293 - DNA, 15 bp, Homo sapiens
aaaggcaggaggtgg

SEQ ID NO: 2400294 - DNA, 20 bp, Homo sapiens
aaatctagagtttatacagt

SEQ ID NO: 2400295 - DNA, 18 bp, Homo sapiens
aaatgatagaactgtact

SEQ ID NO: 2400296 - DNA, 15 bp, Homo sapiens
aaatgtactggtaat

SEQ ID NO: 2400297 - DNA, 23 bp, Homo sapiens
aaatgtactggtaattgtacaat

SEQ ID NO: 2400298 - DNA, 15 bp, Homo sapiens
aaatgtttactgtaa

SEQ ID NO: 2400299 - DNA, 16 bp, Homo sapiens
aaatgtttactgtaaa

SEQ ID NO: 2400300 - DNA, 17 bp, Homo sapiens
aaatgtttactgtaaat

SEQ ID NO: 2400301 - DNA, 18 bp, Homo sapiens
aaatgtttactgtaaatt

SEQ ID NO: 2400302 - DNA, 18 bp, Homo sapiens
aacaaccaccaccacaat

SEQ ID NO: 2400303 - DNA, 21 bp, Homo sapiens
aacaaggccctttaacttgtc

SEQ ID NO: 2400304 - DNA, 14 bp, Homo sapiens
aacacactgagtga

SEQ ID NO: 2400305 - DNA, 18 bp, Homo sapiens
aacaggagttcagcggag

SEQ ID NO: 2400306 - DNA, 17 bp, Homo sapiens
aacagttgcacagcatc

SEQ ID NO: 2400307 - DNA, 14 bp, Homo sapiens
aaccatcctctccc

SEQ ID NO: 2400308 - DNA, 16 bp, Homo sapiens
aaccattgtgcattct

SEQ ID NO: 2400309 - DNA, 11 bp, Homo sapiens
aacccccagcc

SEQ ID NO: 2400310 - DNA, 15 bp, Homo sapiens
aaccctccgttcctc

SEQ ID NO: 2400311 - DNA, 18 bp, Homo sapiens
aacccttaaacagttgca

SEQ ID NO: 2400312 - DNA, 18 bp, Homo sapiens
aataacatatctaaagtc

SEQ ID NO: 2400313 - DNA, 15 bp, Homo sapiens
aataagattttctgg

SEQ ID NO: 2400314 - DNA, 20 bp, Homo sapiens
aatacaaaaattagccgggc

SEQ ID NO: 2400315 - DNA, 20 bp, Homo sapiens
aatactggtaccttccccca

SEQ ID NO: 2400316 - DNA, 21 bp, Homo sapiens
aatactggtaccttcccccag

SEQ ID NO: 2400317 - DNA, 12 bp, Homo sapiens
aatctagagttt

SEQ ID NO: 2400318 - DNA, 19 bp, Homo sapiens
aatctgaaaccctccttct

SEQ ID NO: 2400319 - DNA, 20 bp, Homo sapiens
aatgaaacaaataatcacat

SEQ ID NO: 2400320 - DNA, 15 bp, Homo sapiens
aatgacagaaatgac

SEQ ID NO: 2400321 - DNA, 23 bp, Homo sapiens
aatgacagaaatgacaacaaggc

SEQ ID NO: 2400322 - DNA, 19 bp, Homo sapiens
aatgatagaactgtactgt

SEQ ID NO: 2400323 - DNA, 13 bp, Homo sapiens
aatgcattattga

SEQ ID NO: 2400324 - DNA, 20 bp, Homo sapiens
aatgtactggtaattgtaca

SEQ ID NO: 2400325 - DNA, 21 bp, Homo sapiens
aatgtactggtaattgtacaa

SEQ ID NO: 2400326 - DNA, 18 bp, Homo sapiens
aatgtttactgtaaattt

SEQ ID NO: 2400327 - DNA, 15 bp, Homo sapiens
aattaaggccagagg

SEQ ID NO: 2400328 - DNA, 20 bp, Homo sapiens
aattcctctttggccacaag

SEQ ID NO: 2400329 - DNA, 15 bp, Homo sapiens
aattcttactctgga

SEQ ID NO: 2400330 - DNA, 22 bp, Homo sapiens
aatttggtgctcacgtgtcctt

SEQ ID NO: 2400331 - DNA, 23 bp, Homo sapiens
acaacaaggccctttaacttgtc

SEQ ID NO: 2400332 - DNA, 15 bp, Homo sapiens
acaactatggctgtt

SEQ ID NO: 2400333 - DNA, 19 bp, Homo sapiens
acaagaataagcagcaaat

SEQ ID NO: 2400334 - DNA, 21 bp, Homo sapiens
acaaggcatgtagggggagcc

SEQ ID NO: 2400335 - DNA, 21 bp, Homo sapiens
acaagtagagatgaagttaaa

SEQ ID NO: 2400336 - DNA, 15 bp, Homo sapiens
acacagcccaccctc

SEQ ID NO: 2400337 - DNA, 16 bp, Homo sapiens
acaccgtgaggccaag

SEQ ID NO: 2400338 - DNA, 21 bp, Homo sapiens
acacctgatctggcccaagct

SEQ ID NO: 2400339 - DNA, 13 bp, Homo sapiens
acactttcactgg

SEQ ID NO: 2400340 - DNA, 22 bp, Homo sapiens
acagaaatgacaacaaggccct

SEQ ID NO: 2400341 - DNA, 13 bp, Homo sapiens
acagagtgccctg

SEQ ID NO: 2400342 - DNA, 14 bp, Homo sapiens
acagagtgccctgg

SEQ ID NO: 2400343 - DNA, 18 bp, Homo sapiens
acagagtgccctggggca

SEQ ID NO: 2400344 - DNA, 15 bp, Homo sapiens
acagcatctcagctc

SEQ ID NO: 2400345 - DNA, 21 bp, Homo sapiens
acaggagttcagcggagctag

SEQ ID NO: 2400346 - DNA, 19 bp, Homo sapiens
acaggcaaggatgatccag

SEQ ID NO: 2400347 - DNA, 17 bp, Homo sapiens
acaggcagcaaggtcat

SEQ ID NO: 2400348 - DNA, 12 bp, Homo sapiens
acagtgtacatg

SEQ ID NO: 2400349 - DNA, 15 bp, Homo sapiens
acagttgcacagcat

SEQ ID NO: 2400350 - DNA, 18 bp, Homo sapiens
acatagtaaagtattttt

SEQ ID NO: 2400351 - DNA, 12 bp, Homo sapiens
acatccccacct

SEQ ID NO: 2400352 - DNA, 18 bp, Homo sapiens
acatccccaccttccaag

SEQ ID NO: 2400353 - DNA, 15 bp, Homo sapiens
acatgggccagccct

SEQ ID NO: 2400354 - DNA, 17 bp, Homo sapiens
acattcctcagctgcca

SEQ ID NO: 2400355 - DNA, 19 bp, Homo sapiens
acattcctcagctgccaag

SEQ ID NO: 2400356 - DNA, 22 bp, Homo sapiens
acattcctcagctgccaagcac

SEQ ID NO: 2400357 - DNA, 18 bp, Homo sapiens
acattccttgtcaccagc

SEQ ID NO: 2400358 - DNA, 19 bp, Homo sapiens
acattccttgtcaccagca

SEQ ID NO: 2400359 - DNA, 22 bp, Homo sapiens
acattttctctcgttaattttc

SEQ ID NO: 2400360 - DNA, 19 bp, Homo sapiens
acatttttaaattcttact

SEQ ID NO: 2400361 - DNA, 24 bp, Homo sapiens
acatttttaaattcttactctgga

SEQ ID NO: 2400362 - DNA, 22 bp, Homo sapiens
accaactctgcactccatggcc

SEQ ID NO: 2400363 - DNA, 24 bp, Homo sapiens
accaaggtggcttctccttggctg

SEQ ID NO: 2400364 - DNA, 14 bp, Homo sapiens
accacaatgacaga

SEQ ID NO: 2400365 - DNA, 19 bp, Homo sapiens
accagaacagcatggcccg

SEQ ID NO: 2400366 - DNA, 12 bp, Homo sapiens
accagcctgcca

SEQ ID NO: 2400367 - DNA, 16 bp, Homo sapiens
accagcctgccaggcc

SEQ ID NO: 2400368 - DNA, 18 bp, Homo sapiens
accagcctgccaggccct

SEQ ID NO: 2400369 - DNA, 17 bp, Homo sapiens
accagcgcccttgcaca

SEQ ID NO: 2400370 - DNA, 11 bp, Homo sapiens
accaggccaat

SEQ ID NO: 2400371 - DNA, 14 bp, Homo sapiens
accatcctctccct

SEQ ID NO: 2400372 - DNA, 13 bp, Homo sapiens
accatcctggccc

SEQ ID NO: 2400373 - DNA, 14 bp, Homo sapiens
accattgacaggca

SEQ ID NO: 2400374 - DNA, 15 bp, Homo sapiens
accattgacctcagc

SEQ ID NO: 2400375 - DNA, 18 bp, Homo sapiens
accattgacctcagctgc

SEQ ID NO: 2400376 - DNA, 16 bp, Homo sapiens
acccacctccaccccc

SEQ ID NO: 2400377 - DNA, 17 bp, Homo sapiens
acccatagatcttctga

SEQ ID NO: 2400378 - DNA, 22 bp, Homo sapiens
acccatagatcttctgaaatga

SEQ ID NO: 2400379 - DNA, 14 bp, Homo sapiens
acccatgccagcgc

SEQ ID NO: 2400380 - DNA, 20 bp, Homo sapiens
acccccacctcaaggtcagg

SEQ ID NO: 2400381 - DNA, 15 bp, Homo sapiens
acccccagcccctcc

SEQ ID NO: 2400382 - DNA, 19 bp, Homo sapiens
acccccgccacggccaccc

SEQ ID NO: 2400383 - DNA, 21 bp, Homo sapiens
acccccgccacggccaccctc

SEQ ID NO: 2400384 - DNA, 13 bp, Homo sapiens
accccgcctgccc

SEQ ID NO: 2400385 - DNA, 14 bp, Homo sapiens
acccctcccaacct

SEQ ID NO: 2400386 - DNA, 21 bp, Homo sapiens
acccgagcccagctacattcc

SEQ ID NO: 2400387 - DNA, 17 bp, Homo sapiens
acccgggaggtggagct

SEQ ID NO: 2400388 - DNA, 19 bp, Homo sapiens
acccgggaggtggagcttg

SEQ ID NO: 2400389 - DNA, 21 bp, Homo sapiens
acccgggaggtggagcttgca

SEQ ID NO: 2400390 - DNA, 15 bp, Homo sapiens
acccgtaggcagcct

SEQ ID NO: 2400391 - DNA, 19 bp, Homo sapiens
acccgtaggcagcctctct

SEQ ID NO: 2400392 - DNA, 21 bp, Homo sapiens
acccgtaggcagcctctctgc

SEQ ID NO: 2400393 - DNA, 14 bp, Homo sapiens
accctcccccacca

SEQ ID NO: 2400394 - DNA, 14 bp, Homo sapiens
accctcttctctgg

SEQ ID NO: 2400395 - DNA, 17 bp, Homo sapiens
accctgcctgagcccag

SEQ ID NO: 2400396 - DNA, 11 bp, Homo sapiens
accctggcccg

SEQ ID NO: 2400397 - DNA, 18 bp, Homo sapiens
accggtcccagcctgggc

SEQ ID NO: 2400398 - DNA, 19 bp, Homo sapiens
accggtcccagcctgggct

SEQ ID NO: 2400399 - DNA, 15 bp, Homo sapiens
acctactgtctaagc

SEQ ID NO: 2400400 - DNA, 15 bp, Homo sapiens
acctcaatgccctgc

SEQ ID NO: 2400401 - DNA, 16 bp, Homo sapiens
acctcaatgccctgcc

SEQ ID NO: 2400402 - DNA, 19 bp, Homo sapiens
acctcaatgccctgccatt

SEQ ID NO: 2400403 - DNA, 12 bp, Homo sapiens
acctcagctgca

SEQ ID NO: 2400404 - DNA, 16 bp, Homo sapiens
acctcagctgcacatt

SEQ ID NO: 2400405 - DNA, 17 bp, Homo sapiens
agcttattggccactgg

SEQ ID NO: 2400406 - DNA, 19 bp, Homo sapiens
agcttgcaatgagccaaga

SEQ ID NO: 2400407 - DNA, 22 bp, Homo sapiens
aggaacacctgatcttacagaa

SEQ ID NO: 2400408 - DNA, 18 bp, Homo sapiens
aggaaggcgtgtccagga

SEQ ID NO: 2400409 - DNA, 20 bp, Homo sapiens
aggagacacgtgtggcgggc

SEQ ID NO: 2400410 - DNA, 16 bp, Homo sapiens
aggagctgagtcacct

SEQ ID NO: 2400411 - DNA, 18 bp, Homo sapiens
aggagctgagtcacctcc

SEQ ID NO: 2400412 - DNA, 18 bp, Homo sapiens
aggaggacagagtgccct

SEQ ID NO: 2400413 - DNA, 18 bp, Homo sapiens
aggaggatcccctgaggt

SEQ ID NO: 2400414 - DNA, 14 bp, Homo sapiens
aggagggcgcccat

SEQ ID NO: 2400415 - DNA, 13 bp, Homo sapiens
aggaggtgggtga

SEQ ID NO: 2400416 - DNA, 22 bp, Homo sapiens
aggagttcgagagcagcctggc

SEQ ID NO: 2400417 - DNA, 18 bp, Homo sapiens
aggatcctcctggagcag

SEQ ID NO: 2400418 - DNA, 20 bp, Homo sapiens
aggatggttactgaggacca

SEQ ID NO: 2400419 - DNA, 17 bp, Homo sapiens
aggcagaaccggtccca

SEQ ID NO: 2400420 - DNA, 18 bp, Homo sapiens
aggcagaaccggtcccag

SEQ ID NO: 2400421 - DNA, 22 bp, Homo sapiens
aggcagaaccggtcccagcctg

SEQ ID NO: 2400422 - DNA, 23 bp, Homo sapiens
aggcagaaccggtcccagcctgg

SEQ ID NO: 2400423 - DNA, 18 bp, Homo sapiens
aggcaggagaatggcgtg

SEQ ID NO: 2400424 - DNA, 20 bp, Homo sapiens
aggcaggtgggggctgcgtc

SEQ ID NO: 2400425 - DNA, 18 bp, Homo sapiens
aggcatgtagggggagcc

SEQ ID NO: 2400426 - DNA, 16 bp, Homo sapiens
aggccaagatcccctc

SEQ ID NO: 2400427 - DNA, 15 bp, Homo sapiens
aggccagaggcccat

SEQ ID NO: 2400428 - DNA, 13 bp, Homo sapiens
aggcccggggccc

SEQ ID NO: 2400429 - DNA, 15 bp, Homo sapiens
aggccctagaccctc

SEQ ID NO: 2400430 - DNA, 13 bp, Homo sapiens
aggccctccagca

SEQ ID NO: 2400431 - DNA, 19 bp, Homo sapiens
aggcctccctcgggctggt

SEQ ID NO: 2400432 - DNA, 21 bp, Homo sapiens
aggcctccctcgggctggtgt

SEQ ID NO: 2400433 - DNA, 17 bp, Homo sapiens
aggctctgttccacata

SEQ ID NO: 2400434 - DNA, 13 bp, Homo sapiens
aggctgctgcccc

SEQ ID NO: 2400435 - DNA, 18 bp, Homo sapiens
aggctgctgccccctggc

SEQ ID NO: 2400436 - DNA, 21 bp, Homo sapiens
aggctgtggagtagagtttgt

SEQ ID NO: 2400437 - DNA, 17 bp, Homo sapiens
agggacaagggggagga

SEQ ID NO: 2400438 - DNA, 21 bp, Homo sapiens
agggcgcccattcgtctgtcc

SEQ ID NO: 2400439 - DNA, 23 bp, Homo sapiens
agggctcagatggggcctgggct

SEQ ID NO: 2400440 - DNA, 13 bp, Homo sapiens
agggctgtgggtg

SEQ ID NO: 2400441 - DNA, 14 bp, Homo sapiens
agggctgtgggtgg

SEQ ID NO: 2400442 - DNA, 16 bp, Homo sapiens
agggctgtgggtgggg

SEQ ID NO: 2400443 - DNA, 21 bp, Homo sapiens
agggggatgcccctggccctg

SEQ ID NO: 2400444 - DNA, 12 bp, Homo sapiens
agggtgtttcct

SEQ ID NO: 2400445 - DNA, 16 bp, Homo sapiens
agggtgtttcctctaa

SEQ ID NO: 2400446 - DNA, 22 bp, Homo sapiens
aggtaaatctagagtttataca

SEQ ID NO: 2400447 - DNA, 23 bp, Homo sapiens
aggtaaatctagagtttatacag

SEQ ID NO: 2400448 - DNA, 12 bp, Homo sapiens
aggtatttatca

SEQ ID NO: 2400449 - DNA, 15 bp, Homo sapiens
aggtccgagctctgt

SEQ ID NO: 2400450 - DNA, 17 bp, Homo sapiens
aggtccgagctctgtcc

SEQ ID NO: 2400451 - DNA, 18 bp, Homo sapiens
aggtccgagctctgtcct

SEQ ID NO: 2400452 - DNA, 13 bp, Homo sapiens
aggtcctcctggc

SEQ ID NO: 2400453 - DNA, 16 bp, Homo sapiens
aggtcctcctggcctg

SEQ ID NO: 2400454 - DNA, 16 bp, Homo sapiens
aggtggctcatgcctg

SEQ ID NO: 2400455 - DNA, 19 bp, Homo sapiens
aggtgggtgagcgggtggg

SEQ ID NO: 2400456 - DNA, 22 bp, Homo sapiens
aggttctcattttggtttgttt

SEQ ID NO: 2400457 - DNA, 15 bp, Homo sapiens
agtaactgccctttc

SEQ ID NO: 2400458 - DNA, 21 bp, Homo sapiens
agtagagtttgtataggtaac

SEQ ID NO: 2400459 - DNA, 22 bp, Homo sapiens
agtatttttgattaacaatgta

SEQ ID NO: 2400460 - DNA, 18 bp, Homo sapiens
agtcagtcatgtcactga

SEQ ID NO: 2400461 - DNA, 18 bp, Homo sapiens
agtcatcatgaactggct

SEQ ID NO: 2400462 - DNA, 19 bp, Homo sapiens
agtcatcatgaactggctt

SEQ ID NO: 2400463 - DNA, 13 bp, Homo sapiens
agtcatgtcactg

SEQ ID NO: 2400464 - DNA, 12 bp, Homo sapiens
agtccccagccc

SEQ ID NO: 2400465 - DNA, 13 bp, Homo sapiens
agtcggtcaccaa

SEQ ID NO: 2400466 - DNA, 19 bp, Homo sapiens
agtgaattggcttccttga

SEQ ID NO: 2400467 - DNA, 17 bp, Homo sapiens
agtgagcagtgttagct

SEQ ID NO: 2400468 - DNA, 21 bp, Homo sapiens
agtgagccagaaattgattaa

SEQ ID NO: 2400469 - DNA, 17 bp, Homo sapiens
agtgccacttgacattc

SEQ ID NO: 2400470 - DNA, 19 bp, Homo sapiens
agtgccacttgacattcct

SEQ ID NO: 2400471 - DNA, 21 bp, Homo sapiens
agtgccacttgacattccttg

SEQ ID NO: 2400472 - DNA, 17 bp, Homo sapiens
agtggcggggcccctgc

SEQ ID NO: 2400473 - DNA, 15 bp, Homo sapiens
agtgggacccataga

SEQ ID NO: 2400474 - DNA, 21 bp, Homo sapiens
agtgggacccatagatcttct

SEQ ID NO: 2400475 - DNA, 15 bp, Homo sapiens
agtggggcttcctgg

SEQ ID NO: 2400476 - DNA, 19 bp, Homo sapiens
agtgtacatgtacatagta

SEQ ID NO: 2400477 - DNA, 23 bp, Homo sapiens
agttaaaatgtttactgtaaatt

SEQ ID NO: 2400478 - DNA, 14 bp, Homo sapiens
agttcctgtgcaca

SEQ ID NO: 2400479 - DNA, 16 bp, Homo sapiens
agttcctgtgcacagc

SEQ ID NO: 2400480 - DNA, 17 bp, Homo sapiens
agttcctgtgcacagcc

SEQ ID NO: 2400481 - DNA, 20 bp, Homo sapiens
agttcgagagcagcctggcc

SEQ ID NO: 2400482 - DNA, 17 bp, Homo sapiens
agttgattcatgtgctt

SEQ ID NO: 2400483 - DNA, 12 bp, Homo sapiens
agttgcacagca

SEQ ID NO: 2400484 - DNA, 13 bp, Homo sapiens
agttgcacagcat

SEQ ID NO: 2400485 - DNA, 14 bp, Homo sapiens
agttgcacagcatc

SEQ ID NO: 2400486 - DNA, 15 bp, Homo sapiens
agttgcacagcatct

SEQ ID NO: 2400487 - DNA, 17 bp, Homo sapiens
agttgcacagcatctca

SEQ ID NO: 2400488 - DNA, 12 bp, Homo sapiens
agttggggcggc

SEQ ID NO: 2400489 - DNA, 15 bp, Homo sapiens
agtttatacagtgta

SEQ ID NO: 2400490 - DNA, 13 bp, Homo sapiens
agttttgtaaatg

SEQ ID NO: 2400491 - DNA, 17 bp, Homo sapiens
ataacatatctaaagtc

SEQ ID NO: 2400492 - DNA, 22 bp, Homo sapiens
ataagattttctgggataacag

SEQ ID NO: 2400493 - DNA, 17 bp, Homo sapiens
atacagtgtacatgtac

SEQ ID NO: 2400494 - DNA, 14 bp, Homo sapiens
atagatcttctgaa

SEQ ID NO: 2400495 - DNA, 13 bp, Homo sapiens
atatctaaagtca

SEQ ID NO: 2400496 - DNA, 17 bp, Homo sapiens
atcaccctgactgtggg

SEQ ID NO: 2400497 - DNA, 23 bp, Homo sapiens
atcacttgaatccattgaaagtg

SEQ ID NO: 2400498 - DNA, 20 bp, Homo sapiens
atcatgaactggcttgtaca

SEQ ID NO: 2400499 - DNA, 21 bp, Homo sapiens
atcatgaactggcttgtacat

SEQ ID NO: 2400500 - DNA, 24 bp, Homo sapiens
atcatgaactggcttgtacatttt

SEQ ID NO: 2400501 - DNA, 19 bp, Homo sapiens
atccaccttcctgcccagg

SEQ ID NO: 2400502 - DNA, 22 bp, Homo sapiens
atccatcttccctacccttcct

SEQ ID NO: 2400503 - DNA, 14 bp, Homo sapiens
atcccctgcctcta

SEQ ID NO: 2400504 - DNA, 19 bp, Homo sapiens
atccctggccacctgccag

SEQ ID NO: 2400505 - DNA, 11 bp, Homo sapiens
atcctggcccc

SEQ ID NO: 2400506 - DNA, 22 bp, Homo sapiens
atcctgttttcatggacagctg

SEQ ID NO: 2400507 - DNA, 21 bp, Homo sapiens
atccttcatttgacatttagt

SEQ ID NO: 2400508 - DNA, 14 bp, Homo sapiens
atcgctctgagcat

SEQ ID NO: 2400509 - DNA, 23 bp, Homo sapiens
atctagagtttatacagtgtaca

SEQ ID NO: 2400510 - DNA, 21 bp, Homo sapiens
atctatgagggtgtttcctct

SEQ ID NO: 2400511 - DNA, 23 bp, Homo sapiens
atctatgagggtgtttcctctaa

SEQ ID NO: 2400512 - DNA, 16 bp, Homo sapiens
atctcagctcatcttc

SEQ ID NO: 2400513 - DNA, 16 bp, Homo sapiens
atctcgagccccctgg

SEQ ID NO: 2400514 - DNA, 17 bp, Homo sapiens
atctcgagccccctgga

SEQ ID NO: 2400515 - DNA, 19 bp, Homo sapiens
atctgaaaccctccttctg

SEQ ID NO: 2400516 - DNA, 13 bp, Homo sapiens
atctgagccctcc

SEQ ID NO: 2400517 - DNA, 23 bp, Homo sapiens
atctgagccctccctcttcccag

SEQ ID NO: 2400518 - DNA, 18 bp, Homo sapiens
atctgcctgtggccttgc

SEQ ID NO: 2400519 - DNA, 14 bp, Homo sapiens
atcttacagaaaat

SEQ ID NO: 2400520 - DNA, 14 bp, Homo sapiens
atcttgctctgtgg

SEQ ID NO: 2400521 - DNA, 14 bp, Homo sapiens
acgcgagaggctct

SEQ ID NO: 2400522 - DNA, 22 bp, Homo sapiens
acgctgtccattgccacggcca

SEQ ID NO: 2400523 - DNA, 18 bp, Homo sapiens
acggccaccctccttccc

SEQ ID NO: 2400524 - DNA, 17 bp, Homo sapiens
actacatgggccagccc

SEQ ID NO: 2400525 - DNA, 19 bp, Homo sapiens
actacatgggccagccctt

SEQ ID NO: 2400526 - DNA, 21 bp, Homo sapiens
actacatgggccagcccttgc

SEQ ID NO: 2400527 - DNA, 21 bp, Homo sapiens
actacccgagcccagctacat

SEQ ID NO: 2400528 - DNA, 12 bp, Homo sapiens
actactcagcat

SEQ ID NO: 2400529 - DNA, 17 bp, Homo sapiens
actactcagcatggaaa

SEQ ID NO: 2400530 - DNA, 14 bp, Homo sapiens
actccagcccaaca

SEQ ID NO: 2400531 - DNA, 13 bp, Homo sapiens
actccatggccac

SEQ ID NO: 2400532 - DNA, 17 bp, Homo sapiens
actccatggccaccccg

SEQ ID NO: 2400533 - DNA, 23 bp, Homo sapiens
actccatggccaccccgtgccac

SEQ ID NO: 2400534 - DNA, 16 bp, Homo sapiens
actcctcccttcccca

SEQ ID NO: 2400535 - DNA, 22 bp, Homo sapiens
actcctcccttccccactctgc

SEQ ID NO: 2400536 - DNA, 18 bp, Homo sapiens
actctgcactccatggcc

SEQ ID NO: 2400537 - DNA, 23 bp, Homo sapiens
actctgcactccatggccacccc

SEQ ID NO: 2400538 - DNA, 9 bp, Homo sapiens
actctgctc

SEQ ID NO: 2400539 - DNA, 14 bp, Homo sapiens
actgaaaatggcat

SEQ ID NO: 2400540 - DNA, 15 bp, Homo sapiens
actgcactccagcct

SEQ ID NO: 2400541 - DNA, 14 bp, Homo sapiens
actggctacagtac

SEQ ID NO: 2400542 - DNA, 23 bp, Homo sapiens
actggggatcccgtgctggaaga

SEQ ID NO: 2400543 - DNA, 16 bp, Homo sapiens
actgggtctcactcct

SEQ ID NO: 2400544 - DNA, 15 bp, Homo sapiens
actggtaattgtaca

SEQ ID NO: 2400545 - DNA, 16 bp, Homo sapiens
actggtaccttccccc

SEQ ID NO: 2400546 - DNA, 10 bp, Homo sapiens
actgtaaatt

SEQ ID NO: 2400547 - DNA, 18 bp, Homo sapiens
actgtctaagcagttttg

SEQ ID NO: 2400548 - DNA, 16 bp, Homo sapiens
actgtgacctgctcct

SEQ ID NO: 2400549 - DNA, 20 bp, Homo sapiens
actgtgacctgctcctgccc

SEQ ID NO: 2400550 - DNA, 19 bp, Homo sapiens
actgttctatagcagtcat

SEQ ID NO: 2400551 - DNA, 22 bp, Homo sapiens
acttactataatggttggaact

SEQ ID NO: 2400552 - DNA, 15 bp, Homo sapiens
acttagatctgagcc

SEQ ID NO: 2400553 - DNA, 16 bp, Homo sapiens
acttagatctgagccc

SEQ ID NO: 2400554 - DNA, 11 bp, Homo sapiens
acttctctgat

SEQ ID NO: 2400555 - DNA, 13 bp, Homo sapiens
acttgacattcct

SEQ ID NO: 2400556 - DNA, 15 bp, Homo sapiens
actttcccttcccct

SEQ ID NO: 2400557 - DNA, 15 bp, Homo sapiens
actttgataattaag

SEQ ID NO: 2400558 - DNA, 21 bp, Homo sapiens
agaaaagcagacgcagcagct

SEQ ID NO: 2400559 - DNA, 23 bp, Homo sapiens
agaaaccatcctctcccttctta

SEQ ID NO: 2400560 - DNA, 17 bp, Homo sapiens
agaaatgcaaaagaagt

SEQ ID NO: 2400561 - DNA, 14 bp, Homo sapiens
agaacagcatggcc

SEQ ID NO: 2400562 - DNA, 14 bp, Homo sapiens
agaacccttcctgc

SEQ ID NO: 2400563 - DNA, 17 bp, Homo sapiens
agaaccggtcccagcct

SEQ ID NO: 2400564 - DNA, 20 bp, Homo sapiens
agaaccggtcccagcctggg

SEQ ID NO: 2400565 - DNA, 15 bp, Homo sapiens
agaagacaaggcatg

SEQ ID NO: 2400566 - DNA, 23 bp, Homo sapiens
agaagagaaaccatcctctccct

SEQ ID NO: 2400567 - DNA, 18 bp, Homo sapiens
agaagcaaaggcaggagg

SEQ ID NO: 2400568 - DNA, 23 bp, Homo sapiens
agaagttcatgggcacctcatgg

SEQ ID NO: 2400569 - DNA, 15 bp, Homo sapiens
agaatcccctgggga

SEQ ID NO: 2400570 - DNA, 21 bp, Homo sapiens
agaccagaacagcatggcccg

SEQ ID NO: 2400571 - DNA, 20 bp, Homo sapiens
agaccagcctgccaggccct

SEQ ID NO: 2400572 - DNA, 14 bp, Homo sapiens
agaccatcctggcc

SEQ ID NO: 2400573 - DNA, 18 bp, Homo sapiens
agaccctgcctgagccca

SEQ ID NO: 2400574 - DNA, 22 bp, Homo sapiens
agaccctgcctgagcccaggag

SEQ ID NO: 2400575 - DNA, 19 bp, Homo sapiens
agacgcccccaaatccttg

SEQ ID NO: 2400576 - DNA, 18 bp, Homo sapiens
agactcaatgtccccctc

SEQ ID NO: 2400577 - DNA, 11 bp, Homo sapiens
agagcagcctg

SEQ ID NO: 2400578 - DNA, 14 bp, Homo sapiens
agagcagcctggcc

SEQ ID NO: 2400579 - DNA, 22 bp, Homo sapiens
agagcagcctggccaacatggc

SEQ ID NO: 2400580 - DNA, 17 bp, Homo sapiens
agagccccgccccaccc

SEQ ID NO: 2400581 - DNA, 18 bp, Homo sapiens
agagccccgccccacccc

SEQ ID NO: 2400582 - DNA, 23 bp, Homo sapiens
agagggggatgcccctggccctg

SEQ ID NO: 2400583 - DNA, 23 bp, Homo sapiens
agagtttatacagtgtacatgta

SEQ ID NO: 2400584 - DNA, 13 bp, Homo sapiens
agattcagctagt

SEQ ID NO: 2400585 - DNA, 11 bp, Homo sapiens
agcaacaagta

SEQ ID NO: 2400586 - DNA, 24 bp, Homo sapiens
agcaacctactgtctaagcagttt

SEQ ID NO: 2400587 - DNA, 21 bp, Homo sapiens
agcacagacggaggaagccgc

SEQ ID NO: 2400588 - DNA, 13 bp, Homo sapiens
agcacccacgtga

SEQ ID NO: 2400589 - DNA, 21 bp, Homo sapiens
agcaccttatctatgatgttt

SEQ ID NO: 2400590 - DNA, 22 bp, Homo sapiens
agcactcgagaccatcctggcc

SEQ ID NO: 2400591 - DNA, 16 bp, Homo sapiens
agcactttgggaagct

SEQ ID NO: 2400592 - DNA, 20 bp, Homo sapiens
agcagacgcagcagctggga

SEQ ID NO: 2400593 - DNA, 19 bp, Homo sapiens
agcagcaaataaacaacta

SEQ ID NO: 2400594 - DNA, 18 bp, Homo sapiens
agcatatgttccatgcct

SEQ ID NO: 2400595 - DNA, 15 bp, Homo sapiens
agccaagagagcctc

SEQ ID NO: 2400596 - DNA, 15 bp, Homo sapiens
agcccagctacattc

SEQ ID NO: 2400597 - DNA, 15 bp, Homo sapiens
agcccccacccatgc

SEQ ID NO: 2400598 - DNA, 21 bp, Homo sapiens
agcccccacccatgccagcgc

SEQ ID NO: 2400599 - DNA, 23 bp, Homo sapiens
agcccccacccatgccagcgcag

SEQ ID NO: 2400600 - DNA, 19 bp, Homo sapiens
agccccctggatgtcccct

SEQ ID NO: 2400601 - DNA, 18 bp, Homo sapiens
agccccgccccaccccgt

SEQ ID NO: 2400602 - DNA, 21 bp, Homo sapiens
agcccctaccttgagaccctc

SEQ ID NO: 2400603 - DNA, 16 bp, Homo sapiens
agcccttgctctacct

SEQ ID NO: 2400604 - DNA, 17 bp, Homo sapiens
agcccttgctctacctg

SEQ ID NO: 2400605 - DNA, 21 bp, Homo sapiens
agcccttgctctacctggccg

SEQ ID NO: 2400606 - DNA, 22 bp, Homo sapiens
agcccttgctctacctggccgg

SEQ ID NO: 2400607 - DNA, 18 bp, Homo sapiens
agccgcttatcctgtttt

SEQ ID NO: 2400608 - DNA, 16 bp, Homo sapiens
agccgcttccccagct

SEQ ID NO: 2400609 - DNA, 20 bp, Homo sapiens
agccgcttccccagctcaga

SEQ ID NO: 2400610 - DNA, 12 bp, Homo sapiens
agccgggcatgg

SEQ ID NO: 2400611 - DNA, 19 bp, Homo sapiens
agcctatatttcctcttct

SEQ ID NO: 2400612 - DNA, 15 bp, Homo sapiens
agcctcagtgccact

SEQ ID NO: 2400613 - DNA, 18 bp, Homo sapiens
agcctcagtgccacttga

SEQ ID NO: 2400614 - DNA, 15 bp, Homo sapiens
agcctccctttgcca

SEQ ID NO: 2400615 - DNA, 19 bp, Homo sapiens
agcctccctttgccagcca

SEQ ID NO: 2400616 - DNA, 15 bp, Homo sapiens
agcctctctgctata

SEQ ID NO: 2400617 - DNA, 20 bp, Homo sapiens
agcctgccaggccctccagc

SEQ ID NO: 2400618 - DNA, 20 bp, Homo sapiens
agcctggcttttctggctgg

SEQ ID NO: 2400619 - DNA, 14 bp, Homo sapiens
agcctgggctcctc

SEQ ID NO: 2400620 - DNA, 18 bp, Homo sapiens
gctctggccaccctggcc

SEQ ID NO: 2400621 - DNA, 15 bp, Homo sapiens
gctctgtcctctgtc

SEQ ID NO: 2400622 - DNA, 13 bp, Homo sapiens
gctctgtggcctt

SEQ ID NO: 2400623 - DNA, 23 bp, Homo sapiens
gctgagcacagacggaggaagcc

SEQ ID NO: 2400624 - DNA, 15 bp, Homo sapiens
gctgagtcacctcct

SEQ ID NO: 2400625 - DNA, 14 bp, Homo sapiens
gctgcacattcctg

SEQ ID NO: 2400626 - DNA, 19 bp, Homo sapiens
gctgcacattcctggcccc

SEQ ID NO: 2400627 - DNA, 21 bp, Homo sapiens
gctgccaagcactcgagacca

SEQ ID NO: 2400628 - DNA, 21 bp, Homo sapiens
gctgcgtccctgctcagccca

SEQ ID NO: 2400629 - DNA, 17 bp, Homo sapiens
gctgctactacccgagc

SEQ ID NO: 2400630 - DNA, 23 bp, Homo sapiens
gctgctactacccgagcccagct

SEQ ID NO: 2400631 - DNA, 16 bp, Homo sapiens
gctgctgccccctggc

SEQ ID NO: 2400632 - DNA, 17 bp, Homo sapiens
gctggagaccagaacag

SEQ ID NO: 2400633 - DNA, 20 bp, Homo sapiens
gctggagccgcttccccagc

SEQ ID NO: 2400634 - DNA, 16 bp, Homo sapiens
gctggcccagtgggta

SEQ ID NO: 2400635 - DNA, 12 bp, Homo sapiens
gctgggacccct

SEQ ID NO: 2400636 - DNA, 19 bp, Homo sapiens
gctgtccattgccacggcc

SEQ ID NO: 2400637 - DNA, 13 bp, Homo sapiens
gctgtcggtgttt

SEQ ID NO: 2400638 - DNA, 23 bp, Homo sapiens
gctgtcggtgtttggaggctgct

SEQ ID NO: 2400639 - DNA, 12 bp, Homo sapiens
gctgtgggtggg

SEQ ID NO: 2400640 - DNA, 23 bp, Homo sapiens
gctgtgtatgtgaaccacccatg

SEQ ID NO: 2400641 - DNA, 19 bp, Homo sapiens
gctgttcatggcaagtggg

SEQ ID NO: 2400642 - DNA, 23 bp, Homo sapiens
gcttatcctgttttcatggacag

SEQ ID NO: 2400643 - DNA, 13 bp, Homo sapiens
gcttccccagctc

SEQ ID NO: 2400644 - DNA, 20 bp, Homo sapiens
gcttcctgggcagttggggc

SEQ ID NO: 2400645 - DNA, 19 bp, Homo sapiens
gctttccatctgaggacca

SEQ ID NO: 2400646 - DNA, 21 bp, Homo sapiens
gctttctttggtaggtaaatc

SEQ ID NO: 2400647 - DNA, 20 bp, Homo sapiens
gctttttctctgcttccagt

SEQ ID NO: 2400648 - DNA, 15 bp, Homo sapiens
ggaaaggggcgagca

SEQ ID NO: 2400649 - DNA, 21 bp, Homo sapiens
gacccccatcgctctgagcat

SEQ ID NO: 2400650 - DNA, 14 bp, Homo sapiens
gaccctcttctctg

SEQ ID NO: 2400651 - DNA, 17 bp, Homo sapiens
gaccctcttctctgggc

SEQ ID NO: 2400652 - DNA, 21 bp, Homo sapiens
gaccctgcctgagcccaggag

SEQ ID NO: 2400653 - DNA, 15 bp, Homo sapiens
gacctcagctgcaca

SEQ ID NO: 2400654 - DNA, 16 bp, Homo sapiens
gacctcagctgcacat

SEQ ID NO: 2400655 - DNA, 17 bp, Homo sapiens
gacctcagctgcacatt

SEQ ID NO: 2400656 - DNA, 19 bp, Homo sapiens
gacctcagctgcacattcc

SEQ ID NO: 2400657 - DNA, 23 bp, Homo sapiens
gacctcagctgcacattcctggc

SEQ ID NO: 2400658 - DNA, 14 bp, Homo sapiens
gaccttccacaaag

SEQ ID NO: 2400659 - DNA, 19 bp, Homo sapiens
gaccttgggcaagtccctt

SEQ ID NO: 2400660 - DNA, 19 bp, Homo sapiens
gacgaactggctacagtac

SEQ ID NO: 2400661 - DNA, 14 bp, Homo sapiens
gacgcagcagctgg

SEQ ID NO: 2400662 - DNA, 15 bp, Homo sapiens
gacgcgagaggctct

SEQ ID NO: 2400663 - DNA, 23 bp, Homo sapiens
gacgctgtccattgccacggcca

SEQ ID NO: 2400664 - DNA, 20 bp, Homo sapiens
gactcaatgtccccctcacc

SEQ ID NO: 2400665 - DNA, 18 bp, Homo sapiens
gactccaggatcctcctg

SEQ ID NO: 2400666 - DNA, 19 bp, Homo sapiens
gactcctcccttccccact

SEQ ID NO: 2400667 - DNA, 13 bp, Homo sapiens
gagaccctcttct

SEQ ID NO: 2400668 - DNA, 19 bp, Homo sapiens
gagacctgaaggacctccc

SEQ ID NO: 2400669 - DNA, 14 bp, Homo sapiens
gagagaatctgcct

SEQ ID NO: 2400670 - DNA, 15 bp, Homo sapiens
gagagcagcctggcc

SEQ ID NO: 2400671 - DNA, 12 bp, Homo sapiens
ctccagcctggg

SEQ ID NO: 2400672 - DNA, 13 bp, Homo sapiens
ctccagcctgggt

SEQ ID NO: 2400673 - DNA, 14 bp, Homo sapiens
ctccagcctgggtg

SEQ ID NO: 2400674 - DNA, 15 bp, Homo sapiens
ctccagcctgggtga

SEQ ID NO: 2400675 - DNA, 16 bp, Homo sapiens
ctccaggatcctcctg

SEQ ID NO: 2400676 - DNA, 13 bp, Homo sapiens
ctccatggccacc

SEQ ID NO: 2400677 - DNA, 22 bp, Homo sapiens
ctccatggccaccccgtgccac

SEQ ID NO: 2400678 - DNA, 21 bp, Homo sapiens
ctcccatggtgcccgtgcctc

SEQ ID NO: 2400679 - DNA, 15 bp, Homo sapiens
ctcccattcaagatt

SEQ ID NO: 2400680 - DNA, 13 bp, Homo sapiens
ctccccagccccc

SEQ ID NO: 2400681 - DNA, 15 bp, Homo sapiens
ctccccctgtgtggc

SEQ ID NO: 2400682 - DNA, 12 bp, Homo sapiens
ctcccttcccca

SEQ ID NO: 2400683 - DNA, 14 bp, Homo sapiens
ctcccttccccact

SEQ ID NO: 2400684 - DNA, 17 bp, Homo sapiens
ctccctttaagccaaga

SEQ ID NO: 2400685 - DNA, 20 bp, Homo sapiens
cacctcctccactcactcca

SEQ ID NO: 2400686 - DNA, 22 bp, Homo sapiens
cacctcctccactcactccagc

SEQ ID NO: 2400687 - DNA, 17 bp, Homo sapiens
cacctgccaggcctccc

SEQ ID NO: 2400688 - DNA, 17 bp, Homo sapiens
cacctgtcaccttttct

SEQ ID NO: 2400689 - DNA, 22 bp, Homo sapiens
caccttatctatgatgtttctt

SEQ ID NO: 2400690 - DNA, 13 bp, Homo sapiens
caccttccaagga

SEQ ID NO: 2400691 - DNA, 13 bp, Homo sapiens
cacgccagctggc

SEQ ID NO: 2400692 - DNA, 22 bp, Homo sapiens
cacgccagctggcccagtgggt

SEQ ID NO: 2400693 - DNA, 15 bp, Homo sapiens
cacgcccctccccag

SEQ ID NO: 2400694 - DNA, 14 bp, Homo sapiens
ccctgtgactcctc

SEQ ID NO: 2400695 - DNA, 15 bp, Homo sapiens
ccctgtgactcctcc

SEQ ID NO: 2400696 - DNA, 17 bp, Homo sapiens
ccctgtgtggccctgga

SEQ ID NO: 2400697 - DNA, 20 bp, Homo sapiens
cccttaaacagttgcacagc

SEQ ID NO: 2400698 - DNA, 21 bp, Homo sapiens
cccttaaacagttgcacagca

SEQ ID NO: 2400699 - DNA, 15 bp, Homo sapiens
cccttccccactctg

SEQ ID NO: 2400700 - DNA, 14 bp, Homo sapiens
tgccaggcctccct

SEQ ID NO: 2400701 - DNA, 14 bp, Homo sapiens
tgcccacgcccctc

SEQ ID NO: 2400702 - DNA, 21 bp, Homo sapiens
tgcccacgtgcagcacctgtc

SEQ ID NO: 2400703 - DNA, 16 bp, Homo sapiens
tgcccctggccctgcc

SEQ ID NO: 2400704 - DNA, 18 bp, Homo sapiens
tgcccgccagcctcagtg

SEQ ID NO: 2400705 - DNA, 22 bp, Homo sapiens
tgcccgccagcctcagtgccac

SEQ ID NO: 2400706 - DNA, 11 bp, Homo sapiens
tgccctgccat

SEQ ID NO: 2400707 - DNA, 21 bp, Homo sapiens
tgccctggggcatccaccttc

SEQ ID NO: 2400708 - DNA, 12 bp, Homo sapiens
tgcctcactgtg

SEQ ID NO: 2400709 - DNA, 20 bp, Homo sapiens
tgcctcactgtgacctgctc

SEQ ID NO: 2400710 - DNA, 22 bp, Homo sapiens
tgcctcactgtgacctgctcct

SEQ ID NO: 2400711 - DNA, 12 bp, Homo sapiens
tgcctctgtgct

SEQ ID NO: 2400712 - DNA, 23 bp, Homo sapiens
tgcctggcccttgccggggcctg

SEQ ID NO: 2400713 - DNA, 11 bp, Homo sapiens
tgcctggcctg

SEQ ID NO: 2400714 - DNA, 21 bp, Homo sapiens
tgcgccactgcactccagcct

SEQ ID NO: 2400715 - DNA, 21 bp, Homo sapiens
tgcgtccactttcccttcccc

SEQ ID NO: 2400716 - DNA, 16 bp, Homo sapiens
tgcgtccctgctcagc

SEQ ID NO: 2400717 - DNA, 21 bp, Homo sapiens
tgctactacccgagcccagct

SEQ ID NO: 2400718 - DNA, 13 bp, Homo sapiens
tgctcagcccatc

SEQ ID NO: 2400719 - DNA, 21 bp, Homo sapiens
tgctcagcccatcccctgcct

SEQ ID NO: 2400720 - DNA, 23 bp, Homo sapiens
tgctcccagcccctaccttgaga

SEQ ID NO: 2400721 - DNA, 12 bp, Homo sapiens
tgctcctgccca

SEQ ID NO: 2400722 - DNA, 14 bp, Homo sapiens
tgctcctgcccacg

SEQ ID NO: 2400723 - DNA, 9 bp, Homo sapiens
tgctcctgg

SEQ ID NO: 2400724 - DNA, 20 bp, Homo sapiens
tgctccttcctgtggcctca

SEQ ID NO: 2400725 - DNA, 14 bp, Homo sapiens
tgctctgtggcctt

SEQ ID NO: 2400726 - DNA, 14 bp, Homo sapiens
tgcttgctgtgtga

SEQ ID NO: 2400727 - DNA, 13 bp, Homo sapiens
tggaaacaagatg

SEQ ID NO: 2400728 - DNA, 14 bp, Homo sapiens
tggacacagcccac

SEQ ID NO: 2400729 - DNA, 23 bp, Homo sapiens
tggacaccacccagagcaccctc

SEQ ID NO: 2400730 - DNA, 14 bp, Homo sapiens
tggactgcacaggc

SEQ ID NO: 2400731 - DNA, 19 bp, Homo sapiens
tggagcaacctactgtcta

SEQ ID NO: 2400732 - DNA, 17 bp, Homo sapiens
tggagcagcagctgagg

SEQ ID NO: 2400733 - DNA, 17 bp, Homo sapiens
tggagccgcttccccag

SEQ ID NO: 2400734 - DNA, 20 bp, Homo sapiens
tggagccgcttccccagctc

SEQ ID NO: 2400735 - DNA, 21 bp, Homo sapiens
tggagccgcttccccagctca

SEQ ID NO: 2400736 - DNA, 13 bp, Homo sapiens
tggagcctgcagg

SEQ ID NO: 2400737 - DNA, 12 bp, Homo sapiens
tggaggctgctg

SEQ ID NO: 2400738 - DNA, 12 bp, Homo sapiens
tggcaagtgggg

SEQ ID NO: 2400739 - DNA, 16 bp, Homo sapiens
tggccaccccgtgcca

SEQ ID NO: 2400740 - DNA, 17 bp, Homo sapiens
tggccaccccgtgccac

SEQ ID NO: 2400741 - DNA, 18 bp, Homo sapiens
tggccaccccgtgccacc

SEQ ID NO: 2400742 - DNA, 14 bp, Homo sapiens
tggccaccctggcc

SEQ ID NO: 2400743 - DNA, 16 bp, Homo sapiens
tggccaccctggcccg

SEQ ID NO: 2400744 - DNA, 12 bp, Homo sapiens
tggccacctgcc

SEQ ID NO: 2400745 - DNA, 19 bp, Homo sapiens
tggccactgggtctcactc

SEQ ID NO: 2400746 - DNA, 22 bp, Homo sapiens
tggccactgggtctcactcctg

SEQ ID NO: 2400747 - DNA, 23 bp, Homo sapiens
tggccactgggtctcactcctga

SEQ ID NO: 2400748 - DNA, 17 bp, Homo sapiens
tggcccaagctgggctc

SEQ ID NO: 2400749 - DNA, 18 bp, Homo sapiens
tggccccgggctctggcc

SEQ ID NO: 2400750 - DNA, 20 bp, Homo sapiens
tggccccgggctctggccac

SEQ ID NO: 2400751 - DNA, 23 bp, Homo sapiens
tggccccgggctctggccaccct

SEQ ID NO: 2400752 - DNA, 14 bp, Homo sapiens
tggcccgaagcgtg

SEQ ID NO: 2400753 - DNA, 15 bp, Homo sapiens
tggcccgaagcgtgc

SEQ ID NO: 2400754 - DNA, 21 bp, Homo sapiens
tggcccgaagcgtgcggggcc

SEQ ID NO: 2400755 - DNA, 15 bp, Homo sapiens
tggccctgcctcact

SEQ ID NO: 2400756 - DNA, 19 bp, Homo sapiens
tggccctggacacagccca

SEQ ID NO: 2400757 - DNA, 18 bp, Homo sapiens
tggccgcaagtccccagc

SEQ ID NO: 2400758 - DNA, 20 bp, Homo sapiens
tggccgcaagtccccagccc

SEQ ID NO: 2400759 - DNA, 22 bp, Homo sapiens
tggccgcaagtccccagcccct

SEQ ID NO: 2400760 - DNA, 16 bp, Homo sapiens
tggccggtaggctgct

SEQ ID NO: 2400761 - DNA, 19 bp, Homo sapiens
tggcctgagcgcagcgcct

SEQ ID NO: 2400762 - DNA, 22 bp, Homo sapiens
tggccttgcccgccagcctcag

SEQ ID NO: 2400763 - DNA, 17 bp, Homo sapiens
tggcgccccatgggccc

SEQ ID NO: 2400764 - DNA, 21 bp, Homo sapiens
tggcgccccatgggccctcag

SEQ ID NO: 2400765 - DNA, 22 bp, Homo sapiens
tggcttgtacatttttaaattc

SEQ ID NO: 2400766 - DNA, 17 bp, Homo sapiens
tggctttggcgccccat

SEQ ID NO: 2400767 - DNA, 16 bp, Homo sapiens
gccagcctcagtgcca

SEQ ID NO: 2400768 - DNA, 17 bp, Homo sapiens
gccagcgcagcgccagg

SEQ ID NO: 2400769 - DNA, 20 bp, Homo sapiens
gccagcgcagcgccagggct

SEQ ID NO: 2400770 - DNA, 13 bp, Homo sapiens
gccagctggccca

SEQ ID NO: 2400771 - DNA, 21 bp, Homo sapiens
gccagctggcccagtgggtag

SEQ ID NO: 2400772 - DNA, 14 bp, Homo sapiens
gccaggccctccag

SEQ ID NO: 2400773 - DNA, 17 bp, Homo sapiens
gccaggcctccctcggg

SEQ ID NO: 2400774 - DNA, 20 bp, Homo sapiens
gccagggctcagatggggcc

SEQ ID NO: 2400775 - DNA, 23 bp, Homo sapiens
gccagggctcagatggggcctgg

SEQ ID NO: 2400776 - DNA, 21 bp, Homo sapiens
gccatgcccacgcccctcccc

SEQ ID NO: 2400777 - DNA, 16 bp, Homo sapiens
gcccaagctgggctcc

SEQ ID NO: 2400778 - DNA, 19 bp, Homo sapiens
gcccaagctgggctccctt

SEQ ID NO: 2400779 - DNA, 18 bp, Homo sapiens
gcccaatgaggtggctca

SEQ ID NO: 2400780 - DNA, 19 bp, Homo sapiens
gcccacattagggggtttg

SEQ ID NO: 2400781 - DNA, 19 bp, Homo sapiens
gcccacgccagctggccca

SEQ ID NO: 2400782 - DNA, 18 bp, Homo sapiens
gcccacgcccctccccag

SEQ ID NO: 2400783 - DNA, 13 bp, Homo sapiens
gcccacgtgcagc

SEQ ID NO: 2400784 - DNA, 15 bp, Homo sapiens
gcccacgtgcagcac

SEQ ID NO: 2400785 - DNA, 17 bp, Homo sapiens
gcccagataaggcttta

SEQ ID NO: 2400786 - DNA, 21 bp, Homo sapiens
gcccagctacattcctcagct

SEQ ID NO: 2400787 - DNA, 20 bp, Homo sapiens
gcccaggagctgagtcacct

SEQ ID NO: 2400788 - DNA, 21 bp, Homo sapiens
gcccaggagctgagtcacctc

SEQ ID NO: 2400789 - DNA, 14 bp, Homo sapiens
gcccaggccctaga

SEQ ID NO: 2400790 - DNA, 18 bp, Homo sapiens
gcccaggggacgtggcgc

SEQ ID NO: 2400791 - DNA, 16 bp, Homo sapiens
gcccatcccctgcctc

SEQ ID NO: 2400792 - DNA, 23 bp, Homo sapiens
gcccattcgtctgtcccagagct

SEQ ID NO: 2400793 - DNA, 22 bp, Homo sapiens
gccccactcctgtcagcccctc

SEQ ID NO: 2400794 - DNA, 19 bp, Homo sapiens
gccccatgggccctcagcg

SEQ ID NO: 2400795 - DNA, 14 bp, Homo sapiens
gcccccacccatgc

SEQ ID NO: 2400796 - DNA, 20 bp, Homo sapiens
gcccccacccatgccagcgc

SEQ ID NO: 2400797 - DNA, 17 bp, Homo sapiens
gccccgggctctggcca

SEQ ID NO: 2400798 - DNA, 23 bp, Homo sapiens
gcccctaccttgagaccctcttc

SEQ ID NO: 2400799 - DNA, 23 bp, Homo sapiens
gcccctccagaccctgcctgagc

SEQ ID NO: 2400800 - DNA, 17 bp, Homo sapiens
gcccctccccagccccc

SEQ ID NO: 2400801 - DNA, 13 bp, Homo sapiens
agacaaggcatgt

SEQ ID NO: 2400802 - DNA, 13 bp, Homo sapiens
agaccagcctgcc

SEQ ID NO: 2400803 - DNA, 15 bp, Homo sapiens
agaccagcctgccag

SEQ ID NO: 2400804 - DNA, 13 bp, Homo sapiens
agaccatcctggc

SEQ ID NO: 2400805 - DNA, 16 bp, Homo sapiens
agaccatcctggcccc

SEQ ID NO: 2400806 - DNA, 18 bp, Homo sapiens
agaccatcctggcccctc

SEQ ID NO: 2400807 - DNA, 19 bp, Homo sapiens
agaccatcctggcccctcc

SEQ ID NO: 2400808 - DNA, 12 bp, Homo sapiens
agaccctcttct

SEQ ID NO: 2400809 - DNA, 18 bp, Homo sapiens
agaccctcttctctgggc

SEQ ID NO: 2400810 - DNA, 19 bp, Homo sapiens
agaccctcttctctgggcc

SEQ ID NO: 2400811 - DNA, 15 bp, Homo sapiens
agaccctgcctgagc

SEQ ID NO: 2400812 - DNA, 18 bp, Homo sapiens
agacctgaaggacctccc

SEQ ID NO: 2400813 - DNA, 14 bp, Homo sapiens
agacggaggaagcc

SEQ ID NO: 2400814 - DNA, 22 bp, Homo sapiens
agactcaatgtccccctcaccc

SEQ ID NO: 2400815 - DNA, 17 bp, Homo sapiens
agacttagatctgagcc

SEQ ID NO: 2400816 - DNA, 22 bp, Homo sapiens
agacttagatctgagccctccc

SEQ ID NO: 2400817 - DNA, 15 bp, Homo sapiens
agagaggcgtcctgg

SEQ ID NO: 2400818 - DNA, 13 bp, Homo sapiens
agagcaacaagta

SEQ ID NO: 2400819 - DNA, 13 bp, Homo sapiens
agagcagcctggc

SEQ ID NO: 2400820 - DNA, 22 bp, Homo sapiens
agagcctcttgtggaccccgcc

SEQ ID NO: 2400821 - DNA, 15 bp, Homo sapiens
agagctaggctgtgg

SEQ ID NO: 2400822 - DNA, 24 bp, Homo sapiens
agagctaggctgtggagtagagtt

SEQ ID NO: 2400823 - DNA, 17 bp, Homo sapiens
agagcttattggccact

SEQ ID NO: 2400824 - DNA, 18 bp, Homo sapiens
agagcttattggccactg

SEQ ID NO: 2400825 - DNA, 16 bp, Homo sapiens
agaggcgtcctggtga

SEQ ID NO: 2400826 - DNA, 21 bp, Homo sapiens
agaggcgtcctggtgaggaca

SEQ ID NO: 2400827 - DNA, 16 bp, Homo sapiens
agagttaaaatgttta

SEQ ID NO: 2400828 - DNA, 21 bp, Homo sapiens
agagttaaaatgtttactgta

SEQ ID NO: 2400829 - DNA, 20 bp, Homo sapiens
agagtttatacagtgtacat

SEQ ID NO: 2400830 - DNA, 19 bp, Homo sapiens
agatctgagccctccctct

SEQ ID NO: 2400831 - DNA, 17 bp, Homo sapiens
agatcttctgaaatgaa

SEQ ID NO: 2400832 - DNA, 15 bp, Homo sapiens
agatgaaattccatt

SEQ ID NO: 2400833 - DNA, 17 bp, Homo sapiens
agatgaaattccatttg

SEQ ID NO: 2400834 - DNA, 18 bp, Homo sapiens
agatgaaattccatttgt

SEQ ID NO: 2400835 - DNA, 22 bp, Homo sapiens
agatgagatctagacgccccca

SEQ ID NO: 2400836 - DNA, 15 bp, Homo sapiens
agatgcagtgccagg

SEQ ID NO: 2400837 - DNA, 13 bp, Homo sapiens
agatggggcctgg

SEQ ID NO: 2400838 - DNA, 14 bp, Homo sapiens
agatgtctatattg

SEQ ID NO: 2400839 - DNA, 20 bp, Homo sapiens
agattttctgggataacagt

SEQ ID NO: 2400840 - DNA, 23 bp, Homo sapiens
agcacccacgtgagagaatctgc

SEQ ID NO: 2400841 - DNA, 15 bp, Homo sapiens
agcacctgtcacctt

SEQ ID NO: 2400842 - DNA, 19 bp, Homo sapiens
agcactcgagaccatcctg

SEQ ID NO: 2400843 - DNA, 22 bp, Homo sapiens
agcactttgggaagctgaggca

SEQ ID NO: 2400844 - DNA, 13 bp, Homo sapiens
agcagcctggcca

SEQ ID NO: 2400845 - DNA, 21 bp, Homo sapiens
agcaggaggacagagtgccct

SEQ ID NO: 2400846 - DNA, 17 bp, Homo sapiens
agcagggaaggctggtc

SEQ ID NO: 2400847 - DNA, 13 bp, Homo sapiens
agcagtgttagct

SEQ ID NO: 2400848 - DNA, 19 bp, Homo sapiens
agcatatgttccatgcctg

SEQ ID NO: 2400849 - DNA, 22 bp, Homo sapiens
agcatatgttccatgcctggcc

SEQ ID NO: 2400850 - DNA, 15 bp, Homo sapiens
agcatctcagctcat

SEQ ID NO: 2400851 - DNA, 16 bp, Homo sapiens
agccacccctcctcta

SEQ ID NO: 2400852 - DNA, 22 bp, Homo sapiens
agccacccctcctctagctctg

SEQ ID NO: 2400853 - DNA, 14 bp, Homo sapiens
agcccaccctctgt

SEQ ID NO: 2400854 - DNA, 16 bp, Homo sapiens
agcccatcccctgcct

SEQ ID NO: 2400855 - DNA, 18 bp, Homo sapiens
agcccatcccctgcctct

SEQ ID NO: 2400856 - DNA, 19 bp, Homo sapiens
agcccatcccctgcctcta

SEQ ID NO: 2400857 - DNA, 19 bp, Homo sapiens
agcccccacccatgccagc

SEQ ID NO: 2400858 - DNA, 15 bp, Homo sapiens
agccccgccccaccc

SEQ ID NO: 2400859 - DNA, 21 bp, Homo sapiens
agccctccctcttcccagcac

SEQ ID NO: 2400860 - DNA, 22 bp, Homo sapiens
agccctccctcttcccagcaca

SEQ ID NO: 2400861 - DNA, 18 bp, Homo sapiens
agcccttgctctacctgg

SEQ ID NO: 2400862 - DNA, 19 bp, Homo sapiens
agcccttgctctacctggc

SEQ ID NO: 2400863 - DNA, 20 bp, Homo sapiens
agccgggcatggtggcatgt

SEQ ID NO: 2400864 - DNA, 16 bp, Homo sapiens
agcctatatttcctct

SEQ ID NO: 2400865 - DNA, 18 bp, Homo sapiens
agcctatatttcctcttc

SEQ ID NO: 2400866 - DNA, 13 bp, Homo sapiens
agcctcagtgcca

SEQ ID NO: 2400867 - DNA, 14 bp, Homo sapiens
agcctcagtgccac

SEQ ID NO: 2400868 - DNA, 14 bp, Homo sapiens
agcctccctttgcc

SEQ ID NO: 2400869 - DNA, 18 bp, Homo sapiens
agcctccctttgccagcc

SEQ ID NO: 2400870 - DNA, 19 bp, Homo sapiens
agcctgccaggccctccag

SEQ ID NO: 2400871 - DNA, 21 bp, Homo sapiens
agcctgccaggccctccagca

SEQ ID NO: 2400872 - DNA, 22 bp, Homo sapiens
agcctggcttttctggctgggg

SEQ ID NO: 2400873 - DNA, 11 bp, Homo sapiens
agcctgggctc

SEQ ID NO: 2400874 - DNA, 15 bp, Homo sapiens
agcgccagggctcag

SEQ ID NO: 2400875 - DNA, 20 bp, Homo sapiens
agcgcctccaccctgccctg

SEQ ID NO: 2400876 - DNA, 16 bp, Homo sapiens
agcgtctccccatgct

SEQ ID NO: 2400877 - DNA, 19 bp, Homo sapiens
agcgtctccccatgctggg

SEQ ID NO: 2400878 - DNA, 22 bp, Homo sapiens
agcgtctccccatgctgggctc

SEQ ID NO: 2400879 - DNA, 23 bp, Homo sapiens
agcgtctccccatgctgggctca

SEQ ID NO: 2400880 - DNA, 13 bp, Homo sapiens
agctacattcctc

SEQ ID NO: 2400881 - DNA, 16 bp, Homo sapiens
agctacattcctcagc

SEQ ID NO: 2400882 - DNA, 22 bp, Homo sapiens
agctactcatgaggctgaggca

SEQ ID NO: 2400883 - DNA, 22 bp, Homo sapiens
agctcagagccccgccccaccc

SEQ ID NO: 2400884 - DNA, 19 bp, Homo sapiens
agctctggtgggaggcccg

SEQ ID NO: 2400885 - DNA, 23 bp, Homo sapiens
agctgaggccccagggctgtggg

SEQ ID NO: 2400886 - DNA, 14 bp, Homo sapiens
agctgagtcacctc

SEQ ID NO: 2400887 - DNA, 18 bp, Homo sapiens
agctgagtcacctcctcc

SEQ ID NO: 2400888 - DNA, 20 bp, Homo sapiens
agctgagtcacctcctccac

SEQ ID NO: 2400889 - DNA, 18 bp, Homo sapiens
agctgcacattcctggcc

SEQ ID NO: 2400890 - DNA, 15 bp, Homo sapiens
agctgggacccctcc

SEQ ID NO: 2400891 - DNA, 20 bp, Homo sapiens
agcttattggccactgggtc

SEQ ID NO: 2400892 - DNA, 21 bp, Homo sapiens
agctttcccctctgaataaat

SEQ ID NO: 2400893 - DNA, 19 bp, Homo sapiens
aggaaaggggcgagcaccc

SEQ ID NO: 2400894 - DNA, 20 bp, Homo sapiens
aggaaggcgtgtccaggaga

SEQ ID NO: 2400895 - DNA, 21 bp, Homo sapiens
aggaaggcgtgtccaggagac

SEQ ID NO: 2400896 - DNA, 14 bp, Homo sapiens
aggacaaggtacag

SEQ ID NO: 2400897 - DNA, 20 bp, Homo sapiens
aggacagagtgccctggggc

SEQ ID NO: 2400898 - DNA, 15 bp, Homo sapiens
aggacatttggtttt

SEQ ID NO: 2400899 - DNA, 18 bp, Homo sapiens
aggactccgggaccattg

SEQ ID NO: 2400900 - DNA, 20 bp, Homo sapiens
aggagaatggcgtgaacccg

SEQ ID NO: 2400901 - DNA, 15 bp, Homo sapiens
aggaggtgggtgagc

SEQ ID NO: 2400902 - DNA, 21 bp, Homo sapiens
aggagttcagcggagctagca

SEQ ID NO: 2400903 - DNA, 21 bp, Homo sapiens
aggagttcgagagcagcctgg

SEQ ID NO: 2400904 - DNA, 14 bp, Homo sapiens
aggcagcctctctg

SEQ ID NO: 2400905 - DNA, 18 bp, Homo sapiens
aggcaggaggtgggtgag

SEQ ID NO: 2400906 - DNA, 20 bp, Homo sapiens
aggccaatcccttctccact

SEQ ID NO: 2400907 - DNA, 18 bp, Homo sapiens
aggcctccctcgggctgg

SEQ ID NO: 2400908 - DNA, 10 bp, Homo sapiens
aggctgctgc

SEQ ID NO: 2400909 - DNA, 11 bp, Homo sapiens
aggctgctgcc

SEQ ID NO: 2400910 - DNA, 12 bp, Homo sapiens
aggctgctgccc

SEQ ID NO: 2400911 - DNA, 14 bp, Homo sapiens
aggctgctggcgcc

SEQ ID NO: 2400912 - DNA, 15 bp, Homo sapiens
aggctgctggcgcct

SEQ ID NO: 2400913 - DNA, 16 bp, Homo sapiens
agggaaggctggtctc

SEQ ID NO: 2400914 - DNA, 17 bp, Homo sapiens
agggaggaacacctgat

SEQ ID NO: 2400915 - DNA, 20 bp, Homo sapiens
agggcatctcaatggcatgg

SEQ ID NO: 2400916 - DNA, 13 bp, Homo sapiens
agggcatgcctgg

SEQ ID NO: 2400917 - DNA, 14 bp, Homo sapiens
ccaccccgtcctga

SEQ ID NO: 2400918 - DNA, 16 bp, Homo sapiens
ccaccccgtgccaccc

SEQ ID NO: 2400919 - DNA, 16 bp, Homo sapiens
ccaccctgccctgctg

SEQ ID NO: 2400920 - DNA, 12 bp, Homo sapiens
ccaccctggccc

SEQ ID NO: 2400921 - DNA, 23 bp, Homo sapiens
ccacctccacccccgccacggcc

SEQ ID NO: 2400922 - DNA, 15 bp, Homo sapiens
ccacctgccaggcct

SEQ ID NO: 2400923 - DNA, 14 bp, Homo sapiens
ccaccttcctgccc

SEQ ID NO: 2400924 - DNA, 17 bp, Homo sapiens
ccaccttcctgcccagg

SEQ ID NO: 2400925 - DNA, 13 bp, Homo sapiens
ccacgccagctgg

SEQ ID NO: 2400926 - DNA, 18 bp, Homo sapiens
ccacgccagctggcccag

SEQ ID NO: 2400927 - DNA, 20 bp, Homo sapiens
ccacgcccctccccagcccc

SEQ ID NO: 2400928 - DNA, 12 bp, Homo sapiens
ccacggccaccc

SEQ ID NO: 2400929 - DNA, 14 bp, Homo sapiens
ccacggccaccctc

SEQ ID NO: 2400930 - DNA, 16 bp, Homo sapiens
ccacggccaccctcct

SEQ ID NO: 2400931 - DNA, 17 bp, Homo sapiens
ccacggccaccctcctt

SEQ ID NO: 2400932 - DNA, 14 bp, Homo sapiens
ccactaataaagtg

SEQ ID NO: 2400933 - DNA, 14 bp, Homo sapiens
ccactcactccagc

SEQ ID NO: 2400934 - DNA, 14 bp, Homo sapiens
ccactctgctccca

SEQ ID NO: 2400935 - DNA, 15 bp, Homo sapiens
ccactctgctcccag

SEQ ID NO: 2400936 - DNA, 20 bp, Homo sapiens
ccactgggtctcactcctga

SEQ ID NO: 2400937 - DNA, 20 bp, Homo sapiens
ccactttcccttcccctgtg

SEQ ID NO: 2400938 - DNA, 23 bp, Homo sapiens
ccactttcccttcccctgtgact

SEQ ID NO: 2400939 - DNA, 14 bp, Homo sapiens
ccagaatcccctgg

SEQ ID NO: 2400940 - DNA, 12 bp, Homo sapiens
ccagaccctgcc

SEQ ID NO: 2400941 - DNA, 14 bp, Homo sapiens
ccagaccctgcctg

SEQ ID NO: 2400942 - DNA, 19 bp, Homo sapiens
ccagagagaggcgtcctgg

SEQ ID NO: 2400943 - DNA, 22 bp, Homo sapiens
ccagagagaggcgtcctggtga

SEQ ID NO: 2400944 - DNA, 14 bp, Homo sapiens
ccagagcaccctct

SEQ ID NO: 2400945 - DNA, 17 bp, Homo sapiens
ccagagcttattggcca

SEQ ID NO: 2400946 - DNA, 22 bp, Homo sapiens
ccagagcttattggccactggg

SEQ ID NO: 2400947 - DNA, 22 bp, Homo sapiens
ccagagttaaaatgtttactgt

SEQ ID NO: 2400948 - DNA, 13 bp, Homo sapiens
ccagcaacatctc

SEQ ID NO: 2400949 - DNA, 19 bp, Homo sapiens
ccagcactttgggaagctg

SEQ ID NO: 2400950 - DNA, 23 bp, Homo sapiens
ccagcactttgggaagctgaggc

SEQ ID NO: 2400951 - DNA, 16 bp, Homo sapiens
ccagcaggaggacaga

SEQ ID NO: 2400952 - DNA, 20 bp, Homo sapiens
ccagccacccctcctctagc

SEQ ID NO: 2400953 - DNA, 22 bp, Homo sapiens
ccagccacccctcctctagctc

SEQ ID NO: 2400954 - DNA, 22 bp, Homo sapiens
ccagcccccacccatgccagcg

SEQ ID NO: 2400955 - DNA, 22 bp, Homo sapiens
ccagcccctaccttgagaccct

SEQ ID NO: 2400956 - DNA, 20 bp, Homo sapiens
ccagcccttgctctacctgg

SEQ ID NO: 2400957 - DNA, 19 bp, Homo sapiens
ccagcctatatttcctctt

SEQ ID NO: 2400958 - DNA, 15 bp, Homo sapiens
ccagcctcagtgcca

SEQ ID NO: 2400959 - DNA, 19 bp, Homo sapiens
ccagcctcagtgccacttg

SEQ ID NO: 2400960 - DNA, 12 bp, Homo sapiens
ccagcctgccag

SEQ ID NO: 2400961 - DNA, 17 bp, Homo sapiens
ccagcctgccaggccct

SEQ ID NO: 2400962 - DNA, 13 bp, Homo sapiens
ccagcctgggctc

SEQ ID NO: 2400963 - DNA, 13 bp, Homo sapiens
ccagcctgggtga

SEQ ID NO: 2400964 - DNA, 13 bp, Homo sapiens
ccagctacattcc

SEQ ID NO: 2400965 - DNA, 14 bp, Homo sapiens
ccagctacattcct

SEQ ID NO: 2400966 - DNA, 17 bp, Homo sapiens
ccagctacattcctcag

SEQ ID NO: 2400967 - DNA, 19 bp, Homo sapiens
ccagctacattcctcagct

SEQ ID NO: 2400968 - DNA, 22 bp, Homo sapiens
ccagctacattcctcagctgcc

SEQ ID NO: 2400969 - DNA, 14 bp, Homo sapiens
ccagctcagagccc

SEQ ID NO: 2400970 - DNA, 12 bp, Homo sapiens
ccagctggccca

SEQ ID NO: 2400971 - DNA, 13 bp, Homo sapiens
ccagctggcccag

SEQ ID NO: 2400972 - DNA, 19 bp, Homo sapiens
ccagctttccatctgagga

SEQ ID NO: 2400973 - DNA, 22 bp, Homo sapiens
ccaggagctgagtcacctcctc

SEQ ID NO: 2400974 - DNA, 23 bp, Homo sapiens
ccaggagctgagtcacctcctcc

SEQ ID NO: 2400975 - DNA, 12 bp, Homo sapiens
ccaggccaatcc

SEQ ID NO: 2400976 - DNA, 19 bp, Homo sapiens
ccaggccacgggaccttct

SEQ ID NO: 2400977 - DNA, 18 bp, Homo sapiens
ccaggccctagaccctcc

SEQ ID NO: 2400978 - DNA, 15 bp, Homo sapiens
ccaggccctccagca

SEQ ID NO: 2400979 - DNA, 13 bp, Homo sapiens
ccaggcctccctc

SEQ ID NO: 2400980 - DNA, 14 bp, Homo sapiens
ccaggcctccctcg

SEQ ID NO: 2400981 - DNA, 21 bp, Homo sapiens
ccatagatcttctgaaatgaa

SEQ ID NO: 2400982 - DNA, 14 bp, Homo sapiens
ccatcccctgcctc

SEQ ID NO: 2400983 - DNA, 18 bp, Homo sapiens
ccatcctctcccttctta

SEQ ID NO: 2400984 - DNA, 19 bp, Homo sapiens
ccatcctggcccctccaga

SEQ ID NO: 2400985 - DNA, 16 bp, Homo sapiens
ccatcgctctgagcat

SEQ ID NO: 2400986 - DNA, 21 bp, Homo sapiens
ccatcttccctacccttcctg

SEQ ID NO: 2400987 - DNA, 22 bp, Homo sapiens
ccatcttccctacccttcctgc

SEQ ID NO: 2400988 - DNA, 16 bp, Homo sapiens
ccatgagggctggaga

SEQ ID NO: 2400989 - DNA, 20 bp, Homo sapiens
ccatgagggctggagaccag

SEQ ID NO: 2400990 - DNA, 19 bp, Homo sapiens
ccatgcccacgcccctccc

SEQ ID NO: 2400991 - DNA, 12 bp, Homo sapiens
ccatgcctggcc

SEQ ID NO: 2400992 - DNA, 14 bp, Homo sapiens
ccatgcctggccct

SEQ ID NO: 2400993 - DNA, 15 bp, Homo sapiens
ccatgcctggccctt

SEQ ID NO: 2400994 - DNA, 16 bp, Homo sapiens
ccatgctgggctcact

SEQ ID NO: 2400995 - DNA, 22 bp, Homo sapiens
ccatgctgggctcactacatgg

SEQ ID NO: 2400996 - DNA, 12 bp, Homo sapiens
ccatggccaccc

SEQ ID NO: 2400997 - DNA, 14 bp, Homo sapiens
ccatgggccctcag

SEQ ID NO: 2400998 - DNA, 15 bp, Homo sapiens
ccatgtgagggaata

SEQ ID NO: 2400999 - DNA, 20 bp, Homo sapiens
ccattaagtaaacaataaaa

SEQ ID NO: 2401000 - DNA, 14 bp, Homo sapiens
ccattagttgagaa

SEQ ID NO: 2401001 - DNA, 20 bp, Homo sapiens
ccattagttgagaaagtcac

SEQ ID NO: 2401002 - DNA, 19 bp, Homo sapiens
ccattcgtctgtcccagag

SEQ ID NO: 2401003 - DNA, 13 bp, Homo sapiens
ccattgacctcag

SEQ ID NO: 2401004 - DNA, 15 bp, Homo sapiens
ccattgacctcagct

SEQ ID NO: 2401005 - DNA, 23 bp, Homo sapiens
ccattgccacggccatgagggct

SEQ ID NO: 2401006 - DNA, 22 bp, Homo sapiens
ccatttgaattttttagtgact

SEQ ID NO: 2401007 - DNA, 15 bp, Homo sapiens
cccaacctcaatgcc

SEQ ID NO: 2401008 - DNA, 21 bp, Homo sapiens
cccaacctcaatgccctgcca

SEQ ID NO: 2401009 - DNA, 23 bp, Homo sapiens
cccaatgaggtggctcatgcctg

SEQ ID NO: 2401010 - DNA, 14 bp, Homo sapiens
cccaccaactctgc

SEQ ID NO: 2401011 - DNA, 15 bp, Homo sapiens
cccaccaactctgca

SEQ ID NO: 2401012 - DNA, 18 bp, Homo sapiens
cccaccattccacatccc

SEQ ID NO: 2401013 - DNA, 13 bp, Homo sapiens
cccacccatgcca

SEQ ID NO: 2401014 - DNA, 18 bp, Homo sapiens
cccacgcccctccccagc

SEQ ID NO: 2401015 - DNA, 21 bp, Homo sapiens
cccacgtgcagcacctgtcac

SEQ ID NO: 2401016 - DNA, 18 bp, Homo sapiens
cccactctgctcccagcc

SEQ ID NO: 2401017 - DNA, 19 bp, Homo sapiens
cccactctgctcccagccc

SEQ ID NO: 2401018 - DNA, 23 bp, Homo sapiens
cccagagagaggcgtcctggtga

SEQ ID NO: 2401019 - DNA, 19 bp, Homo sapiens
cccagagcttattggccac

SEQ ID NO: 2401020 - DNA, 22 bp, Homo sapiens
cccagagcttattggccactgg

SEQ ID NO: 2401021 - DNA, 23 bp, Homo sapiens
cccagagcttattggccactggg

SEQ ID NO: 2401022 - DNA, 21 bp, Homo sapiens
cccagcacaggcaggggtaga

SEQ ID NO: 2401023 - DNA, 19 bp, Homo sapiens
cccagcccctaccttgaga

SEQ ID NO: 2401024 - DNA, 15 bp, Homo sapiens
cccagcctgggctcc

SEQ ID NO: 2401025 - DNA, 15 bp, Homo sapiens
cccagctacattcct

SEQ ID NO: 2401026 - DNA, 18 bp, Homo sapiens
cccagctacattcctcag

SEQ ID NO: 2401027 - DNA, 21 bp, Homo sapiens
cccagctacattcctcagctg

SEQ ID NO: 2401028 - DNA, 24 bp, Homo sapiens
cccagctacattcctcagctgcca

SEQ ID NO: 2401029 - DNA, 17 bp, Homo sapiens
cccagctcagagccccg

SEQ ID NO: 2401030 - DNA, 19 bp, Homo sapiens
cccagctcagagccccgcc

SEQ ID NO: 2401031 - DNA, 18 bp, Homo sapiens
cccaggagctgagtcacc

SEQ ID NO: 2401032 - DNA, 23 bp, Homo sapiens
cccaggagctgagtcacctcctc

SEQ ID NO: 2401033 - DNA, 13 bp, Homo sapiens
gcaacaagtagag

SEQ ID NO: 2401034 - DNA, 19 bp, Homo sapiens
gcaacatctcgagccccct

SEQ ID NO: 2401035 - DNA, 14 bp, Homo sapiens
gcaagtccccagcc

SEQ ID NO: 2401036 - DNA, 16 bp, Homo sapiens
gcaattggaataatca

SEQ ID NO: 2401037 - DNA, 13 bp, Homo sapiens
gcacagcatctca

SEQ ID NO: 2401038 - DNA, 20 bp, Homo sapiens
gcacagggcatgcctggcct

SEQ ID NO: 2401039 - DNA, 13 bp, Homo sapiens
gcactccagcctg

SEQ ID NO: 2401040 - DNA, 14 bp, Homo sapiens
gcactccagcctgg

SEQ ID NO: 2401041 - DNA, 17 bp, Homo sapiens
gcactccagcctgggtg

SEQ ID NO: 2401042 - DNA, 13 bp, Homo sapiens
gcactccatggcc

SEQ ID NO: 2401043 - DNA, 21 bp, Homo sapiens
gcactcgagaccatcctggcc

SEQ ID NO: 2401044 - DNA, 20 bp, Homo sapiens
gcactttgggaagctgaggc

SEQ ID NO: 2401045 - DNA, 18 bp, Homo sapiens
gcagacgcagcagctggg

SEQ ID NO: 2401046 - DNA, 21 bp, Homo sapiens
gcagcagctgggacccctccc

SEQ ID NO: 2401047 - DNA, 17 bp, Homo sapiens
gcaggagtgctgccctc

SEQ ID NO: 2401048 - DNA, 15 bp, Homo sapiens
gcaggtgggggctgc

SEQ ID NO: 2401049 - DNA, 22 bp, Homo sapiens
gcaggtgggggctgcgtccctg

SEQ ID NO: 2401050 - DNA, 14 bp, Homo sapiens
gcagtgttagctta

SEQ ID NO: 2401051 - DNA, 12 bp, Homo sapiens
gcatagcctttc

SEQ ID NO: 2401052 - DNA, 14 bp, Homo sapiens
gcataggagtgtgt

SEQ ID NO: 2401053 - DNA, 21 bp, Homo sapiens
gcatatgttccatgcctggcc

SEQ ID NO: 2401054 - DNA, 16 bp, Homo sapiens
gcatccaccttcctgc

SEQ ID NO: 2401055 - DNA, 18 bp, Homo sapiens
gcatccaccttcctgccc

SEQ ID NO: 2401056 - DNA, 17 bp, Homo sapiens
gcatctcaatggcatgg

SEQ ID NO: 2401057 - DNA, 15 bp, Homo sapiens
gcatcttgctctgtg

SEQ ID NO: 2401058 - DNA, 19 bp, Homo sapiens
gcatcttgctctgtggcct

SEQ ID NO: 2401059 - DNA, 19 bp, Homo sapiens
gcatggtggcatgtgcctg

SEQ ID NO: 2401060 - DNA, 19 bp, Homo sapiens
gcattccagagttaaaatg

SEQ ID NO: 2401061 - DNA, 18 bp, Homo sapiens
gcattttctgcatctcca

SEQ ID NO: 2401062 - DNA, 15 bp, Homo sapiens
gccaccccgtgccac

SEQ ID NO: 2401063 - DNA, 20 bp, Homo sapiens
gccacccgtaggcagcctct

SEQ ID NO: 2401064 - DNA, 22 bp, Homo sapiens
gccacccgtaggcagcctctct

SEQ ID NO: 2401065 - DNA, 18 bp, Homo sapiens
gccaccctccttcccgcc

SEQ ID NO: 2401066 - DNA, 14 bp, Homo sapiens
gccacctgccaggc

SEQ ID NO: 2401067 - DNA, 21 bp, Homo sapiens
gccacctgccaggcctccctc

SEQ ID NO: 2401068 - DNA, 17 bp, Homo sapiens
gccacggccaccctcct

SEQ ID NO: 2401069 - DNA, 18 bp, Homo sapiens
gccactgggtctcactcc

SEQ ID NO: 2401070 - DNA, 17 bp, Homo sapiens
gccacttgacattcctt

SEQ ID NO: 2401071 - DNA, 23 bp, Homo sapiens
gccacttgacattccttgtcacc

SEQ ID NO: 2401072 - DNA, 21 bp, Homo sapiens
gccagaccaaggcgagtttcc

SEQ ID NO: 2401073 - DNA, 19 bp, Homo sapiens
gccagccatgcccacgccc

SEQ ID NO: 2401074 - DNA, 23 bp, Homo sapiens
gccagcccttgctctacctggcc

SEQ ID NO: 2401075 - DNA, 14 bp, Homo sapiens
gccagcctcagtgc

SEQ ID NO: 2401076 - DNA, 17 bp, Homo sapiens
gccagcctcagtgccac

SEQ ID NO: 2401077 - DNA, 13 bp, Homo sapiens
gccaggccctcca

SEQ ID NO: 2401078 - DNA, 20 bp, Homo sapiens
gccaggcctccctcgggctg

SEQ ID NO: 2401079 - DNA, 23 bp, Homo sapiens
gccagggactaagcagcccagaa

SEQ ID NO: 2401080 - DNA, 16 bp, Homo sapiens
gccagggctcagatgg

SEQ ID NO: 2401081 - DNA, 13 bp, Homo sapiens
gccatgagggctg

SEQ ID NO: 2401082 - DNA, 22 bp, Homo sapiens
gccatgcccacgcccctcccca

SEQ ID NO: 2401083 - DNA, 13 bp, Homo sapiens
gcccaagctgggc

SEQ ID NO: 2401084 - DNA, 23 bp, Homo sapiens
gcccaatgaggtggctcatgcct

SEQ ID NO: 2401085 - DNA, 15 bp, Homo sapiens
gcccacgccagctgg

SEQ ID NO: 2401086 - DNA, 15 bp, Homo sapiens
gcccacgcccctccc

SEQ ID NO: 2401087 - DNA, 21 bp, Homo sapiens
gcccacgcccctccccagccc

SEQ ID NO: 2401088 - DNA, 19 bp, Homo sapiens
gcccacgtgcagcacctgt

SEQ ID NO: 2401089 - DNA, 13 bp, Homo sapiens
gcccagaagccca

SEQ ID NO: 2401090 - DNA, 15 bp, Homo sapiens
gcccagctacattcc

SEQ ID NO: 2401091 - DNA, 18 bp, Homo sapiens
gcccagctacattcctca

SEQ ID NO: 2401092 - DNA, 22 bp, Homo sapiens
gcccagtaactgccctttccct

SEQ ID NO: 2401093 - DNA, 13 bp, Homo sapiens
gcccatcccctgc

SEQ ID NO: 2401094 - DNA, 19 bp, Homo sapiens
gcccatcccctgcctctat

SEQ ID NO: 2401095 - DNA, 23 bp, Homo sapiens
gcccattagttgagaaagtcaca

SEQ ID NO: 2401096 - DNA, 18 bp, Homo sapiens
gcccattcgtctgtccca

SEQ ID NO: 2401097 - DNA, 20 bp, Homo sapiens
gcccattcgtctgtcccaga

SEQ ID NO: 2401098 - DNA, 22 bp, Homo sapiens
gcccattcgtctgtcccagagc

SEQ ID NO: 2401099 - DNA, 16 bp, Homo sapiens
gccccagggctgtggg

SEQ ID NO: 2401100 - DNA, 18 bp, Homo sapiens
gcccccacccatgccagc

SEQ ID NO: 2401101 - DNA, 17 bp, Homo sapiens
gccccgccccaccccgt

SEQ ID NO: 2401102 - DNA, 21 bp, Homo sapiens
gccccggatgacttggggaca

SEQ ID NO: 2401103 - DNA, 20 bp, Homo sapiens
gcccctccagaccctgcctg

SEQ ID NO: 2401104 - DNA, 22 bp, Homo sapiens
gcccctccccagcccccaccca

SEQ ID NO: 2401105 - DNA, 17 bp, Homo sapiens
gcccctggccctgcctc

SEQ ID NO: 2401106 - DNA, 13 bp, Homo sapiens
gcccggggccctt

SEQ ID NO: 2401107 - DNA, 18 bp, Homo sapiens
gccctagaccctccccca

SEQ ID NO: 2401108 - DNA, 20 bp, Homo sapiens
gccctccctcttcccagcac

SEQ ID NO: 2401109 - DNA, 23 bp, Homo sapiens
gccctgcctcactgtgacctgct

SEQ ID NO: 2401110 - DNA, 15 bp, Homo sapiens
gccctggacacagcc

SEQ ID NO: 2401111 - DNA, 23 bp, Homo sapiens
gccctggggcatccaccttcctg

SEQ ID NO: 2401112 - DNA, 22 bp, Homo sapiens
gcccttcctcgcacagggcatg

SEQ ID NO: 2401113 - DNA, 20 bp, Homo sapiens
gcccttgctctacctggccg

SEQ ID NO: 2401114 - DNA, 11 bp, Homo sapiens
gccgggcatgg

SEQ ID NO: 2401115 - DNA, 14 bp, Homo sapiens
gccggggcctggac

SEQ ID NO: 2401116 - DNA, 20 bp, Homo sapiens
gcctaacccccagcccctcc

SEQ ID NO: 2401117 - DNA, 18 bp, Homo sapiens
gcctatatttcctcttct

SEQ ID NO: 2401118 - DNA, 20 bp, Homo sapiens
gcctcactgtgacctgctcc

SEQ ID NO: 2401119 - DNA, 14 bp, Homo sapiens
gcctcagtgccact

SEQ ID NO: 2401120 - DNA, 14 bp, Homo sapiens
gcctccaccctgcc

SEQ ID NO: 2401121 - DNA, 16 bp, Homo sapiens
gcctccctcgggctgg

SEQ ID NO: 2401122 - DNA, 21 bp, Homo sapiens
gcctccctcgggctggtgtct

SEQ ID NO: 2401123 - DNA, 16 bp, Homo sapiens
gcctccctttgccagc

SEQ ID NO: 2401124 - DNA, 19 bp, Homo sapiens
gcctccctttgccagccac

SEQ ID NO: 2401125 - DNA, 21 bp, Homo sapiens
gcctctatccctggccacctg

SEQ ID NO: 2401126 - DNA, 22 bp, Homo sapiens
gcctctatccctggccacctgc

SEQ ID NO: 2401127 - DNA, 14 bp, Homo sapiens
gcctctctgctata

SEQ ID NO: 2401128 - DNA, 23 bp, Homo sapiens
gcctgagcgcagcgcctccaccc

SEQ ID NO: 2401129 - DNA, 15 bp, Homo sapiens
gcctgccaggccctc

SEQ ID NO: 2401130 - DNA, 16 bp, Homo sapiens
gcctggcccttgccgg

SEQ ID NO: 2401131 - DNA, 14 bp, Homo sapiens
gcctggcctgagga

SEQ ID NO: 2401132 - DNA, 15 bp, Homo sapiens
gcctggcctgaggac

SEQ ID NO: 2401133 - DNA, 20 bp, Homo sapiens
gcctgggtgacagagcaaga

SEQ ID NO: 2401134 - DNA, 16 bp, Homo sapiens
gcctgtattcccagct

SEQ ID NO: 2401135 - DNA, 18 bp, Homo sapiens
gcctgtattcccagctac

SEQ ID NO: 2401136 - DNA, 17 bp, Homo sapiens
gcctgtggccttgcccg

SEQ ID NO: 2401137 - DNA, 16 bp, Homo sapiens
gccttggccctgaccc

SEQ ID NO: 2401138 - DNA, 16 bp, Homo sapiens
gccttttagttcctgt

SEQ ID NO: 2401139 - DNA, 17 bp, Homo sapiens
gccttttagttcctgtg

SEQ ID NO: 2401140 - DNA, 20 bp, Homo sapiens
gccttttagttcctgtgcac

SEQ ID NO: 2401141 - DNA, 13 bp, Homo sapiens
gcgagcacccacg

SEQ ID NO: 2401142 - DNA, 13 bp, Homo sapiens
gcgcagcgccagg

SEQ ID NO: 2401143 - DNA, 20 bp, Homo sapiens
gcgccactgcactccagcct

SEQ ID NO: 2401144 - DNA, 21 bp, Homo sapiens
gcgccactgcactccagcctg

SEQ ID NO: 2401145 - DNA, 20 bp, Homo sapiens
gcgcccattcgtctgtccca

SEQ ID NO: 2401146 - DNA, 20 bp, Homo sapiens
gcgcctaggttgtgttgaga

SEQ ID NO: 2401147 - DNA, 15 bp, Homo sapiens
gcgcctccaccctgc

SEQ ID NO: 2401148 - DNA, 23 bp, Homo sapiens
gcgctgtcggtgtttggaggctg

SEQ ID NO: 2401149 - DNA, 12 bp, Homo sapiens
tatcctcctaaa

SEQ ID NO: 2401150 - DNA, 15 bp, Homo sapiens
tatgagttagctttc

SEQ ID NO: 2401151 - DNA, 16 bp, Homo sapiens
tattgacgaactggct

SEQ ID NO: 2401152 - DNA, 17 bp, Homo sapiens
tattgctgaatgcaaga

SEQ ID NO: 2401153 - DNA, 19 bp, Homo sapiens
tatttaaagtttcctttaa

SEQ ID NO: 2401154 - DNA, 13 bp, Homo sapiens
tatttttgattaa

SEQ ID NO: 2401155 - DNA, 15 bp, Homo sapiens
tcaagattcagctag

SEQ ID NO: 2401156 - DNA, 14 bp, Homo sapiens
tcaatgccctgcca

SEQ ID NO: 2401157 - DNA, 15 bp, Homo sapiens
tcaatgccctgccat

SEQ ID NO: 2401158 - DNA, 16 bp, Homo sapiens
tcaatgccctgccatt

SEQ ID NO: 2401159 - DNA, 16 bp, Homo sapiens
tcaccaaggtggcttc

SEQ ID NO: 2401160 - DNA, 16 bp, Homo sapiens
tcaccctgactgtggg

SEQ ID NO: 2401161 - DNA, 16 bp, Homo sapiens
tcaccctgtaatggtt

SEQ ID NO: 2401162 - DNA, 20 bp, Homo sapiens
tcaccctgtaatggttggga

SEQ ID NO: 2401163 - DNA, 16 bp, Homo sapiens
tcacctcctccactca

SEQ ID NO: 2401164 - DNA, 17 bp, Homo sapiens
tcacctcctccactcac

SEQ ID NO: 2401165 - DNA, 19 bp, Homo sapiens
tcacctcctccactcactc

SEQ ID NO: 2401166 - DNA, 21 bp, Homo sapiens
tcacctcctccactcactcca

SEQ ID NO: 2401167 - DNA, 19 bp, Homo sapiens
tcactacatgggccagccc

SEQ ID NO: 2401168 - DNA, 20 bp, Homo sapiens
tcactacatgggccagccct

SEQ ID NO: 2401169 - DNA, 22 bp, Homo sapiens
tcactggggatcccgtgctgga

SEQ ID NO: 2401170 - DNA, 19 bp, Homo sapiens
tcactgtgacctgctcctg

SEQ ID NO: 2401171 - DNA, 21 bp, Homo sapiens
tcactgtgacctgctcctgcc

SEQ ID NO: 2401172 - DNA, 23 bp, Homo sapiens
tcactgtgacctgctcctgccca

SEQ ID NO: 2401173 - DNA, 14 bp, Homo sapiens
tcactgtttcacta

SEQ ID NO: 2401174 - DNA, 13 bp, Homo sapiens
tcagatggggcct

SEQ ID NO: 2401175 - DNA, 18 bp, Homo sapiens
tcagcccctcatcagcct

SEQ ID NO: 2401176 - DNA, 16 bp, Homo sapiens
tcagcctccctttgcc

SEQ ID NO: 2401177 - DNA, 20 bp, Homo sapiens
tcagcctccctttgccagcc

SEQ ID NO: 2401178 - DNA, 23 bp, Homo sapiens
tcagcctccctttgccagccacc

SEQ ID NO: 2401179 - DNA, 15 bp, Homo sapiens
tcagcgtctccccat

SEQ ID NO: 2401180 - DNA, 21 bp, Homo sapiens
tcagcgtctccccatgctggg

SEQ ID NO: 2401181 - DNA, 22 bp, Homo sapiens
tcagcgtctccccatgctgggc

SEQ ID NO: 2401182 - DNA, 17 bp, Homo sapiens
tcagctgcacattcctg

SEQ ID NO: 2401183 - DNA, 20 bp, Homo sapiens
tcagctgcacattcctggcc

SEQ ID NO: 2401184 - DNA, 17 bp, Homo sapiens
tcagtgccacttgacat

SEQ ID NO: 2401185 - DNA, 22 bp, Homo sapiens
tcagtgccacttgacattcctt

SEQ ID NO: 2401186 - DNA, 16 bp, Homo sapiens
tcatcatgaactggct

SEQ ID NO: 2401187 - DNA, 21 bp, Homo sapiens
tcatccaaactgtatcttcct

SEQ ID NO: 2401188 - DNA, 22 bp, Homo sapiens
tcatccaaactgtatcttcctt

SEQ ID NO: 2401189 - DNA, 14 bp, Homo sapiens
tcatctgcagcctc

SEQ ID NO: 2401190 - DNA, 12 bp, Homo sapiens
tcatctgctcct

SEQ ID NO: 2401191 - DNA, 14 bp, Homo sapiens
tcatctgctccttc

SEQ ID NO: 2401192 - DNA, 14 bp, Homo sapiens
tcatgaactggctt

SEQ ID NO: 2401193 - DNA, 18 bp, Homo sapiens
tcatgaactggcttgtac

SEQ ID NO: 2401194 - DNA, 20 bp, Homo sapiens
tcatgaactggcttgtacat

SEQ ID NO: 2401195 - DNA, 19 bp, Homo sapiens
tcatgcctgtaatcccagc

SEQ ID NO: 2401196 - DNA, 22 bp, Homo sapiens
tcatgcgtccactttcccttcc

SEQ ID NO: 2401197 - DNA, 14 bp, Homo sapiens
tcatggacagctga

SEQ ID NO: 2401198 - DNA, 17 bp, Homo sapiens
tcatggacagctgagca

SEQ ID NO: 2401199 - DNA, 20 bp, Homo sapiens
tccaagaaagccaacaacca

SEQ ID NO: 2401200 - DNA, 21 bp, Homo sapiens
tccaagccttcaccctgtgga

SEQ ID NO: 2401201 - DNA, 16 bp, Homo sapiens
tccaaggaaaagcaga

SEQ ID NO: 2401202 - DNA, 17 bp, Homo sapiens
tccacatccccaccttc

SEQ ID NO: 2401203 - DNA, 22 bp, Homo sapiens
tccacccccgccacggccaccc

SEQ ID NO: 2401204 - DNA, 17 bp, Homo sapiens
tccaccttcctgcccag

SEQ ID NO: 2401205 - DNA, 15 bp, Homo sapiens
tccagaccctgcctg

SEQ ID NO: 2401206 - DNA, 22 bp, Homo sapiens
tccagaccctgcctgagcccag

SEQ ID NO: 2401207 - DNA, 15 bp, Homo sapiens
tccagagttaaaatg

SEQ ID NO: 2401208 - DNA, 11 bp, Homo sapiens
tccagcctggg

SEQ ID NO: 2401209 - DNA, 13 bp, Homo sapiens
tccagcctgggtg

SEQ ID NO: 2401210 - DNA, 18 bp, Homo sapiens
tccaggagaccttccaca

SEQ ID NO: 2401211 - DNA, 15 bp, Homo sapiens
tccaggatcctcctg

SEQ ID NO: 2401212 - DNA, 22 bp, Homo sapiens
tccatcttccctacccttcctg

SEQ ID NO: 2401213 - DNA, 19 bp, Homo sapiens
tccatgcctggcccttgcc

SEQ ID NO: 2401214 - DNA, 16 bp, Homo sapiens
tccatgtcaagattca

SEQ ID NO: 2401215 - DNA, 14 bp, Homo sapiens
tccatttctgcaca

SEQ ID NO: 2401216 - DNA, 21 bp, Homo sapiens
tcccaacctcaatgccctgcc

SEQ ID NO: 2401217 - DNA, 22 bp, Homo sapiens
tcccaacctcaatgccctgcca

SEQ ID NO: 2401218 - DNA, 15 bp, Homo sapiens
tcccaccaactctgc

SEQ ID NO: 2401219 - DNA, 18 bp, Homo sapiens
tcccaccaactctgcact

SEQ ID NO: 2401220 - DNA, 19 bp, Homo sapiens
tcccaccaactctgcactc

SEQ ID NO: 2401221 - DNA, 20 bp, Homo sapiens
tcccaccaactctgcactcc

SEQ ID NO: 2401222 - DNA, 21 bp, Homo sapiens
tcccaccaactctgcactcca

SEQ ID NO: 2401223 - DNA, 23 bp, Homo sapiens
tcccaccaactctgcactccatg

SEQ ID NO: 2401224 - DNA, 19 bp, Homo sapiens
tcccagagcttattggcca

SEQ ID NO: 2401225 - DNA, 21 bp, Homo sapiens
tcccagagcttattggccact

SEQ ID NO: 2401226 - DNA, 14 bp, Homo sapiens
tcccagcccctacc

SEQ ID NO: 2401227 - DNA, 12 bp, Homo sapiens
tcccagcctggg

SEQ ID NO: 2401228 - DNA, 23 bp, Homo sapiens
tcccatggtgcccgtgcctctgt

SEQ ID NO: 2401229 - DNA, 18 bp, Homo sapiens
tccccactaataaagtgc

SEQ ID NO: 2401230 - DNA, 20 bp, Homo sapiens
tccccactctgctcccagcc

SEQ ID NO: 2401231 - DNA, 11 bp, Homo sapiens
tccccagcccc

SEQ ID NO: 2401232 - DNA, 15 bp, Homo sapiens
tccccatgctgggct

SEQ ID NO: 2401233 - DNA, 17 bp, Homo sapiens
tcccccaccattccaca

SEQ ID NO: 2401234 - DNA, 22 bp, Homo sapiens
tcccccagctttccatctgagg

SEQ ID NO: 2401235 - DNA, 12 bp, Homo sapiens
tccccctgtgtg

SEQ ID NO: 2401236 - DNA, 12 bp, Homo sapiens
tcccctgcctct

SEQ ID NO: 2401237 - DNA, 20 bp, Homo sapiens
tcccctggggagaacccttc

SEQ ID NO: 2401238 - DNA, 22 bp, Homo sapiens
tcccctggggagaacccttcct

SEQ ID NO: 2401239 - DNA, 16 bp, Homo sapiens
tcccctgtcccaccaa

SEQ ID NO: 2401240 - DNA, 21 bp, Homo sapiens
tcccctgtgactcctcccttc

SEQ ID NO: 2401241 - DNA, 19 bp, Homo sapiens
tccctaattctgccttaaa

SEQ ID NO: 2401242 - DNA, 22 bp, Homo sapiens
tccctacccttcctgccaagcc

SEQ ID NO: 2401243 - DNA, 18 bp, Homo sapiens
tccctcctgttgccacac

SEQ ID NO: 2401244 - DNA, 15 bp, Homo sapiens
tccctcttcccagca

SEQ ID NO: 2401245 - DNA, 17 bp, Homo sapiens
tcccttgacctttccag

SEQ ID NO: 2401246 - DNA, 18 bp, Homo sapiens
tcccttgacctttccagc

SEQ ID NO: 2401247 - DNA, 13 bp, Homo sapiens
tccctttgccagc

SEQ ID NO: 2401248 - DNA, 24 bp, Homo sapiens
tccgggatccccagcctactgcct

SEQ ID NO: 2401249 - DNA, 14 bp, Homo sapiens
tcctcagctgccaa

SEQ ID NO: 2401250 - DNA, 15 bp, Homo sapiens
tcctcagctgccaag

SEQ ID NO: 2401251 - DNA, 20 bp, Homo sapiens
tcctccactcactccagccc

SEQ ID NO: 2401252 - DNA, 17 bp, Homo sapiens
tcctcccttccccactc

SEQ ID NO: 2401253 - DNA, 20 bp, Homo sapiens
tcctcctaaagacctccaaa

SEQ ID NO: 2401254 - DNA, 20 bp, Homo sapiens
tcctcctggcctgagcgcag

SEQ ID NO: 2401255 - DNA, 14 bp, Homo sapiens
tcctctagctctgg

SEQ ID NO: 2401256 - DNA, 15 bp, Homo sapiens
tcctctcccttctta

SEQ ID NO: 2401257 - DNA, 22 bp, Homo sapiens
tcctgataataaagtgactgaa

SEQ ID NO: 2401258 - DNA, 13 bp, Homo sapiens
tcctgccaagcca

SEQ ID NO: 2401259 - DNA, 21 bp, Homo sapiens
tcctgcccacgtgcagcacct

SEQ ID NO: 2401260 - DNA, 20 bp, Homo sapiens
tcctggccccgggctctggc

SEQ ID NO: 2401261 - DNA, 12 bp, Homo sapiens
tcctggcccctc

SEQ ID NO: 2401262 - DNA, 21 bp, Homo sapiens
tcctggcctgagcgcagcgcc

SEQ ID NO: 2401263 - DNA, 23 bp, Homo sapiens
tcctgggcagttggggcggccca

SEQ ID NO: 2401264 - DNA, 19 bp, Homo sapiens
tcctgttttcatggacagc

SEQ ID NO: 2401265 - DNA, 20 bp, Homo sapiens
aaaatcaccctgactgtggg

SEQ ID NO: 2401266 - DNA, 15 bp, Homo sapiens
aaacaaataatcaca

SEQ ID NO: 2401267 - DNA, 15 bp, Homo sapiens
aaacagttgcacagc

SEQ ID NO: 2401268 - DNA, 10 bp, Homo sapiens
aaacattttc

SEQ ID NO: 2401269 - DNA, 23 bp, Homo sapiens
aaagggtagcctggcttttctgg

SEQ ID NO: 2401270 - DNA, 21 bp, Homo sapiens
aaagtgcttcaagggtaatct

SEQ ID NO: 2401271 - DNA, 19 bp, Homo sapiens
aaagtttttatggaagggt

SEQ ID NO: 2401272 - DNA, 13 bp, Homo sapiens
aaatctagagttt

SEQ ID NO: 2401273 - DNA, 20 bp, Homo sapiens
aaatgatagaactgtactgt

SEQ ID NO: 2401274 - DNA, 13 bp, Homo sapiens
aaatgtttactgt

SEQ ID NO: 2401275 - DNA, 17 bp, Homo sapiens
aacaagatgaaattcca

SEQ ID NO: 2401276 - DNA, 14 bp, Homo sapiens
aacaatgtatttta

SEQ ID NO: 2401277 - DNA, 16 bp, Homo sapiens
aacaatgtattttaat

SEQ ID NO: 2401278 - DNA, 22 bp, Homo sapiens
aacaatgtattttaataacata

SEQ ID NO: 2401279 - DNA, 13 bp, Homo sapiens
aacacctgatctg

SEQ ID NO: 2401280 - DNA, 14 bp, Homo sapiens
aacagttgcacagc

SEQ ID NO: 2401281 - DNA, 18 bp, Homo sapiens
aacagttgcacagcatct

SEQ ID NO: 2401282 - DNA, 14 bp, Homo sapiens
aacatatctaaagt

SEQ ID NO: 2401283 - DNA, 16 bp, Homo sapiens
aacatatctaaagtca

SEQ ID NO: 2401284 - DNA, 14 bp, Homo sapiens
aacatctcgagccc

SEQ ID NO: 2401285 - DNA, 15 bp, Homo sapiens
aaccaggccttctga

SEQ ID NO: 2401286 - DNA, 13 bp, Homo sapiens
aaccattgtgcat

SEQ ID NO: 2401287 - DNA, 22 bp, Homo sapiens
aacccttaaacagttgcacagc

SEQ ID NO: 2401288 - DNA, 22 bp, Homo sapiens
aaccggtcccagcctgggctcc

SEQ ID NO: 2401289 - DNA, 16 bp, Homo sapiens
aacctactgtctaagc

SEQ ID NO: 2401290 - DNA, 22 bp, Homo sapiens
aacctactgtctaagcagtttt

SEQ ID NO: 2401291 - DNA, 15 bp, Homo sapiens
aacctcaatgccctg

SEQ ID NO: 2401292 - DNA, 15 bp, Homo sapiens
aacgtacccaaggtc

SEQ ID NO: 2401293 - DNA, 14 bp, Homo sapiens
aactaggtaactta

SEQ ID NO: 2401294 - DNA, 16 bp, Homo sapiens
aactctgcactccatg

SEQ ID NO: 2401295 - DNA, 23 bp, Homo sapiens
aactctgcactccatggccaccc

SEQ ID NO: 2401296 - DNA, 19 bp, Homo sapiens
aactgagccgtgcagctgg

SEQ ID NO: 2401297 - DNA, 21 bp, Homo sapiens
aactgagccgtgcagctggga

SEQ ID NO: 2401298 - DNA, 19 bp, Homo sapiens
aactgccctttccctgcat

SEQ ID NO: 2401299 - DNA, 22 bp, Homo sapiens
aactggcttgtacatttttaaa

SEQ ID NO: 2401300 - DNA, 13 bp, Homo sapiens
aagaaatctattt

SEQ ID NO: 2401301 - DNA, 12 bp, Homo sapiens
aagaagtggcat

SEQ ID NO: 2401302 - DNA, 13 bp, Homo sapiens
aagactacctggg

SEQ ID NO: 2401303 - DNA, 20 bp, Homo sapiens
aagacttagatctgagccct

SEQ ID NO: 2401304 - DNA, 13 bp, Homo sapiens
aagattcagctag

SEQ ID NO: 2401305 - DNA, 14 bp, Homo sapiens
aagattcagctagt

SEQ ID NO: 2401306 - DNA, 15 bp, Homo sapiens
aagcagttttgtaaa

SEQ ID NO: 2401307 - DNA, 16 bp, Homo sapiens
aagcagttttgtaaat

SEQ ID NO: 2401308 - DNA, 13 bp, Homo sapiens
aagctgctctgag

SEQ ID NO: 2401309 - DNA, 15 bp, Homo sapiens
aagctgctctgaggt

SEQ ID NO: 2401310 - DNA, 23 bp, Homo sapiens
aaggacctccccctgtgtggccc

SEQ ID NO: 2401311 - DNA, 20 bp, Homo sapiens
aaggctggtctcccccagcc

SEQ ID NO: 2401312 - DNA, 18 bp, Homo sapiens
aaggtccgagctctgtcc

SEQ ID NO: 2401313 - DNA, 24 bp, Homo sapiens
aagtatttttgattaacaatgtat

SEQ ID NO: 2401314 - DNA, 22 bp, Homo sapiens
aagtcacagatatatttctcca

SEQ ID NO: 2401315 - DNA, 17 bp, Homo sapiens
aataacatatctaaagt

SEQ ID NO: 2401316 - DNA, 15 bp, Homo sapiens
aataatcacattgac

SEQ ID NO: 2401317 - DNA, 13 bp, Homo sapiens
aatctagagttta

SEQ ID NO: 2401318 - DNA, 20 bp, Homo sapiens
aatctgaaaccctccttctg

SEQ ID NO: 2401319 - DNA, 19 bp, Homo sapiens
aatgaaggtcataagtttc

SEQ ID NO: 2401320 - DNA, 22 bp, Homo sapiens
aatgaaggtcataagtttctga

SEQ ID NO: 2401321 - DNA, 15 bp, Homo sapiens
aatgatagaactgta

SEQ ID NO: 2401322 - DNA, 16 bp, Homo sapiens
aatgatagaactgtac

SEQ ID NO: 2401323 - DNA, 14 bp, Homo sapiens
aatgccctgccatt

SEQ ID NO: 2401324 - DNA, 14 bp, Homo sapiens
aatgtactggtaat

SEQ ID NO: 2401325 - DNA, 22 bp, Homo sapiens
aatgtactggtaattgtacaat

SEQ ID NO: 2401326 - DNA, 15 bp, Homo sapiens
aatgtttactgtaaa

SEQ ID NO: 2401327 - DNA, 13 bp, Homo sapiens
aattcttactctg

SEQ ID NO: 2401328 - DNA, 18 bp, Homo sapiens
aattttcctttgtcattt

SEQ ID NO: 2401329 - DNA, 16 bp, Homo sapiens
aatttttctctttaaa

SEQ ID NO: 2401330 - DNA, 12 bp, Homo sapiens
aatttttgttct

SEQ ID NO: 2401331 - DNA, 20 bp, Homo sapiens
acaaggccctttaacttgtc

SEQ ID NO: 2401332 - DNA, 21 bp, Homo sapiens
acaatacttgcattccagagt

SEQ ID NO: 2401333 - DNA, 11 bp, Homo sapiens
acaatgtattt

SEQ ID NO: 2401334 - DNA, 20 bp, Homo sapiens
acacagcccaccctctgtga

SEQ ID NO: 2401335 - DNA, 14 bp, Homo sapiens
acaccacccagagc

SEQ ID NO: 2401336 - DNA, 22 bp, Homo sapiens
acacctgatctggcccaagctg

SEQ ID NO: 2401337 - DNA, 19 bp, Homo sapiens
acacctgatcttacagaaa

SEQ ID NO: 2401338 - DNA, 18 bp, Homo sapiens
acactgagtgaggagtgg

SEQ ID NO: 2401339 - DNA, 13 bp, Homo sapiens
acagcatggcccg

SEQ ID NO: 2401340 - DNA, 17 bp, Homo sapiens
acagggcatgcctggcc

SEQ ID NO: 2401341 - DNA, 15 bp, Homo sapiens
acagtgtacatgtac

SEQ ID NO: 2401342 - DNA, 14 bp, Homo sapiens
acagttgcacagca

SEQ ID NO: 2401343 - DNA, 20 bp, Homo sapiens
acagttgcacagcatctcag

SEQ ID NO: 2401344 - DNA, 18 bp, Homo sapiens
acagttggggctgttcat

SEQ ID NO: 2401345 - DNA, 15 bp, Homo sapiens
acatagtaaagtatt

SEQ ID NO: 2401346 - DNA, 16 bp, Homo sapiens
acatgggccagccctt

SEQ ID NO: 2401347 - DNA, 18 bp, Homo sapiens
acatgtacatagtaaagt

SEQ ID NO: 2401348 - DNA, 19 bp, Homo sapiens
acatgtacatagtaaagta

SEQ ID NO: 2401349 - DNA, 14 bp, Homo sapiens
acattcctggcccc

SEQ ID NO: 2401350 - DNA, 19 bp, Homo sapiens
acattcctggccccgggct

SEQ ID NO: 2401351 - DNA, 21 bp, Homo sapiens
acattcttcaagatcccattt

SEQ ID NO: 2401352 - DNA, 16 bp, Homo sapiens
acatttttaaattctt

SEQ ID NO: 2401353 - DNA, 18 bp, Homo sapiens
accacccagagcaccctc

SEQ ID NO: 2401354 - DNA, 16 bp, Homo sapiens
accagaacagcatggc

SEQ ID NO: 2401355 - DNA, 17 bp, Homo sapiens
accagaacagcatggcc

SEQ ID NO: 2401356 - DNA, 14 bp, Homo sapiens
accagcaacatctc

SEQ ID NO: 2401357 - DNA, 23 bp, Homo sapiens
accagcaacatctcgagccccct

SEQ ID NO: 2401358 - DNA, 13 bp, Homo sapiens
accagcctgccag

SEQ ID NO: 2401359 - DNA, 17 bp, Homo sapiens
accagcctgccaggccc

SEQ ID NO: 2401360 - DNA, 12 bp, Homo sapiens
accaggccaatc

SEQ ID NO: 2401361 - DNA, 18 bp, Homo sapiens
accaggctggagtgcagt

SEQ ID NO: 2401362 - DNA, 17 bp, Homo sapiens
accatcctggcccctcc

SEQ ID NO: 2401363 - DNA, 16 bp, Homo sapiens
accattgacaggcact

SEQ ID NO: 2401364 - DNA, 16 bp, Homo sapiens
accattgacctcagct

SEQ ID NO: 2401365 - DNA, 17 bp, Homo sapiens
accattgacctcagctg

SEQ ID NO: 2401366 - DNA, 19 bp, Homo sapiens
accattgacctcagctgca

SEQ ID NO: 2401367 - DNA, 24 bp, Homo sapiens
accattgacctcagctgcacattc

SEQ ID NO: 2401368 - DNA, 13 bp, Homo sapiens
accattgtgcatt

SEQ ID NO: 2401369 - DNA, 21 bp, Homo sapiens
acccacgtgagagaatctgcc

SEQ ID NO: 2401370 - DNA, 22 bp, Homo sapiens
acccacgtgagagaatctgcct

SEQ ID NO: 2401371 - DNA, 18 bp, Homo sapiens
acccatagatcttctgaa

SEQ ID NO: 2401372 - DNA, 21 bp, Homo sapiens
acccatagatcttctgaaatg

SEQ ID NO: 2401373 - DNA, 16 bp, Homo sapiens
acccatgccagcgcag

SEQ ID NO: 2401374 - DNA, 16 bp, Homo sapiens
accccagaatcccctg

SEQ ID NO: 2401375 - DNA, 14 bp, Homo sapiens
acccccgccacggc

SEQ ID NO: 2401376 - DNA, 14 bp, Homo sapiens
accccgtgccaccc

SEQ ID NO: 2401377 - DNA, 16 bp, Homo sapiens
acccctcccaacctca

SEQ ID NO: 2401378 - DNA, 14 bp, Homo sapiens
acccgagcccagct

SEQ ID NO: 2401379 - DNA, 22 bp, Homo sapiens
acccgagcccagctacattcct

SEQ ID NO: 2401380 - DNA, 17 bp, Homo sapiens
accctccgttcctcctc

SEQ ID NO: 2401381 - DNA, 20 bp, Homo sapiens
catgaactggcttgtacatt

SEQ ID NO: 2401382 - DNA, 21 bp, Homo sapiens
catgaactggcttgtacattt

SEQ ID NO: 2401383 - DNA, 20 bp, Homo sapiens
catgaggctgaggcaggaga

SEQ ID NO: 2401384 - DNA, 12 bp, Homo sapiens
catgagggctgg

SEQ ID NO: 2401385 - DNA, 18 bp, Homo sapiens
catgccagcgcagcgcca

SEQ ID NO: 2401386 - DNA, 20 bp, Homo sapiens
catgccagcgcagcgccagg

SEQ ID NO: 2401387 - DNA, 13 bp, Homo sapiens
catgcccacgccc

SEQ ID NO: 2401388 - DNA, 14 bp, Homo sapiens
catgcctggccctt

SEQ ID NO: 2401389 - DNA, 21 bp, Homo sapiens
catgcgtccactttcccttcc

SEQ ID NO: 2401390 - DNA, 23 bp, Homo sapiens
catgcgtccactttcccttcccc

SEQ ID NO: 2401391 - DNA, 15 bp, Homo sapiens
catgctgggctcact

SEQ ID NO: 2401392 - DNA, 16 bp, Homo sapiens
catggacagctgagca

SEQ ID NO: 2401393 - DNA, 18 bp, Homo sapiens
catggcaagtggggctgg

SEQ ID NO: 2401394 - DNA, 22 bp, Homo sapiens
catggccgcgtcacttctctga

SEQ ID NO: 2401395 - DNA, 14 bp, Homo sapiens
catgggccagccct

SEQ ID NO: 2401396 - DNA, 21 bp, Homo sapiens
catggtctgagtggggcttcc

SEQ ID NO: 2401397 - DNA, 23 bp, Homo sapiens
catggtctgagtggggcttcctg

SEQ ID NO: 2401398 - DNA, 18 bp, Homo sapiens
catggtggcatgtgcctg

SEQ ID NO: 2401399 - DNA, 23 bp, Homo sapiens
catgtacatagtaaagtattttt

SEQ ID NO: 2401400 - DNA, 22 bp, Homo sapiens
catgtgcctgtattcccagcta

SEQ ID NO: 2401401 - DNA, 21 bp, Homo sapiens
catgttcctggacaccaccca

SEQ ID NO: 2401402 - DNA, 12 bp, Homo sapiens
cattccagagtt

SEQ ID NO: 2401403 - DNA, 19 bp, Homo sapiens
cattccagagttaaaatgt

SEQ ID NO: 2401404 - DNA, 15 bp, Homo sapiens
cattcctcagctgcc

SEQ ID NO: 2401405 - DNA, 16 bp, Homo sapiens
cattcctcagctgcca

SEQ ID NO: 2401406 - DNA, 17 bp, Homo sapiens
cattcctcagctgccaa

SEQ ID NO: 2401407 - DNA, 18 bp, Homo sapiens
cattcctcccattcaaga

SEQ ID NO: 2401408 - DNA, 20 bp, Homo sapiens
cattcctctcctagccctcc

SEQ ID NO: 2401409 - DNA, 12 bp, Homo sapiens
cattcctggccc

SEQ ID NO: 2401410 - DNA, 15 bp, Homo sapiens
cattccttgtcacca

SEQ ID NO: 2401411 - DNA, 16 bp, Homo sapiens
cattccttgtcaccag

SEQ ID NO: 2401412 - DNA, 16 bp, Homo sapiens
cattcgtctgtcccag

SEQ ID NO: 2401413 - DNA, 12 bp, Homo sapiens
cattcttcaaga

SEQ ID NO: 2401414 - DNA, 14 bp, Homo sapiens
cattgacctcagct

SEQ ID NO: 2401415 - DNA, 17 bp, Homo sapiens
cattgacctcagctgca

SEQ ID NO: 2401416 - DNA, 12 bp, Homo sapiens
catttagtagaa

SEQ ID NO: 2401417 - DNA, 14 bp, Homo sapiens
catttattccttcc

SEQ ID NO: 2401418 - DNA, 14 bp, Homo sapiens
catttttaaattct

SEQ ID NO: 2401419 - DNA, 19 bp, Homo sapiens
catttttaaattcttactc

SEQ ID NO: 2401420 - DNA, 19 bp, Homo sapiens
ccaaatgatagaactgtac

SEQ ID NO: 2401421 - DNA, 16 bp, Homo sapiens
ccaacctcaatgccct

SEQ ID NO: 2401422 - DNA, 18 bp, Homo sapiens
ccaacctcaatgccctgc

SEQ ID NO: 2401423 - DNA, 13 bp, Homo sapiens
ccaactctgcact

SEQ ID NO: 2401424 - DNA, 14 bp, Homo sapiens
ccaactctgcactc

SEQ ID NO: 2401425 - DNA, 12 bp, Homo sapiens
ccaagctgggct

SEQ ID NO: 2401426 - DNA, 19 bp, Homo sapiens
ccaagctgggctcccttta

SEQ ID NO: 2401427 - DNA, 13 bp, Homo sapiens
ccaatcccttctc

SEQ ID NO: 2401428 - DNA, 18 bp, Homo sapiens
ccaatgaggtggctcatg

SEQ ID NO: 2401429 - DNA, 12 bp, Homo sapiens
ccaccaactctg

SEQ ID NO: 2401430 - DNA, 13 bp, Homo sapiens
ccaccaactctgc

SEQ ID NO: 2401431 - DNA, 17 bp, Homo sapiens
ccaccaactctgcactc

SEQ ID NO: 2401432 - DNA, 14 bp, Homo sapiens
ccacccatgccagc

SEQ ID NO: 2401433 - DNA, 21 bp, Homo sapiens
ccacccccgccacggccaccc

SEQ ID NO: 2401434 - DNA, 16 bp, Homo sapiens
ccacccgtaggcagcc

SEQ ID NO: 2401435 - DNA, 20 bp, Homo sapiens
ccacccgtaggcagcctctc

SEQ ID NO: 2401436 - DNA, 12 bp, Homo sapiens
ccaccctctgtg

SEQ ID NO: 2401437 - DNA, 14 bp, Homo sapiens
ccaccctctgtgag

SEQ ID NO: 2401438 - DNA, 14 bp, Homo sapiens
ccaccctgccctgc

SEQ ID NO: 2401439 - DNA, 22 bp, Homo sapiens
ccacctccacccccgccacggc

SEQ ID NO: 2401440 - DNA, 12 bp, Homo sapiens
ccacctgccagg

SEQ ID NO: 2401441 - DNA, 14 bp, Homo sapiens
ccacctgccaggcc

SEQ ID NO: 2401442 - DNA, 15 bp, Homo sapiens
ccacgccagctggcc

SEQ ID NO: 2401443 - DNA, 16 bp, Homo sapiens
ccacgccagctggccc

SEQ ID NO: 2401444 - DNA, 13 bp, Homo sapiens
ccacggccaccct

SEQ ID NO: 2401445 - DNA, 15 bp, Homo sapiens
ccacggccaccctcc

SEQ ID NO: 2401446 - DNA, 17 bp, Homo sapiens
ccacggccatgagggct

SEQ ID NO: 2401447 - DNA, 18 bp, Homo sapiens
ccacgtgagagaatctgc

SEQ ID NO: 2401448 - DNA, 20 bp, Homo sapiens
ccacgtgagagaatctgcct

SEQ ID NO: 2401449 - DNA, 21 bp, Homo sapiens
ccacgtgagagaatctgcctg

SEQ ID NO: 2401450 - DNA, 15 bp, Homo sapiens
ccactaataaagtgc

SEQ ID NO: 2401451 - DNA, 12 bp, Homo sapiens
ccactcactcca

SEQ ID NO: 2401452 - DNA, 17 bp, Homo sapiens
ccactgcactccagcct

SEQ ID NO: 2401453 - DNA, 21 bp, Homo sapiens
ccactgcactccagcctgggt

SEQ ID NO: 2401454 - DNA, 18 bp, Homo sapiens
ccactgggtctcactcct

SEQ ID NO: 2401455 - DNA, 21 bp, Homo sapiens
ccactgggtctcactcctgag

SEQ ID NO: 2401456 - DNA, 14 bp, Homo sapiens
ccacttgacattcc

SEQ ID NO: 2401457 - DNA, 15 bp, Homo sapiens
ccacttgacattcct

SEQ ID NO: 2401458 - DNA, 12 bp, Homo sapiens
ccacttggcatt

SEQ ID NO: 2401459 - DNA, 16 bp, Homo sapiens
ccactttcccttcccc

SEQ ID NO: 2401460 - DNA, 15 bp, Homo sapiens
ccagaatcccctggg

SEQ ID NO: 2401461 - DNA, 18 bp, Homo sapiens
ccagagagaggcgtcctg

SEQ ID NO: 2401462 - DNA, 21 bp, Homo sapiens
ccagagagaggcgtcctggtg

SEQ ID NO: 2401463 - DNA, 20 bp, Homo sapiens
ccagagcttattggccactg

SEQ ID NO: 2401464 - DNA, 21 bp, Homo sapiens
ccagagcttattggccactgg

SEQ ID NO: 2401465 - DNA, 20 bp, Homo sapiens
ccagcaacatctcgagcccc

SEQ ID NO: 2401466 - DNA, 24 bp, Homo sapiens
ccagcccccacccatgccagcgca

SEQ ID NO: 2401467 - DNA, 16 bp, Homo sapiens
ccagcctgccaggccc

SEQ ID NO: 2401468 - DNA, 21 bp, Homo sapiens
ccagcctgggctcctctgcat

SEQ ID NO: 2401469 - DNA, 23 bp, Homo sapiens
ccagcctgggctcctctgcatct

SEQ ID NO: 2401470 - DNA, 23 bp, Homo sapiens
ccagctacattcctcagctgcca

SEQ ID NO: 2401471 - DNA, 18 bp, Homo sapiens
ccagctcagagccccgcc

SEQ ID NO: 2401472 - DNA, 12 bp, Homo sapiens
ccagctttccat

SEQ ID NO: 2401473 - DNA, 15 bp, Homo sapiens
ccaggagaccttcca

SEQ ID NO: 2401474 - DNA, 17 bp, Homo sapiens
ccaggagctgagtcacc

SEQ ID NO: 2401475 - DNA, 19 bp, Homo sapiens
ccaggagctgagtcacctc

SEQ ID NO: 2401476 - DNA, 15 bp, Homo sapiens
ccaggatcctcctgg

SEQ ID NO: 2401477 - DNA, 13 bp, Homo sapiens
ccaggccctccag

SEQ ID NO: 2401478 - DNA, 16 bp, Homo sapiens
ccaggcctccctcggg

SEQ ID NO: 2401479 - DNA, 17 bp, Homo sapiens
ccaggggacgtggcgct

SEQ ID NO: 2401480 - DNA, 17 bp, Homo sapiens
ccatagatcttctgaaa

SEQ ID NO: 2401481 - DNA, 20 bp, Homo sapiens
ccatagatcttctgaaatga

SEQ ID NO: 2401482 - DNA, 14 bp, Homo sapiens
ccatcctggcccct

SEQ ID NO: 2401483 - DNA, 16 bp, Homo sapiens
ccatcctggcccctcc

SEQ ID NO: 2401484 - DNA, 18 bp, Homo sapiens
ccatcctggcccctccag

SEQ ID NO: 2401485 - DNA, 20 bp, Homo sapiens
ccatcttccctacccttcct

SEQ ID NO: 2401486 - DNA, 21 bp, Homo sapiens
ccatgccagcgcagcgccagg

SEQ ID NO: 2401487 - DNA, 22 bp, Homo sapiens
ccatgcccacgcccctccccag

SEQ ID NO: 2401488 - DNA, 11 bp, Homo sapiens
ccatgcctggc

SEQ ID NO: 2401489 - DNA, 22 bp, Homo sapiens
ccatgcctggcccttgccgggg

SEQ ID NO: 2401490 - DNA, 13 bp, Homo sapiens
ccatgctgggctc

SEQ ID NO: 2401491 - DNA, 14 bp, Homo sapiens
ccatgctgggctca

SEQ ID NO: 2401492 - DNA, 23 bp, Homo sapiens
ccatggaggaaggctctgttcca

SEQ ID NO: 2401493 - DNA, 21 bp, Homo sapiens
ccatggtgcccgtgcctctgt

SEQ ID NO: 2401494 - DNA, 18 bp, Homo sapiens
ccattgacctcagctgca

SEQ ID NO: 2401495 - DNA, 17 bp, Homo sapiens
ccattgtgcattctaga

SEQ ID NO: 2401496 - DNA, 13 bp, Homo sapiens
cccaacctcaatg

SEQ ID NO: 2401497 - DNA, 13 bp, Homo sapiens
cccaagctgggct

SEQ ID NO: 2401498 - DNA, 22 bp, Homo sapiens
ctccgggaccattgacctcagc

SEQ ID NO: 2401499 - DNA, 23 bp, Homo sapiens
ctccgggaccattgacctcagct

SEQ ID NO: 2401500 - DNA, 12 bp, Homo sapiens
ctcctagccctc

SEQ ID NO: 2401501 - DNA, 16 bp, Homo sapiens
ctcctcagcctccctt

SEQ ID NO: 2401502 - DNA, 13 bp, Homo sapiens
ctcctccactcac

SEQ ID NO: 2401503 - DNA, 19 bp, Homo sapiens
ctcctcccttccccactct

SEQ ID NO: 2401504 - DNA, 22 bp, Homo sapiens
ctcctctgcatcttgctctgtg

SEQ ID NO: 2401505 - DNA, 12 bp, Homo sapiens
ctcctgcccacg

SEQ ID NO: 2401506 - DNA, 17 bp, Homo sapiens
ctcctggcctgagcgca

SEQ ID NO: 2401507 - DNA, 15 bp, Homo sapiens
ctcgagaccatcctg

SEQ ID NO: 2401508 - DNA, 16 bp, Homo sapiens
ctcgagaccatcctgg

SEQ ID NO: 2401509 - DNA, 18 bp, Homo sapiens
ctcgagaccatcctggcc

SEQ ID NO: 2401510 - DNA, 19 bp, Homo sapiens
ctcgagaccatcctggccc

SEQ ID NO: 2401511 - DNA, 19 bp, Homo sapiens
ctcgcacagggcatgcctg

SEQ ID NO: 2401512 - DNA, 24 bp, Homo sapiens
ctcgctgctgctactacccgagcc

SEQ ID NO: 2401513 - DNA, 18 bp, Homo sapiens
ctcgttaattttcctttg

SEQ ID NO: 2401514 - DNA, 13 bp, Homo sapiens
ctctagctctggt

SEQ ID NO: 2401515 - DNA, 20 bp, Homo sapiens
ctctatccctggccacctgc

SEQ ID NO: 2401516 - DNA, 23 bp, Homo sapiens
ctctatccctggccacctgccag

SEQ ID NO: 2401517 - DNA, 19 bp, Homo sapiens
ctctcctagccctcctgag

SEQ ID NO: 2401518 - DNA, 21 bp, Homo sapiens
ctctcctagccctcctgaggg

SEQ ID NO: 2401519 - DNA, 22 bp, Homo sapiens
ctctgaataaatacccattgaa

SEQ ID NO: 2401520 - DNA, 13 bp, Homo sapiens
ctctgagggtctg

SEQ ID NO: 2401521 - DNA, 23 bp, Homo sapiens
ctctgattatgtgccctggccag

SEQ ID NO: 2401522 - DNA, 13 bp, Homo sapiens
ctctgcactccat

SEQ ID NO: 2401523 - DNA, 22 bp, Homo sapiens
ctctgcactccatggccacccc

SEQ ID NO: 2401524 - DNA, 13 bp, Homo sapiens
ctctgctcccagc

SEQ ID NO: 2401525 - DNA, 13 bp, Homo sapiens
ctctggccaccct

SEQ ID NO: 2401526 - DNA, 18 bp, Homo sapiens
ctctggccaccctggccc

SEQ ID NO: 2401527 - DNA, 16 bp, Homo sapiens
ctctgggcccagagag

SEQ ID NO: 2401528 - DNA, 13 bp, Homo sapiens
ctctgtcctctgt

SEQ ID NO: 2401529 - DNA, 19 bp, Homo sapiens
ctctgtcctctgtcagtca

SEQ ID NO: 2401530 - DNA, 20 bp, Homo sapiens
ctctgtcctctgtcagtcat

SEQ ID NO: 2401531 - DNA, 19 bp, Homo sapiens
ctctgtggccttggccctg

SEQ ID NO: 2401532 - DNA, 20 bp, Homo sapiens
ctctgtggccttggccctga

SEQ ID NO: 2401533 - DNA, 16 bp, Homo sapiens
ctgaaaccctccttct

SEQ ID NO: 2401534 - DNA, 18 bp, Homo sapiens
ctgaaatgaaacaaataa

SEQ ID NO: 2401535 - DNA, 19 bp, Homo sapiens
ctgaaatgaaacaaataat

SEQ ID NO: 2401536 - DNA, 19 bp, Homo sapiens
ctgaaggacctccccctgt

SEQ ID NO: 2401537 - DNA, 22 bp, Homo sapiens
ctgaaggacctccccctgtgtg

SEQ ID NO: 2401538 - DNA, 12 bp, Homo sapiens
ctgactgtgggg

SEQ ID NO: 2401539 - DNA, 22 bp, Homo sapiens
ctgagcatatgttccatgcctg

SEQ ID NO: 2401540 - DNA, 22 bp, Homo sapiens
ctgagccgtgcagctgggattt

SEQ ID NO: 2401541 - DNA, 22 bp, Homo sapiens
ctgagcgcagcgcctccaccct

SEQ ID NO: 2401542 - DNA, 13 bp, Homo sapiens
ctgaggccccagg

SEQ ID NO: 2401543 - DNA, 17 bp, Homo sapiens
ctgaggtcaggagttcg

SEQ ID NO: 2401544 - DNA, 18 bp, Homo sapiens
ctgagtcacctcctccac

SEQ ID NO: 2401545 - DNA, 18 bp, Homo sapiens
ctgagtggcggggcccct

SEQ ID NO: 2401546 - DNA, 23 bp, Homo sapiens
ctgagtggtaggaggagggggag

SEQ ID NO: 2401547 - DNA, 19 bp, Homo sapiens
ctgatctggcccaagctgg

SEQ ID NO: 2401548 - DNA, 15 bp, Homo sapiens
ctgatcttacagaaa

SEQ ID NO: 2401549 - DNA, 19 bp, Homo sapiens
ctgatttattgaaattttt

SEQ ID NO: 2401550 - DNA, 21 bp, Homo sapiens
ctgatttattgaaatttttct

SEQ ID NO: 2401551 - DNA, 20 bp, Homo sapiens
ctgatttcaaggtccgagct

SEQ ID NO: 2401552 - DNA, 13 bp, Homo sapiens
ctgcacaggcagc

SEQ ID NO: 2401553 - DNA, 17 bp, Homo sapiens
ctgcacattcctggccc

SEQ ID NO: 2401554 - DNA, 22 bp, Homo sapiens
ctgcacattcctggccccgggc

SEQ ID NO: 2401555 - DNA, 20 bp, Homo sapiens
ctgcaccctggatttgcata

SEQ ID NO: 2401556 - DNA, 17 bp, Homo sapiens
ctgcactccagcctggg

SEQ ID NO: 2401557 - DNA, 18 bp, Homo sapiens
ctgcactccagcctgggt

SEQ ID NO: 2401558 - DNA, 14 bp, Homo sapiens
ctgcactccatggc

SEQ ID NO: 2401559 - DNA, 13 bp, Homo sapiens
ctgcatatgcttc

SEQ ID NO: 2401560 - DNA, 16 bp, Homo sapiens
ctgcatatgcttctga

SEQ ID NO: 2401561 - DNA, 22 bp, Homo sapiens
ctgcatatgcttctgatggtgt

SEQ ID NO: 2401562 - DNA, 18 bp, Homo sapiens
ctgcatgttcctggacac

SEQ ID NO: 2401563 - DNA, 24 bp, Homo sapiens
ctgccaagcactcgagaccatcct

SEQ ID NO: 2401564 - DNA, 14 bp, Homo sapiens
ctgccaggccctcc

SEQ ID NO: 2401565 - DNA, 15 bp, Homo sapiens
ctgccaggccctcca

SEQ ID NO: 2401566 - DNA, 15 bp, Homo sapiens
ctgccaggcctccct

SEQ ID NO: 2401567 - DNA, 21 bp, Homo sapiens
ctgccaggcctccctcgggct

SEQ ID NO: 2401568 - DNA, 19 bp, Homo sapiens
ctgcccacgtgcagcacct

SEQ ID NO: 2401569 - DNA, 22 bp, Homo sapiens
ctgcccacgtgcagcacctgtc

SEQ ID NO: 2401570 - DNA, 14 bp, Homo sapiens
ctgccccctggctt

SEQ ID NO: 2401571 - DNA, 18 bp, Homo sapiens
ctgcctcactgtgacctg

SEQ ID NO: 2401572 - DNA, 21 bp, Homo sapiens
ctgcctcactgtgacctgctc

SEQ ID NO: 2401573 - DNA, 16 bp, Homo sapiens
ctgcctctatccctgg

SEQ ID NO: 2401574 - DNA, 17 bp, Homo sapiens
ctgcctctatccctggc

SEQ ID NO: 2401575 - DNA, 18 bp, Homo sapiens
ctgcctctatccctggcc

SEQ ID NO: 2401576 - DNA, 23 bp, Homo sapiens
ctgcctgtggccttgcccgccag

SEQ ID NO: 2401577 - DNA, 12 bp, Homo sapiens
ctgcgtccctgc

SEQ ID NO: 2401578 - DNA, 16 bp, Homo sapiens
ctgcgtccctgctcag

SEQ ID NO: 2401579 - DNA, 20 bp, Homo sapiens
ctgctactacccgagcccag

SEQ ID NO: 2401580 - DNA, 23 bp, Homo sapiens
ctgctactacccgagcccagcta

SEQ ID NO: 2401581 - DNA, 13 bp, Homo sapiens
ctgctcagcccat

SEQ ID NO: 2401582 - DNA, 17 bp, Homo sapiens
ctgctcagcccatcccc

SEQ ID NO: 2401583 - DNA, 23 bp, Homo sapiens
ctgctcagcccatcccctgcctc

SEQ ID NO: 2401584 - DNA, 12 bp, Homo sapiens
ctgctcccagcc

SEQ ID NO: 2401585 - DNA, 16 bp, Homo sapiens
ctgctccgaggggctc

SEQ ID NO: 2401586 - DNA, 12 bp, Homo sapiens
ctgctccttcct

SEQ ID NO: 2401587 - DNA, 22 bp, Homo sapiens
ctggaagacttagatctgagcc

SEQ ID NO: 2401588 - DNA, 23 bp, Homo sapiens
ctggaagacttagatctgagccc

SEQ ID NO: 2401589 - DNA, 23 bp, Homo sapiens
ctggagaccagaacagcatggcc

SEQ ID NO: 2401590 - DNA, 18 bp, Homo sapiens
ctggagcaacctactgtc

SEQ ID NO: 2401591 - DNA, 22 bp, Homo sapiens
ctggagccgcttccccagctca

SEQ ID NO: 2401592 - DNA, 15 bp, Homo sapiens
ctggagcctgcaggc

SEQ ID NO: 2401593 - DNA, 17 bp, Homo sapiens
ctggagcctgcaggcag

SEQ ID NO: 2401594 - DNA, 19 bp, Homo sapiens
ctggatgtcccctgtccca

SEQ ID NO: 2401595 - DNA, 12 bp, Homo sapiens
ctggccaccctg

SEQ ID NO: 2401596 - DNA, 13 bp, Homo sapiens
ctggccaccctgg

SEQ ID NO: 2401597 - DNA, 15 bp, Homo sapiens
ctggccacctgccag

SEQ ID NO: 2401598 - DNA, 18 bp, Homo sapiens
ctggccacctgccaggcc

SEQ ID NO: 2401599 - DNA, 14 bp, Homo sapiens
ctggcccaagctgg

SEQ ID NO: 2401600 - DNA, 16 bp, Homo sapiens
ctggcccaagctgggc

SEQ ID NO: 2401601 - DNA, 17 bp, Homo sapiens
ctggcccaagctgggct

SEQ ID NO: 2401602 - DNA, 20 bp, Homo sapiens
ctggccccgggctctggcca

SEQ ID NO: 2401603 - DNA, 21 bp, Homo sapiens
ctggccccgggctctggccac

SEQ ID NO: 2401604 - DNA, 22 bp, Homo sapiens
ctggccccgggctctggccacc

SEQ ID NO: 2401605 - DNA, 20 bp, Homo sapiens
ctggcccctccagaccctgc

SEQ ID NO: 2401606 - DNA, 19 bp, Homo sapiens
ctggcccgcccctcgctgc

SEQ ID NO: 2401607 - DNA, 13 bp, Homo sapiens
ctggccctgcctc

SEQ ID NO: 2401608 - DNA, 19 bp, Homo sapiens
ctggccgcaagtccccagc

SEQ ID NO: 2401609 - DNA, 20 bp, Homo sapiens
ctggccgcaagtccccagcc

SEQ ID NO: 2401610 - DNA, 13 bp, Homo sapiens
ctggctacagtac

SEQ ID NO: 2401611 - DNA, 14 bp, Homo sapiens
ctggctggggatgg

SEQ ID NO: 2401612 - DNA, 16 bp, Homo sapiens
ctggcttgtacatttt

SEQ ID NO: 2401613 - DNA, 14 bp, Homo sapiens
ctggcttttctggc

SEQ ID NO: 2401614 - DNA, 22 bp, Homo sapiens
gcgcagcgcctccaccctgccc

SEQ ID NO: 2401615 - DNA, 18 bp, Homo sapiens
gcgccactgcactccagc

SEQ ID NO: 2401616 - DNA, 22 bp, Homo sapiens
gcgccactgcactccagcctgg

SEQ ID NO: 2401617 - DNA, 23 bp, Homo sapiens
gcgccactgcactccagcctggg

SEQ ID NO: 2401618 - DNA, 19 bp, Homo sapiens
gcgccccatgggccctcag

SEQ ID NO: 2401619 - DNA, 17 bp, Homo sapiens
gcgcctccaccctgccc

SEQ ID NO: 2401620 - DNA, 22 bp, Homo sapiens
gcgctgagtggcggggcccctg

SEQ ID NO: 2401621 - DNA, 14 bp, Homo sapiens
gcggcccacgccag

SEQ ID NO: 2401622 - DNA, 15 bp, Homo sapiens
gcggcccacgccagc

SEQ ID NO: 2401623 - DNA, 21 bp, Homo sapiens
gcggcccacgccagctggccc

SEQ ID NO: 2401624 - DNA, 13 bp, Homo sapiens
gcgtccctgctca

SEQ ID NO: 2401625 - DNA, 17 bp, Homo sapiens
gcgtccctgctcagccc

SEQ ID NO: 2401626 - DNA, 20 bp, Homo sapiens
gcgtccctgctcagcccatc

SEQ ID NO: 2401627 - DNA, 19 bp, Homo sapiens
gcgtctccccatgctgggc

SEQ ID NO: 2401628 - DNA, 21 bp, Homo sapiens
gcgtctccccatgctgggctc

SEQ ID NO: 2401629 - DNA, 22 bp, Homo sapiens
gcgtggtgggatttgctcctgg

SEQ ID NO: 2401630 - DNA, 15 bp, Homo sapiens
gctacattcctcagc

SEQ ID NO: 2401631 - DNA, 14 bp, Homo sapiens
gctactcatgaggc

SEQ ID NO: 2401632 - DNA, 21 bp, Homo sapiens
gctactcatgaggctgaggca

SEQ ID NO: 2401633 - DNA, 20 bp, Homo sapiens
gctcactacatgggccagcc

SEQ ID NO: 2401634 - DNA, 22 bp, Homo sapiens
gctcactacatgggccagccct

SEQ ID NO: 2401635 - DNA, 21 bp, Homo sapiens
gctcagatggggcctgggctg

SEQ ID NO: 2401636 - DNA, 14 bp, Homo sapiens
gctcagcccatccc

SEQ ID NO: 2401637 - DNA, 22 bp, Homo sapiens
gctcagcccatcccctgcctct

SEQ ID NO: 2401638 - DNA, 17 bp, Homo sapiens
gctcatgttcaggcaga

SEQ ID NO: 2401639 - DNA, 18 bp, Homo sapiens
gctcccagcccctacctt

SEQ ID NO: 2401640 - DNA, 17 bp, Homo sapiens
gctccctttaagccaag

SEQ ID NO: 2401641 - DNA, 11 bp, Homo sapiens
gctcctgccca

SEQ ID NO: 2401642 - DNA, 15 bp, Homo sapiens
gctcctgcccacgtg

SEQ ID NO: 2401643 - DNA, 16 bp, Homo sapiens
gctcctgcccacgtgc

SEQ ID NO: 2401644 - DNA, 14 bp, Homo sapiens
gctctacctggccg

SEQ ID NO: 2401645 - DNA, 12 bp, Homo sapiens
gctctggccacc

SEQ ID NO: 2401646 - DNA, 13 bp, Homo sapiens
gctctggccaccc

SEQ ID NO: 2401647 - DNA, 17 bp, Homo sapiens
gctctggccaccctggc

SEQ ID NO: 2401648 - DNA, 21 bp, Homo sapiens
gctctggccaccctggcccgc

SEQ ID NO: 2401649 - DNA, 12 bp, Homo sapiens
gctctgtggcct

SEQ ID NO: 2401650 - DNA, 22 bp, Homo sapiens
gctgagtcacctcctccactca

SEQ ID NO: 2401651 - DNA, 18 bp, Homo sapiens
gctgcacattcctggccc

SEQ ID NO: 2401652 - DNA, 20 bp, Homo sapiens
gctgcacattcctggccccg

SEQ ID NO: 2401653 - DNA, 14 bp, Homo sapiens
gctgccccctggct

SEQ ID NO: 2401654 - DNA, 13 bp, Homo sapiens
gctgctctgaggt

SEQ ID NO: 2401655 - DNA, 13 bp, Homo sapiens
gctgctggcgcct

SEQ ID NO: 2401656 - DNA, 15 bp, Homo sapiens
gctgctgtctcgggg

SEQ ID NO: 2401657 - DNA, 14 bp, Homo sapiens
gctggagaccagaa

SEQ ID NO: 2401658 - DNA, 23 bp, Homo sapiens
gctgggctccctttaagccaaga

SEQ ID NO: 2401659 - DNA, 16 bp, Homo sapiens
gctggtgtcttgagac

SEQ ID NO: 2401660 - DNA, 18 bp, Homo sapiens
gctggtgtcttgagacca

SEQ ID NO: 2401661 - DNA, 22 bp, Homo sapiens
gctggtgtcttgagaccagcct

SEQ ID NO: 2401662 - DNA, 18 bp, Homo sapiens
gctgtccattgccacggc

SEQ ID NO: 2401663 - DNA, 14 bp, Homo sapiens
gctgtgggtgggga

SEQ ID NO: 2401664 - DNA, 18 bp, Homo sapiens
gctgttgtgtctggagcc

SEQ ID NO: 2401665 - DNA, 12 bp, Homo sapiens
gcttccccagct

SEQ ID NO: 2401666 - DNA, 16 bp, Homo sapiens
gcttccccagctcaga

SEQ ID NO: 2401667 - DNA, 13 bp, Homo sapiens
gcttcctgggcag

SEQ ID NO: 2401668 - DNA, 18 bp, Homo sapiens
gcttgcaatgagccaaga

SEQ ID NO: 2401669 - DNA, 21 bp, Homo sapiens
gcttggcagttgcagtgctgc

SEQ ID NO: 2401670 - DNA, 21 bp, Homo sapiens
gcttgtacatttttaaattct

SEQ ID NO: 2401671 - DNA, 20 bp, Homo sapiens
gctttccatctgaggaccag

SEQ ID NO: 2401672 - DNA, 22 bp, Homo sapiens
gctttctttggtaggtaaatct

SEQ ID NO: 2401673 - DNA, 23 bp, Homo sapiens
gctttctttggtaggtaaatcta

SEQ ID NO: 2401674 - DNA, 16 bp, Homo sapiens
ggacagagtgccctgg

SEQ ID NO: 2401675 - DNA, 17 bp, Homo sapiens
ggaccaggccaatccct

SEQ ID NO: 2401676 - DNA, 21 bp, Homo sapiens
ggaccaggccaatcccttctc

SEQ ID NO: 2401677 - DNA, 18 bp, Homo sapiens
ggaccattgacctcagct

SEQ ID NO: 2401678 - DNA, 24 bp, Homo sapiens
ggaccattgacctcagctgcacat

SEQ ID NO: 2401679 - DNA, 15 bp, Homo sapiens
ggaccccgcctgccc

SEQ ID NO: 2401680 - DNA, 18 bp, Homo sapiens
ggacctccccctgtgtgg

SEQ ID NO: 2401681 - DNA, 23 bp, Homo sapiens
ggacctccccctgtgtggccctg

SEQ ID NO: 2401682 - DNA, 19 bp, Homo sapiens
ggactccaggatcctcctg

SEQ ID NO: 2401683 - DNA, 16 bp, Homo sapiens
ggactgcacaggcagc

SEQ ID NO: 2401684 - DNA, 20 bp, Homo sapiens
ggagaccagaacagcatggc

SEQ ID NO: 2401685 - DNA, 16 bp, Homo sapiens
ggagcagcagctgagg

SEQ ID NO: 2401686 - DNA, 16 bp, Homo sapiens
ggagccattctgtccc

SEQ ID NO: 2401687 - DNA, 20 bp, Homo sapiens
ggagccgcttccccagctca

SEQ ID NO: 2401688 - DNA, 22 bp, Homo sapiens
ggagctagcagaagacaaggca

SEQ ID NO: 2401689 - DNA, 18 bp, Homo sapiens
ggagctgagtcacctcct

SEQ ID NO: 2401690 - DNA, 21 bp, Homo sapiens
ggagcttgcaatgagccaaga

SEQ ID NO: 2401691 - DNA, 22 bp, Homo sapiens
ggaggacagagtgccctggggc

SEQ ID NO: 2401692 - DNA, 24 bp, Homo sapiens
ggaggcccaatgaggtggctcatg

SEQ ID NO: 2401693 - DNA, 16 bp, Homo sapiens
ggaggctgctgccccc

SEQ ID NO: 2401694 - DNA, 22 bp, Homo sapiens
ggaggtggagcttgcaatgagc

SEQ ID NO: 2401695 - DNA, 23 bp, Homo sapiens
ggaggtgggtgagcgggtggggt

SEQ ID NO: 2401696 - DNA, 19 bp, Homo sapiens
ggatcccctgaggtcagga

SEQ ID NO: 2401697 - DNA, 14 bp, Homo sapiens
ggatgacttgggga

SEQ ID NO: 2401698 - DNA, 15 bp, Homo sapiens
ggatgcccctggccc

SEQ ID NO: 2401699 - DNA, 16 bp, Homo sapiens
ggatgcccctggccct

SEQ ID NO: 2401700 - DNA, 19 bp, Homo sapiens
ggatgcccctggccctgcc

SEQ ID NO: 2401701 - DNA, 17 bp, Homo sapiens
ggatgtcccctgtccca

SEQ ID NO: 2401702 - DNA, 19 bp, Homo sapiens
ggcagaaccggtcccagcc

SEQ ID NO: 2401703 - DNA, 21 bp, Homo sapiens
ggcagaagagaaaccatcctc

SEQ ID NO: 2401704 - DNA, 22 bp, Homo sapiens
ggcaggaggatcccctgaggtc

SEQ ID NO: 2401705 - DNA, 24 bp, Homo sapiens
ggcagttggggcggcccacgccag

SEQ ID NO: 2401706 - DNA, 18 bp, Homo sapiens
ggcatccaccttcctgcc

SEQ ID NO: 2401707 - DNA, 21 bp, Homo sapiens
ggcatccaccttcctgcccag

SEQ ID NO: 2401708 - DNA, 13 bp, Homo sapiens
ggcatgcctggcc

SEQ ID NO: 2401709 - DNA, 15 bp, Homo sapiens
ggcatgcctggcctg

SEQ ID NO: 2401710 - DNA, 14 bp, Homo sapiens
ggcatggtggcatg

SEQ ID NO: 2401711 - DNA, 22 bp, Homo sapiens
ggccaagagatgcagtgccagg

SEQ ID NO: 2401712 - DNA, 17 bp, Homo sapiens
ggccaatcccttctcca

SEQ ID NO: 2401713 - DNA, 12 bp, Homo sapiens
ggccaccctcct

SEQ ID NO: 2401714 - DNA, 16 bp, Homo sapiens
ggccaccctccttccc

SEQ ID NO: 2401715 - DNA, 13 bp, Homo sapiens
ggccaccctggcc

SEQ ID NO: 2401716 - DNA, 15 bp, Homo sapiens
ggccaccctggcccg

SEQ ID NO: 2401717 - DNA, 16 bp, Homo sapiens
ggccacctgccaggcc

SEQ ID NO: 2401718 - DNA, 13 bp, Homo sapiens
ggccacgggacct

SEQ ID NO: 2401719 - DNA, 15 bp, Homo sapiens
ggccacgggaccttc

SEQ ID NO: 2401720 - DNA, 13 bp, Homo sapiens
ggccagaggccca

SEQ ID NO: 2401721 - DNA, 14 bp, Homo sapiens
ggccatgagggctg

SEQ ID NO: 2401722 - DNA, 23 bp, Homo sapiens
ggccatgagggctggagaccaga

SEQ ID NO: 2401723 - DNA, 16 bp, Homo sapiens
ggcccaagctgggctc

SEQ ID NO: 2401724 - DNA, 18 bp, Homo sapiens
ggcccaagctgggctccc

SEQ ID NO: 2401725 - DNA, 19 bp, Homo sapiens
ggcccaagctgggctccct

SEQ ID NO: 2401726 - DNA, 19 bp, Homo sapiens
ggcccaatgaggtggctca

SEQ ID NO: 2401727 - DNA, 16 bp, Homo sapiens
ggcccacgccagctgg

SEQ ID NO: 2401728 - DNA, 20 bp, Homo sapiens
ggccccggatgacttgggga

SEQ ID NO: 2401729 - DNA, 22 bp, Homo sapiens
ggcccctgctccgaggggctca

SEQ ID NO: 2401730 - DNA, 16 bp, Homo sapiens
tgaaccaggccttctg

SEQ ID NO: 2401731 - DNA, 17 bp, Homo sapiens
tgaaccaggccttctga

SEQ ID NO: 2401732 - DNA, 21 bp, Homo sapiens
tgaacgtacccaaggtcacat

SEQ ID NO: 2401733 - DNA, 12 bp, Homo sapiens
tgaactgagccg

SEQ ID NO: 2401734 - DNA, 21 bp, Homo sapiens
tgaactgagccgtgcagctgg

SEQ ID NO: 2401735 - DNA, 20 bp, Homo sapiens
tgaactggcttgtacatttt

SEQ ID NO: 2401736 - DNA, 21 bp, Homo sapiens
tgaaggacctccccctgtgtg

SEQ ID NO: 2401737 - DNA, 16 bp, Homo sapiens
tgaaggtcataagttt

SEQ ID NO: 2401738 - DNA, 14 bp, Homo sapiens
tgaataaataccca

SEQ ID NO: 2401739 - DNA, 10 bp, Homo sapiens
tgacattcct

SEQ ID NO: 2401740 - DNA, 11 bp, Homo sapiens
tgacattcctt

SEQ ID NO: 2401741 - DNA, 22 bp, Homo sapiens
tgacctcagctgcacattcctg

SEQ ID NO: 2401742 - DNA, 16 bp, Homo sapiens
tgacctgctcctgccc

SEQ ID NO: 2401743 - DNA, 17 bp, Homo sapiens
tgacctgctcctgccca

SEQ ID NO: 2401744 - DNA, 19 bp, Homo sapiens
tgacgaactggctacagta

SEQ ID NO: 2401745 - DNA, 15 bp, Homo sapiens
tgactaaaccattgt

SEQ ID NO: 2401746 - DNA, 19 bp, Homo sapiens
tgactaaaccattgtgcat

SEQ ID NO: 2401747 - DNA, 14 bp, Homo sapiens
tgacttttctgacc

SEQ ID NO: 2401748 - DNA, 15 bp, Homo sapiens
tgagaccagcctgcc

SEQ ID NO: 2401749 - DNA, 18 bp, Homo sapiens
tgagaccctcttctctgg

SEQ ID NO: 2401750 - DNA, 19 bp, Homo sapiens
tgagaccctcttctctggg

SEQ ID NO: 2401751 - DNA, 21 bp, Homo sapiens
tgagaccctcttctctgggcc

SEQ ID NO: 2401752 - DNA, 18 bp, Homo sapiens
tgagagggggatgcccct

SEQ ID NO: 2401753 - DNA, 20 bp, Homo sapiens
tgagagggggatgcccctgg

SEQ ID NO: 2401754 - DNA, 21 bp, Homo sapiens
tgagatgggagagcaacaagt

SEQ ID NO: 2401755 - DNA, 22 bp, Homo sapiens
tgagcacagacggaggaagccg

SEQ ID NO: 2401756 - DNA, 15 bp, Homo sapiens
tgagcatatgttcca

SEQ ID NO: 2401757 - DNA, 20 bp, Homo sapiens
tgagcatatgttccatgcct

SEQ ID NO: 2401758 - DNA, 22 bp, Homo sapiens
tgagccaagattgcgccactgc

SEQ ID NO: 2401759 - DNA, 22 bp, Homo sapiens
tgagcccaggagctgagtcacc

SEQ ID NO: 2401760 - DNA, 22 bp, Homo sapiens
tgagcgcagcgcctccaccctg

SEQ ID NO: 2401761 - DNA, 14 bp, Homo sapiens
tgagcgggtggggt

SEQ ID NO: 2401762 - DNA, 18 bp, Homo sapiens
tgaggaacggatcagatg

SEQ ID NO: 2401763 - DNA, 24 bp, Homo sapiens
tgaggcaggaggatcccctgaggt

SEQ ID NO: 2401764 - DNA, 23 bp, Homo sapiens
tgaggccccagggctgtgggtgg

SEQ ID NO: 2401765 - DNA, 12 bp, Homo sapiens
tgaggctgaggc

SEQ ID NO: 2401766 - DNA, 18 bp, Homo sapiens
tgagggtgtttcctctaa

SEQ ID NO: 2401767 - DNA, 19 bp, Homo sapiens
tgagggtgtttcctctaaa

SEQ ID NO: 2401768 - DNA, 13 bp, Homo sapiens
tgagtcacctcct

SEQ ID NO: 2401769 - DNA, 23 bp, Homo sapiens
tgagtcacctcctccactcactc

SEQ ID NO: 2401770 - DNA, 20 bp, Homo sapiens
tgagtgaggagtggacgctg

SEQ ID NO: 2401771 - DNA, 14 bp, Homo sapiens
tgataatacccaca

SEQ ID NO: 2401772 - DNA, 16 bp, Homo sapiens
tgataatacccacatt

SEQ ID NO: 2401773 - DNA, 14 bp, Homo sapiens
tgatagaactgtac

SEQ ID NO: 2401774 - DNA, 15 bp, Homo sapiens
tgatagaactgtact

SEQ ID NO: 2401775 - DNA, 14 bp, Homo sapiens
tgatccagggattg

SEQ ID NO: 2401776 - DNA, 18 bp, Homo sapiens
tgattaacaatgtatttt

SEQ ID NO: 2401777 - DNA, 19 bp, Homo sapiens
tgattagctttgtcactgt

SEQ ID NO: 2401778 - DNA, 14 bp, Homo sapiens
tgattcatgtgctt

SEQ ID NO: 2401779 - DNA, 16 bp, Homo sapiens
tgatttattgaaattt

SEQ ID NO: 2401780 - DNA, 22 bp, Homo sapiens
tgatttttttttttttcctgtc

SEQ ID NO: 2401781 - DNA, 13 bp, Homo sapiens
tgcaaaagaagtg

SEQ ID NO: 2401782 - DNA, 22 bp, Homo sapiens
tgcacaggcagcaaggtcatgg

SEQ ID NO: 2401783 - DNA, 18 bp, Homo sapiens
tgcacattcctggccccg

SEQ ID NO: 2401784 - DNA, 14 bp, Homo sapiens
tgcactccagcctg

SEQ ID NO: 2401785 - DNA, 20 bp, Homo sapiens
tgcactccagcctgggtgac

SEQ ID NO: 2401786 - DNA, 16 bp, Homo sapiens
tgcactccatggccac

SEQ ID NO: 2401787 - DNA, 19 bp, Homo sapiens
tgcactccatggccacccc

SEQ ID NO: 2401788 - DNA, 12 bp, Homo sapiens
tgcagcacctgt

SEQ ID NO: 2401789 - DNA, 16 bp, Homo sapiens
tgcagctgggatttga

SEQ ID NO: 2401790 - DNA, 15 bp, Homo sapiens
tgcatatgcttctga

SEQ ID NO: 2401791 - DNA, 17 bp, Homo sapiens
tgcatcttgctctgtgg

SEQ ID NO: 2401792 - DNA, 23 bp, Homo sapiens
tgcatcttgctctgtggccttgg

SEQ ID NO: 2401793 - DNA, 14 bp, Homo sapiens
tgccaagcactcga

SEQ ID NO: 2401794 - DNA, 20 bp, Homo sapiens
tgccacactttcactgggga

SEQ ID NO: 2401795 - DNA, 17 bp, Homo sapiens
tgccacccgtaggcagc

SEQ ID NO: 2401796 - DNA, 16 bp, Homo sapiens
tgccacttgacattcc

SEQ ID NO: 2401797 - DNA, 19 bp, Homo sapiens
tgccagcgcagcgccaggg

SEQ ID NO: 2401798 - DNA, 15 bp, Homo sapiens
tgccaggccctccag

SEQ ID NO: 2401799 - DNA, 17 bp, Homo sapiens
tgcccacgcccctcccc

SEQ ID NO: 2401800 - DNA, 18 bp, Homo sapiens
tgcccacgcccctcccca

SEQ ID NO: 2401801 - DNA, 20 bp, Homo sapiens
tgcccacgcccctccccagc

SEQ ID NO: 2401802 - DNA, 18 bp, Homo sapiens
tgcccacgtgcagcacct

SEQ ID NO: 2401803 - DNA, 19 bp, Homo sapiens
tgcccacgtgcagcacctg

SEQ ID NO: 2401804 - DNA, 19 bp, Homo sapiens
tgcccctggccctgcctca

SEQ ID NO: 2401805 - DNA, 13 bp, Homo sapiens
tgcccgccagcct

SEQ ID NO: 2401806 - DNA, 13 bp, Homo sapiens
tgcccgtgcctct

SEQ ID NO: 2401807 - DNA, 12 bp, Homo sapiens
tgccctgccatt

SEQ ID NO: 2401808 - DNA, 22 bp, Homo sapiens
tgccctggggcatccaccttcc

SEQ ID NO: 2401809 - DNA, 13 bp, Homo sapiens
tgccggggcctgg

SEQ ID NO: 2401810 - DNA, 15 bp, Homo sapiens
tgcctcactgtgacc

SEQ ID NO: 2401811 - DNA, 18 bp, Homo sapiens
tgcctctatccctggcca

SEQ ID NO: 2401812 - DNA, 13 bp, Homo sapiens
tgcctctcagcca

SEQ ID NO: 2401813 - DNA, 12 bp, Homo sapiens
tgcctggccctt

SEQ ID NO: 2401814 - DNA, 16 bp, Homo sapiens
tgcctggcctgaggac

SEQ ID NO: 2401815 - DNA, 20 bp, Homo sapiens
tgcctgtattcccagctact

SEQ ID NO: 2401816 - DNA, 19 bp, Homo sapiens
tgccttaaataaaactgca

SEQ ID NO: 2401817 - DNA, 23 bp, Homo sapiens
tgcgccactgcactccagcctgg

SEQ ID NO: 2401818 - DNA, 14 bp, Homo sapiens
tgcggggccccgga

SEQ ID NO: 2401819 - DNA, 15 bp, Homo sapiens
tgcgtccctgctcag

SEQ ID NO: 2401820 - DNA, 18 bp, Homo sapiens
tgctcaataaagaagccc

SEQ ID NO: 2401821 - DNA, 21 bp, Homo sapiens
tgctcaataaagaagcccatg

SEQ ID NO: 2401822 - DNA, 23 bp, Homo sapiens
tgctcagcccatcccctgcctct

SEQ ID NO: 2401823 - DNA, 13 bp, Homo sapiens
tgctcctgcccac

SEQ ID NO: 2401824 - DNA, 21 bp, Homo sapiens
tgctcctgcccacgtgcagca

SEQ ID NO: 2401825 - DNA, 12 bp, Homo sapiens
tgctccttcctg

SEQ ID NO: 2401826 - DNA, 19 bp, Homo sapiens
tgctccttcctgtggcctc

SEQ ID NO: 2401827 - DNA, 14 bp, Homo sapiens
tgctctacctggcc

SEQ ID NO: 2401828 - DNA, 15 bp, Homo sapiens
tgctctacctggccg

SEQ ID NO: 2401829 - DNA, 21 bp, Homo sapiens
tgctctgtggccttggccctg

SEQ ID NO: 2401830 - DNA, 14 bp, Homo sapiens
tgctgccccctggc

SEQ ID NO: 2401831 - DNA, 13 bp, Homo sapiens
tgctgctactacc

SEQ ID NO: 2401832 - DNA, 16 bp, Homo sapiens
tgcttatattgttcac

SEQ ID NO: 2401833 - DNA, 16 bp, Homo sapiens
tggacacagcccaccc

SEQ ID NO: 2401834 - DNA, 17 bp, Homo sapiens
tggacaccacccagagc

SEQ ID NO: 2401835 - DNA, 13 bp, Homo sapiens
tggacgctgtcca

SEQ ID NO: 2401836 - DNA, 18 bp, Homo sapiens
tggactgcacaggcagca

SEQ ID NO: 2401837 - DNA, 20 bp, Homo sapiens
tggagaccagaacagcatgg

SEQ ID NO: 2401838 - DNA, 21 bp, Homo sapiens
tggagcaacctactgtctaag

SEQ ID NO: 2401839 - DNA, 19 bp, Homo sapiens
tggagccgcttccccagct

SEQ ID NO: 2401840 - DNA, 23 bp, Homo sapiens
tggagccgcttccccagctcaga

SEQ ID NO: 2401841 - DNA, 13 bp, Homo sapiens
tggcagttgcagt

SEQ ID NO: 2401842 - DNA, 18 bp, Homo sapiens
tggccacctgccaggcct

SEQ ID NO: 2401843 - DNA, 23 bp, Homo sapiens
tggccacctgccaggcctccctc

SEQ ID NO: 2401844 - DNA, 21 bp, Homo sapiens
tggccactgggtctcactcct

SEQ ID NO: 2401845 - DNA, 15 bp, Homo sapiens
tggcccaagctgggc

SEQ ID NO: 2401846 - DNA, 18 bp, Homo sapiens
cttacctattttctgcag

SEQ ID NO: 2401847 - DNA, 23 bp, Homo sapiens
cttacgccctgttcccttcctgc

SEQ ID NO: 2401848 - DNA, 14 bp, Homo sapiens
cttcctgccctgtg

SEQ ID NO: 2401849 - DNA, 18 bp, Homo sapiens
cttgctgagacttacgcc

SEQ ID NO: 2401850 - DNA, 20 bp, Homo sapiens
ctttgtgctaaatcctagca

SEQ ID NO: 2401851 - DNA, 18 bp, Homo sapiens
gaaaaggcaaaagaatgg

SEQ ID NO: 2401852 - DNA, 18 bp, Homo sapiens
gaagcatccaaagattgc

SEQ ID NO: 2401853 - DNA, 22 bp, Homo sapiens
gacactgccttgaagcctcctg

SEQ ID NO: 2401854 - DNA, 19 bp, Homo sapiens
gaccaataaaaaaataagt

SEQ ID NO: 2401855 - DNA, 23 bp, Homo sapiens
gaggagaaacctgcatgaaagca

SEQ ID NO: 2401856 - DNA, 17 bp, Homo sapiens
gagtcaccacttcctct

SEQ ID NO: 2401857 - DNA, 16 bp, Homo sapiens
gataagttatagagca

SEQ ID NO: 2401858 - DNA, 16 bp, Homo sapiens
gataatgcagataaat

SEQ ID NO: 2401859 - DNA, 20 bp, Homo sapiens
gataatgcagataaatacat

SEQ ID NO: 2401860 - DNA, 23 bp, Homo sapiens
gataatgcagataaatacattta

SEQ ID NO: 2401861 - DNA, 22 bp, Homo sapiens
gatgaaactttgaaaaagatat

SEQ ID NO: 2401862 - DNA, 15 bp, Homo sapiens
gattactccttcctt

SEQ ID NO: 2401863 - DNA, 14 bp, Homo sapiens
gcagataaatacat

SEQ ID NO: 2401864 - DNA, 18 bp, Homo sapiens
gcattctgtataaatgca

SEQ ID NO: 2401865 - DNA, 16 bp, Homo sapiens
gccagctgggtgcccc

SEQ ID NO: 2401866 - DNA, 20 bp, Homo sapiens
gccagctgggtgccccaggg

SEQ ID NO: 2401867 - DNA, 21 bp, Homo sapiens
gcccacgggccggccagctgg

SEQ ID NO: 2401868 - DNA, 17 bp, Homo sapiens
gccccacatccccacct

SEQ ID NO: 2401869 - DNA, 19 bp, Homo sapiens
gccccacatccccacctgg

SEQ ID NO: 2401870 - DNA, 23 bp, Homo sapiens
gccccagggacgtgataatgcag

SEQ ID NO: 2401871 - DNA, 18 bp, Homo sapiens
gccctgtggcccacgggc

SEQ ID NO: 2401872 - DNA, 15 bp, Homo sapiens
gccctgttcccttcc

SEQ ID NO: 2401873 - DNA, 21 bp, Homo sapiens
gcctcatacgtttaaaataaa

SEQ ID NO: 2401874 - DNA, 14 bp, Homo sapiens
gcctgaccccttca

SEQ ID NO: 2401875 - DNA, 14 bp, Homo sapiens
gccttgctgagact

SEQ ID NO: 2401876 - DNA, 17 bp, Homo sapiens
gccttgctgagacttac

SEQ ID NO: 2401877 - DNA, 22 bp, Homo sapiens
gctgagacttacgccctgttcc

SEQ ID NO: 2401878 - DNA, 17 bp, Homo sapiens
gctgggtgccccaggga

SEQ ID NO: 2401879 - DNA, 21 bp, Homo sapiens
ggctgccccacatccccacct

SEQ ID NO: 2401880 - DNA, 20 bp, Homo sapiens
gggccggccagctgggtgcc

SEQ ID NO: 2401881 - DNA, 22 bp, Homo sapiens
ggtggccactgcagcacctgcc

SEQ ID NO: 2401882 - DNA, 18 bp, Homo sapiens
gtaattctaataatgcac

SEQ ID NO: 2401883 - DNA, 20 bp, Homo sapiens
gtccatagatataaagccat

SEQ ID NO: 2401884 - DNA, 23 bp, Homo sapiens
gtgcaaatggtttatagccctgt

SEQ ID NO: 2401885 - DNA, 16 bp, Homo sapiens
gtgctaaatcctagca

SEQ ID NO: 2401886 - DNA, 20 bp, Homo sapiens
gtggcccacgggccggccag

SEQ ID NO: 2401887 - DNA, 17 bp, Homo sapiens
gtgtccatagatataaa

SEQ ID NO: 2401888 - DNA, 20 bp, Homo sapiens
taaagccatttggtcttaat

SEQ ID NO: 2401889 - DNA, 14 bp, Homo sapiens
taaatacatttata

SEQ ID NO: 2401890 - DNA, 19 bp, Homo sapiens
tacgccctgttcccttcct

SEQ ID NO: 2401891 - DNA, 20 bp, Homo sapiens
tacgccctgttcccttcctg

SEQ ID NO: 2401892 - DNA, 19 bp, Homo sapiens
tactaatttcctgctgaaa

SEQ ID NO: 2401893 - DNA, 14 bp, Homo sapiens
tagcagacactgcc

SEQ ID NO: 2401894 - DNA, 21 bp, Homo sapiens
tatcctgatcaagcatggaac

SEQ ID NO: 2401895 - DNA, 12 bp, Homo sapiens
tatgtgatgaaa

SEQ ID NO: 2401896 - DNA, 22 bp, Homo sapiens
tatgttatttagtcattatgag

SEQ ID NO: 2401897 - DNA, 19 bp, Homo sapiens
tcacaatccacaaatgatg

SEQ ID NO: 2401898 - DNA, 17 bp, Homo sapiens
tccacccccataagatt

SEQ ID NO: 2401899 - DNA, 13 bp, Homo sapiens
tccctcctcagct

SEQ ID NO: 2401900 - DNA, 16 bp, Homo sapiens
tccctcctcagctcca

SEQ ID NO: 2401901 - DNA, 18 bp, Homo sapiens
tcctagcagacactgcct

SEQ ID NO: 2401902 - DNA, 18 bp, Homo sapiens
tctaaaggacatacattt

SEQ ID NO: 2401903 - DNA, 20 bp, Homo sapiens
tctgacgagtgtccatagat

SEQ ID NO: 2401904 - DNA, 17 bp, Homo sapiens
tctgcctgaccccttca

SEQ ID NO: 2401905 - DNA, 16 bp, Homo sapiens
tctgtggaaatatgag

SEQ ID NO: 2401906 - DNA, 15 bp, Homo sapiens
tcttgaaatttgtga

SEQ ID NO: 2401907 - DNA, 14 bp, Homo sapiens
tgaaagctttgaaa

SEQ ID NO: 2401908 - DNA, 19 bp, Homo sapiens
ttggacaatctgcaaaatg

SEQ ID NO: 2401909 - DNA, 23 bp, Homo sapiens
ttggagtcaaaaggcaaatcatt

SEQ ID NO: 2401910 - DNA, 18 bp, Homo sapiens
ttgtgctaaatcctagca

SEQ ID NO: 2401911 - DNA, 22 bp, Homo sapiens
tttactgctccttccatctgcc

SEQ ID NO: 2401912 - DNA, 14 bp, Homo sapiens
tttctgcttcctta

SEQ ID NO: 2401913 - DNA, 21 bp, Homo sapiens
aatggtttatagccctgtgaa

SEQ ID NO: 2401914 - DNA, 19 bp, Homo sapiens
aattaactatcatcagtcc

SEQ ID NO: 2401915 - DNA, 15 bp, Homo sapiens
aattctaataatgca

SEQ ID NO: 2401916 - DNA, 20 bp, Homo sapiens
acacaataggatcccccttc

SEQ ID NO: 2401917 - DNA, 21 bp, Homo sapiens
acctggcggagctctcctccg

SEQ ID NO: 2401918 - DNA, 12 bp, Homo sapiens
acgccctgttcc

SEQ ID NO: 2401919 - DNA, 17 bp, Homo sapiens
acgccctgttcccttcc

SEQ ID NO: 2401920 - DNA, 18 bp, Homo sapiens
acgccctgttcccttcct

SEQ ID NO: 2401921 - DNA, 15 bp, Homo sapiens
acgggccggccagct

SEQ ID NO: 2401922 - DNA, 16 bp, Homo sapiens
acgtgataatgcagat

SEQ ID NO: 2401923 - DNA, 16 bp, Homo sapiens
acgtttaaaataaaac

SEQ ID NO: 2401924 - DNA, 12 bp, Homo sapiens
actgctccttcc

SEQ ID NO: 2401925 - DNA, 15 bp, Homo sapiens
actttgaaaaagata

SEQ ID NO: 2401926 - DNA, 16 bp, Homo sapiens
actttgaaaaagatat

SEQ ID NO: 2401927 - DNA, 17 bp, Homo sapiens
actttgaaaaagatatt

SEQ ID NO: 2401928 - DNA, 20 bp, Homo sapiens
agaaaattggactggtgaaa

SEQ ID NO: 2401929 - DNA, 19 bp, Homo sapiens
agacttacgccctgttccc

SEQ ID NO: 2401930 - DNA, 22 bp, Homo sapiens
agaggagttaaccccaaaggtg

SEQ ID NO: 2401931 - DNA, 14 bp, Homo sapiens
agatataaagccat

SEQ ID NO: 2401932 - DNA, 18 bp, Homo sapiens
agcatggaacaaagcatg

SEQ ID NO: 2401933 - DNA, 13 bp, Homo sapiens
agcattcttccct

SEQ ID NO: 2401934 - DNA, 16 bp, Homo sapiens
agctgggtgccccagg

SEQ ID NO: 2401935 - DNA, 18 bp, Homo sapiens
agctttgaaataaaataa

SEQ ID NO: 2401936 - DNA, 16 bp, Homo sapiens
aggacatacatttaat

SEQ ID NO: 2401937 - DNA, 18 bp, Homo sapiens
aggataagttatagagca

SEQ ID NO: 2401938 - DNA, 13 bp, Homo sapiens
aggatcccccttc

SEQ ID NO: 2401939 - DNA, 14 bp, Homo sapiens
aggcaaatcatttg

SEQ ID NO: 2401940 - DNA, 23 bp, Homo sapiens
agtaatgagttaaataaaacatt

SEQ ID NO: 2401941 - DNA, 21 bp, Homo sapiens
ataaagccatttggtcttaat

SEQ ID NO: 2401942 - DNA, 10 bp, Homo sapiens
ataagattgt

SEQ ID NO: 2401943 - DNA, 22 bp, Homo sapiens
ataagttgttttgttttatagc

SEQ ID NO: 2401944 - DNA, 17 bp, Homo sapiens
atacaatcttggagtca

SEQ ID NO: 2401945 - DNA, 17 bp, Homo sapiens
atagatataaagccatt

SEQ ID NO: 2401946 - DNA, 15 bp, Homo sapiens
atagccctgtgaagt

SEQ ID NO: 2401947 - DNA, 23 bp, Homo sapiens
atccccacctggcggagctctcc

SEQ ID NO: 2401948 - DNA, 11 bp, Homo sapiens
atgaaagcatt

SEQ ID NO: 2401949 - DNA, 13 bp, Homo sapiens
atggttttatttc

SEQ ID NO: 2401950 - DNA, 16 bp, Homo sapiens
attaactatcatcagt

SEQ ID NO: 2401951 - DNA, 15 bp, Homo sapiens
attatataaggcatt

SEQ ID NO: 2401952 - DNA, 14 bp, Homo sapiens
caaagcatgtttca

SEQ ID NO: 2401953 - DNA, 14 bp, Homo sapiens
cacatccccacctg

SEQ ID NO: 2401954 - DNA, 23 bp, Homo sapiens
cacctggcggagctctcctccgc

SEQ ID NO: 2401955 - DNA, 14 bp, Homo sapiens
cacgggccggccag

SEQ ID NO: 2401956 - DNA, 17 bp, Homo sapiens
cacgggccggccagctg

SEQ ID NO: 2401957 - DNA, 13 bp, Homo sapiens
cagataaatacat

SEQ ID NO: 2401958 - DNA, 15 bp, Homo sapiens
cagataaatacattt

SEQ ID NO: 2401959 - DNA, 22 bp, Homo sapiens
cagtaatgagttaaataaaaca

SEQ ID NO: 2401960 - DNA, 16 bp, Homo sapiens
cataagattgtgaagg

SEQ ID NO: 2401961 - DNA, 13 bp, Homo sapiens
catacgtttaaaa

SEQ ID NO: 2401962 - DNA, 15 bp, Homo sapiens
catagatataaagcc

SEQ ID NO: 2401963 - DNA, 14 bp, Homo sapiens
catcagtcctgcat

SEQ ID NO: 2401964 - DNA, 17 bp, Homo sapiens
catcagtcctgcatttc

SEQ ID NO: 2401965 - DNA, 12 bp, Homo sapiens
catccaaagatt

SEQ ID NO: 2401966 - DNA, 14 bp, Homo sapiens
catccaaagattgc

SEQ ID NO: 2401967 - DNA, 14 bp, Homo sapiens
catttatattttta

SEQ ID NO: 2401968 - DNA, 15 bp, Homo sapiens
catttatatttttaa

SEQ ID NO: 2401969 - DNA, 13 bp, Homo sapiens
ccacctggcggag

SEQ ID NO: 2401970 - DNA, 19 bp, Homo sapiens
ccatctgcctgaccccttc

SEQ ID NO: 2401971 - DNA, 22 bp, Homo sapiens
cccagggacgtgataatgcaga

SEQ ID NO: 2401972 - DNA, 23 bp, Homo sapiens
cccagggacgtgataatgcagat

SEQ ID NO: 2401973 - DNA, 20 bp, Homo sapiens
ccctgaaattatataaggca

SEQ ID NO: 2401974 - DNA, 20 bp, Homo sapiens
ccctgtggcccacgggccgg

SEQ ID NO: 2401975 - DNA, 14 bp, Homo sapiens
ccctgttcccttcc

SEQ ID NO: 2401976 - DNA, 17 bp, Homo sapiens
cccttcctgccctgtgg

SEQ ID NO: 2401977 - DNA, 16 bp, Homo sapiens
ccgtcacctctccctc

SEQ ID NO: 2401978 - DNA, 16 bp, Homo sapiens
cctagcagacactgcc

SEQ ID NO: 2401979 - DNA, 20 bp, Homo sapiens
cctcatacgtttaaaataaa

SEQ ID NO: 2401980 - DNA, 20 bp, Homo sapiens
cctccgccttgctgagactt

SEQ ID NO: 2401981 - DNA, 13 bp, Homo sapiens
cctgaccccttca

SEQ ID NO: 2401982 - DNA, 22 bp, Homo sapiens
cctgtggcccacgggccggcca

SEQ ID NO: 2401983 - DNA, 18 bp, Homo sapiens
cgccctgttcccttcctg

SEQ ID NO: 2401984 - DNA, 20 bp, Homo sapiens
cggccagctgggtgccccag

SEQ ID NO: 2401985 - DNA, 23 bp, Homo sapiens
cggccagctgggtgccccaggga

SEQ ID NO: 2401986 - DNA, 13 bp, Homo sapiens
cgggccggccagc

SEQ ID NO: 2401987 - DNA, 17 bp, Homo sapiens
cgggccggccagctggg

SEQ ID NO: 2401988 - DNA, 17 bp, Homo sapiens
ctaatttcctgctgaaa

SEQ ID NO: 2401989 - DNA, 14 bp, Homo sapiens
ctactccttttcct

SEQ ID NO: 2401990 - DNA, 22 bp, Homo sapiens
ctagctcttttattttcctgct

SEQ ID NO: 2401991 - DNA, 21 bp, Homo sapiens
ctatgtgatgaaactttgaaa

SEQ ID NO: 2401992 - DNA, 15 bp, Homo sapiens
ctcaatcttttacct

SEQ ID NO: 2401993 - DNA, 17 bp, Homo sapiens
ctcactcaattttccct

SEQ ID NO: 2401994 - DNA, 15 bp, Homo sapiens
ctccagtctgccata

SEQ ID NO: 2401995 - DNA, 13 bp, Homo sapiens
ctcctccgccttg

SEQ ID NO: 2401996 - DNA, 23 bp, Homo sapiens
ctcctgaattaactatcatcagt

SEQ ID NO: 2401997 - DNA, 14 bp, Homo sapiens
ctccttccttccaa

SEQ ID NO: 2401998 - DNA, 20 bp, Homo sapiens
ctgaccaataaaaaaataag

SEQ ID NO: 2401999 - DNA, 23 bp, Homo sapiens
ctgcctgaccccttcactatgac

SEQ ID NO: 2402000 - DNA, 14 bp, Homo sapiens
ctgttatgtttaac

SEQ ID NO: 2402001 - DNA, 21 bp, Homo sapiens
cttacgccctgttcccttcct

SEQ ID NO: 2402002 - DNA, 22 bp, Homo sapiens
cttacgccctgttcccttcctg

SEQ ID NO: 2402003 - DNA, 14 bp, Homo sapiens
cttcactatgacta

SEQ ID NO: 2402004 - DNA, 15 bp, Homo sapiens
cttcactatgactac

SEQ ID NO: 2402005 - DNA, 17 bp, Homo sapiens
ctttgaaataaaataac

SEQ ID NO: 2402006 - DNA, 22 bp, Homo sapiens
gaagaaaattggactggtgaaa

SEQ ID NO: 2402007 - DNA, 22 bp, Homo sapiens
gagaaacctgcatgaaagcatt

SEQ ID NO: 2402008 - DNA, 20 bp, Homo sapiens
gagacttacgccctgttccc

SEQ ID NO: 2402009 - DNA, 22 bp, Homo sapiens
gaggctaacttacagaaatgaa

SEQ ID NO: 2402010 - DNA, 14 bp, Homo sapiens
gagtcaccacttcc

SEQ ID NO: 2402011 - DNA, 21 bp, Homo sapiens
gatcaagcatggaacaaagca

SEQ ID NO: 2402012 - DNA, 12 bp, Homo sapiens
gatcccccttct

SEQ ID NO: 2402013 - DNA, 16 bp, Homo sapiens
gatggccaagaaagaa

SEQ ID NO: 2402014 - DNA, 17 bp, Homo sapiens
gattgcaacccagggca

SEQ ID NO: 2402015 - DNA, 15 bp, Homo sapiens
gcagataaatacatt

SEQ ID NO: 2402016 - DNA, 18 bp, Homo sapiens
gccactgccgtcacctct

SEQ ID NO: 2402017 - DNA, 15 bp, Homo sapiens
gccagctgggtgccc

SEQ ID NO: 2402018 - DNA, 22 bp, Homo sapiens
gccagctgggtgccccagggac

SEQ ID NO: 2402019 - DNA, 17 bp, Homo sapiens
gcccacgggccggccag

SEQ ID NO: 2402020 - DNA, 12 bp, Homo sapiens
gccgtcacctct

SEQ ID NO: 2402021 - DNA, 19 bp, Homo sapiens
gcctctcagagtcaccact

SEQ ID NO: 2402022 - DNA, 13 bp, Homo sapiens
gctaaatcctagc

SEQ ID NO: 2402023 - DNA, 13 bp, Homo sapiens
gctgagacttacg

SEQ ID NO: 2402024 - DNA, 21 bp, Homo sapiens
gctgagacttacgccctgttc

SEQ ID NO: 2402025 - DNA, 14 bp, Homo sapiens
gctgggtgccccag

SEQ ID NO: 2402026 - DNA, 13 bp, Homo sapiens
ggaacaaagcatg

SEQ ID NO: 2402027 - DNA, 13 bp, Homo sapiens
ggatcccccttct

SEQ ID NO: 2402028 - DNA, 19 bp, Homo sapiens
ggcattctgtataaatgca

SEQ ID NO: 2402029 - DNA, 22 bp, Homo sapiens
ggccagctgggtgccccaggga

SEQ ID NO: 2402030 - DNA, 19 bp, Homo sapiens
ggcccacgggccggccagc

SEQ ID NO: 2402031 - DNA, 23 bp, Homo sapiens
gggtggccactgcagcacctgcc

SEQ ID NO: 2402032 - DNA, 13 bp, Homo sapiens
ggtgccccaggga

SEQ ID NO: 2402033 - DNA, 15 bp, Homo sapiens
gtcaccacttcctct

SEQ ID NO: 2402034 - DNA, 18 bp, Homo sapiens
gtgataatgcagataaat

SEQ ID NO: 2402035 - DNA, 17 bp, Homo sapiens
gtgatgaaactttgaaa

SEQ ID NO: 2402036 - DNA, 22 bp, Homo sapiens
gtggcccacgggccggccagct

SEQ ID NO: 2402037 - DNA, 22 bp, Homo sapiens
gttgaaagctttgaaataaaat

SEQ ID NO: 2402038 - DNA, 19 bp, Homo sapiens
gtttattatcctgatcaag

SEQ ID NO: 2402039 - DNA, 19 bp, Homo sapiens
gtttcaggatcagatcaat

SEQ ID NO: 2402040 - DNA, 21 bp, Homo sapiens
taaatcctagcagacactgcc

SEQ ID NO: 2402041 - DNA, 18 bp, Homo sapiens
aaacctgcatgaaagcat

SEQ ID NO: 2402042 - DNA, 14 bp, Homo sapiens
aaagtctgtttctg

SEQ ID NO: 2402043 - DNA, 12 bp, Homo sapiens
aaataaaataac

SEQ ID NO: 2402044 - DNA, 23 bp, Homo sapiens
aaatggtttatagccctgtgaag

SEQ ID NO: 2402045 - DNA, 15 bp, Homo sapiens
aaattatataaggca

SEQ ID NO: 2402046 - DNA, 17 bp, Homo sapiens
aactaggcaaaaagaag

SEQ ID NO: 2402047 - DNA, 23 bp, Homo sapiens
aactatgtgatgaaactttgaaa

SEQ ID NO: 2402048 - DNA, 16 bp, Homo sapiens
aactttgaaaaagata

SEQ ID NO: 2402049 - DNA, 17 bp, Homo sapiens
aagcatggaacaaagca

SEQ ID NO: 2402050 - DNA, 23 bp, Homo sapiens
aagcctcatacgtttaaaataaa

SEQ ID NO: 2402051 - DNA, 18 bp, Homo sapiens
aagctttgaaataaaata

SEQ ID NO: 2402052 - DNA, 22 bp, Homo sapiens
aaggcattctgtataaatgcaa

SEQ ID NO: 2402053 - DNA, 13 bp, Homo sapiens
aagttatagagca

SEQ ID NO: 2402054 - DNA, 14 bp, Homo sapiens
aatacaatcttgga

SEQ ID NO: 2402055 - DNA, 19 bp, Homo sapiens
aatgcagataaatacattt

SEQ ID NO: 2402056 - DNA, 14 bp, Homo sapiens
aattatataaggca

SEQ ID NO: 2402057 - DNA, 13 bp, Homo sapiens
acatccccacctg

SEQ ID NO: 2402058 - DNA, 19 bp, Homo sapiens
acccttatctgacctcttt

SEQ ID NO: 2402059 - DNA, 17 bp, Homo sapiens
acctgcatgaaagcatt

SEQ ID NO: 2402060 - DNA, 18 bp, Homo sapiens
acctgcatgaaagcattc

SEQ ID NO: 2402061 - DNA, 12 bp, Homo sapiens
acctggcggagc

SEQ ID NO: 2402062 - DNA, 19 bp, Homo sapiens
acgccctgttcccttcctg

SEQ ID NO: 2402063 - DNA, 23 bp, Homo sapiens
acgccctgttcccttcctgccct

SEQ ID NO: 2402064 - DNA, 11 bp, Homo sapiens
acgggccggcc

SEQ ID NO: 2402065 - DNA, 13 bp, Homo sapiens
acgggccggccag

SEQ ID NO: 2402066 - DNA, 16 bp, Homo sapiens
acgggccggccagctg

SEQ ID NO: 2402067 - DNA, 21 bp, Homo sapiens
acgtgataatgcagataaata

SEQ ID NO: 2402068 - DNA, 22 bp, Homo sapiens
actttgtaattctaataatgca

SEQ ID NO: 2402069 - DNA, 19 bp, Homo sapiens
agaaacctgcatgaaagca

SEQ ID NO: 2402070 - DNA, 13 bp, Homo sapiens
agataaatacatt

SEQ ID NO: 2402071 - DNA, 13 bp, Homo sapiens
agatataaagcca

SEQ ID NO: 2402072 - DNA, 16 bp, Homo sapiens
agatataaagccattt

SEQ ID NO: 2402073 - DNA, 12 bp, Homo sapiens
agctccagggca

SEQ ID NO: 2402074 - DNA, 15 bp, Homo sapiens
agctgggtgccccag

SEQ ID NO: 2402075 - DNA, 19 bp, Homo sapiens
agctttgaaataaaataac

SEQ ID NO: 2402076 - DNA, 19 bp, Homo sapiens
aggaagcatccaaagattg

SEQ ID NO: 2402077 - DNA, 21 bp, Homo sapiens
aggcattctgtataaatgcaa

SEQ ID NO: 2402078 - DNA, 16 bp, Homo sapiens
agggacgtgataatgc

SEQ ID NO: 2402079 - DNA, 19 bp, Homo sapiens
agggacgtgataatgcaga

SEQ ID NO: 2402080 - DNA, 21 bp, Homo sapiens
agggggctggagacaaggata

SEQ ID NO: 2402081 - DNA, 16 bp, Homo sapiens
agtcaccacttcctct

SEQ ID NO: 2402082 - DNA, 24 bp, Homo sapiens
agtgtccatagatataaagccatt

SEQ ID NO: 2402083 - DNA, 15 bp, Homo sapiens
ataaatacatttata

SEQ ID NO: 2402084 - DNA, 23 bp, Homo sapiens
ataaggcattctgtataaatgca

SEQ ID NO: 2402085 - DNA, 15 bp, Homo sapiens
ataagttatagagca

SEQ ID NO: 2402086 - DNA, 15 bp, Homo sapiens
ataatgcagataaat

SEQ ID NO: 2402087 - DNA, 14 bp, Homo sapiens
atagatataaagcc

SEQ ID NO: 2402088 - DNA, 14 bp, Homo sapiens
atagccctgtgaag

SEQ ID NO: 2402089 - DNA, 14 bp, Homo sapiens
atataaagccattt

SEQ ID NO: 2402090 - DNA, 14 bp, Homo sapiens
atatttctgtggaa

SEQ ID NO: 2402091 - DNA, 23 bp, Homo sapiens
atcaagcatggaacaaagcatgt

SEQ ID NO: 2402092 - DNA, 17 bp, Homo sapiens
atctccaaaactagcat

SEQ ID NO: 2402093 - DNA, 18 bp, Homo sapiens
atctgcctgaccccttca

SEQ ID NO: 2402094 - DNA, 13 bp, Homo sapiens
atgcaattgttga

SEQ ID NO: 2402095 - DNA, 20 bp, Homo sapiens
atgcagataaatacatttat

SEQ ID NO: 2402096 - DNA, 15 bp, Homo sapiens
atggaacaaagcatg

SEQ ID NO: 2402097 - DNA, 21 bp, Homo sapiens
atggtttatagccctgtgaag

SEQ ID NO: 2402098 - DNA, 13 bp, Homo sapiens
atgttcatggaac

SEQ ID NO: 2402099 - DNA, 14 bp, Homo sapiens
attactccttcctt

SEQ ID NO: 2402100 - DNA, 14 bp, Homo sapiens
attctaataatgca

SEQ ID NO: 2402101 - DNA, 16 bp, Homo sapiens
attgcaacccagggca

SEQ ID NO: 2402102 - DNA, 14 bp, Homo sapiens
attgttgaaagctt

SEQ ID NO: 2402103 - DNA, 17 bp, Homo sapiens
atttaatatttctgtgg

SEQ ID NO: 2402104 - DNA, 20 bp, Homo sapiens
attttctaataatcctgctt

SEQ ID NO: 2402105 - DNA, 22 bp, Homo sapiens
atttttctgacgagtgtccata

SEQ ID NO: 2402106 - DNA, 17 bp, Homo sapiens
caaaaggcaaatcattt

SEQ ID NO: 2402107 - DNA, 23 bp, Homo sapiens
caaggaggtcagaagaaaattgg

SEQ ID NO: 2402108 - DNA, 18 bp, Homo sapiens
caataggatcccccttct

SEQ ID NO: 2402109 - DNA, 19 bp, Homo sapiens
taacaatgtcttcttgaaa

SEQ ID NO: 2402110 - DNA, 19 bp, Homo sapiens
taatgcagataaatacatt

SEQ ID NO: 2402111 - DNA, 20 bp, Homo sapiens
taatgcagataaatacattt

SEQ ID NO: 2402112 - DNA, 21 bp, Homo sapiens
taatgcagataaatacattta

SEQ ID NO: 2402113 - DNA, 22 bp, Homo sapiens
taatgcagataaatacatttat

SEQ ID NO: 2402114 - DNA, 21 bp, Homo sapiens
taattatgttatttagtcatt

SEQ ID NO: 2402115 - DNA, 23 bp, Homo sapiens
tacaaactttgtaattctaataa

SEQ ID NO: 2402116 - DNA, 17 bp, Homo sapiens
tacacatagatataatt

SEQ ID NO: 2402117 - DNA, 13 bp, Homo sapiens
tacttacatagtt

SEQ ID NO: 2402118 - DNA, 19 bp, Homo sapiens
tagaaaaactatgtgatga

SEQ ID NO: 2402119 - DNA, 14 bp, Homo sapiens
tataactaggcaaa

SEQ ID NO: 2402120 - DNA, 13 bp, Homo sapiens
tatatacatctct

SEQ ID NO: 2402121 - DNA, 18 bp, Homo sapiens
tcaaaaggcaaatcattt

SEQ ID NO: 2402122 - DNA, 20 bp, Homo sapiens
tcccagattactccttcctt

SEQ ID NO: 2402123 - DNA, 19 bp, Homo sapiens
tcccccttcttgccctcca

SEQ ID NO: 2402124 - DNA, 14 bp, Homo sapiens
tccctggcttgcct

SEQ ID NO: 2402125 - DNA, 13 bp, Homo sapiens
tcctgccctgtgg

SEQ ID NO: 2402126 - DNA, 15 bp, Homo sapiens
tctccctcctcagct

SEQ ID NO: 2402127 - DNA, 21 bp, Homo sapiens
tctgcttccttacacatagat

SEQ ID NO: 2402128 - DNA, 22 bp, Homo sapiens
tctgttgtagaaaaactatgtg

SEQ ID NO: 2402129 - DNA, 21 bp, Homo sapiens
tcttcttgaaatttgtgatgg

SEQ ID NO: 2402130 - DNA, 13 bp, Homo sapiens
tgaaactttgaaa

SEQ ID NO: 2402131 - DNA, 18 bp, Homo sapiens
tgaaagctttgaaataaa

SEQ ID NO: 2402132 - DNA, 19 bp, Homo sapiens
tgaaatttgtgatggccaa

SEQ ID NO: 2402133 - DNA, 22 bp, Homo sapiens
tgacattaggcttctaaaggac

SEQ ID NO: 2402134 - DNA, 11 bp, Homo sapiens
tgaccccttca

SEQ ID NO: 2402135 - DNA, 16 bp, Homo sapiens
tgataatgcagataaa

SEQ ID NO: 2402136 - DNA, 21 bp, Homo sapiens
tgataatgcagataaatacat

SEQ ID NO: 2402137 - DNA, 13 bp, Homo sapiens
tgcagcacctgcc

SEQ ID NO: 2402138 - DNA, 14 bp, Homo sapiens
tgcatgaaagcatt

SEQ ID NO: 2402139 - DNA, 15 bp, Homo sapiens
tgcctgaccccttca

SEQ ID NO: 2402140 - DNA, 15 bp, Homo sapiens
tgctaaatcctagca

SEQ ID NO: 2402141 - DNA, 13 bp, Homo sapiens
tgctgagacttac

SEQ ID NO: 2402142 - DNA, 16 bp, Homo sapiens
tgcttgacccttatct

SEQ ID NO: 2402143 - DNA, 14 bp, Homo sapiens
tggaacaaagcatg

SEQ ID NO: 2402144 - DNA, 21 bp, Homo sapiens
tggaggaagcatccaaagatt

SEQ ID NO: 2402145 - DNA, 15 bp, Homo sapiens
tgggtgccccaggga

SEQ ID NO: 2402146 - DNA, 20 bp, Homo sapiens
tggtttatagccctgtgaag

SEQ ID NO: 2402147 - DNA, 21 bp, Homo sapiens
tggtttatagccctgtgaagt

SEQ ID NO: 2402148 - DNA, 18 bp, Homo sapiens
tgtaattctaataatgca

SEQ ID NO: 2402149 - DNA, 13 bp, Homo sapiens
tgtcttcttgaaa

SEQ ID NO: 2402150 - DNA, 23 bp, Homo sapiens
tgtggcccacgggccggccagct

SEQ ID NO: 2402151 - DNA, 22 bp, Homo sapiens
tgttcccttcctgccctgtggc

SEQ ID NO: 2402152 - DNA, 23 bp, Homo sapiens
tgttgtagaaaaactatgtgatg

SEQ ID NO: 2402153 - DNA, 20 bp, Homo sapiens
tgtttattatcctgatcaag

SEQ ID NO: 2402154 - DNA, 20 bp, Homo sapiens
ttacgccctgttcccttcct

SEQ ID NO: 2402155 - DNA, 16 bp, Homo sapiens
ttatagccctgtgaag

SEQ ID NO: 2402156 - DNA, 14 bp, Homo sapiens
ttatataaggcatt

SEQ ID NO: 2402157 - DNA, 15 bp, Homo sapiens
ttgaaagctttgaaa

SEQ ID NO: 2402158 - DNA, 22 bp, Homo sapiens
ttggaggaagcatccaaagatt

SEQ ID NO: 2402159 - DNA, 18 bp, Homo sapiens
tttaaaataaaactctca

SEQ ID NO: 2402160 - DNA, 17 bp, Homo sapiens
tttactgctccttccat

SEQ ID NO: 2402161 - DNA, 19 bp, Homo sapiens
tttgtgctaaatcctagca

SEQ ID NO: 2402162 - DNA, 20 bp, Homo sapiens
aaagattgcaacccagggca

SEQ ID NO: 2402163 - DNA, 19 bp, Homo sapiens
aaaggcaaaagaatggcta

SEQ ID NO: 2402164 - DNA, 17 bp, Homo sapiens
aacttacagaaatgaat

SEQ ID NO: 2402165 - DNA, 21 bp, Homo sapiens
aagaaaattggactggtgaaa

SEQ ID NO: 2402166 - DNA, 13 bp, Homo sapiens
aagattgtgaagg

SEQ ID NO: 2402167 - DNA, 18 bp, Homo sapiens
aagcatggaacaaagcat

SEQ ID NO: 2402168 - DNA, 19 bp, Homo sapiens
aagcatggaacaaagcatg

SEQ ID NO: 2402169 - DNA, 16 bp, Homo sapiens
aatctgcaaaatggag

SEQ ID NO: 2402170 - DNA, 20 bp, Homo sapiens
aatgagttaaataaaacatt

SEQ ID NO: 2402171 - DNA, 23 bp, Homo sapiens
aatgagttaaataaaacattgac

SEQ ID NO: 2402172 - DNA, 20 bp, Homo sapiens
aatggagagaatacaataac

SEQ ID NO: 2402173 - DNA, 23 bp, Homo sapiens
aatggtttatagccctgtgaagt

SEQ ID NO: 2402174 - DNA, 20 bp, Homo sapiens
aattgttgaaagctttgaaa

SEQ ID NO: 2402175 - DNA, 18 bp, Homo sapiens
aatttaacttaactctta

SEQ ID NO: 2402176 - DNA, 20 bp, Homo sapiens
aatttcctgctgaaaataac

SEQ ID NO: 2402177 - DNA, 17 bp, Homo sapiens
acaatgtcttcttgaaa

SEQ ID NO: 2402178 - DNA, 11 bp, Homo sapiens
acacatagata

SEQ ID NO: 2402179 - DNA, 19 bp, Homo sapiens
acctctccctcctcagctc

SEQ ID NO: 2402180 - DNA, 15 bp, Homo sapiens
acctgcatgaaagca

SEQ ID NO: 2402181 - DNA, 19 bp, Homo sapiens
acctggcggagctctcctc

SEQ ID NO: 2402182 - DNA, 20 bp, Homo sapiens
acctggcggagctctcctcc

SEQ ID NO: 2402183 - DNA, 15 bp, Homo sapiens
actgcagcacctgcc

SEQ ID NO: 2402184 - DNA, 22 bp, Homo sapiens
acttacgccctgttcccttcct

SEQ ID NO: 2402185 - DNA, 16 bp, Homo sapiens
agataaatacatttat

SEQ ID NO: 2402186 - DNA, 24 bp, Homo sapiens
agattgcaacccagggcaaatgga

SEQ ID NO: 2402187 - DNA, 13 bp, Homo sapiens
agcagacactgcc

SEQ ID NO: 2402188 - DNA, 13 bp, Homo sapiens
agctgggtgcccc

SEQ ID NO: 2402189 - DNA, 14 bp, Homo sapiens
aggatcccccttct

SEQ ID NO: 2402190 - DNA, 21 bp, Homo sapiens
aggctaacttacagaaatgaa

SEQ ID NO: 2402191 - DNA, 13 bp, Homo sapiens
agggcaaatggaa

SEQ ID NO: 2402192 - DNA, 15 bp, Homo sapiens
agggcaaatggaaaa

SEQ ID NO: 2402193 - DNA, 17 bp, Homo sapiens
agttaaataaaacattg

SEQ ID NO: 2402194 - DNA, 15 bp, Homo sapiens
ataagattgtgaagg

SEQ ID NO: 2402195 - DNA, 17 bp, Homo sapiens
atataaggcattctgta

SEQ ID NO: 2402196 - DNA, 20 bp, Homo sapiens
atcaagcatggaacaaagca

SEQ ID NO: 2402197 - DNA, 22 bp, Homo sapiens
atcaagcatggaacaaagcatg

SEQ ID NO: 2402198 - DNA, 14 bp, Homo sapiens
atcctgatcaagca

SEQ ID NO: 2402199 - DNA, 14 bp, Homo sapiens
atgaaactttgaaa

SEQ ID NO: 2402200 - DNA, 12 bp, Homo sapiens
atgaaagcattc

SEQ ID NO: 2402201 - DNA, 17 bp, Homo sapiens
atgagttaaataaaaca

SEQ ID NO: 2402202 - DNA, 19 bp, Homo sapiens
atgagttaaataaaacatt

SEQ ID NO: 2402203 - DNA, 18 bp, Homo sapiens
atgcaattgttgaaagct

SEQ ID NO: 2402204 - DNA, 15 bp, Homo sapiens
atgcagataaataca

SEQ ID NO: 2402205 - DNA, 20 bp, Homo sapiens
atggatcccaatctgagaaa

SEQ ID NO: 2402206 - DNA, 16 bp, Homo sapiens
atggccaagaaagaaa

SEQ ID NO: 2402207 - DNA, 22 bp, Homo sapiens
atggtttatagccctgtgaagt

SEQ ID NO: 2402208 - DNA, 14 bp, Homo sapiens
atgtcttcttgaaa

SEQ ID NO: 2402209 - DNA, 15 bp, Homo sapiens
attactccttccttc

SEQ ID NO: 2402210 - DNA, 17 bp, Homo sapiens
attatcctgatcaagca

SEQ ID NO: 2402211 - DNA, 23 bp, Homo sapiens
attgcaacccagggcaaatggaa

SEQ ID NO: 2402212 - DNA, 19 bp, Homo sapiens
attgttgaaagctttgaaa

SEQ ID NO: 2402213 - DNA, 21 bp, Homo sapiens
atttggacaatctgcaaaatg

SEQ ID NO: 2402214 - DNA, 20 bp, Homo sapiens
cacaataggatcccccttct

SEQ ID NO: 2402215 - DNA, 13 bp, Homo sapiens
cacatccccacct

SEQ ID NO: 2402216 - DNA, 13 bp, Homo sapiens
caccacttcctct

SEQ ID NO: 2402217 - DNA, 15 bp, Homo sapiens
caccacttcctctgt

SEQ ID NO: 2402218 - DNA, 21 bp, Homo sapiens
cacctggcggagctctcctcc

SEQ ID NO: 2402219 - DNA, 16 bp, Homo sapiens
cacgggccggccagct

SEQ ID NO: 2402220 - DNA, 14 bp, Homo sapiens
cagacactgccttg

SEQ ID NO: 2402221 - DNA, 16 bp, Homo sapiens
cagataaatacattta

SEQ ID NO: 2402222 - DNA, 15 bp, Homo sapiens
cagatcaatacaatc

SEQ ID NO: 2402223 - DNA, 17 bp, Homo sapiens
cagattactccttcctt

SEQ ID NO: 2402224 - DNA, 18 bp, Homo sapiens
cagggacgtgataatgca

SEQ ID NO: 2402225 - DNA, 21 bp, Homo sapiens
cagtaatgagttaaataaaac

SEQ ID NO: 2402226 - DNA, 18 bp, Homo sapiens
cagtttactctctccctc

SEQ ID NO: 2402227 - DNA, 12 bp, Homo sapiens
catgaaagcatt

SEQ ID NO: 2402228 - DNA, 16 bp, Homo sapiens
ccaataaaaaaataag

SEQ ID NO: 2402229 - DNA, 15 bp, Homo sapiens
ccacatccccacctg

SEQ ID NO: 2402230 - DNA, 15 bp, Homo sapiens
ccacgggccggccag

SEQ ID NO: 2402231 - DNA, 18 bp, Homo sapiens
ccactgcagcacctgcca

SEQ ID NO: 2402232 - DNA, 18 bp, Homo sapiens
ccagattactccttcctt

SEQ ID NO: 2402233 - DNA, 16 bp, Homo sapiens
ccagctgggtgcccca

SEQ ID NO: 2402234 - DNA, 17 bp, Homo sapiens
ccagctgggtgccccag

SEQ ID NO: 2402235 - DNA, 16 bp, Homo sapiens
ccatagatataaagcc

SEQ ID NO: 2402236 - DNA, 14 bp, Homo sapiens
cccacgggccggcc

SEQ ID NO: 2402237 - DNA, 22 bp, Homo sapiens
cccacgggccggccagctgggt

SEQ ID NO: 2402238 - DNA, 15 bp, Homo sapiens
cccttcctgccctgt

SEQ ID NO: 2402239 - DNA, 22 bp, Homo sapiens
ccggccagctgggtgccccagg

SEQ ID NO: 2402240 - DNA, 17 bp, Homo sapiens
cctccctggcttgcctt

SEQ ID NO: 2402241 - DNA, 20 bp, Homo sapiens
cctctactaatttcctgctg

SEQ ID NO: 2402242 - DNA, 14 bp, Homo sapiens
cctctccctcctca

SEQ ID NO: 2402243 - DNA, 15 bp, Homo sapiens
cctgcatgaaagcat

SEQ ID NO: 2402244 - DNA, 13 bp, Homo sapiens
cctgccctgtggc

SEQ ID NO: 2402245 - DNA, 16 bp, Homo sapiens
cctgccctgtggccca

SEQ ID NO: 2402246 - DNA, 22 bp, Homo sapiens
cctgccctgtggcccacgggcc

SEQ ID NO: 2402247 - DNA, 20 bp, Homo sapiens
cctggcttgccttctacctt

SEQ ID NO: 2402248 - DNA, 21 bp, Homo sapiens
ccttcctgccctgtggcccac

SEQ ID NO: 2402249 - DNA, 21 bp, Homo sapiens
cggccagctgggtgccccagg

SEQ ID NO: 2402250 - DNA, 14 bp, Homo sapiens
ctaatttcctgctg

SEQ ID NO: 2402251 - DNA, 15 bp, Homo sapiens
ctagcagacactgcc

SEQ ID NO: 2402252 - DNA, 18 bp, Homo sapiens
ctcatacgtttaaaataa

SEQ ID NO: 2402253 - DNA, 15 bp, Homo sapiens
ctctccctcctcagc

SEQ ID NO: 2402254 - DNA, 15 bp, Homo sapiens
ctctttggaaactat

SEQ ID NO: 2402255 - DNA, 16 bp, Homo sapiens
ctgcatgaaagcattc

SEQ ID NO: 2402256 - DNA, 14 bp, Homo sapiens
ctgccatatcacca

SEQ ID NO: 2402257 - DNA, 15 bp, Homo sapiens
ctgccatatcaccac

SEQ ID NO: 2402258 - DNA, 20 bp, Homo sapiens
ctgccccacatccccacctg

SEQ ID NO: 2402259 - DNA, 20 bp, Homo sapiens
ctgccctgtggcccacgggc

SEQ ID NO: 2402260 - DNA, 13 bp, Homo sapiens
ctgctccttccat

SEQ ID NO: 2402261 - DNA, 23 bp, Homo sapiens
ctgtggcccacgggccggccagc

SEQ ID NO: 2402262 - DNA, 13 bp, Homo sapiens
ctgttcccttcct

SEQ ID NO: 2402263 - DNA, 20 bp, Homo sapiens
ctgtttctgcttccttacac

SEQ ID NO: 2402264 - DNA, 11 bp, Homo sapiens
aaaaaaataag

SEQ ID NO: 2402265 - DNA, 21 bp, Homo sapiens
aaaaagatatttatgatgtta

SEQ ID NO: 2402266 - DNA, 20 bp, Homo sapiens
aaacctgcatgaaagcattc

SEQ ID NO: 2402267 - DNA, 18 bp, Homo sapiens
aaactttgaaaaagatat

SEQ ID NO: 2402268 - DNA, 22 bp, Homo sapiens
aaataacaatgtcttcttgaaa

SEQ ID NO: 2402269 - DNA, 17 bp, Homo sapiens
aacctgcatgaaagcat

SEQ ID NO: 2402270 - DNA, 18 bp, Homo sapiens
aacctgcatgaaagcatt

SEQ ID NO: 2402271 - DNA, 16 bp, Homo sapiens
aactagcattcttaaa

SEQ ID NO: 2402272 - DNA, 21 bp, Homo sapiens
aatggatcccaatctgagaaa

SEQ ID NO: 2402273 - DNA, 22 bp, Homo sapiens
aatggtttatagccctgtgaag

SEQ ID NO: 2402274 - DNA, 15 bp, Homo sapiens
aatgtcttcttgaaa

SEQ ID NO: 2402275 - DNA, 23 bp, Homo sapiens
aatgttcatggaactagctcttt

SEQ ID NO: 2402276 - DNA, 21 bp, Homo sapiens
acaaactttgtaattctaata

SEQ ID NO: 2402277 - DNA, 14 bp, Homo sapiens
acacaacaaaaatg

SEQ ID NO: 2402278 - DNA, 12 bp, Homo sapiens
acatccccacct

SEQ ID NO: 2402279 - DNA, 16 bp, Homo sapiens
acatccccacctggcg

SEQ ID NO: 2402280 - DNA, 20 bp, Homo sapiens
acgccctgttcccttcctgc

SEQ ID NO: 2402281 - DNA, 14 bp, Homo sapiens
acgggccggccagc

SEQ ID NO: 2402282 - DNA, 20 bp, Homo sapiens
acgtgataatgcagataaat

SEQ ID NO: 2402283 - DNA, 18 bp, Homo sapiens
actaatttcctgctgaaa

SEQ ID NO: 2402284 - DNA, 19 bp, Homo sapiens
actgctccttccatctgcc

SEQ ID NO: 2402285 - DNA, 23 bp, Homo sapiens
acttacgccctgttcccttcctg

SEQ ID NO: 2402286 - DNA, 15 bp, Homo sapiens
agaaaaggcaaaaga

SEQ ID NO: 2402287 - DNA, 21 bp, Homo sapiens
agaaacctgcatgaaagcatt

SEQ ID NO: 2402288 - DNA, 22 bp, Homo sapiens
agaaacctgcatgaaagcattc

SEQ ID NO: 2402289 - DNA, 17 bp, Homo sapiens
agagtcaccacttcctc

SEQ ID NO: 2402290 - DNA, 12 bp, Homo sapiens
agatataaagcc

SEQ ID NO: 2402291 - DNA, 17 bp, Homo sapiens
agattactccttccttc

SEQ ID NO: 2402292 - DNA, 14 bp, Homo sapiens
agcatccaaagatt

SEQ ID NO: 2402293 - DNA, 22 bp, Homo sapiens
agccatttggtcttaattctga

SEQ ID NO: 2402294 - DNA, 16 bp, Homo sapiens
agctctcctccgcctt

SEQ ID NO: 2402295 - DNA, 18 bp, Homo sapiens
agctgggtgccccaggga

SEQ ID NO: 2402296 - DNA, 18 bp, Homo sapiens
aggaagcatccaaagatt

SEQ ID NO: 2402297 - DNA, 22 bp, Homo sapiens
aggatgcaattgttgaaagctt

SEQ ID NO: 2402298 - DNA, 20 bp, Homo sapiens
agtaaagggggctggagaca

SEQ ID NO: 2402299 - DNA, 19 bp, Homo sapiens
agtcaaaaggcaaatcatt

SEQ ID NO: 2402300 - DNA, 21 bp, Homo sapiens
agtgtccatagatataaagcc

SEQ ID NO: 2402301 - DNA, 14 bp, Homo sapiens
agttaaataaaaca

SEQ ID NO: 2402302 - DNA, 16 bp, Homo sapiens
agttgttttgttttat

SEQ ID NO: 2402303 - DNA, 20 bp, Homo sapiens
ataacaatgtcttcttgaaa

SEQ ID NO: 2402304 - DNA, 19 bp, Homo sapiens
ataagttgttttgttttat

SEQ ID NO: 2402305 - DNA, 19 bp, Homo sapiens
ataatgcagataaatacat

SEQ ID NO: 2402306 - DNA, 15 bp, Homo sapiens
atacaaactttgtaa

SEQ ID NO: 2402307 - DNA, 19 bp, Homo sapiens
atagatataaagccatttg

SEQ ID NO: 2402308 - DNA, 22 bp, Homo sapiens
atagccctgtgaagttcttaaa

SEQ ID NO: 2402309 - DNA, 15 bp, Homo sapiens
ataggatcccccttc

SEQ ID NO: 2402310 - DNA, 21 bp, Homo sapiens
atatttatgatgttaacattt

SEQ ID NO: 2402311 - DNA, 13 bp, Homo sapiens
atcaaggaggtca

SEQ ID NO: 2402312 - DNA, 11 bp, Homo sapiens
atccaaagatt

SEQ ID NO: 2402313 - DNA, 13 bp, Homo sapiens
atcctgcttgacc

SEQ ID NO: 2402314 - DNA, 21 bp, Homo sapiens
atgcaattgttgaaagctttg

SEQ ID NO: 2402315 - DNA, 16 bp, Homo sapiens
atgcagataaatacat

SEQ ID NO: 2402316 - DNA, 17 bp, Homo sapiens
atgcagataaatacatt

SEQ ID NO: 2402317 - DNA, 14 bp, Homo sapiens
atggaacaaagcat

SEQ ID NO: 2402318 - DNA, 19 bp, Homo sapiens
atgtgatgaaactttgaaa

SEQ ID NO: 2402319 - DNA, 16 bp, Homo sapiens
attctgtataaatgca

SEQ ID NO: 2402320 - DNA, 19 bp, Homo sapiens
atttaatatttctgtggaa

SEQ ID NO: 2402321 - DNA, 22 bp, Homo sapiens
atttggtcttaattctgaccaa

SEQ ID NO: 2402322 - DNA, 15 bp, Homo sapiens
atttgtgatggccaa

SEQ ID NO: 2402323 - DNA, 20 bp, Homo sapiens
caaaggtgatatggttttat

SEQ ID NO: 2402324 - DNA, 20 bp, Homo sapiens
caagcatggaacaaagcatg

SEQ ID NO: 2402325 - DNA, 16 bp, Homo sapiens
caatgtcttcttgaaa

SEQ ID NO: 2402326 - DNA, 14 bp, Homo sapiens
cacctggcggagct

SEQ ID NO: 2402327 - DNA, 15 bp, Homo sapiens
cactgcagcacctgc

SEQ ID NO: 2402328 - DNA, 24 bp, Homo sapiens
cagaagaaaattggactggtgaaa

SEQ ID NO: 2402329 - DNA, 17 bp, Homo sapiens
cagataaatacatttat

SEQ ID NO: 2402330 - DNA, 14 bp, Homo sapiens
cagctgggtgcccc

SEQ ID NO: 2402331 - DNA, 20 bp, Homo sapiens
cagctgggtgccccagggac

SEQ ID NO: 2402332 - DNA, 17 bp, Homo sapiens
catacgtttaaaataaa

SEQ ID NO: 2402333 - DNA, 19 bp, Homo sapiens
catagatataaagccattt

SEQ ID NO: 2402334 - DNA, 19 bp, Homo sapiens
catctgcctgaccccttca

SEQ ID NO: 2402335 - DNA, 16 bp, Homo sapiens
ccaaatcagtttttct

SEQ ID NO: 2402336 - DNA, 22 bp, Homo sapiens
ccacacaataggatcccccttc

SEQ ID NO: 2402337 - DNA, 22 bp, Homo sapiens
ccacctggcggagctctcctcc

SEQ ID NO: 2402338 - DNA, 18 bp, Homo sapiens
ccacgggccggccagctg

SEQ ID NO: 2402339 - DNA, 20 bp, Homo sapiens
ccagctgggtgccccaggga

SEQ ID NO: 2402340 - DNA, 21 bp, Homo sapiens
ccagctgggtgccccagggac

SEQ ID NO: 2402341 - DNA, 17 bp, Homo sapiens
cccacgggccggccagc

SEQ ID NO: 2402342 - DNA, 16 bp, Homo sapiens
ccctgttcccttcctg

SEQ ID NO: 2402343 - DNA, 18 bp, Homo sapiens
cccttcctgccctgtggc

SEQ ID NO: 2402344 - DNA, 16 bp, Homo sapiens
ccggccagctgggtgc

SEQ ID NO: 2402345 - DNA, 23 bp, Homo sapiens
ccggccagctgggtgccccaggg

SEQ ID NO: 2402346 - DNA, 17 bp, Homo sapiens
cctctccctcctcagct

SEQ ID NO: 2402347 - DNA, 16 bp, Homo sapiens
cctgcatgaaagcatt

SEQ ID NO: 2402348 - DNA, 12 bp, Homo sapiens
cctgccctgtgg

SEQ ID NO: 2402349 - DNA, 21 bp, Homo sapiens
cctgccctgtggcccacgggc

SEQ ID NO: 2402350 - DNA, 18 bp, Homo sapiens
cctgctggtttcttcagt

SEQ ID NO: 2402351 - DNA, 17 bp, Homo sapiens
cctggcggagctctcct

SEQ ID NO: 2402352 - DNA, 19 bp, Homo sapiens
cctgtggcccacgggccgg

SEQ ID NO: 2402353 - DNA, 23 bp, Homo sapiens
cctgtggcccacgggccggccag

SEQ ID NO: 2402354 - DNA, 14 bp, Homo sapiens
cctgttatgtttaa

SEQ ID NO: 2402355 - DNA, 15 bp, Homo sapiens
cctgttcccttcctg

SEQ ID NO: 2402356 - DNA, 14 bp, Homo sapiens
ccttcctgccctgt

SEQ ID NO: 2402357 - DNA, 16 bp, Homo sapiens
ccttcctgccctgtgg

SEQ ID NO: 2402358 - DNA, 14 bp, Homo sapiens
ccttgaagcctcct

SEQ ID NO: 2402359 - DNA, 11 bp, Homo sapiens
cgccctgttcc

SEQ ID NO: 2402360 - DNA, 17 bp, Homo sapiens
cgccctgttcccttcct

SEQ ID NO: 2402361 - DNA, 18 bp, Homo sapiens
cggccagctgggtgcccc

SEQ ID NO: 2402362 - DNA, 14 bp, Homo sapiens
cgggccggccagct

SEQ ID NO: 2402363 - DNA, 22 bp, Homo sapiens
cgtcacctctccctcctcagct

SEQ ID NO: 2402364 - DNA, 15 bp, Homo sapiens
cgtgataatgcagat

SEQ ID NO: 2402365 - DNA, 21 bp, Homo sapiens
ctaaaggacatacatttaata

SEQ ID NO: 2402366 - DNA, 14 bp, Homo sapiens
ctagcattcttaaa

SEQ ID NO: 2402367 - DNA, 18 bp, Homo sapiens
ctatcatcagtcctgcat

SEQ ID NO: 2402368 - DNA, 17 bp, Homo sapiens
ctatgtgatgaaacttt

SEQ ID NO: 2402369 - DNA, 20 bp, Homo sapiens
ctcagagtcaccacttcctc

SEQ ID NO: 2402370 - DNA, 23 bp, Homo sapiens
ctccctctactaatttcctgctg

SEQ ID NO: 2402371 - DNA, 20 bp, Homo sapiens
ctctgttgtagaaaaactat

SEQ ID NO: 2402372 - DNA, 23 bp, Homo sapiens
ctgatcaagcatggaacaaagca

SEQ ID NO: 2402373 - DNA, 23 bp, Homo sapiens
ctgcaaaatggagagaatacaat

SEQ ID NO: 2402374 - DNA, 14 bp, Homo sapiens
ctgcagcacctgcc

SEQ ID NO: 2402375 - DNA, 15 bp, Homo sapiens
ctgcatgaaagcatt

SEQ ID NO: 2402376 - DNA, 22 bp, Homo sapiens
aaagaatggctacttttttcta

SEQ ID NO: 2402377 - DNA, 15 bp, Homo sapiens
aaagcattcttccct

SEQ ID NO: 2402378 - DNA, 21 bp, Homo sapiens
aaagctttgaaataaaataac

SEQ ID NO: 2402379 - DNA, 17 bp, Homo sapiens
aaaggacatacatttaa

SEQ ID NO: 2402380 - DNA, 16 bp, Homo sapiens
aaatacatttatattt

SEQ ID NO: 2402381 - DNA, 12 bp, Homo sapiens
aaatcatttgga

SEQ ID NO: 2402382 - DNA, 14 bp, Homo sapiens
aacaaagcatgttt

SEQ ID NO: 2402383 - DNA, 12 bp, Homo sapiens
aacaggagatcc

SEQ ID NO: 2402384 - DNA, 15 bp, Homo sapiens
aagcatccaaagatt

SEQ ID NO: 2402385 - DNA, 13 bp, Homo sapiens
aaggcaaatcatt

SEQ ID NO: 2402386 - DNA, 11 bp, Homo sapiens
aatacatttat

SEQ ID NO: 2402387 - DNA, 15 bp, Homo sapiens
aatccacaaatgatg

SEQ ID NO: 2402388 - DNA, 19 bp, Homo sapiens
aatcctagcagacactgcc

SEQ ID NO: 2402389 - DNA, 18 bp, Homo sapiens
aatgagttaaataaaaca

SEQ ID NO: 2402390 - DNA, 19 bp, Homo sapiens
tgaaattatataaggcatt

SEQ ID NO: 2402391 - DNA, 23 bp, Homo sapiens
tgaataagttgttttgttttata

SEQ ID NO: 2402392 - DNA, 21 bp, Homo sapiens
tgagacttacgccctgttccc

SEQ ID NO: 2402393 - DNA, 24 bp, Homo sapiens
tgatcaagcatggaacaaagcatg

SEQ ID NO: 2402394 - DNA, 16 bp, Homo sapiens
tgcaaatgtgcatttt

SEQ ID NO: 2402395 - DNA, 13 bp, Homo sapiens
tgcatgaaagcat

SEQ ID NO: 2402396 - DNA, 18 bp, Homo sapiens
tgccccacatccccacct

SEQ ID NO: 2402397 - DNA, 22 bp, Homo sapiens
tgccgtcacctctccctcctca

SEQ ID NO: 2402398 - DNA, 19 bp, Homo sapiens
tggccactgcagcacctgc

SEQ ID NO: 2402399 - DNA, 20 bp, Homo sapiens
tggccactgcagcacctgcc

SEQ ID NO: 2402400 - DNA, 20 bp, Homo sapiens
tggcccacgggccggccagc

SEQ ID NO: 2402401 - DNA, 19 bp, Homo sapiens
tgtccatagatataaagcc

SEQ ID NO: 2402402 - DNA, 17 bp, Homo sapiens
tgttgaaagctttgaaa

SEQ ID NO: 2402403 - DNA, 15 bp, Homo sapiens
ttatagccctgtgaa

SEQ ID NO: 2402404 - DNA, 17 bp, Homo sapiens
ttcccttcctgccctgt

SEQ ID NO: 2402405 - DNA, 15 bp, Homo sapiens
ttgaaataaaataac

SEQ ID NO: 2402406 - DNA, 16 bp, Homo sapiens
ttgaagcctcctgaat

SEQ ID NO: 2402407 - DNA, 16 bp, Homo sapiens
tttaacttaactctta

SEQ ID NO: 2402408 - DNA, 16 bp, Homo sapiens
tttatagccctgtgaa

SEQ ID NO: 2402409 - DNA, 22 bp, Homo sapiens
ctgctcccagattactccttcc

SEQ ID NO: 2402410 - DNA, 21 bp, Homo sapiens
ctgctccttccatctgcctga

SEQ ID NO: 2402411 - DNA, 14 bp, Homo sapiens
ctgctgaaaataac

SEQ ID NO: 2402412 - DNA, 14 bp, Homo sapiens
cttaattctgacca

SEQ ID NO: 2402413 - DNA, 15 bp, Homo sapiens
cttcctgccctgtgg

SEQ ID NO: 2402414 - DNA, 15 bp, Homo sapiens
cttgctgagacttac

SEQ ID NO: 2402415 - DNA, 16 bp, Homo sapiens
ctttgaaataaaataa

SEQ ID NO: 2402416 - DNA, 17 bp, Homo sapiens
gaaactataacatagct

SEQ ID NO: 2402417 - DNA, 18 bp, Homo sapiens
gaaattatataaggcatt

SEQ ID NO: 2402418 - DNA, 16 bp, Homo sapiens
gaagcatccaaagatt

SEQ ID NO: 2402419 - DNA, 16 bp, Homo sapiens
gaagttcttaaagttt

SEQ ID NO: 2402420 - DNA, 23 bp, Homo sapiens
gacaatctgcaaaatggagagaa

SEQ ID NO: 2402421 - DNA, 16 bp, Homo sapiens
gacgtgataatgcaga

SEQ ID NO: 2402422 - DNA, 16 bp, Homo sapiens
gacttacgccctgttc

SEQ ID NO: 2402423 - DNA, 19 bp, Homo sapiens
gagacttacgccctgttcc

SEQ ID NO: 2402424 - DNA, 19 bp, Homo sapiens
gaggtcagaagaaaattgg

SEQ ID NO: 2402425 - DNA, 21 bp, Homo sapiens
gataatgcagataaatacatt

SEQ ID NO: 2402426 - DNA, 11 bp, Homo sapiens
gatataaagcc

SEQ ID NO: 2402427 - DNA, 21 bp, Homo sapiens
gatgaaactttgaaaaagata

SEQ ID NO: 2402428 - DNA, 17 bp, Homo sapiens
gcaattgttgaaagctt

SEQ ID NO: 2402429 - DNA, 16 bp, Homo sapiens
gcagataaatacattt

SEQ ID NO: 2402430 - DNA, 17 bp, Homo sapiens
gcagataaatacattta

SEQ ID NO: 2402431 - DNA, 16 bp, Homo sapiens
gcatggaacaaagcat

SEQ ID NO: 2402432 - DNA, 17 bp, Homo sapiens
gcatggaacaaagcatg

SEQ ID NO: 2402433 - DNA, 18 bp, Homo sapiens
gccactgcagcacctgcc

SEQ ID NO: 2402434 - DNA, 18 bp, Homo sapiens
gcccacgggccggccagc

SEQ ID NO: 2402435 - DNA, 23 bp, Homo sapiens
gccccacatccccacctggcgga

SEQ ID NO: 2402436 - DNA, 22 bp, Homo sapiens
gcctgaccccttcactatgact

SEQ ID NO: 2402437 - DNA, 18 bp, Homo sapiens
gccttgctgagacttacg

SEQ ID NO: 2402438 - DNA, 23 bp, Homo sapiens
gctgctcccagattactccttcc

SEQ ID NO: 2402439 - DNA, 19 bp, Homo sapiens
gctgggtgccccagggacg

SEQ ID NO: 2402440 - DNA, 17 bp, Homo sapiens
ggacaatctgcaaaatg

SEQ ID NO: 2402441 - DNA, 17 bp, Homo sapiens
ggcagtgtccctccctg

SEQ ID NO: 2402442 - DNA, 14 bp, Homo sapiens
ggccaagaaagaaa

SEQ ID NO: 2402443 - DNA, 18 bp, Homo sapiens
ggccactgcagcacctgc

SEQ ID NO: 2402444 - DNA, 13 bp, Homo sapiens
ggccagctgggtg

SEQ ID NO: 2402445 - DNA, 15 bp, Homo sapiens
ggcggagctctcctc

SEQ ID NO: 2402446 - DNA, 13 bp, Homo sapiens
gggccggccagct

SEQ ID NO: 2402447 - DNA, 14 bp, Homo sapiens
gggccggccagctg

SEQ ID NO: 2402448 - DNA, 17 bp, Homo sapiens
gtaattctaataatgca

SEQ ID NO: 2402449 - DNA, 21 bp, Homo sapiens
gtccatagatataaagccatt

SEQ ID NO: 2402450 - DNA, 17 bp, Homo sapiens
gtgctaaatcctagcag

SEQ ID NO: 2402451 - DNA, 12 bp, Homo sapiens
gttcccttcctg

SEQ ID NO: 2402452 - DNA, 16 bp, Homo sapiens
gtttactgctccttcc

SEQ ID NO: 2402453 - DNA, 20 bp, Homo sapiens
gtttactgctccttccatct

SEQ ID NO: 2402454 - DNA, 18 bp, Homo sapiens
gtttatagccctgtgaag

SEQ ID NO: 2402455 - DNA, 22 bp, Homo sapiens
taaaactctcagttgtttatta

SEQ ID NO: 2402456 - DNA, 14 bp, Homo sapiens
taagattgtgaagg

SEQ ID NO: 2402457 - DNA, 18 bp, Homo sapiens
taatgcagataaatacat

SEQ ID NO: 2402458 - DNA, 13 bp, Homo sapiens
tacatttatattt

SEQ ID NO: 2402459 - DNA, 13 bp, Homo sapiens
tagccctgtgaag

SEQ ID NO: 2402460 - DNA, 16 bp, Homo sapiens
tatagccctgtgaagt

SEQ ID NO: 2402461 - DNA, 21 bp, Homo sapiens
tatataaggcattctgtataa

SEQ ID NO: 2402462 - DNA, 16 bp, Homo sapiens
tatgatgttaacattt

SEQ ID NO: 2402463 - DNA, 17 bp, Homo sapiens
tcaaaaggcaaatcatt

SEQ ID NO: 2402464 - DNA, 20 bp, Homo sapiens
tcaaggaggtcagaagaaaa

SEQ ID NO: 2402465 - DNA, 20 bp, Homo sapiens
tcacctctccctcctcagct

SEQ ID NO: 2402466 - DNA, 14 bp, Homo sapiens
tcagctccagggca

SEQ ID NO: 2402467 - DNA, 15 bp, Homo sapiens
tccaaaactagcatt

SEQ ID NO: 2402468 - DNA, 14 bp, Homo sapiens
tccctcctcagctc

SEQ ID NO: 2402469 - DNA, 19 bp, Homo sapiens
tcccttcctgccctgtggc

SEQ ID NO: 2402470 - DNA, 18 bp, Homo sapiens
tccgccttgctgagactt

SEQ ID NO: 2402471 - DNA, 18 bp, Homo sapiens
tctgacctctttggaaac

SEQ ID NO: 2402472 - DNA, 12 bp, Homo sapiens
tctgcagctgct

SEQ ID NO: 2402473 - DNA, 23 bp, Homo sapiens
tcttatctccaaaactagcattc

SEQ ID NO: 2402474 - DNA, 22 bp, Homo sapiens
tgaaagctttgaaataaaataa

SEQ ID NO: 2402475 - DNA, 14 bp, Homo sapiens
tgaaataaaataac

SEQ ID NO: 2402476 - DNA, 13 bp, Homo sapiens
tgaccaataaaaa

SEQ ID NO: 2402477 - DNA, 19 bp, Homo sapiens
tgaccaataaaaaaataag

SEQ ID NO: 2402478 - DNA, 15 bp, Homo sapiens
tgatatggttttatt

SEQ ID NO: 2402479 - DNA, 16 bp, Homo sapiens
tgatgaaactttgaaa

SEQ ID NO: 2402480 - DNA, 18 bp, Homo sapiens
tgcaattgttgaaagctt

SEQ ID NO: 2402481 - DNA, 15 bp, Homo sapiens
tgcatgaaagcattc

SEQ ID NO: 2402482 - DNA, 13 bp, Homo sapiens
tgctgaaaataac

SEQ ID NO: 2402483 - DNA, 16 bp, Homo sapiens
tggccaagaaagaaaa

SEQ ID NO: 2402484 - DNA, 22 bp, Homo sapiens
tggcccacgggccggccagctg

SEQ ID NO: 2402485 - DNA, 14 bp, Homo sapiens
ttaaataaaacatt

SEQ ID NO: 2402486 - DNA, 15 bp, Homo sapiens
ttaaccccaaaggtg

SEQ ID NO: 2402487 - DNA, 13 bp, Homo sapiens
ttactccttcctt

SEQ ID NO: 2402488 - DNA, 12 bp, Homo sapiens
ttatttcctgtt

SEQ ID NO: 2402489 - DNA, 22 bp, Homo sapiens
ttcaggatcagatcaatacaat

SEQ ID NO: 2402490 - DNA, 14 bp, Homo sapiens
ttgctgagacttac

SEQ ID NO: 2402491 - DNA, 23 bp, Homo sapiens
ttggaggaagcatccaaagattg

SEQ ID NO: 2402492 - DNA, 18 bp, Homo sapiens
tttatagccctgtgaagt

SEQ ID NO: 2402493 - DNA, 18 bp, Homo sapiens
tttatgatgttaacattt

SEQ ID NO: 2402494 - DNA, 14 bp, Homo sapiens
cagataaatacatt

SEQ ID NO: 2402495 - DNA, 13 bp, Homo sapiens
cagctccagggca

SEQ ID NO: 2402496 - DNA, 16 bp, Homo sapiens
cagctgggtgccccag

SEQ ID NO: 2402497 - DNA, 17 bp, Homo sapiens
cagctgggtgccccagg

SEQ ID NO: 2402498 - DNA, 19 bp, Homo sapiens
cagctgggtgccccaggga

SEQ ID NO: 2402499 - DNA, 11 bp, Homo sapiens
cagggacgtga

SEQ ID NO: 2402500 - DNA, 21 bp, Homo sapiens
cagggacgtgataatgcagat

SEQ ID NO: 2402501 - DNA, 19 bp, Homo sapiens
cagtctgccatatcaccac

SEQ ID NO: 2402502 - DNA, 11 bp, Homo sapiens
cataagattgt

SEQ ID NO: 2402503 - DNA, 16 bp, Homo sapiens
catggaacaaagcatg

SEQ ID NO: 2402504 - DNA, 17 bp, Homo sapiens
catggaacaaagcatgt

SEQ ID NO: 2402505 - DNA, 16 bp, Homo sapiens
cattaggcttctaaag

SEQ ID NO: 2402506 - DNA, 17 bp, Homo sapiens
cattctgtataaatgca

SEQ ID NO: 2402507 - DNA, 17 bp, Homo sapiens
catttaatatttctgtg

SEQ ID NO: 2402508 - DNA, 16 bp, Homo sapiens
ccacgggccggccagc

SEQ ID NO: 2402509 - DNA, 17 bp, Homo sapiens
ccacgggccggccagct

SEQ ID NO: 2402510 - DNA, 15 bp, Homo sapiens
ccagctgggtgcccc

SEQ ID NO: 2402511 - DNA, 18 bp, Homo sapiens
ccagctgggtgccccagg

SEQ ID NO: 2402512 - DNA, 20 bp, Homo sapiens
ccatctgcctgaccccttca

SEQ ID NO: 2402513 - DNA, 22 bp, Homo sapiens
ccctgaaaagttaggcctctca

SEQ ID NO: 2402514 - DNA, 21 bp, Homo sapiens
ccctgaaattatataaggcat

SEQ ID NO: 2402515 - DNA, 19 bp, Homo sapiens
cctctactaatttcctgct

SEQ ID NO: 2402516 - DNA, 21 bp, Homo sapiens
cctctactaatttcctgctga

SEQ ID NO: 2402517 - DNA, 15 bp, Homo sapiens
cctctccctcctcag

SEQ ID NO: 2402518 - DNA, 20 bp, Homo sapiens
cctgaaattatataaggcat

SEQ ID NO: 2402519 - DNA, 21 bp, Homo sapiens
cctgaattaactatcatcagt

SEQ ID NO: 2402520 - DNA, 15 bp, Homo sapiens
cctgctgaaaataac

SEQ ID NO: 2402521 - DNA, 18 bp, Homo sapiens
ctagcagacactgccttg

SEQ ID NO: 2402522 - DNA, 23 bp, Homo sapiens
ctatgctggagtattttctaata

SEQ ID NO: 2402523 - DNA, 12 bp, Homo sapiens
ctccctcctcag

SEQ ID NO: 2402524 - DNA, 22 bp, Homo sapiens
ctccgccttgctgagacttacg

SEQ ID NO: 2402525 - DNA, 12 bp, Homo sapiens
ctcctcagctcc

SEQ ID NO: 2402526 - DNA, 14 bp, Homo sapiens
ctcctccgccttgc

SEQ ID NO: 2402527 - DNA, 18 bp, Homo sapiens
ctccttccatctgcctga

SEQ ID NO: 2402528 - DNA, 18 bp, Homo sapiens
ctgaaattatataaggca

SEQ ID NO: 2402529 - DNA, 21 bp, Homo sapiens
ctgaaattatataaggcattc

SEQ ID NO: 2402530 - DNA, 12 bp, Homo sapiens
ctgaccccttca

SEQ ID NO: 2402531 - DNA, 22 bp, Homo sapiens
ctgccccacatccccacctggc

SEQ ID NO: 2402532 - DNA, 16 bp, Homo sapiens
ctgcctgaccccttca

SEQ ID NO: 2402533 - DNA, 15 bp, Homo sapiens
cttcttgccctccac

SEQ ID NO: 2402534 - DNA, 17 bp, Homo sapiens
cttttattttcctgctg

SEQ ID NO: 2402535 - DNA, 20 bp, Homo sapiens
gacgtgataatgcagataaa

SEQ ID NO: 2402536 - DNA, 23 bp, Homo sapiens
gacttacgccctgttcccttcct

SEQ ID NO: 2402537 - DNA, 18 bp, Homo sapiens
gagacttacgccctgttc

SEQ ID NO: 2402538 - DNA, 20 bp, Homo sapiens
gagatcctaatatgaaagaa

SEQ ID NO: 2402539 - DNA, 17 bp, Homo sapiens
gagctctcctccgcctt

SEQ ID NO: 2402540 - DNA, 19 bp, Homo sapiens
gaggaagcatccaaagatt

SEQ ID NO: 2402541 - DNA, 20 bp, Homo sapiens
gaggaagcatccaaagattg

SEQ ID NO: 2402542 - DNA, 14 bp, Homo sapiens
gaggtcagaagaaa

SEQ ID NO: 2402543 - DNA, 15 bp, Homo sapiens
gagtgtccatagata

SEQ ID NO: 2402544 - DNA, 19 bp, Homo sapiens
gataaatacatttatattt

SEQ ID NO: 2402545 - DNA, 21 bp, Homo sapiens
gatgcaattgttgaaagcttt

SEQ ID NO: 2402546 - DNA, 11 bp, Homo sapiens
gattgtgaagg

SEQ ID NO: 2402547 - DNA, 22 bp, Homo sapiens
gcaattgttgaaagctttgaaa

SEQ ID NO: 2402548 - DNA, 18 bp, Homo sapiens
gcagataaatacatttat

SEQ ID NO: 2402549 - DNA, 12 bp, Homo sapiens
gcagcacctgcc

SEQ ID NO: 2402550 - DNA, 12 bp, Homo sapiens
gcatgaaagcat

SEQ ID NO: 2402551 - DNA, 13 bp, Homo sapiens
gcatgaaagcatt

SEQ ID NO: 2402552 - DNA, 19 bp, Homo sapiens
gcccacgggccggccagct

SEQ ID NO: 2402553 - DNA, 12 bp, Homo sapiens
gcggagctctcc

SEQ ID NO: 2402554 - DNA, 20 bp, Homo sapiens
gctcttttattttcctgctg

SEQ ID NO: 2402555 - DNA, 20 bp, Homo sapiens
gctgccccacatccccacct

SEQ ID NO: 2402556 - DNA, 15 bp, Homo sapiens
gctgggtgccccagg

SEQ ID NO: 2402557 - DNA, 22 bp, Homo sapiens
gctgggtgccccagggacgtga

SEQ ID NO: 2402558 - DNA, 17 bp, Homo sapiens
ggaagcatccaaagatt

SEQ ID NO: 2402559 - DNA, 23 bp, Homo sapiens
ggagaaacctgcatgaaagcatt

SEQ ID NO: 2402560 - DNA, 19 bp, Homo sapiens
ggccagctgggtgccccag

SEQ ID NO: 2402561 - DNA, 23 bp, Homo sapiens
ggccagctgggtgccccagggac

SEQ ID NO: 2402562 - DNA, 18 bp, Homo sapiens
ggcccacgggccggccag

SEQ ID NO: 2402563 - DNA, 18 bp, Homo sapiens
ggccggccagctgggtgc

SEQ ID NO: 2402564 - DNA, 22 bp, Homo sapiens
ggctgccccacatccccacctg

SEQ ID NO: 2402565 - DNA, 22 bp, Homo sapiens
gtaatgagttaaataaaacatt

SEQ ID NO: 2402566 - DNA, 20 bp, Homo sapiens
gtcacctctccctcctcagc

SEQ ID NO: 2402567 - DNA, 16 bp, Homo sapiens
gtgaaaacagaaaaaa

SEQ ID NO: 2402568 - DNA, 21 bp, Homo sapiens
gtgataatgcagataaataca

SEQ ID NO: 2402569 - DNA, 19 bp, Homo sapiens
gttcccttcctgccctgtg

SEQ ID NO: 2402570 - DNA, 16 bp, Homo sapiens
gttgaaagctttgaaa

SEQ ID NO: 2402571 - DNA, 19 bp, Homo sapiens
gttgaaagctttgaaataa

SEQ ID NO: 2402572 - DNA, 17 bp, Homo sapiens
gtttactctctccctct

SEQ ID NO: 2402573 - DNA, 15 bp, Homo sapiens
gttttatagcccggt

SEQ ID NO: 2402574 - DNA, 15 bp, Homo sapiens
taaaataaaactctc

SEQ ID NO: 2402575 - DNA, 16 bp, Homo sapiens
taaaataaaactctca

SEQ ID NO: 2402576 - DNA, 16 bp, Homo sapiens
taacacaacaaaaatg

SEQ ID NO: 2402577 - DNA, 13 bp, Homo sapiens
taacttaactctt

SEQ ID NO: 2402578 - DNA, 16 bp, Homo sapiens
taatatttctgtggaa

SEQ ID NO: 2402579 - DNA, 16 bp, Homo sapiens
taatttcctgctgaaa

SEQ ID NO: 2402580 - DNA, 16 bp, Homo sapiens
tacacagaatctcctg

SEQ ID NO: 2402581 - DNA, 21 bp, Homo sapiens
tacgtttaaaataaaactctc

SEQ ID NO: 2402582 - DNA, 16 bp, Homo sapiens
tagatataaagccatt

SEQ ID NO: 2402583 - DNA, 15 bp, Homo sapiens
taggatcccccttct

SEQ ID NO: 2402584 - DNA, 12 bp, Homo sapiens
tataaatgcaaa

SEQ ID NO: 2402585 - DNA, 21 bp, Homo sapiens
tataaatgcaaatgtgcattt

SEQ ID NO: 2402586 - DNA, 24 bp, Homo sapiens
tataaggcattctgtataaatgca

SEQ ID NO: 2402587 - DNA, 15 bp, Homo sapiens
tatagccctgtgaag

SEQ ID NO: 2402588 - DNA, 18 bp, Homo sapiens
tatgatgttaacatttca

SEQ ID NO: 2402589 - DNA, 13 bp, Homo sapiens
tatgtgatgaaac

SEQ ID NO: 2402590 - DNA, 19 bp, Homo sapiens
tcacctctccctcctcagc

SEQ ID NO: 2402591 - DNA, 21 bp, Homo sapiens
tcatacgtttaaaataaaact

SEQ ID NO: 2402592 - DNA, 17 bp, Homo sapiens
tccaaaactagcattct

SEQ ID NO: 2402593 - DNA, 22 bp, Homo sapiens
tccagggcagtgtccctccctg

SEQ ID NO: 2402594 - DNA, 20 bp, Homo sapiens
tccatagatataaagccatt

SEQ ID NO: 2402595 - DNA, 18 bp, Homo sapiens
tcccagattactccttcc

SEQ ID NO: 2402596 - DNA, 19 bp, Homo sapiens
tcctagcagacactgcctt

SEQ ID NO: 2402597 - DNA, 18 bp, Homo sapiens
tcctgccctgtggcccac

SEQ ID NO: 2402598 - DNA, 16 bp, Homo sapiens
tccttccatctgcctg

SEQ ID NO: 2402599 - DNA, 19 bp, Homo sapiens
tctcagagtcaccacttcc

SEQ ID NO: 2402600 - DNA, 17 bp, Homo sapiens
tctccctcctcagctcc

SEQ ID NO: 2402601 - DNA, 21 bp, Homo sapiens
tctgaccaataaaaaaataag

SEQ ID NO: 2402602 - DNA, 18 bp, Homo sapiens
tgaaaaagatatttatga

SEQ ID NO: 2402603 - DNA, 19 bp, Homo sapiens
tgaaactttgaaaaagata

SEQ ID NO: 2402604 - DNA, 14 bp, Homo sapiens
tgagaaaaggcaaa

SEQ ID NO: 2402605 - DNA, 13 bp, Homo sapiens
tgataatgcagat

SEQ ID NO: 2402606 - DNA, 15 bp, Homo sapiens
tgcagataaatacat

SEQ ID NO: 2402607 - DNA, 22 bp, Homo sapiens
tgcagataaatacatttatatt

SEQ ID NO: 2402608 - DNA, 15 bp, Homo sapiens
tggaacaaagcatgt

SEQ ID NO: 2402609 - DNA, 14 bp, Homo sapiens
tggagacaaggata

SEQ ID NO: 2402610 - DNA, 15 bp, Homo sapiens
tggagacaaggataa

SEQ ID NO: 2402611 - DNA, 21 bp, Homo sapiens
tggcccacgggccggccagct

SEQ ID NO: 2402612 - DNA, 20 bp, Homo sapiens
tggctacttttttctatgct

SEQ ID NO: 2402613 - DNA, 14 bp, Homo sapiens
tgtgatgaaacttt

SEQ ID NO: 2402614 - DNA, 18 bp, Homo sapiens
tgtgatgaaactttgaaa

SEQ ID NO: 2402615 - DNA, 16 bp, Homo sapiens
tgtgctaaatcctagc

SEQ ID NO: 2402616 - DNA, 21 bp, Homo sapiens
tgtggcccacgggccggccag

SEQ ID NO: 2402617 - DNA, 13 bp, Homo sapiens
tgttttgttttat

SEQ ID NO: 2402618 - DNA, 17 bp, Homo sapiens
ttaatatttctgtggaa

SEQ ID NO: 2402619 - DNA, 16 bp, Homo sapiens
ttcatggaactagctc

SEQ ID NO: 2402620 - DNA, 13 bp, Homo sapiens
ttctgcagctgct

SEQ ID NO: 2402621 - DNA, 13 bp, Homo sapiens
ttctgcttcctta

SEQ ID NO: 2402622 - DNA, 11 bp, Homo sapiens
aaaaagatccc

SEQ ID NO: 2402623 - DNA, 14 bp, Homo sapiens
aaaaagatcccaaa

SEQ ID NO: 2402624 - DNA, 23 bp, Homo sapiens
aaaacagggccacatagatgctg

SEQ ID NO: 2402625 - DNA, 15 bp, Homo sapiens
aaaacccagataaag

SEQ ID NO: 2402626 - DNA, 14 bp, Homo sapiens
aaaagatataagtg

SEQ ID NO: 2402627 - DNA, 15 bp, Homo sapiens
aaaagatataagtgc

SEQ ID NO: 2402628 - DNA, 18 bp, Homo sapiens
aaaagatataagtgctgt

SEQ ID NO: 2402629 - DNA, 10 bp, Homo sapiens
aaaagatccc

SEQ ID NO: 2402630 - DNA, 21 bp, Homo sapiens
aaaagatggggtctgtaaaat

SEQ ID NO: 2402631 - DNA, 19 bp, Homo sapiens
aaaagggactgagaaattt

SEQ ID NO: 2402632 - DNA, 14 bp, Homo sapiens
aaaagttgctattt

SEQ ID NO: 2402633 - DNA, 15 bp, Homo sapiens
aaaataaaaaacact

SEQ ID NO: 2402634 - DNA, 13 bp, Homo sapiens
aaaataaagaatg

SEQ ID NO: 2402635 - DNA, 16 bp, Homo sapiens
aaaataaagaatggaa

SEQ ID NO: 2402636 - DNA, 20 bp, Homo sapiens
aaaataaatctatcaaaatt

SEQ ID NO: 2402637 - DNA, 18 bp, Homo sapiens
aaaatatatatcaaatat

SEQ ID NO: 2402638 - DNA, 18 bp, Homo sapiens
aaaatcagccaattatgt

SEQ ID NO: 2402639 - DNA, 21 bp, Homo sapiens
aaaatcagccaattatgttaa

SEQ ID NO: 2402640 - DNA, 22 bp, Homo sapiens
aaaatcagccaattatgttaaa

SEQ ID NO: 2402641 - DNA, 11 bp, Homo sapiens
aaaatcttgtc

SEQ ID NO: 2402642 - DNA, 13 bp, Homo sapiens
aaaatcttgtcat

SEQ ID NO: 2402643 - DNA, 23 bp, Homo sapiens
aaaatctttctttcttagaaatt

SEQ ID NO: 2402644 - DNA, 11 bp, Homo sapiens
aaaatgagaaa

SEQ ID NO: 2402645 - DNA, 12 bp, Homo sapiens
aaaatgtaggag

SEQ ID NO: 2402646 - DNA, 17 bp, Homo sapiens
aaaatgtaggagactgt

SEQ ID NO: 2402647 - DNA, 22 bp, Homo sapiens
aaaatgtgggattatgggtcac

SEQ ID NO: 2402648 - DNA, 20 bp, Homo sapiens
aaaattaagaaaggataaag

SEQ ID NO: 2402649 - DNA, 18 bp, Homo sapiens
aaaattgccatattgcac

SEQ ID NO: 2402650 - DNA, 20 bp, Homo sapiens
aaacaagcactaaacaaaga

SEQ ID NO: 2402651 - DNA, 17 bp, Homo sapiens
aaacacattaggaaaag

SEQ ID NO: 2402652 - DNA, 21 bp, Homo sapiens
aaacactgggagaaatgaaaa

SEQ ID NO: 2402653 - DNA, 24 bp, Homo sapiens
aaacacttgcggatattctggact

SEQ ID NO: 2402654 - DNA, 13 bp, Homo sapiens
aaagcatttgaat

SEQ ID NO: 2402655 - DNA, 17 bp, Homo sapiens
aaagcttcagtgctgcc

SEQ ID NO: 2402656 - DNA, 12 bp, Homo sapiens
aaaggcctttaa

SEQ ID NO: 2402657 - DNA, 17 bp, Homo sapiens
aaaggcctttaaaattt

SEQ ID NO: 2402658 - DNA, 23 bp, Homo sapiens
aaagtatttaattagtgctaagt

SEQ ID NO: 2402659 - DNA, 17 bp, Homo sapiens
aaagtcaatgttttcag

SEQ ID NO: 2402660 - DNA, 14 bp, Homo sapiens
aaagtcattggctt

SEQ ID NO: 2402661 - DNA, 17 bp, Homo sapiens
aaagtcattggctttat

SEQ ID NO: 2402662 - DNA, 23 bp, Homo sapiens
aaagtcattggctttatcctctt

SEQ ID NO: 2402663 - DNA, 21 bp, Homo sapiens
aaagtgggttttttagttgaa

SEQ ID NO: 2402664 - DNA, 16 bp, Homo sapiens
aaagttggtaaacctt

SEQ ID NO: 2402665 - DNA, 17 bp, Homo sapiens
aaagttggtaaaccttt

SEQ ID NO: 2402666 - DNA, 20 bp, Homo sapiens
aaataaattgtatattcact

SEQ ID NO: 2402667 - DNA, 22 bp, Homo sapiens
aaataaattgtatattcacttt

SEQ ID NO: 2402668 - DNA, 23 bp, Homo sapiens
aaataagacggatttatttttcc

SEQ ID NO: 2402669 - DNA, 15 bp, Homo sapiens
aaatacagattttga

SEQ ID NO: 2402670 - DNA, 17 bp, Homo sapiens
aaatacagattttgata

SEQ ID NO: 2402671 - DNA, 23 bp, Homo sapiens
aaatacagattttgatagcaaag

SEQ ID NO: 2402672 - DNA, 20 bp, Homo sapiens
aaatcagccaattatgttaa

SEQ ID NO: 2402673 - DNA, 13 bp, Homo sapiens
aaatctaccactg

SEQ ID NO: 2402674 - DNA, 16 bp, Homo sapiens
aaatcttgtcatgtgt

SEQ ID NO: 2402675 - DNA, 20 bp, Homo sapiens
aaatcttgtcatgtgtataa

SEQ ID NO: 2402676 - DNA, 16 bp, Homo sapiens
aaatctttctttctta

SEQ ID NO: 2402677 - DNA, 23 bp, Homo sapiens
aaatctttctttcttagaaattt

SEQ ID NO: 2402678 - DNA, 13 bp, Homo sapiens
aaatgcatgttgc

SEQ ID NO: 2402679 - DNA, 14 bp, Homo sapiens
aaatggttgtatta

SEQ ID NO: 2402680 - DNA, 16 bp, Homo sapiens
aaatggttgtattaga

SEQ ID NO: 2402681 - DNA, 22 bp, Homo sapiens
aaatggttgtattagatgttct

SEQ ID NO: 2402682 - DNA, 17 bp, Homo sapiens
aaattccaagtgattga

SEQ ID NO: 2402683 - DNA, 23 bp, Homo sapiens
aaattgagctggacctcaccaag

SEQ ID NO: 2402684 - DNA, 18 bp, Homo sapiens
aaattgatgggatttggt

SEQ ID NO: 2402685 - DNA, 14 bp, Homo sapiens
aaattgattttgaa

SEQ ID NO: 2402686 - DNA, 17 bp, Homo sapiens
aaattgtatattcactt

SEQ ID NO: 2402687 - DNA, 20 bp, Homo sapiens
aaattgttctctaatatgta

SEQ ID NO: 2402688 - DNA, 20 bp, Homo sapiens
aaatttatttcctagttctg

SEQ ID NO: 2402689 - DNA, 23 bp, Homo sapiens
aaatttttaatctttaattttac

SEQ ID NO: 2402690 - DNA, 21 bp, Homo sapiens
aaatttttttagaaagcattt

SEQ ID NO: 2402691 - DNA, 16 bp, Homo sapiens
aacagggccacataga

SEQ ID NO: 2402692 - DNA, 21 bp, Homo sapiens
aacagggctgccttctggcct

SEQ ID NO: 2402693 - DNA, 14 bp, Homo sapiens
aacatgcactgatg

SEQ ID NO: 2402694 - DNA, 16 bp, Homo sapiens
aacatgcactgatgtt

SEQ ID NO: 2402695 - DNA, 21 bp, Homo sapiens
aacattcctcatgaatgtaaa

SEQ ID NO: 2402696 - DNA, 22 bp, Homo sapiens
aacatttgttctatagcttttc

SEQ ID NO: 2402697 - DNA, 16 bp, Homo sapiens
aaccaaatattccaga

SEQ ID NO: 2402698 - DNA, 15 bp, Homo sapiens
aaccatttcctcaga

SEQ ID NO: 2402699 - DNA, 17 bp, Homo sapiens
aacctggagatggtgga

SEQ ID NO: 2402700 - DNA, 15 bp, Homo sapiens
aacgtataaaagcct

SEQ ID NO: 2402701 - DNA, 14 bp, Homo sapiens
aacgtgcattgtgc

SEQ ID NO: 2402702 - DNA, 13 bp, Homo sapiens
aacgtggcccaga

SEQ ID NO: 2402703 - DNA, 21 bp, Homo sapiens
aactaggtgcatatttataaa

SEQ ID NO: 2402704 - DNA, 12 bp, Homo sapiens
aactatggcctg

SEQ ID NO: 2402705 - DNA, 12 bp, Homo sapiens
aactcatttcta

SEQ ID NO: 2402706 - DNA, 18 bp, Homo sapiens
aactcctgacctcaggca

SEQ ID NO: 2402707 - DNA, 21 bp, Homo sapiens
aactctcttattgcctcactt

SEQ ID NO: 2402708 - DNA, 18 bp, Homo sapiens
aactgagatccttccttt

SEQ ID NO: 2402709 - DNA, 22 bp, Homo sapiens
aactggaccctgttgctaagcc

SEQ ID NO: 2402710 - DNA, 12 bp, Homo sapiens
aactggagcccc

SEQ ID NO: 2402711 - DNA, 14 bp, Homo sapiens
aacttggaaatagt

SEQ ID NO: 2402712 - DNA, 20 bp, Homo sapiens
aactttttattgatttttgg

SEQ ID NO: 2402713 - DNA, 20 bp, Homo sapiens
aagaaaataagagctcagga

SEQ ID NO: 2402714 - DNA, 14 bp, Homo sapiens
aagaaacatttata

SEQ ID NO: 2402715 - DNA, 14 bp, Homo sapiens
aagacagtggcccc

SEQ ID NO: 2402716 - DNA, 15 bp, Homo sapiens
aagacttttatgata

SEQ ID NO: 2402717 - DNA, 14 bp, Homo sapiens
aagagatttttcat

SEQ ID NO: 2402718 - DNA, 15 bp, Homo sapiens
aagagatttttcatg

SEQ ID NO: 2402719 - DNA, 17 bp, Homo sapiens
aagagatttttcatgat

SEQ ID NO: 2402720 - DNA, 16 bp, Homo sapiens
aagatataagtgctgt

SEQ ID NO: 2402721 - DNA, 15 bp, Homo sapiens
aagatcttttatttt

SEQ ID NO: 2402722 - DNA, 18 bp, Homo sapiens
aagatcttttattttgcc

SEQ ID NO: 2402723 - DNA, 21 bp, Homo sapiens
aagatggggtctgtaaaatct

SEQ ID NO: 2402724 - DNA, 17 bp, Homo sapiens
aagattactttttcttt

SEQ ID NO: 2402725 - DNA, 16 bp, Homo sapiens
aagatttccatataaa

SEQ ID NO: 2402726 - DNA, 16 bp, Homo sapiens
aagcactaaacaaaga

SEQ ID NO: 2402727 - DNA, 18 bp, Homo sapiens
aagcatgtattcagcttt

SEQ ID NO: 2402728 - DNA, 12 bp, Homo sapiens
aagcatttgaat

SEQ ID NO: 2402729 - DNA, 21 bp, Homo sapiens
aagcatttgaatgcattttgt

SEQ ID NO: 2402730 - DNA, 21 bp, Homo sapiens
aagccagctgcccccagagcc

SEQ ID NO: 2402731 - DNA, 21 bp, Homo sapiens
aagccatgggtagcctgggtg

SEQ ID NO: 2402732 - DNA, 17 bp, Homo sapiens
aagcctaagggatcctg

SEQ ID NO: 2402733 - DNA, 18 bp, Homo sapiens
aagcctgtttaagagaca

SEQ ID NO: 2402734 - DNA, 20 bp, Homo sapiens
aagccttgattggtgttgcc

SEQ ID NO: 2402735 - DNA, 19 bp, Homo sapiens
aagcgattctcttgcctca

SEQ ID NO: 2402736 - DNA, 17 bp, Homo sapiens
aagctggagtgcagtgg

SEQ ID NO: 2402737 - DNA, 21 bp, Homo sapiens
aagcttttatgtgaaacatgt

SEQ ID NO: 2402738 - DNA, 15 bp, Homo sapiens
aaggaagctgtgcgt

SEQ ID NO: 2402739 - DNA, 12 bp, Homo sapiens
aaggaattttat

SEQ ID NO: 2402740 - DNA, 21 bp, Homo sapiens
aaggataaagttggtaaacct

SEQ ID NO: 2402741 - DNA, 23 bp, Homo sapiens
aaggataaagttggtaaaccttt

SEQ ID NO: 2402742 - DNA, 15 bp, Homo sapiens
aaggattttgcagtt

SEQ ID NO: 2402743 - DNA, 19 bp, Homo sapiens
aaggccaagaggctgttcc

SEQ ID NO: 2402744 - DNA, 15 bp, Homo sapiens
aagggactgagaaat

SEQ ID NO: 2402745 - DNA, 16 bp, Homo sapiens
aagggatcctgcctgc

SEQ ID NO: 2402746 - DNA, 13 bp, Homo sapiens
aagtaaaaacaaa

SEQ ID NO: 2402747 - DNA, 22 bp, Homo sapiens
aagtaaaaacaaagaaattatg

SEQ ID NO: 2402748 - DNA, 16 bp, Homo sapiens
aagtaaggaattttat

SEQ ID NO: 2402749 - DNA, 22 bp, Homo sapiens
aagtatttaattagtgctaagt

SEQ ID NO: 2402750 - DNA, 20 bp, Homo sapiens
aagtcattggctttatcctc

SEQ ID NO: 2402751 - DNA, 16 bp, Homo sapiens
aagtgagaccttcctt

SEQ ID NO: 2402752 - DNA, 17 bp, Homo sapiens
aagtgctgtataaaatc

SEQ ID NO: 2402753 - DNA, 19 bp, Homo sapiens
aagtgctgtataaaatcag

SEQ ID NO: 2402754 - DNA, 23 bp, Homo sapiens
aagtgtttcataaatttgagagt

SEQ ID NO: 2402755 - DNA, 22 bp, Homo sapiens
aagttagaactagccaaaccag

SEQ ID NO: 2402756 - DNA, 16 bp, Homo sapiens
aagtttgaatgttaaa

SEQ ID NO: 2402757 - DNA, 16 bp, Homo sapiens
aataaacactcttgaa

SEQ ID NO: 2402758 - DNA, 19 bp, Homo sapiens
aataaactatttgtaaagt

SEQ ID NO: 2402759 - DNA, 23 bp, Homo sapiens
aataaagtatttaattagtgcta

SEQ ID NO: 2402760 - DNA, 13 bp, Homo sapiens
aataaattgtata

SEQ ID NO: 2402761 - DNA, 15 bp, Homo sapiens
aataaattgtatatt

SEQ ID NO: 2402762 - DNA, 21 bp, Homo sapiens
aataacaatgaaagttgataa

SEQ ID NO: 2402763 - DNA, 21 bp, Homo sapiens
aataatcctaaacatatgaat

SEQ ID NO: 2402764 - DNA, 20 bp, Homo sapiens
aatacagattttgatagcaa

SEQ ID NO: 2402765 - DNA, 21 bp, Homo sapiens
aatacagattttgatagcaaa

SEQ ID NO: 2402766 - DNA, 23 bp, Homo sapiens
aatacagattttgatagcaaagc

SEQ ID NO: 2402767 - DNA, 14 bp, Homo sapiens
aatatattttaaga

SEQ ID NO: 2402768 - DNA, 21 bp, Homo sapiens
aatatattttaagacgaaaca

SEQ ID NO: 2402769 - DNA, 13 bp, Homo sapiens
aatatcagacttt

SEQ ID NO: 2402770 - DNA, 17 bp, Homo sapiens
aatatcttcacttgtca

SEQ ID NO: 2402771 - DNA, 13 bp, Homo sapiens
aatattagaaaca

SEQ ID NO: 2402772 - DNA, 12 bp, Homo sapiens
aatattccagag

SEQ ID NO: 2402773 - DNA, 20 bp, Homo sapiens
aatatttgaatcttgtctca

SEQ ID NO: 2402774 - DNA, 15 bp, Homo sapiens
aatcttgtctcaatg

SEQ ID NO: 2402775 - DNA, 18 bp, Homo sapiens
aatcttgtctcaatgctc

SEQ ID NO: 2402776 - DNA, 14 bp, Homo sapiens
aatctttctttctt

SEQ ID NO: 2402777 - DNA, 14 bp, Homo sapiens
aatgaagcaatgct

SEQ ID NO: 2402778 - DNA, 17 bp, Homo sapiens
aatgaagttgtaggtaa

SEQ ID NO: 2402779 - DNA, 13 bp, Homo sapiens
aatgaagtttgaa

SEQ ID NO: 2402780 - DNA, 14 bp, Homo sapiens
aatgaagtttgaat

SEQ ID NO: 2402781 - DNA, 15 bp, Homo sapiens
aatgaagtttgaatg

SEQ ID NO: 2402782 - DNA, 22 bp, Homo sapiens
aatgaagtttgaatgttaaata

SEQ ID NO: 2402783 - DNA, 22 bp, Homo sapiens
aatgagaaatctaaaaaacgaa

SEQ ID NO: 2402784 - DNA, 18 bp, Homo sapiens
aatgcattttgtttggta

SEQ ID NO: 2402785 - DNA, 21 bp, Homo sapiens
aatgcattttgtttggtattg

SEQ ID NO: 2402786 - DNA, 12 bp, Homo sapiens
aatgctttcgat

SEQ ID NO: 2402787 - DNA, 13 bp, Homo sapiens
aatggttgtatta

SEQ ID NO: 2402788 - DNA, 24 bp, Homo sapiens
aatggttgtattagatgttctcta

SEQ ID NO: 2402789 - DNA, 13 bp, Homo sapiens
aatgtaaatttgt

SEQ ID NO: 2402790 - DNA, 17 bp, Homo sapiens
aatgtaaatttgtacta

SEQ ID NO: 2402791 - DNA, 18 bp, Homo sapiens
aatgtaaatttgtactat

SEQ ID NO: 2402792 - DNA, 16 bp, Homo sapiens
aatgtgatattataca

SEQ ID NO: 2402793 - DNA, 22 bp, Homo sapiens
aatgtgtattacaaatattttg

SEQ ID NO: 2402794 - DNA, 13 bp, Homo sapiens
aatgttaaataaa

SEQ ID NO: 2402795 - DNA, 15 bp, Homo sapiens
aatgttaaataaatt

SEQ ID NO: 2402796 - DNA, 20 bp, Homo sapiens
aatgttaaataaattgtata

SEQ ID NO: 2402797 - DNA, 21 bp, Homo sapiens
aatgttaaataaattgtatat

SEQ ID NO: 2402798 - DNA, 15 bp, Homo sapiens
aatgtttttttttaa

SEQ ID NO: 2402799 - DNA, 19 bp, Homo sapiens
aattaacatgaatatttag

SEQ ID NO: 2402800 - DNA, 20 bp, Homo sapiens
aattaagaaaggataaagtt

SEQ ID NO: 2402801 - DNA, 20 bp, Homo sapiens
aattagtgctaagtgtgaac

SEQ ID NO: 2402802 - DNA, 21 bp, Homo sapiens
aattagtgctaagtgtgaact

SEQ ID NO: 2402803 - DNA, 13 bp, Homo sapiens
aattatgttaaac

SEQ ID NO: 2402804 - DNA, 19 bp, Homo sapiens
aattatgttaaactagcat

SEQ ID NO: 2402805 - DNA, 23 bp, Homo sapiens
aattatgttaaactagcatatct

SEQ ID NO: 2402806 - DNA, 11 bp, Homo sapiens
aattattttgt

SEQ ID NO: 2402807 - DNA, 13 bp, Homo sapiens
aattctcacagaa

SEQ ID NO: 2402808 - DNA, 15 bp, Homo sapiens
aattgaatcactgct

SEQ ID NO: 2402809 - DNA, 13 bp, Homo sapiens
aattgattttgaa

SEQ ID NO: 2402810 - DNA, 12 bp, Homo sapiens
aattgccatatt

SEQ ID NO: 2402811 - DNA, 15 bp, Homo sapiens
aattgccatattgca

SEQ ID NO: 2402812 - DNA, 19 bp, Homo sapiens
aattgccatattgcacatg

SEQ ID NO: 2402813 - DNA, 17 bp, Homo sapiens
aattgtatattcacttt

SEQ ID NO: 2402814 - DNA, 16 bp, Homo sapiens
aattgtattttagtaa

SEQ ID NO: 2402815 - DNA, 20 bp, Homo sapiens
aattgtgtttataattttaa

SEQ ID NO: 2402816 - DNA, 21 bp, Homo sapiens
aattgtgtttataattttaaa

SEQ ID NO: 2402817 - DNA, 16 bp, Homo sapiens
aattgttacaaattgt

SEQ ID NO: 2402818 - DNA, 16 bp, Homo sapiens
aatttacatcatttct

SEQ ID NO: 2402819 - DNA, 19 bp, Homo sapiens
aatttatttcctagttctg

SEQ ID NO: 2402820 - DNA, 18 bp, Homo sapiens
aattttcatctaggattt

SEQ ID NO: 2402821 - DNA, 16 bp, Homo sapiens
aattttgatgaacaaa

SEQ ID NO: 2402822 - DNA, 15 bp, Homo sapiens
aatttttttagaaag

SEQ ID NO: 2402823 - DNA, 20 bp, Homo sapiens
aatttttttagaaagcattt

SEQ ID NO: 2402824 - DNA, 14 bp, Homo sapiens
aattttttttaaca

SEQ ID NO: 2402825 - DNA, 16 bp, Homo sapiens
acaaaactagagactc

SEQ ID NO: 2402826 - DNA, 14 bp, Homo sapiens
acaaagaaattatg

SEQ ID NO: 2402827 - DNA, 16 bp, Homo sapiens
acaaatggaggcctgt

SEQ ID NO: 2402828 - DNA, 15 bp, Homo sapiens
acaacgtgcattgtg

SEQ ID NO: 2402829 - DNA, 17 bp, Homo sapiens
acaacgtgcattgtgct

SEQ ID NO: 2402830 - DNA, 18 bp, Homo sapiens
acaacgtgcattgtgctt

SEQ ID NO: 2402831 - DNA, 14 bp, Homo sapiens
acaataattttcta

SEQ ID NO: 2402832 - DNA, 13 bp, Homo sapiens
acaattgggagct

SEQ ID NO: 2402833 - DNA, 20 bp, Homo sapiens
acaattgggagctgccaaga

SEQ ID NO: 2402834 - DNA, 22 bp, Homo sapiens
acacacaaattatcttaaaact

SEQ ID NO: 2402835 - DNA, 17 bp, Homo sapiens
acacaccaccacgcctg

SEQ ID NO: 2402836 - DNA, 16 bp, Homo sapiens
acacagttcctgggaa

SEQ ID NO: 2402837 - DNA, 15 bp, Homo sapiens
acacatgtatttggt

SEQ ID NO: 2402838 - DNA, 21 bp, Homo sapiens
acaccaggcttgcctgcaggc

SEQ ID NO: 2402839 - DNA, 20 bp, Homo sapiens
acacctatgtcatttcattt

SEQ ID NO: 2402840 - DNA, 19 bp, Homo sapiens
acactcatgcattgtcctc

SEQ ID NO: 2402841 - DNA, 14 bp, Homo sapiens
acagagtcttcctc

SEQ ID NO: 2402842 - DNA, 15 bp, Homo sapiens
acagcccaggatact

SEQ ID NO: 2402843 - DNA, 18 bp, Homo sapiens
acagctcagaagtttctt

SEQ ID NO: 2402844 - DNA, 22 bp, Homo sapiens
acagcttcagccaggagctggg

SEQ ID NO: 2402845 - DNA, 19 bp, Homo sapiens
acaggcgtgagccacctcg

SEQ ID NO: 2402846 - DNA, 22 bp, Homo sapiens
acaggtaaaacagggccacata

SEQ ID NO: 2402847 - DNA, 20 bp, Homo sapiens
acagtgaaagaaaataacaa

SEQ ID NO: 2402848 - DNA, 17 bp, Homo sapiens
acagtgggagccagggc

SEQ ID NO: 2402849 - DNA, 19 bp, Homo sapiens
acagttcccctatgtggaa

SEQ ID NO: 2402850 - DNA, 20 bp, Homo sapiens
acagttcccctatgtggaag

SEQ ID NO: 2402851 - DNA, 16 bp, Homo sapiens
acatcaccacagttta

SEQ ID NO: 2402852 - DNA, 13 bp, Homo sapiens
acatgaagctgtt

SEQ ID NO: 2402853 - DNA, 18 bp, Homo sapiens
acatgaattgcattttac

SEQ ID NO: 2402854 - DNA, 19 bp, Homo sapiens
acatgattccagccatcac

SEQ ID NO: 2402855 - DNA, 22 bp, Homo sapiens
acatgcacttggctgcataaat

SEQ ID NO: 2402856 - DNA, 12 bp, Homo sapiens
acatgtcaatct

SEQ ID NO: 2402857 - DNA, 21 bp, Homo sapiens
acatgtcttaatgaagtttga

SEQ ID NO: 2402858 - DNA, 23 bp, Homo sapiens
acatgtcttaatgaagtttgaat

SEQ ID NO: 2402859 - DNA, 20 bp, Homo sapiens
acattcctcatgaatgtaaa

SEQ ID NO: 2402860 - DNA, 16 bp, Homo sapiens
acatttcctaaatata

SEQ ID NO: 2402861 - DNA, 18 bp, Homo sapiens
acattttctaagaaacat

SEQ ID NO: 2402862 - DNA, 11 bp, Homo sapiens
acattttctcc

SEQ ID NO: 2402863 - DNA, 23 bp, Homo sapiens
accaagtttcaggtattaagaaa

SEQ ID NO: 2402864 - DNA, 15 bp, Homo sapiens
accaccaagccttga

SEQ ID NO: 2402865 - DNA, 16 bp, Homo sapiens
accaccacgcctggct

SEQ ID NO: 2402866 - DNA, 20 bp, Homo sapiens
accacgcctggctaattttt

SEQ ID NO: 2402867 - DNA, 12 bp, Homo sapiens
accaggaccctg

SEQ ID NO: 2402868 - DNA, 22 bp, Homo sapiens
accaggactagggctggagtga

SEQ ID NO: 2402869 - DNA, 18 bp, Homo sapiens
accaggcttgcctgcagg

SEQ ID NO: 2402870 - DNA, 21 bp, Homo sapiens
accagggatgatgcaacatcc

SEQ ID NO: 2402871 - DNA, 23 bp, Homo sapiens
accagtgtgtggctttcagagcc

SEQ ID NO: 2402872 - DNA, 19 bp, Homo sapiens
accatcgtcttcttggcca

SEQ ID NO: 2402873 - DNA, 23 bp, Homo sapiens
accatgctgctggggaagacagt

SEQ ID NO: 2402874 - DNA, 15 bp, Homo sapiens
accatttcctcagac

SEQ ID NO: 2402875 - DNA, 23 bp, Homo sapiens
accatttggatcctgtgtggaga

SEQ ID NO: 2402876 - DNA, 17 bp, Homo sapiens
acccagtaactcatctg

SEQ ID NO: 2402877 - DNA, 22 bp, Homo sapiens
accccatggcagtgggaaaaat

SEQ ID NO: 2402878 - DNA, 21 bp, Homo sapiens
acccctaaaagaaaccctgca

SEQ ID NO: 2402879 - DNA, 23 bp, Homo sapiens
accctatgggtctaggacacagt

SEQ ID NO: 2402880 - DNA, 12 bp, Homo sapiens
accctgttgcta

SEQ ID NO: 2402881 - DNA, 15 bp, Homo sapiens
accctgttgctaagc

SEQ ID NO: 2402882 - DNA, 15 bp, Homo sapiens
acccttattgctgtc

SEQ ID NO: 2402883 - DNA, 19 bp, Homo sapiens
acccttcccttgagccctc

SEQ ID NO: 2402884 - DNA, 18 bp, Homo sapiens
acctagctggctctgtga

SEQ ID NO: 2402885 - DNA, 17 bp, Homo sapiens
acctcaccaagctgctg

SEQ ID NO: 2402886 - DNA, 17 bp, Homo sapiens
acctccacctcctgggt

SEQ ID NO: 2402887 - DNA, 17 bp, Homo sapiens
acctctcccctggaact

SEQ ID NO: 2402888 - DNA, 22 bp, Homo sapiens
acctctgtatttgaatcagcct

SEQ ID NO: 2402889 - DNA, 16 bp, Homo sapiens
acctgaagaatcacaa

SEQ ID NO: 2402890 - DNA, 22 bp, Homo sapiens
acctgaagctatcgtaaaatta

SEQ ID NO: 2402891 - DNA, 22 bp, Homo sapiens
acctgagctaaataaagatatt

SEQ ID NO: 2402892 - DNA, 13 bp, Homo sapiens
acctgatgaaaat

SEQ ID NO: 2402893 - DNA, 21 bp, Homo sapiens
acctgatgaaaataaagaatg

SEQ ID NO: 2402894 - DNA, 17 bp, Homo sapiens
acctgctcagccctgca

SEQ ID NO: 2402895 - DNA, 18 bp, Homo sapiens
accttagaccaccaagcc

SEQ ID NO: 2402896 - DNA, 21 bp, Homo sapiens
accttagaccaccaagccttg

SEQ ID NO: 2402897 - DNA, 22 bp, Homo sapiens
aaaaagtgggttttttagttga

SEQ ID NO: 2402898 - DNA, 11 bp, Homo sapiens
aaaaatgtagg

SEQ ID NO: 2402899 - DNA, 18 bp, Homo sapiens
aaaacagggccacataga

SEQ ID NO: 2402900 - DNA, 12 bp, Homo sapiens
aaaagatataag

SEQ ID NO: 2402901 - DNA, 13 bp, Homo sapiens
aaaagatataagt

SEQ ID NO: 2402902 - DNA, 23 bp, Homo sapiens
aaaagatataagtgctgtataaa

SEQ ID NO: 2402903 - DNA, 16 bp, Homo sapiens
aaaagcctgtttaaga

SEQ ID NO: 2402904 - DNA, 22 bp, Homo sapiens
aaaagctccatttttagtgaaa

SEQ ID NO: 2402905 - DNA, 12 bp, Homo sapiens
aaaataaagaat

SEQ ID NO: 2402906 - DNA, 17 bp, Homo sapiens
aaaatcagccaattatg

SEQ ID NO: 2402907 - DNA, 24 bp, Homo sapiens
aaaatcagccaattatgttaaact

SEQ ID NO: 2402908 - DNA, 19 bp, Homo sapiens
aaaatctttctttcttaga

SEQ ID NO: 2402909 - DNA, 20 bp, Homo sapiens
aaaatctttctttcttagaa

SEQ ID NO: 2402910 - DNA, 22 bp, Homo sapiens
aaaatctttctttcttagaaat

SEQ ID NO: 2402911 - DNA, 12 bp, Homo sapiens
aaaatgagaaat

SEQ ID NO: 2402912 - DNA, 21 bp, Homo sapiens
aaaatgtgggattatgggtca

SEQ ID NO: 2402913 - DNA, 17 bp, Homo sapiens
aaaattaaatcaacctt

SEQ ID NO: 2402914 - DNA, 22 bp, Homo sapiens
aaaattaacatgaatatttagt

SEQ ID NO: 2402915 - DNA, 12 bp, Homo sapiens
aaaattaagaaa

SEQ ID NO: 2402916 - DNA, 12 bp, Homo sapiens
aaaattgccata

SEQ ID NO: 2402917 - DNA, 16 bp, Homo sapiens
aaaattgccatattgc

SEQ ID NO: 2402918 - DNA, 19 bp, Homo sapiens
aaaattgccatattgcaca

SEQ ID NO: 2402919 - DNA, 21 bp, Homo sapiens
aaaattgccatattgcacatg

SEQ ID NO: 2402920 - DNA, 15 bp, Homo sapiens
aaaatttttaatctt

SEQ ID NO: 2402921 - DNA, 13 bp, Homo sapiens
aaacaaagaaatt

SEQ ID NO: 2402922 - DNA, 17 bp, Homo sapiens
aaacactcttgaaaaat

SEQ ID NO: 2402923 - DNA, 17 bp, Homo sapiens
aaacagggccacataga

SEQ ID NO: 2402924 - DNA, 22 bp, Homo sapiens
aaacagggctgccttctggcct

SEQ ID NO: 2402925 - DNA, 19 bp, Homo sapiens
aaacatgtttctttgtaat

SEQ ID NO: 2402926 - DNA, 22 bp, Homo sapiens
aaacatgtttctttgtaatgaa

SEQ ID NO: 2402927 - DNA, 12 bp, Homo sapiens
aaacattctatc

SEQ ID NO: 2402928 - DNA, 21 bp, Homo sapiens
aaaccacattggagatgttta

SEQ ID NO: 2402929 - DNA, 11 bp, Homo sapiens
aaacctggaga

SEQ ID NO: 2402930 - DNA, 18 bp, Homo sapiens
aaaccttttatatttagt

SEQ ID NO: 2402931 - DNA, 19 bp, Homo sapiens
aaactagcatatctgcctt

SEQ ID NO: 2402932 - DNA, 20 bp, Homo sapiens
aaactagcatatctgccttt

SEQ ID NO: 2402933 - DNA, 22 bp, Homo sapiens
aaactgagatccttccttttga

SEQ ID NO: 2402934 - DNA, 15 bp, Homo sapiens
aaagaaattatgtgc

SEQ ID NO: 2402935 - DNA, 15 bp, Homo sapiens
aaagatataagtgct

SEQ ID NO: 2402936 - DNA, 17 bp, Homo sapiens
aaagatataagtgctgt

SEQ ID NO: 2402937 - DNA, 18 bp, Homo sapiens
aaagatataagtgctgta

SEQ ID NO: 2402938 - DNA, 20 bp, Homo sapiens
aaagatataagtgctgtata

SEQ ID NO: 2402939 - DNA, 20 bp, Homo sapiens
aaagatatctcatctcttct

SEQ ID NO: 2402940 - DNA, 13 bp, Homo sapiens
aaagatcccaaat

SEQ ID NO: 2402941 - DNA, 15 bp, Homo sapiens
actttattttgtgtt

SEQ ID NO: 2402942 - DNA, 20 bp, Homo sapiens
acttttcttctattgcctct

SEQ ID NO: 2402943 - DNA, 22 bp, Homo sapiens
acttttgctgtaatgttaatat

SEQ ID NO: 2402944 - DNA, 21 bp, Homo sapiens
agaaaacttgtattatgtgtg

SEQ ID NO: 2402945 - DNA, 15 bp, Homo sapiens
agaaagaagatgaat

SEQ ID NO: 2402946 - DNA, 13 bp, Homo sapiens
agaaagcatttga

SEQ ID NO: 2402947 - DNA, 16 bp, Homo sapiens
agaaagcatttgaatg

SEQ ID NO: 2402948 - DNA, 22 bp, Homo sapiens
agaaagtcttatttattcatat

SEQ ID NO: 2402949 - DNA, 20 bp, Homo sapiens
agaaatatcttcacttgtca

SEQ ID NO: 2402950 - DNA, 18 bp, Homo sapiens
agaaatgaaaaaatatat

SEQ ID NO: 2402951 - DNA, 18 bp, Homo sapiens
agaaatggttgtattaga

SEQ ID NO: 2402952 - DNA, 20 bp, Homo sapiens
agaaatggttgtattagatg

SEQ ID NO: 2402953 - DNA, 22 bp, Homo sapiens
agaaatggttgtattagatgtt

SEQ ID NO: 2402954 - DNA, 19 bp, Homo sapiens
agaactagccaaaccagga

SEQ ID NO: 2402955 - DNA, 13 bp, Homo sapiens
agaactctctgga

SEQ ID NO: 2402956 - DNA, 14 bp, Homo sapiens
agaaggtgggagga

SEQ ID NO: 2402957 - DNA, 22 bp, Homo sapiens
agaaggtgggaggatgtgaatt

SEQ ID NO: 2402958 - DNA, 19 bp, Homo sapiens
agaagttcaatataagctt

SEQ ID NO: 2402959 - DNA, 17 bp, Homo sapiens
agacagcccaggatact

SEQ ID NO: 2402960 - DNA, 23 bp, Homo sapiens
agacagcccaggatactggcaca

SEQ ID NO: 2402961 - DNA, 18 bp, Homo sapiens
agacagtatataactaac

SEQ ID NO: 2402962 - DNA, 16 bp, Homo sapiens
agaccaagcttgtcca

SEQ ID NO: 2402963 - DNA, 21 bp, Homo sapiens
agacccttattgctgtcctgg

SEQ ID NO: 2402964 - DNA, 18 bp, Homo sapiens
agacgaaacatttgttct

SEQ ID NO: 2402965 - DNA, 12 bp, Homo sapiens
agactctaagaa

SEQ ID NO: 2402966 - DNA, 12 bp, Homo sapiens
agacttttatga

SEQ ID NO: 2402967 - DNA, 15 bp, Homo sapiens
agagacagcccagga

SEQ ID NO: 2402968 - DNA, 15 bp, Homo sapiens
agagagttgaaccta

SEQ ID NO: 2402969 - DNA, 18 bp, Homo sapiens
agagcaagaccccatctc

SEQ ID NO: 2402970 - DNA, 21 bp, Homo sapiens
agagcacgcctgtactagagc

SEQ ID NO: 2402971 - DNA, 21 bp, Homo sapiens
agagcagtttggtttctagca

SEQ ID NO: 2402972 - DNA, 15 bp, Homo sapiens
agagcatcaggccta

SEQ ID NO: 2402973 - DNA, 14 bp, Homo sapiens
agagccctgaggcc

SEQ ID NO: 2402974 - DNA, 20 bp, Homo sapiens
agagcctcctttctggcttt

SEQ ID NO: 2402975 - DNA, 12 bp, Homo sapiens
agagctcaggat

SEQ ID NO: 2402976 - DNA, 18 bp, Homo sapiens
agaggcacctgtcccaga

SEQ ID NO: 2402977 - DNA, 21 bp, Homo sapiens
agaggcgcatgaatttgtgaa

SEQ ID NO: 2402978 - DNA, 22 bp, Homo sapiens
agaggctgttcccaccaggctg

SEQ ID NO: 2402979 - DNA, 14 bp, Homo sapiens
agagggaatgtgaa

SEQ ID NO: 2402980 - DNA, 15 bp, Homo sapiens
agagggaatgtgaaa

SEQ ID NO: 2402981 - DNA, 22 bp, Homo sapiens
agagtaatccaagcaaatgtga

SEQ ID NO: 2402982 - DNA, 14 bp, Homo sapiens
agagtggctggggc

SEQ ID NO: 2402983 - DNA, 20 bp, Homo sapiens
agagttgatggttgtacata

SEQ ID NO: 2402984 - DNA, 18 bp, Homo sapiens
agagttttggatgcagtg

SEQ ID NO: 2402985 - DNA, 21 bp, Homo sapiens
agagttttggatgcagtgctc

SEQ ID NO: 2402986 - DNA, 17 bp, Homo sapiens
agataaaggttcatgca

SEQ ID NO: 2402987 - DNA, 20 bp, Homo sapiens
agatagataggtcagtgcaa

SEQ ID NO: 2402988 - DNA, 13 bp, Homo sapiens
agatataagtgct

SEQ ID NO: 2402989 - DNA, 17 bp, Homo sapiens
agatataagtgctgtat

SEQ ID NO: 2402990 - DNA, 20 bp, Homo sapiens
agatataagtgctgtataaa

SEQ ID NO: 2402991 - DNA, 15 bp, Homo sapiens
agatattaccagttt

SEQ ID NO: 2402992 - DNA, 23 bp, Homo sapiens
agatatttacatgaattgcattt

SEQ ID NO: 2402993 - DNA, 13 bp, Homo sapiens
agatatttttcat

SEQ ID NO: 2402994 - DNA, 19 bp, Homo sapiens
agatatttttccatttttt

SEQ ID NO: 2402995 - DNA, 18 bp, Homo sapiens
agatcttttattttgcca

SEQ ID NO: 2402996 - DNA, 16 bp, Homo sapiens
agatggggtctgtaaa

SEQ ID NO: 2402997 - DNA, 18 bp, Homo sapiens
agatggggtctgtaaaat

SEQ ID NO: 2402998 - DNA, 11 bp, Homo sapiens
agatggtggat

SEQ ID NO: 2402999 - DNA, 18 bp, Homo sapiens
agatgttctctatcattt

SEQ ID NO: 2403000 - DNA, 20 bp, Homo sapiens
agatgttctctatcatttaa

SEQ ID NO: 2403001 - DNA, 21 bp, Homo sapiens
agatgttctctatcatttaat

SEQ ID NO: 2403002 - DNA, 19 bp, Homo sapiens
agatttgtgtgcatcaggc

SEQ ID NO: 2403003 - DNA, 18 bp, Homo sapiens
agattttgatagcaaagc

SEQ ID NO: 2403004 - DNA, 15 bp, Homo sapiens
agcaagtcagaatag

SEQ ID NO: 2403005 - DNA, 15 bp, Homo sapiens
agcacctacttacat

SEQ ID NO: 2403006 - DNA, 15 bp, Homo sapiens
agcagtttgaaattg

SEQ ID NO: 2403007 - DNA, 16 bp, Homo sapiens
agcatatctgccttta

SEQ ID NO: 2403008 - DNA, 23 bp, Homo sapiens
agcatatctgcctttattgtgtt

SEQ ID NO: 2403009 - DNA, 15 bp, Homo sapiens
agcatgaagacagag

SEQ ID NO: 2403010 - DNA, 12 bp, Homo sapiens
agcattctgtct

SEQ ID NO: 2403011 - DNA, 15 bp, Homo sapiens
agcatttgaatgcat

SEQ ID NO: 2403012 - DNA, 12 bp, Homo sapiens
agccaaaccagg

SEQ ID NO: 2403013 - DNA, 17 bp, Homo sapiens
agccaactatggcctgt

SEQ ID NO: 2403014 - DNA, 20 bp, Homo sapiens
agccacagttcccctatgtg

SEQ ID NO: 2403015 - DNA, 15 bp, Homo sapiens
agccacggtgttctg

SEQ ID NO: 2403016 - DNA, 15 bp, Homo sapiens
agccagaccagcagg

SEQ ID NO: 2403017 - DNA, 18 bp, Homo sapiens
agccaggagctgggcaga

SEQ ID NO: 2403018 - DNA, 14 bp, Homo sapiens
agccaggaggcctg

SEQ ID NO: 2403019 - DNA, 18 bp, Homo sapiens
agccatcaccttagacca

SEQ ID NO: 2403020 - DNA, 14 bp, Homo sapiens
agcccactgtactt

SEQ ID NO: 2403021 - DNA, 23 bp, Homo sapiens
agcccaggatactggcacagagg

SEQ ID NO: 2403022 - DNA, 14 bp, Homo sapiens
agccctgcaccatg

SEQ ID NO: 2403023 - DNA, 17 bp, Homo sapiens
agccctgggaggctctg

SEQ ID NO: 2403024 - DNA, 17 bp, Homo sapiens
agcccttgcattgcaga

SEQ ID NO: 2403025 - DNA, 16 bp, Homo sapiens
agcctaagggatcctg

SEQ ID NO: 2403026 - DNA, 13 bp, Homo sapiens
agcctcctctctc

SEQ ID NO: 2403027 - DNA, 22 bp, Homo sapiens
agcctgagtagaaaggccttta

SEQ ID NO: 2403028 - DNA, 15 bp, Homo sapiens
agcctgcattgagct

SEQ ID NO: 2403029 - DNA, 21 bp, Homo sapiens
agcctgggtgtaaaacctgga

SEQ ID NO: 2403030 - DNA, 15 bp, Homo sapiens
agccttctctgttca

SEQ ID NO: 2403031 - DNA, 21 bp, Homo sapiens
agccttctctgttcatttcct

SEQ ID NO: 2403032 - DNA, 23 bp, Homo sapiens
agccttggggattcttccatctg

SEQ ID NO: 2403033 - DNA, 14 bp, Homo sapiens
agctcaactctctt

SEQ ID NO: 2403034 - DNA, 19 bp, Homo sapiens
agctcactgcaacctccac

SEQ ID NO: 2403035 - DNA, 18 bp, Homo sapiens
agctcaggatgagggaaa

SEQ ID NO: 2403036 - DNA, 21 bp, Homo sapiens
agctctgaagaactctctgga

SEQ ID NO: 2403037 - DNA, 13 bp, Homo sapiens
agctctgcattat

SEQ ID NO: 2403038 - DNA, 12 bp, Homo sapiens
agctcttgtgag

SEQ ID NO: 2403039 - DNA, 16 bp, Homo sapiens
agctcttgtgaggaaa

SEQ ID NO: 2403040 - DNA, 16 bp, Homo sapiens
agctgcccccagagcc

SEQ ID NO: 2403041 - DNA, 17 bp, Homo sapiens
agctgcccccagagcca

SEQ ID NO: 2403042 - DNA, 19 bp, Homo sapiens
agctgcccccagagccaca

SEQ ID NO: 2403043 - DNA, 16 bp, Homo sapiens
agctggacctcaccaa

SEQ ID NO: 2403044 - DNA, 19 bp, Homo sapiens
agctggagtgcagtggcat

SEQ ID NO: 2403045 - DNA, 20 bp, Homo sapiens
agctggctctgtgagggtgc

SEQ ID NO: 2403046 - DNA, 18 bp, Homo sapiens
agctgggcagaaggccaa

SEQ ID NO: 2403047 - DNA, 23 bp, Homo sapiens
agcttgtccaacccgaggcccgc

SEQ ID NO: 2403048 - DNA, 12 bp, Homo sapiens
agctttgttctt

SEQ ID NO: 2403049 - DNA, 15 bp, Homo sapiens
agcttttcccttttt

SEQ ID NO: 2403050 - DNA, 20 bp, Homo sapiens
aggaaagtcattggctttat

SEQ ID NO: 2403051 - DNA, 13 bp, Homo sapiens
aggaacaaacagg

SEQ ID NO: 2403052 - DNA, 22 bp, Homo sapiens
aggaattttatttttttctgaa

SEQ ID NO: 2403053 - DNA, 18 bp, Homo sapiens
aggacacagttcctggga

SEQ ID NO: 2403054 - DNA, 18 bp, Homo sapiens
aggagtttcgttttcaaa

SEQ ID NO: 2403055 - DNA, 19 bp, Homo sapiens
aggagtttcgttttcaaaa

SEQ ID NO: 2403056 - DNA, 15 bp, Homo sapiens
aggataccatataca

SEQ ID NO: 2403057 - DNA, 22 bp, Homo sapiens
aggataccatatacagctcaga

SEQ ID NO: 2403058 - DNA, 18 bp, Homo sapiens
aggatactatattttagg

SEQ ID NO: 2403059 - DNA, 13 bp, Homo sapiens
aggatggcgcagg

SEQ ID NO: 2403060 - DNA, 23 bp, Homo sapiens
aggcacacaccaccacgcctggc

SEQ ID NO: 2403061 - DNA, 20 bp, Homo sapiens
aggcatccttcctcacacca

SEQ ID NO: 2403062 - DNA, 22 bp, Homo sapiens
aggcattaaattttagcaaaga

SEQ ID NO: 2403063 - DNA, 16 bp, Homo sapiens
aggcctagactctgtc

SEQ ID NO: 2403064 - DNA, 17 bp, Homo sapiens
aggcctagactctgtct

SEQ ID NO: 2403065 - DNA, 17 bp, Homo sapiens
aggcctgactgccaagc

SEQ ID NO: 2403066 - DNA, 23 bp, Homo sapiens
aggccttgcggctcctcagggac

SEQ ID NO: 2403067 - DNA, 15 bp, Homo sapiens
aggcctttccctaag

SEQ ID NO: 2403068 - DNA, 21 bp, Homo sapiens
aggcgatcacaacgtgcattg

SEQ ID NO: 2403069 - DNA, 15 bp, Homo sapiens
aggctctggagccca

SEQ ID NO: 2403070 - DNA, 17 bp, Homo sapiens
aggctgctcagggctgg

SEQ ID NO: 2403071 - DNA, 18 bp, Homo sapiens
aggctgggtcgccctgga

SEQ ID NO: 2403072 - DNA, 20 bp, Homo sapiens
aggctgggtcgccctggact

SEQ ID NO: 2403073 - DNA, 21 bp, Homo sapiens
aggctgggtcgccctggactg

SEQ ID NO: 2403074 - DNA, 21 bp, Homo sapiens
aagacaaggaaaaaataacaa

SEQ ID NO: 2403075 - DNA, 12 bp, Homo sapiens
aagagctcagga

SEQ ID NO: 2403076 - DNA, 18 bp, Homo sapiens
aagaggcacctgtcccag

SEQ ID NO: 2403077 - DNA, 17 bp, Homo sapiens
aagatataagtgctgta

SEQ ID NO: 2403078 - DNA, 20 bp, Homo sapiens
aagatataagtgctgtataa

SEQ ID NO: 2403079 - DNA, 15 bp, Homo sapiens
aagatatttttcatg

SEQ ID NO: 2403080 - DNA, 13 bp, Homo sapiens
aagatatttttcc

SEQ ID NO: 2403081 - DNA, 17 bp, Homo sapiens
aagatcttttattttgc

SEQ ID NO: 2403082 - DNA, 19 bp, Homo sapiens
aagatggggtctgtaaaat

SEQ ID NO: 2403083 - DNA, 21 bp, Homo sapiens
aagattgtgtcccattccccc

SEQ ID NO: 2403084 - DNA, 15 bp, Homo sapiens
aagattgttcctgct

SEQ ID NO: 2403085 - DNA, 20 bp, Homo sapiens
aagcaaatgtgaatcatttt

SEQ ID NO: 2403086 - DNA, 15 bp, Homo sapiens
aagcaatcctaggta

SEQ ID NO: 2403087 - DNA, 21 bp, Homo sapiens
aagcacgtggtaaaacacttg

SEQ ID NO: 2403088 - DNA, 23 bp, Homo sapiens
aagcatgcacaaattctgtctct

SEQ ID NO: 2403089 - DNA, 13 bp, Homo sapiens
aagcattctgtct

SEQ ID NO: 2403090 - DNA, 14 bp, Homo sapiens
aagcatttgaatgc

SEQ ID NO: 2403091 - DNA, 17 bp, Homo sapiens
aagcatttgaatgcatt

SEQ ID NO: 2403092 - DNA, 18 bp, Homo sapiens
aagcatttgaatgcattt

SEQ ID NO: 2403093 - DNA, 22 bp, Homo sapiens
aagccagctgcccccagagcca

SEQ ID NO: 2403094 - DNA, 22 bp, Homo sapiens
aagccatgggtagcctgggtgt

SEQ ID NO: 2403095 - DNA, 14 bp, Homo sapiens
aagcccctgggccc

SEQ ID NO: 2403096 - DNA, 15 bp, Homo sapiens
aagcctgtttaagag

SEQ ID NO: 2403097 - DNA, 23 bp, Homo sapiens
aagccttgattggtgttgccagt

SEQ ID NO: 2403098 - DNA, 15 bp, Homo sapiens
aagctctgaagaact

SEQ ID NO: 2403099 - DNA, 18 bp, Homo sapiens
aagctgtgtggcagtctg

SEQ ID NO: 2403100 - DNA, 16 bp, Homo sapiens
aaggaaaaaataacaa

SEQ ID NO: 2403101 - DNA, 19 bp, Homo sapiens
aaggaaaaaataacaatga

SEQ ID NO: 2403102 - DNA, 11 bp, Homo sapiens
aaggcctttaa

SEQ ID NO: 2403103 - DNA, 21 bp, Homo sapiens
aaggctttgccctgctgccct

SEQ ID NO: 2403104 - DNA, 17 bp, Homo sapiens
aagggactgagaaattt

SEQ ID NO: 2403105 - DNA, 13 bp, Homo sapiens
aagggatcctgcc

SEQ ID NO: 2403106 - DNA, 15 bp, Homo sapiens
aagggattttcagcc

SEQ ID NO: 2403107 - DNA, 21 bp, Homo sapiens
aagggattttcagccctcaga

SEQ ID NO: 2403108 - DNA, 23 bp, Homo sapiens
aagggattttcagccctcagaat

SEQ ID NO: 2403109 - DNA, 19 bp, Homo sapiens
aaggtgaaacattttctcc

SEQ ID NO: 2403110 - DNA, 20 bp, Homo sapiens
aaggtgaggagcttgaaacc

SEQ ID NO: 2403111 - DNA, 22 bp, Homo sapiens
aaggtgggaggatgtgaattgt

SEQ ID NO: 2403112 - DNA, 14 bp, Homo sapiens
aagtacttttggca

SEQ ID NO: 2403113 - DNA, 17 bp, Homo sapiens
aagtatttaattagtgc

SEQ ID NO: 2403114 - DNA, 20 bp, Homo sapiens
aagtatttaattagtgctaa

SEQ ID NO: 2403115 - DNA, 18 bp, Homo sapiens
aagtcaatgttttcagtt

SEQ ID NO: 2403116 - DNA, 18 bp, Homo sapiens
aagtcagctcttctccat

SEQ ID NO: 2403117 - DNA, 23 bp, Homo sapiens
aagtccaggcttttttatcatgt

SEQ ID NO: 2403118 - DNA, 14 bp, Homo sapiens
aagtctccaaagtc

SEQ ID NO: 2403119 - DNA, 22 bp, Homo sapiens
aagtctgtgagattcattcatg

SEQ ID NO: 2403120 - DNA, 16 bp, Homo sapiens
aagtctttcacattta

SEQ ID NO: 2403121 - DNA, 18 bp, Homo sapiens
aagtgattgtatgaattt

SEQ ID NO: 2403122 - DNA, 16 bp, Homo sapiens
aagtgctgtataaaat

SEQ ID NO: 2403123 - DNA, 22 bp, Homo sapiens
aagtgctgtataaaatcagcca

SEQ ID NO: 2403124 - DNA, 23 bp, Homo sapiens
aagtgctgtataaaatcagccaa

SEQ ID NO: 2403125 - DNA, 13 bp, Homo sapiens
aagtgtgaactgg

SEQ ID NO: 2403126 - DNA, 21 bp, Homo sapiens
aagtgtgaactggaccctgtt

SEQ ID NO: 2403127 - DNA, 21 bp, Homo sapiens
ctgctggggaagacagtggcc

SEQ ID NO: 2403128 - DNA, 20 bp, Homo sapiens
ctggaagcccctgggcccag

SEQ ID NO: 2403129 - DNA, 14 bp, Homo sapiens
ctggaccctgttgc

SEQ ID NO: 2403130 - DNA, 16 bp, Homo sapiens
ctggaccctgttgcta

SEQ ID NO: 2403131 - DNA, 17 bp, Homo sapiens
ctggaccctgttgctaa

SEQ ID NO: 2403132 - DNA, 18 bp, Homo sapiens
ctggaccctgttgctaag

SEQ ID NO: 2403133 - DNA, 13 bp, Homo sapiens
ctggacctcacca

SEQ ID NO: 2403134 - DNA, 22 bp, Homo sapiens
ctggactgtgtgctcaggagcc

SEQ ID NO: 2403135 - DNA, 15 bp, Homo sapiens
ctggagcccactgta

SEQ ID NO: 2403136 - DNA, 20 bp, Homo sapiens
ctgggaaagggattttcagc

SEQ ID NO: 2403137 - DNA, 23 bp, Homo sapiens
ctgggactataggcatgcgccac

SEQ ID NO: 2403138 - DNA, 16 bp, Homo sapiens
ctgggaggctctggag

SEQ ID NO: 2403139 - DNA, 21 bp, Homo sapiens
ctgggaggctctggagcccac

SEQ ID NO: 2403140 - DNA, 22 bp, Homo sapiens
ctgggaggctctggagcccact

SEQ ID NO: 2403141 - DNA, 21 bp, Homo sapiens
ctgggattacaggcgtgagcc

SEQ ID NO: 2403142 - DNA, 23 bp, Homo sapiens
ctgggattacaggtgtgagccac

SEQ ID NO: 2403143 - DNA, 10 bp, Homo sapiens
ctgggcccct

SEQ ID NO: 2403144 - DNA, 16 bp, Homo sapiens
ctgggcccctgcctct

SEQ ID NO: 2403145 - DNA, 17 bp, Homo sapiens
ctgggcccctgcctctc

SEQ ID NO: 2403146 - DNA, 14 bp, Homo sapiens
ctggggaagacagt

SEQ ID NO: 2403147 - DNA, 17 bp, Homo sapiens
ctgggtcgccctggact

SEQ ID NO: 2403148 - DNA, 19 bp, Homo sapiens
ctgggtgtaaaacctggag

SEQ ID NO: 2403149 - DNA, 21 bp, Homo sapiens
ctgggtgtaaaacctggagat

SEQ ID NO: 2403150 - DNA, 14 bp, Homo sapiens
ctggtgagccaagc

SEQ ID NO: 2403151 - DNA, 15 bp, Homo sapiens
ctgtaaaatgtggga

SEQ ID NO: 2403152 - DNA, 20 bp, Homo sapiens
ctgtaatcccagcatgctga

SEQ ID NO: 2403153 - DNA, 15 bp, Homo sapiens
ctgtaatgttaatat

SEQ ID NO: 2403154 - DNA, 18 bp, Homo sapiens
ctgtaatgttaatattga

SEQ ID NO: 2403155 - DNA, 19 bp, Homo sapiens
ctgtacttgctcttgatgc

SEQ ID NO: 2403156 - DNA, 22 bp, Homo sapiens
ctgtacttgctcttgatgcctg

SEQ ID NO: 2403157 - DNA, 17 bp, Homo sapiens
ctgtagaaatggttgta

SEQ ID NO: 2403158 - DNA, 22 bp, Homo sapiens
ctgtcacccaggttggagtgca

SEQ ID NO: 2403159 - DNA, 23 bp, Homo sapiens
ctgtcggagccctgtctcctctc

SEQ ID NO: 2403160 - DNA, 20 bp, Homo sapiens
ctgtctcctctctctgtaat

SEQ ID NO: 2403161 - DNA, 22 bp, Homo sapiens
ctgtgaagtgagaccttccttt

SEQ ID NO: 2403162 - DNA, 14 bp, Homo sapiens
ctgtggatcaaatc

SEQ ID NO: 2403163 - DNA, 15 bp, Homo sapiens
ctgtgggtagtatga

SEQ ID NO: 2403164 - DNA, 19 bp, Homo sapiens
ctgtgtgctcaggagccct

SEQ ID NO: 2403165 - DNA, 23 bp, Homo sapiens
ctgtgtgctcaggagccctggga

SEQ ID NO: 2403166 - DNA, 16 bp, Homo sapiens
ctgtgtggagagggaa

SEQ ID NO: 2403167 - DNA, 22 bp, Homo sapiens
ctgtgtggagagggaatgtgaa

SEQ ID NO: 2403168 - DNA, 15 bp, Homo sapiens
ctgttcattcctcca

SEQ ID NO: 2403169 - DNA, 22 bp, Homo sapiens
ctgttcattcctccaggtattc

SEQ ID NO: 2403170 - DNA, 21 bp, Homo sapiens
ctgttgccaggctggagtgca

SEQ ID NO: 2403171 - DNA, 23 bp, Homo sapiens
ctgttgctaagccccagcaagca

SEQ ID NO: 2403172 - DNA, 23 bp, Homo sapiens
ctgttggggtgggtataaaagat

SEQ ID NO: 2403173 - DNA, 17 bp, Homo sapiens
ctgtttttcagggaggt

SEQ ID NO: 2403174 - DNA, 17 bp, Homo sapiens
cttaatacacacagtta

SEQ ID NO: 2403175 - DNA, 17 bp, Homo sapiens
cttaatgaagtttgaat

SEQ ID NO: 2403176 - DNA, 18 bp, Homo sapiens
cttacatgcattactgca

SEQ ID NO: 2403177 - DNA, 19 bp, Homo sapiens
cttacatgcattactgcat

SEQ ID NO: 2403178 - DNA, 13 bp, Homo sapiens
cttataatttaaa

SEQ ID NO: 2403179 - DNA, 14 bp, Homo sapiens
cttataatttaaaa

SEQ ID NO: 2403180 - DNA, 23 bp, Homo sapiens
cttatctaatcatgaaactccct

SEQ ID NO: 2403181 - DNA, 14 bp, Homo sapiens
cttattatttttga

SEQ ID NO: 2403182 - DNA, 13 bp, Homo sapiens
cttattgcctcac

SEQ ID NO: 2403183 - DNA, 14 bp, Homo sapiens
cttattgcctcact

SEQ ID NO: 2403184 - DNA, 19 bp, Homo sapiens
cttattgcctcacttcagg

SEQ ID NO: 2403185 - DNA, 15 bp, Homo sapiens
cttcactgtaaaata

SEQ ID NO: 2403186 - DNA, 16 bp, Homo sapiens
cttcagcactttagaa

SEQ ID NO: 2403187 - DNA, 19 bp, Homo sapiens
cttcagccaggagctgggc

SEQ ID NO: 2403188 - DNA, 16 bp, Homo sapiens
cttcaggacactcact

SEQ ID NO: 2403189 - DNA, 19 bp, Homo sapiens
cttccacgtactgcagcct

SEQ ID NO: 2403190 - DNA, 22 bp, Homo sapiens
cttccggggaaggattttgcag

SEQ ID NO: 2403191 - DNA, 15 bp, Homo sapiens
cttccttcatttcct

SEQ ID NO: 2403192 - DNA, 20 bp, Homo sapiens
cttccttttacttttcttct

SEQ ID NO: 2403193 - DNA, 20 bp, Homo sapiens
cttctattctagcctgcatt

SEQ ID NO: 2403194 - DNA, 24 bp, Homo sapiens
cttctattgcctctgagagcatca

SEQ ID NO: 2403195 - DNA, 13 bp, Homo sapiens
cttctcacattta

SEQ ID NO: 2403196 - DNA, 21 bp, Homo sapiens
cttcttacaataattctatga

SEQ ID NO: 2403197 - DNA, 18 bp, Homo sapiens
cttcttggccatgggagg

SEQ ID NO: 2403198 - DNA, 13 bp, Homo sapiens
cttcttttgtgaa

SEQ ID NO: 2403199 - DNA, 12 bp, Homo sapiens
cttgaaaaatgc

SEQ ID NO: 2403200 - DNA, 16 bp, Homo sapiens
cttgagtgctcagtag

SEQ ID NO: 2403201 - DNA, 19 bp, Homo sapiens
cttgagtttaaattgtaat

SEQ ID NO: 2403202 - DNA, 16 bp, Homo sapiens
cttgataaagggccaa

SEQ ID NO: 2403203 - DNA, 12 bp, Homo sapiens
cttgatgcctgg

SEQ ID NO: 2403204 - DNA, 13 bp, Homo sapiens
cttgatgtaaaat

SEQ ID NO: 2403205 - DNA, 23 bp, Homo sapiens
cttgatgtaaaatcttgtcatgt

SEQ ID NO: 2403206 - DNA, 19 bp, Homo sapiens
cttgattggtgttgccagt

SEQ ID NO: 2403207 - DNA, 19 bp, Homo sapiens
cttgattttagccttctct

SEQ ID NO: 2403208 - DNA, 20 bp, Homo sapiens
cttgattttagccttctctg

SEQ ID NO: 2403209 - DNA, 17 bp, Homo sapiens
cttgcccgctcaggctg

SEQ ID NO: 2403210 - DNA, 13 bp, Homo sapiens
cttgcctgcaggc

SEQ ID NO: 2403211 - DNA, 17 bp, Homo sapiens
cttgctcttgatgcctg

SEQ ID NO: 2403212 - DNA, 15 bp, Homo sapiens
cttggaaaggaccag

SEQ ID NO: 2403213 - DNA, 19 bp, Homo sapiens
cttggtgattccgcagtga

SEQ ID NO: 2403214 - DNA, 14 bp, Homo sapiens
cttgtaagaccctt

SEQ ID NO: 2403215 - DNA, 18 bp, Homo sapiens
cttgtattatgtgtgttt

SEQ ID NO: 2403216 - DNA, 12 bp, Homo sapiens
cttgtcatgtgt

SEQ ID NO: 2403217 - DNA, 14 bp, Homo sapiens
cttgtcatgtgtat

SEQ ID NO: 2403218 - DNA, 17 bp, Homo sapiens
cttgtcatgtgtataaa

SEQ ID NO: 2403219 - DNA, 19 bp, Homo sapiens
cttgtctcaatgctcataa

SEQ ID NO: 2403220 - DNA, 13 bp, Homo sapiens
cttgtttcatatt

SEQ ID NO: 2403221 - DNA, 13 bp, Homo sapiens
cttgttttggatg

SEQ ID NO: 2403222 - DNA, 18 bp, Homo sapiens
ctttaaaatttttttaga

SEQ ID NO: 2403223 - DNA, 23 bp, Homo sapiens
ctttaaaatttttttagaaagca

SEQ ID NO: 2403224 - DNA, 20 bp, Homo sapiens
ctttacacaatagaattata

SEQ ID NO: 2403225 - DNA, 23 bp, Homo sapiens
ctttaggcattaaattttagcaa

SEQ ID NO: 2403226 - DNA, 18 bp, Homo sapiens
ctttatcttgaataatgt

SEQ ID NO: 2403227 - DNA, 23 bp, Homo sapiens
ctttattgtgtttgtcattagcc

SEQ ID NO: 2403228 - DNA, 15 bp, Homo sapiens
ctttctttcttagaa

SEQ ID NO: 2403229 - DNA, 13 bp, Homo sapiens
ctttctttcttta

SEQ ID NO: 2403230 - DNA, 18 bp, Homo sapiens
ctttgaatcctctctctg

SEQ ID NO: 2403231 - DNA, 23 bp, Homo sapiens
ctttgaatcctctctctgtgtta

SEQ ID NO: 2403232 - DNA, 19 bp, Homo sapiens
ctttgacaaaggtaaatca

SEQ ID NO: 2403233 - DNA, 22 bp, Homo sapiens
ctttgacaattgggagctgcca

SEQ ID NO: 2403234 - DNA, 22 bp, Homo sapiens
ctttgcataacgtataaaagcc

SEQ ID NO: 2403235 - DNA, 13 bp, Homo sapiens
ctttgctgaccct

SEQ ID NO: 2403236 - DNA, 14 bp, Homo sapiens
ctttggcagagttc

SEQ ID NO: 2403237 - DNA, 18 bp, Homo sapiens
ctttgggaatatttgaat

SEQ ID NO: 2403238 - DNA, 14 bp, Homo sapiens
ctttgtgcattctg

SEQ ID NO: 2403239 - DNA, 20 bp, Homo sapiens
cttttacgtccatctcttgt

SEQ ID NO: 2403240 - DNA, 15 bp, Homo sapiens
cttttgtctctgcaa

SEQ ID NO: 2403241 - DNA, 22 bp, Homo sapiens
ctttttaatttctgcaaatgta

SEQ ID NO: 2403242 - DNA, 20 bp, Homo sapiens
ctttttaccaagtttcaggt

SEQ ID NO: 2403243 - DNA, 19 bp, Homo sapiens
ctttttgggagagacttgt

SEQ ID NO: 2403244 - DNA, 19 bp, Homo sapiens
cttttttatcatgtgaaat

SEQ ID NO: 2403245 - DNA, 14 bp, Homo sapiens
cttttttctaaagt

SEQ ID NO: 2403246 - DNA, 15 bp, Homo sapiens
gcgcgatctcagctc

SEQ ID NO: 2403247 - DNA, 16 bp, Homo sapiens
gcgcgatctcagctca

SEQ ID NO: 2403248 - DNA, 13 bp, Homo sapiens
gcggcatcaggct

SEQ ID NO: 2403249 - DNA, 14 bp, Homo sapiens
gcggctcctcaggg

SEQ ID NO: 2403250 - DNA, 22 bp, Homo sapiens
gcgtcctgtcggagccctgtct

SEQ ID NO: 2403251 - DNA, 12 bp, Homo sapiens
gcgtgatctcag

SEQ ID NO: 2403252 - DNA, 15 bp, Homo sapiens
gctaaagcccagaga

SEQ ID NO: 2403253 - DNA, 17 bp, Homo sapiens
gctaagccccagcaagc

SEQ ID NO: 2403254 - DNA, 13 bp, Homo sapiens
gctaagtgtgaac

SEQ ID NO: 2403255 - DNA, 18 bp, Homo sapiens
gctaattttgaaaaactg

SEQ ID NO: 2403256 - DNA, 22 bp, Homo sapiens
gctacccgcagagttctcagaa

SEQ ID NO: 2403257 - DNA, 20 bp, Homo sapiens
gctacctgctcagccctgca

SEQ ID NO: 2403258 - DNA, 19 bp, Homo sapiens
gctactctagtattccaga

SEQ ID NO: 2403259 - DNA, 18 bp, Homo sapiens
gctactgtaaggcaatca

SEQ ID NO: 2403260 - DNA, 19 bp, Homo sapiens
gctactgtaaggcaatcat

SEQ ID NO: 2403261 - DNA, 15 bp, Homo sapiens
gctatcgtaaaatta

SEQ ID NO: 2403262 - DNA, 16 bp, Homo sapiens
gctatcgtaaaattaa

SEQ ID NO: 2403263 - DNA, 19 bp, Homo sapiens
gctatgttttgacattttt

SEQ ID NO: 2403264 - DNA, 14 bp, Homo sapiens
gctcaggagccctg

SEQ ID NO: 2403265 - DNA, 23 bp, Homo sapiens
gctcaggagccctgggaggctct

SEQ ID NO: 2403266 - DNA, 19 bp, Homo sapiens
gctccaccttgcagctctc

SEQ ID NO: 2403267 - DNA, 20 bp, Homo sapiens
gctccagctgctctgtcttc

SEQ ID NO: 2403268 - DNA, 21 bp, Homo sapiens
gctccagctgctctgtcttct

SEQ ID NO: 2403269 - DNA, 18 bp, Homo sapiens
gctcctcagggactcagg

SEQ ID NO: 2403270 - DNA, 16 bp, Homo sapiens
gctcgctgttgctgaa

SEQ ID NO: 2403271 - DNA, 22 bp, Homo sapiens
gctctgtgagggtgctgactgg

SEQ ID NO: 2403272 - DNA, 16 bp, Homo sapiens
gctcttgatgcctggc

SEQ ID NO: 2403273 - DNA, 17 bp, Homo sapiens
gctcttgatgcctggcg

SEQ ID NO: 2403274 - DNA, 19 bp, Homo sapiens
gctcttgatgcctggcggg

SEQ ID NO: 2403275 - DNA, 16 bp, Homo sapiens
gctcttgtgaggaaag

SEQ ID NO: 2403276 - DNA, 17 bp, Homo sapiens
gctcttgtgaggaaagt

SEQ ID NO: 2403277 - DNA, 11 bp, Homo sapiens
gctgaaaatat

SEQ ID NO: 2403278 - DNA, 19 bp, Homo sapiens
gctgaataggcgatcacaa

SEQ ID NO: 2403279 - DNA, 17 bp, Homo sapiens
gctgacatgaagctgtt

SEQ ID NO: 2403280 - DNA, 21 bp, Homo sapiens
gctgcccccagagccacagtt

SEQ ID NO: 2403281 - DNA, 18 bp, Homo sapiens
gctgctggggaagacagt

SEQ ID NO: 2403282 - DNA, 17 bp, Homo sapiens
gctggacctcaccaagc

SEQ ID NO: 2403283 - DNA, 15 bp, Homo sapiens
gctggagtgcagtgg

SEQ ID NO: 2403284 - DNA, 19 bp, Homo sapiens
gctggctctgtgagggtgc

SEQ ID NO: 2403285 - DNA, 13 bp, Homo sapiens
gctgggcagaagg

SEQ ID NO: 2403286 - DNA, 13 bp, Homo sapiens
gctgggcccctgc

SEQ ID NO: 2403287 - DNA, 14 bp, Homo sapiens
gctgggcccctgcc

SEQ ID NO: 2403288 - DNA, 21 bp, Homo sapiens
gctgggcccctgcctctctgc

SEQ ID NO: 2403289 - DNA, 15 bp, Homo sapiens
gctggggaagacagt

SEQ ID NO: 2403290 - DNA, 21 bp, Homo sapiens
gctggggaagacagtggcccc

SEQ ID NO: 2403291 - DNA, 21 bp, Homo sapiens
gctggggcatggaaggcaaga

SEQ ID NO: 2403292 - DNA, 19 bp, Homo sapiens
gctgtaatgttaatattga

SEQ ID NO: 2403293 - DNA, 16 bp, Homo sapiens
gctgtacactgcacga

SEQ ID NO: 2403294 - DNA, 14 bp, Homo sapiens
gctgtataaaatca

SEQ ID NO: 2403295 - DNA, 15 bp, Homo sapiens
gctgtcctggagggg

SEQ ID NO: 2403296 - DNA, 16 bp, Homo sapiens
gctgtcctggaggggc

SEQ ID NO: 2403297 - DNA, 23 bp, Homo sapiens
gctgtcctggaggggctggggac

SEQ ID NO: 2403298 - DNA, 16 bp, Homo sapiens
gctgtgtggcagtctg

SEQ ID NO: 2403299 - DNA, 12 bp, Homo sapiens
gctgttgctgaa

SEQ ID NO: 2403300 - DNA, 17 bp, Homo sapiens
gcttatttcctcatttt

SEQ ID NO: 2403301 - DNA, 15 bp, Homo sapiens
gcttcagccaggagc

SEQ ID NO: 2403302 - DNA, 14 bp, Homo sapiens
gcttcatagagact

SEQ ID NO: 2403303 - DNA, 21 bp, Homo sapiens
gcttccacgtactgcagcctc

SEQ ID NO: 2403304 - DNA, 23 bp, Homo sapiens
gcttctttctttgggaatatttg

SEQ ID NO: 2403305 - DNA, 19 bp, Homo sapiens
gcttgaactaggctgagca

SEQ ID NO: 2403306 - DNA, 21 bp, Homo sapiens
gcttgtccaacccgaggcccg

SEQ ID NO: 2403307 - DNA, 14 bp, Homo sapiens
ggaacaaacagggc

SEQ ID NO: 2403308 - DNA, 13 bp, Homo sapiens
ggaagcccctggg

SEQ ID NO: 2403309 - DNA, 17 bp, Homo sapiens
ggaatgagctgaaggtg

SEQ ID NO: 2403310 - DNA, 14 bp, Homo sapiens
ggacacagttcctg

SEQ ID NO: 2403311 - DNA, 17 bp, Homo sapiens
ggacacagttcctggga

SEQ ID NO: 2403312 - DNA, 13 bp, Homo sapiens
ggaccctgttgct

SEQ ID NO: 2403313 - DNA, 17 bp, Homo sapiens
ggacgcccaggacccca

SEQ ID NO: 2403314 - DNA, 22 bp, Homo sapiens
ggactgtgtgctcaggagccct

SEQ ID NO: 2403315 - DNA, 12 bp, Homo sapiens
ggacttgtgtct

SEQ ID NO: 2403316 - DNA, 14 bp, Homo sapiens
ggagattcagactg

SEQ ID NO: 2403317 - DNA, 12 bp, Homo sapiens
ggagccagctct

SEQ ID NO: 2403318 - DNA, 13 bp, Homo sapiens
ggagccagggctg

SEQ ID NO: 2403319 - DNA, 12 bp, Homo sapiens
ggagccctggga

SEQ ID NO: 2403320 - DNA, 16 bp, Homo sapiens
ggagccctgggaggct

SEQ ID NO: 2403321 - DNA, 19 bp, Homo sapiens
ggagccctgggaggctctg

SEQ ID NO: 2403322 - DNA, 22 bp, Homo sapiens
ggagccttcccaagttgtgctt

SEQ ID NO: 2403323 - DNA, 19 bp, Homo sapiens
ggagctgggcagaaggcca

SEQ ID NO: 2403324 - DNA, 15 bp, Homo sapiens
ggatactggcacaga

SEQ ID NO: 2403325 - DNA, 20 bp, Homo sapiens
ggatgagggaaaagaaaaag

SEQ ID NO: 2403326 - DNA, 18 bp, Homo sapiens
ggatgatgactatggaaa

SEQ ID NO: 2403327 - DNA, 12 bp, Homo sapiens
ggattatattat

SEQ ID NO: 2403328 - DNA, 20 bp, Homo sapiens
ggattgatcggagcctcctc

SEQ ID NO: 2403329 - DNA, 14 bp, Homo sapiens
ggatttatttttcc

SEQ ID NO: 2403330 - DNA, 12 bp, Homo sapiens
ggattttcagcc

SEQ ID NO: 2403331 - DNA, 14 bp, Homo sapiens
ggcacacaccacca

SEQ ID NO: 2403332 - DNA, 16 bp, Homo sapiens
ggcagaaggccaagag

SEQ ID NO: 2403333 - DNA, 21 bp, Homo sapiens
ggcagagttctataatgtaaa

SEQ ID NO: 2403334 - DNA, 14 bp, Homo sapiens
ggcagccagaccag

SEQ ID NO: 2403335 - DNA, 15 bp, Homo sapiens
ggcaggaacaaacag

SEQ ID NO: 2403336 - DNA, 21 bp, Homo sapiens
ggcagtgtagggagttgtggg

SEQ ID NO: 2403337 - DNA, 17 bp, Homo sapiens
ggcatcatctcagctca

SEQ ID NO: 2403338 - DNA, 18 bp, Homo sapiens
ggcattttactgtacaga

SEQ ID NO: 2403339 - DNA, 13 bp, Homo sapiens
ggccaagaggctg

SEQ ID NO: 2403340 - DNA, 15 bp, Homo sapiens
ggccatgggaggcct

SEQ ID NO: 2403341 - DNA, 17 bp, Homo sapiens
ggcccctgcctctctgc

SEQ ID NO: 2403342 - DNA, 18 bp, Homo sapiens
ggcccctgcctctctgca

SEQ ID NO: 2403343 - DNA, 14 bp, Homo sapiens
ggcctagaggcctg

SEQ ID NO: 2403344 - DNA, 16 bp, Homo sapiens
ggcctatctaaactgg

SEQ ID NO: 2403345 - DNA, 20 bp, Homo sapiens
ggcctgactgccaagccatg

SEQ ID NO: 2403346 - DNA, 14 bp, Homo sapiens
ggcctttaaaattt

SEQ ID NO: 2403347 - DNA, 22 bp, Homo sapiens
ggcctttaaaatttttttagaa

SEQ ID NO: 2403348 - DNA, 15 bp, Homo sapiens
ggcctttccctaagc

SEQ ID NO: 2403349 - DNA, 23 bp, Homo sapiens
ggcgtgatctcagctcactgcaa

SEQ ID NO: 2403350 - DNA, 13 bp, Homo sapiens
ggctcaaaacagg

SEQ ID NO: 2403351 - DNA, 17 bp, Homo sapiens
ggctctggagcccactg

SEQ ID NO: 2403352 - DNA, 19 bp, Homo sapiens
ggctctggagcccactgta

SEQ ID NO: 2403353 - DNA, 22 bp, Homo sapiens
ggctgacatgaagctgttgtgt

SEQ ID NO: 2403354 - DNA, 15 bp, Homo sapiens
ggctgatggagtaaa

SEQ ID NO: 2403355 - DNA, 16 bp, Homo sapiens
ggctgccttctggcct

SEQ ID NO: 2403356 - DNA, 20 bp, Homo sapiens
ggctggagtgcagtggcgcg

SEQ ID NO: 2403357 - DNA, 14 bp, Homo sapiens
ggctgtgggcaagc

SEQ ID NO: 2403358 - DNA, 20 bp, Homo sapiens
ggctttatcctctttagagt

SEQ ID NO: 2403359 - DNA, 12 bp, Homo sapiens
gggaagacagtg

SEQ ID NO: 2403360 - DNA, 18 bp, Homo sapiens
gggaagagacagcccagg

SEQ ID NO: 2403361 - DNA, 19 bp, Homo sapiens
gggaagagggttaggaggg

SEQ ID NO: 2403362 - DNA, 14 bp, Homo sapiens
gggaatatttgaat

SEQ ID NO: 2403363 - DNA, 11 bp, Homo sapiens
gggaatgtgaa

SEQ ID NO: 2403364 - DNA, 18 bp, Homo sapiens
gggattatgggtcacagg

SEQ ID NO: 2403365 - DNA, 21 bp, Homo sapiens
gggcaattaattccttcagca

SEQ ID NO: 2403366 - DNA, 13 bp, Homo sapiens
gggccaggctggg

SEQ ID NO: 2403367 - DNA, 14 bp, Homo sapiens
gggccaggctgggt

SEQ ID NO: 2403368 - DNA, 22 bp, Homo sapiens
gggcccctgcctctctgcaggt

SEQ ID NO: 2403369 - DNA, 12 bp, Homo sapiens
gggcccggacgc

SEQ ID NO: 2403370 - DNA, 17 bp, Homo sapiens
ggggaagacagtggccc

SEQ ID NO: 2403371 - DNA, 19 bp, Homo sapiens
ggggacacatgtatttggt

SEQ ID NO: 2403372 - DNA, 22 bp, Homo sapiens
ggggagtaaagaattattttgt

SEQ ID NO: 2403373 - DNA, 13 bp, Homo sapiens
ggggccaggctgg

SEQ ID NO: 2403374 - DNA, 16 bp, Homo sapiens
ggggccaggctgggtc

SEQ ID NO: 2403375 - DNA, 15 bp, Homo sapiens
ggggtgggtataaaa

SEQ ID NO: 2403376 - DNA, 12 bp, Homo sapiens
gggtcacaggaa

SEQ ID NO: 2403377 - DNA, 15 bp, Homo sapiens
agtagaaaggccttt

SEQ ID NO: 2403378 - DNA, 16 bp, Homo sapiens
agtagaaaggccttta

SEQ ID NO: 2403379 - DNA, 18 bp, Homo sapiens
agtagaaaggcctttaaa

SEQ ID NO: 2403380 - DNA, 22 bp, Homo sapiens
agtagagacgaggtttcactgt

SEQ ID NO: 2403381 - DNA, 13 bp, Homo sapiens
agtagtcagactg

SEQ ID NO: 2403382 - DNA, 23 bp, Homo sapiens
agtatgcttgaaaagataaatta

SEQ ID NO: 2403383 - DNA, 20 bp, Homo sapiens
agtatgcttggactgaaggg

SEQ ID NO: 2403384 - DNA, 14 bp, Homo sapiens
agtatttaattagt

SEQ ID NO: 2403385 - DNA, 18 bp, Homo sapiens
agtcattggctttatcct

SEQ ID NO: 2403386 - DNA, 22 bp, Homo sapiens
agtcattggctttatcctcttt

SEQ ID NO: 2403387 - DNA, 18 bp, Homo sapiens
agtcgtgagctcttgtga

SEQ ID NO: 2403388 - DNA, 18 bp, Homo sapiens
agtctatcaatcaactta

SEQ ID NO: 2403389 - DNA, 23 bp, Homo sapiens
agtctcacatgattccagccatc

SEQ ID NO: 2403390 - DNA, 22 bp, Homo sapiens
agtcttaatatatatatccaga

SEQ ID NO: 2403391 - DNA, 18 bp, Homo sapiens
agtcttactctgttgcca

SEQ ID NO: 2403392 - DNA, 15 bp, Homo sapiens
agtgaaagaaaataa

SEQ ID NO: 2403393 - DNA, 21 bp, Homo sapiens
agtgagagagtggctggggca

SEQ ID NO: 2403394 - DNA, 21 bp, Homo sapiens
agtgagcttggaaaggaccag

SEQ ID NO: 2403395 - DNA, 17 bp, Homo sapiens
agtgatctgcccgcctc

SEQ ID NO: 2403396 - DNA, 16 bp, Homo sapiens
agtgattgtatgaatt

SEQ ID NO: 2403397 - DNA, 23 bp, Homo sapiens
agtgcagtggcgcgatctcagct

SEQ ID NO: 2403398 - DNA, 23 bp, Homo sapiens
agtgcagtggcgtgatctcagct

SEQ ID NO: 2403399 - DNA, 22 bp, Homo sapiens
agtgcatttatgagctcttcat

SEQ ID NO: 2403400 - DNA, 13 bp, Homo sapiens
agtgctaagtgtg

SEQ ID NO: 2403401 - DNA, 16 bp, Homo sapiens
agtgctaagtgtgaac

SEQ ID NO: 2403402 - DNA, 19 bp, Homo sapiens
agtgctaagtgtgaactgg

SEQ ID NO: 2403403 - DNA, 18 bp, Homo sapiens
agtgctaattttgaaaaa

SEQ ID NO: 2403404 - DNA, 16 bp, Homo sapiens
agtgctcgctgttgct

SEQ ID NO: 2403405 - DNA, 19 bp, Homo sapiens
agtgctcgctgttgctgaa

SEQ ID NO: 2403406 - DNA, 22 bp, Homo sapiens
agtgctcgctgttgctgaatag

SEQ ID NO: 2403407 - DNA, 23 bp, Homo sapiens
agtgctcgctgttgctgaatagg

SEQ ID NO: 2403408 - DNA, 20 bp, Homo sapiens
agtgctggcattacaggtgt

SEQ ID NO: 2403409 - DNA, 19 bp, Homo sapiens
agtgctgtataaaatcagc

SEQ ID NO: 2403410 - DNA, 20 bp, Homo sapiens
agtggcgcgatctcagctca

SEQ ID NO: 2403411 - DNA, 13 bp, Homo sapiens
agtggctggggca

SEQ ID NO: 2403412 - DNA, 17 bp, Homo sapiens
agtggctttaatgaata

SEQ ID NO: 2403413 - DNA, 15 bp, Homo sapiens
agtgggttttttagt

SEQ ID NO: 2403414 - DNA, 20 bp, Homo sapiens
agttacactggatgaaaatg

SEQ ID NO: 2403415 - DNA, 18 bp, Homo sapiens
agttcccctatgtggaag

SEQ ID NO: 2403416 - DNA, 19 bp, Homo sapiens
agttcggtgagctacaaat

SEQ ID NO: 2403417 - DNA, 23 bp, Homo sapiens
agttgaaaatcttataatttaaa

SEQ ID NO: 2403418 - DNA, 12 bp, Homo sapiens
agttgaattttt

SEQ ID NO: 2403419 - DNA, 23 bp, Homo sapiens
agttgaattttttttaacattcc

SEQ ID NO: 2403420 - DNA, 19 bp, Homo sapiens
agttgcaactttgtataaa

SEQ ID NO: 2403421 - DNA, 17 bp, Homo sapiens
agtttaaattgtaatag

SEQ ID NO: 2403422 - DNA, 15 bp, Homo sapiens
agtttcgttttcaaa

SEQ ID NO: 2403423 - DNA, 17 bp, Homo sapiens
agtttctgagttttacc

SEQ ID NO: 2403424 - DNA, 18 bp, Homo sapiens
agtttctgagttttacca

SEQ ID NO: 2403425 - DNA, 12 bp, Homo sapiens
agtttgaatgtt

SEQ ID NO: 2403426 - DNA, 15 bp, Homo sapiens
agtttgaatgttaaa

SEQ ID NO: 2403427 - DNA, 21 bp, Homo sapiens
agtttgaatgttaaataaatt

SEQ ID NO: 2403428 - DNA, 16 bp, Homo sapiens
agtttggtttctagca

SEQ ID NO: 2403429 - DNA, 22 bp, Homo sapiens
agttttcctaagtgattgtatg

SEQ ID NO: 2403430 - DNA, 15 bp, Homo sapiens
agttttggatgcagt

SEQ ID NO: 2403431 - DNA, 18 bp, Homo sapiens
agttttggatgcagtgct

SEQ ID NO: 2403432 - DNA, 15 bp, Homo sapiens
agttttttttataca

SEQ ID NO: 2403433 - DNA, 15 bp, Homo sapiens
ataaaaaagatccca

SEQ ID NO: 2403434 - DNA, 19 bp, Homo sapiens
ataaaaataaaaaagatcc

SEQ ID NO: 2403435 - DNA, 15 bp, Homo sapiens
ataaaagacagtgaa

SEQ ID NO: 2403436 - DNA, 19 bp, Homo sapiens
ataaaagatggggtctgta

SEQ ID NO: 2403437 - DNA, 21 bp, Homo sapiens
ataaaagatggggtctgtaaa

SEQ ID NO: 2403438 - DNA, 22 bp, Homo sapiens
ataaaagggactgagaaattta

SEQ ID NO: 2403439 - DNA, 22 bp, Homo sapiens
ataaaatcagccaattatgtta

SEQ ID NO: 2403440 - DNA, 23 bp, Homo sapiens
ataaaatcagccaattatgttaa

SEQ ID NO: 2403441 - DNA, 20 bp, Homo sapiens
ataaaatttttaatctttaa

SEQ ID NO: 2403442 - DNA, 18 bp, Homo sapiens
ataaacactcttgaaaaa

SEQ ID NO: 2403443 - DNA, 20 bp, Homo sapiens
ataaacttttttcttactgt

SEQ ID NO: 2403444 - DNA, 16 bp, Homo sapiens
ataaagatattgttca

SEQ ID NO: 2403445 - DNA, 18 bp, Homo sapiens
ataaaggattaatgtcaa

SEQ ID NO: 2403446 - DNA, 17 bp, Homo sapiens
ataaaggttcatgcaaa

SEQ ID NO: 2403447 - DNA, 15 bp, Homo sapiens
ataaagtatttaatt

SEQ ID NO: 2403448 - DNA, 13 bp, Homo sapiens
ataaataaagttt

SEQ ID NO: 2403449 - DNA, 14 bp, Homo sapiens
ataaatatccttta

SEQ ID NO: 2403450 - DNA, 13 bp, Homo sapiens
ataaattattgtt

SEQ ID NO: 2403451 - DNA, 14 bp, Homo sapiens
ataaattgtatatt

SEQ ID NO: 2403452 - DNA, 18 bp, Homo sapiens
ataaattgtatattcact

SEQ ID NO: 2403453 - DNA, 14 bp, Homo sapiens
ataacaatgaaagt

SEQ ID NO: 2403454 - DNA, 21 bp, Homo sapiens
ataacggatcagaaatacaga

SEQ ID NO: 2403455 - DNA, 15 bp, Homo sapiens
ataactggaaagaag

SEQ ID NO: 2403456 - DNA, 15 bp, Homo sapiens
ataagagctcaggat

SEQ ID NO: 2403457 - DNA, 16 bp, Homo sapiens
ataagatatttttcat

SEQ ID NO: 2403458 - DNA, 15 bp, Homo sapiens
ataagatcttttatt

SEQ ID NO: 2403459 - DNA, 22 bp, Homo sapiens
ataagtgctgtataaaatcagc

SEQ ID NO: 2403460 - DNA, 19 bp, Homo sapiens
ataatatattttaaatatt

SEQ ID NO: 2403461 - DNA, 13 bp, Homo sapiens
ataattttaaatg

SEQ ID NO: 2403462 - DNA, 19 bp, Homo sapiens
atacagattttgatagcaa

SEQ ID NO: 2403463 - DNA, 21 bp, Homo sapiens
atacaggatgatgactatgga

SEQ ID NO: 2403464 - DNA, 16 bp, Homo sapiens
atacattttctaagaa

SEQ ID NO: 2403465 - DNA, 20 bp, Homo sapiens
atacctgggatactgtgccc

SEQ ID NO: 2403466 - DNA, 20 bp, Homo sapiens
atacttgtggactaaaagat

SEQ ID NO: 2403467 - DNA, 18 bp, Homo sapiens
atagaatggtatcaataa

SEQ ID NO: 2403468 - DNA, 18 bp, Homo sapiens
atagataggtcagtgcaa

SEQ ID NO: 2403469 - DNA, 22 bp, Homo sapiens
atagtcatgtaagctgaaaata

SEQ ID NO: 2403470 - DNA, 17 bp, Homo sapiens
atagtccagctttgttc

SEQ ID NO: 2403471 - DNA, 13 bp, Homo sapiens
atataactaacaa

SEQ ID NO: 2403472 - DNA, 13 bp, Homo sapiens
atataagtgctgt

SEQ ID NO: 2403473 - DNA, 17 bp, Homo sapiens
atataagtgctgtataa

SEQ ID NO: 2403474 - DNA, 15 bp, Homo sapiens
atatacttgtggact

SEQ ID NO: 2403475 - DNA, 13 bp, Homo sapiens
atatatgctaagt

SEQ ID NO: 2403476 - DNA, 23 bp, Homo sapiens
atatctgcctttattgtgtttgt

SEQ ID NO: 2403477 - DNA, 19 bp, Homo sapiens
ctaggacacagttcctggg

SEQ ID NO: 2403478 - DNA, 13 bp, Homo sapiens
ctataatttaaat

SEQ ID NO: 2403479 - DNA, 15 bp, Homo sapiens
ctatcatttaataat

SEQ ID NO: 2403480 - DNA, 18 bp, Homo sapiens
ctatcgtaaaattaagaa

SEQ ID NO: 2403481 - DNA, 19 bp, Homo sapiens
ctatgaactctgttttctt

SEQ ID NO: 2403482 - DNA, 23 bp, Homo sapiens
ctatgtggaagtggggcgggctt

SEQ ID NO: 2403483 - DNA, 17 bp, Homo sapiens
ctattatccccatttct

SEQ ID NO: 2403484 - DNA, 14 bp, Homo sapiens
ctattcttgatgta

SEQ ID NO: 2403485 - DNA, 17 bp, Homo sapiens
ctattcttgatgtaaaa

SEQ ID NO: 2403486 - DNA, 18 bp, Homo sapiens
ctattttaataaacactc

SEQ ID NO: 2403487 - DNA, 18 bp, Homo sapiens
ctcaacgttgctccccat

SEQ ID NO: 2403488 - DNA, 18 bp, Homo sapiens
ctcaactagcagatacag

SEQ ID NO: 2403489 - DNA, 13 bp, Homo sapiens
ctcaatgctcata

SEQ ID NO: 2403490 - DNA, 23 bp, Homo sapiens
ctcacactcatgcattgtcctct

SEQ ID NO: 2403491 - DNA, 18 bp, Homo sapiens
ctcacatgattccagcca

SEQ ID NO: 2403492 - DNA, 15 bp, Homo sapiens
ctcactaattcatta

SEQ ID NO: 2403493 - DNA, 18 bp, Homo sapiens
ctcactgcttgaactagg

SEQ ID NO: 2403494 - DNA, 12 bp, Homo sapiens
ctcacttcaggt

SEQ ID NO: 2403495 - DNA, 19 bp, Homo sapiens
ctcagaagtttcttcttta

SEQ ID NO: 2403496 - DNA, 14 bp, Homo sapiens
ctcagactctaaga

SEQ ID NO: 2403497 - DNA, 18 bp, Homo sapiens
ctcagactctaagaaaga

SEQ ID NO: 2403498 - DNA, 21 bp, Homo sapiens
ctcagatgcacatgagctggc

SEQ ID NO: 2403499 - DNA, 16 bp, Homo sapiens
ctcagccctgcaccat

SEQ ID NO: 2403500 - DNA, 14 bp, Homo sapiens
ctcagctcactgca

SEQ ID NO: 2403501 - DNA, 20 bp, Homo sapiens
ctcagctcactgcaacctcc

SEQ ID NO: 2403502 - DNA, 12 bp, Homo sapiens
ctcaggagccct

SEQ ID NO: 2403503 - DNA, 14 bp, Homo sapiens
ctcaggagccctgg

SEQ ID NO: 2403504 - DNA, 15 bp, Homo sapiens
ctcaggagccctggg

SEQ ID NO: 2403505 - DNA, 16 bp, Homo sapiens
ctcaggagccctggga

SEQ ID NO: 2403506 - DNA, 22 bp, Homo sapiens
ctcaggagccctgggaggctct

SEQ ID NO: 2403507 - DNA, 16 bp, Homo sapiens
ctcaggatgagggaaa

SEQ ID NO: 2403508 - DNA, 20 bp, Homo sapiens
ctcaggatgagggaaaagaa

SEQ ID NO: 2403509 - DNA, 17 bp, Homo sapiens
ctcatctccccatcatt

SEQ ID NO: 2403510 - DNA, 15 bp, Homo sapiens
ctcatctcttctttt

SEQ ID NO: 2403511 - DNA, 14 bp, Homo sapiens
ctcatctttttact

SEQ ID NO: 2403512 - DNA, 15 bp, Homo sapiens
ctcatgaatgtaaat

SEQ ID NO: 2403513 - DNA, 16 bp, Homo sapiens
ctccaccatcgtcttc

SEQ ID NO: 2403514 - DNA, 21 bp, Homo sapiens
ctccagagagtatctgaggca

SEQ ID NO: 2403515 - DNA, 20 bp, Homo sapiens
ctccagctgctctgtcttct

SEQ ID NO: 2403516 - DNA, 22 bp, Homo sapiens
ctcccaagcacctgggattaca

SEQ ID NO: 2403517 - DNA, 19 bp, Homo sapiens
ctccccaaaggctttgccc

SEQ ID NO: 2403518 - DNA, 12 bp, Homo sapiens
ctcccctgcact

SEQ ID NO: 2403519 - DNA, 16 bp, Homo sapiens
ctcccctgcactgtaa

SEQ ID NO: 2403520 - DNA, 21 bp, Homo sapiens
ctcccctgcactgtaaaatgt

SEQ ID NO: 2403521 - DNA, 13 bp, Homo sapiens
ctccctggatttt

SEQ ID NO: 2403522 - DNA, 19 bp, Homo sapiens
ctccctggatttttaccag

SEQ ID NO: 2403523 - DNA, 21 bp, Homo sapiens
ctcccttctctacactcttgt

SEQ ID NO: 2403524 - DNA, 17 bp, Homo sapiens
ctcctaaagtactggga

SEQ ID NO: 2403525 - DNA, 22 bp, Homo sapiens
ctcctagtactaactcctagga

SEQ ID NO: 2403526 - DNA, 17 bp, Homo sapiens
ctcctcagggactcagg

SEQ ID NO: 2403527 - DNA, 15 bp, Homo sapiens
ctcctctccaccatc

SEQ ID NO: 2403528 - DNA, 17 bp, Homo sapiens
ctcctgcctcagcctcc

SEQ ID NO: 2403529 - DNA, 14 bp, Homo sapiens
ctccttccggggaa

SEQ ID NO: 2403530 - DNA, 20 bp, Homo sapiens
ctccttccggggaaggattt

SEQ ID NO: 2403531 - DNA, 22 bp, Homo sapiens
ctccttgagggcaagagccaca

SEQ ID NO: 2403532 - DNA, 21 bp, Homo sapiens
ctccttggtgattccgcagtg

SEQ ID NO: 2403533 - DNA, 13 bp, Homo sapiens
ctcgctgttgctg

SEQ ID NO: 2403534 - DNA, 14 bp, Homo sapiens
ctctaagaaagaac

SEQ ID NO: 2403535 - DNA, 15 bp, Homo sapiens
ctctagtattccaga

SEQ ID NO: 2403536 - DNA, 21 bp, Homo sapiens
ctctatcatttaataatatac

SEQ ID NO: 2403537 - DNA, 14 bp, Homo sapiens
ctctcatgaacctc

SEQ ID NO: 2403538 - DNA, 21 bp, Homo sapiens
ctctcccctggaactgtctct

SEQ ID NO: 2403539 - DNA, 12 bp, Homo sapiens
ctctctgcaggt

SEQ ID NO: 2403540 - DNA, 22 bp, Homo sapiens
ctctctgcaggtccctaataaa

SEQ ID NO: 2403541 - DNA, 19 bp, Homo sapiens
ctctgaagaactctctgga

SEQ ID NO: 2403542 - DNA, 23 bp, Homo sapiens
ctctgagagcatcaggcctagag

SEQ ID NO: 2403543 - DNA, 16 bp, Homo sapiens
ctctgcaggtccctaa

SEQ ID NO: 2403544 - DNA, 18 bp, Homo sapiens
ctctgcaggtccctaata

SEQ ID NO: 2403545 - DNA, 14 bp, Homo sapiens
ctctggaatttgaa

SEQ ID NO: 2403546 - DNA, 12 bp, Homo sapiens
ctctggagccca

SEQ ID NO: 2403547 - DNA, 19 bp, Homo sapiens
ctctggattatattatgaa

SEQ ID NO: 2403548 - DNA, 20 bp, Homo sapiens
ctctggattatattatgaag

SEQ ID NO: 2403549 - DNA, 18 bp, Homo sapiens
ctctgtcgcccatgctgg

SEQ ID NO: 2403550 - DNA, 20 bp, Homo sapiens
ctctgtcgcccatgctggag

SEQ ID NO: 2403551 - DNA, 16 bp, Homo sapiens
ctctgtctacctggtc

SEQ ID NO: 2403552 - DNA, 22 bp, Homo sapiens
ctctgtctcctaagctggagtg

SEQ ID NO: 2403553 - DNA, 13 bp, Homo sapiens
ctctgttcatttc

SEQ ID NO: 2403554 - DNA, 16 bp, Homo sapiens
ctctgttcatttcctc

SEQ ID NO: 2403555 - DNA, 17 bp, Homo sapiens
ctctgttcatttcctca

SEQ ID NO: 2403556 - DNA, 21 bp, Homo sapiens
ctctgttgccaggctggagtg

SEQ ID NO: 2403557 - DNA, 14 bp, Homo sapiens
ctcttattgcctca

SEQ ID NO: 2403558 - DNA, 23 bp, Homo sapiens
ctcttcttttaaaccattttctt

SEQ ID NO: 2403559 - DNA, 13 bp, Homo sapiens
ctcttgatgcctg

SEQ ID NO: 2403560 - DNA, 20 bp, Homo sapiens
ctcttgcctcaacctcccaa

SEQ ID NO: 2403561 - DNA, 17 bp, Homo sapiens
ctctttagagttagact

SEQ ID NO: 2403562 - DNA, 21 bp, Homo sapiens
ctctttagagttagactgttg

SEQ ID NO: 2403563 - DNA, 17 bp, Homo sapiens
ctgaacatcacagctta

SEQ ID NO: 2403564 - DNA, 21 bp, Homo sapiens
ctgaagctatcgtaaaattaa

SEQ ID NO: 2403565 - DNA, 17 bp, Homo sapiens
ctgaaggggttctcaca

SEQ ID NO: 2403566 - DNA, 22 bp, Homo sapiens
ctgaaggtgaaacattttctcc

SEQ ID NO: 2403567 - DNA, 18 bp, Homo sapiens
ctgaataggcgatcacaa

SEQ ID NO: 2403568 - DNA, 21 bp, Homo sapiens
ctgaataggcgatcacaacgt

SEQ ID NO: 2403569 - DNA, 23 bp, Homo sapiens
ctgactattcttgatgtaaaatc

SEQ ID NO: 2403570 - DNA, 18 bp, Homo sapiens
ctgactgccaagccatgg

SEQ ID NO: 2403571 - DNA, 21 bp, Homo sapiens
ctgagaaaagctttgaaccct

SEQ ID NO: 2403572 - DNA, 17 bp, Homo sapiens
ctgagacaaatggaggc

SEQ ID NO: 2403573 - DNA, 14 bp, Homo sapiens
ctgagagaaaataa

SEQ ID NO: 2403574 - DNA, 15 bp, Homo sapiens
ctgaggcctagactc

SEQ ID NO: 2403575 - DNA, 13 bp, Homo sapiens
ctgagttttacca

SEQ ID NO: 2403576 - DNA, 14 bp, Homo sapiens
ctgagttttaccaa

SEQ ID NO: 2403577 - DNA, 20 bp, Homo sapiens
ctgatgaaaataaagaatgg

SEQ ID NO: 2403578 - DNA, 12 bp, Homo sapiens
ctgatgttgtgt

SEQ ID NO: 2403579 - DNA, 14 bp, Homo sapiens
ctgcaacctccacc

SEQ ID NO: 2403580 - DNA, 16 bp, Homo sapiens
ctgcaacctccacctc

SEQ ID NO: 2403581 - DNA, 19 bp, Homo sapiens
ctgcaccatgctgctgggg

SEQ ID NO: 2403582 - DNA, 21 bp, Homo sapiens
ctgcaccatgctgctggggaa

SEQ ID NO: 2403583 - DNA, 23 bp, Homo sapiens
ctgcaccatgctgctggggaaga

SEQ ID NO: 2403584 - DNA, 22 bp, Homo sapiens
ctgcacgaatggaagaggcacc

SEQ ID NO: 2403585 - DNA, 11 bp, Homo sapiens
ctgcactgtaa

SEQ ID NO: 2403586 - DNA, 14 bp, Homo sapiens
ctgcactgtaaaat

SEQ ID NO: 2403587 - DNA, 20 bp, Homo sapiens
ctgcactgtaaaatgtggga

SEQ ID NO: 2403588 - DNA, 15 bp, Homo sapiens
ctgcaggtccctaat

SEQ ID NO: 2403589 - DNA, 16 bp, Homo sapiens
ctgcaggtccctaata

SEQ ID NO: 2403590 - DNA, 17 bp, Homo sapiens
ctgcaggtccctaataa

SEQ ID NO: 2403591 - DNA, 18 bp, Homo sapiens
ctgcaggtccctaataaa

SEQ ID NO: 2403592 - DNA, 13 bp, Homo sapiens
ctgcagtcacagc

SEQ ID NO: 2403593 - DNA, 15 bp, Homo sapiens
ctgcagttttgctat

SEQ ID NO: 2403594 - DNA, 23 bp, Homo sapiens
ctgcattgagcttgcatgcttgc

SEQ ID NO: 2403595 - DNA, 12 bp, Homo sapiens
ctgccaagccat

SEQ ID NO: 2403596 - DNA, 16 bp, Homo sapiens
ctgcccccagagccac

SEQ ID NO: 2403597 - DNA, 17 bp, Homo sapiens
ctgcccccagagccaca

SEQ ID NO: 2403598 - DNA, 17 bp, Homo sapiens
ctgcccctaccctggac

SEQ ID NO: 2403599 - DNA, 13 bp, Homo sapiens
ctgcctaagccct

SEQ ID NO: 2403600 - DNA, 12 bp, Homo sapiens
ctgcctctctgc

SEQ ID NO: 2403601 - DNA, 15 bp, Homo sapiens
ctgcctctctgcagg

SEQ ID NO: 2403602 - DNA, 20 bp, Homo sapiens
ctgcctctctgcaggtccct

SEQ ID NO: 2403603 - DNA, 20 bp, Homo sapiens
ctgcctggaagagcagccct

SEQ ID NO: 2403604 - DNA, 19 bp, Homo sapiens
ctgccttcttcggaaagaa

SEQ ID NO: 2403605 - DNA, 12 bp, Homo sapiens
ctgcctttattg

SEQ ID NO: 2403606 - DNA, 22 bp, Homo sapiens
ctgcctttattgtgtttgtcat

SEQ ID NO: 2403607 - DNA, 16 bp, Homo sapiens
gtttgaatgttaaata

SEQ ID NO: 2403608 - DNA, 17 bp, Homo sapiens
gtttgaatgttaaataa

SEQ ID NO: 2403609 - DNA, 21 bp, Homo sapiens
gtttggaaattgattttgaac

SEQ ID NO: 2403610 - DNA, 17 bp, Homo sapiens
gtttggtattgtattta

SEQ ID NO: 2403611 - DNA, 18 bp, Homo sapiens
gtttggtattgtatttat

SEQ ID NO: 2403612 - DNA, 21 bp, Homo sapiens
gtttgtcattagcctgagtag

SEQ ID NO: 2403613 - DNA, 17 bp, Homo sapiens
gttttggtggttttagt

SEQ ID NO: 2403614 - DNA, 15 bp, Homo sapiens
gtttttttttaaaga

SEQ ID NO: 2403615 - DNA, 19 bp, Homo sapiens
taaaaataaaaaagatccc

SEQ ID NO: 2403616 - DNA, 21 bp, Homo sapiens
taaaaatgttctattttaatt

SEQ ID NO: 2403617 - DNA, 12 bp, Homo sapiens
taaaagatataa

SEQ ID NO: 2403618 - DNA, 19 bp, Homo sapiens
taaaagatggggtctgtaa

SEQ ID NO: 2403619 - DNA, 19 bp, Homo sapiens
taaaagggactgagaaatt

SEQ ID NO: 2403620 - DNA, 20 bp, Homo sapiens
taaaagggactgagaaattt

SEQ ID NO: 2403621 - DNA, 22 bp, Homo sapiens
taaaagttttttattatgcatt

SEQ ID NO: 2403622 - DNA, 21 bp, Homo sapiens
taaaatcagccaattatgtta

SEQ ID NO: 2403623 - DNA, 14 bp, Homo sapiens
taaaatcttgtcat

SEQ ID NO: 2403624 - DNA, 15 bp, Homo sapiens
taaaatcttgtcatg

SEQ ID NO: 2403625 - DNA, 16 bp, Homo sapiens
taaaatcttgtcatgt

SEQ ID NO: 2403626 - DNA, 18 bp, Homo sapiens
taaaatcttgtcatgtgt

SEQ ID NO: 2403627 - DNA, 19 bp, Homo sapiens
taaaatcttgtcatgtgta

SEQ ID NO: 2403628 - DNA, 22 bp, Homo sapiens
taaaatcttgtcatgtgtataa

SEQ ID NO: 2403629 - DNA, 18 bp, Homo sapiens
taaaatgtgggattatgg

SEQ ID NO: 2403630 - DNA, 20 bp, Homo sapiens
taaaatgtgggattatgggt

SEQ ID NO: 2403631 - DNA, 23 bp, Homo sapiens
taaaatgtgggattatgggtcac

SEQ ID NO: 2403632 - DNA, 16 bp, Homo sapiens
taaaattacactttga

SEQ ID NO: 2403633 - DNA, 12 bp, Homo sapiens
taaaattgccat

SEQ ID NO: 2403634 - DNA, 16 bp, Homo sapiens
taaaattgccatattg

SEQ ID NO: 2403635 - DNA, 21 bp, Homo sapiens
taaaatttttttagaaagcat

SEQ ID NO: 2403636 - DNA, 17 bp, Homo sapiens
taaacactcttgaaaaa

SEQ ID NO: 2403637 - DNA, 18 bp, Homo sapiens
taaacactcttgaaaaat

SEQ ID NO: 2403638 - DNA, 21 bp, Homo sapiens
taaactagcatatctgccttt

SEQ ID NO: 2403639 - DNA, 17 bp, Homo sapiens
taaactcatttctagca

SEQ ID NO: 2403640 - DNA, 18 bp, Homo sapiens
taaagaaaatctctgtga

SEQ ID NO: 2403641 - DNA, 13 bp, Homo sapiens
taaagaattattt

SEQ ID NO: 2403642 - DNA, 14 bp, Homo sapiens
taaaggaatttaaa

SEQ ID NO: 2403643 - DNA, 22 bp, Homo sapiens
taaagtaaaaacaaagaaatta

SEQ ID NO: 2403644 - DNA, 14 bp, Homo sapiens
taaagtgtttgaaa

SEQ ID NO: 2403645 - DNA, 21 bp, Homo sapiens
taaataaagtttgttgaaaca

SEQ ID NO: 2403646 - DNA, 18 bp, Homo sapiens
taaatatatgctaagtct

SEQ ID NO: 2403647 - DNA, 20 bp, Homo sapiens
taaatcagactatgaagttt

SEQ ID NO: 2403648 - DNA, 12 bp, Homo sapiens
taaatgaagaaa

SEQ ID NO: 2403649 - DNA, 20 bp, Homo sapiens
taaatgtttttttttaaaga

SEQ ID NO: 2403650 - DNA, 18 bp, Homo sapiens
taaattattgtttttctt

SEQ ID NO: 2403651 - DNA, 13 bp, Homo sapiens
taaattgtatatt

SEQ ID NO: 2403652 - DNA, 17 bp, Homo sapiens
taaattgtatattcact

SEQ ID NO: 2403653 - DNA, 18 bp, Homo sapiens
taaattgtatattcactt

SEQ ID NO: 2403654 - DNA, 19 bp, Homo sapiens
taaatttgtactatttaac

SEQ ID NO: 2403655 - DNA, 20 bp, Homo sapiens
taaatttgtactatttaact

SEQ ID NO: 2403656 - DNA, 21 bp, Homo sapiens
taaatttgtactatttaactg

SEQ ID NO: 2403657 - DNA, 14 bp, Homo sapiens
taacatgaatattt

SEQ ID NO: 2403658 - DNA, 10 bp, Homo sapiens
taacattcct

SEQ ID NO: 2403659 - DNA, 11 bp, Homo sapiens
taacattcctc

SEQ ID NO: 2403660 - DNA, 22 bp, Homo sapiens
taacattcctcatgaatgtaaa

SEQ ID NO: 2403661 - DNA, 23 bp, Homo sapiens
taacattcctcatgaatgtaaat

SEQ ID NO: 2403662 - DNA, 13 bp, Homo sapiens
taaccagatcatt

SEQ ID NO: 2403663 - DNA, 23 bp, Homo sapiens
taactatagtccagctttgttct

SEQ ID NO: 2403664 - DNA, 15 bp, Homo sapiens
taacttaattgctat

SEQ ID NO: 2403665 - DNA, 13 bp, Homo sapiens
taagacaaatatg

SEQ ID NO: 2403666 - DNA, 22 bp, Homo sapiens
taagacccttattgctgtcctg

SEQ ID NO: 2403667 - DNA, 14 bp, Homo sapiens
taagagctcaggat

SEQ ID NO: 2403668 - DNA, 22 bp, Homo sapiens
taagagctcaggatgagggaaa

SEQ ID NO: 2403669 - DNA, 19 bp, Homo sapiens
taagatatttttcatgatt

SEQ ID NO: 2403670 - DNA, 18 bp, Homo sapiens
taagatcttttattttgc

SEQ ID NO: 2403671 - DNA, 15 bp, Homo sapiens
taagcatgcacaaat

SEQ ID NO: 2403672 - DNA, 22 bp, Homo sapiens
taagcgctagaggaagcagcca

SEQ ID NO: 2403673 - DNA, 13 bp, Homo sapiens
taagctgaaaata

SEQ ID NO: 2403674 - DNA, 14 bp, Homo sapiens
taagctgaaaatat

SEQ ID NO: 2403675 - DNA, 20 bp, Homo sapiens
taagcttttcttttctttgt

SEQ ID NO: 2403676 - DNA, 14 bp, Homo sapiens
taaggcaatcatgg

SEQ ID NO: 2403677 - DNA, 18 bp, Homo sapiens
taagtgctgtataaaatc

SEQ ID NO: 2403678 - DNA, 22 bp, Homo sapiens
taagtgtgaactggaccctgtt

SEQ ID NO: 2403679 - DNA, 12 bp, Homo sapiens
taataaacactc

SEQ ID NO: 2403680 - DNA, 12 bp, Homo sapiens
taataaactcat

SEQ ID NO: 2403681 - DNA, 22 bp, Homo sapiens
taataatatacttgtggactaa

SEQ ID NO: 2403682 - DNA, 18 bp, Homo sapiens
taatacttgctttggaaa

SEQ ID NO: 2403683 - DNA, 13 bp, Homo sapiens
taatatacttgtg

SEQ ID NO: 2403684 - DNA, 15 bp, Homo sapiens
taatatacttgtgga

SEQ ID NO: 2403685 - DNA, 16 bp, Homo sapiens
taatattcctcagttc

SEQ ID NO: 2403686 - DNA, 20 bp, Homo sapiens
taatcattcttatttcatga

SEQ ID NO: 2403687 - DNA, 22 bp, Homo sapiens
taatcattcttatttcatgaaa

SEQ ID NO: 2403688 - DNA, 21 bp, Homo sapiens
taatcccagcatgctgagatt

SEQ ID NO: 2403689 - DNA, 20 bp, Homo sapiens
taatccccagtaaaattgcc

SEQ ID NO: 2403690 - DNA, 17 bp, Homo sapiens
taatccccttctcccct

SEQ ID NO: 2403691 - DNA, 13 bp, Homo sapiens
taatctgcctccc

SEQ ID NO: 2403692 - DNA, 13 bp, Homo sapiens
taatgaagtttga

SEQ ID NO: 2403693 - DNA, 17 bp, Homo sapiens
taatgaagtttgaatgt

SEQ ID NO: 2403694 - DNA, 20 bp, Homo sapiens
taatgacatcaccacagttt

SEQ ID NO: 2403695 - DNA, 16 bp, Homo sapiens
taatggtgccttcatt

SEQ ID NO: 2403696 - DNA, 18 bp, Homo sapiens
taatggtgccttcatttg

SEQ ID NO: 2403697 - DNA, 19 bp, Homo sapiens
taatgtgtattacaaatat

SEQ ID NO: 2403698 - DNA, 16 bp, Homo sapiens
taatgttaatattgat

SEQ ID NO: 2403699 - DNA, 16 bp, Homo sapiens
taattagtgctaagtg

SEQ ID NO: 2403700 - DNA, 13 bp, Homo sapiens
taattcatgttgc

SEQ ID NO: 2403701 - DNA, 22 bp, Homo sapiens
taattccgtaggttattttcag

SEQ ID NO: 2403702 - DNA, 12 bp, Homo sapiens
taattttctacc

SEQ ID NO: 2403703 - DNA, 17 bp, Homo sapiens
taattttgaaaaactgc

SEQ ID NO: 2403704 - DNA, 13 bp, Homo sapiens
tacaaaaattcct

SEQ ID NO: 2403705 - DNA, 21 bp, Homo sapiens
tacaagcattctgtcttgaag

SEQ ID NO: 2403706 - DNA, 19 bp, Homo sapiens
tacaattaaagctgttatt

SEQ ID NO: 2403707 - DNA, 16 bp, Homo sapiens
tacacaatagaattat

SEQ ID NO: 2403708 - DNA, 13 bp, Homo sapiens
tacagaattttat

SEQ ID NO: 2403709 - DNA, 22 bp, Homo sapiens
tacagattttgatagcaaagcg

SEQ ID NO: 2403710 - DNA, 15 bp, Homo sapiens
tacaggcctcacaca

SEQ ID NO: 2403711 - DNA, 13 bp, Homo sapiens
tacagttaagttt

SEQ ID NO: 2403712 - DNA, 20 bp, Homo sapiens
tacatcatttctttttggga

SEQ ID NO: 2403713 - DNA, 15 bp, Homo sapiens
tacatggtgtttgtg

SEQ ID NO: 2403714 - DNA, 17 bp, Homo sapiens
tacatgtactgattact

SEQ ID NO: 2403715 - DNA, 15 bp, Homo sapiens
tacattaattatcta

SEQ ID NO: 2403716 - DNA, 20 bp, Homo sapiens
tacatttatagttgtaacta

SEQ ID NO: 2403717 - DNA, 15 bp, Homo sapiens
tacattttctaagaa

SEQ ID NO: 2403718 - DNA, 21 bp, Homo sapiens
taccaagtttcaggtattaag

SEQ ID NO: 2403719 - DNA, 13 bp, Homo sapiens
taccagaaagcag

SEQ ID NO: 2403720 - DNA, 14 bp, Homo sapiens
taccagtctcacat

SEQ ID NO: 2403721 - DNA, 17 bp, Homo sapiens
taccttgcatctcacag

SEQ ID NO: 2403722 - DNA, 16 bp, Homo sapiens
tactactgaatctcta

SEQ ID NO: 2403723 - DNA, 20 bp, Homo sapiens
tactcactttctagattaag

SEQ ID NO: 2403724 - DNA, 14 bp, Homo sapiens
tactcagaattaag

SEQ ID NO: 2403725 - DNA, 23 bp, Homo sapiens
tactgtacagacagaaaaaactg

SEQ ID NO: 2403726 - DNA, 23 bp, Homo sapiens
tacttacatgcattactgcatgc

SEQ ID NO: 2403727 - DNA, 22 bp, Homo sapiens
tacttcgtgtccgactcttctg

SEQ ID NO: 2403728 - DNA, 14 bp, Homo sapiens
tacttgacctccta

SEQ ID NO: 2403729 - DNA, 20 bp, Homo sapiens
tacttgctcttgatgcctgg

SEQ ID NO: 2403730 - DNA, 15 bp, Homo sapiens
tacttgtttcagagt

SEQ ID NO: 2403731 - DNA, 20 bp, Homo sapiens
tactttatgttactacatgc

SEQ ID NO: 2403732 - DNA, 15 bp, Homo sapiens
tactttgtgcattct

SEQ ID NO: 2403733 - DNA, 13 bp, Homo sapiens
tagaaagcatttg

SEQ ID NO: 2403734 - DNA, 16 bp, Homo sapiens
tagaaagcatttgaat

SEQ ID NO: 2403735 - DNA, 19 bp, Homo sapiens
tagaaagcatttgaatgca

SEQ ID NO: 2403736 - DNA, 23 bp, Homo sapiens
tagaaatttatttcctagttctg

SEQ ID NO: 2403737 - DNA, 14 bp, Homo sapiens
tagaactagccaaa

SEQ ID NO: 2403738 - DNA, 15 bp, Homo sapiens
tagaccaccaagcct

SEQ ID NO: 2403739 - DNA, 16 bp, Homo sapiens
tagaccaccaagcctt

SEQ ID NO: 2403740 - DNA, 23 bp, Homo sapiens
tagactgttggggtgggtataaa

SEQ ID NO: 2403741 - DNA, 17 bp, Homo sapiens
tagaggcttccttcatt

SEQ ID NO: 2403742 - DNA, 17 bp, Homo sapiens
tagagttagactgttgg

SEQ ID NO: 2403743 - DNA, 22 bp, Homo sapiens
tagatgctctatgtgcttgtaa

SEQ ID NO: 2403744 - DNA, 22 bp, Homo sapiens
tagatgttctctatcatttaat

SEQ ID NO: 2403745 - DNA, 20 bp, Homo sapiens
tagatttgtgtgcatcaggc

SEQ ID NO: 2403746 - DNA, 22 bp, Homo sapiens
tagatttgtgtgcatcaggctt

SEQ ID NO: 2403747 - DNA, 17 bp, Homo sapiens
tagcaaagatatctcat

SEQ ID NO: 2403748 - DNA, 14 bp, Homo sapiens
tagccaagtgcagg

SEQ ID NO: 2403749 - DNA, 17 bp, Homo sapiens
tagccagaggctctaat

SEQ ID NO: 2403750 - DNA, 16 bp, Homo sapiens
tagccttctctgttca

SEQ ID NO: 2403751 - DNA, 19 bp, Homo sapiens
taggacacagttcctggga

SEQ ID NO: 2403752 - DNA, 23 bp, Homo sapiens
taggcgatcacaacgtgcattgt

SEQ ID NO: 2403753 - DNA, 21 bp, Homo sapiens
tagggcaattaattccttcag

SEQ ID NO: 2403754 - DNA, 19 bp, Homo sapiens
tagggtttaatccccagta

SEQ ID NO: 2403755 - DNA, 16 bp, Homo sapiens
taggtaaattacagtt

SEQ ID NO: 2403756 - DNA, 14 bp, Homo sapiens
taggtagggtttaa

SEQ ID NO: 2403757 - DNA, 16 bp, Homo sapiens
taggtcagtgcaaata

SEQ ID NO: 2403758 - DNA, 12 bp, Homo sapiens
tagtaatcatat

SEQ ID NO: 2403759 - DNA, 19 bp, Homo sapiens
tagtctcactgcttgaact

SEQ ID NO: 2403760 - DNA, 19 bp, Homo sapiens
tagtgatcaaattgtgcag

SEQ ID NO: 2403761 - DNA, 22 bp, Homo sapiens
tagttagccaatatttttctta

SEQ ID NO: 2403762 - DNA, 18 bp, Homo sapiens
tagttctgtagaaatggt

SEQ ID NO: 2403763 - DNA, 19 bp, Homo sapiens
tataaaaataaaaaagatc

SEQ ID NO: 2403764 - DNA, 22 bp, Homo sapiens
tataaaacaggatggtggcagg

SEQ ID NO: 2403765 - DNA, 22 bp, Homo sapiens
tataaaagatggggtctgtaaa

SEQ ID NO: 2403766 - DNA, 17 bp, Homo sapiens
tataaaagcctgtttaa

SEQ ID NO: 2403767 - DNA, 22 bp, Homo sapiens
tataaaagggactgagaaattt

SEQ ID NO: 2403768 - DNA, 16 bp, Homo sapiens
tataaaatcagccaat

SEQ ID NO: 2403769 - DNA, 17 bp, Homo sapiens
tataagtgtgtgttttt

SEQ ID NO: 2403770 - DNA, 13 bp, Homo sapiens
tatagtccagctt

SEQ ID NO: 2403771 - DNA, 15 bp, Homo sapiens
tatatttacaaatgg

SEQ ID NO: 2403772 - DNA, 14 bp, Homo sapiens
tatattttaagacg

SEQ ID NO: 2403773 - DNA, 17 bp, Homo sapiens
tatcatgtgaaatcatt

SEQ ID NO: 2403774 - DNA, 14 bp, Homo sapiens
tatcattccaaagg

SEQ ID NO: 2403775 - DNA, 17 bp, Homo sapiens
tatccaggcaccaggac

SEQ ID NO: 2403776 - DNA, 14 bp, Homo sapiens
tatcctctttagag

SEQ ID NO: 2403777 - DNA, 22 bp, Homo sapiens
tatcctctttagagttagactg

SEQ ID NO: 2403778 - DNA, 15 bp, Homo sapiens
tatcgtaaaattaag

SEQ ID NO: 2403779 - DNA, 23 bp, Homo sapiens
tatctaaactggattcacagctc

SEQ ID NO: 2403780 - DNA, 12 bp, Homo sapiens
tatctcacactc

SEQ ID NO: 2403781 - DNA, 13 bp, Homo sapiens
tatctgaggtcac

SEQ ID NO: 2403782 - DNA, 18 bp, Homo sapiens
tatctgcctttattgtgt

SEQ ID NO: 2403783 - DNA, 18 bp, Homo sapiens
tatctgggctgtgggcaa

SEQ ID NO: 2403784 - DNA, 15 bp, Homo sapiens
tatgagctcttcatg

SEQ ID NO: 2403785 - DNA, 16 bp, Homo sapiens
tatgagctcttcatgt

SEQ ID NO: 2403786 - DNA, 17 bp, Homo sapiens
tatgatacttgaaaatt

SEQ ID NO: 2403787 - DNA, 22 bp, Homo sapiens
tatggcctgtgagctaggaatt

SEQ ID NO: 2403788 - DNA, 11 bp, Homo sapiens
tatgggtcaca

SEQ ID NO: 2403789 - DNA, 14 bp, Homo sapiens
tatgggtcacagga

SEQ ID NO: 2403790 - DNA, 14 bp, Homo sapiens
tatgggtctaggac

SEQ ID NO: 2403791 - DNA, 23 bp, Homo sapiens
tatgtagaaaaaagtaaatgtga

SEQ ID NO: 2403792 - DNA, 17 bp, Homo sapiens
tatgtgtatctcacact

SEQ ID NO: 2403793 - DNA, 13 bp, Homo sapiens
tatgtgtgtttta

SEQ ID NO: 2403794 - DNA, 16 bp, Homo sapiens
tatgttgcatagaata

SEQ ID NO: 2403795 - DNA, 22 bp, Homo sapiens
tattaatatatattatcttttc

SEQ ID NO: 2403796 - DNA, 17 bp, Homo sapiens
tattatatttacaaatg

SEQ ID NO: 2403797 - DNA, 12 bp, Homo sapiens
tattatcttttc

SEQ ID NO: 2403798 - DNA, 14 bp, Homo sapiens
tattatcttttcat

SEQ ID NO: 2403799 - DNA, 19 bp, Homo sapiens
tattatcttttcatacatt

SEQ ID NO: 2403800 - DNA, 14 bp, Homo sapiens
tattcttgatgtaa

SEQ ID NO: 2403801 - DNA, 17 bp, Homo sapiens
tattgataagatctttt

SEQ ID NO: 2403802 - DNA, 17 bp, Homo sapiens
tattgcacatgtcttaa

SEQ ID NO: 2403803 - DNA, 15 bp, Homo sapiens
tattgtatttattca

SEQ ID NO: 2403804 - DNA, 16 bp, Homo sapiens
tattgtatttattcaa

SEQ ID NO: 2403805 - DNA, 16 bp, Homo sapiens
tattgtgtttgtcatt

SEQ ID NO: 2403806 - DNA, 18 bp, Homo sapiens
tatttaattagtgctaag

SEQ ID NO: 2403807 - DNA, 14 bp, Homo sapiens
tatttgaacttttt

SEQ ID NO: 2403808 - DNA, 12 bp, Homo sapiens
tatttgaatctt

SEQ ID NO: 2403809 - DNA, 14 bp, Homo sapiens
tattttaataaaca

SEQ ID NO: 2403810 - DNA, 17 bp, Homo sapiens
tattttaataaacactc

SEQ ID NO: 2403811 - DNA, 22 bp, Homo sapiens
tattttgccaagggcataaatt

SEQ ID NO: 2403812 - DNA, 21 bp, Homo sapiens
tatttttaatatatactatga

SEQ ID NO: 2403813 - DNA, 22 bp, Homo sapiens
tcaaacagtacactatcttaat

SEQ ID NO: 2403814 - DNA, 18 bp, Homo sapiens
tcaaactcctgacctcag

SEQ ID NO: 2403815 - DNA, 22 bp, Homo sapiens
tcaaatatattcagcctggctt

SEQ ID NO: 2403816 - DNA, 23 bp, Homo sapiens
tcaaatatattcagcctggcttc

SEQ ID NO: 2403817 - DNA, 17 bp, Homo sapiens
tcaaattgtaagcatgc

SEQ ID NO: 2403818 - DNA, 12 bp, Homo sapiens
tcaacctcccaa

SEQ ID NO: 2403819 - DNA, 19 bp, Homo sapiens
tcaagattgttcctgcttt

SEQ ID NO: 2403820 - DNA, 14 bp, Homo sapiens
tcaagtcagctctt

SEQ ID NO: 2403821 - DNA, 19 bp, Homo sapiens
tcaagtcctgcctcttaaa

SEQ ID NO: 2403822 - DNA, 11 bp, Homo sapiens
tcaataaagta

SEQ ID NO: 2403823 - DNA, 12 bp, Homo sapiens
tcaatgctcata

SEQ ID NO: 2403824 - DNA, 15 bp, Homo sapiens
tcaatgttttcagtt

SEQ ID NO: 2403825 - DNA, 15 bp, Homo sapiens
tcaattcttgccaaa

SEQ ID NO: 2403826 - DNA, 21 bp, Homo sapiens
tcacaacgtgcattgtgcttc

SEQ ID NO: 2403827 - DNA, 15 bp, Homo sapiens
tcacaataattttct

SEQ ID NO: 2403828 - DNA, 22 bp, Homo sapiens
tcacaccaggcttgcctgcagg

SEQ ID NO: 2403829 - DNA, 23 bp, Homo sapiens
tcacaccaggcttgcctgcaggc

SEQ ID NO: 2403830 - DNA, 19 bp, Homo sapiens
tcacatgattccagccatc

SEQ ID NO: 2403831 - DNA, 20 bp, Homo sapiens
tcacatgattccagccatca

SEQ ID NO: 2403832 - DNA, 21 bp, Homo sapiens
tcacatgattccagccatcac

SEQ ID NO: 2403833 - DNA, 23 bp, Homo sapiens
tcacccctaaaagaaaccctgca

SEQ ID NO: 2403834 - DNA, 16 bp, Homo sapiens
tcaccttagaccacca

SEQ ID NO: 2403835 - DNA, 20 bp, Homo sapiens
tcaccttagaccaccaagcc

SEQ ID NO: 2403836 - DNA, 14 bp, Homo sapiens
tcactaattcatta

SEQ ID NO: 2403837 - DNA, 21 bp, Homo sapiens
tcactttacacaatagaatta

SEQ ID NO: 2403838 - DNA, 14 bp, Homo sapiens
tcactttctagatt

SEQ ID NO: 2403839 - DNA, 13 bp, Homo sapiens
tcagaaatacaga

SEQ ID NO: 2403840 - DNA, 19 bp, Homo sapiens
tcagactctaagaaagaac

SEQ ID NO: 2403841 - DNA, 16 bp, Homo sapiens
tcagagcgcacaggga

SEQ ID NO: 2403842 - DNA, 22 bp, Homo sapiens
tcagagttgatggttgtacata

SEQ ID NO: 2403843 - DNA, 13 bp, Homo sapiens
tcagatcctcctc

SEQ ID NO: 2403844 - DNA, 21 bp, Homo sapiens
tcagcaagttagaactagcca

SEQ ID NO: 2403845 - DNA, 12 bp, Homo sapiens
tcaggagccctg

SEQ ID NO: 2403846 - DNA, 19 bp, Homo sapiens
tcaggagccctgggaggct

SEQ ID NO: 2403847 - DNA, 23 bp, Homo sapiens
tcaggagccctgggaggctctgg

SEQ ID NO: 2403848 - DNA, 23 bp, Homo sapiens
tcagggactcatctttccctcct

SEQ ID NO: 2403849 - DNA, 13 bp, Homo sapiens
tcagtagtcagac

SEQ ID NO: 2403850 - DNA, 19 bp, Homo sapiens
tcagttctcttgattttca

SEQ ID NO: 2403851 - DNA, 18 bp, Homo sapiens
tcataaataaagtttgtt

SEQ ID NO: 2403852 - DNA, 22 bp, Homo sapiens
tcataacggatcagaaatacag

SEQ ID NO: 2403853 - DNA, 21 bp, Homo sapiens
tcatacattttctaagaaaca

SEQ ID NO: 2403854 - DNA, 15 bp, Homo sapiens
tcatattttctttca

SEQ ID NO: 2403855 - DNA, 14 bp, Homo sapiens
tcatccattctatt

SEQ ID NO: 2403856 - DNA, 18 bp, Homo sapiens
tcatctttccctccttgg

SEQ ID NO: 2403857 - DNA, 19 bp, Homo sapiens
tcatctttccctccttggt

SEQ ID NO: 2403858 - DNA, 11 bp, Homo sapiens
tcatgaacctc

SEQ ID NO: 2403859 - DNA, 19 bp, Homo sapiens
tcatgaatgtaaatttgta

SEQ ID NO: 2403860 - DNA, 14 bp, Homo sapiens
tcatgcaaacttta

SEQ ID NO: 2403861 - DNA, 16 bp, Homo sapiens
tcatgtgaaatcattc

SEQ ID NO: 2403862 - DNA, 10 bp, Homo sapiens
tcatgtgtat

SEQ ID NO: 2403863 - DNA, 19 bp, Homo sapiens
tcattagcctgagtagaaa

SEQ ID NO: 2403864 - DNA, 20 bp, Homo sapiens
tcattcacatcgcagattct

SEQ ID NO: 2403865 - DNA, 22 bp, Homo sapiens
tcattcacatcgcagattctcc

SEQ ID NO: 2403866 - DNA, 13 bp, Homo sapiens
tcattcctccagg

SEQ ID NO: 2403867 - DNA, 18 bp, Homo sapiens
tcattcttatttcatgaa

SEQ ID NO: 2403868 - DNA, 23 bp, Homo sapiens
tcattgccttaactggagcccca

SEQ ID NO: 2403869 - DNA, 11 bp, Homo sapiens
tcattggcttt

SEQ ID NO: 2403870 - DNA, 18 bp, Homo sapiens
tcatttaataatatactt

SEQ ID NO: 2403871 - DNA, 15 bp, Homo sapiens
tcatttcatttccta

SEQ ID NO: 2403872 - DNA, 23 bp, Homo sapiens
tccaaagtctctggaatttgaaa

SEQ ID NO: 2403873 - DNA, 13 bp, Homo sapiens
tccaagcaaatgt

SEQ ID NO: 2403874 - DNA, 15 bp, Homo sapiens
tccacgtactgcagc

SEQ ID NO: 2403875 - DNA, 18 bp, Homo sapiens
tccacgtactgcagcctc

SEQ ID NO: 2403876 - DNA, 23 bp, Homo sapiens
tccagaaagaaaacttgtattat

SEQ ID NO: 2403877 - DNA, 15 bp, Homo sapiens
tccagacctgaagaa

SEQ ID NO: 2403878 - DNA, 16 bp, Homo sapiens
tccagagacaacaggt

SEQ ID NO: 2403879 - DNA, 14 bp, Homo sapiens
tccagagactggga

SEQ ID NO: 2403880 - DNA, 15 bp, Homo sapiens
tccagccatcacctt

SEQ ID NO: 2403881 - DNA, 21 bp, Homo sapiens
tccaggcaggtctgaagctca

SEQ ID NO: 2403882 - DNA, 13 bp, Homo sapiens
tccatataaatat

SEQ ID NO: 2403883 - DNA, 20 bp, Homo sapiens
tcccaagtagctgagactac

SEQ ID NO: 2403884 - DNA, 16 bp, Homo sapiens
tcccaagttgtgcttg

SEQ ID NO: 2403885 - DNA, 21 bp, Homo sapiens
tcccacttcagcctcccaagc

SEQ ID NO: 2403886 - DNA, 23 bp, Homo sapiens
tccccaaaggctttgccctgctg

SEQ ID NO: 2403887 - DNA, 14 bp, Homo sapiens
tccccacgccacag

SEQ ID NO: 2403888 - DNA, 15 bp, Homo sapiens
tccccacgccacagc

SEQ ID NO: 2403889 - DNA, 23 bp, Homo sapiens
tcccctatgtggaagtggggcgg

SEQ ID NO: 2403890 - DNA, 13 bp, Homo sapiens
tcccctgcactgt

SEQ ID NO: 2403891 - DNA, 14 bp, Homo sapiens
tcccctgcactgta

SEQ ID NO: 2403892 - DNA, 22 bp, Homo sapiens
tcccctgcactgtaaaatgtgg

SEQ ID NO: 2403893 - DNA, 20 bp, Homo sapiens
tcccctggaactgtctctca

SEQ ID NO: 2403894 - DNA, 13 bp, Homo sapiens
tccccttcactcc

SEQ ID NO: 2403895 - DNA, 24 bp, Homo sapiens
tcccctttgcttcattcaagtcag

SEQ ID NO: 2403896 - DNA, 20 bp, Homo sapiens
tcccgtcacccctgtttctg

SEQ ID NO: 2403897 - DNA, 12 bp, Homo sapiens
tccctaataaag

SEQ ID NO: 2403898 - DNA, 14 bp, Homo sapiens
tccctctcgtaaga

SEQ ID NO: 2403899 - DNA, 14 bp, Homo sapiens
tcccttgagccctc

SEQ ID NO: 2403900 - DNA, 16 bp, Homo sapiens
tccgttcacatgtgtg

SEQ ID NO: 2403901 - DNA, 19 bp, Homo sapiens
tcctaaatatattttaaga

SEQ ID NO: 2403902 - DNA, 14 bp, Homo sapiens
tcctaggaaaatac

SEQ ID NO: 2403903 - DNA, 23 bp, Homo sapiens
tcctagttctgtagaaatggttg

SEQ ID NO: 2403904 - DNA, 16 bp, Homo sapiens
tcctcagactctaaga

SEQ ID NO: 2403905 - DNA, 21 bp, Homo sapiens
tcctcagactctaagaaagaa

SEQ ID NO: 2403906 - DNA, 15 bp, Homo sapiens
tcctcatgaatgtaa

SEQ ID NO: 2403907 - DNA, 20 bp, Homo sapiens
tcctcatgaatgtaaatttg

SEQ ID NO: 2403908 - DNA, 21 bp, Homo sapiens
tcctcatgaatgtaaatttgt

SEQ ID NO: 2403909 - DNA, 22 bp, Homo sapiens
tcctcatttttataatgtccct

SEQ ID NO: 2403910 - DNA, 22 bp, Homo sapiens
tcctccttccggggaaggattt

SEQ ID NO: 2403911 - DNA, 15 bp, Homo sapiens
tcctgacctcaggca

SEQ ID NO: 2403912 - DNA, 15 bp, Homo sapiens
tcctgacctgtctca

SEQ ID NO: 2403913 - DNA, 22 bp, Homo sapiens
tcctgcaggcaggaacaaacag

SEQ ID NO: 2403914 - DNA, 17 bp, Homo sapiens
tcctgcctcagcctccc

SEQ ID NO: 2403915 - DNA, 11 bp, Homo sapiens
tcctggagggg

SEQ ID NO: 2403916 - DNA, 19 bp, Homo sapiens
tcctggaggggctggggac

SEQ ID NO: 2403917 - DNA, 16 bp, Homo sapiens
tcctgtgtggagaggg

SEQ ID NO: 2403918 - DNA, 14 bp, Homo sapiens
tccttcatttcctc

SEQ ID NO: 2403919 - DNA, 23 bp, Homo sapiens
tccttgattttagccttctctgt

SEQ ID NO: 2403920 - DNA, 21 bp, Homo sapiens
tcgcaccactgtgtatttaac

SEQ ID NO: 2403921 - DNA, 14 bp, Homo sapiens
tcgctgttgctgaa

SEQ ID NO: 2403922 - DNA, 15 bp, Homo sapiens
tcggagccctgtctc

SEQ ID NO: 2403923 - DNA, 20 bp, Homo sapiens
tcgtaagatttccttctttt

SEQ ID NO: 2403924 - DNA, 18 bp, Homo sapiens
tcgtctgtttataaacat

SEQ ID NO: 2403925 - DNA, 21 bp, Homo sapiens
tctaaactggattcacagctc

SEQ ID NO: 2403926 - DNA, 15 bp, Homo sapiens
tctaagaaacattta

SEQ ID NO: 2403927 - DNA, 18 bp, Homo sapiens
tctaagaaacatttatat

SEQ ID NO: 2403928 - DNA, 13 bp, Homo sapiens
tctaagaaagaac

SEQ ID NO: 2403929 - DNA, 15 bp, Homo sapiens
tctacctggtctggt

SEQ ID NO: 2403930 - DNA, 12 bp, Homo sapiens
tctagcatgaag

SEQ ID NO: 2403931 - DNA, 23 bp, Homo sapiens
tctaggacacagttcctgggaac

SEQ ID NO: 2403932 - DNA, 21 bp, Homo sapiens
tctattgcctctgagagcatc

SEQ ID NO: 2403933 - DNA, 23 bp, Homo sapiens
tctattgttgtacacagaaatac

SEQ ID NO: 2403934 - DNA, 12 bp, Homo sapiens
tctattttaatt

SEQ ID NO: 2403935 - DNA, 21 bp, Homo sapiens
tctcaaactcctgacctcagg

SEQ ID NO: 2403936 - DNA, 23 bp, Homo sapiens
tctcaaactcctgacctcaggca

SEQ ID NO: 2403937 - DNA, 19 bp, Homo sapiens
tctcacagtgggagccagg

SEQ ID NO: 2403938 - DNA, 22 bp, Homo sapiens
tctcacatgattccagccatca

SEQ ID NO: 2403939 - DNA, 18 bp, Homo sapiens
tctcaccatttggatcct

SEQ ID NO: 2403940 - DNA, 15 bp, Homo sapiens
tctcagctcactgca

SEQ ID NO: 2403941 - DNA, 18 bp, Homo sapiens
tctcatctcttcttttaa

SEQ ID NO: 2403942 - DNA, 23 bp, Homo sapiens
tctccaccatcgtcttcttggcc

SEQ ID NO: 2403943 - DNA, 19 bp, Homo sapiens
tctccagcctcagcctccc

SEQ ID NO: 2403944 - DNA, 15 bp, Homo sapiens
tctccagtgcacctg

SEQ ID NO: 2403945 - DNA, 12 bp, Homo sapiens
tctcccctgcac

SEQ ID NO: 2403946 - DNA, 14 bp, Homo sapiens
tctctatcatttaa

SEQ ID NO: 2403947 - DNA, 13 bp, Homo sapiens
tctctccagtgca

SEQ ID NO: 2403948 - DNA, 20 bp, Homo sapiens
tctctgcaggcagcctgcct

SEQ ID NO: 2403949 - DNA, 14 bp, Homo sapiens
tctctgcaggtccc

SEQ ID NO: 2403950 - DNA, 16 bp, Homo sapiens
tctctgcaggtcccta

SEQ ID NO: 2403951 - DNA, 13 bp, Homo sapiens
tctctgttcattt

SEQ ID NO: 2403952 - DNA, 18 bp, Homo sapiens
tctctgttcatttcctca

SEQ ID NO: 2403953 - DNA, 16 bp, Homo sapiens
tctcttattgcctcac

SEQ ID NO: 2403954 - DNA, 15 bp, Homo sapiens
tctgaattattttct

SEQ ID NO: 2403955 - DNA, 15 bp, Homo sapiens
tctgacataagtatt

SEQ ID NO: 2403956 - DNA, 24 bp, Homo sapiens
tctgagaagctctgaagaactctc

SEQ ID NO: 2403957 - DNA, 16 bp, Homo sapiens
tctgagttttaccaaa

SEQ ID NO: 2403958 - DNA, 16 bp, Homo sapiens
tctgattgtgatgtga

SEQ ID NO: 2403959 - DNA, 15 bp, Homo sapiens
tctgcaaactgcctt

SEQ ID NO: 2403960 - DNA, 14 bp, Homo sapiens
tctgcaggtcccta

SEQ ID NO: 2403961 - DNA, 22 bp, Homo sapiens
tctgcaggtccctaataaagct

SEQ ID NO: 2403962 - DNA, 17 bp, Homo sapiens
tctggaagcccctgggc

SEQ ID NO: 2403963 - DNA, 19 bp, Homo sapiens
tctgggctgtctattctag

SEQ ID NO: 2403964 - DNA, 14 bp, Homo sapiens
tctgtaaaatcttt

SEQ ID NO: 2403965 - DNA, 22 bp, Homo sapiens
tctgtaaaatctttctttctta

SEQ ID NO: 2403966 - DNA, 24 bp, Homo sapiens
tctgtaataaactcatttctagca

SEQ ID NO: 2403967 - DNA, 17 bp, Homo sapiens
tctgtagaaatggttgt

SEQ ID NO: 2403968 - DNA, 22 bp, Homo sapiens
tctgtctctggattatattatg

SEQ ID NO: 2403969 - DNA, 12 bp, Homo sapiens
tctgtcttgaag

SEQ ID NO: 2403970 - DNA, 17 bp, Homo sapiens
tctgtgagattcattca

SEQ ID NO: 2403971 - DNA, 12 bp, Homo sapiens
tcttaaaactcc

SEQ ID NO: 2403972 - DNA, 15 bp, Homo sapiens
tcttaaataaacctt

SEQ ID NO: 2403973 - DNA, 16 bp, Homo sapiens
tcttaatgaagtttga

SEQ ID NO: 2403974 - DNA, 17 bp, Homo sapiens
tcttaatgaagtttgaa

SEQ ID NO: 2403975 - DNA, 19 bp, Homo sapiens
tcttaatgaagtttgaatg

SEQ ID NO: 2403976 - DNA, 12 bp, Homo sapiens
tcttagaaattt

SEQ ID NO: 2403977 - DNA, 14 bp, Homo sapiens
tcttataatttaaa

SEQ ID NO: 2403978 - DNA, 14 bp, Homo sapiens
tcttctattgcctc

SEQ ID NO: 2403979 - DNA, 16 bp, Homo sapiens
tcttctattgcctctg

SEQ ID NO: 2403980 - DNA, 19 bp, Homo sapiens
tcttcttggccatgggagg

SEQ ID NO: 2403981 - DNA, 23 bp, Homo sapiens
tcttcttggccatgggaggcctt

SEQ ID NO: 2403982 - DNA, 14 bp, Homo sapiens
tcttgatgtaaaat

SEQ ID NO: 2403983 - DNA, 22 bp, Homo sapiens
tcttgatgtaaaatcttgtcat

SEQ ID NO: 2403984 - DNA, 22 bp, Homo sapiens
tcttggccatgggaggcctttc

SEQ ID NO: 2403985 - DNA, 14 bp, Homo sapiens
tcttgtctcaatgc

SEQ ID NO: 2403986 - DNA, 21 bp, Homo sapiens
tcttgtctcaatgctcataac

SEQ ID NO: 2403987 - DNA, 23 bp, Homo sapiens
tcttgtgaggaaagtcattggct

SEQ ID NO: 2403988 - DNA, 20 bp, Homo sapiens
tctttaacttaattgctatg

SEQ ID NO: 2403989 - DNA, 16 bp, Homo sapiens
tctttccctccttggt

SEQ ID NO: 2403990 - DNA, 16 bp, Homo sapiens
tctttcttagaaattt

SEQ ID NO: 2403991 - DNA, 13 bp, Homo sapiens
tctttctttattt

SEQ ID NO: 2403992 - DNA, 15 bp, Homo sapiens
tctttctttcttaga

SEQ ID NO: 2403993 - DNA, 15 bp, Homo sapiens
tctttgtaatgaaaa

SEQ ID NO: 2403994 - DNA, 14 bp, Homo sapiens
tcttttcatacatt

SEQ ID NO: 2403995 - DNA, 21 bp, Homo sapiens
tcttttttctaaagtaaaaac

SEQ ID NO: 2403996 - DNA, 18 bp, Homo sapiens
tgaaaaccacattggaga

SEQ ID NO: 2403997 - DNA, 16 bp, Homo sapiens
tgaaaataaagaatgg

SEQ ID NO: 2403998 - DNA, 14 bp, Homo sapiens
tgaaaattaacatg

SEQ ID NO: 2403999 - DNA, 18 bp, Homo sapiens
tgaaactcatagacactg

SEQ ID NO: 2404000 - DNA, 15 bp, Homo sapiens
tgaaattgtattaca

SEQ ID NO: 2404001 - DNA, 21 bp, Homo sapiens
tgaactaggattgtagtccca

SEQ ID NO: 2404002 - DNA, 17 bp, Homo sapiens
tgaactaggctgagcaa

SEQ ID NO: 2404003 - DNA, 18 bp, Homo sapiens
tgaactggaccctgttgc

SEQ ID NO: 2404004 - DNA, 20 bp, Homo sapiens
tgaactggaccctgttgcta

SEQ ID NO: 2404005 - DNA, 22 bp, Homo sapiens
tgaactggaccctgttgctaag

SEQ ID NO: 2404006 - DNA, 23 bp, Homo sapiens
tgaactggaccctgttgctaagc

SEQ ID NO: 2404007 - DNA, 22 bp, Homo sapiens
tgaacttgtaaaggaatttaaa

SEQ ID NO: 2404008 - DNA, 15 bp, Homo sapiens
tgaagatatttttcc

SEQ ID NO: 2404009 - DNA, 18 bp, Homo sapiens
gtaaaatgtgggattatg

SEQ ID NO: 2404010 - DNA, 20 bp, Homo sapiens
gtaaatttgtactatttaac

SEQ ID NO: 2404011 - DNA, 15 bp, Homo sapiens
gtaactcatctgtca

SEQ ID NO: 2404012 - DNA, 18 bp, Homo sapiens
gtaagaacaactacctga

SEQ ID NO: 2404013 - DNA, 21 bp, Homo sapiens
gtaatccaagcaaatgtgaat

SEQ ID NO: 2404014 - DNA, 11 bp, Homo sapiens
gtaatgaaaac

SEQ ID NO: 2404015 - DNA, 23 bp, Homo sapiens
gtacaaccacacccacactcaga

SEQ ID NO: 2404016 - DNA, 15 bp, Homo sapiens
gtacagacagaaaaa

SEQ ID NO: 2404017 - DNA, 20 bp, Homo sapiens
gtaccaagactactagggaa

SEQ ID NO: 2404018 - DNA, 22 bp, Homo sapiens
gtactaactcctaggaaaatac

SEQ ID NO: 2404019 - DNA, 13 bp, Homo sapiens
gtactgcagcctc

SEQ ID NO: 2404020 - DNA, 19 bp, Homo sapiens
gtactggctgatggagtaa

SEQ ID NO: 2404021 - DNA, 14 bp, Homo sapiens
gtacttgctcttga

SEQ ID NO: 2404022 - DNA, 18 bp, Homo sapiens
gtacttgctcttgatgcc

SEQ ID NO: 2404023 - DNA, 19 bp, Homo sapiens
gtacttgctcttgatgcct

SEQ ID NO: 2404024 - DNA, 21 bp, Homo sapiens
gtagaaaggcctttaaaattt

SEQ ID NO: 2404025 - DNA, 20 bp, Homo sapiens
gtagaaatggttgtattaga

SEQ ID NO: 2404026 - DNA, 19 bp, Homo sapiens
gtaggagactgtttggaaa

SEQ ID NO: 2404027 - DNA, 20 bp, Homo sapiens
gtagtctcactgcttgaact

SEQ ID NO: 2404028 - DNA, 18 bp, Homo sapiens
gtagtggggaagagggtt

SEQ ID NO: 2404029 - DNA, 20 bp, Homo sapiens
gtagtttttatatgttgtaa

SEQ ID NO: 2404030 - DNA, 16 bp, Homo sapiens
gtataaaaataaaaaa

SEQ ID NO: 2404031 - DNA, 19 bp, Homo sapiens
gtataaaaataaaaaagat

SEQ ID NO: 2404032 - DNA, 23 bp, Homo sapiens
gtataaaaataaaaaagatccca

SEQ ID NO: 2404033 - DNA, 18 bp, Homo sapiens
gtataaaagcctgtttaa

SEQ ID NO: 2404034 - DNA, 18 bp, Homo sapiens
gtataaaagggactgaga

SEQ ID NO: 2404035 - DNA, 19 bp, Homo sapiens
gtataaaagggactgagaa

SEQ ID NO: 2404036 - DNA, 16 bp, Homo sapiens
gtatagactcctgaaa

SEQ ID NO: 2404037 - DNA, 12 bp, Homo sapiens
gtattagatgtt

SEQ ID NO: 2404038 - DNA, 17 bp, Homo sapiens
gtattgtatttattcaa

SEQ ID NO: 2404039 - DNA, 18 bp, Homo sapiens
gtattgtatttattcaat

SEQ ID NO: 2404040 - DNA, 22 bp, Homo sapiens
gtattgtatttattcaataaag

SEQ ID NO: 2404041 - DNA, 16 bp, Homo sapiens
gtatttaattcatgtt

SEQ ID NO: 2404042 - DNA, 17 bp, Homo sapiens
gtatttattcaataaag

SEQ ID NO: 2404043 - DNA, 19 bp, Homo sapiens
gtatttattcaataaagta

SEQ ID NO: 2404044 - DNA, 15 bp, Homo sapiens
gtcaatgttttcagt

SEQ ID NO: 2404045 - DNA, 16 bp, Homo sapiens
gtcactgacacacacg

SEQ ID NO: 2404046 - DNA, 13 bp, Homo sapiens
gtcagaatagaaa

SEQ ID NO: 2404047 - DNA, 21 bp, Homo sapiens
gtcattagcctgagtagaaag

SEQ ID NO: 2404048 - DNA, 20 bp, Homo sapiens
gtccaacccgaggcccgcat

SEQ ID NO: 2404049 - DNA, 23 bp, Homo sapiens
gtcccattcccccagtgcggcca

SEQ ID NO: 2404050 - DNA, 15 bp, Homo sapiens
gtccctaataaagct

SEQ ID NO: 2404051 - DNA, 13 bp, Homo sapiens
gtcctggaggggc

SEQ ID NO: 2404052 - DNA, 20 bp, Homo sapiens
gtcgcccatgctggagtgca

SEQ ID NO: 2404053 - DNA, 12 bp, Homo sapiens
gtcggagccctg

SEQ ID NO: 2404054 - DNA, 14 bp, Homo sapiens
gtctcactgcttga

SEQ ID NO: 2404055 - DNA, 15 bp, Homo sapiens
gtctctcatgaacct

SEQ ID NO: 2404056 - DNA, 16 bp, Homo sapiens
gtctctcatgaacctc

SEQ ID NO: 2404057 - DNA, 15 bp, Homo sapiens
gtctgtaaaatcttt

SEQ ID NO: 2404058 - DNA, 17 bp, Homo sapiens
gtctgtttataaacatt

SEQ ID NO: 2404059 - DNA, 14 bp, Homo sapiens
gtcttaatgaagtt

SEQ ID NO: 2404060 - DNA, 18 bp, Homo sapiens
gtcttaatgaagtttgaa

SEQ ID NO: 2404061 - DNA, 22 bp, Homo sapiens
gtcttaatgaagtttgaatgtt

SEQ ID NO: 2404062 - DNA, 20 bp, Homo sapiens
gtcttctttgcccacaatgc

SEQ ID NO: 2404063 - DNA, 24 bp, Homo sapiens
gtcttttaggacccttcccttgag

SEQ ID NO: 2404064 - DNA, 15 bp, Homo sapiens
gtgaaacattttctc

SEQ ID NO: 2404065 - DNA, 19 bp, Homo sapiens
gtgaaacattttctccctg

SEQ ID NO: 2404066 - DNA, 20 bp, Homo sapiens
gtgaaatttacatcatttct

SEQ ID NO: 2404067 - DNA, 19 bp, Homo sapiens
gtgaactggaccctgttgc

SEQ ID NO: 2404068 - DNA, 23 bp, Homo sapiens
gtgaactggaccctgttgctaag

SEQ ID NO: 2404069 - DNA, 20 bp, Homo sapiens
gtgagagagtggctggggca

SEQ ID NO: 2404070 - DNA, 15 bp, Homo sapiens
gtgaggaaagtcatt

SEQ ID NO: 2404071 - DNA, 19 bp, Homo sapiens
gtgatataagtgtgtgttt

SEQ ID NO: 2404072 - DNA, 20 bp, Homo sapiens
gtgatccacccgcctcagcc

SEQ ID NO: 2404073 - DNA, 24 bp, Homo sapiens
gtgatccacccgcctcagcctccc

SEQ ID NO: 2404074 - DNA, 21 bp, Homo sapiens
gtgatccctagctgtgacctc

SEQ ID NO: 2404075 - DNA, 22 bp, Homo sapiens
gtgatccctagctgtgacctct

SEQ ID NO: 2404076 - DNA, 14 bp, Homo sapiens
gtgatctcagctca

SEQ ID NO: 2404077 - DNA, 15 bp, Homo sapiens
gtgattccgcagtga

SEQ ID NO: 2404078 - DNA, 23 bp, Homo sapiens
gtgcagggcctgtaatcccagca

SEQ ID NO: 2404079 - DNA, 15 bp, Homo sapiens
gtgcagtactttgtg

SEQ ID NO: 2404080 - DNA, 24 bp, Homo sapiens
gtgcagtggcgtgatctcagctca

SEQ ID NO: 2404081 - DNA, 22 bp, Homo sapiens
gtgcccccaaccatttcctcag

SEQ ID NO: 2404082 - DNA, 11 bp, Homo sapiens
gtgccttcatt

SEQ ID NO: 2404083 - DNA, 13 bp, Homo sapiens
gtgcgtgaatatt

SEQ ID NO: 2404084 - DNA, 13 bp, Homo sapiens
gtgcgtggtgcga

SEQ ID NO: 2404085 - DNA, 14 bp, Homo sapiens
gtgctaagtgtgaa

SEQ ID NO: 2404086 - DNA, 20 bp, Homo sapiens
gtgctaagtgtgaactggac

SEQ ID NO: 2404087 - DNA, 18 bp, Homo sapiens
gtgctcgctgttgctgaa

SEQ ID NO: 2404088 - DNA, 16 bp, Homo sapiens
gtgctgggcccctgcc

SEQ ID NO: 2404089 - DNA, 19 bp, Homo sapiens
gtgctgggcccctgcctct

SEQ ID NO: 2404090 - DNA, 13 bp, Homo sapiens
gtgctgtataaaa

SEQ ID NO: 2404091 - DNA, 17 bp, Homo sapiens
gtgctgtataaaatcag

SEQ ID NO: 2404092 - DNA, 21 bp, Homo sapiens
gtgctgtataaaatcagccaa

SEQ ID NO: 2404093 - DNA, 14 bp, Homo sapiens
gtggactaaaagat

SEQ ID NO: 2404094 - DNA, 23 bp, Homo sapiens
gtggactaaaagatataagtgct

SEQ ID NO: 2404095 - DNA, 14 bp, Homo sapiens
gtggagagggaatg

SEQ ID NO: 2404096 - DNA, 15 bp, Homo sapiens
gtggagagggaatgt

SEQ ID NO: 2404097 - DNA, 18 bp, Homo sapiens
gtggagagggaatgtgaa

SEQ ID NO: 2404098 - DNA, 22 bp, Homo sapiens
gtggcaaagccttcattgcctt

SEQ ID NO: 2404099 - DNA, 13 bp, Homo sapiens
gtggctggggcat

SEQ ID NO: 2404100 - DNA, 14 bp, Homo sapiens
gtgtataaaaataa

SEQ ID NO: 2404101 - DNA, 16 bp, Homo sapiens
gtgtatgtgtgtgtgt

SEQ ID NO: 2404102 - DNA, 16 bp, Homo sapiens
gtgtctgagagattca

SEQ ID NO: 2404103 - DNA, 17 bp, Homo sapiens
gtgtgaactggaccctg

SEQ ID NO: 2404104 - DNA, 16 bp, Homo sapiens
gtgtgcgtcctgtcgg

SEQ ID NO: 2404105 - DNA, 21 bp, Homo sapiens
gtgtggagagggaatgtgaaa

SEQ ID NO: 2404106 - DNA, 16 bp, Homo sapiens
gtgtgttttaaaatga

SEQ ID NO: 2404107 - DNA, 14 bp, Homo sapiens
gtgtgtttttcata

SEQ ID NO: 2404108 - DNA, 22 bp, Homo sapiens
gtgtttatcctatctctccaac

SEQ ID NO: 2404109 - DNA, 18 bp, Homo sapiens
gtgttttaaaatgagaaa

SEQ ID NO: 2404110 - DNA, 20 bp, Homo sapiens
gttaaactagcatatctgcc

SEQ ID NO: 2404111 - DNA, 13 bp, Homo sapiens
gttaaataaattg

SEQ ID NO: 2404112 - DNA, 17 bp, Homo sapiens
gttaaataaattgtata

SEQ ID NO: 2404113 - DNA, 20 bp, Homo sapiens
gttaaataaattgtatattc

SEQ ID NO: 2404114 - DNA, 21 bp, Homo sapiens
gttaaataaattgtatattca

SEQ ID NO: 2404115 - DNA, 21 bp, Homo sapiens
gttaatattgatttattaata

SEQ ID NO: 2404116 - DNA, 19 bp, Homo sapiens
gttattatatttacaaatg

SEQ ID NO: 2404117 - DNA, 15 bp, Homo sapiens
gttcattcctccagg

SEQ ID NO: 2404118 - DNA, 19 bp, Homo sapiens
gttcccaccaggctgctca

SEQ ID NO: 2404119 - DNA, 17 bp, Homo sapiens
gttcccctttgcttcat

SEQ ID NO: 2404120 - DNA, 12 bp, Homo sapiens
gttcctgcatgc

SEQ ID NO: 2404121 - DNA, 14 bp, Homo sapiens
gttctgtagaaatg

SEQ ID NO: 2404122 - DNA, 16 bp, Homo sapiens
gttgcacagctatgaa

SEQ ID NO: 2404123 - DNA, 22 bp, Homo sapiens
gttgctaagccccagcaagcaa

SEQ ID NO: 2404124 - DNA, 13 bp, Homo sapiens
gttgctgaatagg

SEQ ID NO: 2404125 - DNA, 18 bp, Homo sapiens
gttgggactacaggcgtg

SEQ ID NO: 2404126 - DNA, 14 bp, Homo sapiens
gttgggcagccaga

SEQ ID NO: 2404127 - DNA, 21 bp, Homo sapiens
gttggggacacatgtatttgg

SEQ ID NO: 2404128 - DNA, 15 bp, Homo sapiens
gttgtattagatgtt

SEQ ID NO: 2404129 - DNA, 20 bp, Homo sapiens
gttgtcctccttccggggaa

SEQ ID NO: 2404130 - DNA, 22 bp, Homo sapiens
gttgtcctccttccggggaagg

SEQ ID NO: 2404131 - DNA, 19 bp, Homo sapiens
gtttaatccccagtaaaat

SEQ ID NO: 2404132 - DNA, 14 bp, Homo sapiens
gtttatttcttaaa

SEQ ID NO: 2404133 - DNA, 22 bp, Homo sapiens
gtttcaggagagagttgaacct

SEQ ID NO: 2404134 - DNA, 23 bp, Homo sapiens
gtttcaggagagagttgaaccta

SEQ ID NO: 2404135 - DNA, 16 bp, Homo sapiens
gtttcatccttttcat

SEQ ID NO: 2404136 - DNA, 16 bp, Homo sapiens
gtttccttatattatg

SEQ ID NO: 2404137 - DNA, 17 bp, Homo sapiens
gtttctgagttttacca

SEQ ID NO: 2404138 - DNA, 12 bp, Homo sapiens
gtttctttcttt

SEQ ID NO: 2404139 - DNA, 14 bp, Homo sapiens
gtttctttgtaatg

SEQ ID NO: 2404140 - DNA, 18 bp, Homo sapiens
gtttctttgtaatgaaaa

SEQ ID NO: 2404141 - DNA, 15 bp, Homo sapiens
gtttgaatgttaaat

SEQ ID NO: 2404142 - DNA, 17 bp, Homo sapiens
tttaattagtgctaagt

SEQ ID NO: 2404143 - DNA, 22 bp, Homo sapiens
tttaattagtgctaagtgtgaa

SEQ ID NO: 2404144 - DNA, 13 bp, Homo sapiens
tttaccagaaagc

SEQ ID NO: 2404145 - DNA, 15 bp, Homo sapiens
tttacttgtttcaga

SEQ ID NO: 2404146 - DNA, 17 bp, Homo sapiens
tttacttgtttcagagt

SEQ ID NO: 2404147 - DNA, 19 bp, Homo sapiens
tttagaaagcatttgaatg

SEQ ID NO: 2404148 - DNA, 22 bp, Homo sapiens
tttagaaagcatttgaatgcat

SEQ ID NO: 2404149 - DNA, 18 bp, Homo sapiens
tttagagttagactgttg

SEQ ID NO: 2404150 - DNA, 16 bp, Homo sapiens
tttagtatctttttat

SEQ ID NO: 2404151 - DNA, 20 bp, Homo sapiens
tttatgttactacatgcact

SEQ ID NO: 2404152 - DNA, 13 bp, Homo sapiens
tttattcaataaa

SEQ ID NO: 2404153 - DNA, 17 bp, Homo sapiens
tttattgtgtttgtcat

SEQ ID NO: 2404154 - DNA, 17 bp, Homo sapiens
tttatttttttctgaat

SEQ ID NO: 2404155 - DNA, 15 bp, Homo sapiens
tttcagcagctgcag

SEQ ID NO: 2404156 - DNA, 19 bp, Homo sapiens
tttcagggaggtggctggg

SEQ ID NO: 2404157 - DNA, 16 bp, Homo sapiens
tttcatacattttcta

SEQ ID NO: 2404158 - DNA, 18 bp, Homo sapiens
tttcatataaatggaatt

SEQ ID NO: 2404159 - DNA, 11 bp, Homo sapiens
tttccctaagc

SEQ ID NO: 2404160 - DNA, 20 bp, Homo sapiens
tttccctaagccagctgccc

SEQ ID NO: 2404161 - DNA, 13 bp, Homo sapiens
tttccctccttgg

SEQ ID NO: 2404162 - DNA, 21 bp, Homo sapiens
tttcctagttctgtagaaatg

SEQ ID NO: 2404163 - DNA, 18 bp, Homo sapiens
tttcctcatttttataat

SEQ ID NO: 2404164 - DNA, 14 bp, Homo sapiens
tttctaaagtaaaa

SEQ ID NO: 2404165 - DNA, 21 bp, Homo sapiens
tttctccctggatttttacca

SEQ ID NO: 2404166 - DNA, 22 bp, Homo sapiens
tttctccctggatttttaccag

SEQ ID NO: 2404167 - DNA, 16 bp, Homo sapiens
tttctgagttttacca

SEQ ID NO: 2404168 - DNA, 18 bp, Homo sapiens
tttcttaaccagatcatt

SEQ ID NO: 2404169 - DNA, 14 bp, Homo sapiens
tttctttcaaaatt

SEQ ID NO: 2404170 - DNA, 19 bp, Homo sapiens
tttctttgggaatatttga

SEQ ID NO: 2404171 - DNA, 13 bp, Homo sapiens
tttcttttctttg

SEQ ID NO: 2404172 - DNA, 12 bp, Homo sapiens
tttgaatcttgt

SEQ ID NO: 2404173 - DNA, 13 bp, Homo sapiens
tttgaatgcattt

SEQ ID NO: 2404174 - DNA, 14 bp, Homo sapiens
tttgaatgcatttt

SEQ ID NO: 2404175 - DNA, 16 bp, Homo sapiens
tttgaatgcattttgt

SEQ ID NO: 2404176 - DNA, 16 bp, Homo sapiens
tttgaatgttaaataa

SEQ ID NO: 2404177 - DNA, 21 bp, Homo sapiens
tttgcagctgagagaaaataa

SEQ ID NO: 2404178 - DNA, 18 bp, Homo sapiens
tttgcataacgtataaaa

SEQ ID NO: 2404179 - DNA, 15 bp, Homo sapiens
tttgcatctgaaaat

SEQ ID NO: 2404180 - DNA, 21 bp, Homo sapiens
tttgccctgctgccctccccc

SEQ ID NO: 2404181 - DNA, 17 bp, Homo sapiens
tttgctgaccctcccca

SEQ ID NO: 2404182 - DNA, 10 bp, Homo sapiens
tttggatgcc

SEQ ID NO: 2404183 - DNA, 14 bp, Homo sapiens
tttggtattgtatt

SEQ ID NO: 2404184 - DNA, 15 bp, Homo sapiens
tttggtcaacactaa

SEQ ID NO: 2404185 - DNA, 18 bp, Homo sapiens
tttggtgattacatttta

SEQ ID NO: 2404186 - DNA, 13 bp, Homo sapiens
tttggtttctagc

SEQ ID NO: 2404187 - DNA, 12 bp, Homo sapiens
tttgtataaaag

SEQ ID NO: 2404188 - DNA, 17 bp, Homo sapiens
tttgtattttgtttaaa

SEQ ID NO: 2404189 - DNA, 23 bp, Homo sapiens
tttgtcattagcctgagtagaaa

SEQ ID NO: 2404190 - DNA, 16 bp, Homo sapiens
tttgtttggtattgta

SEQ ID NO: 2404191 - DNA, 22 bp, Homo sapiens
ttttaaaaattaaatcaacctt

SEQ ID NO: 2404192 - DNA, 14 bp, Homo sapiens
ttttaaaatccact

SEQ ID NO: 2404193 - DNA, 23 bp, Homo sapiens
ttttaaaatccactttatcttga

SEQ ID NO: 2404194 - DNA, 13 bp, Homo sapiens
ttttaacattcct

SEQ ID NO: 2404195 - DNA, 20 bp, Homo sapiens
ttttaatttctgcaaatgta

SEQ ID NO: 2404196 - DNA, 13 bp, Homo sapiens
ttttaccaagttt

SEQ ID NO: 2404197 - DNA, 16 bp, Homo sapiens
ttttagaaagcatttg

SEQ ID NO: 2404198 - DNA, 18 bp, Homo sapiens
ttttagaaagcatttgaa

SEQ ID NO: 2404199 - DNA, 20 bp, Homo sapiens
ttttatgatacttgaaaatt

SEQ ID NO: 2404200 - DNA, 22 bp, Homo sapiens
ttttatgttgcatagaataaaa

SEQ ID NO: 2404201 - DNA, 22 bp, Homo sapiens
ttttattaataaacattctatc

SEQ ID NO: 2404202 - DNA, 21 bp, Homo sapiens
ttttattcagctcatggactt

SEQ ID NO: 2404203 - DNA, 14 bp, Homo sapiens
ttttattttgccaa

SEQ ID NO: 2404204 - DNA, 21 bp, Homo sapiens
ttttcaaaattgttacaaatt

SEQ ID NO: 2404205 - DNA, 18 bp, Homo sapiens
ttttcatacattttctaa

SEQ ID NO: 2404206 - DNA, 13 bp, Homo sapiens
ttttcctaagtga

SEQ ID NO: 2404207 - DNA, 16 bp, Homo sapiens
ttttctataatttaaa

SEQ ID NO: 2404208 - DNA, 16 bp, Homo sapiens
ttttggatgcagtgct

SEQ ID NO: 2404209 - DNA, 19 bp, Homo sapiens
ttttgtttggtattgtatt

SEQ ID NO: 2404210 - DNA, 22 bp, Homo sapiens
ttttgtttggtattgtatttat

SEQ ID NO: 2404211 - DNA, 13 bp, Homo sapiens
tttttaatcttta

SEQ ID NO: 2404212 - DNA, 20 bp, Homo sapiens
tttttagaaagcatttgaat

SEQ ID NO: 2404213 - DNA, 16 bp, Homo sapiens
tttttgagacagagtc

SEQ ID NO: 2404214 - DNA, 18 bp, Homo sapiens
ttagagttagactgttgg

SEQ ID NO: 2404215 - DNA, 23 bp, Homo sapiens
ttagatgttctctatcatttaat

SEQ ID NO: 2404216 - DNA, 22 bp, Homo sapiens
ttagcaaagatatctcatctct

SEQ ID NO: 2404217 - DNA, 17 bp, Homo sapiens
ttagcctgagtagaaag

SEQ ID NO: 2404218 - DNA, 14 bp, Homo sapiens
ttagccttctctgt

SEQ ID NO: 2404219 - DNA, 14 bp, Homo sapiens
ttaggcctctgaga

SEQ ID NO: 2404220 - DNA, 16 bp, Homo sapiens
ttagtcgtgagctctt

SEQ ID NO: 2404221 - DNA, 21 bp, Homo sapiens
ttagtgctaagtgtgaactgg

SEQ ID NO: 2404222 - DNA, 15 bp, Homo sapiens
ttataaaaataaaaa

SEQ ID NO: 2404223 - DNA, 12 bp, Homo sapiens
ttataaactttt

SEQ ID NO: 2404224 - DNA, 15 bp, Homo sapiens
ttatagttgtaacta

SEQ ID NO: 2404225 - DNA, 17 bp, Homo sapiens
ttatattgataagatct

SEQ ID NO: 2404226 - DNA, 20 bp, Homo sapiens
ttatcatgtgaaatcattca

SEQ ID NO: 2404227 - DNA, 17 bp, Homo sapiens
ttatcctctttagagtt

SEQ ID NO: 2404228 - DNA, 18 bp, Homo sapiens
ttatctaatcatgaaact

SEQ ID NO: 2404229 - DNA, 18 bp, Homo sapiens
ttatctgagtcaactcct

SEQ ID NO: 2404230 - DNA, 16 bp, Homo sapiens
ttatcttaaaactcct

SEQ ID NO: 2404231 - DNA, 16 bp, Homo sapiens
ttatcttgaataatgt

SEQ ID NO: 2404232 - DNA, 18 bp, Homo sapiens
ttatgagctcttcatgtt

SEQ ID NO: 2404233 - DNA, 11 bp, Homo sapiens
ttatgtagttt

SEQ ID NO: 2404234 - DNA, 21 bp, Homo sapiens
ttatgtagtttttatatgttg

SEQ ID NO: 2404235 - DNA, 11 bp, Homo sapiens
ttatgttaaac

SEQ ID NO: 2404236 - DNA, 14 bp, Homo sapiens
ttattaataaacat

SEQ ID NO: 2404237 - DNA, 12 bp, Homo sapiens
ttattaatttga

SEQ ID NO: 2404238 - DNA, 14 bp, Homo sapiens
ttattatatttaca

SEQ ID NO: 2404239 - DNA, 14 bp, Homo sapiens
ttattcaataaagt

SEQ ID NO: 2404240 - DNA, 22 bp, Homo sapiens
ttattgtgtttgtcattagcct

SEQ ID NO: 2404241 - DNA, 21 bp, Homo sapiens
ttatttcctagttctgtagaa

SEQ ID NO: 2404242 - DNA, 18 bp, Homo sapiens
ttatttttacattctgaa

SEQ ID NO: 2404243 - DNA, 13 bp, Homo sapiens
ttatttttttctg

SEQ ID NO: 2404244 - DNA, 16 bp, Homo sapiens
ttcaaaattgttacaa

SEQ ID NO: 2404245 - DNA, 21 bp, Homo sapiens
ttcaaaattgttacaaattgt

SEQ ID NO: 2404246 - DNA, 14 bp, Homo sapiens
ttcaagcaatcctc

SEQ ID NO: 2404247 - DNA, 16 bp, Homo sapiens
ttcaagcaatcctccc

SEQ ID NO: 2404248 - DNA, 18 bp, Homo sapiens
ttcaagtgcttctccagc

SEQ ID NO: 2404249 - DNA, 19 bp, Homo sapiens
ttcaatataagcttttctt

SEQ ID NO: 2404250 - DNA, 17 bp, Homo sapiens
ttcacatttttgtattt

SEQ ID NO: 2404251 - DNA, 22 bp, Homo sapiens
ttcagagcctcctttctggctt

SEQ ID NO: 2404252 - DNA, 23 bp, Homo sapiens
ttcagcactttagaatatgcctt

SEQ ID NO: 2404253 - DNA, 17 bp, Homo sapiens
ttcatgcaaactttatt

SEQ ID NO: 2404254 - DNA, 14 bp, Homo sapiens
ttcattcctccagg

SEQ ID NO: 2404255 - DNA, 21 bp, Homo sapiens
ttcattgccttaactggagcc

SEQ ID NO: 2404256 - DNA, 21 bp, Homo sapiens
ttcattttaacatctgagaaa

SEQ ID NO: 2404257 - DNA, 19 bp, Homo sapiens
ttccacgtactgcagcctc

SEQ ID NO: 2404258 - DNA, 14 bp, Homo sapiens
ttccagacctgaag

SEQ ID NO: 2404259 - DNA, 17 bp, Homo sapiens
ttccagacctgaagaat

SEQ ID NO: 2404260 - DNA, 12 bp, Homo sapiens
ttccagccatca

SEQ ID NO: 2404261 - DNA, 12 bp, Homo sapiens
ttccatctgatt

SEQ ID NO: 2404262 - DNA, 13 bp, Homo sapiens
ttcccaattgctt

SEQ ID NO: 2404263 - DNA, 12 bp, Homo sapiens
ttccctaagcca

SEQ ID NO: 2404264 - DNA, 13 bp, Homo sapiens
ttccctccttggt

SEQ ID NO: 2404265 - DNA, 15 bp, Homo sapiens
ttcccttgagccctc

SEQ ID NO: 2404266 - DNA, 20 bp, Homo sapiens
ttcctaggtataattcacat

SEQ ID NO: 2404267 - DNA, 15 bp, Homo sapiens
ttcctcatgaatgta

SEQ ID NO: 2404268 - DNA, 11 bp, Homo sapiens
ttcctctgccc

SEQ ID NO: 2404269 - DNA, 18 bp, Homo sapiens
ttcctctgtctcctaagc

SEQ ID NO: 2404270 - DNA, 16 bp, Homo sapiens
ttcctgggaacatcac

SEQ ID NO: 2404271 - DNA, 14 bp, Homo sapiens
ttccttcagcactt

SEQ ID NO: 2404272 - DNA, 12 bp, Homo sapiens
ttccttttactt

SEQ ID NO: 2404273 - DNA, 22 bp, Homo sapiens
ttccttttacttttcttctatt

SEQ ID NO: 2404274 - DNA, 18 bp, Homo sapiens
ttcggtgagctacaaatg

SEQ ID NO: 2404275 - DNA, 16 bp, Homo sapiens
ttctaagaaacattta

SEQ ID NO: 2404276 - DNA, 20 bp, Homo sapiens
ttctaagaaacatttatatt

SEQ ID NO: 2404277 - DNA, 23 bp, Homo sapiens
ttctaagaaacatttatattgat

SEQ ID NO: 2404278 - DNA, 18 bp, Homo sapiens
ttctacaaaatcctgatg

SEQ ID NO: 2404279 - DNA, 19 bp, Homo sapiens
ttctagcatgaagacagag

SEQ ID NO: 2404280 - DNA, 13 bp, Homo sapiens
ttctattgcctct

SEQ ID NO: 2404281 - DNA, 16 bp, Homo sapiens
ttctcccctgcactgt

SEQ ID NO: 2404282 - DNA, 19 bp, Homo sapiens
ttctcccctgcactgtaaa

SEQ ID NO: 2404283 - DNA, 21 bp, Homo sapiens
ttctcccctgcactgtaaaat

SEQ ID NO: 2404284 - DNA, 20 bp, Homo sapiens
ttctccctggatttttacca

SEQ ID NO: 2404285 - DNA, 13 bp, Homo sapiens
ttctcttgcctca

SEQ ID NO: 2404286 - DNA, 16 bp, Homo sapiens
ttctgagttttaccaa

SEQ ID NO: 2404287 - DNA, 21 bp, Homo sapiens
ttctgtagaaatggttgtatt

SEQ ID NO: 2404288 - DNA, 22 bp, Homo sapiens
ttctgtagaaatggttgtatta

SEQ ID NO: 2404289 - DNA, 22 bp, Homo sapiens
ttcttagaaatttatttcctag

SEQ ID NO: 2404290 - DNA, 18 bp, Homo sapiens
ttcttctattgcctctga

SEQ ID NO: 2404291 - DNA, 20 bp, Homo sapiens
ttcttctattgcctctgaga

SEQ ID NO: 2404292 - DNA, 17 bp, Homo sapiens
ttcttggccatgggagg

SEQ ID NO: 2404293 - DNA, 20 bp, Homo sapiens
ttctttgggaatatttgaat

SEQ ID NO: 2404294 - DNA, 17 bp, Homo sapiens
ttctttgtttctttctt

SEQ ID NO: 2404295 - DNA, 15 bp, Homo sapiens
ttgaaaaatgcatgt

SEQ ID NO: 2404296 - DNA, 21 bp, Homo sapiens
ttgaaggatgctgtcttcgta

SEQ ID NO: 2404297 - DNA, 17 bp, Homo sapiens
ttgaagggaaatttcag

SEQ ID NO: 2404298 - DNA, 22 bp, Homo sapiens
ttgaatcttgtctcaatgctca

SEQ ID NO: 2404299 - DNA, 17 bp, Homo sapiens
ttgatccagaaagaaaa

SEQ ID NO: 2404300 - DNA, 15 bp, Homo sapiens
ttgatgtaaaatctt

SEQ ID NO: 2404301 - DNA, 16 bp, Homo sapiens
ttgatgtaaaatcttg

SEQ ID NO: 2404302 - DNA, 21 bp, Homo sapiens
ttgatgtaaaatcttgtcatg

SEQ ID NO: 2404303 - DNA, 18 bp, Homo sapiens
ttgcagcgattaataaca

SEQ ID NO: 2404304 - DNA, 23 bp, Homo sapiens
ttgccaggctggagtgcagtggc

SEQ ID NO: 2404305 - DNA, 19 bp, Homo sapiens
ttgccagttgtcctccttc

SEQ ID NO: 2404306 - DNA, 15 bp, Homo sapiens
ttgccatattgcaca

SEQ ID NO: 2404307 - DNA, 22 bp, Homo sapiens
ttgccatattgcacatgtctta

SEQ ID NO: 2404308 - DNA, 18 bp, Homo sapiens
ttgcctctgagagcatca

SEQ ID NO: 2404309 - DNA, 14 bp, Homo sapiens
ttgcggctcctcag

SEQ ID NO: 2404310 - DNA, 14 bp, Homo sapiens
ttgctcttgatgcc

SEQ ID NO: 2404311 - DNA, 18 bp, Homo sapiens
ttgctgaataggcgatca

SEQ ID NO: 2404312 - DNA, 16 bp, Homo sapiens
ttgctgtaatgttaat

SEQ ID NO: 2404313 - DNA, 16 bp, Homo sapiens
ttgcttttaaaatcca

SEQ ID NO: 2404314 - DNA, 18 bp, Homo sapiens
ttggatcctgtgtggaga

SEQ ID NO: 2404315 - DNA, 23 bp, Homo sapiens
ttggatgcagtgctcgctgttgc

SEQ ID NO: 2404316 - DNA, 21 bp, Homo sapiens
ttggctttatcctctttagag

SEQ ID NO: 2404317 - DNA, 22 bp, Homo sapiens
ttggctttatcctctttagagt

SEQ ID NO: 2404318 - DNA, 14 bp, Homo sapiens
ttggtaaacctttt

SEQ ID NO: 2404319 - DNA, 21 bp, Homo sapiens
ttggtattgtatttattcaat

SEQ ID NO: 2404320 - DNA, 16 bp, Homo sapiens
ttggtgattccgcagt

SEQ ID NO: 2404321 - DNA, 12 bp, Homo sapiens
ttgtaatgaaaa

SEQ ID NO: 2404322 - DNA, 13 bp, Homo sapiens
ttgtactatttaa

SEQ ID NO: 2404323 - DNA, 19 bp, Homo sapiens
ttgtactatttaactgact

SEQ ID NO: 2404324 - DNA, 18 bp, Homo sapiens
ttgtactttagggaagta

SEQ ID NO: 2404325 - DNA, 20 bp, Homo sapiens
ttgtataccttgtaatttga

SEQ ID NO: 2404326 - DNA, 14 bp, Homo sapiens
ttgtatattcactt

SEQ ID NO: 2404327 - DNA, 16 bp, Homo sapiens
ttgtattagatgttct

SEQ ID NO: 2404328 - DNA, 15 bp, Homo sapiens
ttgtatttattcaat

SEQ ID NO: 2404329 - DNA, 16 bp, Homo sapiens
ttgtatttattcaata

SEQ ID NO: 2404330 - DNA, 22 bp, Homo sapiens
ttgtcatgtgtataaaaataaa

SEQ ID NO: 2404331 - DNA, 19 bp, Homo sapiens
ttgtcattagcctgagtag

SEQ ID NO: 2404332 - DNA, 21 bp, Homo sapiens
ttgtccaacccgaggcccgca

SEQ ID NO: 2404333 - DNA, 18 bp, Homo sapiens
ttgtctattacctgttag

SEQ ID NO: 2404334 - DNA, 16 bp, Homo sapiens
ttgtctcaatgctcat

SEQ ID NO: 2404335 - DNA, 17 bp, Homo sapiens
ttgtgaaggtggaaata

SEQ ID NO: 2404336 - DNA, 18 bp, Homo sapiens
ttgtgaaggtggaaataa

SEQ ID NO: 2404337 - DNA, 18 bp, Homo sapiens
ttgtgatgtgagttgcac

SEQ ID NO: 2404338 - DNA, 14 bp, Homo sapiens
ttgtgtttgtcatt

SEQ ID NO: 2404339 - DNA, 22 bp, Homo sapiens
ttgttagtttctgagttttacc

SEQ ID NO: 2404340 - DNA, 16 bp, Homo sapiens
ttgtttggtattgtat

SEQ ID NO: 2404341 - DNA, 12 bp, Homo sapiens
tttaaaatgtct

SEQ ID NO: 2404342 - DNA, 21 bp, Homo sapiens
tttaaatatatgctaagtctt

SEQ ID NO: 2404343 - DNA, 12 bp, Homo sapiens
tttaacattcct

SEQ ID NO: 2404344 - DNA, 23 bp, Homo sapiens
tttaacattcctcatgaatgtaa

SEQ ID NO: 2404345 - DNA, 14 bp, Homo sapiens
tttaataaacactc

SEQ ID NO: 2404346 - DNA, 15 bp, Homo sapiens
tttaatccccagtaa

SEQ ID NO: 2404347 - DNA, 14 bp, Homo sapiens
tttaatgagataat

SEQ ID NO: 2404348 - DNA, 15 bp, Homo sapiens
tggccatgggaggcc

SEQ ID NO: 2404349 - DNA, 20 bp, Homo sapiens
tggctggggcatggaaggca

SEQ ID NO: 2404350 - DNA, 21 bp, Homo sapiens
tggcttgagtttaaattgtaa

SEQ ID NO: 2404351 - DNA, 14 bp, Homo sapiens
tggctttaatgaat

SEQ ID NO: 2404352 - DNA, 16 bp, Homo sapiens
tggctttatcctcttt

SEQ ID NO: 2404353 - DNA, 15 bp, Homo sapiens
tggctttcagagcct

SEQ ID NO: 2404354 - DNA, 17 bp, Homo sapiens
tggctttcagagcctcc

SEQ ID NO: 2404355 - DNA, 16 bp, Homo sapiens
tgggaaaaatgtagga

SEQ ID NO: 2404356 - DNA, 15 bp, Homo sapiens
tgggagaaatgaaaa

SEQ ID NO: 2404357 - DNA, 15 bp, Homo sapiens
tgggaggatgtgaat

SEQ ID NO: 2404358 - DNA, 20 bp, Homo sapiens
tgggaggcctttccctaagc

SEQ ID NO: 2404359 - DNA, 19 bp, Homo sapiens
tgggattatgggtcacagg

SEQ ID NO: 2404360 - DNA, 21 bp, Homo sapiens
tgggattatgggtcacaggaa

SEQ ID NO: 2404361 - DNA, 16 bp, Homo sapiens
tgggatttggtcaaca

SEQ ID NO: 2404362 - DNA, 17 bp, Homo sapiens
tgggcagaaggccaaga

SEQ ID NO: 2404363 - DNA, 12 bp, Homo sapiens
tgggcagccaga

SEQ ID NO: 2404364 - DNA, 19 bp, Homo sapiens
tgggcccctgcctctctgc

SEQ ID NO: 2404365 - DNA, 14 bp, Homo sapiens
tggggaagacagtg

SEQ ID NO: 2404366 - DNA, 18 bp, Homo sapiens
tggggaagacagtggccc

SEQ ID NO: 2404367 - DNA, 21 bp, Homo sapiens
tggggccaggctgggtcgccc

SEQ ID NO: 2404368 - DNA, 22 bp, Homo sapiens
tggggccaggctgggtcgccct

SEQ ID NO: 2404369 - DNA, 14 bp, Homo sapiens
tgggggacttacat

SEQ ID NO: 2404370 - DNA, 13 bp, Homo sapiens
tggggtctgtaaa

SEQ ID NO: 2404371 - DNA, 15 bp, Homo sapiens
tggggtgggtataaa

SEQ ID NO: 2404372 - DNA, 17 bp, Homo sapiens
tgggtagtggggaagag

SEQ ID NO: 2404373 - DNA, 14 bp, Homo sapiens
tgggtataaaagat

SEQ ID NO: 2404374 - DNA, 21 bp, Homo sapiens
tgggtatcaccactggagatc

SEQ ID NO: 2404375 - DNA, 12 bp, Homo sapiens
tgggtcacagga

SEQ ID NO: 2404376 - DNA, 21 bp, Homo sapiens
tgggtcgccctggactgtgtg

SEQ ID NO: 2404377 - DNA, 18 bp, Homo sapiens
tggtacatggtgtttgtg

SEQ ID NO: 2404378 - DNA, 14 bp, Homo sapiens
tggtattgtattta

SEQ ID NO: 2404379 - DNA, 18 bp, Homo sapiens
tggtattgtatttattca

SEQ ID NO: 2404380 - DNA, 22 bp, Homo sapiens
tggtattgtatttattcaataa

SEQ ID NO: 2404381 - DNA, 22 bp, Homo sapiens
tggtccatgggccatatgaaaa

SEQ ID NO: 2404382 - DNA, 16 bp, Homo sapiens
tggtctggttgggcag

SEQ ID NO: 2404383 - DNA, 17 bp, Homo sapiens
tggtctggttgggcagc

SEQ ID NO: 2404384 - DNA, 22 bp, Homo sapiens
tggtgatttagcaggaagctgt

SEQ ID NO: 2404385 - DNA, 20 bp, Homo sapiens
tggtgttgccagttgtcctc

SEQ ID NO: 2404386 - DNA, 13 bp, Homo sapiens
tggttagaaaagt

SEQ ID NO: 2404387 - DNA, 20 bp, Homo sapiens
tggttgtacatataagtgat

SEQ ID NO: 2404388 - DNA, 16 bp, Homo sapiens
tggttgtattagatgt

SEQ ID NO: 2404389 - DNA, 22 bp, Homo sapiens
tgtaaaatcttgtcatgtgtat

SEQ ID NO: 2404390 - DNA, 13 bp, Homo sapiens
tgtaaatttgtac

SEQ ID NO: 2404391 - DNA, 14 bp, Homo sapiens
tgtaaatttgtact

SEQ ID NO: 2404392 - DNA, 19 bp, Homo sapiens
tgtaactatagtccagctt

SEQ ID NO: 2404393 - DNA, 22 bp, Homo sapiens
tgtaagacccttattgctgtcc

SEQ ID NO: 2404394 - DNA, 15 bp, Homo sapiens
tgtaaggcaatcatg

SEQ ID NO: 2404395 - DNA, 11 bp, Homo sapiens
tgtaatgaaaa

SEQ ID NO: 2404396 - DNA, 12 bp, Homo sapiens
tgtaatgaaaac

SEQ ID NO: 2404397 - DNA, 13 bp, Homo sapiens
tgtaatgaaaacc

SEQ ID NO: 2404398 - DNA, 15 bp, Homo sapiens
tgtacttgctcttga

SEQ ID NO: 2404399 - DNA, 21 bp, Homo sapiens
tgtagaaatggttgtattaga

SEQ ID NO: 2404400 - DNA, 14 bp, Homo sapiens
tgtataaaatcagc

SEQ ID NO: 2404401 - DNA, 14 bp, Homo sapiens
tgtatattcacttt

SEQ ID NO: 2404402 - DNA, 18 bp, Homo sapiens
tgtatctatgcattttct

SEQ ID NO: 2404403 - DNA, 15 bp, Homo sapiens
tgtcaatctgtccgt

SEQ ID NO: 2404404 - DNA, 11 bp, Homo sapiens
tgtcatgtgta

SEQ ID NO: 2404405 - DNA, 21 bp, Homo sapiens
tgtcattagcctgagtagaaa

SEQ ID NO: 2404406 - DNA, 20 bp, Homo sapiens
tgtccagccccgtagacgtg

SEQ ID NO: 2404407 - DNA, 15 bp, Homo sapiens
tgtccgactcttctg

SEQ ID NO: 2404408 - DNA, 17 bp, Homo sapiens
tgtcctgacctgtctca

SEQ ID NO: 2404409 - DNA, 20 bp, Homo sapiens
tgtctatggatttgccttct

SEQ ID NO: 2404410 - DNA, 18 bp, Homo sapiens
tgtctattacctgttagt

SEQ ID NO: 2404411 - DNA, 20 bp, Homo sapiens
tgtctatttttaatgtttgt

SEQ ID NO: 2404412 - DNA, 16 bp, Homo sapiens
tgtctcaatgctcata

SEQ ID NO: 2404413 - DNA, 19 bp, Homo sapiens
tgtgaactggaccctgttg

SEQ ID NO: 2404414 - DNA, 16 bp, Homo sapiens
tgtgaatcattttacc

SEQ ID NO: 2404415 - DNA, 22 bp, Homo sapiens
tgtgaggaaagtcattggcttt

SEQ ID NO: 2404416 - DNA, 13 bp, Homo sapiens
tgtgatataagtg

SEQ ID NO: 2404417 - DNA, 15 bp, Homo sapiens
tgtgcattctggatt

SEQ ID NO: 2404418 - DNA, 15 bp, Homo sapiens
tgtgctcaggagccc

SEQ ID NO: 2404419 - DNA, 16 bp, Homo sapiens
tgtgctcaggagccct

SEQ ID NO: 2404420 - DNA, 20 bp, Homo sapiens
tgtgctcaggagccctggga

SEQ ID NO: 2404421 - DNA, 14 bp, Homo sapiens
tgtgcttctttctt

SEQ ID NO: 2404422 - DNA, 15 bp, Homo sapiens
tgtggactaaaagat

SEQ ID NO: 2404423 - DNA, 19 bp, Homo sapiens
tgtggagagggaatgtgaa

SEQ ID NO: 2404424 - DNA, 21 bp, Homo sapiens
tgtggatcaaatccagcctgc

SEQ ID NO: 2404425 - DNA, 21 bp, Homo sapiens
tgtggtacaagcattctgtct

SEQ ID NO: 2404426 - DNA, 16 bp, Homo sapiens
tgtggtacatggtgtt

SEQ ID NO: 2404427 - DNA, 17 bp, Homo sapiens
tgtgtggctttcagagc

SEQ ID NO: 2404428 - DNA, 19 bp, Homo sapiens
tgtgtttgtcattagcctg

SEQ ID NO: 2404429 - DNA, 19 bp, Homo sapiens
tgttaaactagcatatctg

SEQ ID NO: 2404430 - DNA, 20 bp, Homo sapiens
tgttaaactagcatatctgc

SEQ ID NO: 2404431 - DNA, 13 bp, Homo sapiens
tgttaaataaatt

SEQ ID NO: 2404432 - DNA, 14 bp, Homo sapiens
tgttaaataaattg

SEQ ID NO: 2404433 - DNA, 17 bp, Homo sapiens
tgttacaaattgtagaa

SEQ ID NO: 2404434 - DNA, 23 bp, Homo sapiens
tgttagtttctgagttttaccaa

SEQ ID NO: 2404435 - DNA, 15 bp, Homo sapiens
tgttatataatcatt

SEQ ID NO: 2404436 - DNA, 16 bp, Homo sapiens
tgttatataatcatta

SEQ ID NO: 2404437 - DNA, 21 bp, Homo sapiens
tgttcaagcgattctcctgcc

SEQ ID NO: 2404438 - DNA, 13 bp, Homo sapiens
tgttcataaataa

SEQ ID NO: 2404439 - DNA, 17 bp, Homo sapiens
tgttcataaataaagtt

SEQ ID NO: 2404440 - DNA, 13 bp, Homo sapiens
tgttcatttcctc

SEQ ID NO: 2404441 - DNA, 22 bp, Homo sapiens
tgttcccctttgcttcattcaa

SEQ ID NO: 2404442 - DNA, 15 bp, Homo sapiens
tgttgcatagaataa

SEQ ID NO: 2404443 - DNA, 18 bp, Homo sapiens
tgttgccagttgtcctcc

SEQ ID NO: 2404444 - DNA, 21 bp, Homo sapiens
tgttgctaagccccagcaagc

SEQ ID NO: 2404445 - DNA, 13 bp, Homo sapiens
tgttgctgaatag

SEQ ID NO: 2404446 - DNA, 14 bp, Homo sapiens
tgttgctgaatagg

SEQ ID NO: 2404447 - DNA, 14 bp, Homo sapiens
tgttggctagcctc

SEQ ID NO: 2404448 - DNA, 12 bp, Homo sapiens
tgtttaagagac

SEQ ID NO: 2404449 - DNA, 19 bp, Homo sapiens
tgtttagtaaactcaataa

SEQ ID NO: 2404450 - DNA, 17 bp, Homo sapiens
tgtttagtaatcatatt

SEQ ID NO: 2404451 - DNA, 21 bp, Homo sapiens
tgtttgacgggaaacaaaact

SEQ ID NO: 2404452 - DNA, 20 bp, Homo sapiens
tgtttgctcagcttctccaa

SEQ ID NO: 2404453 - DNA, 16 bp, Homo sapiens
tgtttggtattgtatt

SEQ ID NO: 2404454 - DNA, 18 bp, Homo sapiens
tgtttttttttaaagact

SEQ ID NO: 2404455 - DNA, 12 bp, Homo sapiens
ttaaaactcctg

SEQ ID NO: 2404456 - DNA, 12 bp, Homo sapiens
ttaaaatgagaa

SEQ ID NO: 2404457 - DNA, 14 bp, Homo sapiens
ttaaagctgttatt

SEQ ID NO: 2404458 - DNA, 15 bp, Homo sapiens
ttaaataaattgtat

SEQ ID NO: 2404459 - DNA, 17 bp, Homo sapiens
ttaaataaattgtatat

SEQ ID NO: 2404460 - DNA, 17 bp, Homo sapiens
ttaataaacactcttga

SEQ ID NO: 2404461 - DNA, 14 bp, Homo sapiens
ttaataatatactt

SEQ ID NO: 2404462 - DNA, 21 bp, Homo sapiens
ttaataatatacttgtggact

SEQ ID NO: 2404463 - DNA, 15 bp, Homo sapiens
ttaataccacagctt

SEQ ID NO: 2404464 - DNA, 13 bp, Homo sapiens
ttaatctttaatt

SEQ ID NO: 2404465 - DNA, 14 bp, Homo sapiens
ttaatgaagtttga

SEQ ID NO: 2404466 - DNA, 15 bp, Homo sapiens
ttaatgaagtttgaa

SEQ ID NO: 2404467 - DNA, 17 bp, Homo sapiens
ttaatgaagtttgaatg

SEQ ID NO: 2404468 - DNA, 18 bp, Homo sapiens
ttaatgaagtttgaatgt

SEQ ID NO: 2404469 - DNA, 23 bp, Homo sapiens
ttaatgaagtttgaatgttaaat

SEQ ID NO: 2404470 - DNA, 16 bp, Homo sapiens
ttaattagtgctaagt

SEQ ID NO: 2404471 - DNA, 16 bp, Homo sapiens
ttacatgattcatttt

SEQ ID NO: 2404472 - DNA, 17 bp, Homo sapiens
ttacatgattcatttta

SEQ ID NO: 2404473 - DNA, 21 bp, Homo sapiens
ttaccagatttttacacatgt

SEQ ID NO: 2404474 - DNA, 24 bp, Homo sapiens
ttaccagatttttacacatgtatc

SEQ ID NO: 2404475 - DNA, 15 bp, Homo sapiens
ttaccttattgcact

SEQ ID NO: 2404476 - DNA, 13 bp, Homo sapiens
ttactacatgcac

SEQ ID NO: 2404477 - DNA, 22 bp, Homo sapiens
ttacttcgtgtccgactcttct

SEQ ID NO: 2404478 - DNA, 14 bp, Homo sapiens
ttacttgacctcct

SEQ ID NO: 2404479 - DNA, 14 bp, Homo sapiens
ttacttttgctgta

SEQ ID NO: 2404480 - DNA, 21 bp, Homo sapiens
ttagaaagcatttgaatgcat

SEQ ID NO: 2404481 - DNA, 17 bp, Homo sapiens
ttagaaatttatttcct

SEQ ID NO: 2404482 - DNA, 17 bp, Homo sapiens
ttagagttagactgttg

SEQ ID NO: 2404483 - DNA, 16 bp, Homo sapiens
tgaagctgttgtgtga

SEQ ID NO: 2404484 - DNA, 14 bp, Homo sapiens
tgaaggctgtacac

SEQ ID NO: 2404485 - DNA, 12 bp, Homo sapiens
tgaagtttgaat

SEQ ID NO: 2404486 - DNA, 18 bp, Homo sapiens
tgaataggcgatcacaac

SEQ ID NO: 2404487 - DNA, 19 bp, Homo sapiens
tgaatcttgtctcaatgct

SEQ ID NO: 2404488 - DNA, 21 bp, Homo sapiens
tgaatcttgtctcaatgctca

SEQ ID NO: 2404489 - DNA, 15 bp, Homo sapiens
tgaatgcattttgtt

SEQ ID NO: 2404490 - DNA, 22 bp, Homo sapiens
tgaatgtaaatttgtactattt

SEQ ID NO: 2404491 - DNA, 16 bp, Homo sapiens
tgaatgttaaataaat

SEQ ID NO: 2404492 - DNA, 21 bp, Homo sapiens
tgaatgttaaataaattgtat

SEQ ID NO: 2404493 - DNA, 16 bp, Homo sapiens
tgaattattttctctc

SEQ ID NO: 2404494 - DNA, 21 bp, Homo sapiens
tgaatttgtgaaggtggaaat

SEQ ID NO: 2404495 - DNA, 23 bp, Homo sapiens
tgaatttgtgaaggtggaaataa

SEQ ID NO: 2404496 - DNA, 15 bp, Homo sapiens
tgaattttttttaac

SEQ ID NO: 2404497 - DNA, 19 bp, Homo sapiens
tgaattttttttaacattc

SEQ ID NO: 2404498 - DNA, 19 bp, Homo sapiens
tgacctgccaggcacactg

SEQ ID NO: 2404499 - DNA, 19 bp, Homo sapiens
tgactattcttgatgtaaa

SEQ ID NO: 2404500 - DNA, 14 bp, Homo sapiens
tgactcttggcaca

SEQ ID NO: 2404501 - DNA, 13 bp, Homo sapiens
tgactgccaagcc

SEQ ID NO: 2404502 - DNA, 14 bp, Homo sapiens
tgactgccaagcca

SEQ ID NO: 2404503 - DNA, 17 bp, Homo sapiens
tgactgccaagccatgg

SEQ ID NO: 2404504 - DNA, 21 bp, Homo sapiens
tgagaaagtcttatttattca

SEQ ID NO: 2404505 - DNA, 17 bp, Homo sapiens
tgagaaatttataaact

SEQ ID NO: 2404506 - DNA, 13 bp, Homo sapiens
tgagagaaaataa

SEQ ID NO: 2404507 - DNA, 15 bp, Homo sapiens
tgagagagtggctgg

SEQ ID NO: 2404508 - DNA, 21 bp, Homo sapiens
tgagagcagtttggtttctag

SEQ ID NO: 2404509 - DNA, 20 bp, Homo sapiens
tgagagccctgaggcctaga

SEQ ID NO: 2404510 - DNA, 18 bp, Homo sapiens
tgagatccttccttttga

SEQ ID NO: 2404511 - DNA, 18 bp, Homo sapiens
tgagatggagtcttgctc

SEQ ID NO: 2404512 - DNA, 23 bp, Homo sapiens
tgagatgtagcccctctcctgga

SEQ ID NO: 2404513 - DNA, 21 bp, Homo sapiens
tgagctaaataaagatattgt

SEQ ID NO: 2404514 - DNA, 16 bp, Homo sapiens
tgagctacaaatgcat

SEQ ID NO: 2404515 - DNA, 12 bp, Homo sapiens
tgagctcttcat

SEQ ID NO: 2404516 - DNA, 16 bp, Homo sapiens
tgagctcttcatgttt

SEQ ID NO: 2404517 - DNA, 18 bp, Homo sapiens
tgagctcttcatgtttca

SEQ ID NO: 2404518 - DNA, 18 bp, Homo sapiens
tgagctgaaggtgaaaca

SEQ ID NO: 2404519 - DNA, 18 bp, Homo sapiens
tgagctggacctcaccaa

SEQ ID NO: 2404520 - DNA, 19 bp, Homo sapiens
tgaggaaagcatgtattca

SEQ ID NO: 2404521 - DNA, 15 bp, Homo sapiens
tgaggaaagtcattg

SEQ ID NO: 2404522 - DNA, 18 bp, Homo sapiens
tgaggaaagtcattggct

SEQ ID NO: 2404523 - DNA, 19 bp, Homo sapiens
tgaggaaagtcattggctt

SEQ ID NO: 2404524 - DNA, 13 bp, Homo sapiens
tgaggatcagagt

SEQ ID NO: 2404525 - DNA, 17 bp, Homo sapiens
tgaggcacatgtcagca

SEQ ID NO: 2404526 - DNA, 13 bp, Homo sapiens
tgagttttaccaa

SEQ ID NO: 2404527 - DNA, 13 bp, Homo sapiens
tgatccccacgcc

SEQ ID NO: 2404528 - DNA, 19 bp, Homo sapiens
tgatccccacgccacagcc

SEQ ID NO: 2404529 - DNA, 15 bp, Homo sapiens
tgatgaaaataaaga

SEQ ID NO: 2404530 - DNA, 20 bp, Homo sapiens
tgatgatttagagtgctgtc

SEQ ID NO: 2404531 - DNA, 14 bp, Homo sapiens
tgatggttgtacat

SEQ ID NO: 2404532 - DNA, 11 bp, Homo sapiens
tgatgtaaaat

SEQ ID NO: 2404533 - DNA, 13 bp, Homo sapiens
tgattatatgtca

SEQ ID NO: 2404534 - DNA, 17 bp, Homo sapiens
tgattcattttaacatc

SEQ ID NO: 2404535 - DNA, 22 bp, Homo sapiens
tgatttatctgagtcaactcct

SEQ ID NO: 2404536 - DNA, 19 bp, Homo sapiens
tgatttatttgtttaaaaa

SEQ ID NO: 2404537 - DNA, 19 bp, Homo sapiens
tgattttaagaatccaaac

SEQ ID NO: 2404538 - DNA, 15 bp, Homo sapiens
tgattttagccttct

SEQ ID NO: 2404539 - DNA, 19 bp, Homo sapiens
tgattttagccttctctgt

SEQ ID NO: 2404540 - DNA, 18 bp, Homo sapiens
tgattttcacctgttata

SEQ ID NO: 2404541 - DNA, 20 bp, Homo sapiens
tgcaaatgtaattgatttat

SEQ ID NO: 2404542 - DNA, 13 bp, Homo sapiens
tgcaaggcaaaga

SEQ ID NO: 2404543 - DNA, 16 bp, Homo sapiens
tgcacatgtcttaatg

SEQ ID NO: 2404544 - DNA, 15 bp, Homo sapiens
tgcactgatgttgtg

SEQ ID NO: 2404545 - DNA, 14 bp, Homo sapiens
tgcagactcactgt

SEQ ID NO: 2404546 - DNA, 22 bp, Homo sapiens
tgcagctctccccttctctgta

SEQ ID NO: 2404547 - DNA, 11 bp, Homo sapiens
tgcaggtccct

SEQ ID NO: 2404548 - DNA, 17 bp, Homo sapiens
tgcaggtccctaataaa

SEQ ID NO: 2404549 - DNA, 18 bp, Homo sapiens
tgcaggtccctaataaag

SEQ ID NO: 2404550 - DNA, 17 bp, Homo sapiens
tgcagtactttgtgcat

SEQ ID NO: 2404551 - DNA, 15 bp, Homo sapiens
tgcagtatgaaaata

SEQ ID NO: 2404552 - DNA, 16 bp, Homo sapiens
tgcagtatgaaaataa

SEQ ID NO: 2404553 - DNA, 17 bp, Homo sapiens
tgcagtgctcgctgttg

SEQ ID NO: 2404554 - DNA, 22 bp, Homo sapiens
tgcagtgctcgctgttgctgaa

SEQ ID NO: 2404555 - DNA, 21 bp, Homo sapiens
tgcagttctttggctgaaagg

SEQ ID NO: 2404556 - DNA, 22 bp, Homo sapiens
tgcataacgtataaaagcctgt

SEQ ID NO: 2404557 - DNA, 15 bp, Homo sapiens
tgcataatggtcaga

SEQ ID NO: 2404558 - DNA, 17 bp, Homo sapiens
tgcatagaataaaattt

SEQ ID NO: 2404559 - DNA, 18 bp, Homo sapiens
tgcatccattctcctgag

SEQ ID NO: 2404560 - DNA, 19 bp, Homo sapiens
tgcatccattctcctgagg

SEQ ID NO: 2404561 - DNA, 17 bp, Homo sapiens
tgccaagggcataaatt

SEQ ID NO: 2404562 - DNA, 21 bp, Homo sapiens
tgccaagggcataaattattg

SEQ ID NO: 2404563 - DNA, 22 bp, Homo sapiens
tgccagttgtcctccttccggg

SEQ ID NO: 2404564 - DNA, 21 bp, Homo sapiens
tgccatattgcacatgtctta

SEQ ID NO: 2404565 - DNA, 17 bp, Homo sapiens
tgcccccagagccacag

SEQ ID NO: 2404566 - DNA, 18 bp, Homo sapiens
tgcccccagagccacagt

SEQ ID NO: 2404567 - DNA, 17 bp, Homo sapiens
tgccctgctgccctccc

SEQ ID NO: 2404568 - DNA, 14 bp, Homo sapiens
tgcctcaacctccc

SEQ ID NO: 2404569 - DNA, 14 bp, Homo sapiens
tgcctcacttcagg

SEQ ID NO: 2404570 - DNA, 22 bp, Homo sapiens
tgcctccctctcgtaagatttc

SEQ ID NO: 2404571 - DNA, 23 bp, Homo sapiens
tgcctccctctcgtaagatttcc

SEQ ID NO: 2404572 - DNA, 9 bp, Homo sapiens
tgcctctct

SEQ ID NO: 2404573 - DNA, 15 bp, Homo sapiens
tgcctctctgcaggt

SEQ ID NO: 2404574 - DNA, 20 bp, Homo sapiens
tgcctctctgcaggtcccta

SEQ ID NO: 2404575 - DNA, 12 bp, Homo sapiens
tgcctctgagag

SEQ ID NO: 2404576 - DNA, 18 bp, Homo sapiens
tgcctggaagagcagccc

SEQ ID NO: 2404577 - DNA, 15 bp, Homo sapiens
tgcctggcggggtgg

SEQ ID NO: 2404578 - DNA, 16 bp, Homo sapiens
tgccttaactggagcc

SEQ ID NO: 2404579 - DNA, 20 bp, Homo sapiens
tgccttgcataatggtcaga

SEQ ID NO: 2404580 - DNA, 13 bp, Homo sapiens
tgcggctcctcag

SEQ ID NO: 2404581 - DNA, 18 bp, Homo sapiens
tgctaagccccagcaagc

SEQ ID NO: 2404582 - DNA, 14 bp, Homo sapiens
tgctaagtgtgaac

SEQ ID NO: 2404583 - DNA, 22 bp, Homo sapiens
tgctatcgcaccactgtgtatt

SEQ ID NO: 2404584 - DNA, 13 bp, Homo sapiens
tgctcagccctgc

SEQ ID NO: 2404585 - DNA, 14 bp, Homo sapiens
tgctcaggagccct

SEQ ID NO: 2404586 - DNA, 18 bp, Homo sapiens
tgctcaggagccctggga

SEQ ID NO: 2404587 - DNA, 13 bp, Homo sapiens
tgctcgctgttgc

SEQ ID NO: 2404588 - DNA, 19 bp, Homo sapiens
tgctcgctgttgctgaata

SEQ ID NO: 2404589 - DNA, 14 bp, Homo sapiens
tgctctgatttatc

SEQ ID NO: 2404590 - DNA, 21 bp, Homo sapiens
tgctgaataggcgatcacaac

SEQ ID NO: 2404591 - DNA, 16 bp, Homo sapiens
tgctgatggagccttc

SEQ ID NO: 2404592 - DNA, 15 bp, Homo sapiens
tgctgcctgcttttt

SEQ ID NO: 2404593 - DNA, 15 bp, Homo sapiens
tgctgctggggaaga

SEQ ID NO: 2404594 - DNA, 20 bp, Homo sapiens
tgctgctggggaagacagtg

SEQ ID NO: 2404595 - DNA, 23 bp, Homo sapiens
tgctgctggggaagacagtggcc

SEQ ID NO: 2404596 - DNA, 19 bp, Homo sapiens
tgctgggcccctgcctctc

SEQ ID NO: 2404597 - DNA, 23 bp, Homo sapiens
tgctgggcccctgcctctctgca

SEQ ID NO: 2404598 - DNA, 13 bp, Homo sapiens
tgctgtataaaat

SEQ ID NO: 2404599 - DNA, 14 bp, Homo sapiens
tgctgtataaaatc

SEQ ID NO: 2404600 - DNA, 16 bp, Homo sapiens
tgctgtataaaatcag

SEQ ID NO: 2404601 - DNA, 18 bp, Homo sapiens
tgctgtccggtggagatc

SEQ ID NO: 2404602 - DNA, 21 bp, Homo sapiens
tgcttgagccaggaggcctgc

SEQ ID NO: 2404603 - DNA, 16 bp, Homo sapiens
tgcttgcataagagct

SEQ ID NO: 2404604 - DNA, 16 bp, Homo sapiens
tgctttttatggcctg

SEQ ID NO: 2404605 - DNA, 19 bp, Homo sapiens
tggaaagacagcttctcat

SEQ ID NO: 2404606 - DNA, 14 bp, Homo sapiens
tggaaagagtactc

SEQ ID NO: 2404607 - DNA, 20 bp, Homo sapiens
tggaaggcaagattgtgtcc

SEQ ID NO: 2404608 - DNA, 14 bp, Homo sapiens
tggaagtgctaatt

SEQ ID NO: 2404609 - DNA, 19 bp, Homo sapiens
tggaagtggggcgggcttc

SEQ ID NO: 2404610 - DNA, 14 bp, Homo sapiens
tggaatttgaaaca

SEQ ID NO: 2404611 - DNA, 14 bp, Homo sapiens
tggaccctgttgct

SEQ ID NO: 2404612 - DNA, 15 bp, Homo sapiens
tggacctcaccaagc

SEQ ID NO: 2404613 - DNA, 22 bp, Homo sapiens
tggactaaaagatataagtgct

SEQ ID NO: 2404614 - DNA, 16 bp, Homo sapiens
tggatcctgtgtggag

SEQ ID NO: 2404615 - DNA, 15 bp, Homo sapiens
tggatgaaaatgttc

SEQ ID NO: 2404616 - DNA, 14 bp, Homo sapiens
tggatgcagtgctc

SEQ ID NO: 2404617 - DNA, 15 bp, Homo sapiens
tggatgcagtgctcg

SEQ ID NO: 2404618 - DNA, 19 bp, Homo sapiens
acactcagatcctcctcat

SEQ ID NO: 2404619 - DNA, 20 bp, Homo sapiens
acactgggagaaatgaaaaa

SEQ ID NO: 2404620 - DNA, 19 bp, Homo sapiens
acagagtcttcctctgtct

SEQ ID NO: 2404621 - DNA, 19 bp, Homo sapiens
acagattttgatagcaaag

SEQ ID NO: 2404622 - DNA, 12 bp, Homo sapiens
acagcaagtcag

SEQ ID NO: 2404623 - DNA, 20 bp, Homo sapiens
acagcccaggatactggcac

SEQ ID NO: 2404624 - DNA, 15 bp, Homo sapiens
acagcttcagccagg

SEQ ID NO: 2404625 - DNA, 20 bp, Homo sapiens
acagcttctcatcctgcagg

SEQ ID NO: 2404626 - DNA, 12 bp, Homo sapiens
acaggaaaaagt

SEQ ID NO: 2404627 - DNA, 17 bp, Homo sapiens
acaggcacacaccacca

SEQ ID NO: 2404628 - DNA, 20 bp, Homo sapiens
acaggcgtgagccacctcgc

SEQ ID NO: 2404629 - DNA, 15 bp, Homo sapiens
acagggccacataga

SEQ ID NO: 2404630 - DNA, 14 bp, Homo sapiens
acaggtaaaacagg

SEQ ID NO: 2404631 - DNA, 16 bp, Homo sapiens
acaggtaaaacagggc

SEQ ID NO: 2404632 - DNA, 16 bp, Homo sapiens
acagtgggagccaggg

SEQ ID NO: 2404633 - DNA, 18 bp, Homo sapiens
acagttcccctatgtgga

SEQ ID NO: 2404634 - DNA, 19 bp, Homo sapiens
acagttcggtgagctacaa

SEQ ID NO: 2404635 - DNA, 22 bp, Homo sapiens
acagttcggtgagctacaaatg

SEQ ID NO: 2404636 - DNA, 23 bp, Homo sapiens
acagttcggtgagctacaaatgc

SEQ ID NO: 2404637 - DNA, 20 bp, Homo sapiens
acataagtatttaattcatg

SEQ ID NO: 2404638 - DNA, 21 bp, Homo sapiens
acatacacctatgtcatttca

SEQ ID NO: 2404639 - DNA, 22 bp, Homo sapiens
acatcatttctttttgggagag

SEQ ID NO: 2404640 - DNA, 19 bp, Homo sapiens
acatgaagctgttgtgtga

SEQ ID NO: 2404641 - DNA, 21 bp, Homo sapiens
acatgctgaacatcacagctt

SEQ ID NO: 2404642 - DNA, 17 bp, Homo sapiens
acattcctcatgaatgt

SEQ ID NO: 2404643 - DNA, 19 bp, Homo sapiens
acattcctcatgaatgtaa

SEQ ID NO: 2404644 - DNA, 21 bp, Homo sapiens
acattcctcatgaatgtaaat

SEQ ID NO: 2404645 - DNA, 21 bp, Homo sapiens
acatttgtagcatcctcttta

SEQ ID NO: 2404646 - DNA, 19 bp, Homo sapiens
acatttgttctatagcttt

SEQ ID NO: 2404647 - DNA, 19 bp, Homo sapiens
acattttctaagaaacatt

SEQ ID NO: 2404648 - DNA, 17 bp, Homo sapiens
acattttctccctggat

SEQ ID NO: 2404649 - DNA, 17 bp, Homo sapiens
accacaatgcagtgcct

SEQ ID NO: 2404650 - DNA, 24 bp, Homo sapiens
accacattggagatgtttagtaat

SEQ ID NO: 2404651 - DNA, 12 bp, Homo sapiens
accaccaagcct

SEQ ID NO: 2404652 - DNA, 14 bp, Homo sapiens
accaccaagccttg

SEQ ID NO: 2404653 - DNA, 24 bp, Homo sapiens
accagaaagcagttgagacaagaa

SEQ ID NO: 2404654 - DNA, 13 bp, Homo sapiens
accagatcattgt

SEQ ID NO: 2404655 - DNA, 16 bp, Homo sapiens
accatgctgctgggga

SEQ ID NO: 2404656 - DNA, 14 bp, Homo sapiens
accatgtacatagc

SEQ ID NO: 2404657 - DNA, 15 bp, Homo sapiens
accattgtctcagag

SEQ ID NO: 2404658 - DNA, 18 bp, Homo sapiens
accattgtctcagagcag

SEQ ID NO: 2404659 - DNA, 19 bp, Homo sapiens
accattgtctcagagcagg

SEQ ID NO: 2404660 - DNA, 22 bp, Homo sapiens
acccacactcagatcctcctca

SEQ ID NO: 2404661 - DNA, 18 bp, Homo sapiens
acccacaggcccacagta

SEQ ID NO: 2404662 - DNA, 19 bp, Homo sapiens
acccacttgcttttaaaat

SEQ ID NO: 2404663 - DNA, 14 bp, Homo sapiens
atcttttattttgc

SEQ ID NO: 2404664 - DNA, 14 bp, Homo sapiens
atgaaaataaagaa

SEQ ID NO: 2404665 - DNA, 16 bp, Homo sapiens
atgaagagatttttca

SEQ ID NO: 2404666 - DNA, 18 bp, Homo sapiens
atgaagcttttatgtgaa

SEQ ID NO: 2404667 - DNA, 19 bp, Homo sapiens
atgaagcttttatgtgaaa

SEQ ID NO: 2404668 - DNA, 20 bp, Homo sapiens
atgaagcttttatgtgaaac

SEQ ID NO: 2404669 - DNA, 20 bp, Homo sapiens
atgaagtttgaatgttaaat

SEQ ID NO: 2404670 - DNA, 16 bp, Homo sapiens
atgaatatttagtgtt

SEQ ID NO: 2404671 - DNA, 19 bp, Homo sapiens
atgaatgtaaatttgtact

SEQ ID NO: 2404672 - DNA, 23 bp, Homo sapiens
atgagaaatctaaaaaacgaaaa

SEQ ID NO: 2404673 - DNA, 14 bp, Homo sapiens
atgagaactctgag

SEQ ID NO: 2404674 - DNA, 17 bp, Homo sapiens
atgagagttttggatgc

SEQ ID NO: 2404675 - DNA, 16 bp, Homo sapiens
atgagatattaaacca

SEQ ID NO: 2404676 - DNA, 16 bp, Homo sapiens
atgagctcttcatgtt

SEQ ID NO: 2404677 - DNA, 13 bp, Homo sapiens
atgagggaaaaga

SEQ ID NO: 2404678 - DNA, 18 bp, Homo sapiens
atgatccccacgccacag

SEQ ID NO: 2404679 - DNA, 16 bp, Homo sapiens
atgatgggtgttttta

SEQ ID NO: 2404680 - DNA, 22 bp, Homo sapiens
atgcacaaattctgtctctgga

SEQ ID NO: 2404681 - DNA, 17 bp, Homo sapiens
atgcagtgctcgctgtt

SEQ ID NO: 2404682 - DNA, 20 bp, Homo sapiens
atgcagtgctcgctgttgct

SEQ ID NO: 2404683 - DNA, 21 bp, Homo sapiens
atgcagtgctcgctgttgctg

SEQ ID NO: 2404684 - DNA, 19 bp, Homo sapiens
atgcattttgtttggtatt

SEQ ID NO: 2404685 - DNA, 23 bp, Homo sapiens
atgcattttgtttggtattgtat

SEQ ID NO: 2404686 - DNA, 16 bp, Homo sapiens
atgcggcccaggatgg

SEQ ID NO: 2404687 - DNA, 20 bp, Homo sapiens
atgcggcccaggatggcttt

SEQ ID NO: 2404688 - DNA, 14 bp, Homo sapiens
atgctgctggggaa

SEQ ID NO: 2404689 - DNA, 20 bp, Homo sapiens
atgctgctggggaagacagt

SEQ ID NO: 2404690 - DNA, 21 bp, Homo sapiens
atgctgctggggaagacagtg

SEQ ID NO: 2404691 - DNA, 14 bp, Homo sapiens
atgctggtgagcca

SEQ ID NO: 2404692 - DNA, 17 bp, Homo sapiens
atgcttgcataagagct

SEQ ID NO: 2404693 - DNA, 12 bp, Homo sapiens
atggaggcctgt

SEQ ID NO: 2404694 - DNA, 15 bp, Homo sapiens
atggaggcctgtcct

SEQ ID NO: 2404695 - DNA, 15 bp, Homo sapiens
atggagtcttgctct

SEQ ID NO: 2404696 - DNA, 18 bp, Homo sapiens
atggataggcacaggaaa

SEQ ID NO: 2404697 - DNA, 14 bp, Homo sapiens
atggtgccttcatt

SEQ ID NO: 2404698 - DNA, 14 bp, Homo sapiens
atggttgtattaga

SEQ ID NO: 2404699 - DNA, 21 bp, Homo sapiens
atggttgtattagatgttctc

SEQ ID NO: 2404700 - DNA, 12 bp, Homo sapiens
atgtaaaatctt

SEQ ID NO: 2404701 - DNA, 21 bp, Homo sapiens
atgtaaaatcttgtcatgtgt

SEQ ID NO: 2404702 - DNA, 13 bp, Homo sapiens
atgtaaaattaca

SEQ ID NO: 2404703 - DNA, 19 bp, Homo sapiens
atgtaaagaacataaataa

SEQ ID NO: 2404704 - DNA, 16 bp, Homo sapiens
atgtaaagtgatattt

SEQ ID NO: 2404705 - DNA, 15 bp, Homo sapiens
atgtaaatttgtact

SEQ ID NO: 2404706 - DNA, 22 bp, Homo sapiens
atgtaggaaagaccatttttcc

SEQ ID NO: 2404707 - DNA, 20 bp, Homo sapiens
atgtagtttttatatgttgt

SEQ ID NO: 2404708 - DNA, 15 bp, Homo sapiens
atgtcatttcatttc

SEQ ID NO: 2404709 - DNA, 21 bp, Homo sapiens
atgtcttaatgaagtttgaat

SEQ ID NO: 2404710 - DNA, 17 bp, Homo sapiens
atgtgaaatcattcatt

SEQ ID NO: 2404711 - DNA, 13 bp, Homo sapiens
atgtgggattatg

SEQ ID NO: 2404712 - DNA, 18 bp, Homo sapiens
atgtgggattatgggtca

SEQ ID NO: 2404713 - DNA, 22 bp, Homo sapiens
atgtgtacaaaagtttcatcct

SEQ ID NO: 2404714 - DNA, 15 bp, Homo sapiens
atgtgtgttttaaaa

SEQ ID NO: 2404715 - DNA, 23 bp, Homo sapiens
atgttaaactagcatatctgcct

SEQ ID NO: 2404716 - DNA, 16 bp, Homo sapiens
atgttaaataaattgt

SEQ ID NO: 2404717 - DNA, 12 bp, Homo sapiens
atgttagccagg

SEQ ID NO: 2404718 - DNA, 20 bp, Homo sapiens
atgttctctatcatttaata

SEQ ID NO: 2404719 - DNA, 14 bp, Homo sapiens
atgtttagtaaact

SEQ ID NO: 2404720 - DNA, 18 bp, Homo sapiens
atgtttctttgtaatgaa

SEQ ID NO: 2404721 - DNA, 15 bp, Homo sapiens
attaagaaaatctat

SEQ ID NO: 2404722 - DNA, 21 bp, Homo sapiens
attaagatatgggacattttt

SEQ ID NO: 2404723 - DNA, 24 bp, Homo sapiens
attaagtctgtgagattcattcat

SEQ ID NO: 2404724 - DNA, 17 bp, Homo sapiens
attacaggcgtgagcca

SEQ ID NO: 2404725 - DNA, 15 bp, Homo sapiens
attactctgaaattg

SEQ ID NO: 2404726 - DNA, 14 bp, Homo sapiens
attagatgttctct

SEQ ID NO: 2404727 - DNA, 19 bp, Homo sapiens
attagatgttctctatcat

SEQ ID NO: 2404728 - DNA, 21 bp, Homo sapiens
attagatgttctctatcattt

SEQ ID NO: 2404729 - DNA, 19 bp, Homo sapiens
attagcatttgtcaacaaa

SEQ ID NO: 2404730 - DNA, 20 bp, Homo sapiens
attagtactcccctccttga

SEQ ID NO: 2404731 - DNA, 13 bp, Homo sapiens
attagtgctaagt

SEQ ID NO: 2404732 - DNA, 18 bp, Homo sapiens
attagtgctaagtgtgaa

SEQ ID NO: 2404733 - DNA, 20 bp, Homo sapiens
attatatggcttgagtttaa

SEQ ID NO: 2404734 - DNA, 16 bp, Homo sapiens
attatatttacaaatg

SEQ ID NO: 2404735 - DNA, 11 bp, Homo sapiens
attatgttaaa

SEQ ID NO: 2404736 - DNA, 14 bp, Homo sapiens
attatgttaaacta

SEQ ID NO: 2404737 - DNA, 23 bp, Homo sapiens
attatgttaaactagcatatctg

SEQ ID NO: 2404738 - DNA, 18 bp, Homo sapiens
attattgttgcattaaaa

SEQ ID NO: 2404739 - DNA, 21 bp, Homo sapiens
attcaataaagtatttaatta

SEQ ID NO: 2404740 - DNA, 17 bp, Homo sapiens
attcagagttgatggtt

SEQ ID NO: 2404741 - DNA, 16 bp, Homo sapiens
attcatattttctttc

SEQ ID NO: 2404742 - DNA, 24 bp, Homo sapiens
attcctagaaactgacacatgctg

SEQ ID NO: 2404743 - DNA, 18 bp, Homo sapiens
attcctcatgaatgtaaa

SEQ ID NO: 2404744 - DNA, 11 bp, Homo sapiens
attcctccagg

SEQ ID NO: 2404745 - DNA, 17 bp, Homo sapiens
attcgttatctaatagg

SEQ ID NO: 2404746 - DNA, 15 bp, Homo sapiens
attctcccttgctct

SEQ ID NO: 2404747 - DNA, 17 bp, Homo sapiens
attcttgatgtaaaatc

SEQ ID NO: 2404748 - DNA, 14 bp, Homo sapiens
attgagcttgcatg

SEQ ID NO: 2404749 - DNA, 18 bp, Homo sapiens
attgatccagaaagaaaa

SEQ ID NO: 2404750 - DNA, 12 bp, Homo sapiens
attgattttgaa

SEQ ID NO: 2404751 - DNA, 12 bp, Homo sapiens
attgatttttgg

SEQ ID NO: 2404752 - DNA, 16 bp, Homo sapiens
attgccatattgcaca

SEQ ID NO: 2404753 - DNA, 18 bp, Homo sapiens
attgccatattgcacatg

SEQ ID NO: 2404754 - DNA, 19 bp, Homo sapiens
attgccatattgcacatgt

SEQ ID NO: 2404755 - DNA, 14 bp, Homo sapiens
attgcttgcacaaa

SEQ ID NO: 2404756 - DNA, 19 bp, Homo sapiens
attggacagtaaaatccac

SEQ ID NO: 2404757 - DNA, 13 bp, Homo sapiens
attggtgttgcca

SEQ ID NO: 2404758 - DNA, 22 bp, Homo sapiens
attggtgttgccagttgtcctc

SEQ ID NO: 2404759 - DNA, 23 bp, Homo sapiens
attgtaataggcgtaactaattt

SEQ ID NO: 2404760 - DNA, 13 bp, Homo sapiens
attgtatattcac

SEQ ID NO: 2404761 - DNA, 15 bp, Homo sapiens
attgtattacaaatc

SEQ ID NO: 2404762 - DNA, 14 bp, Homo sapiens
attgtatttattca

SEQ ID NO: 2404763 - DNA, 19 bp, Homo sapiens
attgtatttattcaataaa

SEQ ID NO: 2404764 - DNA, 12 bp, Homo sapiens
attgtctcagag

SEQ ID NO: 2404765 - DNA, 14 bp, Homo sapiens
attgtctcagagca

SEQ ID NO: 2404766 - DNA, 13 bp, Homo sapiens
attgtgtttgtca

SEQ ID NO: 2404767 - DNA, 18 bp, Homo sapiens
attgtgtttgtcattagc

SEQ ID NO: 2404768 - DNA, 13 bp, Homo sapiens
atttaactgacta

SEQ ID NO: 2404769 - DNA, 13 bp, Homo sapiens
atttaataatata

SEQ ID NO: 2404770 - DNA, 15 bp, Homo sapiens
atttaataatatact

SEQ ID NO: 2404771 - DNA, 19 bp, Homo sapiens
atttacccttcttttctga

SEQ ID NO: 2404772 - DNA, 22 bp, Homo sapiens
atttataaaaataaaaaacact

SEQ ID NO: 2404773 - DNA, 21 bp, Homo sapiens
atttatattgataagatcttt

SEQ ID NO: 2404774 - DNA, 22 bp, Homo sapiens
atttatattgataagatctttt

SEQ ID NO: 2404775 - DNA, 20 bp, Homo sapiens
atttatgcctctgtatttaa

SEQ ID NO: 2404776 - DNA, 20 bp, Homo sapiens
atttattaatatatattatc

SEQ ID NO: 2404777 - DNA, 13 bp, Homo sapiens
atttattcaataa

SEQ ID NO: 2404778 - DNA, 14 bp, Homo sapiens
atttattcaataaa

SEQ ID NO: 2404779 - DNA, 17 bp, Homo sapiens
atttattcaataaagta

SEQ ID NO: 2404780 - DNA, 18 bp, Homo sapiens
atttattcaataaagtat

SEQ ID NO: 2404781 - DNA, 21 bp, Homo sapiens
atttattcaataaagtattta

SEQ ID NO: 2404782 - DNA, 22 bp, Homo sapiens
atttattcaataaagtatttaa

SEQ ID NO: 2404783 - DNA, 18 bp, Homo sapiens
atttatttcctagttctg

SEQ ID NO: 2404784 - DNA, 14 bp, Homo sapiens
atttcatgaaaatt

SEQ ID NO: 2404785 - DNA, 24 bp, Homo sapiens
atttcctcaacgttgctccccatc

SEQ ID NO: 2404786 - DNA, 20 bp, Homo sapiens
atttcctccgtcacctcaga

SEQ ID NO: 2404787 - DNA, 23 bp, Homo sapiens
atttctttttgggagagacttgt

SEQ ID NO: 2404788 - DNA, 20 bp, Homo sapiens
atttgaactttttattgatt

SEQ ID NO: 2404789 - DNA, 17 bp, Homo sapiens
atttgtactatttaact

SEQ ID NO: 2404790 - DNA, 18 bp, Homo sapiens
atttgtactatttaactg

SEQ ID NO: 2404791 - DNA, 20 bp, Homo sapiens
atttgtactatttaactgac

SEQ ID NO: 2404792 - DNA, 19 bp, Homo sapiens
atttgttctatagcttttc

SEQ ID NO: 2404793 - DNA, 16 bp, Homo sapiens
cgtataaaagcctgtt

SEQ ID NO: 2404794 - DNA, 22 bp, Homo sapiens
cgtataaaagcctgtttaagag

SEQ ID NO: 2404795 - DNA, 12 bp, Homo sapiens
cgtcacctcaga

SEQ ID NO: 2404796 - DNA, 17 bp, Homo sapiens
cgtctgtttataaacat

SEQ ID NO: 2404797 - DNA, 15 bp, Homo sapiens
cgtgagctcttgtga

SEQ ID NO: 2404798 - DNA, 13 bp, Homo sapiens
cgtgatccacccg

SEQ ID NO: 2404799 - DNA, 17 bp, Homo sapiens
cgtgatccacccgcctc

SEQ ID NO: 2404800 - DNA, 18 bp, Homo sapiens
cgtgcacgcacactgtct

SEQ ID NO: 2404801 - DNA, 22 bp, Homo sapiens
cgtggtgatttagcaggaagct

SEQ ID NO: 2404802 - DNA, 20 bp, Homo sapiens
cgttagtcgtgagctcttgt

SEQ ID NO: 2404803 - DNA, 16 bp, Homo sapiens
ctaaaagatataagtg

SEQ ID NO: 2404804 - DNA, 21 bp, Homo sapiens
ctaaaagatataagtgctgta

SEQ ID NO: 2404805 - DNA, 19 bp, Homo sapiens
ctaaaaggaaagaaaataa

SEQ ID NO: 2404806 - DNA, 19 bp, Homo sapiens
ctaacccaggtatccaaaa

SEQ ID NO: 2404807 - DNA, 15 bp, Homo sapiens
ctaagaaagaacacg

SEQ ID NO: 2404808 - DNA, 22 bp, Homo sapiens
ctaagaaagcccttaggaagaa

SEQ ID NO: 2404809 - DNA, 20 bp, Homo sapiens
ctaagcacgggccatatgaa

SEQ ID NO: 2404810 - DNA, 16 bp, Homo sapiens
ctaagccccagcaagc

SEQ ID NO: 2404811 - DNA, 23 bp, Homo sapiens
ctaagcgctagaggaagcagcca

SEQ ID NO: 2404812 - DNA, 21 bp, Homo sapiens
ctaagcttcactgtaaaataa

SEQ ID NO: 2404813 - DNA, 14 bp, Homo sapiens
ctaagtgtgaactg

SEQ ID NO: 2404814 - DNA, 15 bp, Homo sapiens
ctaatccccttctcc

SEQ ID NO: 2404815 - DNA, 16 bp, Homo sapiens
ctaatccccttctccc

SEQ ID NO: 2404816 - DNA, 16 bp, Homo sapiens
ctaatctactttctgt

SEQ ID NO: 2404817 - DNA, 22 bp, Homo sapiens
ctaatgacatcaccacagttta

SEQ ID NO: 2404818 - DNA, 18 bp, Homo sapiens
ctaattatataatatttt

SEQ ID NO: 2404819 - DNA, 22 bp, Homo sapiens
ctaattggcatgaaggtgtcat

SEQ ID NO: 2404820 - DNA, 23 bp, Homo sapiens
ctacacgagatacagaattttat

SEQ ID NO: 2404821 - DNA, 19 bp, Homo sapiens
ctacctgctcagccctgca

SEQ ID NO: 2404822 - DNA, 20 bp, Homo sapiens
ctactagggaaatgcctttg

SEQ ID NO: 2404823 - DNA, 22 bp, Homo sapiens
ctacttacatgcattactgcat

SEQ ID NO: 2404824 - DNA, 18 bp, Homo sapiens
ctagaggcttccttcatt

SEQ ID NO: 2404825 - DNA, 16 bp, Homo sapiens
ctagccaaaccaggac

SEQ ID NO: 2404826 - DNA, 20 bp, Homo sapiens
ctagccaaaccaggaccctg

SEQ ID NO: 2404827 - DNA, 13 bp, Homo sapiens
ctagctggctctg

SEQ ID NO: 2404828 - DNA, 12 bp, Homo sapiens
ctaggaaaatac

SEQ ID NO: 2404829 - DNA, 22 bp, Homo sapiens
ctaggtaaattacagttcctag

SEQ ID NO: 2404830 - DNA, 15 bp, Homo sapiens
ctaggtagggtttaa

SEQ ID NO: 2404831 - DNA, 13 bp, Homo sapiens
ctagtcataacct

SEQ ID NO: 2404832 - DNA, 20 bp, Homo sapiens
ctagtgtagaattgtgcaac

SEQ ID NO: 2404833 - DNA, 14 bp, Homo sapiens
ctagttctgtagaa

SEQ ID NO: 2404834 - DNA, 15 bp, Homo sapiens
ctagttctgtagaaa

SEQ ID NO: 2404835 - DNA, 17 bp, Homo sapiens
ctatcatttaataatat

SEQ ID NO: 2404836 - DNA, 17 bp, Homo sapiens
ctatcgtaaaattaaga

SEQ ID NO: 2404837 - DNA, 13 bp, Homo sapiens
ctatgaaggctgt

SEQ ID NO: 2404838 - DNA, 19 bp, Homo sapiens
ctatgggtctaggacacag

SEQ ID NO: 2404839 - DNA, 22 bp, Homo sapiens
ctatgtaggaaagaccattttt

SEQ ID NO: 2404840 - DNA, 16 bp, Homo sapiens
ctattatccccatttc

SEQ ID NO: 2404841 - DNA, 23 bp, Homo sapiens
ctattctagcctgcattgagctt

SEQ ID NO: 2404842 - DNA, 16 bp, Homo sapiens
ctattcttgatgtaaa

SEQ ID NO: 2404843 - DNA, 19 bp, Homo sapiens
ctattcttgatgtaaaatc

SEQ ID NO: 2404844 - DNA, 22 bp, Homo sapiens
ctattcttgatgtaaaatcttg

SEQ ID NO: 2404845 - DNA, 14 bp, Homo sapiens
ctattgcctctgag

SEQ ID NO: 2404846 - DNA, 17 bp, Homo sapiens
ctattgcctctgagagc

SEQ ID NO: 2404847 - DNA, 13 bp, Homo sapiens
ctatttaactgac

SEQ ID NO: 2404848 - DNA, 14 bp, Homo sapiens
ctcaaactcctgac

SEQ ID NO: 2404849 - DNA, 13 bp, Homo sapiens
ctcaagccctgca

SEQ ID NO: 2404850 - DNA, 17 bp, Homo sapiens
ctcaagctgcatctaga

SEQ ID NO: 2404851 - DNA, 13 bp, Homo sapiens
ctcacatttatat

SEQ ID NO: 2404852 - DNA, 17 bp, Homo sapiens
ctcaccatttggatcct

SEQ ID NO: 2404853 - DNA, 16 bp, Homo sapiens
ctcactgcttgaacta

SEQ ID NO: 2404854 - DNA, 14 bp, Homo sapiens
ctcagatcctcctc

SEQ ID NO: 2404855 - DNA, 15 bp, Homo sapiens
ctcagccctgcacca

SEQ ID NO: 2404856 - DNA, 17 bp, Homo sapiens
ctcaggagccctgggag

SEQ ID NO: 2404857 - DNA, 23 bp, Homo sapiens
ctcaggagccctgggaggctctg

SEQ ID NO: 2404858 - DNA, 22 bp, Homo sapiens
ctcaggatgagggaaaagaaaa

SEQ ID NO: 2404859 - DNA, 19 bp, Homo sapiens
ctcataacggatcagaaat

SEQ ID NO: 2404860 - DNA, 14 bp, Homo sapiens
ctcatagacactga

SEQ ID NO: 2404861 - DNA, 21 bp, Homo sapiens
ctcatatccagtattgttcct

SEQ ID NO: 2404862 - DNA, 21 bp, Homo sapiens
ctcatctaggtaaattacagt

SEQ ID NO: 2404863 - DNA, 14 bp, Homo sapiens
ctcatctttccctc

SEQ ID NO: 2404864 - DNA, 17 bp, Homo sapiens
ctcatctttccctcctt

SEQ ID NO: 2404865 - DNA, 19 bp, Homo sapiens
ctcatctttccctccttgg

SEQ ID NO: 2404866 - DNA, 20 bp, Homo sapiens
ctcatctttccctccttggt

SEQ ID NO: 2404867 - DNA, 21 bp, Homo sapiens
ctcatgaacctcaagctgcat

SEQ ID NO: 2404868 - DNA, 13 bp, Homo sapiens
ctcatgaatgtaa

SEQ ID NO: 2404869 - DNA, 14 bp, Homo sapiens
ctcatgaatgtaaa

SEQ ID NO: 2404870 - DNA, 16 bp, Homo sapiens
ctcatgcattgtcctc

SEQ ID NO: 2404871 - DNA, 18 bp, Homo sapiens
ctcattttaggcaaatat

SEQ ID NO: 2404872 - DNA, 12 bp, Homo sapiens
ctccaacaataa

SEQ ID NO: 2404873 - DNA, 18 bp, Homo sapiens
ctccacaccattcaggtc

SEQ ID NO: 2404874 - DNA, 22 bp, Homo sapiens
ctccaccatcgtcttcttggcc

SEQ ID NO: 2404875 - DNA, 17 bp, Homo sapiens
ctccagcctcagcctcc

SEQ ID NO: 2404876 - DNA, 23 bp, Homo sapiens
ctccaggtattcgttatctaata

SEQ ID NO: 2404877 - DNA, 20 bp, Homo sapiens
ctccccaaaggctttgccct

SEQ ID NO: 2404878 - DNA, 13 bp, Homo sapiens
ctcccctgcactg

SEQ ID NO: 2404879 - DNA, 17 bp, Homo sapiens
ctccctagttccttcat

SEQ ID NO: 2404880 - DNA, 23 bp, Homo sapiens
ctccgccattctcaagccctgca

SEQ ID NO: 2404881 - DNA, 14 bp, Homo sapiens
ctcctgacctcagg

SEQ ID NO: 2404882 - DNA, 15 bp, Homo sapiens
ctcctgacctcaggc

SEQ ID NO: 2404883 - DNA, 19 bp, Homo sapiens
ctcctgggttcaagcgatt

SEQ ID NO: 2404884 - DNA, 16 bp, Homo sapiens
ctcgctgttgctgaat

SEQ ID NO: 2404885 - DNA, 19 bp, Homo sapiens
ctctaatatgtaaaattac

SEQ ID NO: 2404886 - DNA, 23 bp, Homo sapiens
ctctatcatttaataatatactt

SEQ ID NO: 2404887 - DNA, 16 bp, Homo sapiens
ctctcaccatttggat

SEQ ID NO: 2404888 - DNA, 16 bp, Homo sapiens
ctctctgcaggtccct

SEQ ID NO: 2404889 - DNA, 21 bp, Homo sapiens
ctctctgtaataaactcattt

SEQ ID NO: 2404890 - DNA, 23 bp, Homo sapiens
ctctcttattgcctcacttcagg

SEQ ID NO: 2404891 - DNA, 19 bp, Homo sapiens
ctctgaatttgagatacaa

SEQ ID NO: 2404892 - DNA, 16 bp, Homo sapiens
ctctgagaagctctga

SEQ ID NO: 2404893 - DNA, 15 bp, Homo sapiens
ctctgcaaactgcct

SEQ ID NO: 2404894 - DNA, 13 bp, Homo sapiens
ctctgcaggtccc

SEQ ID NO: 2404895 - DNA, 15 bp, Homo sapiens
ctctgcaggtcccta

SEQ ID NO: 2404896 - DNA, 15 bp, Homo sapiens
ctctggagcccactg

SEQ ID NO: 2404897 - DNA, 18 bp, Homo sapiens
ctctgttcattcctccag

SEQ ID NO: 2404898 - DNA, 19 bp, Homo sapiens
ctctgttcattcctccagg

SEQ ID NO: 2404899 - DNA, 22 bp, Homo sapiens
ctcttattgcctcacttcaggt

SEQ ID NO: 2404900 - DNA, 13 bp, Homo sapiens
ctcttcctttctt

SEQ ID NO: 2404901 - DNA, 18 bp, Homo sapiens
ctcttgcctcaacctccc

SEQ ID NO: 2404902 - DNA, 15 bp, Homo sapiens
ctctttagagttaga

SEQ ID NO: 2404903 - DNA, 19 bp, Homo sapiens
ctctttagagttagactgt

SEQ ID NO: 2404904 - DNA, 22 bp, Homo sapiens
ctgaaaattgatgggatttggt

SEQ ID NO: 2404905 - DNA, 16 bp, Homo sapiens
ctgaaaggaagctgtg

SEQ ID NO: 2404906 - DNA, 22 bp, Homo sapiens
ctgaagctatcgtaaaattaag

SEQ ID NO: 2404907 - DNA, 23 bp, Homo sapiens
ctgaataggcgatcacaacgtgc

SEQ ID NO: 2404908 - DNA, 12 bp, Homo sapiens
ctgaattatttt

SEQ ID NO: 2404909 - DNA, 17 bp, Homo sapiens
ctgaccctatgggtcta

SEQ ID NO: 2404910 - DNA, 23 bp, Homo sapiens
ctgacgacttgagtgctcagtag

SEQ ID NO: 2404911 - DNA, 19 bp, Homo sapiens
ctgactattcttgatgtaa

SEQ ID NO: 2404912 - DNA, 14 bp, Homo sapiens
ctgactgccaagcc

SEQ ID NO: 2404913 - DNA, 15 bp, Homo sapiens
ctgactgccaagcca

SEQ ID NO: 2404914 - DNA, 22 bp, Homo sapiens
ctgagccagtgtcaggaggaag

SEQ ID NO: 2404915 - DNA, 19 bp, Homo sapiens
ctgaggatcagagtaatcc

SEQ ID NO: 2404916 - DNA, 19 bp, Homo sapiens
ctgaggcctagactctgtc

SEQ ID NO: 2404917 - DNA, 12 bp, Homo sapiens
ctgagtagaaag

SEQ ID NO: 2404918 - DNA, 14 bp, Homo sapiens
ctgagttcctgcat

SEQ ID NO: 2404919 - DNA, 15 bp, Homo sapiens
ctgatctggctgcag

SEQ ID NO: 2404920 - DNA, 12 bp, Homo sapiens
ctgatgaaaata

SEQ ID NO: 2404921 - DNA, 18 bp, Homo sapiens
ctgatgaaaataaagaat

SEQ ID NO: 2404922 - DNA, 21 bp, Homo sapiens
ctgatgatttagagtgctgtc

SEQ ID NO: 2404923 - DNA, 14 bp, Homo sapiens
gcctctgagagcat

SEQ ID NO: 2404924 - DNA, 14 bp, Homo sapiens
gcctgactgccaag

SEQ ID NO: 2404925 - DNA, 15 bp, Homo sapiens
gcctgactgccaagc

SEQ ID NO: 2404926 - DNA, 16 bp, Homo sapiens
gcctgactgccaagcc

SEQ ID NO: 2404927 - DNA, 20 bp, Homo sapiens
gcctgactgccaagccatgg

SEQ ID NO: 2404928 - DNA, 20 bp, Homo sapiens
gcctgagtgacagagcaaga

SEQ ID NO: 2404929 - DNA, 21 bp, Homo sapiens
gcctgcatccattctcctgag

SEQ ID NO: 2404930 - DNA, 22 bp, Homo sapiens
gcctgcccctaccctggacttg

SEQ ID NO: 2404931 - DNA, 22 bp, Homo sapiens
gcctgctttttatggcctgtga

SEQ ID NO: 2404932 - DNA, 15 bp, Homo sapiens
gcctgggtctcctaa

SEQ ID NO: 2404933 - DNA, 22 bp, Homo sapiens
gcctgggtgtaaaacctggaga

SEQ ID NO: 2404934 - DNA, 20 bp, Homo sapiens
gcctgtcctgacctgtctca

SEQ ID NO: 2404935 - DNA, 18 bp, Homo sapiens
gccttgcggctcctcagg

SEQ ID NO: 2404936 - DNA, 20 bp, Homo sapiens
gccttgcggctcctcaggga

SEQ ID NO: 2404937 - DNA, 12 bp, Homo sapiens
gccttgtgtaca

SEQ ID NO: 2404938 - DNA, 21 bp, Homo sapiens
gcctttaaaatttttttagaa

SEQ ID NO: 2404939 - DNA, 22 bp, Homo sapiens
gcctttattgtgtttgtcatta

SEQ ID NO: 2404940 - DNA, 23 bp, Homo sapiens
gcctttattgtgtttgtcattag

SEQ ID NO: 2404941 - DNA, 14 bp, Homo sapiens
gcgatctcagctca

SEQ ID NO: 2404942 - DNA, 18 bp, Homo sapiens
gcgattctcttgcctcaa

SEQ ID NO: 2404943 - DNA, 12 bp, Homo sapiens
gcggctcctcag

SEQ ID NO: 2404944 - DNA, 23 bp, Homo sapiens
gcggggatcagagcgcacaggga

SEQ ID NO: 2404945 - DNA, 15 bp, Homo sapiens
gcgtgatctcagctc

SEQ ID NO: 2404946 - DNA, 16 bp, Homo sapiens
gcgtgatctcagctca

SEQ ID NO: 2404947 - DNA, 21 bp, Homo sapiens
gctaggaattgtgtttataat

SEQ ID NO: 2404948 - DNA, 16 bp, Homo sapiens
gctcagccctgcacca

SEQ ID NO: 2404949 - DNA, 21 bp, Homo sapiens
gctcaggagccctgggaggct

SEQ ID NO: 2404950 - DNA, 18 bp, Homo sapiens
gctcatggacttctgcca

SEQ ID NO: 2404951 - DNA, 19 bp, Homo sapiens
gctcctcagggactcaggt

SEQ ID NO: 2404952 - DNA, 20 bp, Homo sapiens
gctcctcagggactcaggtg

SEQ ID NO: 2404953 - DNA, 13 bp, Homo sapiens
gctcgctgttgct

SEQ ID NO: 2404954 - DNA, 14 bp, Homo sapiens
gctcgctgttgctg

SEQ ID NO: 2404955 - DNA, 21 bp, Homo sapiens
gctcgctgttgctgaataggc

SEQ ID NO: 2404956 - DNA, 20 bp, Homo sapiens
gctctctccaggcaggtctg

SEQ ID NO: 2404957 - DNA, 23 bp, Homo sapiens
gctctggagcccactgtacttgc

SEQ ID NO: 2404958 - DNA, 14 bp, Homo sapiens
gctcttcatgtttc

SEQ ID NO: 2404959 - DNA, 17 bp, Homo sapiens
gctgatggagccttccc

SEQ ID NO: 2404960 - DNA, 17 bp, Homo sapiens
gctgcagttttgctatc

SEQ ID NO: 2404961 - DNA, 15 bp, Homo sapiens
gctgcccccagagcc

SEQ ID NO: 2404962 - DNA, 20 bp, Homo sapiens
gctgcctggaagagcagccc

SEQ ID NO: 2404963 - DNA, 13 bp, Homo sapiens
gctgctagagtga

SEQ ID NO: 2404964 - DNA, 19 bp, Homo sapiens
gctgctagagtgactcact

SEQ ID NO: 2404965 - DNA, 20 bp, Homo sapiens
gctgctggggaagacagtgg

SEQ ID NO: 2404966 - DNA, 21 bp, Homo sapiens
gctgctggggaagacagtggc

SEQ ID NO: 2404967 - DNA, 12 bp, Homo sapiens
gctggagtgcag

SEQ ID NO: 2404968 - DNA, 14 bp, Homo sapiens
gctggagtgcagtg

SEQ ID NO: 2404969 - DNA, 20 bp, Homo sapiens
gctgggcccctgcctctctg

SEQ ID NO: 2404970 - DNA, 22 bp, Homo sapiens
gctgggcccctgcctctctgca

SEQ ID NO: 2404971 - DNA, 23 bp, Homo sapiens
gctgggcccctgcctctctgcag

SEQ ID NO: 2404972 - DNA, 14 bp, Homo sapiens
gctggggaagacag

SEQ ID NO: 2404973 - DNA, 19 bp, Homo sapiens
gctggggccaggctgggtc

SEQ ID NO: 2404974 - DNA, 17 bp, Homo sapiens
gctgggtcgccctggac

SEQ ID NO: 2404975 - DNA, 18 bp, Homo sapiens
gctgggtcgccctggact

SEQ ID NO: 2404976 - DNA, 20 bp, Homo sapiens
gctgtataaaatcagccaat

SEQ ID NO: 2404977 - DNA, 22 bp, Homo sapiens
gctgtataaaatcagccaatta

SEQ ID NO: 2404978 - DNA, 16 bp, Homo sapiens
gctgttgctgaatagg

SEQ ID NO: 2404979 - DNA, 18 bp, Homo sapiens
gcttatcaactaatgatt

SEQ ID NO: 2404980 - DNA, 19 bp, Homo sapiens
gcttcagccaggagctggg

SEQ ID NO: 2404981 - DNA, 17 bp, Homo sapiens
gcttcatagagacttgg

SEQ ID NO: 2404982 - DNA, 17 bp, Homo sapiens
gcttccttcatttcctc

SEQ ID NO: 2404983 - DNA, 16 bp, Homo sapiens
gcttctcatcctgcag

SEQ ID NO: 2404984 - DNA, 18 bp, Homo sapiens
gcttctcatcctgcaggc

SEQ ID NO: 2404985 - DNA, 20 bp, Homo sapiens
gcttgaactaggctgagcaa

SEQ ID NO: 2404986 - DNA, 17 bp, Homo sapiens
gctttatcctctttaga

SEQ ID NO: 2404987 - DNA, 19 bp, Homo sapiens
gctttatcctctttagagt

SEQ ID NO: 2404988 - DNA, 20 bp, Homo sapiens
gctttatcctctttagagtt

SEQ ID NO: 2404989 - DNA, 13 bp, Homo sapiens
gctttcagagcct

SEQ ID NO: 2404990 - DNA, 18 bp, Homo sapiens
gctttgccctgctgccct

SEQ ID NO: 2404991 - DNA, 23 bp, Homo sapiens
gctttgccctgctgccctccccc

SEQ ID NO: 2404992 - DNA, 14 bp, Homo sapiens
gctttggaagccat

SEQ ID NO: 2404993 - DNA, 13 bp, Homo sapiens
gcttttatgtgaa

SEQ ID NO: 2404994 - DNA, 20 bp, Homo sapiens
gcttttatgtgaaacatgtt

SEQ ID NO: 2404995 - DNA, 15 bp, Homo sapiens
gcttttttatcatgt

SEQ ID NO: 2404996 - DNA, 18 bp, Homo sapiens
gcttttttatcatgtgaa

SEQ ID NO: 2404997 - DNA, 21 bp, Homo sapiens
ggaaactaggtgcatatttat

SEQ ID NO: 2404998 - DNA, 21 bp, Homo sapiens
ggaaagaaaataaatctatca

SEQ ID NO: 2404999 - DNA, 21 bp, Homo sapiens
ggaaagaagaaggtgggagga

SEQ ID NO: 2405000 - DNA, 19 bp, Homo sapiens
ggaaagcagcctggccaac

SEQ ID NO: 2405001 - DNA, 16 bp, Homo sapiens
ggaaagtcattggctt

SEQ ID NO: 2405002 - DNA, 21 bp, Homo sapiens
ggaaagtcattggctttatcc

SEQ ID NO: 2405003 - DNA, 16 bp, Homo sapiens
ggaaattgattttgaa

SEQ ID NO: 2405004 - DNA, 15 bp, Homo sapiens
ggaacaaacagggct

SEQ ID NO: 2405005 - DNA, 14 bp, Homo sapiens
ggaagacagtggcc

SEQ ID NO: 2405006 - DNA, 16 bp, Homo sapiens
ggaagagacagcccag

SEQ ID NO: 2405007 - DNA, 18 bp, Homo sapiens
ggaagcccctgggcccag

SEQ ID NO: 2405008 - DNA, 19 bp, Homo sapiens
ggaagcccctgggcccagt

SEQ ID NO: 2405009 - DNA, 18 bp, Homo sapiens
ggaagtggggcgggcttc

SEQ ID NO: 2405010 - DNA, 13 bp, Homo sapiens
ggaatatttgaat

SEQ ID NO: 2405011 - DNA, 15 bp, Homo sapiens
ggaatatttgaatct

SEQ ID NO: 2405012 - DNA, 12 bp, Homo sapiens
ggaattgtgttt

SEQ ID NO: 2405013 - DNA, 21 bp, Homo sapiens
ggacacagttcctgggaacat

SEQ ID NO: 2405014 - DNA, 17 bp, Homo sapiens
ggaccctgttgctaagc

SEQ ID NO: 2405015 - DNA, 21 bp, Homo sapiens
ggacccttcccttgagccctc

SEQ ID NO: 2405016 - DNA, 13 bp, Homo sapiens
ggacctcaccaag

SEQ ID NO: 2405017 - DNA, 21 bp, Homo sapiens
ggactcatctttccctccttg

SEQ ID NO: 2405018 - DNA, 12 bp, Homo sapiens
ggagagacttgt

SEQ ID NO: 2405019 - DNA, 20 bp, Homo sapiens
ggagagagttgaacctaaac

SEQ ID NO: 2405020 - DNA, 14 bp, Homo sapiens
ggagagggaatgtg

SEQ ID NO: 2405021 - DNA, 19 bp, Homo sapiens
ggagatggaggaaagtgat

SEQ ID NO: 2405022 - DNA, 18 bp, Homo sapiens
ggagccctgtctcctctc

SEQ ID NO: 2405023 - DNA, 23 bp, Homo sapiens
ggagccttcccaagttgtgcttg

SEQ ID NO: 2405024 - DNA, 20 bp, Homo sapiens
ggaggctaaagcccagagac

SEQ ID NO: 2405025 - DNA, 17 bp, Homo sapiens
ggaggctctggagccca

SEQ ID NO: 2405026 - DNA, 20 bp, Homo sapiens
ggagggtttcattgtctgtg

SEQ ID NO: 2405027 - DNA, 12 bp, Homo sapiens
ggagtcttgctc

SEQ ID NO: 2405028 - DNA, 12 bp, Homo sapiens
ggagtgcagtgg

SEQ ID NO: 2405029 - DNA, 21 bp, Homo sapiens
ggatacgcatcagacagatgg

SEQ ID NO: 2405030 - DNA, 17 bp, Homo sapiens
ggatactggcacagagg

SEQ ID NO: 2405031 - DNA, 18 bp, Homo sapiens
ggatactggcacagaggt

SEQ ID NO: 2405032 - DNA, 14 bp, Homo sapiens
ggatcagaaataca

SEQ ID NO: 2405033 - DNA, 16 bp, Homo sapiens
ggatcagaaatacaga

SEQ ID NO: 2405034 - DNA, 16 bp, Homo sapiens
ggatcctgtgtggaga

SEQ ID NO: 2405035 - DNA, 20 bp, Homo sapiens
ggatgagagttttggatgca

SEQ ID NO: 2405036 - DNA, 20 bp, Homo sapiens
ggatgatccccacgccacag

SEQ ID NO: 2405037 - DNA, 21 bp, Homo sapiens
ggatgatccccacgccacagc

SEQ ID NO: 2405038 - DNA, 19 bp, Homo sapiens
ggattgaaggatgctgtct

SEQ ID NO: 2405039 - DNA, 12 bp, Homo sapiens
ggatttttacca

SEQ ID NO: 2405040 - DNA, 16 bp, Homo sapiens
ggcaaatatcttgaaa

SEQ ID NO: 2405041 - DNA, 18 bp, Homo sapiens
ggcaagattgtgtcccat

SEQ ID NO: 2405042 - DNA, 17 bp, Homo sapiens
ggcaattaattccttca

SEQ ID NO: 2405043 - DNA, 13 bp, Homo sapiens
ggcagccagacca

SEQ ID NO: 2405044 - DNA, 15 bp, Homo sapiens
ggcagccagaccagc

SEQ ID NO: 2405045 - DNA, 23 bp, Homo sapiens
ggcatgtgtttactttatgttac

SEQ ID NO: 2405046 - DNA, 22 bp, Homo sapiens
ggccatgggaggcctttcccta

SEQ ID NO: 2405047 - DNA, 15 bp, Homo sapiens
ggcccagagaagcca

SEQ ID NO: 2405048 - DNA, 18 bp, Homo sapiens
ggcccctttgctgaccct

SEQ ID NO: 2405049 - DNA, 19 bp, Homo sapiens
ggcctgactgccaagccat

SEQ ID NO: 2405050 - DNA, 20 bp, Homo sapiens
ggcgatcacaacgtgcattg

SEQ ID NO: 2405051 - DNA, 20 bp, Homo sapiens
ggctaagcttcactgtaaaa

SEQ ID NO: 2405052 - DNA, 19 bp, Homo sapiens
gtgctcaggagccctggga

SEQ ID NO: 2405053 - DNA, 22 bp, Homo sapiens
gtgctcgctgttgctgaatagg

SEQ ID NO: 2405054 - DNA, 16 bp, Homo sapiens
gtgctggaaatggaca

SEQ ID NO: 2405055 - DNA, 13 bp, Homo sapiens
gtgcttctttctt

SEQ ID NO: 2405056 - DNA, 14 bp, Homo sapiens
gtgcttctttcttt

SEQ ID NO: 2405057 - DNA, 14 bp, Homo sapiens
gtgcttgagccagg

SEQ ID NO: 2405058 - DNA, 20 bp, Homo sapiens
gtggaaattaagactttatg

SEQ ID NO: 2405059 - DNA, 15 bp, Homo sapiens
gtggactaaaagata

SEQ ID NO: 2405060 - DNA, 12 bp, Homo sapiens
gtggagagggaa

SEQ ID NO: 2405061 - DNA, 23 bp, Homo sapiens
gtggatgatccccacgccacagc

SEQ ID NO: 2405062 - DNA, 19 bp, Homo sapiens
gtggcatcatctcagctca

SEQ ID NO: 2405063 - DNA, 19 bp, Homo sapiens
gtggcgcgatctcagctca

SEQ ID NO: 2405064 - DNA, 22 bp, Homo sapiens
gtgggattatgggtcacaggaa

SEQ ID NO: 2405065 - DNA, 18 bp, Homo sapiens
gtggggggggtgctgggc

SEQ ID NO: 2405066 - DNA, 12 bp, Homo sapiens
gtgggtataaaa

SEQ ID NO: 2405067 - DNA, 15 bp, Homo sapiens
gtgggtataaaagat

SEQ ID NO: 2405068 - DNA, 16 bp, Homo sapiens
gtgggtataaaagatg

SEQ ID NO: 2405069 - DNA, 18 bp, Homo sapiens
gtgggttttttagttgaa

SEQ ID NO: 2405070 - DNA, 17 bp, Homo sapiens
gtggtgcgagtgcgtga

SEQ ID NO: 2405071 - DNA, 14 bp, Homo sapiens
gtgtgaactggacc

SEQ ID NO: 2405072 - DNA, 14 bp, Homo sapiens
gtgtgcgtcctgtc

SEQ ID NO: 2405073 - DNA, 17 bp, Homo sapiens
gtgtgctcaggagccct

SEQ ID NO: 2405074 - DNA, 19 bp, Homo sapiens
gtgtgctcaggagccctgg

SEQ ID NO: 2405075 - DNA, 13 bp, Homo sapiens
gtgtttgtcatta

SEQ ID NO: 2405076 - DNA, 15 bp, Homo sapiens
gtgtttgtcattagc

SEQ ID NO: 2405077 - DNA, 22 bp, Homo sapiens
gttaaactagcatatctgcctt

SEQ ID NO: 2405078 - DNA, 19 bp, Homo sapiens
gttaaataaattgtatatt

SEQ ID NO: 2405079 - DNA, 22 bp, Homo sapiens
gttaaataaattgtatattcac

SEQ ID NO: 2405080 - DNA, 18 bp, Homo sapiens
gttaatattgatttatta

SEQ ID NO: 2405081 - DNA, 18 bp, Homo sapiens
gttacactggatgaaaat

SEQ ID NO: 2405082 - DNA, 20 bp, Homo sapiens
gttacccagtaactcatctg

SEQ ID NO: 2405083 - DNA, 13 bp, Homo sapiens
gttaggaggtcct

SEQ ID NO: 2405084 - DNA, 20 bp, Homo sapiens
gttatccacctgccttggct

SEQ ID NO: 2405085 - DNA, 20 bp, Homo sapiens
gttattatatttacaaatgg

SEQ ID NO: 2405086 - DNA, 20 bp, Homo sapiens
gttatttttacattctgaat

SEQ ID NO: 2405087 - DNA, 19 bp, Homo sapiens
gttcccttcaagtataata

SEQ ID NO: 2405088 - DNA, 18 bp, Homo sapiens
gttctctatcatttaata

SEQ ID NO: 2405089 - DNA, 22 bp, Homo sapiens
gttctgtagaaatggttgtatt

SEQ ID NO: 2405090 - DNA, 14 bp, Homo sapiens
gttcttcatctaag

SEQ ID NO: 2405091 - DNA, 23 bp, Homo sapiens
gttgaattttttttaacattcct

SEQ ID NO: 2405092 - DNA, 14 bp, Homo sapiens
gttggagtgcagtg

SEQ ID NO: 2405093 - DNA, 14 bp, Homo sapiens
gttgtattagatgt

SEQ ID NO: 2405094 - DNA, 13 bp, Homo sapiens
gttgtgcttgagc

SEQ ID NO: 2405095 - DNA, 21 bp, Homo sapiens
gtttaatccccagtaaaattg

SEQ ID NO: 2405096 - DNA, 15 bp, Homo sapiens
gtttaccagaaagca

SEQ ID NO: 2405097 - DNA, 16 bp, Homo sapiens
gtttacttgtttcaga

SEQ ID NO: 2405098 - DNA, 22 bp, Homo sapiens
gtttcatatttttcatagctaa

SEQ ID NO: 2405099 - DNA, 16 bp, Homo sapiens
gtttctgagttttacc

SEQ ID NO: 2405100 - DNA, 23 bp, Homo sapiens
gtttctttctttctttattttga

SEQ ID NO: 2405101 - DNA, 14 bp, Homo sapiens
gtttgaatgttaaa

SEQ ID NO: 2405102 - DNA, 15 bp, Homo sapiens
gttttaaaatgagaa

SEQ ID NO: 2405103 - DNA, 20 bp, Homo sapiens
gttttcaaaattgttacaaa

SEQ ID NO: 2405104 - DNA, 14 bp, Homo sapiens
gttttgacattttt

SEQ ID NO: 2405105 - DNA, 16 bp, Homo sapiens
gttttttagttgaatt

SEQ ID NO: 2405106 - DNA, 17 bp, Homo sapiens
gtttttttttaaagact

SEQ ID NO: 2405107 - DNA, 21 bp, Homo sapiens
taaaaacaaagaaattatgtg

SEQ ID NO: 2405108 - DNA, 16 bp, Homo sapiens
taaaaagtcaatgttt

SEQ ID NO: 2405109 - DNA, 18 bp, Homo sapiens
taaaaataaaaaacactg

SEQ ID NO: 2405110 - DNA, 16 bp, Homo sapiens
taaaaataaaaaagat

SEQ ID NO: 2405111 - DNA, 22 bp, Homo sapiens
taaaacaagcactaaacaaaga

SEQ ID NO: 2405112 - DNA, 16 bp, Homo sapiens
taaaagaaaccctgca

SEQ ID NO: 2405113 - DNA, 17 bp, Homo sapiens
taaaagaaaccctgcac

SEQ ID NO: 2405114 - DNA, 20 bp, Homo sapiens
taaaagacagtgaaagaaaa

SEQ ID NO: 2405115 - DNA, 19 bp, Homo sapiens
taaaagatataagtgctgt

SEQ ID NO: 2405116 - DNA, 22 bp, Homo sapiens
taaaagatataagtgctgtata

SEQ ID NO: 2405117 - DNA, 20 bp, Homo sapiens
taaaagatggggtctgtaaa

SEQ ID NO: 2405118 - DNA, 21 bp, Homo sapiens
taaaagatggggtctgtaaaa

SEQ ID NO: 2405119 - DNA, 17 bp, Homo sapiens
taaaagggactgagaaa

SEQ ID NO: 2405120 - DNA, 21 bp, Homo sapiens
taaaagttttttattatgcat

SEQ ID NO: 2405121 - DNA, 13 bp, Homo sapiens
taaaatcagccaa

SEQ ID NO: 2405122 - DNA, 22 bp, Homo sapiens
taaaatcagccaattatgttaa

SEQ ID NO: 2405123 - DNA, 23 bp, Homo sapiens
taaaatcagccaattatgttaaa

SEQ ID NO: 2405124 - DNA, 11 bp, Homo sapiens
taaaatcttgt

SEQ ID NO: 2405125 - DNA, 12 bp, Homo sapiens
taaaatcttgtc

SEQ ID NO: 2405126 - DNA, 23 bp, Homo sapiens
taaaatcttgtcatgtgtataaa

SEQ ID NO: 2405127 - DNA, 19 bp, Homo sapiens
taaaatctttctttcttag

SEQ ID NO: 2405128 - DNA, 13 bp, Homo sapiens
taaaatgagaaat

SEQ ID NO: 2405129 - DNA, 16 bp, Homo sapiens
taaaatgagaaatcta

SEQ ID NO: 2405130 - DNA, 13 bp, Homo sapiens
taaaattgccata

SEQ ID NO: 2405131 - DNA, 15 bp, Homo sapiens
taaaattgccatatt

SEQ ID NO: 2405132 - DNA, 18 bp, Homo sapiens
taaaattgccatattgca

SEQ ID NO: 2405133 - DNA, 17 bp, Homo sapiens
taaaatttttaatcttt

SEQ ID NO: 2405134 - DNA, 19 bp, Homo sapiens
taaaatttttaatctttaa

SEQ ID NO: 2405135 - DNA, 20 bp, Homo sapiens
taaaatttttttagaaagca

SEQ ID NO: 2405136 - DNA, 18 bp, Homo sapiens
taaacaatatcagacttt

SEQ ID NO: 2405137 - DNA, 19 bp, Homo sapiens
taaacccagtagtggtgac

SEQ ID NO: 2405138 - DNA, 15 bp, Homo sapiens
taaagaacataaata

SEQ ID NO: 2405139 - DNA, 16 bp, Homo sapiens
taaagaattattttgt

SEQ ID NO: 2405140 - DNA, 18 bp, Homo sapiens
taaagcaggcagaactca

SEQ ID NO: 2405141 - DNA, 20 bp, Homo sapiens
taaagtatcaggatactata

SEQ ID NO: 2405142 - DNA, 15 bp, Homo sapiens
taaagtgatatttcc

SEQ ID NO: 2405143 - DNA, 16 bp, Homo sapiens
taaagtgatatttccc

SEQ ID NO: 2405144 - DNA, 16 bp, Homo sapiens
taaagttggtaaacct

SEQ ID NO: 2405145 - DNA, 14 bp, Homo sapiens
taaataaattgtat

SEQ ID NO: 2405146 - DNA, 18 bp, Homo sapiens
taaataaattgtatattc

SEQ ID NO: 2405147 - DNA, 20 bp, Homo sapiens
taaataaattgtatattcac

SEQ ID NO: 2405148 - DNA, 22 bp, Homo sapiens
taaataaattgtatattcactt

SEQ ID NO: 2405149 - DNA, 17 bp, Homo sapiens
taaatagaccattaatc

SEQ ID NO: 2405150 - DNA, 24 bp, Homo sapiens
taaatgtttttttttaaagacttt

SEQ ID NO: 2405151 - DNA, 13 bp, Homo sapiens
taacatctgagaa

SEQ ID NO: 2405152 - DNA, 14 bp, Homo sapiens
taacatgatttggg

SEQ ID NO: 2405153 - DNA, 18 bp, Homo sapiens
taacatggtgtgcttctt

SEQ ID NO: 2405154 - DNA, 19 bp, Homo sapiens
taacggatcagaaatacag

SEQ ID NO: 2405155 - DNA, 21 bp, Homo sapiens
taacggatcagaaatacagat

SEQ ID NO: 2405156 - DNA, 15 bp, Homo sapiens
taactcatctgtcac

SEQ ID NO: 2405157 - DNA, 22 bp, Homo sapiens
taactgactattcttgatgtaa

SEQ ID NO: 2405158 - DNA, 13 bp, Homo sapiens
taactggaaagaa

SEQ ID NO: 2405159 - DNA, 14 bp, Homo sapiens
taactggaaagaag

SEQ ID NO: 2405160 - DNA, 15 bp, Homo sapiens
taactttctctatga

SEQ ID NO: 2405161 - DNA, 20 bp, Homo sapiens
taagacggatttatttttcc

SEQ ID NO: 2405162 - DNA, 15 bp, Homo sapiens
taagagctcaggatg

SEQ ID NO: 2405163 - DNA, 21 bp, Homo sapiens
taagatatgggacatttttga

SEQ ID NO: 2405164 - DNA, 14 bp, Homo sapiens
taagatatttttca

SEQ ID NO: 2405165 - DNA, 15 bp, Homo sapiens
taagatatttttcat

SEQ ID NO: 2405166 - DNA, 16 bp, Homo sapiens
taagccccagcaagca

SEQ ID NO: 2405167 - DNA, 17 bp, Homo sapiens
taagccccagcaagcaa

SEQ ID NO: 2405168 - DNA, 22 bp, Homo sapiens
taagccccagcaagcaatccta

SEQ ID NO: 2405169 - DNA, 22 bp, Homo sapiens
taaggaattttatttttttctg

SEQ ID NO: 2405170 - DNA, 17 bp, Homo sapiens
taagtttatttcttaaa

SEQ ID NO: 2405171 - DNA, 18 bp, Homo sapiens
taataaacactcttgaaa

SEQ ID NO: 2405172 - DNA, 15 bp, Homo sapiens
taataaggttgaaca

SEQ ID NO: 2405173 - DNA, 14 bp, Homo sapiens
taataatatacttg

SEQ ID NO: 2405174 - DNA, 17 bp, Homo sapiens
taatatacttgtggact

SEQ ID NO: 2405175 - DNA, 21 bp, Homo sapiens
taatatacttgtggactaaaa

SEQ ID NO: 2405176 - DNA, 18 bp, Homo sapiens
taatatatattatctttt

SEQ ID NO: 2405177 - DNA, 19 bp, Homo sapiens
taatatatattatcttttc

SEQ ID NO: 2405178 - DNA, 22 bp, Homo sapiens
taatccaagcaaatgtgaatca

SEQ ID NO: 2405179 - DNA, 18 bp, Homo sapiens
taatccccagtaaaattg

SEQ ID NO: 2405180 - DNA, 21 bp, Homo sapiens
taatccccagtaaaattgcca

SEQ ID NO: 2405181 - DNA, 14 bp, Homo sapiens
taatccccttctcc

SEQ ID NO: 2405182 - DNA, 18 bp, Homo sapiens
tggtctaaggttcagcct

SEQ ID NO: 2405183 - DNA, 18 bp, Homo sapiens
tggtctcaaactcctgac

SEQ ID NO: 2405184 - DNA, 14 bp, Homo sapiens
tggtgccttcattt

SEQ ID NO: 2405185 - DNA, 21 bp, Homo sapiens
tggtggatgatccccacgcca

SEQ ID NO: 2405186 - DNA, 22 bp, Homo sapiens
tggtgttgccagttgtcctcct

SEQ ID NO: 2405187 - DNA, 18 bp, Homo sapiens
tggttgtattagatgttc

SEQ ID NO: 2405188 - DNA, 15 bp, Homo sapiens
tggtttctagcatga

SEQ ID NO: 2405189 - DNA, 19 bp, Homo sapiens
tgtaaaatcttgtcatgtg

SEQ ID NO: 2405190 - DNA, 20 bp, Homo sapiens
tgtaaaatcttgtcatgtgt

SEQ ID NO: 2405191 - DNA, 21 bp, Homo sapiens
tgtaaaatctttctttcttag

SEQ ID NO: 2405192 - DNA, 18 bp, Homo sapiens
tgtaaatttgtactattt

SEQ ID NO: 2405193 - DNA, 18 bp, Homo sapiens
tgtaactttctctatgaa

SEQ ID NO: 2405194 - DNA, 18 bp, Homo sapiens
tgtaagacccttattgct

SEQ ID NO: 2405195 - DNA, 16 bp, Homo sapiens
tgtaagctgaaaatat

SEQ ID NO: 2405196 - DNA, 21 bp, Homo sapiens
tgtaagggccagaaatatctt

SEQ ID NO: 2405197 - DNA, 17 bp, Homo sapiens
tgtaatgttaatattga

SEQ ID NO: 2405198 - DNA, 14 bp, Homo sapiens
tgtacatataagtg

SEQ ID NO: 2405199 - DNA, 14 bp, Homo sapiens
tgtactatttaact

SEQ ID NO: 2405200 - DNA, 18 bp, Homo sapiens
tgtactatttaactgact

SEQ ID NO: 2405201 - DNA, 20 bp, Homo sapiens
tgtaggagaggttgtctgtg

SEQ ID NO: 2405202 - DNA, 16 bp, Homo sapiens
tgtataaaatcagcca

SEQ ID NO: 2405203 - DNA, 22 bp, Homo sapiens
tgtattacaaatccaatgaaat

SEQ ID NO: 2405204 - DNA, 13 bp, Homo sapiens
tgtattagatgtt

SEQ ID NO: 2405205 - DNA, 14 bp, Homo sapiens
tgtattagatgttc

SEQ ID NO: 2405206 - DNA, 16 bp, Homo sapiens
tgtattagatgttctc

SEQ ID NO: 2405207 - DNA, 18 bp, Homo sapiens
tgtattagatgttctcta

SEQ ID NO: 2405208 - DNA, 11 bp, Homo sapiens
tgtattatgtg

SEQ ID NO: 2405209 - DNA, 13 bp, Homo sapiens
tgtatttattcaa

SEQ ID NO: 2405210 - DNA, 14 bp, Homo sapiens
tgtatttattcaat

SEQ ID NO: 2405211 - DNA, 17 bp, Homo sapiens
tgtatttattcaataaa

SEQ ID NO: 2405212 - DNA, 21 bp, Homo sapiens
tgtcaagggttcaagattgtt

SEQ ID NO: 2405213 - DNA, 22 bp, Homo sapiens
tgtcacccaggttggagtgcag

SEQ ID NO: 2405214 - DNA, 15 bp, Homo sapiens
tgtcatgtgtataaa

SEQ ID NO: 2405215 - DNA, 13 bp, Homo sapiens
tgtcattagcctg

SEQ ID NO: 2405216 - DNA, 17 bp, Homo sapiens
tgtcatttcatttccta

SEQ ID NO: 2405217 - DNA, 17 bp, Homo sapiens
tgtccaaactgcctaag

SEQ ID NO: 2405218 - DNA, 19 bp, Homo sapiens
tgtctcaatgctcataacg

SEQ ID NO: 2405219 - DNA, 15 bp, Homo sapiens
tgtctcctctctctg

SEQ ID NO: 2405220 - DNA, 22 bp, Homo sapiens
tgtctctggattatattatgaa

SEQ ID NO: 2405221 - DNA, 19 bp, Homo sapiens
tgtctgtgaagtgagacct

SEQ ID NO: 2405222 - DNA, 15 bp, Homo sapiens
tgtcttaatgaagtt

SEQ ID NO: 2405223 - DNA, 18 bp, Homo sapiens
tgtcttaatgaagtttga

SEQ ID NO: 2405224 - DNA, 13 bp, Homo sapiens
tgtgaaacatgtt

SEQ ID NO: 2405225 - DNA, 21 bp, Homo sapiens
tgtgaactggaccctgttgct

SEQ ID NO: 2405226 - DNA, 16 bp, Homo sapiens
tgtgaggaaagtcatt

SEQ ID NO: 2405227 - DNA, 24 bp, Homo sapiens
tgtgattttcacctgttataataa

SEQ ID NO: 2405228 - DNA, 19 bp, Homo sapiens
tgtgcagtactttgtgcat

SEQ ID NO: 2405229 - DNA, 13 bp, Homo sapiens
tgtgcatcaggct

SEQ ID NO: 2405230 - DNA, 14 bp, Homo sapiens
tgtgcgtcctgtcg

SEQ ID NO: 2405231 - DNA, 17 bp, Homo sapiens
tgtgctcaggagccctg

SEQ ID NO: 2405232 - DNA, 19 bp, Homo sapiens
tgtgcttgagccaggaggc

SEQ ID NO: 2405233 - DNA, 17 bp, Homo sapiens
tgtggagagggaatgtg

SEQ ID NO: 2405234 - DNA, 20 bp, Homo sapiens
tgtggagagggaatgtgaaa

SEQ ID NO: 2405235 - DNA, 17 bp, Homo sapiens
tgtggctttcagagcct

SEQ ID NO: 2405236 - DNA, 13 bp, Homo sapiens
tgtgggattatgg

SEQ ID NO: 2405237 - DNA, 21 bp, Homo sapiens
tgtgtataaaaataaaaaaga

SEQ ID NO: 2405238 - DNA, 15 bp, Homo sapiens
tgtgtgcatcaggct

SEQ ID NO: 2405239 - DNA, 19 bp, Homo sapiens
tgtgtgcgtcctgtcggag

SEQ ID NO: 2405240 - DNA, 21 bp, Homo sapiens
tgtgtggagagggaatgtgaa

SEQ ID NO: 2405241 - DNA, 20 bp, Homo sapiens
tgtgtttactttatgttact

SEQ ID NO: 2405242 - DNA, 14 bp, Homo sapiens
tgtgtttgtcatta

SEQ ID NO: 2405243 - DNA, 17 bp, Homo sapiens
tgtgtttgtcattagcc

SEQ ID NO: 2405244 - DNA, 15 bp, Homo sapiens
tgtgtttttcataaa

SEQ ID NO: 2405245 - DNA, 23 bp, Homo sapiens
tgttaaactagcatatctgcctt

SEQ ID NO: 2405246 - DNA, 16 bp, Homo sapiens
tgttaaataaattgta

SEQ ID NO: 2405247 - DNA, 20 bp, Homo sapiens
tgttaaataaattgtatatt

SEQ ID NO: 2405248 - DNA, 13 bp, Homo sapiens
tgttaatattgat

SEQ ID NO: 2405249 - DNA, 19 bp, Homo sapiens
tgttaatattgatttatta

SEQ ID NO: 2405250 - DNA, 21 bp, Homo sapiens
tgttagcatgctggtgagcca

SEQ ID NO: 2405251 - DNA, 14 bp, Homo sapiens
tgttcattcctcca

SEQ ID NO: 2405252 - DNA, 15 bp, Homo sapiens
tgttcattcctccag

SEQ ID NO: 2405253 - DNA, 16 bp, Homo sapiens
tgttcattcctccagg

SEQ ID NO: 2405254 - DNA, 18 bp, Homo sapiens
tgttccccatggccactt

SEQ ID NO: 2405255 - DNA, 18 bp, Homo sapiens
tgttctgtgatataagtg

SEQ ID NO: 2405256 - DNA, 15 bp, Homo sapiens
tgtttgcatctgaaa

SEQ ID NO: 2405257 - DNA, 14 bp, Homo sapiens
tgttttaggagcat

SEQ ID NO: 2405258 - DNA, 19 bp, Homo sapiens
tgtttttaacatgtcaatc

SEQ ID NO: 2405259 - DNA, 19 bp, Homo sapiens
ttaaaatgagaaatctaaa

SEQ ID NO: 2405260 - DNA, 18 bp, Homo sapiens
ttaaaatttttttagaaa

SEQ ID NO: 2405261 - DNA, 22 bp, Homo sapiens
ttaaactagcatatctgccttt

SEQ ID NO: 2405262 - DNA, 23 bp, Homo sapiens
ttaaactagcatatctgccttta

SEQ ID NO: 2405263 - DNA, 18 bp, Homo sapiens
ttaaataaattgtatatt

SEQ ID NO: 2405264 - DNA, 20 bp, Homo sapiens
ttaaataaattgtatattca

SEQ ID NO: 2405265 - DNA, 14 bp, Homo sapiens
ttaacaacttgtct

SEQ ID NO: 2405266 - DNA, 23 bp, Homo sapiens
ttaacattcctcatgaatgtaaa

SEQ ID NO: 2405267 - DNA, 12 bp, Homo sapiens
ttaagagtaaaa

SEQ ID NO: 2405268 - DNA, 18 bp, Homo sapiens
ttaagtaaggaattttat

SEQ ID NO: 2405269 - DNA, 13 bp, Homo sapiens
ttaataaacactc

SEQ ID NO: 2405270 - DNA, 16 bp, Homo sapiens
ttaatattgatttatt

SEQ ID NO: 2405271 - DNA, 17 bp, Homo sapiens
ttaatccccagtaaaat

SEQ ID NO: 2405272 - DNA, 21 bp, Homo sapiens
ttaatccccagtaaaattgcc

SEQ ID NO: 2405273 - DNA, 13 bp, Homo sapiens
ttaatgtgtatta

SEQ ID NO: 2405274 - DNA, 19 bp, Homo sapiens
ttaattagccagtgaaaaa

SEQ ID NO: 2405275 - DNA, 14 bp, Homo sapiens
ttaattattgtaca

SEQ ID NO: 2405276 - DNA, 19 bp, Homo sapiens
ttaattccttcagcacttt

SEQ ID NO: 2405277 - DNA, 21 bp, Homo sapiens
ttacactggatgaaaatgttc

SEQ ID NO: 2405278 - DNA, 17 bp, Homo sapiens
ttacatgaattgcattt

SEQ ID NO: 2405279 - DNA, 18 bp, Homo sapiens
ttacattttaaacacatt

SEQ ID NO: 2405280 - DNA, 15 bp, Homo sapiens
ttaccaaataaagta

SEQ ID NO: 2405281 - DNA, 19 bp, Homo sapiens
ttactgtcttttttctaaa

SEQ ID NO: 2405282 - DNA, 18 bp, Homo sapiens
ttacttattatcttcagg

SEQ ID NO: 2405283 - DNA, 16 bp, Homo sapiens
ttactttatgttacta

SEQ ID NO: 2405284 - DNA, 12 bp, Homo sapiens
ttagaaagcatt

SEQ ID NO: 2405285 - DNA, 23 bp, Homo sapiens
ttagaaagcatttgaatgcattt

SEQ ID NO: 2405286 - DNA, 17 bp, Homo sapiens
ttagaccaccaagcctt

SEQ ID NO: 2405287 - DNA, 13 bp, Homo sapiens
ttagagttagact

SEQ ID NO: 2405288 - DNA, 22 bp, Homo sapiens
ttagatgttctctatcatttaa

SEQ ID NO: 2405289 - DNA, 21 bp, Homo sapiens
ttagccgtggtgatttagcag

SEQ ID NO: 2405290 - DNA, 12 bp, Homo sapiens
ttagccttctct

SEQ ID NO: 2405291 - DNA, 15 bp, Homo sapiens
ttagccttctctgtt

SEQ ID NO: 2405292 - DNA, 21 bp, Homo sapiens
ttagccttctctgttcatttc

SEQ ID NO: 2405293 - DNA, 14 bp, Homo sapiens
ttagtaatcatatt

SEQ ID NO: 2405294 - DNA, 24 bp, Homo sapiens
ttagtcgtgagctcttgtgaggaa

SEQ ID NO: 2405295 - DNA, 20 bp, Homo sapiens
ttagtgctaagtgtgaactg

SEQ ID NO: 2405296 - DNA, 13 bp, Homo sapiens
ttagttgcaactt

SEQ ID NO: 2405297 - DNA, 21 bp, Homo sapiens
ttataaaaataaaaaacactg

SEQ ID NO: 2405298 - DNA, 22 bp, Homo sapiens
ttataaacttttttcttactgt

SEQ ID NO: 2405299 - DNA, 16 bp, Homo sapiens
ttataactggaaagaa

SEQ ID NO: 2405300 - DNA, 12 bp, Homo sapiens
ttataatttaaa

SEQ ID NO: 2405301 - DNA, 12 bp, Homo sapiens
ttataattttaa

SEQ ID NO: 2405302 - DNA, 20 bp, Homo sapiens
ttatataatcattattactt

SEQ ID NO: 2405303 - DNA, 18 bp, Homo sapiens
ttatcatgtgaaatcatt

SEQ ID NO: 2405304 - DNA, 22 bp, Homo sapiens
ttatcatgtgaaatcattcatt

SEQ ID NO: 2405305 - DNA, 20 bp, Homo sapiens
ttatcctctttagagttaga

SEQ ID NO: 2405306 - DNA, 20 bp, Homo sapiens
ttatcttcaggacactcact

SEQ ID NO: 2405307 - DNA, 20 bp, Homo sapiens
ttatcttgaataatgtaaga

SEQ ID NO: 2405308 - DNA, 20 bp, Homo sapiens
ttatgaagcttttatgtgaa

SEQ ID NO: 2405309 - DNA, 20 bp, Homo sapiens
ttattaatatatattatctt

SEQ ID NO: 2405310 - DNA, 17 bp, Homo sapiens
ttattcaataaagtatt

SEQ ID NO: 2405311 - DNA, 15 bp, Homo sapiens
ttattgtgtttgtca

SEQ ID NO: 2405312 - DNA, 22 bp, Homo sapiens
aatgtaggagactgtttggaaa

SEQ ID NO: 2405313 - DNA, 14 bp, Homo sapiens
aatgtgggattatg

SEQ ID NO: 2405314 - DNA, 13 bp, Homo sapiens
aatgtgtaagaac

SEQ ID NO: 2405315 - DNA, 18 bp, Homo sapiens
aatgttaaataaattgta

SEQ ID NO: 2405316 - DNA, 12 bp, Homo sapiens
aatgttcatcat

SEQ ID NO: 2405317 - DNA, 17 bp, Homo sapiens
aattaattccttcagca

SEQ ID NO: 2405318 - DNA, 21 bp, Homo sapiens
aattaccacaccatctcccat

SEQ ID NO: 2405319 - DNA, 18 bp, Homo sapiens
aattagtgctaagtgtga

SEQ ID NO: 2405320 - DNA, 22 bp, Homo sapiens
aattagtgctaagtgtgaactg

SEQ ID NO: 2405321 - DNA, 19 bp, Homo sapiens
aattataactggaaagaag

SEQ ID NO: 2405322 - DNA, 22 bp, Homo sapiens
aattatgtgccagatttatgca

SEQ ID NO: 2405323 - DNA, 12 bp, Homo sapiens
aattattgtaca

SEQ ID NO: 2405324 - DNA, 21 bp, Homo sapiens
aattattgtacatttatagtt

SEQ ID NO: 2405325 - DNA, 16 bp, Homo sapiens
aattattgtttttctt

SEQ ID NO: 2405326 - DNA, 18 bp, Homo sapiens
aattccaagtgattgaaa

SEQ ID NO: 2405327 - DNA, 17 bp, Homo sapiens
aattgatcgacttgcca

SEQ ID NO: 2405328 - DNA, 14 bp, Homo sapiens
aattgattttgaac

SEQ ID NO: 2405329 - DNA, 23 bp, Homo sapiens
aattgcctgacgaactccttgat

SEQ ID NO: 2405330 - DNA, 23 bp, Homo sapiens
aattgctatgttttgacattttt

SEQ ID NO: 2405331 - DNA, 12 bp, Homo sapiens
aattgtatattc

SEQ ID NO: 2405332 - DNA, 14 bp, Homo sapiens
aattgtatattcac

SEQ ID NO: 2405333 - DNA, 16 bp, Homo sapiens
aattgtatattcactt

SEQ ID NO: 2405334 - DNA, 21 bp, Homo sapiens
aattgtgcagtactttgtgca

SEQ ID NO: 2405335 - DNA, 21 bp, Homo sapiens
aatttaaatcactcaaattgt

SEQ ID NO: 2405336 - DNA, 22 bp, Homo sapiens
aatttataaacttttttcttac

SEQ ID NO: 2405337 - DNA, 16 bp, Homo sapiens
aatttatttcctagtt

SEQ ID NO: 2405338 - DNA, 17 bp, Homo sapiens
aatttgagatacaaaca

SEQ ID NO: 2405339 - DNA, 18 bp, Homo sapiens
aatttgggggacttacat

SEQ ID NO: 2405340 - DNA, 13 bp, Homo sapiens
aattttgaaaaac

SEQ ID NO: 2405341 - DNA, 14 bp, Homo sapiens
aattttgatgaaca

SEQ ID NO: 2405342 - DNA, 15 bp, Homo sapiens
aattttttttaacat

SEQ ID NO: 2405343 - DNA, 19 bp, Homo sapiens
aattttttttaacattcct

SEQ ID NO: 2405344 - DNA, 19 bp, Homo sapiens
acaaaaaaaaaatttgcca

SEQ ID NO: 2405345 - DNA, 22 bp, Homo sapiens
acaaaagtttcatccttttcat

SEQ ID NO: 2405346 - DNA, 20 bp, Homo sapiens
acaaacagggctgccttctg

SEQ ID NO: 2405347 - DNA, 12 bp, Homo sapiens
acaaagaaatta

SEQ ID NO: 2405348 - DNA, 21 bp, Homo sapiens
acaaatctcaagcaaacagct

SEQ ID NO: 2405349 - DNA, 21 bp, Homo sapiens
acaaattctgtctctggatta

SEQ ID NO: 2405350 - DNA, 14 bp, Homo sapiens
acaacaatccttct

SEQ ID NO: 2405351 - DNA, 19 bp, Homo sapiens
acaagaaaataagagctca

SEQ ID NO: 2405352 - DNA, 23 bp, Homo sapiens
acaagaaaataagagctcaggat

SEQ ID NO: 2405353 - DNA, 18 bp, Homo sapiens
acaagcactaaacaaaga

SEQ ID NO: 2405354 - DNA, 21 bp, Homo sapiens
acaagcattctgtcttgaagg

SEQ ID NO: 2405355 - DNA, 15 bp, Homo sapiens
acacagttcctggga

SEQ ID NO: 2405356 - DNA, 20 bp, Homo sapiens
acactctcaaagcaaataat

SEQ ID NO: 2405357 - DNA, 17 bp, Homo sapiens
acagattttgatagcaa

SEQ ID NO: 2405358 - DNA, 20 bp, Homo sapiens
acagattttgatagcaaagc

SEQ ID NO: 2405359 - DNA, 16 bp, Homo sapiens
acagcaagtcagggtt

SEQ ID NO: 2405360 - DNA, 16 bp, Homo sapiens
acagcccttttgtctc

SEQ ID NO: 2405361 - DNA, 18 bp, Homo sapiens
acagcttcagccaggagc

SEQ ID NO: 2405362 - DNA, 21 bp, Homo sapiens
acagcttcagccaggagctgg

SEQ ID NO: 2405363 - DNA, 21 bp, Homo sapiens
acaggatgatgactatggaaa

SEQ ID NO: 2405364 - DNA, 16 bp, Homo sapiens
acagggctgccttctg

SEQ ID NO: 2405365 - DNA, 15 bp, Homo sapiens
acaggtaaaacaggg

SEQ ID NO: 2405366 - DNA, 13 bp, Homo sapiens
acagtgggagcca

SEQ ID NO: 2405367 - DNA, 21 bp, Homo sapiens
acagttcctgggaacatcaca

SEQ ID NO: 2405368 - DNA, 20 bp, Homo sapiens
acagtttaataccacagctt

SEQ ID NO: 2405369 - DNA, 16 bp, Homo sapiens
acatagaaattgcctg

SEQ ID NO: 2405370 - DNA, 20 bp, Homo sapiens
acatagtgggaccctgtctc

SEQ ID NO: 2405371 - DNA, 13 bp, Homo sapiens
acatcaaaatcaa

SEQ ID NO: 2405372 - DNA, 12 bp, Homo sapiens
acatcatttctt

SEQ ID NO: 2405373 - DNA, 13 bp, Homo sapiens
acatcatttcttt

SEQ ID NO: 2405374 - DNA, 20 bp, Homo sapiens
acatcccactcacaacagct

SEQ ID NO: 2405375 - DNA, 13 bp, Homo sapiens
acatgattcattt

SEQ ID NO: 2405376 - DNA, 18 bp, Homo sapiens
acatgcacttggctgcat

SEQ ID NO: 2405377 - DNA, 20 bp, Homo sapiens
acatgcattactgcatgcac

SEQ ID NO: 2405378 - DNA, 18 bp, Homo sapiens
acatgtatctatgcattt

SEQ ID NO: 2405379 - DNA, 15 bp, Homo sapiens
acatgtcaatctgtc

SEQ ID NO: 2405380 - DNA, 12 bp, Homo sapiens
acatgtcttaat

SEQ ID NO: 2405381 - DNA, 15 bp, Homo sapiens
acatgtcttaatgaa

SEQ ID NO: 2405382 - DNA, 16 bp, Homo sapiens
acatgtcttaatgaag

SEQ ID NO: 2405383 - DNA, 18 bp, Homo sapiens
acatgtcttaatgaagtt

SEQ ID NO: 2405384 - DNA, 23 bp, Homo sapiens
acatgtttctttgtaatgaaaac

SEQ ID NO: 2405385 - DNA, 18 bp, Homo sapiens
acattcctcatgaatgta

SEQ ID NO: 2405386 - DNA, 14 bp, Homo sapiens
accaagctgctgtg

SEQ ID NO: 2405387 - DNA, 17 bp, Homo sapiens
accacacccacactcag

SEQ ID NO: 2405388 - DNA, 16 bp, Homo sapiens
accactgtgtatttaa

SEQ ID NO: 2405389 - DNA, 23 bp, Homo sapiens
accagaaagcagttgagacaaga

SEQ ID NO: 2405390 - DNA, 19 bp, Homo sapiens
accaggcttgcctgcaggc

SEQ ID NO: 2405391 - DNA, 22 bp, Homo sapiens
accatcaccagaattaatttta

SEQ ID NO: 2405392 - DNA, 19 bp, Homo sapiens
accatgaagagatttttca

SEQ ID NO: 2405393 - DNA, 20 bp, Homo sapiens
accatggccagctaattttt

SEQ ID NO: 2405394 - DNA, 18 bp, Homo sapiens
accattgatttaatgtaa

SEQ ID NO: 2405395 - DNA, 14 bp, Homo sapiens
accattgtctcaga

SEQ ID NO: 2405396 - DNA, 23 bp, Homo sapiens
acccaaccacatcccactcacaa

SEQ ID NO: 2405397 - DNA, 23 bp, Homo sapiens
acccacactcagatcctcctcat

SEQ ID NO: 2405398 - DNA, 16 bp, Homo sapiens
acccagtctgttcccc

SEQ ID NO: 2405399 - DNA, 19 bp, Homo sapiens
acccagtgttttaggagca

SEQ ID NO: 2405400 - DNA, 22 bp, Homo sapiens
acccagtgttttaggagcatga

SEQ ID NO: 2405401 - DNA, 22 bp, Homo sapiens
acccattagcagtccctccaca

SEQ ID NO: 2405402 - DNA, 19 bp, Homo sapiens
accccagctggggccaggc

SEQ ID NO: 2405403 - DNA, 14 bp, Homo sapiens
acccgaggcccgca

SEQ ID NO: 2405404 - DNA, 13 bp, Homo sapiens
acccgttcaactt

SEQ ID NO: 2405405 - DNA, 16 bp, Homo sapiens
accctatgggtctagg

SEQ ID NO: 2405406 - DNA, 20 bp, Homo sapiens
accctcagatgcacatgagc

SEQ ID NO: 2405407 - DNA, 17 bp, Homo sapiens
accctggaaaatgaatc

SEQ ID NO: 2405408 - DNA, 19 bp, Homo sapiens
accctgtccaaactgccta

SEQ ID NO: 2405409 - DNA, 21 bp, Homo sapiens
acccttattgctgtcctggag

SEQ ID NO: 2405410 - DNA, 12 bp, Homo sapiens
acctatgtcatt

SEQ ID NO: 2405411 - DNA, 19 bp, Homo sapiens
acctatgtcatttcatttc

SEQ ID NO: 2405412 - DNA, 22 bp, Homo sapiens
acctatgtcatttcatttccta

SEQ ID NO: 2405413 - DNA, 15 bp, Homo sapiens
acctccacctcctgg

SEQ ID NO: 2405414 - DNA, 14 bp, Homo sapiens
acctgaagaatcac

SEQ ID NO: 2405415 - DNA, 18 bp, Homo sapiens
acctgatgaaaataaaga

SEQ ID NO: 2405416 - DNA, 16 bp, Homo sapiens
acctgctcagccctgc

SEQ ID NO: 2405417 - DNA, 14 bp, Homo sapiens
acctggtctctcct

SEQ ID NO: 2405418 - DNA, 13 bp, Homo sapiens
acctgtctcacca

SEQ ID NO: 2405419 - DNA, 15 bp, Homo sapiens
accttccagaaatac

SEQ ID NO: 2405420 - DNA, 18 bp, Homo sapiens
acctttgacaaaggtaaa

SEQ ID NO: 2405421 - DNA, 17 bp, Homo sapiens
acggatcagaaatacag

SEQ ID NO: 2405422 - DNA, 15 bp, Homo sapiens
acggatttatttttc

SEQ ID NO: 2405423 - DNA, 20 bp, Homo sapiens
acgtactgcagcctccagag

SEQ ID NO: 2405424 - DNA, 14 bp, Homo sapiens
acgtgcattgtgct

SEQ ID NO: 2405425 - DNA, 15 bp, Homo sapiens
acgtggcccagagaa

SEQ ID NO: 2405426 - DNA, 13 bp, Homo sapiens
acgttgctcccca

SEQ ID NO: 2405427 - DNA, 20 bp, Homo sapiens
actaaaagatataagtgctg

SEQ ID NO: 2405428 - DNA, 23 bp, Homo sapiens
actaaaagatataagtgctgtat

SEQ ID NO: 2405429 - DNA, 21 bp, Homo sapiens
actactagggaaatgcctttg

SEQ ID NO: 2405430 - DNA, 23 bp, Homo sapiens
actagaaaattgtgctggaaatg

SEQ ID NO: 2405431 - DNA, 20 bp, Homo sapiens
actataggcatgcgccacca

SEQ ID NO: 2405432 - DNA, 22 bp, Homo sapiens
actataggcatgcgccaccatg

SEQ ID NO: 2405433 - DNA, 12 bp, Homo sapiens
actatttaactg

SEQ ID NO: 2405434 - DNA, 16 bp, Homo sapiens
actatttaactgacta

SEQ ID NO: 2405435 - DNA, 17 bp, Homo sapiens
actcacaacagctgcct

SEQ ID NO: 2405436 - DNA, 18 bp, Homo sapiens
actcactaattcattaat

SEQ ID NO: 2405437 - DNA, 18 bp, Homo sapiens
actcatagacactgatct

SEQ ID NO: 2405438 - DNA, 16 bp, Homo sapiens
actcatctaggtaaat

SEQ ID NO: 2405439 - DNA, 18 bp, Homo sapiens
actcatctaggtaaatta

SEQ ID NO: 2405440 - DNA, 17 bp, Homo sapiens
actcatctttccctcct

SEQ ID NO: 2405441 - DNA, 15 bp, Homo sapiens
caggcttgcctgcag

SEQ ID NO: 2405442 - DNA, 23 bp, Homo sapiens
caggcttttttatcatgtgaaat

SEQ ID NO: 2405443 - DNA, 12 bp, Homo sapiens
cagggactcagg

SEQ ID NO: 2405444 - DNA, 23 bp, Homo sapiens
cagggactcatctttccctcctt

SEQ ID NO: 2405445 - DNA, 14 bp, Homo sapiens
cagggaggtggctg

SEQ ID NO: 2405446 - DNA, 14 bp, Homo sapiens
caggtaaaacaggg

SEQ ID NO: 2405447 - DNA, 14 bp, Homo sapiens
caggtaggaggcaa

SEQ ID NO: 2405448 - DNA, 16 bp, Homo sapiens
caggtccctaataaag

SEQ ID NO: 2405449 - DNA, 19 bp, Homo sapiens
caggtccctaataaagctg

SEQ ID NO: 2405450 - DNA, 21 bp, Homo sapiens
caggtctgaagctcaactctc

SEQ ID NO: 2405451 - DNA, 16 bp, Homo sapiens
cagtaaaattgccata

SEQ ID NO: 2405452 - DNA, 18 bp, Homo sapiens
cagtaaaattgccatatt

SEQ ID NO: 2405453 - DNA, 20 bp, Homo sapiens
cagtaaaattgccatattgc

SEQ ID NO: 2405454 - DNA, 13 bp, Homo sapiens
cagtccctccaca

SEQ ID NO: 2405455 - DNA, 17 bp, Homo sapiens
cagtgaaaaactattaa

SEQ ID NO: 2405456 - DNA, 16 bp, Homo sapiens
cagtgaaagaaaataa

SEQ ID NO: 2405457 - DNA, 20 bp, Homo sapiens
cagtgaattgtgtaggagag

SEQ ID NO: 2405458 - DNA, 21 bp, Homo sapiens
cagtgagagagtggctggggc

SEQ ID NO: 2405459 - DNA, 15 bp, Homo sapiens
cagtgctcgctgttg

SEQ ID NO: 2405460 - DNA, 19 bp, Homo sapiens
cagtgctcgctgttgctga

SEQ ID NO: 2405461 - DNA, 20 bp, Homo sapiens
cagtgctcgctgttgctgaa

SEQ ID NO: 2405462 - DNA, 21 bp, Homo sapiens
cagtggcatcatctcagctca

SEQ ID NO: 2405463 - DNA, 13 bp, Homo sapiens
cagtgggagccag

SEQ ID NO: 2405464 - DNA, 22 bp, Homo sapiens
cagtgtgtggctttcagagcct

SEQ ID NO: 2405465 - DNA, 20 bp, Homo sapiens
cagtgttttaggagcatgag

SEQ ID NO: 2405466 - DNA, 21 bp, Homo sapiens
cagttattatatttacaaatg

SEQ ID NO: 2405467 - DNA, 15 bp, Homo sapiens
cagttcctgggaaca

SEQ ID NO: 2405468 - DNA, 22 bp, Homo sapiens
cagttcggtgagctacaaatgc

SEQ ID NO: 2405469 - DNA, 14 bp, Homo sapiens
cagttgaatttcat

SEQ ID NO: 2405470 - DNA, 12 bp, Homo sapiens
cagttgtcctcc

SEQ ID NO: 2405471 - DNA, 14 bp, Homo sapiens
cataaagcaggcag

SEQ ID NO: 2405472 - DNA, 18 bp, Homo sapiens
cataaccttaccagattt

SEQ ID NO: 2405473 - DNA, 15 bp, Homo sapiens
cataatacttgcttt

SEQ ID NO: 2405474 - DNA, 18 bp, Homo sapiens
catagagacttgggaatg

SEQ ID NO: 2405475 - DNA, 17 bp, Homo sapiens
catatacagctcagaag

SEQ ID NO: 2405476 - DNA, 18 bp, Homo sapiens
catatccagtattgttcc

SEQ ID NO: 2405477 - DNA, 12 bp, Homo sapiens
catatctgcctt

SEQ ID NO: 2405478 - DNA, 13 bp, Homo sapiens
catatctgccttt

SEQ ID NO: 2405479 - DNA, 15 bp, Homo sapiens
catatctgcctttat

SEQ ID NO: 2405480 - DNA, 20 bp, Homo sapiens
catatctgcctttattgtgt

SEQ ID NO: 2405481 - DNA, 15 bp, Homo sapiens
catatgatgtacatg

SEQ ID NO: 2405482 - DNA, 17 bp, Homo sapiens
catattgcacatgtctt

SEQ ID NO: 2405483 - DNA, 21 bp, Homo sapiens
catattgcacatgtcttaatg

SEQ ID NO: 2405484 - DNA, 23 bp, Homo sapiens
catattgcacatgtcttaatgaa

SEQ ID NO: 2405485 - DNA, 17 bp, Homo sapiens
catatttataaaaataa

SEQ ID NO: 2405486 - DNA, 22 bp, Homo sapiens
catcaagtctttcacatttaaa

SEQ ID NO: 2405487 - DNA, 15 bp, Homo sapiens
catcaccttagacca

SEQ ID NO: 2405488 - DNA, 17 bp, Homo sapiens
catcaccttagaccacc

SEQ ID NO: 2405489 - DNA, 18 bp, Homo sapiens
catcaccttagaccacca

SEQ ID NO: 2405490 - DNA, 23 bp, Homo sapiens
catcaccttagaccaccaagcct

SEQ ID NO: 2405491 - DNA, 14 bp, Homo sapiens
catcagacagatgg

SEQ ID NO: 2405492 - DNA, 14 bp, Homo sapiens
catcagctccagct

SEQ ID NO: 2405493 - DNA, 13 bp, Homo sapiens
catccctcctggg

SEQ ID NO: 2405494 - DNA, 12 bp, Homo sapiens
catcctgcaggc

SEQ ID NO: 2405495 - DNA, 17 bp, Homo sapiens
catcgtcttcttggcca

SEQ ID NO: 2405496 - DNA, 23 bp, Homo sapiens
catctagaggcttccttcatttc

SEQ ID NO: 2405497 - DNA, 17 bp, Homo sapiens
catctaggtaaattaca

SEQ ID NO: 2405498 - DNA, 20 bp, Homo sapiens
catctcagctcactgcaacc

SEQ ID NO: 2405499 - DNA, 16 bp, Homo sapiens
catctcttgtttaaat

SEQ ID NO: 2405500 - DNA, 17 bp, Homo sapiens
catgaagatatttttcc

SEQ ID NO: 2405501 - DNA, 13 bp, Homo sapiens
catgattcatttt

SEQ ID NO: 2405502 - DNA, 18 bp, Homo sapiens
catgattcattttaacat

SEQ ID NO: 2405503 - DNA, 16 bp, Homo sapiens
catgattccagccatc

SEQ ID NO: 2405504 - DNA, 17 bp, Homo sapiens
catgattccagccatca

SEQ ID NO: 2405505 - DNA, 15 bp, Homo sapiens
catgcactgatgttg

SEQ ID NO: 2405506 - DNA, 20 bp, Homo sapiens
catgcactgatgttgtgttt

SEQ ID NO: 2405507 - DNA, 17 bp, Homo sapiens
catgcacttggctgcat

SEQ ID NO: 2405508 - DNA, 14 bp, Homo sapiens
catgctaattatat

SEQ ID NO: 2405509 - DNA, 14 bp, Homo sapiens
catgctgctgggga

SEQ ID NO: 2405510 - DNA, 16 bp, Homo sapiens
catgctgctggggaag

SEQ ID NO: 2405511 - DNA, 21 bp, Homo sapiens
catgctgctggggaagacagt

SEQ ID NO: 2405512 - DNA, 13 bp, Homo sapiens
catggaaggcaag

SEQ ID NO: 2405513 - DNA, 14 bp, Homo sapiens
catggaaggcaaga

SEQ ID NO: 2405514 - DNA, 22 bp, Homo sapiens
catggccacttgggtcttccct

SEQ ID NO: 2405515 - DNA, 21 bp, Homo sapiens
catgggaggcctttccctaag

SEQ ID NO: 2405516 - DNA, 17 bp, Homo sapiens
catgtaagctgaaaata

SEQ ID NO: 2405517 - DNA, 18 bp, Homo sapiens
catgtaagctgaaaatat

SEQ ID NO: 2405518 - DNA, 20 bp, Homo sapiens
catgtcaagggttcaagatt

SEQ ID NO: 2405519 - DNA, 16 bp, Homo sapiens
catgtcttaatgaagt

SEQ ID NO: 2405520 - DNA, 23 bp, Homo sapiens
catgtcttaatgaagtttgaatg

SEQ ID NO: 2405521 - DNA, 17 bp, Homo sapiens
catgtgaaatcattcat

SEQ ID NO: 2405522 - DNA, 13 bp, Homo sapiens
catgtgtataaaa

SEQ ID NO: 2405523 - DNA, 20 bp, Homo sapiens
catgtttctttgtaatgaaa

SEQ ID NO: 2405524 - DNA, 18 bp, Homo sapiens
cattagaccaagcttgtc

SEQ ID NO: 2405525 - DNA, 19 bp, Homo sapiens
cattaggaaaagttgctat

SEQ ID NO: 2405526 - DNA, 17 bp, Homo sapiens
cattcaagtcagctctt

SEQ ID NO: 2405527 - DNA, 17 bp, Homo sapiens
cattcacatcgcagatt

SEQ ID NO: 2405528 - DNA, 19 bp, Homo sapiens
cattcattttctgggtgtt

SEQ ID NO: 2405529 - DNA, 14 bp, Homo sapiens
cattcccccagtgc

SEQ ID NO: 2405530 - DNA, 17 bp, Homo sapiens
cattcctcatgaatgta

SEQ ID NO: 2405531 - DNA, 19 bp, Homo sapiens
cattcctcatgaatgtaaa

SEQ ID NO: 2405532 - DNA, 12 bp, Homo sapiens
cattcctccagg

SEQ ID NO: 2405533 - DNA, 14 bp, Homo sapiens
cattcctctgccct

SEQ ID NO: 2405534 - DNA, 17 bp, Homo sapiens
cattctcaagccctgca

SEQ ID NO: 2405535 - DNA, 13 bp, Homo sapiens
cattctggaataa

SEQ ID NO: 2405536 - DNA, 21 bp, Homo sapiens
cattcttatttcatgaaaatt

SEQ ID NO: 2405537 - DNA, 17 bp, Homo sapiens
cattgccttaactggag

SEQ ID NO: 2405538 - DNA, 17 bp, Homo sapiens
cattgttatataatcat

SEQ ID NO: 2405539 - DNA, 14 bp, Homo sapiens
catttaataatata

SEQ ID NO: 2405540 - DNA, 22 bp, Homo sapiens
catttaataatatacttgtgga

SEQ ID NO: 2405541 - DNA, 15 bp, Homo sapiens
catttaggtttctga

SEQ ID NO: 2405542 - DNA, 20 bp, Homo sapiens
catttatattgataagatct

SEQ ID NO: 2405543 - DNA, 17 bp, Homo sapiens
catttatgagctcttca

SEQ ID NO: 2405544 - DNA, 23 bp, Homo sapiens
catttatgagctcttcatgtttc

SEQ ID NO: 2405545 - DNA, 15 bp, Homo sapiens
catttcctaaatata

SEQ ID NO: 2405546 - DNA, 22 bp, Homo sapiens
catttctttttgggagagactt

SEQ ID NO: 2405547 - DNA, 10 bp, Homo sapiens
catttgaatg

SEQ ID NO: 2405548 - DNA, 16 bp, Homo sapiens
cattttaacatctgag

SEQ ID NO: 2405549 - DNA, 12 bp, Homo sapiens
cattttctccct

SEQ ID NO: 2405550 - DNA, 16 bp, Homo sapiens
ccaaaccaggaccctg

SEQ ID NO: 2405551 - DNA, 12 bp, Homo sapiens
ccaaactgccta

SEQ ID NO: 2405552 - DNA, 19 bp, Homo sapiens
ccaaactgcctaagccctc

SEQ ID NO: 2405553 - DNA, 14 bp, Homo sapiens
ccaaaggaggatgg

SEQ ID NO: 2405554 - DNA, 13 bp, Homo sapiens
ccaacatgcactg

SEQ ID NO: 2405555 - DNA, 23 bp, Homo sapiens
ccaacatgcactgatgttgtgtt

SEQ ID NO: 2405556 - DNA, 15 bp, Homo sapiens
ccaacccgaggcccg

SEQ ID NO: 2405557 - DNA, 21 bp, Homo sapiens
ccaagccatgggtagcctggg

SEQ ID NO: 2405558 - DNA, 23 bp, Homo sapiens
ccaagcttgtccaacccgaggcc

SEQ ID NO: 2405559 - DNA, 22 bp, Homo sapiens
ccaagttgtgcttgagccagga

SEQ ID NO: 2405560 - DNA, 11 bp, Homo sapiens
ccacactcaga

SEQ ID NO: 2405561 - DNA, 19 bp, Homo sapiens
ccacactcagatcctcctc

SEQ ID NO: 2405562 - DNA, 16 bp, Homo sapiens
ccacagaagtgctttc

SEQ ID NO: 2405563 - DNA, 12 bp, Homo sapiens
ccaccaagcctt

SEQ ID NO: 2405564 - DNA, 13 bp, Homo sapiens
ccaccaagccttg

SEQ ID NO: 2405565 - DNA, 14 bp, Homo sapiens
ccaccaagccttga

SEQ ID NO: 2405566 - DNA, 12 bp, Homo sapiens
ccacgccacagc

SEQ ID NO: 2405567 - DNA, 14 bp, Homo sapiens
ccacgccacagccc

SEQ ID NO: 2405568 - DNA, 18 bp, Homo sapiens
ccacgccacagccctttt

SEQ ID NO: 2405569 - DNA, 19 bp, Homo sapiens
ccactgtacttgctcttga

SEQ ID NO: 2405570 - DNA, 17 bp, Homo sapiens
ccacttcaagtgaccac

SEQ ID NO: 2405571 - DNA, 14 bp, Homo sapiens
ccacttcagcctcc

SEQ ID NO: 2405572 - DNA, 17 bp, Homo sapiens
ctgttcattcctccagg

SEQ ID NO: 2405573 - DNA, 12 bp, Homo sapiens
ctgttgctaagc

SEQ ID NO: 2405574 - DNA, 22 bp, Homo sapiens
ctgttgctaagccccagcaagc

SEQ ID NO: 2405575 - DNA, 15 bp, Homo sapiens
ctgttgctgaatagg

SEQ ID NO: 2405576 - DNA, 17 bp, Homo sapiens
ctgttggggtgggtata

SEQ ID NO: 2405577 - DNA, 20 bp, Homo sapiens
ctgttggggtgggtataaaa

SEQ ID NO: 2405578 - DNA, 21 bp, Homo sapiens
cttaaggatggagccagctct

SEQ ID NO: 2405579 - DNA, 19 bp, Homo sapiens
cttaatatatatatccaga

SEQ ID NO: 2405580 - DNA, 12 bp, Homo sapiens
cttaatgaagtt

SEQ ID NO: 2405581 - DNA, 14 bp, Homo sapiens
cttaatgaagtttg

SEQ ID NO: 2405582 - DNA, 19 bp, Homo sapiens
cttaatgaagtttgaatgt

SEQ ID NO: 2405583 - DNA, 20 bp, Homo sapiens
cttaatgaagtttgaatgtt

SEQ ID NO: 2405584 - DNA, 21 bp, Homo sapiens
cttaatgaagtttgaatgtta

SEQ ID NO: 2405585 - DNA, 22 bp, Homo sapiens
cttaatgaagtttgaatgttaa

SEQ ID NO: 2405586 - DNA, 11 bp, Homo sapiens
cttacacccac

SEQ ID NO: 2405587 - DNA, 15 bp, Homo sapiens
cttagaccaccaagc

SEQ ID NO: 2405588 - DNA, 21 bp, Homo sapiens
cttatattaatattcctcagt

SEQ ID NO: 2405589 - DNA, 15 bp, Homo sapiens
cttatttcctcattt

SEQ ID NO: 2405590 - DNA, 15 bp, Homo sapiens
cttcagcactttaga

SEQ ID NO: 2405591 - DNA, 15 bp, Homo sapiens
cttcagccaggagct

SEQ ID NO: 2405592 - DNA, 19 bp, Homo sapiens
cttcatagagacttgggaa

SEQ ID NO: 2405593 - DNA, 14 bp, Homo sapiens
cttcatttcctccg

SEQ ID NO: 2405594 - DNA, 20 bp, Homo sapiens
cttccacgtactgcagcctc

SEQ ID NO: 2405595 - DNA, 13 bp, Homo sapiens
cttccagaaatac

SEQ ID NO: 2405596 - DNA, 23 bp, Homo sapiens
cttcccaaagtcctgggattaca

SEQ ID NO: 2405597 - DNA, 22 bp, Homo sapiens
cttccctgtatgattccttgat

SEQ ID NO: 2405598 - DNA, 16 bp, Homo sapiens
cttcccttgagccctc

SEQ ID NO: 2405599 - DNA, 15 bp, Homo sapiens
cttccttttgaggga

SEQ ID NO: 2405600 - DNA, 19 bp, Homo sapiens
cttctattgcctctgagag

SEQ ID NO: 2405601 - DNA, 22 bp, Homo sapiens
cttctattgcctctgagagcat

SEQ ID NO: 2405602 - DNA, 15 bp, Homo sapiens
cttctcatcctgcag

SEQ ID NO: 2405603 - DNA, 17 bp, Homo sapiens
cttctcccctgcactgt

SEQ ID NO: 2405604 - DNA, 20 bp, Homo sapiens
cttctcccctgcactgtaaa

SEQ ID NO: 2405605 - DNA, 21 bp, Homo sapiens
cttctcccctgcactgtaaaa

SEQ ID NO: 2405606 - DNA, 22 bp, Homo sapiens
cttctcccctgcactgtaaaat

SEQ ID NO: 2405607 - DNA, 13 bp, Homo sapiens
cttctctgttcat

SEQ ID NO: 2405608 - DNA, 16 bp, Homo sapiens
cttcttggccatggga

SEQ ID NO: 2405609 - DNA, 19 bp, Homo sapiens
cttcttttaaaccattttc

SEQ ID NO: 2405610 - DNA, 18 bp, Homo sapiens
cttgaaaaatgcatgttg

SEQ ID NO: 2405611 - DNA, 18 bp, Homo sapiens
cttgaaaattaacatgaa

SEQ ID NO: 2405612 - DNA, 12 bp, Homo sapiens
cttgacctccta

SEQ ID NO: 2405613 - DNA, 18 bp, Homo sapiens
cttgagggcaagagccac

SEQ ID NO: 2405614 - DNA, 17 bp, Homo sapiens
cttgatgtaaaatcttg

SEQ ID NO: 2405615 - DNA, 18 bp, Homo sapiens
cttgatgtaaaatcttgt

SEQ ID NO: 2405616 - DNA, 21 bp, Homo sapiens
cttgattttagccttctctgt

SEQ ID NO: 2405617 - DNA, 14 bp, Homo sapiens
cttgcattgcagag

SEQ ID NO: 2405618 - DNA, 13 bp, Homo sapiens
cttgccaaattta

SEQ ID NO: 2405619 - DNA, 14 bp, Homo sapiens
cttgcctctgcaca

SEQ ID NO: 2405620 - DNA, 15 bp, Homo sapiens
cttgcggctcctcag

SEQ ID NO: 2405621 - DNA, 21 bp, Homo sapiens
cttgctgcagtatgaaaataa

SEQ ID NO: 2405622 - DNA, 20 bp, Homo sapiens
cttgcttgattgtatggtgg

SEQ ID NO: 2405623 - DNA, 19 bp, Homo sapiens
cttggccatgggaggcctt

SEQ ID NO: 2405624 - DNA, 21 bp, Homo sapiens
cttggggattcttccatctga

SEQ ID NO: 2405625 - DNA, 13 bp, Homo sapiens
cttgtcatgtgta

SEQ ID NO: 2405626 - DNA, 18 bp, Homo sapiens
cttgtcatgtgtataaaa

SEQ ID NO: 2405627 - DNA, 22 bp, Homo sapiens
cttgtcattgttatataatcat

SEQ ID NO: 2405628 - DNA, 17 bp, Homo sapiens
cttgtctcaatgctcat

SEQ ID NO: 2405629 - DNA, 20 bp, Homo sapiens
cttgtctcccagctcagggc

SEQ ID NO: 2405630 - DNA, 10 bp, Homo sapiens
cttgtgtctg

SEQ ID NO: 2405631 - DNA, 21 bp, Homo sapiens
ctttaaaatttttttagaaag

SEQ ID NO: 2405632 - DNA, 19 bp, Homo sapiens
ctttaacttaattgctatg

SEQ ID NO: 2405633 - DNA, 16 bp, Homo sapiens
ctttaccttttttctt

SEQ ID NO: 2405634 - DNA, 16 bp, Homo sapiens
ctttagaatatgcctt

SEQ ID NO: 2405635 - DNA, 17 bp, Homo sapiens
ctttagagttagactgt

SEQ ID NO: 2405636 - DNA, 20 bp, Homo sapiens
ctttagagttagactgttgg

SEQ ID NO: 2405637 - DNA, 15 bp, Homo sapiens
ctttaggcattaaat

SEQ ID NO: 2405638 - DNA, 21 bp, Homo sapiens
ctttattttctataatttaaa

SEQ ID NO: 2405639 - DNA, 13 bp, Homo sapiens
ctttattttgaga

SEQ ID NO: 2405640 - DNA, 11 bp, Homo sapiens
ctttcagagcc

SEQ ID NO: 2405641 - DNA, 14 bp, Homo sapiens
ctttcagagcctcc

SEQ ID NO: 2405642 - DNA, 18 bp, Homo sapiens
ctttccctaagccagctg

SEQ ID NO: 2405643 - DNA, 18 bp, Homo sapiens
ctttccctccttggtgat

SEQ ID NO: 2405644 - DNA, 17 bp, Homo sapiens
ctttcttagaaatttat

SEQ ID NO: 2405645 - DNA, 17 bp, Homo sapiens
ctttctttcttagaaat

SEQ ID NO: 2405646 - DNA, 18 bp, Homo sapiens
ctttctttgggaatattt

SEQ ID NO: 2405647 - DNA, 20 bp, Homo sapiens
ctttctttgggaatatttga

SEQ ID NO: 2405648 - DNA, 17 bp, Homo sapiens
ctttgacaaaggtaaat

SEQ ID NO: 2405649 - DNA, 18 bp, Homo sapiens
ctttgacaattgggagct

SEQ ID NO: 2405650 - DNA, 23 bp, Homo sapiens
ctttgacaattgggagctgccaa

SEQ ID NO: 2405651 - DNA, 18 bp, Homo sapiens
ctttgccctgctgccctc

SEQ ID NO: 2405652 - DNA, 14 bp, Homo sapiens
ctttgctgaccctc

SEQ ID NO: 2405653 - DNA, 23 bp, Homo sapiens
ctttgctgaccctccccaaaggc

SEQ ID NO: 2405654 - DNA, 12 bp, Homo sapiens
ctttgcttcatt

SEQ ID NO: 2405655 - DNA, 20 bp, Homo sapiens
ctttgggaatatttgaatct

SEQ ID NO: 2405656 - DNA, 13 bp, Homo sapiens
ctttgtaatgaaa

SEQ ID NO: 2405657 - DNA, 14 bp, Homo sapiens
ctttgtaatgaaaa

SEQ ID NO: 2405658 - DNA, 16 bp, Homo sapiens
ctttgtaatgaaaacc

SEQ ID NO: 2405659 - DNA, 14 bp, Homo sapiens
cttttatgtgaaac

SEQ ID NO: 2405660 - DNA, 18 bp, Homo sapiens
cttttcttctattgcctc

SEQ ID NO: 2405661 - DNA, 17 bp, Homo sapiens
ctttttgggagagactt

SEQ ID NO: 2405662 - DNA, 16 bp, Homo sapiens
ctttttttagagaagt

SEQ ID NO: 2405663 - DNA, 14 bp, Homo sapiens
gaaaaatgtaggag

SEQ ID NO: 2405664 - DNA, 17 bp, Homo sapiens
gaaaaatgtaggagact

SEQ ID NO: 2405665 - DNA, 19 bp, Homo sapiens
gaaaacttgtattatgtgt

SEQ ID NO: 2405666 - DNA, 19 bp, Homo sapiens
gaaaataagagctcaggat

SEQ ID NO: 2405667 - DNA, 18 bp, Homo sapiens
gaaaatcttataatttaa

SEQ ID NO: 2405668 - DNA, 22 bp, Homo sapiens
gaaaattctaacccaggtatcc

SEQ ID NO: 2405669 - DNA, 23 bp, Homo sapiens
gaaaattgtgctggaaatggaca

SEQ ID NO: 2405670 - DNA, 13 bp, Homo sapiens
gaaacatttatat

SEQ ID NO: 2405671 - DNA, 19 bp, Homo sapiens
gaaactaggtgcatattta

SEQ ID NO: 2405672 - DNA, 16 bp, Homo sapiens
gaaagaccatttttcc

SEQ ID NO: 2405673 - DNA, 16 bp, Homo sapiens
gaaagcttcagtgctg

SEQ ID NO: 2405674 - DNA, 18 bp, Homo sapiens
gaaaggcctttaaaattt

SEQ ID NO: 2405675 - DNA, 11 bp, Homo sapiens
gaaatgaaaaa

SEQ ID NO: 2405676 - DNA, 17 bp, Homo sapiens
gaaattgcctgacgaac

SEQ ID NO: 2405677 - DNA, 16 bp, Homo sapiens
gaaattgtattacaaa

SEQ ID NO: 2405678 - DNA, 18 bp, Homo sapiens
gaaattgtattacaaatc

SEQ ID NO: 2405679 - DNA, 17 bp, Homo sapiens
gaaatttataaactttt

SEQ ID NO: 2405680 - DNA, 14 bp, Homo sapiens
gaactactgaggat

SEQ ID NO: 2405681 - DNA, 18 bp, Homo sapiens
gaactagccaaaccagga

SEQ ID NO: 2405682 - DNA, 15 bp, Homo sapiens
gaactccttgatttt

SEQ ID NO: 2405683 - DNA, 21 bp, Homo sapiens
gaactgcctttggcagagttc

SEQ ID NO: 2405684 - DNA, 18 bp, Homo sapiens
gaactggaccctgttgct

SEQ ID NO: 2405685 - DNA, 22 bp, Homo sapiens
gaactggaccctgttgctaagc

SEQ ID NO: 2405686 - DNA, 21 bp, Homo sapiens
gaactgtctctcatgaacctc

SEQ ID NO: 2405687 - DNA, 22 bp, Homo sapiens
gaacttgctgctgagtgcacca

SEQ ID NO: 2405688 - DNA, 22 bp, Homo sapiens
gaacttgtaaaggaatttaaaa

SEQ ID NO: 2405689 - DNA, 20 bp, Homo sapiens
gaagctatcgtaaaattaag

SEQ ID NO: 2405690 - DNA, 14 bp, Homo sapiens
gaaggatgctgtct

SEQ ID NO: 2405691 - DNA, 11 bp, Homo sapiens
gaaggcaagat

SEQ ID NO: 2405692 - DNA, 13 bp, Homo sapiens
gaagtttgaatgt

SEQ ID NO: 2405693 - DNA, 20 bp, Homo sapiens
gaagtttgaatgttaaataa

SEQ ID NO: 2405694 - DNA, 20 bp, Homo sapiens
gaataatcctaaacatatga

SEQ ID NO: 2405695 - DNA, 12 bp, Homo sapiens
gaatatttgaat

SEQ ID NO: 2405696 - DNA, 16 bp, Homo sapiens
gaatatttgaatcttg

SEQ ID NO: 2405697 - DNA, 18 bp, Homo sapiens
gaatcagcctacaggcct

SEQ ID NO: 2405698 - DNA, 19 bp, Homo sapiens
gaatccccaacatgcactg

SEQ ID NO: 2405699 - DNA, 18 bp, Homo sapiens
gaatctctgaatttgaga

SEQ ID NO: 2405700 - DNA, 13 bp, Homo sapiens
gaatcttgtctca

SEQ ID NO: 2405701 - DNA, 15 bp, Homo sapiens
gaatggaaagcttca

SEQ ID NO: 2405702 - DNA, 18 bp, Homo sapiens
gtgatttacgctcattgt

SEQ ID NO: 2405703 - DNA, 22 bp, Homo sapiens
gtgcacatatccaggcaccagg

SEQ ID NO: 2405704 - DNA, 18 bp, Homo sapiens
gtgcacgcacactgtctg

SEQ ID NO: 2405705 - DNA, 24 bp, Homo sapiens
gtgcagtggcatcatctcagctca

SEQ ID NO: 2405706 - DNA, 11 bp, Homo sapiens
gtgcattgtgc

SEQ ID NO: 2405707 - DNA, 17 bp, Homo sapiens
gtgcatttatgagctct

SEQ ID NO: 2405708 - DNA, 12 bp, Homo sapiens
gtgccttcattt

SEQ ID NO: 2405709 - DNA, 13 bp, Homo sapiens
gtgctaagtgtga

SEQ ID NO: 2405710 - DNA, 17 bp, Homo sapiens
gtgctaagtgtgaactg

SEQ ID NO: 2405711 - DNA, 13 bp, Homo sapiens
gtgctaattttga

SEQ ID NO: 2405712 - DNA, 15 bp, Homo sapiens
gtgctaattttgaaa

SEQ ID NO: 2405713 - DNA, 19 bp, Homo sapiens
gtgctcgctgttgctgaat

SEQ ID NO: 2405714 - DNA, 15 bp, Homo sapiens
gtgctgtataaaatc

SEQ ID NO: 2405715 - DNA, 15 bp, Homo sapiens
gtggcaggaaaatgg

SEQ ID NO: 2405716 - DNA, 11 bp, Homo sapiens
gtggcagtctg

SEQ ID NO: 2405717 - DNA, 19 bp, Homo sapiens
gtggcgtgatctcagctca

SEQ ID NO: 2405718 - DNA, 17 bp, Homo sapiens
gtggctttcagagcctc

SEQ ID NO: 2405719 - DNA, 12 bp, Homo sapiens
gtgggctaagca

SEQ ID NO: 2405720 - DNA, 13 bp, Homo sapiens
gtgggtataaaag

SEQ ID NO: 2405721 - DNA, 12 bp, Homo sapiens
gtgtataaaaat

SEQ ID NO: 2405722 - DNA, 18 bp, Homo sapiens
gtgtataaaaataaaaaa

SEQ ID NO: 2405723 - DNA, 21 bp, Homo sapiens
gtgtcccattcccccagtgcg

SEQ ID NO: 2405724 - DNA, 22 bp, Homo sapiens
gtgtgaactggaccctgttgct

SEQ ID NO: 2405725 - DNA, 16 bp, Homo sapiens
gtgtgctcaggagccc

SEQ ID NO: 2405726 - DNA, 20 bp, Homo sapiens
gtgtggagagggaatgtgaa

SEQ ID NO: 2405727 - DNA, 23 bp, Homo sapiens
gtgttacccagtaactcatctgt

SEQ ID NO: 2405728 - DNA, 12 bp, Homo sapiens
gtgtttgtcatt

SEQ ID NO: 2405729 - DNA, 15 bp, Homo sapiens
gttaaagctgccggc

SEQ ID NO: 2405730 - DNA, 18 bp, Homo sapiens
gttaaataaattgtatat

SEQ ID NO: 2405731 - DNA, 15 bp, Homo sapiens
gttactacatgcact

SEQ ID NO: 2405732 - DNA, 20 bp, Homo sapiens
gttagtcgtgagctcttgtg

SEQ ID NO: 2405733 - DNA, 22 bp, Homo sapiens
gttagtcgtgagctcttgtgag

SEQ ID NO: 2405734 - DNA, 19 bp, Homo sapiens
gttatctaatagggcaatt

SEQ ID NO: 2405735 - DNA, 17 bp, Homo sapiens
gttattatatttacaaa

SEQ ID NO: 2405736 - DNA, 17 bp, Homo sapiens
gttcaagcgattctctt

SEQ ID NO: 2405737 - DNA, 18 bp, Homo sapiens
gttcaagcgattctcttg

SEQ ID NO: 2405738 - DNA, 14 bp, Homo sapiens
gttcagtaccacat

SEQ ID NO: 2405739 - DNA, 16 bp, Homo sapiens
gttcatccattctatt

SEQ ID NO: 2405740 - DNA, 13 bp, Homo sapiens
gttcattcctcca

SEQ ID NO: 2405741 - DNA, 13 bp, Homo sapiens
gttcatttcctca

SEQ ID NO: 2405742 - DNA, 20 bp, Homo sapiens
gttctctaatatgtaaaatt

SEQ ID NO: 2405743 - DNA, 22 bp, Homo sapiens
gttctctatcatttaataatat

SEQ ID NO: 2405744 - DNA, 19 bp, Homo sapiens
gttcttctaccacccacca

SEQ ID NO: 2405745 - DNA, 20 bp, Homo sapiens
gttgaattttttttaacatt

SEQ ID NO: 2405746 - DNA, 16 bp, Homo sapiens
gttgcaactttgtata

SEQ ID NO: 2405747 - DNA, 17 bp, Homo sapiens
gttgctaagccccagca

SEQ ID NO: 2405748 - DNA, 15 bp, Homo sapiens
gttggagtgcagtgg

SEQ ID NO: 2405749 - DNA, 19 bp, Homo sapiens
gttgggcagccagaccagc

SEQ ID NO: 2405750 - DNA, 23 bp, Homo sapiens
gttggggtgggtataaaagatgg

SEQ ID NO: 2405751 - DNA, 17 bp, Homo sapiens
gttgtaatatttcttca

SEQ ID NO: 2405752 - DNA, 19 bp, Homo sapiens
gtttaggaactactgagga

SEQ ID NO: 2405753 - DNA, 20 bp, Homo sapiens
gtttctgagttcctgcatgc

SEQ ID NO: 2405754 - DNA, 19 bp, Homo sapiens
gtttctttgtaatgaaaac

SEQ ID NO: 2405755 - DNA, 19 bp, Homo sapiens
gtttgcatctgaaaattga

SEQ ID NO: 2405756 - DNA, 15 bp, Homo sapiens
gtttggtattgtatt

SEQ ID NO: 2405757 - DNA, 16 bp, Homo sapiens
gttttaaaatgagaaa

SEQ ID NO: 2405758 - DNA, 17 bp, Homo sapiens
gttttgacatttttagt

SEQ ID NO: 2405759 - DNA, 15 bp, Homo sapiens
gtttttcataaagca

SEQ ID NO: 2405760 - DNA, 12 bp, Homo sapiens
taaaaaacactg

SEQ ID NO: 2405761 - DNA, 17 bp, Homo sapiens
taaaaaagatcccaaat

SEQ ID NO: 2405762 - DNA, 21 bp, Homo sapiens
taaaaataaaaaacactggga

SEQ ID NO: 2405763 - DNA, 17 bp, Homo sapiens
taaaaataaaaaagatc

SEQ ID NO: 2405764 - DNA, 13 bp, Homo sapiens
taaaagatataag

SEQ ID NO: 2405765 - DNA, 16 bp, Homo sapiens
taaaagatataagtgc

SEQ ID NO: 2405766 - DNA, 20 bp, Homo sapiens
taaaagatataagtgctgta

SEQ ID NO: 2405767 - DNA, 18 bp, Homo sapiens
taaaagatggggtctgta

SEQ ID NO: 2405768 - DNA, 21 bp, Homo sapiens
taaaagggactgagaaattta

SEQ ID NO: 2405769 - DNA, 14 bp, Homo sapiens
taaaatcagccaat

SEQ ID NO: 2405770 - DNA, 17 bp, Homo sapiens
taaaatcagccaattat

SEQ ID NO: 2405771 - DNA, 20 bp, Homo sapiens
taaaatcttgtcatgtgtat

SEQ ID NO: 2405772 - DNA, 21 bp, Homo sapiens
taaaatcttgtcatgtgtata

SEQ ID NO: 2405773 - DNA, 18 bp, Homo sapiens
taaaatctttctttctta

SEQ ID NO: 2405774 - DNA, 22 bp, Homo sapiens
taaaatctttctttcttagaaa

SEQ ID NO: 2405775 - DNA, 19 bp, Homo sapiens
taaaattacactttgaact

SEQ ID NO: 2405776 - DNA, 14 bp, Homo sapiens
taaaattgccatat

SEQ ID NO: 2405777 - DNA, 16 bp, Homo sapiens
taaaatttttttagaa

SEQ ID NO: 2405778 - DNA, 17 bp, Homo sapiens
taaaatttttttagaaa

SEQ ID NO: 2405779 - DNA, 19 bp, Homo sapiens
taaaatttttttagaaagc

SEQ ID NO: 2405780 - DNA, 15 bp, Homo sapiens
taaacactcttgaaa

SEQ ID NO: 2405781 - DNA, 19 bp, Homo sapiens
taaactagcatatctgcct

SEQ ID NO: 2405782 - DNA, 23 bp, Homo sapiens
taaactagcatatctgcctttat

SEQ ID NO: 2405783 - DNA, 20 bp, Homo sapiens
taaacttttttcttactgtc

SEQ ID NO: 2405784 - DNA, 15 bp, Homo sapiens
taaagaattattttg

SEQ ID NO: 2405785 - DNA, 16 bp, Homo sapiens
taaagacttttatgat

SEQ ID NO: 2405786 - DNA, 14 bp, Homo sapiens
taaagtatttaatt

SEQ ID NO: 2405787 - DNA, 19 bp, Homo sapiens
taaagtatttaattagtgc

SEQ ID NO: 2405788 - DNA, 17 bp, Homo sapiens
taaagttggtaaacctt

SEQ ID NO: 2405789 - DNA, 17 bp, Homo sapiens
taaataaaaataatcct

SEQ ID NO: 2405790 - DNA, 12 bp, Homo sapiens
taaataaagttt

SEQ ID NO: 2405791 - DNA, 16 bp, Homo sapiens
taaataaattgtatat

SEQ ID NO: 2405792 - DNA, 17 bp, Homo sapiens
taaataaattgtatatt

SEQ ID NO: 2405793 - DNA, 19 bp, Homo sapiens
taaataaattgtatattca

SEQ ID NO: 2405794 - DNA, 16 bp, Homo sapiens
taaatatattttaaga

SEQ ID NO: 2405795 - DNA, 22 bp, Homo sapiens
taaatatattttaagacgaaac

SEQ ID NO: 2405796 - DNA, 22 bp, Homo sapiens
taaatattttttcttttctatt

SEQ ID NO: 2405797 - DNA, 23 bp, Homo sapiens
taaatgtttttttttaaagactt

SEQ ID NO: 2405798 - DNA, 22 bp, Homo sapiens
taaatttgtactatttaactga

SEQ ID NO: 2405799 - DNA, 15 bp, Homo sapiens
taacaaccaaagact

SEQ ID NO: 2405800 - DNA, 19 bp, Homo sapiens
taacatgaatatttagtgt

SEQ ID NO: 2405801 - DNA, 20 bp, Homo sapiens
taacatgaatatttagtgtt

SEQ ID NO: 2405802 - DNA, 21 bp, Homo sapiens
taaccttaccagatttttaca

SEQ ID NO: 2405803 - DNA, 20 bp, Homo sapiens
taacgataaaagacagtgaa

SEQ ID NO: 2405804 - DNA, 14 bp, Homo sapiens
taacggatcagaaa

SEQ ID NO: 2405805 - DNA, 13 bp, Homo sapiens
taacgtataaaag

SEQ ID NO: 2405806 - DNA, 17 bp, Homo sapiens
taacgtataaaagcctg

SEQ ID NO: 2405807 - DNA, 14 bp, Homo sapiens
taactcatctgtca

SEQ ID NO: 2405808 - DNA, 14 bp, Homo sapiens
taactgactattct

SEQ ID NO: 2405809 - DNA, 21 bp, Homo sapiens
taactgactattcttgatgta

SEQ ID NO: 2405810 - DNA, 15 bp, Homo sapiens
taactggaaagaagt

SEQ ID NO: 2405811 - DNA, 20 bp, Homo sapiens
taacttccctgaaaaatcta

SEQ ID NO: 2405812 - DNA, 12 bp, Homo sapiens
taagagctcagg

SEQ ID NO: 2405813 - DNA, 19 bp, Homo sapiens
taagatatgggacattttt

SEQ ID NO: 2405814 - DNA, 18 bp, Homo sapiens
taagatatttttcatgat

SEQ ID NO: 2405815 - DNA, 15 bp, Homo sapiens
taagccagctgcccc

SEQ ID NO: 2405816 - DNA, 22 bp, Homo sapiens
taagccagctgcccccagagcc

SEQ ID NO: 2405817 - DNA, 15 bp, Homo sapiens
taagccatgggagac

SEQ ID NO: 2405818 - DNA, 16 bp, Homo sapiens
taagctggagtgcagt

SEQ ID NO: 2405819 - DNA, 16 bp, Homo sapiens
taagcttttcttttct

SEQ ID NO: 2405820 - DNA, 20 bp, Homo sapiens
taaggatggagccagctctg

SEQ ID NO: 2405821 - DNA, 19 bp, Homo sapiens
taagggccagaaatatctt

SEQ ID NO: 2405822 - DNA, 22 bp, Homo sapiens
taagtgattgctggttttagtt

SEQ ID NO: 2405823 - DNA, 15 bp, Homo sapiens
taagtgctgtataaa

SEQ ID NO: 2405824 - DNA, 22 bp, Homo sapiens
taagtgctgtataaaatcagcc

SEQ ID NO: 2405825 - DNA, 23 bp, Homo sapiens
taagtgctgtataaaatcagcca

SEQ ID NO: 2405826 - DNA, 15 bp, Homo sapiens
taagtgtgaactgga

SEQ ID NO: 2405827 - DNA, 20 bp, Homo sapiens
taagttatttttacattctg

SEQ ID NO: 2405828 - DNA, 12 bp, Homo sapiens
taataaagctgt

SEQ ID NO: 2405829 - DNA, 13 bp, Homo sapiens
taataatatactt

SEQ ID NO: 2405830 - DNA, 19 bp, Homo sapiens
taataatatacttgtggac

SEQ ID NO: 2405831 - DNA, 21 bp, Homo sapiens
taataatatacttgtggacta

SEQ ID NO: 2405832 - DNA, 19 bp, Homo sapiens
tgttgccttgcataatggt

SEQ ID NO: 2405833 - DNA, 12 bp, Homo sapiens
tgttgctaagcc

SEQ ID NO: 2405834 - DNA, 22 bp, Homo sapiens
tgttgctaagccccagcaagca

SEQ ID NO: 2405835 - DNA, 11 bp, Homo sapiens
tgttgctgaat

SEQ ID NO: 2405836 - DNA, 23 bp, Homo sapiens
tgttgctgaataggcgatcacaa

SEQ ID NO: 2405837 - DNA, 18 bp, Homo sapiens
tgttggggtgggtataaa

SEQ ID NO: 2405838 - DNA, 23 bp, Homo sapiens
tgttggggtgggtataaaagatg

SEQ ID NO: 2405839 - DNA, 18 bp, Homo sapiens
tgtttctttgtaatgaaa

SEQ ID NO: 2405840 - DNA, 19 bp, Homo sapiens
tgtttctttgtaatgaaaa

SEQ ID NO: 2405841 - DNA, 20 bp, Homo sapiens
tgtttgtacacaacaatcct

SEQ ID NO: 2405842 - DNA, 12 bp, Homo sapiens
tgttttttctaa

SEQ ID NO: 2405843 - DNA, 20 bp, Homo sapiens
ttaaactaaggccctcttga

SEQ ID NO: 2405844 - DNA, 17 bp, Homo sapiens
ttaaactagcatatctg

SEQ ID NO: 2405845 - DNA, 21 bp, Homo sapiens
ttaaactagcatatctgcctt

SEQ ID NO: 2405846 - DNA, 13 bp, Homo sapiens
ttaaataaattgt

SEQ ID NO: 2405847 - DNA, 21 bp, Homo sapiens
ttaaatgtttttttttaaaga

SEQ ID NO: 2405848 - DNA, 18 bp, Homo sapiens
ttaacacctttaaagtgt

SEQ ID NO: 2405849 - DNA, 11 bp, Homo sapiens
ttaacattcct

SEQ ID NO: 2405850 - DNA, 19 bp, Homo sapiens
ttaagacgaaacatttgtt

SEQ ID NO: 2405851 - DNA, 22 bp, Homo sapiens
ttaagacgaaacatttgttcta

SEQ ID NO: 2405852 - DNA, 20 bp, Homo sapiens
ttaatatatattatcttttc

SEQ ID NO: 2405853 - DNA, 13 bp, Homo sapiens
ttaatattgattt

SEQ ID NO: 2405854 - DNA, 16 bp, Homo sapiens
ttaatctgtatttccc

SEQ ID NO: 2405855 - DNA, 19 bp, Homo sapiens
ttaatggtgccttcatttg

SEQ ID NO: 2405856 - DNA, 20 bp, Homo sapiens
ttaatggtgccttcatttgg

SEQ ID NO: 2405857 - DNA, 22 bp, Homo sapiens
ttaatgtcaattcttgccaaat

SEQ ID NO: 2405858 - DNA, 14 bp, Homo sapiens
ttaattagtgctaa

SEQ ID NO: 2405859 - DNA, 18 bp, Homo sapiens
ttaattagtgctaagtgt

SEQ ID NO: 2405860 - DNA, 21 bp, Homo sapiens
ttaattagtgctaagtgtgaa

SEQ ID NO: 2405861 - DNA, 20 bp, Homo sapiens
ttaattccttcagcacttta

SEQ ID NO: 2405862 - DNA, 13 bp, Homo sapiens
ttacatcatttct

SEQ ID NO: 2405863 - DNA, 14 bp, Homo sapiens
ttacatcatttctt

SEQ ID NO: 2405864 - DNA, 22 bp, Homo sapiens
ttacatgcattactgcatgcac

SEQ ID NO: 2405865 - DNA, 13 bp, Homo sapiens
ttacattctgaat

SEQ ID NO: 2405866 - DNA, 13 bp, Homo sapiens
ttacctttgacaa

SEQ ID NO: 2405867 - DNA, 14 bp, Homo sapiens
ttactacatgcact

SEQ ID NO: 2405868 - DNA, 17 bp, Homo sapiens
ttactgtcttttttcta

SEQ ID NO: 2405869 - DNA, 19 bp, Homo sapiens
ttagaaagcatttgaatgc

SEQ ID NO: 2405870 - DNA, 19 bp, Homo sapiens
ttagaccaccaagccttga

SEQ ID NO: 2405871 - DNA, 20 bp, Homo sapiens
ttagactgttggggtgggta

SEQ ID NO: 2405872 - DNA, 14 bp, Homo sapiens
ttagagttagactg

SEQ ID NO: 2405873 - DNA, 18 bp, Homo sapiens
ttagcaggaagctgtgag

SEQ ID NO: 2405874 - DNA, 17 bp, Homo sapiens
ttagccttctctgttca

SEQ ID NO: 2405875 - DNA, 13 bp, Homo sapiens
ttagtaatcatat

SEQ ID NO: 2405876 - DNA, 19 bp, Homo sapiens
ttagtcgtgagctcttgtg

SEQ ID NO: 2405877 - DNA, 21 bp, Homo sapiens
ttagtcgtgagctcttgtgag

SEQ ID NO: 2405878 - DNA, 16 bp, Homo sapiens
ttagtgctaagtgtga

SEQ ID NO: 2405879 - DNA, 17 bp, Homo sapiens
ttagtgctaagtgtgaa

SEQ ID NO: 2405880 - DNA, 19 bp, Homo sapiens
ttagtgctaagtgtgaact

SEQ ID NO: 2405881 - DNA, 14 bp, Homo sapiens
ttagtgttcataaa

SEQ ID NO: 2405882 - DNA, 20 bp, Homo sapiens
ttagttgcaactttgtataa

SEQ ID NO: 2405883 - DNA, 22 bp, Homo sapiens
ttataaaaataaaaaacactgg

SEQ ID NO: 2405884 - DNA, 16 bp, Homo sapiens
ttatatttacaaatgg

SEQ ID NO: 2405885 - DNA, 17 bp, Homo sapiens
ttatcatgtgaaatcat

SEQ ID NO: 2405886 - DNA, 14 bp, Homo sapiens
ttatcttgaataat

SEQ ID NO: 2405887 - DNA, 13 bp, Homo sapiens
ttatgggtcacag

SEQ ID NO: 2405888 - DNA, 15 bp, Homo sapiens
ttatgggtcacagga

SEQ ID NO: 2405889 - DNA, 13 bp, Homo sapiens
ttatgtgaaacat

SEQ ID NO: 2405890 - DNA, 15 bp, Homo sapiens
ttatgtgaaacatgt

SEQ ID NO: 2405891 - DNA, 10 bp, Homo sapiens
ttatgttaaa

SEQ ID NO: 2405892 - DNA, 12 bp, Homo sapiens
ttatgttaaact

SEQ ID NO: 2405893 - DNA, 13 bp, Homo sapiens
ttatgttaaacta

SEQ ID NO: 2405894 - DNA, 15 bp, Homo sapiens
ttattatatttacaa

SEQ ID NO: 2405895 - DNA, 21 bp, Homo sapiens
ttattcaataaagtatttaat

SEQ ID NO: 2405896 - DNA, 19 bp, Homo sapiens
ttattgcagcgattaataa

SEQ ID NO: 2405897 - DNA, 19 bp, Homo sapiens
ttattgtgtttgtcattag

SEQ ID NO: 2405898 - DNA, 20 bp, Homo sapiens
ttattgtgtttgtcattagc

SEQ ID NO: 2405899 - DNA, 20 bp, Homo sapiens
ttatttatgcctctgtattt

SEQ ID NO: 2405900 - DNA, 15 bp, Homo sapiens
ttatttcatgaaaat

SEQ ID NO: 2405901 - DNA, 18 bp, Homo sapiens
ttatttcctagttctgta

SEQ ID NO: 2405902 - DNA, 20 bp, Homo sapiens
ttattttatgttgcatagaa

SEQ ID NO: 2405903 - DNA, 17 bp, Homo sapiens
ttatttttttctgaatt

SEQ ID NO: 2405904 - DNA, 18 bp, Homo sapiens
ttcaagcgattctcctgc

SEQ ID NO: 2405905 - DNA, 21 bp, Homo sapiens
ttcaagcgattctcctgcctc

SEQ ID NO: 2405906 - DNA, 18 bp, Homo sapiens
ttcaataaagtatttaat

SEQ ID NO: 2405907 - DNA, 13 bp, Homo sapiens
ttcagccaggagc

SEQ ID NO: 2405908 - DNA, 15 bp, Homo sapiens
ttcagccctcagaat

SEQ ID NO: 2405909 - DNA, 18 bp, Homo sapiens
ttcaggacactcactaca

SEQ ID NO: 2405910 - DNA, 20 bp, Homo sapiens
ttcaggagagagttgaacct

SEQ ID NO: 2405911 - DNA, 20 bp, Homo sapiens
ttcataaataaagtttgttg

SEQ ID NO: 2405912 - DNA, 13 bp, Homo sapiens
ttcattcctccag

SEQ ID NO: 2405913 - DNA, 16 bp, Homo sapiens
ttccagacctgaagaa

SEQ ID NO: 2405914 - DNA, 18 bp, Homo sapiens
ttcccaccaggctgctca

SEQ ID NO: 2405915 - DNA, 23 bp, Homo sapiens
ttccccatggttttaatctgtat

SEQ ID NO: 2405916 - DNA, 15 bp, Homo sapiens
ttccctttttttaag

SEQ ID NO: 2405917 - DNA, 19 bp, Homo sapiens
ttccgtaggttattttcag

SEQ ID NO: 2405918 - DNA, 21 bp, Homo sapiens
ttcctaaatatattttaagac

SEQ ID NO: 2405919 - DNA, 16 bp, Homo sapiens
ttcctagttctgtaga

SEQ ID NO: 2405920 - DNA, 20 bp, Homo sapiens
ttcctagttctgtagaaatg

SEQ ID NO: 2405921 - DNA, 21 bp, Homo sapiens
ttcctcacaccaggcttgcct

SEQ ID NO: 2405922 - DNA, 16 bp, Homo sapiens
ttcctcatgaatgtaa

SEQ ID NO: 2405923 - DNA, 15 bp, Homo sapiens
ttcctgcttttcccc

SEQ ID NO: 2405924 - DNA, 21 bp, Homo sapiens
ttcctgtggatgtaaagtgat

SEQ ID NO: 2405925 - DNA, 19 bp, Homo sapiens
ttccttcagcactttagaa

SEQ ID NO: 2405926 - DNA, 17 bp, Homo sapiens
ttccttcatttcctccg

SEQ ID NO: 2405927 - DNA, 22 bp, Homo sapiens
ttcctttgaatcctctctctgt

SEQ ID NO: 2405928 - DNA, 19 bp, Homo sapiens
ttcgtctgtttataaacat

SEQ ID NO: 2405929 - DNA, 13 bp, Homo sapiens
ttcgttatctaat

SEQ ID NO: 2405930 - DNA, 15 bp, Homo sapiens
ttctaaagtaaaaac

SEQ ID NO: 2405931 - DNA, 14 bp, Homo sapiens
ttctaagaaacatt

SEQ ID NO: 2405932 - DNA, 14 bp, Homo sapiens
ttctataatttaaa

SEQ ID NO: 2405933 - DNA, 14 bp, Homo sapiens
ttctatagcttttc

SEQ ID NO: 2405934 - DNA, 15 bp, Homo sapiens
ttctattgcctctga

SEQ ID NO: 2405935 - DNA, 17 bp, Homo sapiens
ttctattgcctctgaga

SEQ ID NO: 2405936 - DNA, 15 bp, Homo sapiens
ttctcaagccctgca

SEQ ID NO: 2405937 - DNA, 21 bp, Homo sapiens
ttctcacagtgggagccaggg

SEQ ID NO: 2405938 - DNA, 19 bp, Homo sapiens
ttctccagcctcagcctcc

SEQ ID NO: 2405939 - DNA, 15 bp, Homo sapiens
ttctccatcctacca

SEQ ID NO: 2405940 - DNA, 23 bp, Homo sapiens
ttctcccaattcatcctcactca

SEQ ID NO: 2405941 - DNA, 18 bp, Homo sapiens
ttctcccctgcactgtaa

SEQ ID NO: 2405942 - DNA, 20 bp, Homo sapiens
ttctcccctgcactgtaaaa

SEQ ID NO: 2405943 - DNA, 14 bp, Homo sapiens
ttctgagcatttaa

SEQ ID NO: 2405944 - DNA, 12 bp, Homo sapiens
ttctgagttcct

SEQ ID NO: 2405945 - DNA, 15 bp, Homo sapiens
ttctgagttttacca

SEQ ID NO: 2405946 - DNA, 19 bp, Homo sapiens
ttctggacccgttcaactt

SEQ ID NO: 2405947 - DNA, 12 bp, Homo sapiens
ttcttagaaatt

SEQ ID NO: 2405948 - DNA, 14 bp, Homo sapiens
ttcttatttcatga

SEQ ID NO: 2405949 - DNA, 16 bp, Homo sapiens
ttcttatttcatgaaa

SEQ ID NO: 2405950 - DNA, 14 bp, Homo sapiens
ttcttccatctgat

SEQ ID NO: 2405951 - DNA, 15 bp, Homo sapiens
ttcttgatgtaaaat

SEQ ID NO: 2405952 - DNA, 19 bp, Homo sapiens
ttcttgatgtaaaatcttg

SEQ ID NO: 2405953 - DNA, 14 bp, Homo sapiens
ttctttaacttaat

SEQ ID NO: 2405954 - DNA, 13 bp, Homo sapiens
ttctttcttagaa

SEQ ID NO: 2405955 - DNA, 14 bp, Homo sapiens
ttctttcttagaaa

SEQ ID NO: 2405956 - DNA, 19 bp, Homo sapiens
ttctttttgggagagactt

SEQ ID NO: 2405957 - DNA, 21 bp, Homo sapiens
ttgaaaggggttgtgaagagg

SEQ ID NO: 2405958 - DNA, 20 bp, Homo sapiens
ttgaacctgatgaaaataaa

SEQ ID NO: 2405959 - DNA, 17 bp, Homo sapiens
ttgaatcttgtctcaat

SEQ ID NO: 2405960 - DNA, 20 bp, Homo sapiens
ttgaatcttgtctcaatgct

SEQ ID NO: 2405961 - DNA, 23 bp, Homo sapiens
ttgaatcttgtctcaatgctcat

SEQ ID NO: 2405962 - DNA, 20 bp, Homo sapiens
aatattttgctagtttttga

SEQ ID NO: 2405963 - DNA, 18 bp, Homo sapiens
aatcagccaattatgtta

SEQ ID NO: 2405964 - DNA, 19 bp, Homo sapiens
aatcagccaattatgttaa

SEQ ID NO: 2405965 - DNA, 15 bp, Homo sapiens
aatcatcaagtcttt

SEQ ID NO: 2405966 - DNA, 17 bp, Homo sapiens
aatcatggtgctcagag

SEQ ID NO: 2405967 - DNA, 18 bp, Homo sapiens
aatccccaacatgcactg

SEQ ID NO: 2405968 - DNA, 16 bp, Homo sapiens
aatccccttctcccct

SEQ ID NO: 2405969 - DNA, 23 bp, Homo sapiens
aatccccttctcccctgcactgt

SEQ ID NO: 2405970 - DNA, 23 bp, Homo sapiens
aatcgctccaccttgcagctctc

SEQ ID NO: 2405971 - DNA, 18 bp, Homo sapiens
aatcttgtcatgtgtata

SEQ ID NO: 2405972 - DNA, 12 bp, Homo sapiens
agatatttttca

SEQ ID NO: 2405973 - DNA, 13 bp, Homo sapiens
aaacattttctcc

SEQ ID NO: 2405974 - DNA, 19 bp, Homo sapiens
aaacctggagatggtggat

SEQ ID NO: 2405975 - DNA, 21 bp, Homo sapiens
aaactagcatatctgccttta

SEQ ID NO: 2405976 - DNA, 22 bp, Homo sapiens
aaactagcatatctgcctttat

SEQ ID NO: 2405977 - DNA, 22 bp, Homo sapiens
aaactaggtgcatatttataaa

SEQ ID NO: 2405978 - DNA, 16 bp, Homo sapiens
aaactcatttctagca

SEQ ID NO: 2405979 - DNA, 13 bp, Homo sapiens
aaagacagtgaaa

SEQ ID NO: 2405980 - DNA, 15 bp, Homo sapiens
aaagaccatttttcc

SEQ ID NO: 2405981 - DNA, 17 bp, Homo sapiens
aaagagtactcttgttt

SEQ ID NO: 2405982 - DNA, 16 bp, Homo sapiens
aaagatataagtgctg

SEQ ID NO: 2405983 - DNA, 21 bp, Homo sapiens
aaagatataagtgctgtataa

SEQ ID NO: 2405984 - DNA, 18 bp, Homo sapiens
aaagatggggtctgtaaa

SEQ ID NO: 2405985 - DNA, 21 bp, Homo sapiens
aaagatggggtctgtaaaatc

SEQ ID NO: 2405986 - DNA, 12 bp, Homo sapiens
atcatttaataa

SEQ ID NO: 2405987 - DNA, 21 bp, Homo sapiens
atcatttaataatatacttgt

SEQ ID NO: 2405988 - DNA, 20 bp, Homo sapiens
atccacccgcctcagcctcc

SEQ ID NO: 2405989 - DNA, 20 bp, Homo sapiens
atccccaacatgcactgatg

SEQ ID NO: 2405990 - DNA, 17 bp, Homo sapiens
atccccacgccacagcc

SEQ ID NO: 2405991 - DNA, 20 bp, Homo sapiens
atccccacgccacagccctt

SEQ ID NO: 2405992 - DNA, 15 bp, Homo sapiens
atccccagtaaaatt

SEQ ID NO: 2405993 - DNA, 21 bp, Homo sapiens
atccccagtaaaattgccata

SEQ ID NO: 2405994 - DNA, 13 bp, Homo sapiens
atccccttctccc

SEQ ID NO: 2405995 - DNA, 22 bp, Homo sapiens
atccccttctcccctgcactgt

SEQ ID NO: 2405996 - DNA, 23 bp, Homo sapiens
atccccttctcccctgcactgta

SEQ ID NO: 2405997 - DNA, 21 bp, Homo sapiens
atcctaccacaatgcagtgcc

SEQ ID NO: 2405998 - DNA, 22 bp, Homo sapiens
atcctaccacaatgcagtgcct

SEQ ID NO: 2405999 - DNA, 15 bp, Homo sapiens
atcctctttagagtt

SEQ ID NO: 2406000 - DNA, 19 bp, Homo sapiens
cacttcttacaataattct

SEQ ID NO: 2406001 - DNA, 22 bp, Homo sapiens
cacttgcggatattctggactg

SEQ ID NO: 2406002 - DNA, 22 bp, Homo sapiens
cactttacacaatagaattata

SEQ ID NO: 2406003 - DNA, 18 bp, Homo sapiens
cactttagaatatgcctt

SEQ ID NO: 2406004 - DNA, 12 bp, Homo sapiens
cactttgcataa

SEQ ID NO: 2406005 - DNA, 14 bp, Homo sapiens
cagaaatactactg

SEQ ID NO: 2406006 - DNA, 13 bp, Homo sapiens
cagaaggccaaga

SEQ ID NO: 2406007 - DNA, 14 bp, Homo sapiens
cagaaggccaagag

SEQ ID NO: 2406008 - DNA, 23 bp, Homo sapiens
cagaatcgctccaccttgcagct

SEQ ID NO: 2406009 - DNA, 14 bp, Homo sapiens
cagagacaacaggt

SEQ ID NO: 2406010 - DNA, 20 bp, Homo sapiens
cagagccccaccctcagatg

SEQ ID NO: 2406011 - DNA, 15 bp, Homo sapiens
cagagcgcacaggga

SEQ ID NO: 2406012 - DNA, 16 bp, Homo sapiens
cagatcctcctcattc

SEQ ID NO: 2406013 - DNA, 18 bp, Homo sapiens
cagattttgatagcaaag

SEQ ID NO: 2406014 - DNA, 19 bp, Homo sapiens
cagattttgatagcaaagc

SEQ ID NO: 2406015 - DNA, 20 bp, Homo sapiens
cagattttgatagcaaagcg

SEQ ID NO: 2406016 - DNA, 15 bp, Homo sapiens
cagcaagtcagggtt

SEQ ID NO: 2406017 - DNA, 22 bp, Homo sapiens
cagccaagtcggttagtggaag

SEQ ID NO: 2406018 - DNA, 17 bp, Homo sapiens
cagccaattatgttaaa

SEQ ID NO: 2406019 - DNA, 21 bp, Homo sapiens
cagccacggggactcagccct

SEQ ID NO: 2406020 - DNA, 22 bp, Homo sapiens
cagcccaggatactggcacaga

SEQ ID NO: 2406021 - DNA, 15 bp, Homo sapiens
cagccctgcaccatg

SEQ ID NO: 2406022 - DNA, 12 bp, Homo sapiens
cagcctccagag

SEQ ID NO: 2406023 - DNA, 13 bp, Homo sapiens
catttgaatgcat

SEQ ID NO: 2406024 - DNA, 15 bp, Homo sapiens
catttgaatgcattt

SEQ ID NO: 2406025 - DNA, 18 bp, Homo sapiens
catttgaatgcattttgt

SEQ ID NO: 2406026 - DNA, 23 bp, Homo sapiens
cattttacctttgacaaaggtaa

SEQ ID NO: 2406027 - DNA, 23 bp, Homo sapiens
cattttctaagaaacatttatat

SEQ ID NO: 2406028 - DNA, 17 bp, Homo sapiens
cattttctccctggatt

SEQ ID NO: 2406029 - DNA, 20 bp, Homo sapiens
cattttgtttggtattgtat

SEQ ID NO: 2406030 - DNA, 22 bp, Homo sapiens
cattttgtttggtattgtattt

SEQ ID NO: 2406031 - DNA, 20 bp, Homo sapiens
catttttgtattttgtttaa

SEQ ID NO: 2406032 - DNA, 19 bp, Homo sapiens
ccaaagtcctgggattaca

SEQ ID NO: 2406033 - DNA, 18 bp, Homo sapiens
ccaaagtgctgggattaa

SEQ ID NO: 2406034 - DNA, 17 bp, Homo sapiens
ccaacccgaggcccgca

SEQ ID NO: 2406035 - DNA, 16 bp, Homo sapiens
ccaactatggcctgtg

SEQ ID NO: 2406036 - DNA, 21 bp, Homo sapiens
ccaagaggctgttcccaccag

SEQ ID NO: 2406037 - DNA, 20 bp, Homo sapiens
ccaagcacctgggattacaa

SEQ ID NO: 2406038 - DNA, 20 bp, Homo sapiens
ccaagcagttgggactacag

SEQ ID NO: 2406039 - DNA, 22 bp, Homo sapiens
ccaagccttgattggtgttgcc

SEQ ID NO: 2406040 - DNA, 17 bp, Homo sapiens
ccaagttgtgcttgagc

SEQ ID NO: 2406041 - DNA, 14 bp, Homo sapiens
ccaattatgttaaa

SEQ ID NO: 2406042 - DNA, 15 bp, Homo sapiens
ccaattatgttaaac

SEQ ID NO: 2406043 - DNA, 21 bp, Homo sapiens
ccacactcagatcctcctcat

SEQ ID NO: 2406044 - DNA, 22 bp, Homo sapiens
ccacagctttttaccaagtttc

SEQ ID NO: 2406045 - DNA, 22 bp, Homo sapiens
ccacatcccactcacaacagct

SEQ ID NO: 2406046 - DNA, 21 bp, Homo sapiens
ccacctcgcaggttcaagcaa

SEQ ID NO: 2406047 - DNA, 17 bp, Homo sapiens
ccacggggactcagccc

SEQ ID NO: 2406048 - DNA, 16 bp, Homo sapiens
ccacgtactgcagcct

SEQ ID NO: 2406049 - DNA, 21 bp, Homo sapiens
cctgagacaaatggaggcctg

SEQ ID NO: 2406050 - DNA, 13 bp, Homo sapiens
cctgaggcctaga

SEQ ID NO: 2406051 - DNA, 21 bp, Homo sapiens
cctgagtagaaaggcctttaa

SEQ ID NO: 2406052 - DNA, 14 bp, Homo sapiens
cctgatgaaaataa

SEQ ID NO: 2406053 - DNA, 15 bp, Homo sapiens
cctgatgaaaataaa

SEQ ID NO: 2406054 - DNA, 18 bp, Homo sapiens
cctgatgaaaataaagaa

SEQ ID NO: 2406055 - DNA, 19 bp, Homo sapiens
cctgcaccatgctgctggg

SEQ ID NO: 2406056 - DNA, 11 bp, Homo sapiens
cctgcactgta

SEQ ID NO: 2406057 - DNA, 14 bp, Homo sapiens
cctgcactgtaaaa

SEQ ID NO: 2406058 - DNA, 15 bp, Homo sapiens
cctgcactgtaaaat

SEQ ID NO: 2406059 - DNA, 15 bp, Homo sapiens
cctgcagactcactg

SEQ ID NO: 2406060 - DNA, 22 bp, Homo sapiens
cctgcaggcaggaacaaacagg

SEQ ID NO: 2406061 - DNA, 23 bp, Homo sapiens
cctgcaggcaggaacaaacaggg

SEQ ID NO: 2406062 - DNA, 22 bp, Homo sapiens
cctgcatccattctcctgagga

SEQ ID NO: 2406063 - DNA, 16 bp, Homo sapiens
cctgctcagccctgca

SEQ ID NO: 2406064 - DNA, 11 bp, Homo sapiens
cctgctgccct

SEQ ID NO: 2406065 - DNA, 18 bp, Homo sapiens
cctgctgccctccccctc

SEQ ID NO: 2406066 - DNA, 18 bp, Homo sapiens
cctggaactgtctctcat

SEQ ID NO: 2406067 - DNA, 17 bp, Homo sapiens
cctggactgtgtgctca

SEQ ID NO: 2406068 - DNA, 20 bp, Homo sapiens
cctggactgtgtgctcagga

SEQ ID NO: 2406069 - DNA, 16 bp, Homo sapiens
cctggatttttaccag

SEQ ID NO: 2406070 - DNA, 16 bp, Homo sapiens
cctgtccaatctttga

SEQ ID NO: 2406071 - DNA, 22 bp, Homo sapiens
cctgtcggagccctgtctcctc

SEQ ID NO: 2406072 - DNA, 12 bp, Homo sapiens
cctgtgtggaga

SEQ ID NO: 2406073 - DNA, 14 bp, Homo sapiens
cctgtgtggagagg

SEQ ID NO: 2406074 - DNA, 15 bp, Homo sapiens
cctgtgtggagaggg

SEQ ID NO: 2406075 - DNA, 22 bp, Homo sapiens
cctgtgtggagagggaatgtga

SEQ ID NO: 2406076 - DNA, 23 bp, Homo sapiens
cctgtgtggagagggaatgtgaa

SEQ ID NO: 2406077 - DNA, 22 bp, Homo sapiens
cctgttgctaagccccagcaag

SEQ ID NO: 2406078 - DNA, 18 bp, Homo sapiens
ccttattgctgtcctgga

SEQ ID NO: 2406079 - DNA, 19 bp, Homo sapiens
ccttattgctgtcctggag

SEQ ID NO: 2406080 - DNA, 14 bp, Homo sapiens
ccttcatttcctcc

SEQ ID NO: 2406081 - DNA, 15 bp, Homo sapiens
ccttcatttcctccg

SEQ ID NO: 2406082 - DNA, 15 bp, Homo sapiens
ccttctattctagcc

SEQ ID NO: 2406083 - DNA, 17 bp, Homo sapiens
ccttctcccctgcactg

SEQ ID NO: 2406084 - DNA, 19 bp, Homo sapiens
ccttctctgttcatttcct

SEQ ID NO: 2406085 - DNA, 16 bp, Homo sapiens
ccttctggccttgtaa

SEQ ID NO: 2406086 - DNA, 18 bp, Homo sapiens
ccttgattggtgttgcca

SEQ ID NO: 2406087 - DNA, 15 bp, Homo sapiens
ccttgcggctcctca

SEQ ID NO: 2406088 - DNA, 18 bp, Homo sapiens
ccttggggattcttccat

SEQ ID NO: 2406089 - DNA, 20 bp, Homo sapiens
ccttggtgattccgcagtga

SEQ ID NO: 2406090 - DNA, 21 bp, Homo sapiens
ccttgttctgataatgaaaat

SEQ ID NO: 2406091 - DNA, 14 bp, Homo sapiens
cctttgctgaccct

SEQ ID NO: 2406092 - DNA, 16 bp, Homo sapiens
cgacttgccaaattta

SEQ ID NO: 2406093 - DNA, 17 bp, Homo sapiens
cgaggaggtaatgaatt

SEQ ID NO: 2406094 - DNA, 18 bp, Homo sapiens
cgatcacaacgtgcattg

SEQ ID NO: 2406095 - DNA, 23 bp, Homo sapiens
cgccaggatggcgcaggaactca

SEQ ID NO: 2406096 - DNA, 18 bp, Homo sapiens
cgccattctcaagccctg

SEQ ID NO: 2406097 - DNA, 16 bp, Homo sapiens
cgccctggactgtgtg

SEQ ID NO: 2406098 - DNA, 15 bp, Homo sapiens
cgcgatctcagctca

SEQ ID NO: 2406099 - DNA, 21 bp, Homo sapiens
cgctaatcccgattcaccctg

SEQ ID NO: 2406100 - DNA, 14 bp, Homo sapiens
cgctgttgctgaat

SEQ ID NO: 2406101 - DNA, 13 bp, Homo sapiens
cggctcctcaggg

SEQ ID NO: 2406102 - DNA, 14 bp, Homo sapiens
cgtactgcagcctc

SEQ ID NO: 2406103 - DNA, 14 bp, Homo sapiens
cgtgatctcagctc

SEQ ID NO: 2406104 - DNA, 21 bp, Homo sapiens
cgtgcattgtgcttctttctt

SEQ ID NO: 2406105 - DNA, 15 bp, Homo sapiens
cgtggtgatttagca

SEQ ID NO: 2406106 - DNA, 20 bp, Homo sapiens
cgtgtgtgtgcgtcctgtcg

SEQ ID NO: 2406107 - DNA, 19 bp, Homo sapiens
cgttcaacttttcctttga

SEQ ID NO: 2406108 - DNA, 17 bp, Homo sapiens
ctaaaagatataagtgc

SEQ ID NO: 2406109 - DNA, 18 bp, Homo sapiens
ctaaaaggaaagaaaata

SEQ ID NO: 2406110 - DNA, 20 bp, Homo sapiens
ctaaaaggaaagaaaataaa

SEQ ID NO: 2406111 - DNA, 18 bp, Homo sapiens
ctaaatatattttaagac

SEQ ID NO: 2406112 - DNA, 14 bp, Homo sapiens
ctaacacccagtct

SEQ ID NO: 2406113 - DNA, 23 bp, Homo sapiens
ctaacacggtgctcattttttct

SEQ ID NO: 2406114 - DNA, 15 bp, Homo sapiens
ctaacatgatttggg

SEQ ID NO: 2406115 - DNA, 21 bp, Homo sapiens
ctaagaaacatttatattgat

SEQ ID NO: 2406116 - DNA, 12 bp, Homo sapiens
ctaagaaagaac

SEQ ID NO: 2406117 - DNA, 15 bp, Homo sapiens
ctaatatgtaaaatt

SEQ ID NO: 2406118 - DNA, 14 bp, Homo sapiens
ctaatcatgaaact

SEQ ID NO: 2406119 - DNA, 18 bp, Homo sapiens
ctaatccccttctcccct

SEQ ID NO: 2406120 - DNA, 20 bp, Homo sapiens
ctaatccccttctcccctgc

SEQ ID NO: 2406121 - DNA, 13 bp, Homo sapiens
ctaatttttgtat

SEQ ID NO: 2406122 - DNA, 16 bp, Homo sapiens
ctacaacctccgcctc

SEQ ID NO: 2406123 - DNA, 16 bp, Homo sapiens
ctacaggcctcacaca

SEQ ID NO: 2406124 - DNA, 20 bp, Homo sapiens
ctacaggcctcacacacaat

SEQ ID NO: 2406125 - DNA, 15 bp, Homo sapiens
ctacccgcagagttc

SEQ ID NO: 2406126 - DNA, 14 bp, Homo sapiens
ctacctgagctaaa

SEQ ID NO: 2406127 - DNA, 21 bp, Homo sapiens
ctagaggcctgactgccaagc

SEQ ID NO: 2406128 - DNA, 14 bp, Homo sapiens
ctagcatatctgcc

SEQ ID NO: 2406129 - DNA, 15 bp, Homo sapiens
ctagcatatctgcct

SEQ ID NO: 2406130 - DNA, 17 bp, Homo sapiens
ctagcatatctgccttt

SEQ ID NO: 2406131 - DNA, 16 bp, Homo sapiens
ctagcatgaagacaga

SEQ ID NO: 2406132 - DNA, 19 bp, Homo sapiens
ctagcctgcattgagcttg

SEQ ID NO: 2406133 - DNA, 14 bp, Homo sapiens
ctagctggctctgt

SEQ ID NO: 2406134 - DNA, 19 bp, Homo sapiens
ctagggttaggaggtcctt

SEQ ID NO: 2406135 - DNA, 16 bp, Homo sapiens
ctagtactaactccta

SEQ ID NO: 2406136 - DNA, 23 bp, Homo sapiens
ctagtattccagacctgaagaat

SEQ ID NO: 2406137 - DNA, 16 bp, Homo sapiens
ctagttctgtagaaat

SEQ ID NO: 2406138 - DNA, 12 bp, Homo sapiens
ctataatttaaa

SEQ ID NO: 2406139 - DNA, 22 bp, Homo sapiens
ctatgaagttttttttatacag

SEQ ID NO: 2406140 - DNA, 23 bp, Homo sapiens
ctatgtaggaaagaccatttttc

SEQ ID NO: 2406141 - DNA, 16 bp, Homo sapiens
ctatgtcatttcattt

SEQ ID NO: 2406142 - DNA, 18 bp, Homo sapiens
ctatgtcatttcatttcc

SEQ ID NO: 2406143 - DNA, 19 bp, Homo sapiens
ctatgtggaagtggggcgg

SEQ ID NO: 2406144 - DNA, 15 bp, Homo sapiens
ctatttaactgacta

SEQ ID NO: 2406145 - DNA, 19 bp, Homo sapiens
ctatttttaatgtttgtac

SEQ ID NO: 2406146 - DNA, 14 bp, Homo sapiens
ctatttttcagaat

SEQ ID NO: 2406147 - DNA, 12 bp, Homo sapiens
ctcaagccctgc

SEQ ID NO: 2406148 - DNA, 22 bp, Homo sapiens
ctcaagccctgcagtcacagct

SEQ ID NO: 2406149 - DNA, 15 bp, Homo sapiens
ctcaatgctcataac

SEQ ID NO: 2406150 - DNA, 22 bp, Homo sapiens
ctcacactcatgcattgtcctc

SEQ ID NO: 2406151 - DNA, 19 bp, Homo sapiens
ctcacagtgggagccaggg

SEQ ID NO: 2406152 - DNA, 22 bp, Homo sapiens
ctcacatgattccagccatcac

SEQ ID NO: 2406153 - DNA, 22 bp, Homo sapiens
ctcacgcctgtaatcccagcat

SEQ ID NO: 2406154 - DNA, 20 bp, Homo sapiens
ctcagccctgcaccatgctg

SEQ ID NO: 2406155 - DNA, 20 bp, Homo sapiens
ctcagctcactacaacctcc

SEQ ID NO: 2406156 - DNA, 15 bp, Homo sapiens
ctcagctcactgcaa

SEQ ID NO: 2406157 - DNA, 13 bp, Homo sapiens
ctcaggagccctg

SEQ ID NO: 2406158 - DNA, 21 bp, Homo sapiens
ctcaggagccctgggaggctc

SEQ ID NO: 2406159 - DNA, 24 bp, Homo sapiens
ctcaggagccctgggaggctctgg

SEQ ID NO: 2406160 - DNA, 17 bp, Homo sapiens
ctcaggctgaccacttt

SEQ ID NO: 2406161 - DNA, 21 bp, Homo sapiens
ctcagggactcatctttccct

SEQ ID NO: 2406162 - DNA, 23 bp, Homo sapiens
ctcagggactcatctttccctcc

SEQ ID NO: 2406163 - DNA, 18 bp, Homo sapiens
ctcagtagtcagactgga

SEQ ID NO: 2406164 - DNA, 18 bp, Homo sapiens
ctcagttcatccattcta

SEQ ID NO: 2406165 - DNA, 17 bp, Homo sapiens
ctcataacggatcagaa

SEQ ID NO: 2406166 - DNA, 22 bp, Homo sapiens
ctcataactctgtgatcttgct

SEQ ID NO: 2406167 - DNA, 18 bp, Homo sapiens
ctcatagacactgatctg

SEQ ID NO: 2406168 - DNA, 12 bp, Homo sapiens
ctcatctcttct

SEQ ID NO: 2406169 - DNA, 12 bp, Homo sapiens
ctcatctgtcac

SEQ ID NO: 2406170 - DNA, 14 bp, Homo sapiens
ctcatctgtcacca

SEQ ID NO: 2406171 - DNA, 16 bp, Homo sapiens
ctcatctttccctcct

SEQ ID NO: 2406172 - DNA, 12 bp, Homo sapiens
ctcatgaatgta

SEQ ID NO: 2406173 - DNA, 14 bp, Homo sapiens
ctcatttctagcag

SEQ ID NO: 2406174 - DNA, 23 bp, Homo sapiens
ctcatttttataatgtcccttca

SEQ ID NO: 2406175 - DNA, 16 bp, Homo sapiens
ctccaaagtctctgga

SEQ ID NO: 2406176 - DNA, 20 bp, Homo sapiens
ctccacaccattcaggtctt

SEQ ID NO: 2406177 - DNA, 14 bp, Homo sapiens
ctccacctcctggg

SEQ ID NO: 2406178 - DNA, 17 bp, Homo sapiens
ctccaccttgcagctct

SEQ ID NO: 2406179 - DNA, 15 bp, Homo sapiens
ctccagcctcagcct

SEQ ID NO: 2406180 - DNA, 22 bp, Homo sapiens
aaagattactttttctttatgt

SEQ ID NO: 2406181 - DNA, 19 bp, Homo sapiens
aaagcaggcagaactcatc

SEQ ID NO: 2406182 - DNA, 14 bp, Homo sapiens
aaagcatttgaatg

SEQ ID NO: 2406183 - DNA, 17 bp, Homo sapiens
aaagcatttgaatgcat

SEQ ID NO: 2406184 - DNA, 19 bp, Homo sapiens
aaagcatttgaatgcattt

SEQ ID NO: 2406185 - DNA, 16 bp, Homo sapiens
aaagcctgtttaagag

SEQ ID NO: 2406186 - DNA, 14 bp, Homo sapiens
aaagctgtgtggca

SEQ ID NO: 2406187 - DNA, 13 bp, Homo sapiens
aaaggaatttaaa

SEQ ID NO: 2406188 - DNA, 20 bp, Homo sapiens
aaagggactgagaaatttat

SEQ ID NO: 2406189 - DNA, 21 bp, Homo sapiens
aaagtaaaaacaaagaaatta

SEQ ID NO: 2406190 - DNA, 18 bp, Homo sapiens
aaagtcaatgttttcagt

SEQ ID NO: 2406191 - DNA, 21 bp, Homo sapiens
aaagtcattggctttatcctc

SEQ ID NO: 2406192 - DNA, 19 bp, Homo sapiens
aaagtctctggaatttgaa

SEQ ID NO: 2406193 - DNA, 22 bp, Homo sapiens
aaagtgggttttttagttgaat

SEQ ID NO: 2406194 - DNA, 16 bp, Homo sapiens
aaataaagaatggaaa

SEQ ID NO: 2406195 - DNA, 15 bp, Homo sapiens
aaataaattgtatat

SEQ ID NO: 2406196 - DNA, 14 bp, Homo sapiens
aaatatatatcaaa

SEQ ID NO: 2406197 - DNA, 14 bp, Homo sapiens
aaatattagaaaca

SEQ ID NO: 2406198 - DNA, 17 bp, Homo sapiens
aaatcagccaattatgt

SEQ ID NO: 2406199 - DNA, 22 bp, Homo sapiens
aaatcataagatatttttcatg

SEQ ID NO: 2406200 - DNA, 15 bp, Homo sapiens
aaatccactttatct

SEQ ID NO: 2406201 - DNA, 17 bp, Homo sapiens
aaatctaccactgtatg

SEQ ID NO: 2406202 - DNA, 14 bp, Homo sapiens
aaatcttgtcatgt

SEQ ID NO: 2406203 - DNA, 18 bp, Homo sapiens
aaatctttctttcttaga

SEQ ID NO: 2406204 - DNA, 22 bp, Homo sapiens
aaatctttctttcttagaaatt

SEQ ID NO: 2406205 - DNA, 14 bp, Homo sapiens
aaatgagaaatcta

SEQ ID NO: 2406206 - DNA, 15 bp, Homo sapiens
aaatgcctttgtact

SEQ ID NO: 2406207 - DNA, 17 bp, Homo sapiens
aaatggttgtattagat

SEQ ID NO: 2406208 - DNA, 19 bp, Homo sapiens
aaatgtgggattatgggtc

SEQ ID NO: 2406209 - DNA, 18 bp, Homo sapiens
aaatgtttttttttaaag

SEQ ID NO: 2406210 - DNA, 23 bp, Homo sapiens
aaattatgtgccagatttatgca

SEQ ID NO: 2406211 - DNA, 12 bp, Homo sapiens
aaattattgttt

SEQ ID NO: 2406212 - DNA, 18 bp, Homo sapiens
aaattgccatattgcaca

SEQ ID NO: 2406213 - DNA, 20 bp, Homo sapiens
aaattgtaagcatgcacaaa

SEQ ID NO: 2406214 - DNA, 14 bp, Homo sapiens
aaattgtatattca

SEQ ID NO: 2406215 - DNA, 15 bp, Homo sapiens
aaattgtatattcac

SEQ ID NO: 2406216 - DNA, 23 bp, Homo sapiens
aaattgtgcagtactttgtgcat

SEQ ID NO: 2406217 - DNA, 13 bp, Homo sapiens
aaatttatttcct

SEQ ID NO: 2406218 - DNA, 17 bp, Homo sapiens
aaatttgtactatttaa

SEQ ID NO: 2406219 - DNA, 15 bp, Homo sapiens
aacaaagaaattatg

SEQ ID NO: 2406220 - DNA, 12 bp, Homo sapiens
aacaataaaaga

SEQ ID NO: 2406221 - DNA, 21 bp, Homo sapiens
aacactgggagaaatgaaaaa

SEQ ID NO: 2406222 - DNA, 20 bp, Homo sapiens
aacagggccacatagatgct

SEQ ID NO: 2406223 - DNA, 15 bp, Homo sapiens
aacatccctcctggg

SEQ ID NO: 2406224 - DNA, 17 bp, Homo sapiens
aaccacacccacactca

SEQ ID NO: 2406225 - DNA, 20 bp, Homo sapiens
aaccacattggagatgttta

SEQ ID NO: 2406226 - DNA, 23 bp, Homo sapiens
aaccatgaagagatttttcatga

SEQ ID NO: 2406227 - DNA, 16 bp, Homo sapiens
aaccatttcctcagac

SEQ ID NO: 2406228 - DNA, 15 bp, Homo sapiens
aacccgaggcccgca

SEQ ID NO: 2406229 - DNA, 17 bp, Homo sapiens
aacctgatgaaaataaa

SEQ ID NO: 2406230 - DNA, 20 bp, Homo sapiens
aacctgatgaaaataaagaa

SEQ ID NO: 2406231 - DNA, 15 bp, Homo sapiens
aacctggagatggtg

SEQ ID NO: 2406232 - DNA, 18 bp, Homo sapiens
aacctttgtttgcatctg

SEQ ID NO: 2406233 - DNA, 13 bp, Homo sapiens
aacggatcagaaa

SEQ ID NO: 2406234 - DNA, 16 bp, Homo sapiens
aacgtgcattgtgctt

SEQ ID NO: 2406235 - DNA, 23 bp, Homo sapiens
aacgtgcattgtgcttctttctt

SEQ ID NO: 2406236 - DNA, 18 bp, Homo sapiens
aacgttaagaattgttaa

SEQ ID NO: 2406237 - DNA, 14 bp, Homo sapiens
aacgttgctcccca

SEQ ID NO: 2406238 - DNA, 15 bp, Homo sapiens
aactacctgagctaa

SEQ ID NO: 2406239 - DNA, 18 bp, Homo sapiens
aactagcatatctgcctt

SEQ ID NO: 2406240 - DNA, 15 bp, Homo sapiens
aactaggctgagcaa

SEQ ID NO: 2406241 - DNA, 17 bp, Homo sapiens
aactcctgacctcaggc

SEQ ID NO: 2406242 - DNA, 20 bp, Homo sapiens
aactgactattcttgatgta

SEQ ID NO: 2406243 - DNA, 23 bp, Homo sapiens
aactgactattcttgatgtaaaa

SEQ ID NO: 2406244 - DNA, 14 bp, Homo sapiens
aactggaccctgtt

SEQ ID NO: 2406245 - DNA, 19 bp, Homo sapiens
aactgtctctcatgaacct

SEQ ID NO: 2406246 - DNA, 22 bp, Homo sapiens
aagaaaatctattttgtaactt

SEQ ID NO: 2406247 - DNA, 19 bp, Homo sapiens
aagaaagcccttaggaaga

SEQ ID NO: 2406248 - DNA, 13 bp, Homo sapiens
aagaaatatacct

SEQ ID NO: 2406249 - DNA, 21 bp, Homo sapiens
aagaatcacaataattttcta

SEQ ID NO: 2406250 - DNA, 16 bp, Homo sapiens
aagtgtgtgtttttca

SEQ ID NO: 2406251 - DNA, 21 bp, Homo sapiens
aagtgtgtgtttttcataaag

SEQ ID NO: 2406252 - DNA, 21 bp, Homo sapiens
aagttggggacacatgtattt

SEQ ID NO: 2406253 - DNA, 20 bp, Homo sapiens
aagttgtgcttgagccagga

SEQ ID NO: 2406254 - DNA, 18 bp, Homo sapiens
aagtttgaatgttaaata

SEQ ID NO: 2406255 - DNA, 12 bp, Homo sapiens
aataaaaataat

SEQ ID NO: 2406256 - DNA, 16 bp, Homo sapiens
aataaagtatttaatt

SEQ ID NO: 2406257 - DNA, 19 bp, Homo sapiens
aataaagtatttaattagt

SEQ ID NO: 2406258 - DNA, 15 bp, Homo sapiens
aataacaataaaaga

SEQ ID NO: 2406259 - DNA, 14 bp, Homo sapiens
aataaggttgaaca

SEQ ID NO: 2406260 - DNA, 16 bp, Homo sapiens
aataatatacttgtgg

SEQ ID NO: 2406261 - DNA, 17 bp, Homo sapiens
aataatatattttaaat

SEQ ID NO: 2406262 - DNA, 22 bp, Homo sapiens
aataatttttcacttcaaaaca

SEQ ID NO: 2406263 - DNA, 21 bp, Homo sapiens
aatacccatgtctacacagat

SEQ ID NO: 2406264 - DNA, 17 bp, Homo sapiens
aatagaaatggggaact

SEQ ID NO: 2406265 - DNA, 22 bp, Homo sapiens
aatagttttattaataaacatt

SEQ ID NO: 2406266 - DNA, 15 bp, Homo sapiens
aatatacttgtggac

SEQ ID NO: 2406267 - DNA, 22 bp, Homo sapiens
aatatacttgtggactaaaaga

SEQ ID NO: 2406268 - DNA, 23 bp, Homo sapiens
aatatacttgtggactaaaagat

SEQ ID NO: 2406269 - DNA, 19 bp, Homo sapiens
aatatatattatcttttca

SEQ ID NO: 2406270 - DNA, 12 bp, Homo sapiens
aatatttagtgt

SEQ ID NO: 2406271 - DNA, 13 bp, Homo sapiens
aatatttgaatct

SEQ ID NO: 2406272 - DNA, 23 bp, Homo sapiens
aatcataagatatttttcatgat

SEQ ID NO: 2406273 - DNA, 20 bp, Homo sapiens
aatcatgaagatatttttcc

SEQ ID NO: 2406274 - DNA, 18 bp, Homo sapiens
aatccaagcaaatgtgaa

SEQ ID NO: 2406275 - DNA, 15 bp, Homo sapiens
aatccaatgaaatga

SEQ ID NO: 2406276 - DNA, 17 bp, Homo sapiens
aatccccagtaaaattg

SEQ ID NO: 2406277 - DNA, 15 bp, Homo sapiens
aatccccttctcccc

SEQ ID NO: 2406278 - DNA, 16 bp, Homo sapiens
aatcccgattcaccct

SEQ ID NO: 2406279 - DNA, 18 bp, Homo sapiens
aatcctctctctgtgtta

SEQ ID NO: 2406280 - DNA, 21 bp, Homo sapiens
aatcctggggaacatagaact

SEQ ID NO: 2406281 - DNA, 19 bp, Homo sapiens
aatccttctattctagcct

SEQ ID NO: 2406282 - DNA, 14 bp, Homo sapiens
aatctattttgtaa

SEQ ID NO: 2406283 - DNA, 17 bp, Homo sapiens
aatctattttgtaactt

SEQ ID NO: 2406284 - DNA, 19 bp, Homo sapiens
aatcttataatttaaaata

SEQ ID NO: 2406285 - DNA, 15 bp, Homo sapiens
aatcttgtcatgtgt

SEQ ID NO: 2406286 - DNA, 17 bp, Homo sapiens
aatcttgtctcaatgct

SEQ ID NO: 2406287 - DNA, 20 bp, Homo sapiens
aatcttgtctcaatgctcat

SEQ ID NO: 2406288 - DNA, 16 bp, Homo sapiens
aatctttctttcttag

SEQ ID NO: 2406289 - DNA, 22 bp, Homo sapiens
aatctttctttcttagaaattt

SEQ ID NO: 2406290 - DNA, 12 bp, Homo sapiens
aatgaagtttga

SEQ ID NO: 2406291 - DNA, 17 bp, Homo sapiens
aatgaagtttgaatgtt

SEQ ID NO: 2406292 - DNA, 18 bp, Homo sapiens
aatgaagtttgaatgtta

SEQ ID NO: 2406293 - DNA, 18 bp, Homo sapiens
aatgacatcaccacagtt

SEQ ID NO: 2406294 - DNA, 16 bp, Homo sapiens
aatgctcataacggat

SEQ ID NO: 2406295 - DNA, 12 bp, Homo sapiens
aatggttgtatt

SEQ ID NO: 2406296 - DNA, 16 bp, Homo sapiens
aatggttgtattagat

SEQ ID NO: 2406297 - DNA, 18 bp, Homo sapiens
aatggttgtattagatgt

SEQ ID NO: 2406298 - DNA, 19 bp, Homo sapiens
aatggttgtattagatgtt

SEQ ID NO: 2406299 - DNA, 12 bp, Homo sapiens
aatgtaaatttg

SEQ ID NO: 2406300 - DNA, 23 bp, Homo sapiens
aatgttaaataaattgtatattc

SEQ ID NO: 2406301 - DNA, 21 bp, Homo sapiens
aattaagaaaggataaagttg

SEQ ID NO: 2406302 - DNA, 14 bp, Homo sapiens
aattaccttctatt

SEQ ID NO: 2406303 - DNA, 15 bp, Homo sapiens
aattatgttaaacta

SEQ ID NO: 2406304 - DNA, 16 bp, Homo sapiens
aattattatttggccc

SEQ ID NO: 2406305 - DNA, 21 bp, Homo sapiens
aattcttgccaaatataaata

SEQ ID NO: 2406306 - DNA, 19 bp, Homo sapiens
aattgatgggatttggtca

SEQ ID NO: 2406307 - DNA, 13 bp, Homo sapiens
aattgccatattg

SEQ ID NO: 2406308 - DNA, 16 bp, Homo sapiens
aattgccatattgcac

SEQ ID NO: 2406309 - DNA, 17 bp, Homo sapiens
aattgccatattgcaca

SEQ ID NO: 2406310 - DNA, 21 bp, Homo sapiens
aattgtggggatgatgaaata

SEQ ID NO: 2406311 - DNA, 22 bp, Homo sapiens
aatttatttcctagttctgtag

SEQ ID NO: 2406312 - DNA, 21 bp, Homo sapiens
aatttgggggacttacatgat

SEQ ID NO: 2406313 - DNA, 19 bp, Homo sapiens
aatttgtactatttaactg

SEQ ID NO: 2406314 - DNA, 22 bp, Homo sapiens
aatttttaatctttaattttac

SEQ ID NO: 2406315 - DNA, 18 bp, Homo sapiens
aatttttttagaaagcat

SEQ ID NO: 2406316 - DNA, 17 bp, Homo sapiens
aattttttttaacattc

SEQ ID NO: 2406317 - DNA, 16 bp, Homo sapiens
acaaagaaattatgtg

SEQ ID NO: 2406318 - DNA, 14 bp, Homo sapiens
acaacagctgcctg

SEQ ID NO: 2406319 - DNA, 16 bp, Homo sapiens
acaacaggtaaaacag

SEQ ID NO: 2406320 - DNA, 13 bp, Homo sapiens
acaacgtgcattg

SEQ ID NO: 2406321 - DNA, 14 bp, Homo sapiens
acaacgtgcattgt

SEQ ID NO: 2406322 - DNA, 16 bp, Homo sapiens
acaacgtgcattgtgc

SEQ ID NO: 2406323 - DNA, 14 bp, Homo sapiens
acaatgtgtctgag

SEQ ID NO: 2406324 - DNA, 18 bp, Homo sapiens
acacaaattatcttaaaa

SEQ ID NO: 2406325 - DNA, 14 bp, Homo sapiens
acacaatgtgtctg

SEQ ID NO: 2406326 - DNA, 20 bp, Homo sapiens
acacaccaccacgcctggct

SEQ ID NO: 2406327 - DNA, 18 bp, Homo sapiens
acacagttcctgggaaca

SEQ ID NO: 2406328 - DNA, 18 bp, Homo sapiens
acacatgctgaacatcac

SEQ ID NO: 2406329 - DNA, 14 bp, Homo sapiens
acaccctccagaga

SEQ ID NO: 2406330 - DNA, 21 bp, Homo sapiens
ctttttttttttttaataaat

SEQ ID NO: 2406331 - DNA, 12 bp, Homo sapiens
gaaaagaaaaag

SEQ ID NO: 2406332 - DNA, 12 bp, Homo sapiens
gaaaataaagaa

SEQ ID NO: 2406333 - DNA, 16 bp, Homo sapiens
gaaaataaagaatgga

SEQ ID NO: 2406334 - DNA, 18 bp, Homo sapiens
gaaaataatcattcttat

SEQ ID NO: 2406335 - DNA, 11 bp, Homo sapiens
gaaaatcatat

SEQ ID NO: 2406336 - DNA, 21 bp, Homo sapiens
gaaaccctgcacccattagca

SEQ ID NO: 2406337 - DNA, 18 bp, Homo sapiens
gaaactcatagacactga

SEQ ID NO: 2406338 - DNA, 17 bp, Homo sapiens
gaaagacagcttctcat

SEQ ID NO: 2406339 - DNA, 21 bp, Homo sapiens
gaaagagtactcttgtttcct

SEQ ID NO: 2406340 - DNA, 18 bp, Homo sapiens
gaaagcagttgagacaag

SEQ ID NO: 2406341 - DNA, 14 bp, Homo sapiens
gaaagcatttgaat

SEQ ID NO: 2406342 - DNA, 15 bp, Homo sapiens
gaaagcatttgaatg

SEQ ID NO: 2406343 - DNA, 18 bp, Homo sapiens
gaaagcatttgaatgcat

SEQ ID NO: 2406344 - DNA, 21 bp, Homo sapiens
gaaagcatttgaatgcatttt

SEQ ID NO: 2406345 - DNA, 17 bp, Homo sapiens
gaaagtcattggcttta

SEQ ID NO: 2406346 - DNA, 18 bp, Homo sapiens
gaaagtcattggctttat

SEQ ID NO: 2406347 - DNA, 21 bp, Homo sapiens
gaaagtcattggctttatcct

SEQ ID NO: 2406348 - DNA, 22 bp, Homo sapiens
gaaatacagattttgatagcaa

SEQ ID NO: 2406349 - DNA, 19 bp, Homo sapiens
gaaatggttgtattagatg

SEQ ID NO: 2406350 - DNA, 23 bp, Homo sapiens
gaaattaagactttatgtagttt

SEQ ID NO: 2406351 - DNA, 16 bp, Homo sapiens
gaaatttataaacttt

SEQ ID NO: 2406352 - DNA, 23 bp, Homo sapiens
gaaatttatttcctagttctgta

SEQ ID NO: 2406353 - DNA, 15 bp, Homo sapiens
gaacctgatgaaaat

SEQ ID NO: 2406354 - DNA, 20 bp, Homo sapiens
gaacctgatgaaaataaaga

SEQ ID NO: 2406355 - DNA, 15 bp, Homo sapiens
gaacgtcttatctaa

SEQ ID NO: 2406356 - DNA, 15 bp, Homo sapiens
gaactaggctgagca

SEQ ID NO: 2406357 - DNA, 20 bp, Homo sapiens
gaactcatctaggtaaatta

SEQ ID NO: 2406358 - DNA, 22 bp, Homo sapiens
gaactcatctaggtaaattaca

SEQ ID NO: 2406359 - DNA, 22 bp, Homo sapiens
gaactccttgattttagccttc

SEQ ID NO: 2406360 - DNA, 13 bp, Homo sapiens
gaagacagtggcc

SEQ ID NO: 2406361 - DNA, 15 bp, Homo sapiens
gaagacagtggcccc

SEQ ID NO: 2406362 - DNA, 15 bp, Homo sapiens
gaagagacagcccag

SEQ ID NO: 2406363 - DNA, 12 bp, Homo sapiens
gaagagcagccc

SEQ ID NO: 2406364 - DNA, 19 bp, Homo sapiens
gaagcacgtggtaaaacac

SEQ ID NO: 2406365 - DNA, 16 bp, Homo sapiens
gaagctgttgtgtgag

SEQ ID NO: 2406366 - DNA, 21 bp, Homo sapiens
gaagggcttggactcaagcaa

SEQ ID NO: 2406367 - DNA, 19 bp, Homo sapiens
gaagtttgaatgttaaata

SEQ ID NO: 2406368 - DNA, 12 bp, Homo sapiens
gaataaaatttt

SEQ ID NO: 2406369 - DNA, 22 bp, Homo sapiens
gaataggcgatcacaacgtgca

SEQ ID NO: 2406370 - DNA, 13 bp, Homo sapiens
gaatatttgaatc

SEQ ID NO: 2406371 - DNA, 16 bp, Homo sapiens
gaatcttgtctcaatg

SEQ ID NO: 2406372 - DNA, 20 bp, Homo sapiens
gaatcttgtctcaatgctca

SEQ ID NO: 2406373 - DNA, 14 bp, Homo sapiens
gaatgtaaatttgt

SEQ ID NO: 2406374 - DNA, 13 bp, Homo sapiens
gaatgttaaataa

SEQ ID NO: 2406375 - DNA, 16 bp, Homo sapiens
gaatgttaaataaatt

SEQ ID NO: 2406376 - DNA, 21 bp, Homo sapiens
gaatgttaaataaattgtata

SEQ ID NO: 2406377 - DNA, 19 bp, Homo sapiens
gaattttttttaacattcc

SEQ ID NO: 2406378 - DNA, 15 bp, Homo sapiens
gacaaaactagagac

SEQ ID NO: 2406379 - DNA, 20 bp, Homo sapiens
gacaacaggtaaaacagggc

SEQ ID NO: 2406380 - DNA, 16 bp, Homo sapiens
gacaaggaaaaaataa

SEQ ID NO: 2406381 - DNA, 15 bp, Homo sapiens
gacacagttcctggg

SEQ ID NO: 2406382 - DNA, 16 bp, Homo sapiens
gacacagttcctggga

SEQ ID NO: 2406383 - DNA, 19 bp, Homo sapiens
gacagagccccaccctcag

SEQ ID NO: 2406384 - DNA, 18 bp, Homo sapiens
gacaggatgtttgctcag

SEQ ID NO: 2406385 - DNA, 12 bp, Homo sapiens
gaccaccaagcc

SEQ ID NO: 2406386 - DNA, 15 bp, Homo sapiens
gaccaccaagccttg

SEQ ID NO: 2406387 - DNA, 15 bp, Homo sapiens
gaccctgttgctaag

SEQ ID NO: 2406388 - DNA, 16 bp, Homo sapiens
gacgggtttcaccatg

SEQ ID NO: 2406389 - DNA, 12 bp, Homo sapiens
gactaaaagata

SEQ ID NO: 2406390 - DNA, 13 bp, Homo sapiens
gactaaaagatat

SEQ ID NO: 2406391 - DNA, 23 bp, Homo sapiens
gactaaaagatataagtgctgta

SEQ ID NO: 2406392 - DNA, 22 bp, Homo sapiens
gactattcttgatgtaaaatct

SEQ ID NO: 2406393 - DNA, 15 bp, Homo sapiens
gactcatctttccct

SEQ ID NO: 2406394 - DNA, 18 bp, Homo sapiens
gactcatctttccctcct

SEQ ID NO: 2406395 - DNA, 22 bp, Homo sapiens
gactcatctttccctccttggt

SEQ ID NO: 2406396 - DNA, 16 bp, Homo sapiens
gactctaagaaagaac

SEQ ID NO: 2406397 - DNA, 13 bp, Homo sapiens
gactgccaagcca

SEQ ID NO: 2406398 - DNA, 14 bp, Homo sapiens
gactgccaagccat

SEQ ID NO: 2406399 - DNA, 15 bp, Homo sapiens
gactgccaagccatg

SEQ ID NO: 2406400 - DNA, 20 bp, Homo sapiens
gactgtgtgctcaggagccc

SEQ ID NO: 2406401 - DNA, 21 bp, Homo sapiens
gactgttggggtgggtataaa

SEQ ID NO: 2406402 - DNA, 19 bp, Homo sapiens
gactttatagatcagccag

SEQ ID NO: 2406403 - DNA, 21 bp, Homo sapiens
gagaaatgaaaaaatatatat

SEQ ID NO: 2406404 - DNA, 14 bp, Homo sapiens
gagaaatttataaa

SEQ ID NO: 2406405 - DNA, 13 bp, Homo sapiens
gagacttgggaat

SEQ ID NO: 2406406 - DNA, 14 bp, Homo sapiens
gagagccctgaggc

SEQ ID NO: 2406407 - DNA, 15 bp, Homo sapiens
gagagggaatgtgaa

SEQ ID NO: 2406408 - DNA, 17 bp, Homo sapiens
gagagtggctggggcat

SEQ ID NO: 2406409 - DNA, 11 bp, Homo sapiens
gagatatttac

SEQ ID NO: 2406410 - DNA, 22 bp, Homo sapiens
gagatatttacatgaattgcat

SEQ ID NO: 2406411 - DNA, 18 bp, Homo sapiens
gagatggagtcttgctct

SEQ ID NO: 2406412 - DNA, 14 bp, Homo sapiens
gagattcagactgt

SEQ ID NO: 2406413 - DNA, 21 bp, Homo sapiens
gagcccactgtacttgctctt

SEQ ID NO: 2406414 - DNA, 18 bp, Homo sapiens
gagccccatcagctccag

SEQ ID NO: 2406415 - DNA, 12 bp, Homo sapiens
gagccctgggag

SEQ ID NO: 2406416 - DNA, 18 bp, Homo sapiens
gagccctgggaggctctg

SEQ ID NO: 2406417 - DNA, 22 bp, Homo sapiens
gagcctcctctctcaaactggg

SEQ ID NO: 2406418 - DNA, 12 bp, Homo sapiens
gagctcaggatg

SEQ ID NO: 2406419 - DNA, 13 bp, Homo sapiens
gagctcaggatga

SEQ ID NO: 2406420 - DNA, 22 bp, Homo sapiens
gagcttgaaacccgtggcgctt

SEQ ID NO: 2406421 - DNA, 12 bp, Homo sapiens
gaggaaagtcat

SEQ ID NO: 2406422 - DNA, 19 bp, Homo sapiens
gaggaggtaatgaattaaa

SEQ ID NO: 2406423 - DNA, 15 bp, Homo sapiens
gaggcctagactctg

SEQ ID NO: 2406424 - DNA, 19 bp, Homo sapiens
gaggcctttccctaagcca

SEQ ID NO: 2406425 - DNA, 18 bp, Homo sapiens
gaggctactgtaaggcaa

SEQ ID NO: 2406426 - DNA, 14 bp, Homo sapiens
gaggctctggagcc

SEQ ID NO: 2406427 - DNA, 19 bp, Homo sapiens
gaggctctggagcccactg

SEQ ID NO: 2406428 - DNA, 23 bp, Homo sapiens
gaggggctggggacttgtgtctg

SEQ ID NO: 2406429 - DNA, 15 bp, Homo sapiens
gagtagaaaggcctt

SEQ ID NO: 2406430 - DNA, 15 bp, Homo sapiens
gagtctatcaatcaa

SEQ ID NO: 2406431 - DNA, 14 bp, Homo sapiens
gagtggctggggca

SEQ ID NO: 2406432 - DNA, 12 bp, Homo sapiens
gagttagactgt

SEQ ID NO: 2406433 - DNA, 21 bp, Homo sapiens
gagttgaaaatcttataattt

SEQ ID NO: 2406434 - DNA, 16 bp, Homo sapiens
gatacttgaaaattaa

SEQ ID NO: 2406435 - DNA, 17 bp, Homo sapiens
gatacttgaaaattaac

SEQ ID NO: 2406436 - DNA, 18 bp, Homo sapiens
gatataagtgctgtataa

SEQ ID NO: 2406437 - DNA, 19 bp, Homo sapiens
gatataagtgctgtataaa

SEQ ID NO: 2406438 - DNA, 22 bp, Homo sapiens
gatataagtgctgtataaaatc

SEQ ID NO: 2406439 - DNA, 15 bp, Homo sapiens
gatataagtgtgtgt

SEQ ID NO: 2406440 - DNA, 13 bp, Homo sapiens
gatatctcatctc

SEQ ID NO: 2406441 - DNA, 16 bp, Homo sapiens
gatatgggacattttt

SEQ ID NO: 2406442 - DNA, 17 bp, Homo sapiens
gatatgggacatttttg

SEQ ID NO: 2406443 - DNA, 21 bp, Homo sapiens
gatcacaacgtgcattgtgct

SEQ ID NO: 2406444 - DNA, 19 bp, Homo sapiens
gatcacagcttcagccagg

SEQ ID NO: 2406445 - DNA, 21 bp, Homo sapiens
gatcacagcttcagccaggag

SEQ ID NO: 2406446 - DNA, 14 bp, Homo sapiens
gatcagaaatacag

SEQ ID NO: 2406447 - DNA, 16 bp, Homo sapiens
gatccccacgccacag

SEQ ID NO: 2406448 - DNA, 19 bp, Homo sapiens
gatccccacgccacagccc

SEQ ID NO: 2406449 - DNA, 19 bp, Homo sapiens
gatccctagctgtgacctc

SEQ ID NO: 2406450 - DNA, 20 bp, Homo sapiens
gatcggagcctcctctctca

SEQ ID NO: 2406451 - DNA, 19 bp, Homo sapiens
gatctcagctcactgcaac

SEQ ID NO: 2406452 - DNA, 14 bp, Homo sapiens
gatcttttattttg

SEQ ID NO: 2406453 - DNA, 19 bp, Homo sapiens
gatgaaaataaagaatgga

SEQ ID NO: 2406454 - DNA, 13 bp, Homo sapiens
gatgagagttttg

SEQ ID NO: 2406455 - DNA, 18 bp, Homo sapiens
gatgagagttttggatgc

SEQ ID NO: 2406456 - DNA, 15 bp, Homo sapiens
gatgatccccacgcc

SEQ ID NO: 2406457 - DNA, 23 bp, Homo sapiens
gatgccccctaatccccttctcc

SEQ ID NO: 2406458 - DNA, 14 bp, Homo sapiens
gatgctgatggagc

SEQ ID NO: 2406459 - DNA, 14 bp, Homo sapiens
gatggcgcaggaac

SEQ ID NO: 2406460 - DNA, 21 bp, Homo sapiens
gatggctttgaatgcggccca

SEQ ID NO: 2406461 - DNA, 15 bp, Homo sapiens
gatgtaaaatcttgt

SEQ ID NO: 2406462 - DNA, 16 bp, Homo sapiens
gatgtaaaatcttgtc

SEQ ID NO: 2406463 - DNA, 20 bp, Homo sapiens
gatgtaaaatcttgtcatgt

SEQ ID NO: 2406464 - DNA, 19 bp, Homo sapiens
gatgtgagttgcacagcta

SEQ ID NO: 2406465 - DNA, 14 bp, Homo sapiens
gattatgggtcaca

SEQ ID NO: 2406466 - DNA, 16 bp, Homo sapiens
gattatgggtcacagg

SEQ ID NO: 2406467 - DNA, 21 bp, Homo sapiens
gattcaccctgtccaaactgc

SEQ ID NO: 2406468 - DNA, 19 bp, Homo sapiens
gattcattttaacatctga

SEQ ID NO: 2406469 - DNA, 14 bp, Homo sapiens
gattccagccatca

SEQ ID NO: 2406470 - DNA, 18 bp, Homo sapiens
gattccagccatcacctt

SEQ ID NO: 2406471 - DNA, 15 bp, Homo sapiens
gattctcttgcctca

SEQ ID NO: 2406472 - DNA, 22 bp, Homo sapiens
gattgatcggagcctcctctct

SEQ ID NO: 2406473 - DNA, 18 bp, Homo sapiens
gattgtgtcccattcccc

SEQ ID NO: 2406474 - DNA, 21 bp, Homo sapiens
gatttattaatatatattatc

SEQ ID NO: 2406475 - DNA, 21 bp, Homo sapiens
gattttgaaaccatgaagaga

SEQ ID NO: 2406476 - DNA, 21 bp, Homo sapiens
gattttgaaatcatgaagata

SEQ ID NO: 2406477 - DNA, 22 bp, Homo sapiens
gcaaagactattcccttctaac

SEQ ID NO: 2406478 - DNA, 16 bp, Homo sapiens
gcaacctccacctcct

SEQ ID NO: 2406479 - DNA, 20 bp, Homo sapiens
gcaagcaatcctaggtaggg

SEQ ID NO: 2406480 - DNA, 20 bp, Homo sapiens
gcaatcctcccacttcagcc

SEQ ID NO: 2406481 - DNA, 23 bp, Homo sapiens
gcacaaattctgtctctggatta

SEQ ID NO: 2406482 - DNA, 16 bp, Homo sapiens
gcacagctatgaaggc

SEQ ID NO: 2406483 - DNA, 22 bp, Homo sapiens
gcacagggagtgcacatatcca

SEQ ID NO: 2406484 - DNA, 14 bp, Homo sapiens
gcacctacttacat

SEQ ID NO: 2406485 - DNA, 22 bp, Homo sapiens
gcacctgtcccagaaaaagcat

SEQ ID NO: 2406486 - DNA, 18 bp, Homo sapiens
gcacgtggtaaaacactt

SEQ ID NO: 2406487 - DNA, 20 bp, Homo sapiens
gcactgatgttgtgttttta

SEQ ID NO: 2406488 - DNA, 9 bp, Homo sapiens
gcactgtaa

SEQ ID NO: 2406489 - DNA, 12 bp, Homo sapiens
gcactgtaaaat

SEQ ID NO: 2406490 - DNA, 16 bp, Homo sapiens
gcactgtaaaatgtgg

SEQ ID NO: 2406491 - DNA, 23 bp, Homo sapiens
gcactgtaaaatgtgggattatg

SEQ ID NO: 2406492 - DNA, 13 bp, Homo sapiens
gcagactcactgt

SEQ ID NO: 2406493 - DNA, 19 bp, Homo sapiens
gcagattctcccttgctct

SEQ ID NO: 2406494 - DNA, 21 bp, Homo sapiens
gcagattctcccttgctctgc

SEQ ID NO: 2406495 - DNA, 18 bp, Homo sapiens
gcaggaacaaacagggct

SEQ ID NO: 2406496 - DNA, 18 bp, Homo sapiens
gcaggcaggaacaaacag

SEQ ID NO: 2406497 - DNA, 13 bp, Homo sapiens
gcaggtccctaat

SEQ ID NO: 2406498 - DNA, 14 bp, Homo sapiens
gcaggtccctaata

SEQ ID NO: 2406499 - DNA, 15 bp, Homo sapiens
gcaggtccctaataa

SEQ ID NO: 2406500 - DNA, 18 bp, Homo sapiens
gcagtgctcgctgttgct

SEQ ID NO: 2406501 - DNA, 21 bp, Homo sapiens
gcagtgctcgctgttgctgaa

SEQ ID NO: 2406502 - DNA, 22 bp, Homo sapiens
gcagtggcatcatctcagctca

SEQ ID NO: 2406503 - DNA, 14 bp, Homo sapiens
gcagtgggaaaaat

SEQ ID NO: 2406504 - DNA, 17 bp, Homo sapiens
gcagtgggaaaaatgta

SEQ ID NO: 2406505 - DNA, 22 bp, Homo sapiens
gcataacgtataaaagcctgtt

SEQ ID NO: 2406506 - DNA, 12 bp, Homo sapiens
gcatatctgcct

SEQ ID NO: 2406507 - DNA, 18 bp, Homo sapiens
gcatatctgcctttattg

SEQ ID NO: 2406508 - DNA, 19 bp, Homo sapiens
gcatatttataaaaataaa

SEQ ID NO: 2406509 - DNA, 15 bp, Homo sapiens
gcatcatctcagctc

SEQ ID NO: 2406510 - DNA, 21 bp, Homo sapiens
gcatctagaggcttccttcat

SEQ ID NO: 2406511 - DNA, 17 bp, Homo sapiens
gcatgaatttgtgaagg

SEQ ID NO: 2406512 - DNA, 17 bp, Homo sapiens
gcatgctggtgagccaa

SEQ ID NO: 2406513 - DNA, 14 bp, Homo sapiens
gcattactgcatgc

SEQ ID NO: 2406514 - DNA, 17 bp, Homo sapiens
gcattactgcatgcact

SEQ ID NO: 2406515 - DNA, 12 bp, Homo sapiens
gcattgtcctct

SEQ ID NO: 2406516 - DNA, 16 bp, Homo sapiens
gcatttgaatgcattt

SEQ ID NO: 2406517 - DNA, 17 bp, Homo sapiens
gcattttactgtacaga

SEQ ID NO: 2406518 - DNA, 16 bp, Homo sapiens
gcattttgtttggtat

SEQ ID NO: 2406519 - DNA, 18 bp, Homo sapiens
gcattttgtttggtattg

SEQ ID NO: 2406520 - DNA, 23 bp, Homo sapiens
gcattttgtttggtattgtattt

SEQ ID NO: 2406521 - DNA, 14 bp, Homo sapiens
gccaactatggcct

SEQ ID NO: 2406522 - DNA, 16 bp, Homo sapiens
gccaattatgttaaac

SEQ ID NO: 2406523 - DNA, 13 bp, Homo sapiens
gccacagcccttt

SEQ ID NO: 2406524 - DNA, 15 bp, Homo sapiens
gccacagttccccta

SEQ ID NO: 2406525 - DNA, 13 bp, Homo sapiens
gccaccatgcccg

SEQ ID NO: 2406526 - DNA, 18 bp, Homo sapiens
gccacggggactcagccc

SEQ ID NO: 2406527 - DNA, 16 bp, Homo sapiens
gccagaccagcaggct

SEQ ID NO: 2406528 - DNA, 18 bp, Homo sapiens
gccagaccagcaggctgg

SEQ ID NO: 2406529 - DNA, 22 bp, Homo sapiens
gccagagctacccgcagagttc

SEQ ID NO: 2406530 - DNA, 19 bp, Homo sapiens
gccagctgcccccagagcc

SEQ ID NO: 2406531 - DNA, 13 bp, Homo sapiens
gccaggagctggg

SEQ ID NO: 2406532 - DNA, 22 bp, Homo sapiens
gccaggagctgggcagaaggcc

SEQ ID NO: 2406533 - DNA, 23 bp, Homo sapiens
gccaggagctgggcagaaggcca

SEQ ID NO: 2406534 - DNA, 14 bp, Homo sapiens
gccaggatggcgca

SEQ ID NO: 2406535 - DNA, 16 bp, Homo sapiens
gccaggctggagtgca

SEQ ID NO: 2406536 - DNA, 19 bp, Homo sapiens
gccaggctggagtgcagtg

SEQ ID NO: 2406537 - DNA, 13 bp, Homo sapiens
gccaggctgggtc

SEQ ID NO: 2406538 - DNA, 14 bp, Homo sapiens
gccagttgtcctcc

SEQ ID NO: 2406539 - DNA, 16 bp, Homo sapiens
gccatatgaaaaggct

SEQ ID NO: 2406540 - DNA, 20 bp, Homo sapiens
gccatcaccttagaccacca

SEQ ID NO: 2406541 - DNA, 12 bp, Homo sapiens
gccatgggaggc

SEQ ID NO: 2406542 - DNA, 15 bp, Homo sapiens
gccatgggaggcctt

SEQ ID NO: 2406543 - DNA, 19 bp, Homo sapiens
gccatgggtagcctgggtg

SEQ ID NO: 2406544 - DNA, 20 bp, Homo sapiens
gccatgggtagcctgggtgt

SEQ ID NO: 2406545 - DNA, 13 bp, Homo sapiens
gcccagagaagcc

SEQ ID NO: 2406546 - DNA, 21 bp, Homo sapiens
gcccaggaccccatggcagtg

SEQ ID NO: 2406547 - DNA, 17 bp, Homo sapiens
gcccaggatactggcac

SEQ ID NO: 2406548 - DNA, 23 bp, Homo sapiens
gcccaggatactggcacagaggt

SEQ ID NO: 2406549 - DNA, 15 bp, Homo sapiens
gcccaggatggcttt

SEQ ID NO: 2406550 - DNA, 22 bp, Homo sapiens
gcccagtacctagctggctctg

SEQ ID NO: 2406551 - DNA, 18 bp, Homo sapiens
gccccaccctcagatgca

SEQ ID NO: 2406552 - DNA, 15 bp, Homo sapiens
gccccatcagctcca

SEQ ID NO: 2406553 - DNA, 21 bp, Homo sapiens
gcccccaaccatttcctcaga

SEQ ID NO: 2406554 - DNA, 15 bp, Homo sapiens
gcccccagagccaca

SEQ ID NO: 2406555 - DNA, 17 bp, Homo sapiens
gcccccagagccacagt

SEQ ID NO: 2406556 - DNA, 17 bp, Homo sapiens
gcccctgcctctctgca

SEQ ID NO: 2406557 - DNA, 23 bp, Homo sapiens
gcccctgcctctctgcaggtccc

SEQ ID NO: 2406558 - DNA, 20 bp, Homo sapiens
gcccctttgctgaccctccc

SEQ ID NO: 2406559 - DNA, 19 bp, Homo sapiens
gcccgcatgcggcccagga

SEQ ID NO: 2406560 - DNA, 19 bp, Homo sapiens
gcccggacgcccaggaccc

SEQ ID NO: 2406561 - DNA, 12 bp, Homo sapiens
gccctactggga

SEQ ID NO: 2406562 - DNA, 14 bp, Homo sapiens
gccctccccctcct

SEQ ID NO: 2406563 - DNA, 23 bp, Homo sapiens
gccctccgccattctcaagccct

SEQ ID NO: 2406564 - DNA, 17 bp, Homo sapiens
gccctgcaccatgctgc

SEQ ID NO: 2406565 - DNA, 22 bp, Homo sapiens
gccctgcaccatgctgctgggg

SEQ ID NO: 2406566 - DNA, 16 bp, Homo sapiens
gccctggactgtgtgc

SEQ ID NO: 2406567 - DNA, 15 bp, Homo sapiens
gccctgggaggctct

SEQ ID NO: 2406568 - DNA, 16 bp, Homo sapiens
gccctgggaggctctg

SEQ ID NO: 2406569 - DNA, 18 bp, Homo sapiens
gccctgggaggctctgga

SEQ ID NO: 2406570 - DNA, 19 bp, Homo sapiens
gccctgggaggctctggag

SEQ ID NO: 2406571 - DNA, 23 bp, Homo sapiens
gccgtggtgatttagcaggaagc

SEQ ID NO: 2406572 - DNA, 23 bp, Homo sapiens
gcctaagggatcctgcctgcccc

SEQ ID NO: 2406573 - DNA, 17 bp, Homo sapiens
gcctattttaataaaca

SEQ ID NO: 2406574 - DNA, 14 bp, Homo sapiens
gcctcccatgttca

SEQ ID NO: 2406575 - DNA, 16 bp, Homo sapiens
gcctccctggtccctt

SEQ ID NO: 2406576 - DNA, 17 bp, Homo sapiens
gcctctctgcaggtccc

SEQ ID NO: 2406577 - DNA, 20 bp, Homo sapiens
gcctctctgcaggtccctaa

SEQ ID NO: 2406578 - DNA, 21 bp, Homo sapiens
gcctctgcacaccctccagag

SEQ ID NO: 2406579 - DNA, 19 bp, Homo sapiens
gcctcttaaataaaccttt

SEQ ID NO: 2406580 - DNA, 16 bp, Homo sapiens
gcctgagtagaaaggc

SEQ ID NO: 2406581 - DNA, 21 bp, Homo sapiens
gcctgagtagaaaggccttta

SEQ ID NO: 2406582 - DNA, 21 bp, Homo sapiens
gcctgcattgagcttgcatgc

SEQ ID NO: 2406583 - DNA, 17 bp, Homo sapiens
gcctggaagagcagccc

SEQ ID NO: 2406584 - DNA, 20 bp, Homo sapiens
gccttcccaagttgtgcttg

SEQ ID NO: 2406585 - DNA, 14 bp, Homo sapiens
gccttctctgttca

SEQ ID NO: 2406586 - DNA, 14 bp, Homo sapiens
gccttctggccttg

SEQ ID NO: 2406587 - DNA, 16 bp, Homo sapiens
gccttgcggctcctca

SEQ ID NO: 2406588 - DNA, 18 bp, Homo sapiens
gcctttccctaagccagc

SEQ ID NO: 2406589 - DNA, 23 bp, Homo sapiens
gcgattctcctgcctcagcctcc

SEQ ID NO: 2406590 - DNA, 17 bp, Homo sapiens
gggtctgtaaaatcttt

SEQ ID NO: 2406591 - DNA, 21 bp, Homo sapiens
gggtctgtaaaatctttcttt

SEQ ID NO: 2406592 - DNA, 18 bp, Homo sapiens
gggtggggggggtgctgg

SEQ ID NO: 2406593 - DNA, 12 bp, Homo sapiens
gggtgggtataa

SEQ ID NO: 2406594 - DNA, 23 bp, Homo sapiens
gggtttaatccccagtaaaattg

SEQ ID NO: 2406595 - DNA, 18 bp, Homo sapiens
ggtaaaacagggccacat

SEQ ID NO: 2406596 - DNA, 22 bp, Homo sapiens
ggtaaatcagactatgaagttt

SEQ ID NO: 2406597 - DNA, 15 bp, Homo sapiens
ggtagtctcactgct

SEQ ID NO: 2406598 - DNA, 23 bp, Homo sapiens
ggtattgtatttattcaataaag

SEQ ID NO: 2406599 - DNA, 18 bp, Homo sapiens
ggtccctaataaagctgt

SEQ ID NO: 2406600 - DNA, 17 bp, Homo sapiens
ggtctcaaactcctgac

SEQ ID NO: 2406601 - DNA, 20 bp, Homo sapiens
ggtctcccttctctacactc

SEQ ID NO: 2406602 - DNA, 12 bp, Homo sapiens
ggtctgtaaaat

SEQ ID NO: 2406603 - DNA, 14 bp, Homo sapiens
ggtctgtaaaatct

SEQ ID NO: 2406604 - DNA, 19 bp, Homo sapiens
ggtgaaacattttctccct

SEQ ID NO: 2406605 - DNA, 20 bp, Homo sapiens
ggtgaaacattttctccctg

SEQ ID NO: 2406606 - DNA, 18 bp, Homo sapiens
ggtgcgagtgcgtgaata

SEQ ID NO: 2406607 - DNA, 13 bp, Homo sapiens
ggtgctgggcccc

SEQ ID NO: 2406608 - DNA, 14 bp, Homo sapiens
ggtgggtataaaag

SEQ ID NO: 2406609 - DNA, 17 bp, Homo sapiens
ggtgttgccagttgtcc

SEQ ID NO: 2406610 - DNA, 21 bp, Homo sapiens
ggttgggcagccagaccagca

SEQ ID NO: 2406611 - DNA, 18 bp, Homo sapiens
ggttgtattagatgttct

SEQ ID NO: 2406612 - DNA, 17 bp, Homo sapiens
gtaaaacagggccacat

SEQ ID NO: 2406613 - DNA, 20 bp, Homo sapiens
gtaaaatcttgtcatgtgta

SEQ ID NO: 2406614 - DNA, 22 bp, Homo sapiens
gtaaaatcttgtcatgtgtata

SEQ ID NO: 2406615 - DNA, 14 bp, Homo sapiens
gtaaaatctttctt

SEQ ID NO: 2406616 - DNA, 19 bp, Homo sapiens
catattgttactggtacca

SEQ ID NO: 2406617 - DNA, 19 bp, Homo sapiens
catcaggcctagaggcctg

SEQ ID NO: 2406618 - DNA, 11 bp, Homo sapiens
catcaggcttt

SEQ ID NO: 2406619 - DNA, 15 bp, Homo sapiens
catcatggctatctg

SEQ ID NO: 2406620 - DNA, 23 bp, Homo sapiens
catcccactcacaacagctgcct

SEQ ID NO: 2406621 - DNA, 21 bp, Homo sapiens
catcctaccacaatgcagtgc

SEQ ID NO: 2406622 - DNA, 18 bp, Homo sapiens
catccttcctcacaccag

SEQ ID NO: 2406623 - DNA, 12 bp, Homo sapiens
catctaggattt

SEQ ID NO: 2406624 - DNA, 13 bp, Homo sapiens
catctttccctcc

SEQ ID NO: 2406625 - DNA, 16 bp, Homo sapiens
catctttccctccttg

SEQ ID NO: 2406626 - DNA, 13 bp, Homo sapiens
catgaatgtaaat

SEQ ID NO: 2406627 - DNA, 14 bp, Homo sapiens
catgaatgtaaatt

SEQ ID NO: 2406628 - DNA, 19 bp, Homo sapiens
catgaatgtaaatttgtac

SEQ ID NO: 2406629 - DNA, 16 bp, Homo sapiens
catgaatttgtgaagg

SEQ ID NO: 2406630 - DNA, 14 bp, Homo sapiens
catgattccagcca

SEQ ID NO: 2406631 - DNA, 12 bp, Homo sapiens
catgcacaaatt

SEQ ID NO: 2406632 - DNA, 14 bp, Homo sapiens
catgcactgatgtt

SEQ ID NO: 2406633 - DNA, 15 bp, Homo sapiens
catgcattgtcctct

SEQ ID NO: 2406634 - DNA, 16 bp, Homo sapiens
catgcggcccaggatg

SEQ ID NO: 2406635 - DNA, 23 bp, Homo sapiens
catggaaggcaagattgtgtccc

SEQ ID NO: 2406636 - DNA, 16 bp, Homo sapiens
catggccagctaattt

SEQ ID NO: 2406637 - DNA, 19 bp, Homo sapiens
catgggaggcctttcccta

SEQ ID NO: 2406638 - DNA, 23 bp, Homo sapiens
catgtatctatgcattttctgga

SEQ ID NO: 2406639 - DNA, 13 bp, Homo sapiens
catgtcttaatga

SEQ ID NO: 2406640 - DNA, 14 bp, Homo sapiens
catgtgtataaaaa

SEQ ID NO: 2406641 - DNA, 13 bp, Homo sapiens
catgttagccagg

SEQ ID NO: 2406642 - DNA, 12 bp, Homo sapiens
cattaatctgcc

SEQ ID NO: 2406643 - DNA, 13 bp, Homo sapiens
cattactgcatgc

SEQ ID NO: 2406644 - DNA, 16 bp, Homo sapiens
cattactgcatgcact

SEQ ID NO: 2406645 - DNA, 18 bp, Homo sapiens
cattagcctgagtagaaa

SEQ ID NO: 2406646 - DNA, 19 bp, Homo sapiens
cattagcctgagtagaaag

SEQ ID NO: 2406647 - DNA, 12 bp, Homo sapiens
cattattacttt

SEQ ID NO: 2406648 - DNA, 16 bp, Homo sapiens
cattattacttttgct

SEQ ID NO: 2406649 - DNA, 18 bp, Homo sapiens
cattattacttttgctgt

SEQ ID NO: 2406650 - DNA, 16 bp, Homo sapiens
cattcaagtcagctct

SEQ ID NO: 2406651 - DNA, 15 bp, Homo sapiens
cattcccccagtgcg

SEQ ID NO: 2406652 - DNA, 16 bp, Homo sapiens
cattctcaagccctgc

SEQ ID NO: 2406653 - DNA, 15 bp, Homo sapiens
cattctgtcttgaag

SEQ ID NO: 2406654 - DNA, 23 bp, Homo sapiens
cattgtattcagagttgatggtt

SEQ ID NO: 2406655 - DNA, 14 bp, Homo sapiens
cattgtctcagagc

SEQ ID NO: 2406656 - DNA, 13 bp, Homo sapiens
cattgtgcttctt

SEQ ID NO: 2406657 - DNA, 17 bp, Homo sapiens
cattgtgcttctttctt

SEQ ID NO: 2406658 - DNA, 22 bp, Homo sapiens
catttacccttcttttctgact

SEQ ID NO: 2406659 - DNA, 14 bp, Homo sapiens
catttatattgata

SEQ ID NO: 2406660 - DNA, 21 bp, Homo sapiens
catttatattgataagatctt

SEQ ID NO: 2406661 - DNA, 14 bp, Homo sapiens
catttcctcagact

SEQ ID NO: 2406662 - DNA, 22 bp, Homo sapiens
catttcctcagactctaagaaa

SEQ ID NO: 2406663 - DNA, 11 bp, Homo sapiens
catttgaatgc

SEQ ID NO: 2406664 - DNA, 12 bp, Homo sapiens
catttgaatgca

SEQ ID NO: 2406665 - DNA, 14 bp, Homo sapiens
cattttctaagaaa

SEQ ID NO: 2406666 - DNA, 17 bp, Homo sapiens
cattttctaagaaacat

SEQ ID NO: 2406667 - DNA, 13 bp, Homo sapiens
cattttctccctg

SEQ ID NO: 2406668 - DNA, 21 bp, Homo sapiens
cattttgtttggtattgtatt

SEQ ID NO: 2406669 - DNA, 19 bp, Homo sapiens
ccaaaaatgtgtaagaaca

SEQ ID NO: 2406670 - DNA, 14 bp, Homo sapiens
ccaaactgcctaag

SEQ ID NO: 2406671 - DNA, 22 bp, Homo sapiens
ccaaatcaaaagactttttcct

SEQ ID NO: 2406672 - DNA, 21 bp, Homo sapiens
ccaacatgcactgatgttgtg

SEQ ID NO: 2406673 - DNA, 14 bp, Homo sapiens
ccaaccatttcctc

SEQ ID NO: 2406674 - DNA, 24 bp, Homo sapiens
ccaacggcaagggaacaagtactt

SEQ ID NO: 2406675 - DNA, 14 bp, Homo sapiens
ccaactatggcctg

SEQ ID NO: 2406676 - DNA, 15 bp, Homo sapiens
ccaactatggcctgt

SEQ ID NO: 2406677 - DNA, 22 bp, Homo sapiens
ccaagcagttgggactacaggc

SEQ ID NO: 2406678 - DNA, 20 bp, Homo sapiens
ccaagttgtgcttgagccag

SEQ ID NO: 2406679 - DNA, 17 bp, Homo sapiens
ccaattatgttaaacta

SEQ ID NO: 2406680 - DNA, 18 bp, Homo sapiens
ccacactcagatcctcct

SEQ ID NO: 2406681 - DNA, 22 bp, Homo sapiens
ccaccaggctgctcagggctgg

SEQ ID NO: 2406682 - DNA, 16 bp, Homo sapiens
ccaccatggccagcta

SEQ ID NO: 2406683 - DNA, 21 bp, Homo sapiens
ccacgccacagcccttttgtc

SEQ ID NO: 2406684 - DNA, 14 bp, Homo sapiens
ccacggtgttctgt

SEQ ID NO: 2406685 - DNA, 17 bp, Homo sapiens
ccactgtacttgctctt

SEQ ID NO: 2406686 - DNA, 20 bp, Homo sapiens
ccactgtacttgctcttgat

SEQ ID NO: 2406687 - DNA, 18 bp, Homo sapiens
ccagaaacctttgtttgc

SEQ ID NO: 2406688 - DNA, 16 bp, Homo sapiens
ccagaatttaaaccta

SEQ ID NO: 2406689 - DNA, 18 bp, Homo sapiens
ccagaccattgtctcaga

SEQ ID NO: 2406690 - DNA, 20 bp, Homo sapiens
ccagagctacccgcagagtt

SEQ ID NO: 2406691 - DNA, 16 bp, Homo sapiens
ccagatttttacacat

SEQ ID NO: 2406692 - DNA, 23 bp, Homo sapiens
ccagccatcaccttagaccacca

SEQ ID NO: 2406693 - DNA, 19 bp, Homo sapiens
ccagctgcccccagagcca

SEQ ID NO: 2406694 - DNA, 17 bp, Homo sapiens
ccagctggggccaggct

SEQ ID NO: 2406695 - DNA, 21 bp, Homo sapiens
ccagctggggccaggctgggt

SEQ ID NO: 2406696 - DNA, 11 bp, Homo sapiens
ccaggacccca

SEQ ID NO: 2406697 - DNA, 17 bp, Homo sapiens
ccaggatactggcacag

SEQ ID NO: 2406698 - DNA, 21 bp, Homo sapiens
ccaggatactggcacagaggt

SEQ ID NO: 2406699 - DNA, 13 bp, Homo sapiens
ccaggctgctcag

SEQ ID NO: 2406700 - DNA, 19 bp, Homo sapiens
ccaggctgctcagggctgg

SEQ ID NO: 2406701 - DNA, 18 bp, Homo sapiens
ccaggctggagtgcagtg

SEQ ID NO: 2406702 - DNA, 16 bp, Homo sapiens
ccaggctgggtcgccc

SEQ ID NO: 2406703 - DNA, 23 bp, Homo sapiens
ccaggctgggtcgccctggactg

SEQ ID NO: 2406704 - DNA, 19 bp, Homo sapiens
ccaggcttttttatcatgt

SEQ ID NO: 2406705 - DNA, 19 bp, Homo sapiens
ccaggtatccaaaaatgtg

SEQ ID NO: 2406706 - DNA, 23 bp, Homo sapiens
ccaggtgaacaaagtttaccaga

SEQ ID NO: 2406707 - DNA, 18 bp, Homo sapiens
ccaggttggagtgcagtg

SEQ ID NO: 2406708 - DNA, 15 bp, Homo sapiens
ccagtaaaattgcca

SEQ ID NO: 2406709 - DNA, 19 bp, Homo sapiens
ccagtaaaattgccatatt

SEQ ID NO: 2406710 - DNA, 23 bp, Homo sapiens
ccagtaaaattgccatattgcac

SEQ ID NO: 2406711 - DNA, 16 bp, Homo sapiens
ccagtgaccaaccttt

SEQ ID NO: 2406712 - DNA, 19 bp, Homo sapiens
ccagtgttttaggagcatg

SEQ ID NO: 2406713 - DNA, 14 bp, Homo sapiens
ccagttgtcctcct

SEQ ID NO: 2406714 - DNA, 15 bp, Homo sapiens
ccagttgtcctcctt

SEQ ID NO: 2406715 - DNA, 21 bp, Homo sapiens
ccatattgcacatgtcttaat

SEQ ID NO: 2406716 - DNA, 14 bp, Homo sapiens
ccatcgtcttcttg

SEQ ID NO: 2406717 - DNA, 19 bp, Homo sapiens
ccatgctgctggggaagac

SEQ ID NO: 2406718 - DNA, 16 bp, Homo sapiens
ccatttaggtttctga

SEQ ID NO: 2406719 - DNA, 21 bp, Homo sapiens
ccatttaggtttctgagttcc

SEQ ID NO: 2406720 - DNA, 19 bp, Homo sapiens
cccaaaggctttgccctgc

SEQ ID NO: 2406721 - DNA, 17 bp, Homo sapiens
cccaaccatttcctcag

SEQ ID NO: 2406722 - DNA, 21 bp, Homo sapiens
cccacactcagatcctcctca

SEQ ID NO: 2406723 - DNA, 22 bp, Homo sapiens
cccacactcagatcctcctcat

SEQ ID NO: 2406724 - DNA, 16 bp, Homo sapiens
cccaccaggctgctca

SEQ ID NO: 2406725 - DNA, 17 bp, Homo sapiens
cccaccaggctgctcag

SEQ ID NO: 2406726 - DNA, 15 bp, Homo sapiens
cccacgccacagccc

SEQ ID NO: 2406727 - DNA, 16 bp, Homo sapiens
cccacgccacagccct

SEQ ID NO: 2406728 - DNA, 17 bp, Homo sapiens
cccacgccacagccctt

SEQ ID NO: 2406729 - DNA, 18 bp, Homo sapiens
cccactgtacttgctctt

SEQ ID NO: 2406730 - DNA, 15 bp, Homo sapiens
cccacttcagcctcc

SEQ ID NO: 2406731 - DNA, 22 bp, Homo sapiens
cccagctggggccaggctgggt

SEQ ID NO: 2406732 - DNA, 23 bp, Homo sapiens
cccagctggggccaggctgggtc

SEQ ID NO: 2406733 - DNA, 19 bp, Homo sapiens
cccaggatactggcacaga

SEQ ID NO: 2406734 - DNA, 17 bp, Homo sapiens
cccagtaaaattgccat

SEQ ID NO: 2406735 - DNA, 17 bp, Homo sapiens
cccagtctgttccccat

SEQ ID NO: 2406736 - DNA, 18 bp, Homo sapiens
cccatcagctccagctgc

SEQ ID NO: 2406737 - DNA, 18 bp, Homo sapiens
cccattagaccaagcttg

SEQ ID NO: 2406738 - DNA, 16 bp, Homo sapiens
ccccaacatgcactga

SEQ ID NO: 2406739 - DNA, 16 bp, Homo sapiens
ccccagagccacagtt

SEQ ID NO: 2406740 - DNA, 17 bp, Homo sapiens
ccccagtaaaattgcca

SEQ ID NO: 2406741 - DNA, 16 bp, Homo sapiens
cccccagagccacagt

SEQ ID NO: 2406742 - DNA, 21 bp, Homo sapiens
cccctgagacaaatggaggcc

SEQ ID NO: 2406743 - DNA, 19 bp, Homo sapiens
ccccttctcccctgcactg

SEQ ID NO: 2406744 - DNA, 18 bp, Homo sapiens
cccctttgctgaccctcc

SEQ ID NO: 2406745 - DNA, 12 bp, Homo sapiens
cccgaggcccgc

SEQ ID NO: 2406746 - DNA, 13 bp, Homo sapiens
cccgaggcccgca

SEQ ID NO: 2406747 - DNA, 15 bp, Homo sapiens
cccgaggcccgcatg

SEQ ID NO: 2406748 - DNA, 18 bp, Homo sapiens
ccctaataaagctgtgtg

SEQ ID NO: 2406749 - DNA, 12 bp, Homo sapiens
ccctgaggccta

SEQ ID NO: 2406750 - DNA, 16 bp, Homo sapiens
ccctgcactgtaaaat

SEQ ID NO: 2406751 - DNA, 20 bp, Homo sapiens
ccctgcactgtaaaatgtgg

SEQ ID NO: 2406752 - DNA, 13 bp, Homo sapiens
ccctgcctctctg

SEQ ID NO: 2406753 - DNA, 22 bp, Homo sapiens
ccctgcctctctgcaggtccct

SEQ ID NO: 2406754 - DNA, 21 bp, Homo sapiens
ccctggactgtgtgctcagga

SEQ ID NO: 2406755 - DNA, 19 bp, Homo sapiens
ccctgtctcctctctctgt

SEQ ID NO: 2406756 - DNA, 17 bp, Homo sapiens
cccttcccttgagccct

SEQ ID NO: 2406757 - DNA, 23 bp, Homo sapiens
ccgcaggatttgggctcttggaa

SEQ ID NO: 2406758 - DNA, 21 bp, Homo sapiens
ccgccattctcaagccctgca

SEQ ID NO: 2406759 - DNA, 24 bp, Homo sapiens
ccgtagacgtgcacgcacactgtc

SEQ ID NO: 2406760 - DNA, 17 bp, Homo sapiens
ccgtcacccctgtttct

SEQ ID NO: 2406761 - DNA, 16 bp, Homo sapiens
cctaaatatattttaa

SEQ ID NO: 2406762 - DNA, 16 bp, Homo sapiens
cctaagccagctgccc

SEQ ID NO: 2406763 - DNA, 18 bp, Homo sapiens
cctaagccagctgccccc

SEQ ID NO: 2406764 - DNA, 12 bp, Homo sapiens
cctaataaagct

SEQ ID NO: 2406765 - DNA, 20 bp, Homo sapiens
cctagactctgtctacctgg

SEQ ID NO: 2406766 - DNA, 13 bp, Homo sapiens
cctagctggctct

SEQ ID NO: 2406767 - DNA, 15 bp, Homo sapiens
cctagctggctctgt

SEQ ID NO: 2406768 - DNA, 18 bp, Homo sapiens
cctatgtcatttcatttc

SEQ ID NO: 2406769 - DNA, 15 bp, Homo sapiens
cctcagggactcagg

SEQ ID NO: 2406770 - DNA, 16 bp, Homo sapiens
cctcagggactcaggt

SEQ ID NO: 2406771 - DNA, 17 bp, Homo sapiens
cctcatgaatgtaaatt

SEQ ID NO: 2406772 - DNA, 19 bp, Homo sapiens
cctcatgaatgtaaatttg

SEQ ID NO: 2406773 - DNA, 21 bp, Homo sapiens
cctcatttttataatgtccct

SEQ ID NO: 2406774 - DNA, 13 bp, Homo sapiens
cctccacctcctg

SEQ ID NO: 2406775 - DNA, 19 bp, Homo sapiens
cctccatgactgcacagta

SEQ ID NO: 2406776 - DNA, 19 bp, Homo sapiens
cctctcgtaagatttcctt

SEQ ID NO: 2406777 - DNA, 16 bp, Homo sapiens
cctctctgcaggtccc

SEQ ID NO: 2406778 - DNA, 19 bp, Homo sapiens
cctctctgcaggtccctaa

SEQ ID NO: 2406779 - DNA, 22 bp, Homo sapiens
cctctctgcaggtccctaataa

SEQ ID NO: 2406780 - DNA, 15 bp, Homo sapiens
cctctgcccttcctg

SEQ ID NO: 2406781 - DNA, 23 bp, Homo sapiens
cctctgtatttgaatcagcctac

SEQ ID NO: 2406782 - DNA, 23 bp, Homo sapiens
cctgaagctatcgtaaaattaag

SEQ ID NO: 2406783 - DNA, 13 bp, Homo sapiens
cctgacctcaggc

SEQ ID NO: 2406784 - DNA, 16 bp, Homo sapiens
cctgacctgtctcacc

SEQ ID NO: 2406785 - DNA, 14 bp, Homo sapiens
cctgactgccaagc

SEQ ID NO: 2406786 - DNA, 15 bp, Homo sapiens
cctgactgccaagcc

SEQ ID NO: 2406787 - DNA, 19 bp, Homo sapiens
cctgaggcctagactctgt

SEQ ID NO: 2406788 - DNA, 13 bp, Homo sapiens
cctgatgaaaata

SEQ ID NO: 2406789 - DNA, 17 bp, Homo sapiens
cctgatgaaaataaaga

SEQ ID NO: 2406790 - DNA, 19 bp, Homo sapiens
cctgatgaaaataaagaat

SEQ ID NO: 2406791 - DNA, 21 bp, Homo sapiens
cctgatgaaaataaagaatgg

SEQ ID NO: 2406792 - DNA, 16 bp, Homo sapiens
cctgcactgtaaaatg

SEQ ID NO: 2406793 - DNA, 22 bp, Homo sapiens
cctgcctcaccagccctggcaa

SEQ ID NO: 2406794 - DNA, 13 bp, Homo sapiens
cctgcctctctgc

SEQ ID NO: 2406795 - DNA, 14 bp, Homo sapiens
cctgcctctctgca

SEQ ID NO: 2406796 - DNA, 15 bp, Homo sapiens
cctgcctctctgcag

SEQ ID NO: 2406797 - DNA, 17 bp, Homo sapiens
cctgcctctctgcaggt

SEQ ID NO: 2406798 - DNA, 21 bp, Homo sapiens
cctgcctcttaaataaacctt

SEQ ID NO: 2406799 - DNA, 20 bp, Homo sapiens
cctgctcagccctgcaccat

SEQ ID NO: 2406800 - DNA, 14 bp, Homo sapiens
cctgctgccctccc

SEQ ID NO: 2406801 - DNA, 19 bp, Homo sapiens
cctggaggggctggggact

SEQ ID NO: 2406802 - DNA, 12 bp, Homo sapiens
cctggcggggtg

SEQ ID NO: 2406803 - DNA, 21 bp, Homo sapiens
cctgggatgagagttttggat

SEQ ID NO: 2406804 - DNA, 17 bp, Homo sapiens
cctggtagaatagatat

SEQ ID NO: 2406805 - DNA, 19 bp, Homo sapiens
cctgtccaaactgcctaag

SEQ ID NO: 2406806 - DNA, 22 bp, Homo sapiens
cctgtgagctaggaattgtgtt

SEQ ID NO: 2406807 - DNA, 19 bp, Homo sapiens
cctgtgtggagagggaatg

SEQ ID NO: 2406808 - DNA, 14 bp, Homo sapiens
cctgtttctggcac

SEQ ID NO: 2406809 - DNA, 16 bp, Homo sapiens
ccttagaccaccaagc

SEQ ID NO: 2406810 - DNA, 21 bp, Homo sapiens
ccttagaccaccaagccttga

SEQ ID NO: 2406811 - DNA, 16 bp, Homo sapiens
ccttaggcctctgaga

SEQ ID NO: 2406812 - DNA, 16 bp, Homo sapiens
ccttatcgaaactcat

SEQ ID NO: 2406813 - DNA, 20 bp, Homo sapiens
ccttcattgccttaactgga

SEQ ID NO: 2406814 - DNA, 15 bp, Homo sapiens
ccttctcccctgcac

SEQ ID NO: 2406815 - DNA, 23 bp, Homo sapiens
ccttctcccctgcactgtaaaat

SEQ ID NO: 2406816 - DNA, 24 bp, Homo sapiens
ccttctcccctgcactgtaaaatg

SEQ ID NO: 2406817 - DNA, 17 bp, Homo sapiens
ccttctctgttcatttc

SEQ ID NO: 2406818 - DNA, 10 bp, Homo sapiens
ccttctggcc

SEQ ID NO: 2406819 - DNA, 17 bp, Homo sapiens
ccttgagggcaagagcc

SEQ ID NO: 2406820 - DNA, 19 bp, Homo sapiens
ccttgatggagatatttac

SEQ ID NO: 2406821 - DNA, 21 bp, Homo sapiens
ccttgattttagccttctctg

SEQ ID NO: 2406822 - DNA, 14 bp, Homo sapiens
ccttgcataatggt

SEQ ID NO: 2406823 - DNA, 16 bp, Homo sapiens
ccttgcggctcctcag

SEQ ID NO: 2406824 - DNA, 18 bp, Homo sapiens
ccttgcggctcctcaggg

SEQ ID NO: 2406825 - DNA, 21 bp, Homo sapiens
ccttgtttctcttcctttctt

SEQ ID NO: 2406826 - DNA, 15 bp, Homo sapiens
cctttacttgacctc

SEQ ID NO: 2406827 - DNA, 12 bp, Homo sapiens
cctttattgtgt

SEQ ID NO: 2406828 - DNA, 15 bp, Homo sapiens
cctttccctaagcca

SEQ ID NO: 2406829 - DNA, 17 bp, Homo sapiens
cctttgctgaccctccc

SEQ ID NO: 2406830 - DNA, 21 bp, Homo sapiens
cctttgctgaccctccccaaa

SEQ ID NO: 2406831 - DNA, 23 bp, Homo sapiens
cgaaggaaaagggctttctcaat

SEQ ID NO: 2406832 - DNA, 13 bp, Homo sapiens
cgaggcccgcatg

SEQ ID NO: 2406833 - DNA, 22 bp, Homo sapiens
cgatcacaacgtgcattgtgct

SEQ ID NO: 2406834 - DNA, 24 bp, Homo sapiens
cgatcacaacgtgcattgtgcttc

SEQ ID NO: 2406835 - DNA, 14 bp, Homo sapiens
cgcatgcggcccag

SEQ ID NO: 2406836 - DNA, 14 bp, Homo sapiens
cgccacagcccttt

SEQ ID NO: 2406837 - DNA, 17 bp, Homo sapiens
cgccacagcccttttgt

SEQ ID NO: 2406838 - DNA, 16 bp, Homo sapiens
cgcgccaggatggcgc

SEQ ID NO: 2406839 - DNA, 14 bp, Homo sapiens
cgctctctccaggc

SEQ ID NO: 2406840 - DNA, 17 bp, Homo sapiens
cgctgttgctgaatagg

SEQ ID NO: 2406841 - DNA, 20 bp, Homo sapiens
cgcttatcaactaatgattt

SEQ ID NO: 2406842 - DNA, 16 bp, Homo sapiens
cggaaagaagaaggtg

SEQ ID NO: 2406843 - DNA, 16 bp, Homo sapiens
cggacgcccaggaccc

SEQ ID NO: 2406844 - DNA, 14 bp, Homo sapiens
cggctcctcaggga

SEQ ID NO: 2406845 - DNA, 20 bp, Homo sapiens
cggctcctcagggactcagg

SEQ ID NO: 2406846 - DNA, 20 bp, Homo sapiens
cgggaattttcatctaggat

SEQ ID NO: 2406847 - DNA, 13 bp, Homo sapiens
cggggaaggattt

SEQ ID NO: 2406848 - DNA, 14 bp, Homo sapiens
cggggactcagccc

SEQ ID NO: 2406849 - DNA, 20 bp, Homo sapiens
cggtggctcacgcctgtaat

SEQ ID NO: 2406850 - DNA, 17 bp, Homo sapiens
cgtataaaagcctgttt

SEQ ID NO: 2406851 - DNA, 21 bp, Homo sapiens
cgtataaaagcctgtttaaga

SEQ ID NO: 2406852 - DNA, 14 bp, Homo sapiens
cgtgagccacctcg

SEQ ID NO: 2406853 - DNA, 24 bp, Homo sapiens
cgtgatccacccgcctcagcctcc

SEQ ID NO: 2406854 - DNA, 12 bp, Homo sapiens
cgtgcattgtgc

SEQ ID NO: 2406855 - DNA, 20 bp, Homo sapiens
ctaaaagatataagtgctgt

SEQ ID NO: 2406856 - DNA, 17 bp, Homo sapiens
ctaaatatattttaaga

SEQ ID NO: 2406857 - DNA, 16 bp, Homo sapiens
ctaacaaccaaagact

SEQ ID NO: 2406858 - DNA, 20 bp, Homo sapiens
ctaagaaacatttatattga

SEQ ID NO: 2406859 - DNA, 16 bp, Homo sapiens
ctaagccagctgcccc

SEQ ID NO: 2406860 - DNA, 22 bp, Homo sapiens
ctaagccagctgcccccagagc

SEQ ID NO: 2406861 - DNA, 17 bp, Homo sapiens
ctaagtgtttcataaat

SEQ ID NO: 2406862 - DNA, 12 bp, Homo sapiens
ctaataaagctg

SEQ ID NO: 2406863 - DNA, 14 bp, Homo sapiens
ctaataaagctgtg

SEQ ID NO: 2406864 - DNA, 22 bp, Homo sapiens
ctaatagggcaattaattcctt

SEQ ID NO: 2406865 - DNA, 23 bp, Homo sapiens
ctaatagttttattaataaacat

SEQ ID NO: 2406866 - DNA, 20 bp, Homo sapiens
ctaatttttgtatttttagt

SEQ ID NO: 2406867 - DNA, 23 bp, Homo sapiens
ctaatttttgtatttttagtaga

SEQ ID NO: 2406868 - DNA, 21 bp, Homo sapiens
ctacaggcgtgagccaccatg

SEQ ID NO: 2406869 - DNA, 13 bp, Homo sapiens
ctaccctggactt

SEQ ID NO: 2406870 - DNA, 14 bp, Homo sapiens
ctagaatttcttta

SEQ ID NO: 2406871 - DNA, 16 bp, Homo sapiens
ctagaggaagcagcca

SEQ ID NO: 2406872 - DNA, 23 bp, Homo sapiens
ctagaggcctgactgccaagcca

SEQ ID NO: 2406873 - DNA, 21 bp, Homo sapiens
ctagaggcttccttcatttcc

SEQ ID NO: 2406874 - DNA, 24 bp, Homo sapiens
ctagagtgactcactaattcatta

SEQ ID NO: 2406875 - DNA, 18 bp, Homo sapiens
ctagcatatctgccttta

SEQ ID NO: 2406876 - DNA, 18 bp, Homo sapiens
ctgcctttggcagagttc

SEQ ID NO: 2406877 - DNA, 21 bp, Homo sapiens
ctgctcagccctgcaccatgc

SEQ ID NO: 2406878 - DNA, 13 bp, Homo sapiens
ctgctgccctccc

SEQ ID NO: 2406879 - DNA, 14 bp, Homo sapiens
ctgctgccctcccc

SEQ ID NO: 2406880 - DNA, 14 bp, Homo sapiens
ctgctgcctgcttt

SEQ ID NO: 2406881 - DNA, 23 bp, Homo sapiens
ctgctgcctgctttttatggcct

SEQ ID NO: 2406882 - DNA, 17 bp, Homo sapiens
ctgctggggaagacagt

SEQ ID NO: 2406883 - DNA, 14 bp, Homo sapiens
caagctgcatctag

SEQ ID NO: 2406884 - DNA, 18 bp, Homo sapiens
caaggaaaaaataacaat

SEQ ID NO: 2406885 - DNA, 23 bp, Homo sapiens
caagggcagggggcccctttgct

SEQ ID NO: 2406886 - DNA, 18 bp, Homo sapiens
caagggcataaattattg

SEQ ID NO: 2406887 - DNA, 18 bp, Homo sapiens
caagtcctgcctcttaaa

SEQ ID NO: 2406888 - DNA, 22 bp, Homo sapiens
caataaagtatttaattagtgc

SEQ ID NO: 2406889 - DNA, 15 bp, Homo sapiens
caattcttgccaaat

SEQ ID NO: 2406890 - DNA, 22 bp, Homo sapiens
cacaaagcccatcataatataa

SEQ ID NO: 2406891 - DNA, 21 bp, Homo sapiens
cacaaattctgtctctggatt

SEQ ID NO: 2406892 - DNA, 19 bp, Homo sapiens
cacaacgtgcattgtgctt

SEQ ID NO: 2406893 - DNA, 14 bp, Homo sapiens
cacaatagaattat

SEQ ID NO: 2406894 - DNA, 19 bp, Homo sapiens
cacacagcaagtcagggtt

SEQ ID NO: 2406895 - DNA, 23 bp, Homo sapiens
cacagaggtagtctcactgcttg

SEQ ID NO: 2406896 - DNA, 12 bp, Homo sapiens
cacagctatgaa

SEQ ID NO: 2406897 - DNA, 22 bp, Homo sapiens
cacagtggaaagacagcttctc

SEQ ID NO: 2406898 - DNA, 18 bp, Homo sapiens
cacagtgggagccagggc

SEQ ID NO: 2406899 - DNA, 19 bp, Homo sapiens
cacatatccaggcaccagg

SEQ ID NO: 2406900 - DNA, 15 bp, Homo sapiens
cacatgtcttaatga

SEQ ID NO: 2406901 - DNA, 16 bp, Homo sapiens
cacatgtcttaatgaa

SEQ ID NO: 2406902 - DNA, 22 bp, Homo sapiens
cacatgtcttaatgaagtttga

SEQ ID NO: 2406903 - DNA, 23 bp, Homo sapiens
cacatgtcttaatgaagtttgaa

SEQ ID NO: 2406904 - DNA, 23 bp, Homo sapiens
caccagtgtgtggctttcagagc

SEQ ID NO: 2406905 - DNA, 18 bp, Homo sapiens
caccatgtacatagcttg

SEQ ID NO: 2406906 - DNA, 20 bp, Homo sapiens
caccatgttggccaggcttg

SEQ ID NO: 2406907 - DNA, 13 bp, Homo sapiens
caccattcaggtc

SEQ ID NO: 2406908 - DNA, 22 bp, Homo sapiens
cacccaccagttgaatttcatc

SEQ ID NO: 2406909 - DNA, 17 bp, Homo sapiens
cacccagtctgttcccc

SEQ ID NO: 2406910 - DNA, 20 bp, Homo sapiens
caccctgtccaaactgccta

SEQ ID NO: 2406911 - DNA, 20 bp, Homo sapiens
cacctatgtcatttcatttc

SEQ ID NO: 2406912 - DNA, 20 bp, Homo sapiens
cacctcctgggttcaagcga

SEQ ID NO: 2406913 - DNA, 17 bp, Homo sapiens
cacctgttataataaat

SEQ ID NO: 2406914 - DNA, 18 bp, Homo sapiens
caccttagaccaccaagc

SEQ ID NO: 2406915 - DNA, 15 bp, Homo sapiens
cacgcacactgtctg

SEQ ID NO: 2406916 - DNA, 11 bp, Homo sapiens
cacgccacagc

SEQ ID NO: 2406917 - DNA, 13 bp, Homo sapiens
cactaaacaaaga

SEQ ID NO: 2406918 - DNA, 16 bp, Homo sapiens
cactaacatgatttgg

SEQ ID NO: 2406919 - DNA, 13 bp, Homo sapiens
cactacaacctcc

SEQ ID NO: 2406920 - DNA, 23 bp, Homo sapiens
cactacgcctggctgatttttgt

SEQ ID NO: 2406921 - DNA, 18 bp, Homo sapiens
cactcagatcctcctcat

SEQ ID NO: 2406922 - DNA, 22 bp, Homo sapiens
cactctgttcattcctccaggt

SEQ ID NO: 2406923 - DNA, 19 bp, Homo sapiens
cactgatgttgtgttttta

SEQ ID NO: 2406924 - DNA, 14 bp, Homo sapiens
cactgcaacctcca

SEQ ID NO: 2406925 - DNA, 17 bp, Homo sapiens
cactgcaacctccacct

SEQ ID NO: 2406926 - DNA, 19 bp, Homo sapiens
cactgcaacctccacctcg

SEQ ID NO: 2406927 - DNA, 12 bp, Homo sapiens
cactgtaaaatg

SEQ ID NO: 2406928 - DNA, 13 bp, Homo sapiens
cactgtaaaatgt

SEQ ID NO: 2406929 - DNA, 15 bp, Homo sapiens
cactgtgtatttaac

SEQ ID NO: 2406930 - DNA, 21 bp, Homo sapiens
cacttcaagtgaccaccagga

SEQ ID NO: 2406931 - DNA, 23 bp, Homo sapiens
cacttggctgcataaatgtggta

SEQ ID NO: 2406932 - DNA, 22 bp, Homo sapiens
cagaaagcagttgagacaagaa

SEQ ID NO: 2406933 - DNA, 18 bp, Homo sapiens
cagaaggccaagaggctg

SEQ ID NO: 2406934 - DNA, 17 bp, Homo sapiens
cagaccattgtctcaga

SEQ ID NO: 2406935 - DNA, 14 bp, Homo sapiens
cagactctaagaaa

SEQ ID NO: 2406936 - DNA, 17 bp, Homo sapiens
cagactctaagaaagaa

SEQ ID NO: 2406937 - DNA, 19 bp, Homo sapiens
cagactggatagtccgtct

SEQ ID NO: 2406938 - DNA, 20 bp, Homo sapiens
cagagaagccaaaagattgg

SEQ ID NO: 2406939 - DNA, 17 bp, Homo sapiens
cagagaccttccagaaa

SEQ ID NO: 2406940 - DNA, 13 bp, Homo sapiens
cagagccacagtt

SEQ ID NO: 2406941 - DNA, 20 bp, Homo sapiens
cagagcctcctttctggctt

SEQ ID NO: 2406942 - DNA, 16 bp, Homo sapiens
cagatggcatgtgttt

SEQ ID NO: 2406943 - DNA, 14 bp, Homo sapiens
cagattgtcagctc

SEQ ID NO: 2406944 - DNA, 14 bp, Homo sapiens
cagccaggagctgg

SEQ ID NO: 2406945 - DNA, 15 bp, Homo sapiens
cagccaggagctggg

SEQ ID NO: 2406946 - DNA, 21 bp, Homo sapiens
cagccatcaccttagaccacc

SEQ ID NO: 2406947 - DNA, 23 bp, Homo sapiens
cagccctgcaccatgctgctggg

SEQ ID NO: 2406948 - DNA, 16 bp, Homo sapiens
cagcctacaggcctca

SEQ ID NO: 2406949 - DNA, 13 bp, Homo sapiens
cagctcactgcaa

SEQ ID NO: 2406950 - DNA, 18 bp, Homo sapiens
cagctggggccaggctgg

SEQ ID NO: 2406951 - DNA, 20 bp, Homo sapiens
cagctggggccaggctgggt

SEQ ID NO: 2406952 - DNA, 17 bp, Homo sapiens
cagcttcagccaggagc

SEQ ID NO: 2406953 - DNA, 19 bp, Homo sapiens
cagcttgatcaaaggcaca

SEQ ID NO: 2406954 - DNA, 14 bp, Homo sapiens
caggaacaaacagg

SEQ ID NO: 2406955 - DNA, 15 bp, Homo sapiens
caggaacaaacaggg

SEQ ID NO: 2406956 - DNA, 11 bp, Homo sapiens
caggagccctg

SEQ ID NO: 2406957 - DNA, 14 bp, Homo sapiens
caggagccctggga

SEQ ID NO: 2406958 - DNA, 16 bp, Homo sapiens
caggagccctgggagg

SEQ ID NO: 2406959 - DNA, 17 bp, Homo sapiens
caggatactggcacaga

SEQ ID NO: 2406960 - DNA, 18 bp, Homo sapiens
caggatactggcacagag

SEQ ID NO: 2406961 - DNA, 19 bp, Homo sapiens
caggatactggcacagagg

SEQ ID NO: 2406962 - DNA, 18 bp, Homo sapiens
caggatgatgactatgga

SEQ ID NO: 2406963 - DNA, 20 bp, Homo sapiens
caggatgatgactatggaaa

SEQ ID NO: 2406964 - DNA, 14 bp, Homo sapiens
caggatggcgcagg

SEQ ID NO: 2406965 - DNA, 16 bp, Homo sapiens
caggcacacaccacca

SEQ ID NO: 2406966 - DNA, 17 bp, Homo sapiens
caggcctggcaagtggg

SEQ ID NO: 2406967 - DNA, 20 bp, Homo sapiens
caggcctggcaagtgggtga

SEQ ID NO: 2406968 - DNA, 18 bp, Homo sapiens
caggcgtgagccacctcg

SEQ ID NO: 2406969 - DNA, 21 bp, Homo sapiens
caggctgggtcgccctggact

SEQ ID NO: 2406970 - DNA, 16 bp, Homo sapiens
caggcttgcctgcagg

SEQ ID NO: 2406971 - DNA, 21 bp, Homo sapiens
cagggactcatctttccctcc

SEQ ID NO: 2406972 - DNA, 20 bp, Homo sapiens
caggtaaaacagggccacat

SEQ ID NO: 2406973 - DNA, 23 bp, Homo sapiens
caggtaaaacagggccacataga

SEQ ID NO: 2406974 - DNA, 14 bp, Homo sapiens
caggtatacctcac

SEQ ID NO: 2406975 - DNA, 16 bp, Homo sapiens
caggtatacctcactt

SEQ ID NO: 2406976 - DNA, 17 bp, Homo sapiens
caggtatagactcctga

SEQ ID NO: 2406977 - DNA, 15 bp, Homo sapiens
caggtatccaaaaat

SEQ ID NO: 2406978 - DNA, 14 bp, Homo sapiens
caggtccctaataa

SEQ ID NO: 2406979 - DNA, 15 bp, Homo sapiens
caggtccctaataaa

SEQ ID NO: 2406980 - DNA, 17 bp, Homo sapiens
caggtccctaataaagc

SEQ ID NO: 2406981 - DNA, 22 bp, Homo sapiens
caggtccctaataaagctgtgt

SEQ ID NO: 2406982 - DNA, 15 bp, Homo sapiens
caggtggccctactg

SEQ ID NO: 2406983 - DNA, 23 bp, Homo sapiens
cagtaaagaacatccctcctggg

SEQ ID NO: 2406984 - DNA, 18 bp, Homo sapiens
cagtactttgtgcattct

SEQ ID NO: 2406985 - DNA, 13 bp, Homo sapiens
cagtatgaaaata

SEQ ID NO: 2406986 - DNA, 14 bp, Homo sapiens
cagtatgaaaataa

SEQ ID NO: 2406987 - DNA, 22 bp, Homo sapiens
cagtctcacatgattccagcca

SEQ ID NO: 2406988 - DNA, 22 bp, Homo sapiens
cagtctgatgagaactctgagc

SEQ ID NO: 2406989 - DNA, 21 bp, Homo sapiens
cagtctgttccccatggccac

SEQ ID NO: 2406990 - DNA, 20 bp, Homo sapiens
cagtgaaagaaaataacaat

SEQ ID NO: 2406991 - DNA, 23 bp, Homo sapiens
cagtgagagagtggctggggcat

SEQ ID NO: 2406992 - DNA, 16 bp, Homo sapiens
cagtgctcgctgttgc

SEQ ID NO: 2406993 - DNA, 18 bp, Homo sapiens
cagtgctcgctgttgctg

SEQ ID NO: 2406994 - DNA, 21 bp, Homo sapiens
cagtggcgcgatctcagctca

SEQ ID NO: 2406995 - DNA, 21 bp, Homo sapiens
cagtggcgtgatctcagctca

SEQ ID NO: 2406996 - DNA, 17 bp, Homo sapiens
cagtgggagccagggct

SEQ ID NO: 2406997 - DNA, 18 bp, Homo sapiens
cagtgggagccagggctg

SEQ ID NO: 2406998 - DNA, 15 bp, Homo sapiens
cagttgtcctccttc

SEQ ID NO: 2406999 - DNA, 12 bp, Homo sapiens
cataaattattg

SEQ ID NO: 2407000 - DNA, 17 bp, Homo sapiens
cataacggatcagaaat

SEQ ID NO: 2407001 - DNA, 16 bp, Homo sapiens
catacattttctaaga

SEQ ID NO: 2407002 - DNA, 18 bp, Homo sapiens
catacattttctaagaaa

SEQ ID NO: 2407003 - DNA, 16 bp, Homo sapiens
catataagtgattgct

SEQ ID NO: 2407004 - DNA, 17 bp, Homo sapiens
catatgatgtacatgta

SEQ ID NO: 2407005 - DNA, 15 bp, Homo sapiens
attcagcctggcttc

SEQ ID NO: 2407006 - DNA, 21 bp, Homo sapiens
attcataattattatttggcc

SEQ ID NO: 2407007 - DNA, 17 bp, Homo sapiens
attccagacctgaagaa

SEQ ID NO: 2407008 - DNA, 18 bp, Homo sapiens
attccagacctgaagaat

SEQ ID NO: 2407009 - DNA, 16 bp, Homo sapiens
attcctcatgaatgta

SEQ ID NO: 2407010 - DNA, 17 bp, Homo sapiens
attcctcatgaatgtaa

SEQ ID NO: 2407011 - DNA, 23 bp, Homo sapiens
attcctcatgaatgtaaatttgt

SEQ ID NO: 2407012 - DNA, 22 bp, Homo sapiens
attcctgtggatgtaaagtgat

SEQ ID NO: 2407013 - DNA, 15 bp, Homo sapiens
attctatctattcct

SEQ ID NO: 2407014 - DNA, 16 bp, Homo sapiens
attctcaagccctgca

SEQ ID NO: 2407015 - DNA, 13 bp, Homo sapiens
attcttccatctg

SEQ ID NO: 2407016 - DNA, 14 bp, Homo sapiens
attcttccatctga

SEQ ID NO: 2407017 - DNA, 15 bp, Homo sapiens
attcttccatctgat

SEQ ID NO: 2407018 - DNA, 23 bp, Homo sapiens
attcttccatctgattgtgatgt

SEQ ID NO: 2407019 - DNA, 18 bp, Homo sapiens
attcttgatgtaaaatct

SEQ ID NO: 2407020 - DNA, 19 bp, Homo sapiens
attcttgatgtaaaatctt

SEQ ID NO: 2407021 - DNA, 20 bp, Homo sapiens
attcttgatgtaaaatcttg

SEQ ID NO: 2407022 - DNA, 17 bp, Homo sapiens
attcttgccaaatataa

SEQ ID NO: 2407023 - DNA, 17 bp, Homo sapiens
attgaaggatgctgtct

SEQ ID NO: 2407024 - DNA, 11 bp, Homo sapiens
attgagagaat

SEQ ID NO: 2407025 - DNA, 17 bp, Homo sapiens
attgataagatctttta

SEQ ID NO: 2407026 - DNA, 16 bp, Homo sapiens
attgatccagaaagaa

SEQ ID NO: 2407027 - DNA, 17 bp, Homo sapiens
attgatccagaaagaaa

SEQ ID NO: 2407028 - DNA, 22 bp, Homo sapiens
attgatccagaaagaaaacttg

SEQ ID NO: 2407029 - DNA, 21 bp, Homo sapiens
attgcacatgtcttaatgaag

SEQ ID NO: 2407030 - DNA, 15 bp, Homo sapiens
attgcctcacttcag

SEQ ID NO: 2407031 - DNA, 13 bp, Homo sapiens
attgcctctgaga

SEQ ID NO: 2407032 - DNA, 22 bp, Homo sapiens
attgctatgttttgacattttt

SEQ ID NO: 2407033 - DNA, 14 bp, Homo sapiens
attggctttatcct

SEQ ID NO: 2407034 - DNA, 17 bp, Homo sapiens
attggctttatcctctt

SEQ ID NO: 2407035 - DNA, 21 bp, Homo sapiens
attggctttatcctctttaga

SEQ ID NO: 2407036 - DNA, 16 bp, Homo sapiens
attggtgttgccagtt

SEQ ID NO: 2407037 - DNA, 14 bp, Homo sapiens
attgtattacaaat

SEQ ID NO: 2407038 - DNA, 16 bp, Homo sapiens
attgtatttattcaat

SEQ ID NO: 2407039 - DNA, 18 bp, Homo sapiens
attgtatttattcaataa

SEQ ID NO: 2407040 - DNA, 23 bp, Homo sapiens
attgtatttattcaataaagtat

SEQ ID NO: 2407041 - DNA, 15 bp, Homo sapiens
attgtgtttgtcatt

SEQ ID NO: 2407042 - DNA, 19 bp, Homo sapiens
attgtgtttgtcattagcc

SEQ ID NO: 2407043 - DNA, 14 bp, Homo sapiens
attgttaaaggcta

SEQ ID NO: 2407044 - DNA, 21 bp, Homo sapiens
attgttgtacacagaaataca

SEQ ID NO: 2407045 - DNA, 18 bp, Homo sapiens
atttaataatatacttgt

SEQ ID NO: 2407046 - DNA, 19 bp, Homo sapiens
atttaataatatacttgtg

SEQ ID NO: 2407047 - DNA, 21 bp, Homo sapiens
atttaattagtgctaagtgtg

SEQ ID NO: 2407048 - DNA, 22 bp, Homo sapiens
atttaattagtgctaagtgtga

SEQ ID NO: 2407049 - DNA, 23 bp, Homo sapiens
atttaattagtgctaagtgtgaa

SEQ ID NO: 2407050 - DNA, 16 bp, Homo sapiens
atttacatcatttctt

SEQ ID NO: 2407051 - DNA, 21 bp, Homo sapiens
atttacatgaattgcatttta

SEQ ID NO: 2407052 - DNA, 14 bp, Homo sapiens
atttaggtttctga

SEQ ID NO: 2407053 - DNA, 21 bp, Homo sapiens
atttaggtttctgagttcctg

SEQ ID NO: 2407054 - DNA, 23 bp, Homo sapiens
atttaggtttctgagttcctgca

SEQ ID NO: 2407055 - DNA, 20 bp, Homo sapiens
atttagtatctttttattca

SEQ ID NO: 2407056 - DNA, 13 bp, Homo sapiens
atttagtgttcat

SEQ ID NO: 2407057 - DNA, 16 bp, Homo sapiens
atttagtgttcataaa

SEQ ID NO: 2407058 - DNA, 17 bp, Homo sapiens
atttagtgttcataaat

SEQ ID NO: 2407059 - DNA, 23 bp, Homo sapiens
atttataaaaataaaaaacactg

SEQ ID NO: 2407060 - DNA, 13 bp, Homo sapiens
atttatattgata

SEQ ID NO: 2407061 - DNA, 20 bp, Homo sapiens
atttatattgataagatctt

SEQ ID NO: 2407062 - DNA, 17 bp, Homo sapiens
atttatgagctcttcat

SEQ ID NO: 2407063 - DNA, 22 bp, Homo sapiens
atttatgcatattattttatgt

SEQ ID NO: 2407064 - DNA, 16 bp, Homo sapiens
atttattcaataaagt

SEQ ID NO: 2407065 - DNA, 16 bp, Homo sapiens
atttcagcagctgcag

SEQ ID NO: 2407066 - DNA, 22 bp, Homo sapiens
atttccatataaatattagaaa

SEQ ID NO: 2407067 - DNA, 19 bp, Homo sapiens
atttcctaattttgagaaa

SEQ ID NO: 2407068 - DNA, 15 bp, Homo sapiens
atttcctagttctgt

SEQ ID NO: 2407069 - DNA, 18 bp, Homo sapiens
atttcctagttctgtaga

SEQ ID NO: 2407070 - DNA, 22 bp, Homo sapiens
atttcctagttctgtagaaatg

SEQ ID NO: 2407071 - DNA, 22 bp, Homo sapiens
atttcctcaacgttgctcccca

SEQ ID NO: 2407072 - DNA, 23 bp, Homo sapiens
atttgaatcagcctacaggcctc

SEQ ID NO: 2407073 - DNA, 22 bp, Homo sapiens
atttgaatcttgtctcaatgct

SEQ ID NO: 2407074 - DNA, 14 bp, Homo sapiens
atttgaatgcattt

SEQ ID NO: 2407075 - DNA, 16 bp, Homo sapiens
atttgaatgcattttg

SEQ ID NO: 2407076 - DNA, 18 bp, Homo sapiens
atttgaatgcattttgtt

SEQ ID NO: 2407077 - DNA, 22 bp, Homo sapiens
atttgcagctgagagaaaataa

SEQ ID NO: 2407078 - DNA, 19 bp, Homo sapiens
atttgtactatttaactga

SEQ ID NO: 2407079 - DNA, 19 bp, Homo sapiens
atttgtgcccccaaccatt

SEQ ID NO: 2407080 - DNA, 14 bp, Homo sapiens
attttaaacacatt

SEQ ID NO: 2407081 - DNA, 23 bp, Homo sapiens
attttaaacacattaggaaaagt

SEQ ID NO: 2407082 - DNA, 16 bp, Homo sapiens
attttaataaacactc

SEQ ID NO: 2407083 - DNA, 20 bp, Homo sapiens
attttactgtacagacagaa

SEQ ID NO: 2407084 - DNA, 22 bp, Homo sapiens
attttactgtacagacagaaaa

SEQ ID NO: 2407085 - DNA, 18 bp, Homo sapiens
attttagccttctctgtt

SEQ ID NO: 2407086 - DNA, 18 bp, Homo sapiens
attttatgttgcatagaa

SEQ ID NO: 2407087 - DNA, 15 bp, Homo sapiens
attttcattattcct

SEQ ID NO: 2407088 - DNA, 15 bp, Homo sapiens
attttctataattta

SEQ ID NO: 2407089 - DNA, 19 bp, Homo sapiens
attttctataatttaaata

SEQ ID NO: 2407090 - DNA, 14 bp, Homo sapiens
attttctttcaaaa

SEQ ID NO: 2407091 - DNA, 22 bp, Homo sapiens
attttgaacctgatgaaaataa

SEQ ID NO: 2407092 - DNA, 14 bp, Homo sapiens
attttgatgaacaa

SEQ ID NO: 2407093 - DNA, 17 bp, Homo sapiens
attttgtgatgcaaata

SEQ ID NO: 2407094 - DNA, 17 bp, Homo sapiens
attttgtttggtattgt

SEQ ID NO: 2407095 - DNA, 20 bp, Homo sapiens
attttgtttggtattgtatt

SEQ ID NO: 2407096 - DNA, 21 bp, Homo sapiens
attttgtttggtattgtattt

SEQ ID NO: 2407097 - DNA, 19 bp, Homo sapiens
atttttaatatatactatg

SEQ ID NO: 2407098 - DNA, 17 bp, Homo sapiens
atttttacattctgaat

SEQ ID NO: 2407099 - DNA, 23 bp, Homo sapiens
atttttggaagaggactccttaa

SEQ ID NO: 2407100 - DNA, 21 bp, Homo sapiens
atttttggggggagtaaagaa

SEQ ID NO: 2407101 - DNA, 17 bp, Homo sapiens
atttttttagaaagcat

SEQ ID NO: 2407102 - DNA, 18 bp, Homo sapiens
attttttttaacattcct

SEQ ID NO: 2407103 - DNA, 23 bp, Homo sapiens
caaactgcctaagccctccgcca

SEQ ID NO: 2407104 - DNA, 14 bp, Homo sapiens
caaactgccttctt

SEQ ID NO: 2407105 - DNA, 15 bp, Homo sapiens
caaagaaattatgtg

SEQ ID NO: 2407106 - DNA, 15 bp, Homo sapiens
caaaggctttgccct

SEQ ID NO: 2407107 - DNA, 14 bp, Homo sapiens
caaaggtaaatcag

SEQ ID NO: 2407108 - DNA, 22 bp, Homo sapiens
caaaggtaaatcagactatgaa

SEQ ID NO: 2407109 - DNA, 19 bp, Homo sapiens
caaagtttaccagaaagca

SEQ ID NO: 2407110 - DNA, 20 bp, Homo sapiens
caaataatttttcacttcaa

SEQ ID NO: 2407111 - DNA, 17 bp, Homo sapiens
caaatattccagagact

SEQ ID NO: 2407112 - DNA, 14 bp, Homo sapiens
caaatctaccactg

SEQ ID NO: 2407113 - DNA, 18 bp, Homo sapiens
caaatctaccactgtatg

SEQ ID NO: 2407114 - DNA, 16 bp, Homo sapiens
caaattcgcaaacttt

SEQ ID NO: 2407115 - DNA, 21 bp, Homo sapiens
caaattgtaagcatgcacaaa

SEQ ID NO: 2407116 - DNA, 16 bp, Homo sapiens
caaccatttcctcaga

SEQ ID NO: 2407117 - DNA, 14 bp, Homo sapiens
caacctccacctcc

SEQ ID NO: 2407118 - DNA, 16 bp, Homo sapiens
caacgtgcattgtgct

SEQ ID NO: 2407119 - DNA, 14 bp, Homo sapiens
caacgtggcccaga

SEQ ID NO: 2407120 - DNA, 20 bp, Homo sapiens
caacgtggcccagagaagcc

SEQ ID NO: 2407121 - DNA, 17 bp, Homo sapiens
atcataagatatttttc

SEQ ID NO: 2407122 - DNA, 18 bp, Homo sapiens
atcatgaagatatttttc

SEQ ID NO: 2407123 - DNA, 19 bp, Homo sapiens
atcattcttatttcatgaa

SEQ ID NO: 2407124 - DNA, 23 bp, Homo sapiens
atcattcttatttcatgaaaatt

SEQ ID NO: 2407125 - DNA, 14 bp, Homo sapiens
atcatttaataata

SEQ ID NO: 2407126 - DNA, 18 bp, Homo sapiens
atcccactcacaacagct

SEQ ID NO: 2407127 - DNA, 18 bp, Homo sapiens
atccccacgccacagccc

SEQ ID NO: 2407128 - DNA, 12 bp, Homo sapiens
atcccccagcct

SEQ ID NO: 2407129 - DNA, 20 bp, Homo sapiens
atccccttctcccctgcact

SEQ ID NO: 2407130 - DNA, 15 bp, Homo sapiens
atcccgattcaccct

SEQ ID NO: 2407131 - DNA, 21 bp, Homo sapiens
atcctatctctccaaccagat

SEQ ID NO: 2407132 - DNA, 20 bp, Homo sapiens
atcctcccacttcagcctcc

SEQ ID NO: 2407133 - DNA, 13 bp, Homo sapiens
atcctctttagag

SEQ ID NO: 2407134 - DNA, 19 bp, Homo sapiens
atcctctttagagttagac

SEQ ID NO: 2407135 - DNA, 21 bp, Homo sapiens
atcctctttagagttagactg

SEQ ID NO: 2407136 - DNA, 12 bp, Homo sapiens
atcctgcctgcc

SEQ ID NO: 2407137 - DNA, 18 bp, Homo sapiens
atcctgtgtggagaggga

SEQ ID NO: 2407138 - DNA, 23 bp, Homo sapiens
atcctgtgtggagagggaatgtg

SEQ ID NO: 2407139 - DNA, 20 bp, Homo sapiens
atcgatttttaaaaattaaa

SEQ ID NO: 2407140 - DNA, 16 bp, Homo sapiens
atcggagcctcctctc

SEQ ID NO: 2407141 - DNA, 14 bp, Homo sapiens
atcgtaaaattaag

SEQ ID NO: 2407142 - DNA, 13 bp, Homo sapiens
atctatcaaaatt

SEQ ID NO: 2407143 - DNA, 16 bp, Homo sapiens
atctatgcattttctg

SEQ ID NO: 2407144 - DNA, 22 bp, Homo sapiens
atctcacactcatgcattgtcc

SEQ ID NO: 2407145 - DNA, 13 bp, Homo sapiens
atctcagctcact

SEQ ID NO: 2407146 - DNA, 16 bp, Homo sapiens
atctcttgtttaaatt

SEQ ID NO: 2407147 - DNA, 20 bp, Homo sapiens
atctgatatcagtccagttt

SEQ ID NO: 2407148 - DNA, 16 bp, Homo sapiens
atctgcctttattgtg

SEQ ID NO: 2407149 - DNA, 14 bp, Homo sapiens
atcttataatttaa

SEQ ID NO: 2407150 - DNA, 16 bp, Homo sapiens
atcttataatttaaaa

SEQ ID NO: 2407151 - DNA, 22 bp, Homo sapiens
atcttataatttaaaatatgct

SEQ ID NO: 2407152 - DNA, 11 bp, Homo sapiens
atcttgtcatg

SEQ ID NO: 2407153 - DNA, 14 bp, Homo sapiens
atcttgtcatgtgt

SEQ ID NO: 2407154 - DNA, 14 bp, Homo sapiens
atcttgtccccaac

SEQ ID NO: 2407155 - DNA, 15 bp, Homo sapiens
atcttgtctcaatgc

SEQ ID NO: 2407156 - DNA, 17 bp, Homo sapiens
atctttccctccttggt

SEQ ID NO: 2407157 - DNA, 15 bp, Homo sapiens
atctttctttcttag

SEQ ID NO: 2407158 - DNA, 20 bp, Homo sapiens
atctttctttcttagaaatt

SEQ ID NO: 2407159 - DNA, 22 bp, Homo sapiens
atgaaaaaatatatatcaaata

SEQ ID NO: 2407160 - DNA, 23 bp, Homo sapiens
atgaaaaaatatatatcaaatat

SEQ ID NO: 2407161 - DNA, 15 bp, Homo sapiens
atgaaaataaagaat

SEQ ID NO: 2407162 - DNA, 17 bp, Homo sapiens
atgaaaataaagaatgg

SEQ ID NO: 2407163 - DNA, 23 bp, Homo sapiens
atgaacctcaagctgcatctaga

SEQ ID NO: 2407164 - DNA, 20 bp, Homo sapiens
atgaagagatttttcatgat

SEQ ID NO: 2407165 - DNA, 13 bp, Homo sapiens
atgaagctgttgt

SEQ ID NO: 2407166 - DNA, 18 bp, Homo sapiens
atgaaggtgtcatacaga

SEQ ID NO: 2407167 - DNA, 18 bp, Homo sapiens
atgaagtttgaatgttaa

SEQ ID NO: 2407168 - DNA, 19 bp, Homo sapiens
atgaagttttttttataca

SEQ ID NO: 2407169 - DNA, 21 bp, Homo sapiens
atgaatatttagtgttcataa

SEQ ID NO: 2407170 - DNA, 12 bp, Homo sapiens
atgaatgtaaat

SEQ ID NO: 2407171 - DNA, 15 bp, Homo sapiens
atgaatgtaaatttg

SEQ ID NO: 2407172 - DNA, 15 bp, Homo sapiens
atgagaaatctaaaa

SEQ ID NO: 2407173 - DNA, 15 bp, Homo sapiens
atgagagttttggat

SEQ ID NO: 2407174 - DNA, 18 bp, Homo sapiens
atgagagttttggatgca

SEQ ID NO: 2407175 - DNA, 21 bp, Homo sapiens
atgagagttttggatgcagtg

SEQ ID NO: 2407176 - DNA, 14 bp, Homo sapiens
atgagggaaaagaa

SEQ ID NO: 2407177 - DNA, 21 bp, Homo sapiens
atgagtggaaattaagacttt

SEQ ID NO: 2407178 - DNA, 17 bp, Homo sapiens
atgagtggctttaatga

SEQ ID NO: 2407179 - DNA, 21 bp, Homo sapiens
atgatacttgaaaattaacat

SEQ ID NO: 2407180 - DNA, 13 bp, Homo sapiens
atgattccagcca

SEQ ID NO: 2407181 - DNA, 22 bp, Homo sapiens
atgattccttgatggagatatt

SEQ ID NO: 2407182 - DNA, 13 bp, Homo sapiens
atgcagtgctcgc

SEQ ID NO: 2407183 - DNA, 19 bp, Homo sapiens
atgcagtgctcgctgttgc

SEQ ID NO: 2407184 - DNA, 21 bp, Homo sapiens
atgctcataacggatcagaaa

SEQ ID NO: 2407185 - DNA, 21 bp, Homo sapiens
atgctgagattacaggtgtga

SEQ ID NO: 2407186 - DNA, 18 bp, Homo sapiens
atgctgctggggaagaca

SEQ ID NO: 2407187 - DNA, 19 bp, Homo sapiens
atggaaagcttcagtgctg

SEQ ID NO: 2407188 - DNA, 21 bp, Homo sapiens
atggagccagctctgcattat

SEQ ID NO: 2407189 - DNA, 13 bp, Homo sapiens
atggcgcaggaac

SEQ ID NO: 2407190 - DNA, 13 bp, Homo sapiens
atgggacattttt

SEQ ID NO: 2407191 - DNA, 21 bp, Homo sapiens
atgggaggcctttccctaagc

SEQ ID NO: 2407192 - DNA, 17 bp, Homo sapiens
atggggtctgtaaaatc

SEQ ID NO: 2407193 - DNA, 13 bp, Homo sapiens
atgggtcacagga

SEQ ID NO: 2407194 - DNA, 16 bp, Homo sapiens
atggtgccttcatttg

SEQ ID NO: 2407195 - DNA, 19 bp, Homo sapiens
atggtggatgatccccacg

SEQ ID NO: 2407196 - DNA, 18 bp, Homo sapiens
atggttgtattagatgtt

SEQ ID NO: 2407197 - DNA, 13 bp, Homo sapiens
atgtaaaatcttg

SEQ ID NO: 2407198 - DNA, 14 bp, Homo sapiens
atgtaaaatcttgt

SEQ ID NO: 2407199 - DNA, 16 bp, Homo sapiens
atgtaaaatcttgtca

SEQ ID NO: 2407200 - DNA, 13 bp, Homo sapiens
atgtaaatttgta

SEQ ID NO: 2407201 - DNA, 17 bp, Homo sapiens
atgtaaatttgtactat

SEQ ID NO: 2407202 - DNA, 19 bp, Homo sapiens
atgtaaatttgtactattt

SEQ ID NO: 2407203 - DNA, 21 bp, Homo sapiens
atgtaaatttgtactatttaa

SEQ ID NO: 2407204 - DNA, 14 bp, Homo sapiens
atgtaactagaatt

SEQ ID NO: 2407205 - DNA, 16 bp, Homo sapiens
atgtaagctgaaaata

SEQ ID NO: 2407206 - DNA, 22 bp, Homo sapiens
atgtaataaggttgaacacttt

SEQ ID NO: 2407207 - DNA, 22 bp, Homo sapiens
atgtcaagggttcaagattgtt

SEQ ID NO: 2407208 - DNA, 18 bp, Homo sapiens
atgtcatttcatttccta

SEQ ID NO: 2407209 - DNA, 19 bp, Homo sapiens
atgtcttaatgaagtttga

SEQ ID NO: 2407210 - DNA, 20 bp, Homo sapiens
atgtcttaatgaagtttgaa

SEQ ID NO: 2407211 - DNA, 23 bp, Homo sapiens
atgtcttaatgaagtttgaatgt

SEQ ID NO: 2407212 - DNA, 14 bp, Homo sapiens
atgtgaaacatgtt

SEQ ID NO: 2407213 - DNA, 14 bp, Homo sapiens
atgtgaaatcattc

SEQ ID NO: 2407214 - DNA, 23 bp, Homo sapiens
atgtgaaatttacatcatttctt

SEQ ID NO: 2407215 - DNA, 20 bp, Homo sapiens
atgtgggattatgggtcaca

SEQ ID NO: 2407216 - DNA, 13 bp, Homo sapiens
atgtgtataaaaa

SEQ ID NO: 2407217 - DNA, 16 bp, Homo sapiens
atgtgtgtgtgtgtat

SEQ ID NO: 2407218 - DNA, 23 bp, Homo sapiens
atgtgtgttttaaaatgagaaat

SEQ ID NO: 2407219 - DNA, 19 bp, Homo sapiens
atgttaaactagcatatct

SEQ ID NO: 2407220 - DNA, 17 bp, Homo sapiens
atgttactacatgcact

SEQ ID NO: 2407221 - DNA, 15 bp, Homo sapiens
atgttctctatcatt

SEQ ID NO: 2407222 - DNA, 17 bp, Homo sapiens
atgttgcatagaataaa

SEQ ID NO: 2407223 - DNA, 14 bp, Homo sapiens
atgttgtaatattt

SEQ ID NO: 2407224 - DNA, 19 bp, Homo sapiens
atgttgtaatatttcttca

SEQ ID NO: 2407225 - DNA, 22 bp, Homo sapiens
atgtttgctcagcttctccaac

SEQ ID NO: 2407226 - DNA, 14 bp, Homo sapiens
atgttttgacattt

SEQ ID NO: 2407227 - DNA, 16 bp, Homo sapiens
atgttttgacattttt

SEQ ID NO: 2407228 - DNA, 22 bp, Homo sapiens
attaattccttcagcactttag

SEQ ID NO: 2407229 - DNA, 22 bp, Homo sapiens
attacaggcgtgagccacctcg

SEQ ID NO: 2407230 - DNA, 19 bp, Homo sapiens
attaccttctattggtctc

SEQ ID NO: 2407231 - DNA, 18 bp, Homo sapiens
attgatgggatttggtca

SEQ ID NO: 2407232 - DNA, 18 bp, Homo sapiens
attgcacatgtcttaatg

SEQ ID NO: 2407233 - DNA, 12 bp, Homo sapiens
attgccatattg

SEQ ID NO: 2407234 - DNA, 15 bp, Homo sapiens
attgccatattgcac

SEQ ID NO: 2407235 - DNA, 17 bp, Homo sapiens
attgccatattgcacat

SEQ ID NO: 2407236 - DNA, 22 bp, Homo sapiens
attgccatattgcacatgtctt

SEQ ID NO: 2407237 - DNA, 14 bp, Homo sapiens
attgcctctgagag

SEQ ID NO: 2407238 - DNA, 18 bp, Homo sapiens
attgccttaactggagcc

SEQ ID NO: 2407239 - DNA, 15 bp, Homo sapiens
attgggtatcaccac

SEQ ID NO: 2407240 - DNA, 18 bp, Homo sapiens
attgtaagcatgcacaaa

SEQ ID NO: 2407241 - DNA, 16 bp, Homo sapiens
attgtagtcctgtaat

SEQ ID NO: 2407242 - DNA, 14 bp, Homo sapiens
attgtatattcact

SEQ ID NO: 2407243 - DNA, 13 bp, Homo sapiens
attgtattcagag

SEQ ID NO: 2407244 - DNA, 20 bp, Homo sapiens
attgtatttattcaataaag

SEQ ID NO: 2407245 - DNA, 15 bp, Homo sapiens
attgtgaaattattc

SEQ ID NO: 2407246 - DNA, 20 bp, Homo sapiens
attgtgcagtactttgtgca

SEQ ID NO: 2407247 - DNA, 15 bp, Homo sapiens
attgtgcttctttct

SEQ ID NO: 2407248 - DNA, 14 bp, Homo sapiens
actcctttctcatc

SEQ ID NO: 2407249 - DNA, 23 bp, Homo sapiens
actctcttattgcctcacttcag

SEQ ID NO: 2407250 - DNA, 19 bp, Homo sapiens
actcttgaaaaatgcatgt

SEQ ID NO: 2407251 - DNA, 20 bp, Homo sapiens
actgactattcttgatgtaa

SEQ ID NO: 2407252 - DNA, 22 bp, Homo sapiens
actgactattcttgatgtaaaa

SEQ ID NO: 2407253 - DNA, 20 bp, Homo sapiens
actgagatccttccttttga

SEQ ID NO: 2407254 - DNA, 20 bp, Homo sapiens
actgatgtatgaggaatttc

SEQ ID NO: 2407255 - DNA, 13 bp, Homo sapiens
actgcaacctcca

SEQ ID NO: 2407256 - DNA, 14 bp, Homo sapiens
actgcaacctccac

SEQ ID NO: 2407257 - DNA, 16 bp, Homo sapiens
actgcaacctccacct

SEQ ID NO: 2407258 - DNA, 18 bp, Homo sapiens
actgcaacctccacctcc

SEQ ID NO: 2407259 - DNA, 18 bp, Homo sapiens
actgccaagccatgggta

SEQ ID NO: 2407260 - DNA, 14 bp, Homo sapiens
actgcctaagccct

SEQ ID NO: 2407261 - DNA, 19 bp, Homo sapiens
actgcctttggcagagttc

SEQ ID NO: 2407262 - DNA, 16 bp, Homo sapiens
actggaccctgttgct

SEQ ID NO: 2407263 - DNA, 17 bp, Homo sapiens
actggaccctgttgcta

SEQ ID NO: 2407264 - DNA, 13 bp, Homo sapiens
actggcttcagca

SEQ ID NO: 2407265 - DNA, 17 bp, Homo sapiens
actgtaaaataataact

SEQ ID NO: 2407266 - DNA, 16 bp, Homo sapiens
actgtaaggcaatcat

SEQ ID NO: 2407267 - DNA, 20 bp, Homo sapiens
actgtacagacagaaaaaac

SEQ ID NO: 2407268 - DNA, 15 bp, Homo sapiens
actgtctctcatgaa

SEQ ID NO: 2407269 - DNA, 23 bp, Homo sapiens
actgtcttttttctaaagtaaaa

SEQ ID NO: 2407270 - DNA, 21 bp, Homo sapiens
actgtgtaagggccagaaata

SEQ ID NO: 2407271 - DNA, 15 bp, Homo sapiens
actgtgtgctcagga

SEQ ID NO: 2407272 - DNA, 19 bp, Homo sapiens
actgtgtgctcaggagccc

SEQ ID NO: 2407273 - DNA, 21 bp, Homo sapiens
actgtgtgctcaggagccctg

SEQ ID NO: 2407274 - DNA, 23 bp, Homo sapiens
actgtttttcagggaggtggctg

SEQ ID NO: 2407275 - DNA, 18 bp, Homo sapiens
acttacatgattcatttt

SEQ ID NO: 2407276 - DNA, 22 bp, Homo sapiens
acttctgccagcataatacttg

SEQ ID NO: 2407277 - DNA, 18 bp, Homo sapiens
acttgaaaattaacatga

SEQ ID NO: 2407278 - DNA, 21 bp, Homo sapiens
acttgctgcagtatgaaaata

SEQ ID NO: 2407279 - DNA, 22 bp, Homo sapiens
acttgctgcagtatgaaaataa

SEQ ID NO: 2407280 - DNA, 19 bp, Homo sapiens
acttgtattatgtgtgttt

SEQ ID NO: 2407281 - DNA, 16 bp, Homo sapiens
acttgtctattacctg

SEQ ID NO: 2407282 - DNA, 15 bp, Homo sapiens
acttgtggactaaaa

SEQ ID NO: 2407283 - DNA, 13 bp, Homo sapiens
acttgttttggat

SEQ ID NO: 2407284 - DNA, 17 bp, Homo sapiens
actttagaatatgcctt

SEQ ID NO: 2407285 - DNA, 18 bp, Homo sapiens
actttgtgcattctggat

SEQ ID NO: 2407286 - DNA, 12 bp, Homo sapiens
acttttatgata

SEQ ID NO: 2407287 - DNA, 18 bp, Homo sapiens
acttttcctttgaatcct

SEQ ID NO: 2407288 - DNA, 14 bp, Homo sapiens
acttttggcatttt

SEQ ID NO: 2407289 - DNA, 15 bp, Homo sapiens
actttttctttatgt

SEQ ID NO: 2407290 - DNA, 17 bp, Homo sapiens
agaaaataatcattctt

SEQ ID NO: 2407291 - DNA, 19 bp, Homo sapiens
agaaacatttatattgata

SEQ ID NO: 2407292 - DNA, 13 bp, Homo sapiens
agaaaccctgcac

SEQ ID NO: 2407293 - DNA, 21 bp, Homo sapiens
agaaagcatttgaatgcattt

SEQ ID NO: 2407294 - DNA, 22 bp, Homo sapiens
agaaagcatttgaatgcatttt

SEQ ID NO: 2407295 - DNA, 19 bp, Homo sapiens
agaaagtcttatttattca

SEQ ID NO: 2407296 - DNA, 21 bp, Homo sapiens
agaaatacagattttgatagc

SEQ ID NO: 2407297 - DNA, 23 bp, Homo sapiens
agaaatactactgtgtaagggcc

SEQ ID NO: 2407298 - DNA, 15 bp, Homo sapiens
agaaatctaaaaaac

SEQ ID NO: 2407299 - DNA, 12 bp, Homo sapiens
agaaattatgtg

SEQ ID NO: 2407300 - DNA, 13 bp, Homo sapiens
agaaattatgtgc

SEQ ID NO: 2407301 - DNA, 22 bp, Homo sapiens
agaaattatgtgccagatttat

SEQ ID NO: 2407302 - DNA, 17 bp, Homo sapiens
agaaatttataaacttt

SEQ ID NO: 2407303 - DNA, 13 bp, Homo sapiens
agaacatccctcc

SEQ ID NO: 2407304 - DNA, 17 bp, Homo sapiens
agaactagccaaaccag

SEQ ID NO: 2407305 - DNA, 21 bp, Homo sapiens
agaactagccaaaccaggacc

SEQ ID NO: 2407306 - DNA, 21 bp, Homo sapiens
agaactcatgacggaagagtt

SEQ ID NO: 2407307 - DNA, 18 bp, Homo sapiens
agaagatgaatgagcaaa

SEQ ID NO: 2407308 - DNA, 22 bp, Homo sapiens
agaagttggggacacatgtatt

SEQ ID NO: 2407309 - DNA, 12 bp, Homo sapiens
agaataaaattt

SEQ ID NO: 2407310 - DNA, 17 bp, Homo sapiens
agaataaaatttttaat

SEQ ID NO: 2407311 - DNA, 12 bp, Homo sapiens
agaatatgcctt

SEQ ID NO: 2407312 - DNA, 19 bp, Homo sapiens
agacaacaggtaaaacagg

SEQ ID NO: 2407313 - DNA, 20 bp, Homo sapiens
agacagaatctcagtctgtc

SEQ ID NO: 2407314 - DNA, 22 bp, Homo sapiens
agacagagccccaccctcagat

SEQ ID NO: 2407315 - DNA, 24 bp, Homo sapiens
agacagagccccaccctcagatgc

SEQ ID NO: 2407316 - DNA, 20 bp, Homo sapiens
agacagagtcttactctgtt

SEQ ID NO: 2407317 - DNA, 23 bp, Homo sapiens
agacagcttctcatcctgcaggc

SEQ ID NO: 2407318 - DNA, 13 bp, Homo sapiens
agaccaagcttgt

SEQ ID NO: 2407319 - DNA, 13 bp, Homo sapiens
agaccaccaagcc

SEQ ID NO: 2407320 - DNA, 14 bp, Homo sapiens
agaccaccaagcct

SEQ ID NO: 2407321 - DNA, 21 bp, Homo sapiens
agactggatagtccgtctctg

SEQ ID NO: 2407322 - DNA, 15 bp, Homo sapiens
agacttttatgatac

SEQ ID NO: 2407323 - DNA, 16 bp, Homo sapiens
agagacagcccaggat

SEQ ID NO: 2407324 - DNA, 16 bp, Homo sapiens
agagaccttccagaaa

SEQ ID NO: 2407325 - DNA, 16 bp, Homo sapiens
agagagtggctggggc

SEQ ID NO: 2407326 - DNA, 17 bp, Homo sapiens
agagagtggctggggca

SEQ ID NO: 2407327 - DNA, 18 bp, Homo sapiens
agagcaggtgctggctct

SEQ ID NO: 2407328 - DNA, 13 bp, Homo sapiens
agagctcaggatg

SEQ ID NO: 2407329 - DNA, 13 bp, Homo sapiens
agagggaatgtga

SEQ ID NO: 2407330 - DNA, 16 bp, Homo sapiens
agagggaatgtgaaat

SEQ ID NO: 2407331 - DNA, 18 bp, Homo sapiens
agagtaatccaagcaaat

SEQ ID NO: 2407332 - DNA, 21 bp, Homo sapiens
agagtgctgtccggtggagat

SEQ ID NO: 2407333 - DNA, 12 bp, Homo sapiens
agagttgaacct

SEQ ID NO: 2407334 - DNA, 13 bp, Homo sapiens
agagttgaaccta

SEQ ID NO: 2407335 - DNA, 15 bp, Homo sapiens
agatataagtgctgt

SEQ ID NO: 2407336 - DNA, 17 bp, Homo sapiens
agatatgggacattttt

SEQ ID NO: 2407337 - DNA, 19 bp, Homo sapiens
agatatttttcatgatttt

SEQ ID NO: 2407338 - DNA, 12 bp, Homo sapiens
agatcctcctca

SEQ ID NO: 2407339 - DNA, 15 bp, Homo sapiens
agatccttccttttg

SEQ ID NO: 2407340 - DNA, 13 bp, Homo sapiens
agatgcacatgag

SEQ ID NO: 2407341 - DNA, 16 bp, Homo sapiens
agatgcacatgagctg

SEQ ID NO: 2407342 - DNA, 20 bp, Homo sapiens
agatgctgatggagccttcc

SEQ ID NO: 2407343 - DNA, 19 bp, Homo sapiens
agatggggtctgtaaaatc

SEQ ID NO: 2407344 - DNA, 15 bp, Homo sapiens
agatgtgttcacaat

SEQ ID NO: 2407345 - DNA, 17 bp, Homo sapiens
agatgttctctatcatt

SEQ ID NO: 2407346 - DNA, 13 bp, Homo sapiens
agattgagagaat

SEQ ID NO: 2407347 - DNA, 18 bp, Homo sapiens
agatttccatataaatat

SEQ ID NO: 2407348 - DNA, 17 bp, Homo sapiens
agatttttcatgatttt

SEQ ID NO: 2407349 - DNA, 20 bp, Homo sapiens
agcaaagatatctcatctct

SEQ ID NO: 2407350 - DNA, 17 bp, Homo sapiens
agcaagaccccatctca

SEQ ID NO: 2407351 - DNA, 21 bp, Homo sapiens
agcactttagaatatgccttg

SEQ ID NO: 2407352 - DNA, 20 bp, Homo sapiens
agcaggaagctgtgagagca

SEQ ID NO: 2407353 - DNA, 23 bp, Homo sapiens
agcagtttggtttctagcatgaa

SEQ ID NO: 2407354 - DNA, 15 bp, Homo sapiens
agcatatctgccttt

SEQ ID NO: 2407355 - DNA, 17 bp, Homo sapiens
agcatatctgcctttat

SEQ ID NO: 2407356 - DNA, 22 bp, Homo sapiens
agcatatctgcctttattgtgt

SEQ ID NO: 2407357 - DNA, 20 bp, Homo sapiens
agcatcacatgaacttgtaa

SEQ ID NO: 2407358 - DNA, 21 bp, Homo sapiens
agcatcaggcctagaggcctg

SEQ ID NO: 2407359 - DNA, 12 bp, Homo sapiens
agcatgaagaca

SEQ ID NO: 2407360 - DNA, 12 bp, Homo sapiens
agcatttgaatg

SEQ ID NO: 2407361 - DNA, 14 bp, Homo sapiens
agcatttgaatgca

SEQ ID NO: 2407362 - DNA, 16 bp, Homo sapiens
agcatttgaatgcatt

SEQ ID NO: 2407363 - DNA, 15 bp, Homo sapiens
agccaattatgttaa

SEQ ID NO: 2407364 - DNA, 16 bp, Homo sapiens
agccaattatgttaaa

SEQ ID NO: 2407365 - DNA, 16 bp, Homo sapiens
agccagctctgcatta

SEQ ID NO: 2407366 - DNA, 13 bp, Homo sapiens
agccagctgcccc

SEQ ID NO: 2407367 - DNA, 14 bp, Homo sapiens
agccagctgccccc

SEQ ID NO: 2407368 - DNA, 20 bp, Homo sapiens
agccagctgcccccagagcc

SEQ ID NO: 2407369 - DNA, 14 bp, Homo sapiens
agccaggagctggg

SEQ ID NO: 2407370 - DNA, 14 bp, Homo sapiens
agccatcaccttag

SEQ ID NO: 2407371 - DNA, 17 bp, Homo sapiens
agccccatcagctccag

SEQ ID NO: 2407372 - DNA, 14 bp, Homo sapiens
agcccctgggccca

SEQ ID NO: 2407373 - DNA, 23 bp, Homo sapiens
agccctccgccattctcaagccc

SEQ ID NO: 2407374 - DNA, 12 bp, Homo sapiens
agccctgcacca

SEQ ID NO: 2407375 - DNA, 20 bp, Homo sapiens
agccctgcaccatgctgctg

SEQ ID NO: 2407376 - DNA, 22 bp, Homo sapiens
agccctgcaccatgctgctggg

SEQ ID NO: 2407377 - DNA, 18 bp, Homo sapiens
agccctgggaggctctgg

SEQ ID NO: 2407378 - DNA, 14 bp, Homo sapiens
attttctataattt

SEQ ID NO: 2407379 - DNA, 17 bp, Homo sapiens
attttctataatttaaa

SEQ ID NO: 2407380 - DNA, 18 bp, Homo sapiens
attttctataatttaaat

SEQ ID NO: 2407381 - DNA, 22 bp, Homo sapiens
attttgagaaagtcttatttat

SEQ ID NO: 2407382 - DNA, 19 bp, Homo sapiens
attttgccaagggcataaa

SEQ ID NO: 2407383 - DNA, 17 bp, Homo sapiens
attttgtaactttctct

SEQ ID NO: 2407384 - DNA, 15 bp, Homo sapiens
atttttcacttcaaa

SEQ ID NO: 2407385 - DNA, 23 bp, Homo sapiens
atttttttagaaagcatttgaat

SEQ ID NO: 2407386 - DNA, 15 bp, Homo sapiens
atttttttctgaatt

SEQ ID NO: 2407387 - DNA, 14 bp, Homo sapiens
attttttttaacat

SEQ ID NO: 2407388 - DNA, 21 bp, Homo sapiens
caaaaggataatgaatacttt

SEQ ID NO: 2407389 - DNA, 18 bp, Homo sapiens
caaaagtttcatcctttt

SEQ ID NO: 2407390 - DNA, 16 bp, Homo sapiens
caaaattgttacaaat

SEQ ID NO: 2407391 - DNA, 13 bp, Homo sapiens
caaacccagtgtt

SEQ ID NO: 2407392 - DNA, 19 bp, Homo sapiens
caaactcctgacctcaggc

SEQ ID NO: 2407393 - DNA, 21 bp, Homo sapiens
caaaggctttgccctgctgcc

SEQ ID NO: 2407394 - DNA, 22 bp, Homo sapiens
caaagggggaggctaaagccca

SEQ ID NO: 2407395 - DNA, 13 bp, Homo sapiens
caaatattccaga

SEQ ID NO: 2407396 - DNA, 18 bp, Homo sapiens
caaattctgtctctggat

SEQ ID NO: 2407397 - DNA, 17 bp, Homo sapiens
caacaggtaaaacaggg

SEQ ID NO: 2407398 - DNA, 23 bp, Homo sapiens
caacaggtaaaacagggccacat

SEQ ID NO: 2407399 - DNA, 14 bp, Homo sapiens
caaccacacccaca

SEQ ID NO: 2407400 - DNA, 16 bp, Homo sapiens
caacccgaggcccgca

SEQ ID NO: 2407401 - DNA, 20 bp, Homo sapiens
caacctccacctcctgggtt

SEQ ID NO: 2407402 - DNA, 13 bp, Homo sapiens
caacgtgcattgt

SEQ ID NO: 2407403 - DNA, 17 bp, Homo sapiens
caacgtggcccagagaa

SEQ ID NO: 2407404 - DNA, 21 bp, Homo sapiens
caactacctgagctaaataaa

SEQ ID NO: 2407405 - DNA, 13 bp, Homo sapiens
caactatggcctg

SEQ ID NO: 2407406 - DNA, 16 bp, Homo sapiens
caactctcttattgcc

SEQ ID NO: 2407407 - DNA, 14 bp, Homo sapiens
caacttactactga

SEQ ID NO: 2407408 - DNA, 11 bp, Homo sapiens
caactttgtat

SEQ ID NO: 2407409 - DNA, 20 bp, Homo sapiens
caacttttcctttgaatcct

SEQ ID NO: 2407410 - DNA, 22 bp, Homo sapiens
caagattgttcctgcttttccc

SEQ ID NO: 2407411 - DNA, 18 bp, Homo sapiens
caagcctaagggatcctg

SEQ ID NO: 2407412 - DNA, 15 bp, Homo sapiens
caagcgattctcttg

SEQ ID NO: 2407413 - DNA, 17 bp, Homo sapiens
caagcttgtccaacccg

SEQ ID NO: 2407414 - DNA, 20 bp, Homo sapiens
caaggaaaaaataacaatga

SEQ ID NO: 2407415 - DNA, 22 bp, Homo sapiens
caagggcagggggcccctttgc

SEQ ID NO: 2407416 - DNA, 21 bp, Homo sapiens
caagtataatattaataatac

SEQ ID NO: 2407417 - DNA, 18 bp, Homo sapiens
caagttgtgcttgagcca

SEQ ID NO: 2407418 - DNA, 13 bp, Homo sapiens
caataaagcaatg

SEQ ID NO: 2407419 - DNA, 20 bp, Homo sapiens
caataaagtatttaattagt

SEQ ID NO: 2407420 - DNA, 16 bp, Homo sapiens
caataaatagaccatt

SEQ ID NO: 2407421 - DNA, 13 bp, Homo sapiens
caataattttcta

SEQ ID NO: 2407422 - DNA, 14 bp, Homo sapiens
caataattttctac

SEQ ID NO: 2407423 - DNA, 14 bp, Homo sapiens
caatatcagacttt

SEQ ID NO: 2407424 - DNA, 13 bp, Homo sapiens
caatgttcatcat

SEQ ID NO: 2407425 - DNA, 15 bp, Homo sapiens
caattaattccttca

SEQ ID NO: 2407426 - DNA, 18 bp, Homo sapiens
caattaattccttcagca

SEQ ID NO: 2407427 - DNA, 13 bp, Homo sapiens
caattatgttaaa

SEQ ID NO: 2407428 - DNA, 21 bp, Homo sapiens
caattgggagctgccaagagt

SEQ ID NO: 2407429 - DNA, 20 bp, Homo sapiens
caatttctacaaaatcctga

SEQ ID NO: 2407430 - DNA, 15 bp, Homo sapiens
cacaaattatcttaa

SEQ ID NO: 2407431 - DNA, 17 bp, Homo sapiens
cacaacgtgcattgtgc

SEQ ID NO: 2407432 - DNA, 22 bp, Homo sapiens
cacaatgcagtgcctttcttct

SEQ ID NO: 2407433 - DNA, 18 bp, Homo sapiens
cacacaatgtgtctgaga

SEQ ID NO: 2407434 - DNA, 22 bp, Homo sapiens
cacaccaggcttgcctgcaggc

SEQ ID NO: 2407435 - DNA, 14 bp, Homo sapiens
cacagcccttttgt

SEQ ID NO: 2407436 - DNA, 18 bp, Homo sapiens
cacagcttcagccaggag

SEQ ID NO: 2407437 - DNA, 14 bp, Homo sapiens
cacagtgggagcca

SEQ ID NO: 2407438 - DNA, 19 bp, Homo sapiens
cacatcgcagattctccct

SEQ ID NO: 2407439 - DNA, 16 bp, Homo sapiens
cacatgattccagcca

SEQ ID NO: 2407440 - DNA, 18 bp, Homo sapiens
cacatgggtgaacactca

SEQ ID NO: 2407441 - DNA, 13 bp, Homo sapiens
cacatgtcttaat

SEQ ID NO: 2407442 - DNA, 14 bp, Homo sapiens
cacatgtcttaatg

SEQ ID NO: 2407443 - DNA, 12 bp, Homo sapiens
cacatgtgtggt

SEQ ID NO: 2407444 - DNA, 18 bp, Homo sapiens
cacattggagatgtttag

SEQ ID NO: 2407445 - DNA, 13 bp, Homo sapiens
caccaagccttga

SEQ ID NO: 2407446 - DNA, 21 bp, Homo sapiens
caccagtgtgtggctttcaga

SEQ ID NO: 2407447 - DNA, 20 bp, Homo sapiens
caccctcagatgcacatgag

SEQ ID NO: 2407448 - DNA, 21 bp, Homo sapiens
caccctggattgatcggagcc

SEQ ID NO: 2407449 - DNA, 19 bp, Homo sapiens
cacctatgtcatttcattt

SEQ ID NO: 2407450 - DNA, 22 bp, Homo sapiens
cacctcctgggttcaagcgatt

SEQ ID NO: 2407451 - DNA, 19 bp, Homo sapiens
cacctcgcaggttcaagca

SEQ ID NO: 2407452 - DNA, 20 bp, Homo sapiens
cacctgggattacaagcatg

SEQ ID NO: 2407453 - DNA, 20 bp, Homo sapiens
caccttagaccaccaagcct

SEQ ID NO: 2407454 - DNA, 13 bp, Homo sapiens
caccttgcagctc

SEQ ID NO: 2407455 - DNA, 22 bp, Homo sapiens
caccttgcagctctccccttct

SEQ ID NO: 2407456 - DNA, 17 bp, Homo sapiens
cactctgttcattcctc

SEQ ID NO: 2407457 - DNA, 19 bp, Homo sapiens
cactctgttcattcctcca

SEQ ID NO: 2407458 - DNA, 20 bp, Homo sapiens
cactctgttcattcctccag

SEQ ID NO: 2407459 - DNA, 13 bp, Homo sapiens
cactgcaacctcc

SEQ ID NO: 2407460 - DNA, 17 bp, Homo sapiens
cactgcttgaactaggc

SEQ ID NO: 2407461 - DNA, 20 bp, Homo sapiens
cactgcttgaactaggctga

SEQ ID NO: 2407462 - DNA, 18 bp, Homo sapiens
cactgggagaaatgaaaa

SEQ ID NO: 2407463 - DNA, 19 bp, Homo sapiens
cactgggagaaatgaaaaa

SEQ ID NO: 2407464 - DNA, 18 bp, Homo sapiens
cactgtacttgctcttga

SEQ ID NO: 2407465 - DNA, 19 bp, Homo sapiens
cactgtacttgctcttgat

SEQ ID NO: 2407466 - DNA, 15 bp, Homo sapiens
cactgtatgagtgga

SEQ ID NO: 2407467 - DNA, 19 bp, Homo sapiens
cacttcaggtatacctcac

SEQ ID NO: 2407468 - DNA, 18 bp, Homo sapiens
cacttgtcattgttatat

SEQ ID NO: 2407469 - DNA, 21 bp, Homo sapiens
cactttgaactactagaaaat

SEQ ID NO: 2407470 - DNA, 20 bp, Homo sapiens
cagaaatacagattttgata

SEQ ID NO: 2407471 - DNA, 18 bp, Homo sapiens
cagactctaagaaagaac

SEQ ID NO: 2407472 - DNA, 22 bp, Homo sapiens
cagagacaacaggtaaaacagg

SEQ ID NO: 2407473 - DNA, 17 bp, Homo sapiens
cagagcaagaccccatc

SEQ ID NO: 2407474 - DNA, 12 bp, Homo sapiens
cagagccacagt

SEQ ID NO: 2407475 - DNA, 13 bp, Homo sapiens
cagagcgcacagg

SEQ ID NO: 2407476 - DNA, 20 bp, Homo sapiens
cagagctacccgcagagttc

SEQ ID NO: 2407477 - DNA, 22 bp, Homo sapiens
cagaggtagtctcactgcttga

SEQ ID NO: 2407478 - DNA, 21 bp, Homo sapiens
cagagtaatccaagcaaatgt

SEQ ID NO: 2407479 - DNA, 13 bp, Homo sapiens
cagatcctcctca

SEQ ID NO: 2407480 - DNA, 14 bp, Homo sapiens
cagatcctcctcat

SEQ ID NO: 2407481 - DNA, 22 bp, Homo sapiens
cagatggcatgtgtttacttta

SEQ ID NO: 2407482 - DNA, 13 bp, Homo sapiens
cagatttatgcat

SEQ ID NO: 2407483 - DNA, 16 bp, Homo sapiens
cagattttgatagcaa

SEQ ID NO: 2407484 - DNA, 14 bp, Homo sapiens
cagcaggctggcct

SEQ ID NO: 2407485 - DNA, 13 bp, Homo sapiens
cagcataatactt

SEQ ID NO: 2407486 - DNA, 16 bp, Homo sapiens
cagccagaccagcagg

SEQ ID NO: 2407487 - DNA, 11 bp, Homo sapiens
cagccaggagc

SEQ ID NO: 2407488 - DNA, 12 bp, Homo sapiens
cagccaggagct

SEQ ID NO: 2407489 - DNA, 16 bp, Homo sapiens
cagccaggagctgggc

SEQ ID NO: 2407490 - DNA, 22 bp, Homo sapiens
cagccaggagctgggcagaagg

SEQ ID NO: 2407491 - DNA, 19 bp, Homo sapiens
cagccatcaccttagacca

SEQ ID NO: 2407492 - DNA, 20 bp, Homo sapiens
cagcccaggatactggcaca

SEQ ID NO: 2407493 - DNA, 17 bp, Homo sapiens
cagccctgcaccatgct

SEQ ID NO: 2407494 - DNA, 17 bp, Homo sapiens
cagctgagagaaaataa

SEQ ID NO: 2407495 - DNA, 16 bp, Homo sapiens
cagctgcccccagagc

SEQ ID NO: 2407496 - DNA, 17 bp, Homo sapiens
cagctgcccccagagcc

SEQ ID NO: 2407497 - DNA, 21 bp, Homo sapiens
cagctgcccccagagccacag

SEQ ID NO: 2407498 - DNA, 22 bp, Homo sapiens
cagctgcccccagagccacagt

SEQ ID NO: 2407499 - DNA, 21 bp, Homo sapiens
cagctggggccaggctgggtc

SEQ ID NO: 2407500 - DNA, 19 bp, Homo sapiens
cagcttctcatcctgcagg

SEQ ID NO: 2407501 - DNA, 20 bp, Homo sapiens
cagcttctcatcctgcaggc

SEQ ID NO: 2407502 - DNA, 22 bp, Homo sapiens
caggaacaaacagggctgcctt

SEQ ID NO: 2407503 - DNA, 22 bp, Homo sapiens
caggaagctgtgagagcagttt

SEQ ID NO: 2407504 - DNA, 19 bp, Homo sapiens
caggagagagttgaaccta

SEQ ID NO: 2407505 - DNA, 15 bp, Homo sapiens
caggatactggcaca

SEQ ID NO: 2407506 - DNA, 20 bp, Homo sapiens
caggcaggtctgaagctcaa

SEQ ID NO: 2407507 - DNA, 17 bp, Homo sapiens
caggctgctcagggctg

SEQ ID NO: 2407508 - DNA, 16 bp, Homo sapiens
ctcatgaatgtaaatt

SEQ ID NO: 2407509 - DNA, 21 bp, Homo sapiens
ctcatgaatgtaaatttgtac

SEQ ID NO: 2407510 - DNA, 22 bp, Homo sapiens
ctcatgaatgtaaatttgtact

SEQ ID NO: 2407511 - DNA, 16 bp, Homo sapiens
ctccatcctaccacaa

SEQ ID NO: 2407512 - DNA, 21 bp, Homo sapiens
ctcccaaagtgctgggattaa

SEQ ID NO: 2407513 - DNA, 17 bp, Homo sapiens
ctcccctgcactgtaaa

SEQ ID NO: 2407514 - DNA, 18 bp, Homo sapiens
ctcccctgcactgtaaaa

SEQ ID NO: 2407515 - DNA, 22 bp, Homo sapiens
ctcccctggaactgtctctcat

SEQ ID NO: 2407516 - DNA, 11 bp, Homo sapiens
ctcctcaggga

SEQ ID NO: 2407517 - DNA, 15 bp, Homo sapiens
ctcctcctttttcct

SEQ ID NO: 2407518 - DNA, 19 bp, Homo sapiens
ctcctgaggatgtgtccca

SEQ ID NO: 2407519 - DNA, 21 bp, Homo sapiens
ctccttgattttagccttctc

SEQ ID NO: 2407520 - DNA, 14 bp, Homo sapiens
ctcctttctggctt

SEQ ID NO: 2407521 - DNA, 16 bp, Homo sapiens
ctcgtaagatttcctt

SEQ ID NO: 2407522 - DNA, 15 bp, Homo sapiens
ctctacactcttgta

SEQ ID NO: 2407523 - DNA, 14 bp, Homo sapiens
ctctatcatttaat

SEQ ID NO: 2407524 - DNA, 15 bp, Homo sapiens
ctctatcatttaata

SEQ ID NO: 2407525 - DNA, 20 bp, Homo sapiens
ctctatgaactctgttttct

SEQ ID NO: 2407526 - DNA, 13 bp, Homo sapiens
ctctcatgaacct

SEQ ID NO: 2407527 - DNA, 23 bp, Homo sapiens
ctctccaggcaggtctgaagctc

SEQ ID NO: 2407528 - DNA, 14 bp, Homo sapiens
ctctctgcaggtcc

SEQ ID NO: 2407529 - DNA, 17 bp, Homo sapiens
ctctctgcaggtcccta

SEQ ID NO: 2407530 - DNA, 20 bp, Homo sapiens
ctctctggaagcccctgggc

SEQ ID NO: 2407531 - DNA, 16 bp, Homo sapiens
ctctgcaaactgcctt

SEQ ID NO: 2407532 - DNA, 20 bp, Homo sapiens
ctctgcaaactgccttcttc

SEQ ID NO: 2407533 - DNA, 20 bp, Homo sapiens
ctctgcacaccctccagaga

SEQ ID NO: 2407534 - DNA, 22 bp, Homo sapiens
ctctgcacaccctccagagaca

SEQ ID NO: 2407535 - DNA, 14 bp, Homo sapiens
ctctgcaggtccct

SEQ ID NO: 2407536 - DNA, 17 bp, Homo sapiens
ctctgcaggtccctaat

SEQ ID NO: 2407537 - DNA, 19 bp, Homo sapiens
ctctgcaggtccctaataa

SEQ ID NO: 2407538 - DNA, 20 bp, Homo sapiens
ctctgcaggtccctaataaa

SEQ ID NO: 2407539 - DNA, 21 bp, Homo sapiens
ctctgcaggtccctaataaag

SEQ ID NO: 2407540 - DNA, 19 bp, Homo sapiens
ctctggagcccactgtact

SEQ ID NO: 2407541 - DNA, 15 bp, Homo sapiens
ctctggtaacctctt

SEQ ID NO: 2407542 - DNA, 22 bp, Homo sapiens
ctctgtatttgaatcagcctac

SEQ ID NO: 2407543 - DNA, 20 bp, Homo sapiens
ctctgtctacctggtctggt

SEQ ID NO: 2407544 - DNA, 23 bp, Homo sapiens
ctctgtcttctttgcccacaatg

SEQ ID NO: 2407545 - DNA, 17 bp, Homo sapiens
ctctgtgagggtgctga

SEQ ID NO: 2407546 - DNA, 14 bp, Homo sapiens
ctctgttcatttcc

SEQ ID NO: 2407547 - DNA, 20 bp, Homo sapiens
ctcttattgcctcacttcag

SEQ ID NO: 2407548 - DNA, 16 bp, Homo sapiens
ctcttgatgcctggcg

SEQ ID NO: 2407549 - DNA, 21 bp, Homo sapiens
ctcttgatgcctggcggggtg

SEQ ID NO: 2407550 - DNA, 18 bp, Homo sapiens
ctctttagagttagactg

SEQ ID NO: 2407551 - DNA, 19 bp, Homo sapiens
ctgaaactcatagacactg

SEQ ID NO: 2407552 - DNA, 15 bp, Homo sapiens
ctgaaagacaatata

SEQ ID NO: 2407553 - DNA, 17 bp, Homo sapiens
ctgaagaactctctgga

SEQ ID NO: 2407554 - DNA, 21 bp, Homo sapiens
ctgacacatgctgaacatcac

SEQ ID NO: 2407555 - DNA, 23 bp, Homo sapiens
ctgacatgaagctgttgtgtgag

SEQ ID NO: 2407556 - DNA, 22 bp, Homo sapiens
ctgaccctccccaaaggctttg

SEQ ID NO: 2407557 - DNA, 18 bp, Homo sapiens
ctgactattcttgatgta

SEQ ID NO: 2407558 - DNA, 20 bp, Homo sapiens
ctgactattcttgatgtaaa

SEQ ID NO: 2407559 - DNA, 13 bp, Homo sapiens
ctgagaagctctg

SEQ ID NO: 2407560 - DNA, 16 bp, Homo sapiens
ctgagaagctctgaag

SEQ ID NO: 2407561 - DNA, 17 bp, Homo sapiens
ctgaggatcagagtaat

SEQ ID NO: 2407562 - DNA, 17 bp, Homo sapiens
ctgaggcctagactctg

SEQ ID NO: 2407563 - DNA, 14 bp, Homo sapiens
ctgagtagaaaggc

SEQ ID NO: 2407564 - DNA, 19 bp, Homo sapiens
ctgagtagaaaggccttta

SEQ ID NO: 2407565 - DNA, 20 bp, Homo sapiens
ctgagtagaaaggcctttaa

SEQ ID NO: 2407566 - DNA, 16 bp, Homo sapiens
ctgagttcctgcatgc

SEQ ID NO: 2407567 - DNA, 14 bp, Homo sapiens
ctgatgaaaataaa

SEQ ID NO: 2407568 - DNA, 17 bp, Homo sapiens
ctgatgaaaataaagaa

SEQ ID NO: 2407569 - DNA, 15 bp, Homo sapiens
ctgatggagccttcc

SEQ ID NO: 2407570 - DNA, 13 bp, Homo sapiens
ctgcaacctccac

SEQ ID NO: 2407571 - DNA, 17 bp, Homo sapiens
ctgcaacctccacctcc

SEQ ID NO: 2407572 - DNA, 20 bp, Homo sapiens
ctgcacaccctccagagaca

SEQ ID NO: 2407573 - DNA, 13 bp, Homo sapiens
ctgcactgtaaaa

SEQ ID NO: 2407574 - DNA, 15 bp, Homo sapiens
ctgcactgtaaaatg

SEQ ID NO: 2407575 - DNA, 22 bp, Homo sapiens
ctgcaggcaggaacaaacaggg

SEQ ID NO: 2407576 - DNA, 16 bp, Homo sapiens
ctgcagtatgaaaata

SEQ ID NO: 2407577 - DNA, 14 bp, Homo sapiens
ctgcagtcacagct

SEQ ID NO: 2407578 - DNA, 16 bp, Homo sapiens
ctgcagttttgctatc

SEQ ID NO: 2407579 - DNA, 20 bp, Homo sapiens
ctgcatctagaggcttcctt

SEQ ID NO: 2407580 - DNA, 13 bp, Homo sapiens
ctgccaagccatg

SEQ ID NO: 2407581 - DNA, 19 bp, Homo sapiens
ctgcccccagagccacagt

SEQ ID NO: 2407582 - DNA, 20 bp, Homo sapiens
ctgcccccagagccacagtt

SEQ ID NO: 2407583 - DNA, 13 bp, Homo sapiens
ctgcctattttaa

SEQ ID NO: 2407584 - DNA, 18 bp, Homo sapiens
ctgcctctctgcaggtcc

SEQ ID NO: 2407585 - DNA, 19 bp, Homo sapiens
ctgcctcttaaataaacct

SEQ ID NO: 2407586 - DNA, 18 bp, Homo sapiens
ctgccttctggccttgta

SEQ ID NO: 2407587 - DNA, 14 bp, Homo sapiens
ctgctggggaagac

SEQ ID NO: 2407588 - DNA, 18 bp, Homo sapiens
ctgctggggaagacagtg

SEQ ID NO: 2407589 - DNA, 17 bp, Homo sapiens
ctgctttttatggcctg

SEQ ID NO: 2407590 - DNA, 18 bp, Homo sapiens
ctgctttttatggcctgt

SEQ ID NO: 2407591 - DNA, 11 bp, Homo sapiens
ctggaaagaag

SEQ ID NO: 2407592 - DNA, 23 bp, Homo sapiens
ctggaataatcctaaacatatga

SEQ ID NO: 2407593 - DNA, 15 bp, Homo sapiens
ctggaccctgttgct

SEQ ID NO: 2407594 - DNA, 13 bp, Homo sapiens
ctggactgtgtgc

SEQ ID NO: 2407595 - DNA, 19 bp, Homo sapiens
ctggactgtgtgctcagga

SEQ ID NO: 2407596 - DNA, 19 bp, Homo sapiens
ctggatagtccgtctctgc

SEQ ID NO: 2407597 - DNA, 13 bp, Homo sapiens
ctggatgaaaatg

SEQ ID NO: 2407598 - DNA, 19 bp, Homo sapiens
ctggcagtggaactaagaa

SEQ ID NO: 2407599 - DNA, 16 bp, Homo sapiens
ctgggagaaatgaaaa

SEQ ID NO: 2407600 - DNA, 17 bp, Homo sapiens
ctgggaggctctggagc

SEQ ID NO: 2407601 - DNA, 18 bp, Homo sapiens
ctgggaggctctggagcc

SEQ ID NO: 2407602 - DNA, 20 bp, Homo sapiens
ctgggaggctctggagccca

SEQ ID NO: 2407603 - DNA, 13 bp, Homo sapiens
ctgggcagaaggc

SEQ ID NO: 2407604 - DNA, 19 bp, Homo sapiens
ctgggcccctgcctctctg

SEQ ID NO: 2407605 - DNA, 20 bp, Homo sapiens
ctgggcccctgcctctctgc

SEQ ID NO: 2407606 - DNA, 23 bp, Homo sapiens
ctgggcccctgcctctctgcagg

SEQ ID NO: 2407607 - DNA, 15 bp, Homo sapiens
ctgggctgtgggcaa

SEQ ID NO: 2407608 - DNA, 15 bp, Homo sapiens
ctggggaagacagtg

SEQ ID NO: 2407609 - DNA, 17 bp, Homo sapiens
ctggggaagacagtggc

SEQ ID NO: 2407610 - DNA, 13 bp, Homo sapiens
ctggggacttgtg

SEQ ID NO: 2407611 - DNA, 18 bp, Homo sapiens
ctggggacttgtgtctgc

SEQ ID NO: 2407612 - DNA, 17 bp, Homo sapiens
ctggggcatggaaggca

SEQ ID NO: 2407613 - DNA, 13 bp, Homo sapiens
ctgggtcgccctg

SEQ ID NO: 2407614 - DNA, 22 bp, Homo sapiens
ctgggtcgccctggactgtgtg

SEQ ID NO: 2407615 - DNA, 14 bp, Homo sapiens
ctggtctctccttg

SEQ ID NO: 2407616 - DNA, 21 bp, Homo sapiens
ctggtctggttgggcagccag

SEQ ID NO: 2407617 - DNA, 13 bp, Homo sapiens
ctggttgggcagc

SEQ ID NO: 2407618 - DNA, 11 bp, Homo sapiens
ctgtaaaatct

SEQ ID NO: 2407619 - DNA, 22 bp, Homo sapiens
ctgtaataaactcatttctagc

SEQ ID NO: 2407620 - DNA, 17 bp, Homo sapiens
ctgtaatgttaatattg

SEQ ID NO: 2407621 - DNA, 13 bp, Homo sapiens
ctgtacactgcac

SEQ ID NO: 2407622 - DNA, 15 bp, Homo sapiens
ctgtacactgcacga

SEQ ID NO: 2407623 - DNA, 16 bp, Homo sapiens
ctgtacttgctcttga

SEQ ID NO: 2407624 - DNA, 13 bp, Homo sapiens
ctgtagaaatggt

SEQ ID NO: 2407625 - DNA, 11 bp, Homo sapiens
ctgtataaaat

SEQ ID NO: 2407626 - DNA, 18 bp, Homo sapiens
ctgtatttgaatcagcct

SEQ ID NO: 2407627 - DNA, 14 bp, Homo sapiens
ctgtctacctggtc

SEQ ID NO: 2407628 - DNA, 13 bp, Homo sapiens
ctgtctattctag

SEQ ID NO: 2407629 - DNA, 17 bp, Homo sapiens
ctgtctcctctctctgt

SEQ ID NO: 2407630 - DNA, 13 bp, Homo sapiens
ctgtctctcatga

SEQ ID NO: 2407631 - DNA, 17 bp, Homo sapiens
ctgtgacctctcccctg

SEQ ID NO: 2407632 - DNA, 22 bp, Homo sapiens
ctgtgcgtgtgtgtgtgtgtat

SEQ ID NO: 2407633 - DNA, 14 bp, Homo sapiens
ctgtgtgctcagga

SEQ ID NO: 2407634 - DNA, 20 bp, Homo sapiens
ctgtgtgctcaggagccctg

SEQ ID NO: 2407635 - DNA, 21 bp, Homo sapiens
ctgtgtgctcaggagccctgg

SEQ ID NO: 2407636 - DNA, 17 bp, Homo sapiens
ctgttataataaatgta

SEQ ID NO: 2407637 - DNA, 20 bp, Homo sapiens
ctgttataataaatgtacct

SEQ ID NO: 2407638 - DNA, 16 bp, Homo sapiens
ggcctgactgccaagc

SEQ ID NO: 2407639 - DNA, 18 bp, Homo sapiens
ggcctgactgccaagcca

SEQ ID NO: 2407640 - DNA, 18 bp, Homo sapiens
ggccttgcggctcctcag

SEQ ID NO: 2407641 - DNA, 17 bp, Homo sapiens
ggcctttccctaagcca

SEQ ID NO: 2407642 - DNA, 18 bp, Homo sapiens
ggcgatcacaacgtgcat

SEQ ID NO: 2407643 - DNA, 17 bp, Homo sapiens
ggcgtgagccacctcgc

SEQ ID NO: 2407644 - DNA, 13 bp, Homo sapiens
ggctctggagccc

SEQ ID NO: 2407645 - DNA, 14 bp, Homo sapiens
ggctctggagccca

SEQ ID NO: 2407646 - DNA, 23 bp, Homo sapiens
ggctctggagcccactgtacttg

SEQ ID NO: 2407647 - DNA, 14 bp, Homo sapiens
ggctgggtcgccct

SEQ ID NO: 2407648 - DNA, 17 bp, Homo sapiens
ggctgggtcgccctgga

SEQ ID NO: 2407649 - DNA, 20 bp, Homo sapiens
ggctgggtcgccctggactg

SEQ ID NO: 2407650 - DNA, 13 bp, Homo sapiens
ggctggtctcaaa

SEQ ID NO: 2407651 - DNA, 13 bp, Homo sapiens
ggcttacacccac

SEQ ID NO: 2407652 - DNA, 14 bp, Homo sapiens
ggcttgcctgcagg

SEQ ID NO: 2407653 - DNA, 15 bp, Homo sapiens
ggctttatcctcttt

SEQ ID NO: 2407654 - DNA, 21 bp, Homo sapiens
ggctttatcctctttagagtt

SEQ ID NO: 2407655 - DNA, 11 bp, Homo sapiens
gggaagacagt

SEQ ID NO: 2407656 - DNA, 22 bp, Homo sapiens
gggaatatgagtgcgtggtgcg

SEQ ID NO: 2407657 - DNA, 13 bp, Homo sapiens
gggactgagaaat

SEQ ID NO: 2407658 - DNA, 12 bp, Homo sapiens
gggagccagggc

SEQ ID NO: 2407659 - DNA, 14 bp, Homo sapiens
gggaggtggctggg

SEQ ID NO: 2407660 - DNA, 20 bp, Homo sapiens
gggattatgggtcacaggaa

SEQ ID NO: 2407661 - DNA, 17 bp, Homo sapiens
gggattgaaggatgctg

SEQ ID NO: 2407662 - DNA, 21 bp, Homo sapiens
gggattttcagccctcagaat

SEQ ID NO: 2407663 - DNA, 20 bp, Homo sapiens
gggcaattaattccttcagc

SEQ ID NO: 2407664 - DNA, 14 bp, Homo sapiens
gggcataaattatt

SEQ ID NO: 2407665 - DNA, 13 bp, Homo sapiens
gggcccctgcctc

SEQ ID NO: 2407666 - DNA, 19 bp, Homo sapiens
gggcccctgcctctctgca

SEQ ID NO: 2407667 - DNA, 18 bp, Homo sapiens
gggcccctttgctgaccc

SEQ ID NO: 2407668 - DNA, 17 bp, Homo sapiens
gggctgccttctggcct

SEQ ID NO: 2407669 - DNA, 17 bp, Homo sapiens
ggggacacatgtatttg

SEQ ID NO: 2407670 - DNA, 19 bp, Homo sapiens
ggggacttacatgattcat

SEQ ID NO: 2407671 - DNA, 14 bp, Homo sapiens
ggggccaggctggg

SEQ ID NO: 2407672 - DNA, 18 bp, Homo sapiens
ggggtgctgggcccctgc

SEQ ID NO: 2407673 - DNA, 20 bp, Homo sapiens
ggggtggggggggtgctggg

SEQ ID NO: 2407674 - DNA, 15 bp, Homo sapiens
gggtcgccctggact

SEQ ID NO: 2407675 - DNA, 14 bp, Homo sapiens
gggtctgtaaaatc

SEQ ID NO: 2407676 - DNA, 17 bp, Homo sapiens
gggtgctgggcccctgc

SEQ ID NO: 2407677 - DNA, 18 bp, Homo sapiens
gggtgctgggcccctgcc

SEQ ID NO: 2407678 - DNA, 18 bp, Homo sapiens
gggtgtaaaacctggaga

SEQ ID NO: 2407679 - DNA, 22 bp, Homo sapiens
gggttttttagttgaatttttt

SEQ ID NO: 2407680 - DNA, 18 bp, Homo sapiens
ggtacatggtgtttgtgg

SEQ ID NO: 2407681 - DNA, 17 bp, Homo sapiens
ggtagaggatgaggaaa

SEQ ID NO: 2407682 - DNA, 20 bp, Homo sapiens
ggtagtctcactgcttgaac

SEQ ID NO: 2407683 - DNA, 12 bp, Homo sapiens
ggtataaaagat

SEQ ID NO: 2407684 - DNA, 14 bp, Homo sapiens
ggtatacctcactt

SEQ ID NO: 2407685 - DNA, 17 bp, Homo sapiens
ggtattcgttatctaat

SEQ ID NO: 2407686 - DNA, 19 bp, Homo sapiens
ggtattgtatttattcaat

SEQ ID NO: 2407687 - DNA, 22 bp, Homo sapiens
ggtattgtatttattcaataaa

SEQ ID NO: 2407688 - DNA, 13 bp, Homo sapiens
ggtccctaataaa

SEQ ID NO: 2407689 - DNA, 15 bp, Homo sapiens
ggtctggttgggcag

SEQ ID NO: 2407690 - DNA, 21 bp, Homo sapiens
ggtgcatatttataaaaataa

SEQ ID NO: 2407691 - DNA, 11 bp, Homo sapiens
ggtgctgggcc

SEQ ID NO: 2407692 - DNA, 20 bp, Homo sapiens
ggtgctgggcccctgcctct

SEQ ID NO: 2407693 - DNA, 22 bp, Homo sapiens
ggttaggagggtttcattgtct

SEQ ID NO: 2407694 - DNA, 19 bp, Homo sapiens
ggtttaatccccagtaaaa

SEQ ID NO: 2407695 - DNA, 22 bp, Homo sapiens
ggtttaatccccagtaaaattg

SEQ ID NO: 2407696 - DNA, 19 bp, Homo sapiens
ggtttcaccatgttggcca

SEQ ID NO: 2407697 - DNA, 12 bp, Homo sapiens
ggtttctagcat

SEQ ID NO: 2407698 - DNA, 12 bp, Homo sapiens
gtaaaatcttgt

SEQ ID NO: 2407699 - DNA, 15 bp, Homo sapiens
gtaaaatcttgtcat

SEQ ID NO: 2407700 - DNA, 19 bp, Homo sapiens
gtaaaatcttgtcatgtgt

SEQ ID NO: 2407701 - DNA, 23 bp, Homo sapiens
gtaaaatcttgtcatgtgtataa

SEQ ID NO: 2407702 - DNA, 21 bp, Homo sapiens
gtaaaatctttctttcttaga

SEQ ID NO: 2407703 - DNA, 23 bp, Homo sapiens
gtaaaatgtgggattatgggtca

SEQ ID NO: 2407704 - DNA, 16 bp, Homo sapiens
gtaaaattgccatatt

SEQ ID NO: 2407705 - DNA, 18 bp, Homo sapiens
gtaaaattgccatattgc

SEQ ID NO: 2407706 - DNA, 19 bp, Homo sapiens
gtaaaattgccatattgca

SEQ ID NO: 2407707 - DNA, 14 bp, Homo sapiens
gtaaagaattattt

SEQ ID NO: 2407708 - DNA, 22 bp, Homo sapiens
gtaaagtatcaggatactatat

SEQ ID NO: 2407709 - DNA, 23 bp, Homo sapiens
gtaagaacaactacctgagctaa

SEQ ID NO: 2407710 - DNA, 13 bp, Homo sapiens
gtaagatttcctt

SEQ ID NO: 2407711 - DNA, 18 bp, Homo sapiens
gtaagatttccttctttt

SEQ ID NO: 2407712 - DNA, 13 bp, Homo sapiens
gtaataaactcat

SEQ ID NO: 2407713 - DNA, 17 bp, Homo sapiens
gtaatgttaatattgat

SEQ ID NO: 2407714 - DNA, 21 bp, Homo sapiens
gtacagttatttatgcctctg

SEQ ID NO: 2407715 - DNA, 23 bp, Homo sapiens
gtaccaagactactagggaaatg

SEQ ID NO: 2407716 - DNA, 14 bp, Homo sapiens
gtactatttaactg

SEQ ID NO: 2407717 - DNA, 15 bp, Homo sapiens
gtactatttaactga

SEQ ID NO: 2407718 - DNA, 18 bp, Homo sapiens
gtactatttaactgacta

SEQ ID NO: 2407719 - DNA, 15 bp, Homo sapiens
gtacttgctcttgat

SEQ ID NO: 2407720 - DNA, 16 bp, Homo sapiens
gtagaaaggcctttaa

SEQ ID NO: 2407721 - DNA, 17 bp, Homo sapiens
gtagaaaggcctttaaa

SEQ ID NO: 2407722 - DNA, 17 bp, Homo sapiens
gtagaaatggttgtatt

SEQ ID NO: 2407723 - DNA, 23 bp, Homo sapiens
gtagacgtgcacgcacactgtct

SEQ ID NO: 2407724 - DNA, 20 bp, Homo sapiens
gtaggagactgtttggaaat

SEQ ID NO: 2407725 - DNA, 13 bp, Homo sapiens
gtagtatgatggg

SEQ ID NO: 2407726 - DNA, 12 bp, Homo sapiens
gtataaaagatg

SEQ ID NO: 2407727 - DNA, 17 bp, Homo sapiens
gtataaaagcctgttta

SEQ ID NO: 2407728 - DNA, 15 bp, Homo sapiens
gtataaaatcagcca

SEQ ID NO: 2407729 - DNA, 17 bp, Homo sapiens
gtataaaatcagccaat

SEQ ID NO: 2407730 - DNA, 13 bp, Homo sapiens
gtatctcacactc

SEQ ID NO: 2407731 - DNA, 12 bp, Homo sapiens
gtatgtgtgtgt

SEQ ID NO: 2407732 - DNA, 13 bp, Homo sapiens
gtatgtgtgtgtg

SEQ ID NO: 2407733 - DNA, 18 bp, Homo sapiens
gtattaagaaaatctatt

SEQ ID NO: 2407734 - DNA, 22 bp, Homo sapiens
gtattagatgttctctatcatt

SEQ ID NO: 2407735 - DNA, 15 bp, Homo sapiens
gtattatgtgtgttt

SEQ ID NO: 2407736 - DNA, 19 bp, Homo sapiens
gtattcccattagaccaag

SEQ ID NO: 2407737 - DNA, 15 bp, Homo sapiens
gtattgtatttattc

SEQ ID NO: 2407738 - DNA, 16 bp, Homo sapiens
gtattgtgattatcaa

SEQ ID NO: 2407739 - DNA, 19 bp, Homo sapiens
gtatttaattagtgctaag

SEQ ID NO: 2407740 - DNA, 13 bp, Homo sapiens
gtatttattcaat

SEQ ID NO: 2407741 - DNA, 20 bp, Homo sapiens
gtatttattcaataaagtat

SEQ ID NO: 2407742 - DNA, 20 bp, Homo sapiens
gtcacccaggttggagtgca

SEQ ID NO: 2407743 - DNA, 16 bp, Homo sapiens
gtcacctcagagacat

SEQ ID NO: 2407744 - DNA, 16 bp, Homo sapiens
gtcactacgcctggct

SEQ ID NO: 2407745 - DNA, 22 bp, Homo sapiens
gtcccagaaaaagcatcatggc

SEQ ID NO: 2407746 - DNA, 19 bp, Homo sapiens
gtcccattcccccagtgcg

SEQ ID NO: 2407747 - DNA, 15 bp, Homo sapiens
gtcctgacctgtctc

SEQ ID NO: 2407748 - DNA, 16 bp, Homo sapiens
gtcctgacctgtctca

SEQ ID NO: 2407749 - DNA, 18 bp, Homo sapiens
gtcctgtcggagccctgt

SEQ ID NO: 2407750 - DNA, 20 bp, Homo sapiens
gtcctgtcggagccctgtct

SEQ ID NO: 2407751 - DNA, 21 bp, Homo sapiens
gtcctgtcggagccctgtctc

SEQ ID NO: 2407752 - DNA, 14 bp, Homo sapiens
gtcgccctggactg

SEQ ID NO: 2407753 - DNA, 14 bp, Homo sapiens
gtctaggacacagt

SEQ ID NO: 2407754 - DNA, 15 bp, Homo sapiens
gtctcaaactcctga

SEQ ID NO: 2407755 - DNA, 20 bp, Homo sapiens
gtctcctaagctggagtgca

SEQ ID NO: 2407756 - DNA, 17 bp, Homo sapiens
gtctctgcaaactgcct

SEQ ID NO: 2407757 - DNA, 18 bp, Homo sapiens
gtctgtaaaatctttctt

SEQ ID NO: 2407758 - DNA, 18 bp, Homo sapiens
gtctgtgaagtgagacct

SEQ ID NO: 2407759 - DNA, 21 bp, Homo sapiens
gtctgttccccatggccactt

SEQ ID NO: 2407760 - DNA, 17 bp, Homo sapiens
gtcttaatgaagtttga

SEQ ID NO: 2407761 - DNA, 19 bp, Homo sapiens
gtcttaatgaagtttgaat

SEQ ID NO: 2407762 - DNA, 19 bp, Homo sapiens
gtcttatatattgtagata

SEQ ID NO: 2407763 - DNA, 22 bp, Homo sapiens
gtgaactggaccctgttgctaa

SEQ ID NO: 2407764 - DNA, 18 bp, Homo sapiens
gtgaattgttagtttctg

SEQ ID NO: 2407765 - DNA, 15 bp, Homo sapiens
gtgagagagtggctg

SEQ ID NO: 2407766 - DNA, 18 bp, Homo sapiens
gtgaggagcttgaaaccc

SEQ ID NO: 2407767 - DNA, 15 bp, Homo sapiens
gtgatgtgagttgca

SEQ ID NO: 2407768 - DNA, 13 bp, Homo sapiens
tccctaataaagc

SEQ ID NO: 2407769 - DNA, 15 bp, Homo sapiens
tccctaataaagctg

SEQ ID NO: 2407770 - DNA, 19 bp, Homo sapiens
tccctcctgggaatgaagc

SEQ ID NO: 2407771 - DNA, 19 bp, Homo sapiens
tccctggatttttaccagt

SEQ ID NO: 2407772 - DNA, 22 bp, Homo sapiens
tccctgtttcttccacagtgcc

SEQ ID NO: 2407773 - DNA, 20 bp, Homo sapiens
tcccttcacaaacccagtgt

SEQ ID NO: 2407774 - DNA, 16 bp, Homo sapiens
tcctagttctgtagaa

SEQ ID NO: 2407775 - DNA, 18 bp, Homo sapiens
tcctagttctgtagaaat

SEQ ID NO: 2407776 - DNA, 19 bp, Homo sapiens
tcctagttctgtagaaatg

SEQ ID NO: 2407777 - DNA, 17 bp, Homo sapiens
tcctcagactctaagaa

SEQ ID NO: 2407778 - DNA, 14 bp, Homo sapiens
tcctcatgaatgta

SEQ ID NO: 2407779 - DNA, 20 bp, Homo sapiens
tcctcccacttcagcctccc

SEQ ID NO: 2407780 - DNA, 16 bp, Homo sapiens
tcctctctctgtgtta

SEQ ID NO: 2407781 - DNA, 15 bp, Homo sapiens
tcctctttagagtta

SEQ ID NO: 2407782 - DNA, 20 bp, Homo sapiens
tcctctttagagttagactg

SEQ ID NO: 2407783 - DNA, 21 bp, Homo sapiens
tcctgaccccaagttatccac

SEQ ID NO: 2407784 - DNA, 23 bp, Homo sapiens
tcctgagccagtgtcaggaggaa

SEQ ID NO: 2407785 - DNA, 23 bp, Homo sapiens
tcctggaagtgctaattttgaaa

SEQ ID NO: 2407786 - DNA, 13 bp, Homo sapiens
tcctggtagaata

SEQ ID NO: 2407787 - DNA, 18 bp, Homo sapiens
tcctgtgtggagagggaa

SEQ ID NO: 2407788 - DNA, 21 bp, Homo sapiens
tcctgtgtggagagggaatgt

SEQ ID NO: 2407789 - DNA, 17 bp, Homo sapiens
tccttaggcctctgaga

SEQ ID NO: 2407790 - DNA, 17 bp, Homo sapiens
tccttatcgaaactcat

SEQ ID NO: 2407791 - DNA, 18 bp, Homo sapiens
tccttcagcactttagaa

SEQ ID NO: 2407792 - DNA, 21 bp, Homo sapiens
tccttcctcacaccaggcttg

SEQ ID NO: 2407793 - DNA, 20 bp, Homo sapiens
tcctttgaatcctctctctg

SEQ ID NO: 2407794 - DNA, 21 bp, Homo sapiens
tcctttgaatcctctctctgt

SEQ ID NO: 2407795 - DNA, 21 bp, Homo sapiens
tcgcccagcggcatcaggctt

SEQ ID NO: 2407796 - DNA, 17 bp, Homo sapiens
tcgctgttgctgaatag

SEQ ID NO: 2407797 - DNA, 14 bp, Homo sapiens
tcggagccctgtct

SEQ ID NO: 2407798 - DNA, 13 bp, Homo sapiens
tcgtaaaattaag

SEQ ID NO: 2407799 - DNA, 16 bp, Homo sapiens
tcgtaaaattaagaaa

SEQ ID NO: 2407800 - DNA, 15 bp, Homo sapiens
tcgtgagctcttgtg

SEQ ID NO: 2407801 - DNA, 20 bp, Homo sapiens
tctaaagccattgtagtcct

SEQ ID NO: 2407802 - DNA, 13 bp, Homo sapiens
tctaagaaacatt

SEQ ID NO: 2407803 - DNA, 22 bp, Homo sapiens
tctaagaaacatttatattgat

SEQ ID NO: 2407804 - DNA, 22 bp, Homo sapiens
tctaatagggcaattaattcct

SEQ ID NO: 2407805 - DNA, 18 bp, Homo sapiens
tctaatcatgaaactccc

SEQ ID NO: 2407806 - DNA, 18 bp, Homo sapiens
tctacaaaatcctgatga

SEQ ID NO: 2407807 - DNA, 19 bp, Homo sapiens
tctacactcttgtaataaa

SEQ ID NO: 2407808 - DNA, 21 bp, Homo sapiens
tctacctggtctctccttgtt

SEQ ID NO: 2407809 - DNA, 13 bp, Homo sapiens
tctaggacacagt

SEQ ID NO: 2407810 - DNA, 15 bp, Homo sapiens
tctaggtaaattaca

SEQ ID NO: 2407811 - DNA, 13 bp, Homo sapiens
tctataatttaaa

SEQ ID NO: 2407812 - DNA, 12 bp, Homo sapiens
tctatcaaaatt

SEQ ID NO: 2407813 - DNA, 12 bp, Homo sapiens
tctatcatttaa

SEQ ID NO: 2407814 - DNA, 15 bp, Homo sapiens
tctatcatttaataa

SEQ ID NO: 2407815 - DNA, 16 bp, Homo sapiens
tctatcatttaataat

SEQ ID NO: 2407816 - DNA, 18 bp, Homo sapiens
tctatcatttaataatat

SEQ ID NO: 2407817 - DNA, 22 bp, Homo sapiens
tctatcatttaataatatactt

SEQ ID NO: 2407818 - DNA, 14 bp, Homo sapiens
tctatgcattttct

SEQ ID NO: 2407819 - DNA, 14 bp, Homo sapiens
tctcaaactggggc

SEQ ID NO: 2407820 - DNA, 12 bp, Homo sapiens
tctcaatttcta

SEQ ID NO: 2407821 - DNA, 12 bp, Homo sapiens
tctcacagtggg

SEQ ID NO: 2407822 - DNA, 22 bp, Homo sapiens
tctcacagtgggagccagggct

SEQ ID NO: 2407823 - DNA, 23 bp, Homo sapiens
tctcacagtgggagccagggctg

SEQ ID NO: 2407824 - DNA, 20 bp, Homo sapiens
tctcacatgattccagccat

SEQ ID NO: 2407825 - DNA, 15 bp, Homo sapiens
tctcaccatttggat

SEQ ID NO: 2407826 - DNA, 14 bp, Homo sapiens
tctcactgcttgaa

SEQ ID NO: 2407827 - DNA, 18 bp, Homo sapiens
tctcactgcttgaactag

SEQ ID NO: 2407828 - DNA, 16 bp, Homo sapiens
tctcagctcactgcaa

SEQ ID NO: 2407829 - DNA, 18 bp, Homo sapiens
tctcagctcactgcaacc

SEQ ID NO: 2407830 - DNA, 13 bp, Homo sapiens
tctcatcctgcag

SEQ ID NO: 2407831 - DNA, 22 bp, Homo sapiens
tctcatgaacctcaagctgcat

SEQ ID NO: 2407832 - DNA, 13 bp, Homo sapiens
tctcccctgcact

SEQ ID NO: 2407833 - DNA, 17 bp, Homo sapiens
tctcccctgcactgtaa

SEQ ID NO: 2407834 - DNA, 13 bp, Homo sapiens
tctccttgttctg

SEQ ID NO: 2407835 - DNA, 18 bp, Homo sapiens
tctccttgttctgataat

SEQ ID NO: 2407836 - DNA, 12 bp, Homo sapiens
tctctatcattt

SEQ ID NO: 2407837 - DNA, 13 bp, Homo sapiens
tctctatcattta

SEQ ID NO: 2407838 - DNA, 15 bp, Homo sapiens
tctctatcatttaat

SEQ ID NO: 2407839 - DNA, 22 bp, Homo sapiens
tctctcatgaacctcaagctgc

SEQ ID NO: 2407840 - DNA, 11 bp, Homo sapiens
tctctgcaggt

SEQ ID NO: 2407841 - DNA, 18 bp, Homo sapiens
tctctgcaggtccctaat

SEQ ID NO: 2407842 - DNA, 15 bp, Homo sapiens
tctctggaatttgaa

SEQ ID NO: 2407843 - DNA, 17 bp, Homo sapiens
tctctgttcatttcctc

SEQ ID NO: 2407844 - DNA, 17 bp, Homo sapiens
tctgaagctcaactctc

SEQ ID NO: 2407845 - DNA, 14 bp, Homo sapiens
tctgacctccatga

SEQ ID NO: 2407846 - DNA, 16 bp, Homo sapiens
tctgagtcaactcctt

SEQ ID NO: 2407847 - DNA, 14 bp, Homo sapiens
tctgcaaactgcct

SEQ ID NO: 2407848 - DNA, 22 bp, Homo sapiens
tctgcacaccctccagagacaa

SEQ ID NO: 2407849 - DNA, 12 bp, Homo sapiens
tctgcaggtccc

SEQ ID NO: 2407850 - DNA, 13 bp, Homo sapiens
tctgcaggtccct

SEQ ID NO: 2407851 - DNA, 15 bp, Homo sapiens
tctgcaggtccctaa

SEQ ID NO: 2407852 - DNA, 11 bp, Homo sapiens
tctgcctttat

SEQ ID NO: 2407853 - DNA, 16 bp, Homo sapiens
tctggagcccactgta

SEQ ID NO: 2407854 - DNA, 12 bp, Homo sapiens
tctggattatat

SEQ ID NO: 2407855 - DNA, 11 bp, Homo sapiens
tctgtaaaatc

SEQ ID NO: 2407856 - DNA, 12 bp, Homo sapiens
tctgtaaaatct

SEQ ID NO: 2407857 - DNA, 19 bp, Homo sapiens
tctgtaataaactcatttc

SEQ ID NO: 2407858 - DNA, 23 bp, Homo sapiens
tctgtaataaactcatttctagc

SEQ ID NO: 2407859 - DNA, 20 bp, Homo sapiens
tctgtatttccccaacatgt

SEQ ID NO: 2407860 - DNA, 19 bp, Homo sapiens
tctgtgagattcattcatg

SEQ ID NO: 2407861 - DNA, 21 bp, Homo sapiens
tctgtgagggtgctgactggc

SEQ ID NO: 2407862 - DNA, 16 bp, Homo sapiens
tctgttcattcctcca

SEQ ID NO: 2407863 - DNA, 17 bp, Homo sapiens
tctgttcattcctccag

SEQ ID NO: 2407864 - DNA, 18 bp, Homo sapiens
tctgttcatttcctcaaa

SEQ ID NO: 2407865 - DNA, 16 bp, Homo sapiens
tcttaaccagatcatt

SEQ ID NO: 2407866 - DNA, 22 bp, Homo sapiens
tcttaaccagatcattgtgaaa

SEQ ID NO: 2407867 - DNA, 15 bp, Homo sapiens
tcttaatgaagtttg

SEQ ID NO: 2407868 - DNA, 21 bp, Homo sapiens
tcttaatgaagtttgaatgtt

SEQ ID NO: 2407869 - DNA, 20 bp, Homo sapiens
tcttacttattatcttcagg

SEQ ID NO: 2407870 - DNA, 13 bp, Homo sapiens
tcttataatttaa

SEQ ID NO: 2407871 - DNA, 18 bp, Homo sapiens
tcttatttcatgaaaatt

SEQ ID NO: 2407872 - DNA, 14 bp, Homo sapiens
tcttctaccaccca

SEQ ID NO: 2407873 - DNA, 15 bp, Homo sapiens
tcttctattgcctct

SEQ ID NO: 2407874 - DNA, 19 bp, Homo sapiens
tcttctccatcctaccaca

SEQ ID NO: 2407875 - DNA, 15 bp, Homo sapiens
tcttcttttgtgaag

SEQ ID NO: 2407876 - DNA, 13 bp, Homo sapiens
tcttgaaaaatgc

SEQ ID NO: 2407877 - DNA, 16 bp, Homo sapiens
tcttgaataatgtaag

SEQ ID NO: 2407878 - DNA, 20 bp, Homo sapiens
tcttgatgcctggcggggtg

SEQ ID NO: 2407879 - DNA, 21 bp, Homo sapiens
tcttgatgcctggcggggtgg

SEQ ID NO: 2407880 - DNA, 15 bp, Homo sapiens
tcttgatgtaaaatc

SEQ ID NO: 2407881 - DNA, 19 bp, Homo sapiens
tcttgccaaatataaataa

SEQ ID NO: 2407882 - DNA, 17 bp, Homo sapiens
tcttgcccgctcaggct

SEQ ID NO: 2407883 - DNA, 16 bp, Homo sapiens
tcttgcctcaacctcc

SEQ ID NO: 2407884 - DNA, 16 bp, Homo sapiens
tcttggccatgggagg

SEQ ID NO: 2407885 - DNA, 11 bp, Homo sapiens
tcttgtcatgt

SEQ ID NO: 2407886 - DNA, 15 bp, Homo sapiens
tcttgtcatgtgtat

SEQ ID NO: 2407887 - DNA, 18 bp, Homo sapiens
tcttgtctcaatgctcat

SEQ ID NO: 2407888 - DNA, 12 bp, Homo sapiens
tctttattttga

SEQ ID NO: 2407889 - DNA, 14 bp, Homo sapiens
tctttccctccttg

SEQ ID NO: 2407890 - DNA, 13 bp, Homo sapiens
tctttcttagaaa

SEQ ID NO: 2407891 - DNA, 14 bp, Homo sapiens
tctttcttagaaat

SEQ ID NO: 2407892 - DNA, 19 bp, Homo sapiens
tctttcttagaaatttatt

SEQ ID NO: 2407893 - DNA, 21 bp, Homo sapiens
tctttgacaattgggagctgc

SEQ ID NO: 2407894 - DNA, 16 bp, Homo sapiens
tctttgggaatatttg

SEQ ID NO: 2407895 - DNA, 22 bp, Homo sapiens
tctttttgggagagacttgttt

SEQ ID NO: 2407896 - DNA, 15 bp, Homo sapiens
tctttttttcttgaa

SEQ ID NO: 2407897 - DNA, 22 bp, Homo sapiens
tctttttttttttttaataaat

SEQ ID NO: 2407898 - DNA, 16 bp, Homo sapiens
tgaaaagataaattat

SEQ ID NO: 2407899 - DNA, 12 bp, Homo sapiens
tttttagttgaa

SEQ ID NO: 2407900 - DNA, 15 bp, Homo sapiens
tttttagttgaattt

SEQ ID NO: 2407901 - DNA, 15 bp, Homo sapiens
tttttgaagctgtat

SEQ ID NO: 2407902 - DNA, 12 bp, Homo sapiens
ttttttaacatt

SEQ ID NO: 2407903 - DNA, 15 bp, Homo sapiens
ttttttaataaattt

SEQ ID NO: 2407904 - DNA, 10 bp, Homo sapiens
ttttttgaga

SEQ ID NO: 2407905 - DNA, 13 bp, Homo sapiens
aagaactctctgg

SEQ ID NO: 2407906 - DNA, 14 bp, Homo sapiens
aagaattattttgt

SEQ ID NO: 2407907 - DNA, 13 bp, Homo sapiens
aagacaatataat

SEQ ID NO: 2407908 - DNA, 23 bp, Homo sapiens
aagacagtgaaagaaaataacaa

SEQ ID NO: 2407909 - DNA, 20 bp, Homo sapiens
aagagaacccacgaacattc

SEQ ID NO: 2407910 - DNA, 16 bp, Homo sapiens
aagagacagcccagga

SEQ ID NO: 2407911 - DNA, 15 bp, Homo sapiens
aagagattcctgagc

SEQ ID NO: 2407912 - DNA, 13 bp, Homo sapiens
aagagctcaggat

SEQ ID NO: 2407913 - DNA, 17 bp, Homo sapiens
aagaggtgttttttcta

SEQ ID NO: 2407914 - DNA, 19 bp, Homo sapiens
aagatataagtgctgtata

SEQ ID NO: 2407915 - DNA, 17 bp, Homo sapiens
aagatatttttcatgat

SEQ ID NO: 2407916 - DNA, 17 bp, Homo sapiens
aagatggggtctgtaaa

SEQ ID NO: 2407917 - DNA, 20 bp, Homo sapiens
aagatggggtctgtaaaatc

SEQ ID NO: 2407918 - DNA, 22 bp, Homo sapiens
aagatggggtctgtaaaatctt

SEQ ID NO: 2407919 - DNA, 22 bp, Homo sapiens
aagatttccttctttttttctt

SEQ ID NO: 2407920 - DNA, 15 bp, Homo sapiens
aagcatttgaatgca

SEQ ID NO: 2407921 - DNA, 16 bp, Homo sapiens
aagcatttgaatgcat

SEQ ID NO: 2407922 - DNA, 19 bp, Homo sapiens
aagccagctgcccccagag

SEQ ID NO: 2407923 - DNA, 18 bp, Homo sapiens
aagccatgggtagcctgg

SEQ ID NO: 2407924 - DNA, 14 bp, Homo sapiens
aagccccagcaagc

SEQ ID NO: 2407925 - DNA, 22 bp, Homo sapiens
aagcctaagggatcctgcctgc

SEQ ID NO: 2407926 - DNA, 23 bp, Homo sapiens
aagctaaaaggaaagaaaataaa

SEQ ID NO: 2407927 - DNA, 17 bp, Homo sapiens
aagctatcgtaaaatta

SEQ ID NO: 2407928 - DNA, 12 bp, Homo sapiens
aagctgaaaata

SEQ ID NO: 2407929 - DNA, 18 bp, Homo sapiens
aagctgcatctagaggct

SEQ ID NO: 2407930 - DNA, 20 bp, Homo sapiens
aagctggagtgcagtggcat

SEQ ID NO: 2407931 - DNA, 19 bp, Homo sapiens
aagcttcagtgctgccgat

SEQ ID NO: 2407932 - DNA, 19 bp, Homo sapiens
aagcttttatgtgaaacat

SEQ ID NO: 2407933 - DNA, 22 bp, Homo sapiens
aaggagcaagtcagaatagaaa

SEQ ID NO: 2407934 - DNA, 11 bp, Homo sapiens
aaggataaagt

SEQ ID NO: 2407935 - DNA, 15 bp, Homo sapiens
aaggcctttaaaatt

SEQ ID NO: 2407936 - DNA, 22 bp, Homo sapiens
aaggctttgccctgctgccctc

SEQ ID NO: 2407937 - DNA, 17 bp, Homo sapiens
aaggtgaaacattttct

SEQ ID NO: 2407938 - DNA, 22 bp, Homo sapiens
aaggtgaaacattttctccctg

SEQ ID NO: 2407939 - DNA, 20 bp, Homo sapiens
aagtaaaaacaaagaaatta

SEQ ID NO: 2407940 - DNA, 18 bp, Homo sapiens
aagtacccgttcacattt

SEQ ID NO: 2407941 - DNA, 19 bp, Homo sapiens
aagtactaagcgctagagg

SEQ ID NO: 2407942 - DNA, 23 bp, Homo sapiens
aagtatttaattagtgctaagtg

SEQ ID NO: 2407943 - DNA, 17 bp, Homo sapiens
aagtcaatgttttcagt

SEQ ID NO: 2407944 - DNA, 13 bp, Homo sapiens
aagtgattgtatg

SEQ ID NO: 2407945 - DNA, 12 bp, Homo sapiens
aagtgctgtata

SEQ ID NO: 2407946 - DNA, 13 bp, Homo sapiens
aagtgctgtataa

SEQ ID NO: 2407947 - DNA, 17 bp, Homo sapiens
aagtgggttttttagtt

SEQ ID NO: 2407948 - DNA, 21 bp, Homo sapiens
aagtgggttttttagttgaat

SEQ ID NO: 2407949 - DNA, 22 bp, Homo sapiens
aagttcaatataagcttttctt

SEQ ID NO: 2407950 - DNA, 20 bp, Homo sapiens
aagtttaatggtgccttcat

SEQ ID NO: 2407951 - DNA, 22 bp, Homo sapiens
aagtttgaatgttaaataaatt

SEQ ID NO: 2407952 - DNA, 12 bp, Homo sapiens
aataaaattttt

SEQ ID NO: 2407953 - DNA, 11 bp, Homo sapiens
aataaacactc

SEQ ID NO: 2407954 - DNA, 19 bp, Homo sapiens
aataaacactcttgaaaaa

SEQ ID NO: 2407955 - DNA, 12 bp, Homo sapiens
aataaagaatgg

SEQ ID NO: 2407956 - DNA, 17 bp, Homo sapiens
aataaagaatggaaagc

SEQ ID NO: 2407957 - DNA, 13 bp, Homo sapiens
aataaagtattta

SEQ ID NO: 2407958 - DNA, 15 bp, Homo sapiens
aataaagtatttaat

SEQ ID NO: 2407959 - DNA, 20 bp, Homo sapiens
aataaagtatttaattagtg

SEQ ID NO: 2407960 - DNA, 22 bp, Homo sapiens
aataaagtatttaattagtgct

SEQ ID NO: 2407961 - DNA, 20 bp, Homo sapiens
aataaatatcctttaattga

SEQ ID NO: 2407962 - DNA, 12 bp, Homo sapiens
aataaattgtat

SEQ ID NO: 2407963 - DNA, 16 bp, Homo sapiens
aataaattgtatattc

SEQ ID NO: 2407964 - DNA, 15 bp, Homo sapiens
aataacgataaaaga

SEQ ID NO: 2407965 - DNA, 13 bp, Homo sapiens
aataatatacttg

SEQ ID NO: 2407966 - DNA, 12 bp, Homo sapiens
aataatgtaaga

SEQ ID NO: 2407967 - DNA, 19 bp, Homo sapiens
aataatgtaagacaaatat

SEQ ID NO: 2407968 - DNA, 19 bp, Homo sapiens
aatacagattttgatagca

SEQ ID NO: 2407969 - DNA, 21 bp, Homo sapiens
aatagatatccacttgagaca

SEQ ID NO: 2407970 - DNA, 18 bp, Homo sapiens
aataggcgtaactaattt

SEQ ID NO: 2407971 - DNA, 20 bp, Homo sapiens
aatagttttattaataaaca

SEQ ID NO: 2407972 - DNA, 21 bp, Homo sapiens
aatagttttattaataaacat

SEQ ID NO: 2407973 - DNA, 16 bp, Homo sapiens
aatatacttgtggact

SEQ ID NO: 2407974 - DNA, 17 bp, Homo sapiens
aatatacttgtggacta

SEQ ID NO: 2407975 - DNA, 13 bp, Homo sapiens
aatatatattatc

SEQ ID NO: 2407976 - DNA, 15 bp, Homo sapiens
aatatatattatctt

SEQ ID NO: 2407977 - DNA, 18 bp, Homo sapiens
aatatatattatcttttc

SEQ ID NO: 2407978 - DNA, 21 bp, Homo sapiens
aatatattcagcctggcttca

SEQ ID NO: 2407979 - DNA, 18 bp, Homo sapiens
aatatattttaagacgaa

SEQ ID NO: 2407980 - DNA, 11 bp, Homo sapiens
aatatttgaat

SEQ ID NO: 2407981 - DNA, 14 bp, Homo sapiens
aatatttgaatctt

SEQ ID NO: 2407982 - DNA, 16 bp, Homo sapiens
aatatttgaatcttgt

SEQ ID NO: 2407983 - DNA, 17 bp, Homo sapiens
aatatttttaatatata

SEQ ID NO: 2407984 - DNA, 13 bp, Homo sapiens
aatatttttctta

SEQ ID NO: 2407985 - DNA, 20 bp, Homo sapiens
aatcagagaccttccagaaa

SEQ ID NO: 2407986 - DNA, 14 bp, Homo sapiens
aatcagccaattat

SEQ ID NO: 2407987 - DNA, 20 bp, Homo sapiens
aatcagccaattatgttaaa

SEQ ID NO: 2407988 - DNA, 21 bp, Homo sapiens
aatcagccaattatgttaaac

SEQ ID NO: 2407989 - DNA, 17 bp, Homo sapiens
aatccaagcaaatgtga

SEQ ID NO: 2407990 - DNA, 15 bp, Homo sapiens
aatccccagtaaaat

SEQ ID NO: 2407991 - DNA, 16 bp, Homo sapiens
aatccccagtaaaatt

SEQ ID NO: 2407992 - DNA, 21 bp, Homo sapiens
aatccccagtaaaattgccat

SEQ ID NO: 2407993 - DNA, 13 bp, Homo sapiens
aatccccttctcc

SEQ ID NO: 2407994 - DNA, 14 bp, Homo sapiens
aatccccttctccc

SEQ ID NO: 2407995 - DNA, 12 bp, Homo sapiens
aatccgcccatc

SEQ ID NO: 2407996 - DNA, 20 bp, Homo sapiens
aatcctcagtttttgtgaaa

SEQ ID NO: 2407997 - DNA, 22 bp, Homo sapiens
aatccttctattctagcctgca

SEQ ID NO: 2407998 - DNA, 16 bp, Homo sapiens
aatcttataatttaaa

SEQ ID NO: 2407999 - DNA, 15 bp, Homo sapiens
aatctttaattttac

SEQ ID NO: 2408000 - DNA, 16 bp, Homo sapiens
aatctttaattttaca

SEQ ID NO: 2408001 - DNA, 17 bp, Homo sapiens
aatctttctttcttaga

SEQ ID NO: 2408002 - DNA, 18 bp, Homo sapiens
aatctttctttcttagaa

SEQ ID NO: 2408003 - DNA, 19 bp, Homo sapiens
aatctttctttcttagaaa

SEQ ID NO: 2408004 - DNA, 21 bp, Homo sapiens
aatctttctttcttagaaatt

SEQ ID NO: 2408005 - DNA, 15 bp, Homo sapiens
aatgaaaaccacatt

SEQ ID NO: 2408006 - DNA, 21 bp, Homo sapiens
aatgaagtttgaatgttaaat

SEQ ID NO: 2408007 - DNA, 12 bp, Homo sapiens
aatgagaaatct

SEQ ID NO: 2408008 - DNA, 23 bp, Homo sapiens
aatgcattttgtttggtattgta

SEQ ID NO: 2408009 - DNA, 16 bp, Homo sapiens
aatggtgccttcattt

SEQ ID NO: 2408010 - DNA, 15 bp, Homo sapiens
aatggttgtattaga

SEQ ID NO: 2408011 - DNA, 23 bp, Homo sapiens
aatggttgtattagatgttctct

SEQ ID NO: 2408012 - DNA, 14 bp, Homo sapiens
aatgtaaatttgta

SEQ ID NO: 2408013 - DNA, 15 bp, Homo sapiens
aatgtaaatttgtac

SEQ ID NO: 2408014 - DNA, 16 bp, Homo sapiens
aatgtaaatttgtact

SEQ ID NO: 2408015 - DNA, 16 bp, Homo sapiens
aatgtaatagggaaaa

SEQ ID NO: 2408016 - DNA, 20 bp, Homo sapiens
aatgtgatttacgctcattg

SEQ ID NO: 2408017 - DNA, 21 bp, Homo sapiens
aatgtgtaagaacaactacct

SEQ ID NO: 2408018 - DNA, 22 bp, Homo sapiens
aatgttaaataaattgtatatt

SEQ ID NO: 2408019 - DNA, 14 bp, Homo sapiens
aatgttgaattttg

SEQ ID NO: 2408020 - DNA, 20 bp, Homo sapiens
aatgtttttttttaaagact

SEQ ID NO: 2408021 - DNA, 22 bp, Homo sapiens
aatgtttttttttaaagacttt

SEQ ID NO: 2408022 - DNA, 15 bp, Homo sapiens
aattaaagctgttat

SEQ ID NO: 2408023 - DNA, 14 bp, Homo sapiens
aattagtgctaagt

SEQ ID NO: 2408024 - DNA, 18 bp, Homo sapiens
aattataactggaaagaa

SEQ ID NO: 2408025 - DNA, 14 bp, Homo sapiens
aattatgttaaact

SEQ ID NO: 2408026 - DNA, 21 bp, Homo sapiens
aattcattaatctgcctccct

SEQ ID NO: 2408027 - DNA, 17 bp, Homo sapiens
aattctaacccaggtat

SEQ ID NO: 2408028 - DNA, 19 bp, Homo sapiens
aattcttatgccatataat

SEQ ID NO: 2408029 - DNA, 22 bp, Homo sapiens
aattgaatcactgctcacactg

SEQ ID NO: 2408030 - DNA, 23 bp, Homo sapiens
aattgccatattgcacatgtctt

SEQ ID NO: 2408031 - DNA, 15 bp, Homo sapiens
aattgcctgacgaac

SEQ ID NO: 2408032 - DNA, 22 bp, Homo sapiens
aattgctttaccttttttctta

SEQ ID NO: 2408033 - DNA, 11 bp, Homo sapiens
aattgtaatag

SEQ ID NO: 2408034 - DNA, 13 bp, Homo sapiens
aattgtatattca

SEQ ID NO: 2408035 - DNA, 18 bp, Homo sapiens
agttgaattttttttaac

SEQ ID NO: 2408036 - DNA, 22 bp, Homo sapiens
agttgaattttttttaacattc

SEQ ID NO: 2408037 - DNA, 17 bp, Homo sapiens
agttgcacagctatgaa

SEQ ID NO: 2408038 - DNA, 22 bp, Homo sapiens
agttgcataggtttaataattt

SEQ ID NO: 2408039 - DNA, 15 bp, Homo sapiens
agttgctatttgaac

SEQ ID NO: 2408040 - DNA, 14 bp, Homo sapiens
agttgtgcttgagc

SEQ ID NO: 2408041 - DNA, 20 bp, Homo sapiens
agtttaatggtgccttcatt

SEQ ID NO: 2408042 - DNA, 14 bp, Homo sapiens
agtttctgagtttt

SEQ ID NO: 2408043 - DNA, 15 bp, Homo sapiens
agtttgttgaaacac

SEQ ID NO: 2408044 - DNA, 23 bp, Homo sapiens
agttttattaataaacattctat

SEQ ID NO: 2408045 - DNA, 17 bp, Homo sapiens
agttttggatgcagtgc

SEQ ID NO: 2408046 - DNA, 17 bp, Homo sapiens
agtttttatatgttgta

SEQ ID NO: 2408047 - DNA, 19 bp, Homo sapiens
ataaaagcctgtttaagag

SEQ ID NO: 2408048 - DNA, 20 bp, Homo sapiens
ataaaagcctgtttaagaga

SEQ ID NO: 2408049 - DNA, 15 bp, Homo sapiens
ataaaatcagccaat

SEQ ID NO: 2408050 - DNA, 18 bp, Homo sapiens
ataaaatcagccaattat

SEQ ID NO: 2408051 - DNA, 23 bp, Homo sapiens
ataaacactcttgaaaaatgcat

SEQ ID NO: 2408052 - DNA, 13 bp, Homo sapiens
ataaacattgtat

SEQ ID NO: 2408053 - DNA, 11 bp, Homo sapiens
ataaagaatgg

SEQ ID NO: 2408054 - DNA, 12 bp, Homo sapiens
ataaagtattta

SEQ ID NO: 2408055 - DNA, 17 bp, Homo sapiens
ataaagtatttaattag

SEQ ID NO: 2408056 - DNA, 19 bp, Homo sapiens
ataaagtatttaattagtg

SEQ ID NO: 2408057 - DNA, 14 bp, Homo sapiens
ataaataaaaataa

SEQ ID NO: 2408058 - DNA, 17 bp, Homo sapiens
ataaattgtatattcac

SEQ ID NO: 2408059 - DNA, 22 bp, Homo sapiens
ataacgataaaagacagtgaaa

SEQ ID NO: 2408060 - DNA, 20 bp, Homo sapiens
ataacggatcagaaatacag

SEQ ID NO: 2408061 - DNA, 21 bp, Homo sapiens
ataactaacaaccaaagacta

SEQ ID NO: 2408062 - DNA, 18 bp, Homo sapiens
ataagatatttttcatga

SEQ ID NO: 2408063 - DNA, 13 bp, Homo sapiens
ataagatctttta

SEQ ID NO: 2408064 - DNA, 13 bp, Homo sapiens
ataagcttttctt

SEQ ID NO: 2408065 - DNA, 19 bp, Homo sapiens
ataagtgctgtataaaatc

SEQ ID NO: 2408066 - DNA, 20 bp, Homo sapiens
ataagtgctgtataaaatca

SEQ ID NO: 2408067 - DNA, 18 bp, Homo sapiens
ataagtttatttcttaaa

SEQ ID NO: 2408068 - DNA, 21 bp, Homo sapiens
ataatcattattacttttgct

SEQ ID NO: 2408069 - DNA, 22 bp, Homo sapiens
ataatcattattacttttgctg

SEQ ID NO: 2408070 - DNA, 13 bp, Homo sapiens
ataatggtcagag

SEQ ID NO: 2408071 - DNA, 19 bp, Homo sapiens
ataatgtaaacaatatcag

SEQ ID NO: 2408072 - DNA, 15 bp, Homo sapiens
ataatgtcccttcac

SEQ ID NO: 2408073 - DNA, 23 bp, Homo sapiens
ataattcacattgtattcagagt

SEQ ID NO: 2408074 - DNA, 14 bp, Homo sapiens
ataattttaaatgt

SEQ ID NO: 2408075 - DNA, 19 bp, Homo sapiens
atacaaaggcttattaatt

SEQ ID NO: 2408076 - DNA, 13 bp, Homo sapiens
atacacacagtta

SEQ ID NO: 2408077 - DNA, 14 bp, Homo sapiens
atacagattttgat

SEQ ID NO: 2408078 - DNA, 18 bp, Homo sapiens
atacagattttgatagca

SEQ ID NO: 2408079 - DNA, 15 bp, Homo sapiens
atacttgaaaattaa

SEQ ID NO: 2408080 - DNA, 22 bp, Homo sapiens
atagcaaagcgacgttagtcgt

SEQ ID NO: 2408081 - DNA, 18 bp, Homo sapiens
atagctactaattttaaa

SEQ ID NO: 2408082 - DNA, 17 bp, Homo sapiens
ataggcacaggaaacca

SEQ ID NO: 2408083 - DNA, 21 bp, Homo sapiens
ataggcgatcacaacgtgcat

SEQ ID NO: 2408084 - DNA, 17 bp, Homo sapiens
ataggcgtaactaattt

SEQ ID NO: 2408085 - DNA, 22 bp, Homo sapiens
atagggaaaattctaacccagg

SEQ ID NO: 2408086 - DNA, 23 bp, Homo sapiens
atagggcaattaattccttcagc

SEQ ID NO: 2408087 - DNA, 22 bp, Homo sapiens
atataaatattagaaacagctt

SEQ ID NO: 2408088 - DNA, 15 bp, Homo sapiens
atataagtgctgtat

SEQ ID NO: 2408089 - DNA, 18 bp, Homo sapiens
atataagtgctgtataaa

SEQ ID NO: 2408090 - DNA, 14 bp, Homo sapiens
atataatcattatt

SEQ ID NO: 2408091 - DNA, 14 bp, Homo sapiens
atatacttgtggac

SEQ ID NO: 2408092 - DNA, 20 bp, Homo sapiens
atatatattatcttttcata

SEQ ID NO: 2408093 - DNA, 13 bp, Homo sapiens
atatattatcttt

SEQ ID NO: 2408094 - DNA, 16 bp, Homo sapiens
atatcaaatatattca

SEQ ID NO: 2408095 - DNA, 14 bp, Homo sapiens
atatctgcctttat

SEQ ID NO: 2408096 - DNA, 18 bp, Homo sapiens
atatctgcctttattgtg

SEQ ID NO: 2408097 - DNA, 20 bp, Homo sapiens
atatgctctgatttatctga

SEQ ID NO: 2408098 - DNA, 15 bp, Homo sapiens
atatgtaaaattaca

SEQ ID NO: 2408099 - DNA, 14 bp, Homo sapiens
atattaatattcct

SEQ ID NO: 2408100 - DNA, 22 bp, Homo sapiens
atattattttatgttgcataga

SEQ ID NO: 2408101 - DNA, 15 bp, Homo sapiens
atattgatccagaaa

SEQ ID NO: 2408102 - DNA, 13 bp, Homo sapiens
atattgatttatt

SEQ ID NO: 2408103 - DNA, 15 bp, Homo sapiens
atattgatttattaa

SEQ ID NO: 2408104 - DNA, 21 bp, Homo sapiens
atatttacatgaattgcattt

SEQ ID NO: 2408105 - DNA, 13 bp, Homo sapiens
atcaagcccttta

SEQ ID NO: 2408106 - DNA, 13 bp, Homo sapiens
atcaatcaactta

SEQ ID NO: 2408107 - DNA, 17 bp, Homo sapiens
atcacaacgtgcattgt

SEQ ID NO: 2408108 - DNA, 22 bp, Homo sapiens
atcacaacgtgcattgtgcttc

SEQ ID NO: 2408109 - DNA, 19 bp, Homo sapiens
atcaccttagaccaccaag

SEQ ID NO: 2408110 - DNA, 20 bp, Homo sapiens
atcaccttagaccaccaagc

SEQ ID NO: 2408111 - DNA, 14 bp, Homo sapiens
atcagaaatacaga

SEQ ID NO: 2408112 - DNA, 12 bp, Homo sapiens
atcagccaatta

SEQ ID NO: 2408113 - DNA, 14 bp, Homo sapiens
atcagccaattatg

SEQ ID NO: 2408114 - DNA, 14 bp, Homo sapiens
atcaggctttcttt

SEQ ID NO: 2408115 - DNA, 17 bp, Homo sapiens
atcataatataaaacag

SEQ ID NO: 2408116 - DNA, 20 bp, Homo sapiens
atcatatatatacatacatg

SEQ ID NO: 2408117 - DNA, 14 bp, Homo sapiens
atcatctcagctca

SEQ ID NO: 2408118 - DNA, 14 bp, Homo sapiens
atcatgtgaaatca

SEQ ID NO: 2408119 - DNA, 15 bp, Homo sapiens
atcatgtgaaatcat

SEQ ID NO: 2408120 - DNA, 16 bp, Homo sapiens
atcatgtgaaatcatt

SEQ ID NO: 2408121 - DNA, 20 bp, Homo sapiens
atcattcttatttcatgaaa

SEQ ID NO: 2408122 - DNA, 15 bp, Homo sapiens
atcattgtgaaatta

SEQ ID NO: 2408123 - DNA, 17 bp, Homo sapiens
atcatttaataatatac

SEQ ID NO: 2408124 - DNA, 19 bp, Homo sapiens
atcatttaataatatactt

SEQ ID NO: 2408125 - DNA, 17 bp, Homo sapiens
atccacctgccttggct

SEQ ID NO: 2408126 - DNA, 23 bp, Homo sapiens
atccactttatcttgaataatgt

SEQ ID NO: 2408127 - DNA, 18 bp, Homo sapiens
atccagaaagaaaacttg

SEQ ID NO: 2408128 - DNA, 15 bp, Homo sapiens
atccccacgccacag

SEQ ID NO: 2408129 - DNA, 21 bp, Homo sapiens
atccccttctcccctgcactg

SEQ ID NO: 2408130 - DNA, 20 bp, Homo sapiens
atcccgattcaccctgtcca

SEQ ID NO: 2408131 - DNA, 20 bp, Homo sapiens
atcctaggtagggtttaatc

SEQ ID NO: 2408132 - DNA, 20 bp, Homo sapiens
atcctctttagagttagact

SEQ ID NO: 2408133 - DNA, 22 bp, Homo sapiens
atcctctttagagttagactgt

SEQ ID NO: 2408134 - DNA, 21 bp, Homo sapiens
atcctgtgtggagagggaatg

SEQ ID NO: 2408135 - DNA, 17 bp, Homo sapiens
atccttcctcacaccag

SEQ ID NO: 2408136 - DNA, 17 bp, Homo sapiens
atcgctccaccttgcag

SEQ ID NO: 2408137 - DNA, 21 bp, Homo sapiens
atcgctccaccttgcagctct

SEQ ID NO: 2408138 - DNA, 17 bp, Homo sapiens
atcgcttcatgtaacta

SEQ ID NO: 2408139 - DNA, 17 bp, Homo sapiens
atcgtaaaattaagaaa

SEQ ID NO: 2408140 - DNA, 22 bp, Homo sapiens
atctaaactggattcacagctc

SEQ ID NO: 2408141 - DNA, 19 bp, Homo sapiens
atctagaggcttccttcat

SEQ ID NO: 2408142 - DNA, 23 bp, Homo sapiens
atctagaggcttccttcatttcc

SEQ ID NO: 2408143 - DNA, 19 bp, Homo sapiens
atctaggattttaagggaa

SEQ ID NO: 2408144 - DNA, 18 bp, Homo sapiens
atctatgcattttctgga

SEQ ID NO: 2408145 - DNA, 19 bp, Homo sapiens
atctattcctggtagaata

SEQ ID NO: 2408146 - DNA, 14 bp, Homo sapiens
atctcagctcactg

SEQ ID NO: 2408147 - DNA, 15 bp, Homo sapiens
atctctcttcttttc

SEQ ID NO: 2408148 - DNA, 17 bp, Homo sapiens
atctgattgtgatgtga

SEQ ID NO: 2408149 - DNA, 19 bp, Homo sapiens
atctgcctttattgtgttt

SEQ ID NO: 2408150 - DNA, 21 bp, Homo sapiens
atctgcctttattgtgtttgt

SEQ ID NO: 2408151 - DNA, 22 bp, Homo sapiens
atctgcctttattgtgtttgtc

SEQ ID NO: 2408152 - DNA, 22 bp, Homo sapiens
atctggctgcagttttgctatc

SEQ ID NO: 2408153 - DNA, 17 bp, Homo sapiens
atctgggctgtgggcaa

SEQ ID NO: 2408154 - DNA, 16 bp, Homo sapiens
atcttaattattgtac

SEQ ID NO: 2408155 - DNA, 18 bp, Homo sapiens
atcttgaataatgtaaga

SEQ ID NO: 2408156 - DNA, 15 bp, Homo sapiens
atcttgtcatgtgta

SEQ ID NO: 2408157 - DNA, 16 bp, Homo sapiens
atcttgtctcaatgct

SEQ ID NO: 2408158 - DNA, 16 bp, Homo sapiens
atctttaattttacat

SEQ ID NO: 2408159 - DNA, 21 bp, Homo sapiens
atctttaattttacatttcct

SEQ ID NO: 2408160 - DNA, 12 bp, Homo sapiens
atctttccctcc

SEQ ID NO: 2408161 - DNA, 13 bp, Homo sapiens
atctttccctcct

SEQ ID NO: 2408162 - DNA, 16 bp, Homo sapiens
atctttccctccttgg

SEQ ID NO: 2408163 - DNA, 19 bp, Homo sapiens
atctttccctccttggtga

SEQ ID NO: 2408164 - DNA, 17 bp, Homo sapiens
atctttctttcttagaa

SEQ ID NO: 2408165 - DNA, 15 bp, Homo sapiens
ccaggatactggcac

SEQ ID NO: 2408166 - DNA, 22 bp, Homo sapiens
ccaggctgggtcgccctggact

SEQ ID NO: 2408167 - DNA, 24 bp, Homo sapiens
ccaggctgggtcgccctggactgt

SEQ ID NO: 2408168 - DNA, 15 bp, Homo sapiens
ccagtaactcatctg

SEQ ID NO: 2408169 - DNA, 18 bp, Homo sapiens
ccagtacctagctggctc

SEQ ID NO: 2408170 - DNA, 18 bp, Homo sapiens
ccagtgtgtggctttcag

SEQ ID NO: 2408171 - DNA, 21 bp, Homo sapiens
ccagtgtgtggctttcagagc

SEQ ID NO: 2408172 - DNA, 17 bp, Homo sapiens
ccagttagcctctgcag

SEQ ID NO: 2408173 - DNA, 12 bp, Homo sapiens
ccagttgtcctc

SEQ ID NO: 2408174 - DNA, 13 bp, Homo sapiens
ccagttgtcctcc

SEQ ID NO: 2408175 - DNA, 13 bp, Homo sapiens
ccatattgcacat

SEQ ID NO: 2408176 - DNA, 18 bp, Homo sapiens
ccatattgcacatgtctt

SEQ ID NO: 2408177 - DNA, 19 bp, Homo sapiens
ccatcaccttagaccacca

SEQ ID NO: 2408178 - DNA, 23 bp, Homo sapiens
ccatcaccttagaccaccaagcc

SEQ ID NO: 2408179 - DNA, 21 bp, Homo sapiens
ccatcttgcccgctcaggctg

SEQ ID NO: 2408180 - DNA, 18 bp, Homo sapiens
ccatgaagagatttttca

SEQ ID NO: 2408181 - DNA, 22 bp, Homo sapiens
ccatgaagagatttttcatgat

SEQ ID NO: 2408182 - DNA, 16 bp, Homo sapiens
ccatgggtagcctggg

SEQ ID NO: 2408183 - DNA, 15 bp, Homo sapiens
ccattgtctcagagc

SEQ ID NO: 2408184 - DNA, 18 bp, Homo sapiens
cccaaccatttcctcaga

SEQ ID NO: 2408185 - DNA, 13 bp, Homo sapiens
cccaccaggctgc

SEQ ID NO: 2408186 - DNA, 22 bp, Homo sapiens
cccaccaggctgctcagggctg

SEQ ID NO: 2408187 - DNA, 23 bp, Homo sapiens
cccactgtacttgctcttgatgc

SEQ ID NO: 2408188 - DNA, 13 bp, Homo sapiens
cccagagccacag

SEQ ID NO: 2408189 - DNA, 18 bp, Homo sapiens
cccaggttggagtgcagt

SEQ ID NO: 2408190 - DNA, 12 bp, Homo sapiens
cccagtaaaatt

SEQ ID NO: 2408191 - DNA, 17 bp, Homo sapiens
cccagtgttttaggagc

SEQ ID NO: 2408192 - DNA, 14 bp, Homo sapiens
ccccagagccacag

SEQ ID NO: 2408193 - DNA, 22 bp, Homo sapiens
ccccagctggggccaggctggg

SEQ ID NO: 2408194 - DNA, 20 bp, Homo sapiens
cccccaaccatttcctcaga

SEQ ID NO: 2408195 - DNA, 23 bp, Homo sapiens
cccctaatgacatcaccacagtt

SEQ ID NO: 2408196 - DNA, 14 bp, Homo sapiens
cccctgcactgtaa

SEQ ID NO: 2408197 - DNA, 16 bp, Homo sapiens
cccctgcactgtaaaa

SEQ ID NO: 2408198 - DNA, 17 bp, Homo sapiens
cccctgcactgtaaaat

SEQ ID NO: 2408199 - DNA, 14 bp, Homo sapiens
cccctgcctctctg

SEQ ID NO: 2408200 - DNA, 16 bp, Homo sapiens
cccctgcctctctgca

SEQ ID NO: 2408201 - DNA, 19 bp, Homo sapiens
cccctgcctctctgcaggt

SEQ ID NO: 2408202 - DNA, 18 bp, Homo sapiens
ccccttctcccctgcact

SEQ ID NO: 2408203 - DNA, 13 bp, Homo sapiens
cccgctcaggctg

SEQ ID NO: 2408204 - DNA, 13 bp, Homo sapiens
ccctaataaagct

SEQ ID NO: 2408205 - DNA, 14 bp, Homo sapiens
ccctccgccattct

SEQ ID NO: 2408206 - DNA, 17 bp, Homo sapiens
ccctcctctccaccatc

SEQ ID NO: 2408207 - DNA, 20 bp, Homo sapiens
ccctgagacaaatggaggcc

SEQ ID NO: 2408208 - DNA, 23 bp, Homo sapiens
ccctgagacaaatggaggcctgt

SEQ ID NO: 2408209 - DNA, 14 bp, Homo sapiens
ccctgcctctctgc

SEQ ID NO: 2408210 - DNA, 13 bp, Homo sapiens
ccctgctgccctc

SEQ ID NO: 2408211 - DNA, 16 bp, Homo sapiens
ccctggatttttacca

SEQ ID NO: 2408212 - DNA, 20 bp, Homo sapiens
ccctggatttttaccagtct

SEQ ID NO: 2408213 - DNA, 15 bp, Homo sapiens
cccttctcccctgca

SEQ ID NO: 2408214 - DNA, 21 bp, Homo sapiens
cccttctcccctgcactgtaa

SEQ ID NO: 2408215 - DNA, 15 bp, Homo sapiens
ccctttgctgaccct

SEQ ID NO: 2408216 - DNA, 23 bp, Homo sapiens
ccgaaggtgaggagcttgaaacc

SEQ ID NO: 2408217 - DNA, 13 bp, Homo sapiens
ccgattcaccctg

SEQ ID NO: 2408218 - DNA, 20 bp, Homo sapiens
ccgccattctcaagccctgc

SEQ ID NO: 2408219 - DNA, 14 bp, Homo sapiens
ccgttcacatgtgt

SEQ ID NO: 2408220 - DNA, 19 bp, Homo sapiens
cctaaaagaaaccctgcac

SEQ ID NO: 2408221 - DNA, 18 bp, Homo sapiens
cctaagctggagtgcagt

SEQ ID NO: 2408222 - DNA, 18 bp, Homo sapiens
cctaagggatcctgcctg

SEQ ID NO: 2408223 - DNA, 23 bp, Homo sapiens
cctaataaagctgtgtggcagtc

SEQ ID NO: 2408224 - DNA, 16 bp, Homo sapiens
cctaatccccttctcc

SEQ ID NO: 2408225 - DNA, 18 bp, Homo sapiens
cctaatccccttctcccc

SEQ ID NO: 2408226 - DNA, 14 bp, Homo sapiens
cctagctggctctg

SEQ ID NO: 2408227 - DNA, 22 bp, Homo sapiens
cctaggtataattcacattgta

SEQ ID NO: 2408228 - DNA, 19 bp, Homo sapiens
cctagttctgtagaaatgg

SEQ ID NO: 2408229 - DNA, 15 bp, Homo sapiens
cctattttaataaac

SEQ ID NO: 2408230 - DNA, 12 bp, Homo sapiens
cctcaacctccc

SEQ ID NO: 2408231 - DNA, 14 bp, Homo sapiens
cctcaacctcccaa

SEQ ID NO: 2408232 - DNA, 15 bp, Homo sapiens
cctcaagctgcatct

SEQ ID NO: 2408233 - DNA, 11 bp, Homo sapiens
cctcacacagc

SEQ ID NO: 2408234 - DNA, 18 bp, Homo sapiens
cctcaccagccctggcaa

SEQ ID NO: 2408235 - DNA, 20 bp, Homo sapiens
cctcagactctaagaaagaa

SEQ ID NO: 2408236 - DNA, 20 bp, Homo sapiens
cctcagatgcacatgagctg

SEQ ID NO: 2408237 - DNA, 18 bp, Homo sapiens
cctcccatgttcaagcga

SEQ ID NO: 2408238 - DNA, 15 bp, Homo sapiens
cctccccctcctctc

SEQ ID NO: 2408239 - DNA, 14 bp, Homo sapiens
cctcctctccacca

SEQ ID NO: 2408240 - DNA, 17 bp, Homo sapiens
cctcctgggaatgaagc

SEQ ID NO: 2408241 - DNA, 16 bp, Homo sapiens
cctccttggtgattcc

SEQ ID NO: 2408242 - DNA, 15 bp, Homo sapiens
cctctctgcaggtcc

SEQ ID NO: 2408243 - DNA, 23 bp, Homo sapiens
cctctctgcaggtccctaataaa

SEQ ID NO: 2408244 - DNA, 17 bp, Homo sapiens
cctcttaaataaacctt

SEQ ID NO: 2408245 - DNA, 12 bp, Homo sapiens
cctctttagagt

SEQ ID NO: 2408246 - DNA, 19 bp, Homo sapiens
cctctttagagttagactg

SEQ ID NO: 2408247 - DNA, 23 bp, Homo sapiens
cctgaccccaagttatccacctg

SEQ ID NO: 2408248 - DNA, 13 bp, Homo sapiens
cctgactgccaag

SEQ ID NO: 2408249 - DNA, 16 bp, Homo sapiens
cctgactgccaagcca

SEQ ID NO: 2408250 - DNA, 15 bp, Homo sapiens
cctgagacaaatgga

SEQ ID NO: 2408251 - DNA, 20 bp, Homo sapiens
cctgagacaaatggaggcct

SEQ ID NO: 2408252 - DNA, 20 bp, Homo sapiens
cctgagtagaaaggccttta

SEQ ID NO: 2408253 - DNA, 13 bp, Homo sapiens
cctgcactgtaaa

SEQ ID NO: 2408254 - DNA, 16 bp, Homo sapiens
cctgcagactcactgt

SEQ ID NO: 2408255 - DNA, 15 bp, Homo sapiens
cctgcagtcacagct

SEQ ID NO: 2408256 - DNA, 16 bp, Homo sapiens
cctgcccattggagag

SEQ ID NO: 2408257 - DNA, 20 bp, Homo sapiens
cctgctttttatggcctgtg

SEQ ID NO: 2408258 - DNA, 13 bp, Homo sapiens
cctggacttgcct

SEQ ID NO: 2408259 - DNA, 16 bp, Homo sapiens
cctggacttgcctctg

SEQ ID NO: 2408260 - DNA, 13 bp, Homo sapiens
cctgggattacag

SEQ ID NO: 2408261 - DNA, 17 bp, Homo sapiens
cctgtccaaactgccta

SEQ ID NO: 2408262 - DNA, 19 bp, Homo sapiens
cctgtcctgacctgtctca

SEQ ID NO: 2408263 - DNA, 16 bp, Homo sapiens
cctgtgtggagaggga

SEQ ID NO: 2408264 - DNA, 21 bp, Homo sapiens
cctgtgtggagagggaatgtg

SEQ ID NO: 2408265 - DNA, 12 bp, Homo sapiens
cctgttgctaag

SEQ ID NO: 2408266 - DNA, 20 bp, Homo sapiens
ccttcagcactttagaatat

SEQ ID NO: 2408267 - DNA, 13 bp, Homo sapiens
ccttcatttcctc

SEQ ID NO: 2408268 - DNA, 19 bp, Homo sapiens
ccttccttttacttttctt

SEQ ID NO: 2408269 - DNA, 15 bp, Homo sapiens
ccttctattggtctc

SEQ ID NO: 2408270 - DNA, 13 bp, Homo sapiens
ccttctcccctgc

SEQ ID NO: 2408271 - DNA, 16 bp, Homo sapiens
ccttctcccctgcact

SEQ ID NO: 2408272 - DNA, 22 bp, Homo sapiens
ccttctcccctgcactgtaaaa

SEQ ID NO: 2408273 - DNA, 22 bp, Homo sapiens
ccttgattttagccttctctgt

SEQ ID NO: 2408274 - DNA, 17 bp, Homo sapiens
ccttgcggctcctcagg

SEQ ID NO: 2408275 - DNA, 19 bp, Homo sapiens
ccttgcggctcctcaggga

SEQ ID NO: 2408276 - DNA, 20 bp, Homo sapiens
ccttgcggctcctcagggac

SEQ ID NO: 2408277 - DNA, 20 bp, Homo sapiens
ccttggctgacatgaagctg

SEQ ID NO: 2408278 - DNA, 12 bp, Homo sapiens
cctttaaaattt

SEQ ID NO: 2408279 - DNA, 21 bp, Homo sapiens
cctttaaaatttttttagaaa

SEQ ID NO: 2408280 - DNA, 12 bp, Homo sapiens
cctttccctaag

SEQ ID NO: 2408281 - DNA, 14 bp, Homo sapiens
cctttgaatcctct

SEQ ID NO: 2408282 - DNA, 20 bp, Homo sapiens
cctttgaatcctctctctgt

SEQ ID NO: 2408283 - DNA, 18 bp, Homo sapiens
cctttgctgaccctcccc

SEQ ID NO: 2408284 - DNA, 17 bp, Homo sapiens
cgactgccatcttggac

SEQ ID NO: 2408285 - DNA, 23 bp, Homo sapiens
cgatcacaacgtgcattgtgctt

SEQ ID NO: 2408286 - DNA, 13 bp, Homo sapiens
cgatctcagctca

SEQ ID NO: 2408287 - DNA, 16 bp, Homo sapiens
cgcatgcggcccagga

SEQ ID NO: 2408288 - DNA, 19 bp, Homo sapiens
cgccacagcccttttgtct

SEQ ID NO: 2408289 - DNA, 21 bp, Homo sapiens
cgccacagcccttttgtctct

SEQ ID NO: 2408290 - DNA, 19 bp, Homo sapiens
cgccaggatggcgcaggaa

SEQ ID NO: 2408291 - DNA, 18 bp, Homo sapiens
cgctagaggaagcagcca

SEQ ID NO: 2408292 - DNA, 13 bp, Homo sapiens
cgctgttgctgaa

SEQ ID NO: 2408293 - DNA, 17 bp, Homo sapiens
cggcccacaattaattt

SEQ ID NO: 2408294 - DNA, 17 bp, Homo sapiens
cggcccaggatggcttt

SEQ ID NO: 2408295 - DNA, 17 bp, Homo sapiens
cggtgagctacaaatgc

SEQ ID NO: 2408296 - DNA, 14 bp, Homo sapiens
cttgttttggatgc

SEQ ID NO: 2408297 - DNA, 14 bp, Homo sapiens
ctttagagttagac

SEQ ID NO: 2408298 - DNA, 16 bp, Homo sapiens
ctttatcctctttaga

SEQ ID NO: 2408299 - DNA, 19 bp, Homo sapiens
ctttatgtagtttttatat

SEQ ID NO: 2408300 - DNA, 20 bp, Homo sapiens
ctttatgtagtttttatatg

SEQ ID NO: 2408301 - DNA, 16 bp, Homo sapiens
ctttattgtgtttgtc

SEQ ID NO: 2408302 - DNA, 18 bp, Homo sapiens
ctttattgtgtttgtcat

SEQ ID NO: 2408303 - DNA, 19 bp, Homo sapiens
ctttattgtgtttgtcatt

SEQ ID NO: 2408304 - DNA, 11 bp, Homo sapiens
ctttattttga

SEQ ID NO: 2408305 - DNA, 13 bp, Homo sapiens
ctttcagagcctc

SEQ ID NO: 2408306 - DNA, 12 bp, Homo sapiens
ctttccctaagc

SEQ ID NO: 2408307 - DNA, 17 bp, Homo sapiens
ctttccctaagccagct

SEQ ID NO: 2408308 - DNA, 14 bp, Homo sapiens
ctttccctccttgg

SEQ ID NO: 2408309 - DNA, 18 bp, Homo sapiens
ctttctcaataagcctca

SEQ ID NO: 2408310 - DNA, 11 bp, Homo sapiens
ctttcttagaa

SEQ ID NO: 2408311 - DNA, 13 bp, Homo sapiens
ctttcttagaaat

SEQ ID NO: 2408312 - DNA, 14 bp, Homo sapiens
ctttcttagaaatt

SEQ ID NO: 2408313 - DNA, 16 bp, Homo sapiens
ctttctttcttagaaa

SEQ ID NO: 2408314 - DNA, 22 bp, Homo sapiens
ctttctttgggaatatttgaat

SEQ ID NO: 2408315 - DNA, 19 bp, Homo sapiens
ctttgaactactagaaaat

SEQ ID NO: 2408316 - DNA, 21 bp, Homo sapiens
ctttgacaattgggagctgcc

SEQ ID NO: 2408317 - DNA, 22 bp, Homo sapiens
ctttggctgaaaggaagctgtg

SEQ ID NO: 2408318 - DNA, 19 bp, Homo sapiens
ctttgggaatatttgaatc

SEQ ID NO: 2408319 - DNA, 15 bp, Homo sapiens
ctttgtaatgaaaac

SEQ ID NO: 2408320 - DNA, 13 bp, Homo sapiens
ctttgtgcattct

SEQ ID NO: 2408321 - DNA, 17 bp, Homo sapiens
cttttaaaccattttct

SEQ ID NO: 2408322 - DNA, 16 bp, Homo sapiens
cttttacttttcttct

SEQ ID NO: 2408323 - DNA, 18 bp, Homo sapiens
cttttatgtgaaacatgt

SEQ ID NO: 2408324 - DNA, 19 bp, Homo sapiens
cttttcttctattgcctct

SEQ ID NO: 2408325 - DNA, 23 bp, Homo sapiens
cttttcttctattgcctctgaga

SEQ ID NO: 2408326 - DNA, 15 bp, Homo sapiens
cttttggcattttac

SEQ ID NO: 2408327 - DNA, 18 bp, Homo sapiens
cttttttaaatgaagaaa

SEQ ID NO: 2408328 - DNA, 22 bp, Homo sapiens
gaaaacaataacgataaaagac

SEQ ID NO: 2408329 - DNA, 22 bp, Homo sapiens
gaaaacttgtattatgtgtgtt

SEQ ID NO: 2408330 - DNA, 21 bp, Homo sapiens
gaaaagggagattcagactgt

SEQ ID NO: 2408331 - DNA, 15 bp, Homo sapiens
gaaaataaagaatgg

SEQ ID NO: 2408332 - DNA, 16 bp, Homo sapiens
gaaaatgaatccctct

SEQ ID NO: 2408333 - DNA, 14 bp, Homo sapiens
gaaaattaacatga

SEQ ID NO: 2408334 - DNA, 16 bp, Homo sapiens
gaaactgacacatgct

SEQ ID NO: 2408335 - DNA, 15 bp, Homo sapiens
gaaagaagaaggtgg

SEQ ID NO: 2408336 - DNA, 12 bp, Homo sapiens
gaaagcatttga

SEQ ID NO: 2408337 - DNA, 16 bp, Homo sapiens
gaaagcatttgaatgc

SEQ ID NO: 2408338 - DNA, 20 bp, Homo sapiens
gaaagcatttgaatgcattt

SEQ ID NO: 2408339 - DNA, 18 bp, Homo sapiens
gaaagcttcagtgctgcc

SEQ ID NO: 2408340 - DNA, 14 bp, Homo sapiens
gaaaggcctttaaa

SEQ ID NO: 2408341 - DNA, 15 bp, Homo sapiens
gaaaggcctttaaaa

SEQ ID NO: 2408342 - DNA, 20 bp, Homo sapiens
gaaagggattttcagccctc

SEQ ID NO: 2408343 - DNA, 14 bp, Homo sapiens
gaaagtcattggct

SEQ ID NO: 2408344 - DNA, 21 bp, Homo sapiens
gaaagtgatatcccccagcct

SEQ ID NO: 2408345 - DNA, 17 bp, Homo sapiens
gaaatacagattttgat

SEQ ID NO: 2408346 - DNA, 19 bp, Homo sapiens
gaaatatcttcacttgtca

SEQ ID NO: 2408347 - DNA, 13 bp, Homo sapiens
gaaatggttgtat

SEQ ID NO: 2408348 - DNA, 14 bp, Homo sapiens
gaaatggttgtatt

SEQ ID NO: 2408349 - DNA, 20 bp, Homo sapiens
gaaatggttgtattagatgt

SEQ ID NO: 2408350 - DNA, 15 bp, Homo sapiens
gaaattgattttgaa

SEQ ID NO: 2408351 - DNA, 22 bp, Homo sapiens
gaaatttatttcctagttctgt

SEQ ID NO: 2408352 - DNA, 14 bp, Homo sapiens
gaacatccctcctg

SEQ ID NO: 2408353 - DNA, 16 bp, Homo sapiens
gaacctgatgaaaata

SEQ ID NO: 2408354 - DNA, 21 bp, Homo sapiens
gaactcatctaggtaaattac

SEQ ID NO: 2408355 - DNA, 20 bp, Homo sapiens
gaactggaccctgttgctaa

SEQ ID NO: 2408356 - DNA, 23 bp, Homo sapiens
gaactggaccctgttgctaagcc

SEQ ID NO: 2408357 - DNA, 21 bp, Homo sapiens
gaacttgtaaaggaatttaaa

SEQ ID NO: 2408358 - DNA, 16 bp, Homo sapiens
gaactttttattgatt

SEQ ID NO: 2408359 - DNA, 16 bp, Homo sapiens
gaagaaggtgggagga

SEQ ID NO: 2408360 - DNA, 12 bp, Homo sapiens
gaagacagtggc

SEQ ID NO: 2408361 - DNA, 10 bp, Homo sapiens
gaagaggact

SEQ ID NO: 2408362 - DNA, 14 bp, Homo sapiens
gaagatatttttcc

SEQ ID NO: 2408363 - DNA, 22 bp, Homo sapiens
gaagattgagatgtgttcacaa

SEQ ID NO: 2408364 - DNA, 18 bp, Homo sapiens
gaagcccctgggcccagt

SEQ ID NO: 2408365 - DNA, 14 bp, Homo sapiens
gaaggtgggaggat

SEQ ID NO: 2408366 - DNA, 21 bp, Homo sapiens
gaagtacccgttcacattttt

SEQ ID NO: 2408367 - DNA, 12 bp, Homo sapiens
gaagtgagacct

SEQ ID NO: 2408368 - DNA, 12 bp, Homo sapiens
gaagtttgaatg

SEQ ID NO: 2408369 - DNA, 14 bp, Homo sapiens
gaatactttataaa

SEQ ID NO: 2408370 - DNA, 11 bp, Homo sapiens
gaatatgcctt

SEQ ID NO: 2408371 - DNA, 14 bp, Homo sapiens
gaatatttgaatct

SEQ ID NO: 2408372 - DNA, 23 bp, Homo sapiens
gaatcagagaccttccagaaata

SEQ ID NO: 2408373 - DNA, 14 bp, Homo sapiens
gaatcttgtctcaa

SEQ ID NO: 2408374 - DNA, 18 bp, Homo sapiens
gaatcttgtctcaatgct

SEQ ID NO: 2408375 - DNA, 14 bp, Homo sapiens
gaatgcattttgtt

SEQ ID NO: 2408376 - DNA, 20 bp, Homo sapiens
gaattataactggaaagaag

SEQ ID NO: 2408377 - DNA, 14 bp, Homo sapiens
gaattgcagagtac

SEQ ID NO: 2408378 - DNA, 15 bp, Homo sapiens
gaattgtgtttataa

SEQ ID NO: 2408379 - DNA, 23 bp, Homo sapiens
gaattgtgtttataattttaaat

SEQ ID NO: 2408380 - DNA, 16 bp, Homo sapiens
gaattttttttaacat

SEQ ID NO: 2408381 - DNA, 17 bp, Homo sapiens
gaattttttttaacatt

SEQ ID NO: 2408382 - DNA, 21 bp, Homo sapiens
gacagcccaggatactggcac

SEQ ID NO: 2408383 - DNA, 12 bp, Homo sapiens
gacatcaaaatc

SEQ ID NO: 2408384 - DNA, 13 bp, Homo sapiens
gaccaccaagcct

SEQ ID NO: 2408385 - DNA, 17 bp, Homo sapiens
gaccagcaggctggcct

SEQ ID NO: 2408386 - DNA, 20 bp, Homo sapiens
gaccctatgggtctaggaca

SEQ ID NO: 2408387 - DNA, 16 bp, Homo sapiens
gacccttattgctgtc

SEQ ID NO: 2408388 - DNA, 18 bp, Homo sapiens
gacctcaggcaatctgcc

SEQ ID NO: 2408389 - DNA, 18 bp, Homo sapiens
gactaaaagatataagtg

SEQ ID NO: 2408390 - DNA, 21 bp, Homo sapiens
gactattcttgatgtaaaatc

SEQ ID NO: 2408391 - DNA, 21 bp, Homo sapiens
gactcatctttccctccttgg

SEQ ID NO: 2408392 - DNA, 11 bp, Homo sapiens
gactgagaaat

SEQ ID NO: 2408393 - DNA, 17 bp, Homo sapiens
gactgtgtgctcaggag

SEQ ID NO: 2408394 - DNA, 14 bp, Homo sapiens
gacttacatgattc

SEQ ID NO: 2408395 - DNA, 15 bp, Homo sapiens
gacttacatgattca

SEQ ID NO: 2408396 - DNA, 16 bp, Homo sapiens
gacttacatgattcat

SEQ ID NO: 2408397 - DNA, 19 bp, Homo sapiens
gacttacatgattcatttt

SEQ ID NO: 2408398 - DNA, 12 bp, Homo sapiens
gagagacttgtt

SEQ ID NO: 2408399 - DNA, 20 bp, Homo sapiens
gagagacttgttttggatgc

SEQ ID NO: 2408400 - DNA, 13 bp, Homo sapiens
gagagagctggag

SEQ ID NO: 2408401 - DNA, 16 bp, Homo sapiens
gagagagttgaaccta

SEQ ID NO: 2408402 - DNA, 14 bp, Homo sapiens
gagagggaatgtga

SEQ ID NO: 2408403 - DNA, 17 bp, Homo sapiens
gagaggttgtctgtggc

SEQ ID NO: 2408404 - DNA, 14 bp, Homo sapiens
gagagtggctgggg

SEQ ID NO: 2408405 - DNA, 21 bp, Homo sapiens
gagatcaccagtgtgtggctt

SEQ ID NO: 2408406 - DNA, 15 bp, Homo sapiens
gagatccttatcgaa

SEQ ID NO: 2408407 - DNA, 14 bp, Homo sapiens
gagatgtagcccct

SEQ ID NO: 2408408 - DNA, 12 bp, Homo sapiens
gagatttttcat

SEQ ID NO: 2408409 - DNA, 20 bp, Homo sapiens
gagcaagaccccatctcaaa

SEQ ID NO: 2408410 - DNA, 17 bp, Homo sapiens
gagccccaccctcagat

SEQ ID NO: 2408411 - DNA, 12 bp, Homo sapiens
gagccctgtctc

SEQ ID NO: 2408412 - DNA, 21 bp, Homo sapiens
gagcgcacagggagtgcacat

SEQ ID NO: 2408413 - DNA, 12 bp, Homo sapiens
gagctacaaatg

SEQ ID NO: 2408414 - DNA, 18 bp, Homo sapiens
gagctacccgcagagttc

SEQ ID NO: 2408415 - DNA, 23 bp, Homo sapiens
gagctcaggatgagggaaaagaa

SEQ ID NO: 2408416 - DNA, 21 bp, Homo sapiens
gagctcttgtgaggaaagtca

SEQ ID NO: 2408417 - DNA, 17 bp, Homo sapiens
gagctgggcagaaggcc

SEQ ID NO: 2408418 - DNA, 18 bp, Homo sapiens
gaggaaagtcattggctt

SEQ ID NO: 2408419 - DNA, 20 bp, Homo sapiens
gaggcctgactgccaagcca

SEQ ID NO: 2408420 - DNA, 17 bp, Homo sapiens
gaggctgttcccaccag

SEQ ID NO: 2408421 - DNA, 14 bp, Homo sapiens
gaggcttccttcat

SEQ ID NO: 2408422 - DNA, 14 bp, Homo sapiens
gaggtggctgggtt

SEQ ID NO: 2408423 - DNA, 22 bp, Homo sapiens
gagtaatccaagcaaatgtgaa

SEQ ID NO: 2408424 - DNA, 17 bp, Homo sapiens
gagtagaaaggccttta

SEQ ID NO: 2408425 - DNA, 23 bp, Homo sapiens
gagtagaaaggcctttaaaattt

SEQ ID NO: 2408426 - DNA, 15 bp, Homo sapiens
gagtgcgtggtgcga

SEQ ID NO: 2408427 - DNA, 18 bp, Homo sapiens
taatccccttctcccctg

SEQ ID NO: 2408428 - DNA, 17 bp, Homo sapiens
taatcccgattcaccct

SEQ ID NO: 2408429 - DNA, 15 bp, Homo sapiens
taatctgcctccctc

SEQ ID NO: 2408430 - DNA, 15 bp, Homo sapiens
taatgaagtttgaat

SEQ ID NO: 2408431 - DNA, 19 bp, Homo sapiens
taatgaagtttgaatgtta

SEQ ID NO: 2408432 - DNA, 13 bp, Homo sapiens
taatgtgatatta

SEQ ID NO: 2408433 - DNA, 17 bp, Homo sapiens
taatgttaatattgatt

SEQ ID NO: 2408434 - DNA, 20 bp, Homo sapiens
taatgttgtatgtcttgttt

SEQ ID NO: 2408435 - DNA, 15 bp, Homo sapiens
taattagtgctaagt

SEQ ID NO: 2408436 - DNA, 20 bp, Homo sapiens
taattagtgctaagtgtgaa

SEQ ID NO: 2408437 - DNA, 21 bp, Homo sapiens
taattagtgctaagtgtgaac

SEQ ID NO: 2408438 - DNA, 14 bp, Homo sapiens
taattccttcagca

SEQ ID NO: 2408439 - DNA, 21 bp, Homo sapiens
taattccttcagcactttaga

SEQ ID NO: 2408440 - DNA, 15 bp, Homo sapiens
taattctatgagata

SEQ ID NO: 2408441 - DNA, 17 bp, Homo sapiens
taatttttcacttcaaa

SEQ ID NO: 2408442 - DNA, 16 bp, Homo sapiens
tacaataattctatga

SEQ ID NO: 2408443 - DNA, 18 bp, Homo sapiens
tacacaatagaattataa

SEQ ID NO: 2408444 - DNA, 18 bp, Homo sapiens
tacacagaaatacagtta

SEQ ID NO: 2408445 - DNA, 22 bp, Homo sapiens
tacacagatcacagcttcagcc

SEQ ID NO: 2408446 - DNA, 21 bp, Homo sapiens
tacacatgtatctatgcattt

SEQ ID NO: 2408447 - DNA, 21 bp, Homo sapiens
tacacctatgtcatttcattt

SEQ ID NO: 2408448 - DNA, 17 bp, Homo sapiens
tacagattttgatagca

SEQ ID NO: 2408449 - DNA, 18 bp, Homo sapiens
tacagattttgatagcaa

SEQ ID NO: 2408450 - DNA, 14 bp, Homo sapiens
tacatcatttcttt

SEQ ID NO: 2408451 - DNA, 18 bp, Homo sapiens
tacatgaattgcatttta

SEQ ID NO: 2408452 - DNA, 14 bp, Homo sapiens
tacatgcatacact

SEQ ID NO: 2408453 - DNA, 20 bp, Homo sapiens
tacatgcatacactctcaaa

SEQ ID NO: 2408454 - DNA, 16 bp, Homo sapiens
tacatgtggcccaaca

SEQ ID NO: 2408455 - DNA, 18 bp, Homo sapiens
taccacaatgcagtgcct

SEQ ID NO: 2408456 - DNA, 16 bp, Homo sapiens
taccatatacagctca

SEQ ID NO: 2408457 - DNA, 14 bp, Homo sapiens
tacccgcagagttc

SEQ ID NO: 2408458 - DNA, 17 bp, Homo sapiens
tacccgttcacattttt

SEQ ID NO: 2408459 - DNA, 17 bp, Homo sapiens
tacctgctcagccctgc

SEQ ID NO: 2408460 - DNA, 19 bp, Homo sapiens
tactatttaactgactatt

SEQ ID NO: 2408461 - DNA, 13 bp, Homo sapiens
tactgcatgcact

SEQ ID NO: 2408462 - DNA, 23 bp, Homo sapiens
tactgggaaagggattttcagcc

SEQ ID NO: 2408463 - DNA, 19 bp, Homo sapiens
tactgtaaggcaatcatgg

SEQ ID NO: 2408464 - DNA, 19 bp, Homo sapiens
tactgtacagacagaaaaa

SEQ ID NO: 2408465 - DNA, 19 bp, Homo sapiens
tacttgctcttgatgcctg

SEQ ID NO: 2408466 - DNA, 21 bp, Homo sapiens
tacttgctcttgatgcctggc

SEQ ID NO: 2408467 - DNA, 16 bp, Homo sapiens
tacttgtggactaaaa

SEQ ID NO: 2408468 - DNA, 23 bp, Homo sapiens
tacttgtggactaaaagatataa

SEQ ID NO: 2408469 - DNA, 17 bp, Homo sapiens
tactttatgttactaca

SEQ ID NO: 2408470 - DNA, 22 bp, Homo sapiens
tagaaaatttaaaacattactc

SEQ ID NO: 2408471 - DNA, 15 bp, Homo sapiens
tagaaagaagatgaa

SEQ ID NO: 2408472 - DNA, 14 bp, Homo sapiens
tagaaagcatttga

SEQ ID NO: 2408473 - DNA, 15 bp, Homo sapiens
tagaaagcatttgaa

SEQ ID NO: 2408474 - DNA, 15 bp, Homo sapiens
tagaaaggcctttaa

SEQ ID NO: 2408475 - DNA, 13 bp, Homo sapiens
tagaatatgcctt

SEQ ID NO: 2408476 - DNA, 14 bp, Homo sapiens
tagaccaagcttgt

SEQ ID NO: 2408477 - DNA, 18 bp, Homo sapiens
tagaccaagcttgtccaa

SEQ ID NO: 2408478 - DNA, 19 bp, Homo sapiens
tagaggcttccttcatttc

SEQ ID NO: 2408479 - DNA, 15 bp, Homo sapiens
tagagttagactgtt

SEQ ID NO: 2408480 - DNA, 14 bp, Homo sapiens
tagatgttctctat

SEQ ID NO: 2408481 - DNA, 18 bp, Homo sapiens
tagatgttctctatcatt

SEQ ID NO: 2408482 - DNA, 21 bp, Homo sapiens
tagatgttctctatcatttaa

SEQ ID NO: 2408483 - DNA, 23 bp, Homo sapiens
tagatgttctctatcatttaata

SEQ ID NO: 2408484 - DNA, 16 bp, Homo sapiens
tagcaaagatatctca

SEQ ID NO: 2408485 - DNA, 16 bp, Homo sapiens
tagcatatctgccttt

SEQ ID NO: 2408486 - DNA, 18 bp, Homo sapiens
tagccaatatttttctta

SEQ ID NO: 2408487 - DNA, 20 bp, Homo sapiens
tagccttctctgttcatttc

SEQ ID NO: 2408488 - DNA, 22 bp, Homo sapiens
tagccttctctgttcatttcct

SEQ ID NO: 2408489 - DNA, 16 bp, Homo sapiens
tagctgtgacctctcc

SEQ ID NO: 2408490 - DNA, 12 bp, Homo sapiens
taggagcatgag

SEQ ID NO: 2408491 - DNA, 23 bp, Homo sapiens
taggccttgcggctcctcaggga

SEQ ID NO: 2408492 - DNA, 15 bp, Homo sapiens
taggtctcaatacct

SEQ ID NO: 2408493 - DNA, 21 bp, Homo sapiens
taggtcttaatacacacagtt

SEQ ID NO: 2408494 - DNA, 14 bp, Homo sapiens
tagtactaactcct

SEQ ID NO: 2408495 - DNA, 12 bp, Homo sapiens
tagtcgtgagct

SEQ ID NO: 2408496 - DNA, 13 bp, Homo sapiens
tagtgctaagtgt

SEQ ID NO: 2408497 - DNA, 14 bp, Homo sapiens
tagtgctaagtgtg

SEQ ID NO: 2408498 - DNA, 16 bp, Homo sapiens
tagttctgtagaaatg

SEQ ID NO: 2408499 - DNA, 12 bp, Homo sapiens
tagttgaatttt

SEQ ID NO: 2408500 - DNA, 20 bp, Homo sapiens
tagtttctgagttttaccaa

SEQ ID NO: 2408501 - DNA, 15 bp, Homo sapiens
tagtttttatatgtt

SEQ ID NO: 2408502 - DNA, 20 bp, Homo sapiens
tataaaaataaaaaacactg

SEQ ID NO: 2408503 - DNA, 22 bp, Homo sapiens
tataaaaataaaaaagatccca

SEQ ID NO: 2408504 - DNA, 20 bp, Homo sapiens
tataaaagatggggtctgta

SEQ ID NO: 2408505 - DNA, 19 bp, Homo sapiens
tataaaagcctgtttaaga

SEQ ID NO: 2408506 - DNA, 14 bp, Homo sapiens
tataaaatcagcca

SEQ ID NO: 2408507 - DNA, 19 bp, Homo sapiens
tataaaatcagccaattat

SEQ ID NO: 2408508 - DNA, 14 bp, Homo sapiens
tataagcttttctt

SEQ ID NO: 2408509 - DNA, 13 bp, Homo sapiens
tataagtgctgta

SEQ ID NO: 2408510 - DNA, 15 bp, Homo sapiens
tataagtgctgtata

SEQ ID NO: 2408511 - DNA, 16 bp, Homo sapiens
tataagtgctgtataa

SEQ ID NO: 2408512 - DNA, 21 bp, Homo sapiens
tataagtgctgtataaaatca

SEQ ID NO: 2408513 - DNA, 23 bp, Homo sapiens
tataagtgtgtgtttttcataaa

SEQ ID NO: 2408514 - DNA, 16 bp, Homo sapiens
tataataaatgtacct

SEQ ID NO: 2408515 - DNA, 15 bp, Homo sapiens
tataattcacattgt

SEQ ID NO: 2408516 - DNA, 20 bp, Homo sapiens
tataattcacattgtattca

SEQ ID NO: 2408517 - DNA, 17 bp, Homo sapiens
tatactcactttctaga

SEQ ID NO: 2408518 - DNA, 17 bp, Homo sapiens
tatacttgtggactaaa

SEQ ID NO: 2408519 - DNA, 22 bp, Homo sapiens
tatacttgtggactaaaagata

SEQ ID NO: 2408520 - DNA, 16 bp, Homo sapiens
tatatatagcagcttt

SEQ ID NO: 2408521 - DNA, 16 bp, Homo sapiens
tatattgataagatct

SEQ ID NO: 2408522 - DNA, 19 bp, Homo sapiens
tatcaataaatagaccatt

SEQ ID NO: 2408523 - DNA, 21 bp, Homo sapiens
tatcatatatatacatacatg

SEQ ID NO: 2408524 - DNA, 14 bp, Homo sapiens
tatcatttaataat

SEQ ID NO: 2408525 - DNA, 18 bp, Homo sapiens
tatcatttaataatatac

SEQ ID NO: 2408526 - DNA, 19 bp, Homo sapiens
tatcatttaataatatact

SEQ ID NO: 2408527 - DNA, 21 bp, Homo sapiens
tatcatttaataatatacttg

SEQ ID NO: 2408528 - DNA, 15 bp, Homo sapiens
tatccaggcaccagg

SEQ ID NO: 2408529 - DNA, 23 bp, Homo sapiens
tatcctctttagagttagactgt

SEQ ID NO: 2408530 - DNA, 18 bp, Homo sapiens
tatcgtaaaattaagaaa

SEQ ID NO: 2408531 - DNA, 13 bp, Homo sapiens
tatctaatcatga

SEQ ID NO: 2408532 - DNA, 22 bp, Homo sapiens
tatctagtttaattaatctgta

SEQ ID NO: 2408533 - DNA, 11 bp, Homo sapiens
tatctcatctc

SEQ ID NO: 2408534 - DNA, 21 bp, Homo sapiens
tatctgaggcacatgtcagca

SEQ ID NO: 2408535 - DNA, 20 bp, Homo sapiens
tatctgcctttattgtgttt

SEQ ID NO: 2408536 - DNA, 15 bp, Homo sapiens
tatcttgaataatgt

SEQ ID NO: 2408537 - DNA, 23 bp, Homo sapiens
tatcttttcatacattttctaag

SEQ ID NO: 2408538 - DNA, 20 bp, Homo sapiens
tatgaagcttttatgtgaaa

SEQ ID NO: 2408539 - DNA, 22 bp, Homo sapiens
tatgaagcttttatgtgaaaca

SEQ ID NO: 2408540 - DNA, 23 bp, Homo sapiens
tatgaagcttttatgtgaaacat

SEQ ID NO: 2408541 - DNA, 20 bp, Homo sapiens
tatgaagttttttttataca

SEQ ID NO: 2408542 - DNA, 12 bp, Homo sapiens
tatgaataacat

SEQ ID NO: 2408543 - DNA, 21 bp, Homo sapiens
tatgatgggtgtttttagcag

SEQ ID NO: 2408544 - DNA, 16 bp, Homo sapiens
tatgcctctgtattta

SEQ ID NO: 2408545 - DNA, 17 bp, Homo sapiens
tatgtgaaacatgtttc

SEQ ID NO: 2408546 - DNA, 19 bp, Homo sapiens
tatgtgccagatttatgca

SEQ ID NO: 2408547 - DNA, 23 bp, Homo sapiens
tatgtgccagatttatgcatatt

SEQ ID NO: 2408548 - DNA, 12 bp, Homo sapiens
tatgttgcatag

SEQ ID NO: 2408549 - DNA, 14 bp, Homo sapiens
tattagatgttctc

SEQ ID NO: 2408550 - DNA, 17 bp, Homo sapiens
tattagatgttctctat

SEQ ID NO: 2408551 - DNA, 14 bp, Homo sapiens
tattcaataaagta

SEQ ID NO: 2408552 - DNA, 17 bp, Homo sapiens
tattcaataaagtattt

SEQ ID NO: 2408553 - DNA, 19 bp, Homo sapiens
tattcaataaagtatttaa

SEQ ID NO: 2408554 - DNA, 19 bp, Homo sapiens
tattcagctttagtagata

SEQ ID NO: 2408555 - DNA, 14 bp, Homo sapiens
tattcataattatt

SEQ ID NO: 2408556 - DNA, 17 bp, Homo sapiens
tattcgttatctaatag

SEQ ID NO: 2408557 - DNA, 19 bp, Homo sapiens
tgagacagaatctcagtct

SEQ ID NO: 2408558 - DNA, 20 bp, Homo sapiens
tgagagcatcaggcctagag

SEQ ID NO: 2408559 - DNA, 15 bp, Homo sapiens
tgagagttttggatg

SEQ ID NO: 2408560 - DNA, 17 bp, Homo sapiens
tgagagttttggatgca

SEQ ID NO: 2408561 - DNA, 22 bp, Homo sapiens
tgagataatgtgatattataca

SEQ ID NO: 2408562 - DNA, 22 bp, Homo sapiens
tgagctcttgtgaggaaagtca

SEQ ID NO: 2408563 - DNA, 23 bp, Homo sapiens
tgagctcttgtgaggaaagtcat

SEQ ID NO: 2408564 - DNA, 16 bp, Homo sapiens
tgaggagcttgaaacc

SEQ ID NO: 2408565 - DNA, 22 bp, Homo sapiens
tgagtaactgatttgtaacaag

SEQ ID NO: 2408566 - DNA, 12 bp, Homo sapiens
tgataagatctt

SEQ ID NO: 2408567 - DNA, 15 bp, Homo sapiens
tgataagatctttta

SEQ ID NO: 2408568 - DNA, 22 bp, Homo sapiens
tgataagatcttttattttgcc

SEQ ID NO: 2408569 - DNA, 13 bp, Homo sapiens
tgatccagaaaga

SEQ ID NO: 2408570 - DNA, 20 bp, Homo sapiens
tgatccccacgccacagccc

SEQ ID NO: 2408571 - DNA, 18 bp, Homo sapiens
tgatctcagctcactgca

SEQ ID NO: 2408572 - DNA, 12 bp, Homo sapiens
tgatgaaaataa

SEQ ID NO: 2408573 - DNA, 16 bp, Homo sapiens
tgatgaaaataaagaa

SEQ ID NO: 2408574 - DNA, 14 bp, Homo sapiens
tgatgggatttggt

SEQ ID NO: 2408575 - DNA, 21 bp, Homo sapiens
tgatggttgtacatataagtg

SEQ ID NO: 2408576 - DNA, 16 bp, Homo sapiens
tgatgtaaaatcttgt

SEQ ID NO: 2408577 - DNA, 23 bp, Homo sapiens
tgatgtaaaatcttgtcatgtgt

SEQ ID NO: 2408578 - DNA, 20 bp, Homo sapiens
tgattcattttaacatctga

SEQ ID NO: 2408579 - DNA, 22 bp, Homo sapiens
tgattcattttaacatctgaga

SEQ ID NO: 2408580 - DNA, 15 bp, Homo sapiens
tgattccagccatca

SEQ ID NO: 2408581 - DNA, 16 bp, Homo sapiens
tgatttacgctcattg

SEQ ID NO: 2408582 - DNA, 17 bp, Homo sapiens
tgatttagcaggaagct

SEQ ID NO: 2408583 - DNA, 20 bp, Homo sapiens
tgatttagcaggaagctgtg

SEQ ID NO: 2408584 - DNA, 23 bp, Homo sapiens
tgattttgaacctgatgaaaata

SEQ ID NO: 2408585 - DNA, 19 bp, Homo sapiens
tgcaacctccacctcctgg

SEQ ID NO: 2408586 - DNA, 14 bp, Homo sapiens
tgcaacctctgcct

SEQ ID NO: 2408587 - DNA, 22 bp, Homo sapiens
tgcaccatgctgctggggaaga

SEQ ID NO: 2408588 - DNA, 23 bp, Homo sapiens
tgcaccatgctgctggggaagac

SEQ ID NO: 2408589 - DNA, 16 bp, Homo sapiens
tgcacgcacactgtct

SEQ ID NO: 2408590 - DNA, 17 bp, Homo sapiens
tgcacgcacactgtctg

SEQ ID NO: 2408591 - DNA, 19 bp, Homo sapiens
tgcacgcacactgtctgcc

SEQ ID NO: 2408592 - DNA, 21 bp, Homo sapiens
tgcactgatgttgtgttttta

SEQ ID NO: 2408593 - DNA, 14 bp, Homo sapiens
tgcactgtaaaatg

SEQ ID NO: 2408594 - DNA, 14 bp, Homo sapiens
tgcacttcttacaa

SEQ ID NO: 2408595 - DNA, 19 bp, Homo sapiens
tgcagctgagagaaaataa

SEQ ID NO: 2408596 - DNA, 14 bp, Homo sapiens
tgcaggcaggaaca

SEQ ID NO: 2408597 - DNA, 19 bp, Homo sapiens
tgcaggcaggaacaaacag

SEQ ID NO: 2408598 - DNA, 12 bp, Homo sapiens
tgcaggtcccta

SEQ ID NO: 2408599 - DNA, 21 bp, Homo sapiens
tgcagtgctcgctgttgctga

SEQ ID NO: 2408600 - DNA, 23 bp, Homo sapiens
tgcagtgctcgctgttgctgaat

SEQ ID NO: 2408601 - DNA, 23 bp, Homo sapiens
tgcataacgtataaaagcctgtt

SEQ ID NO: 2408602 - DNA, 15 bp, Homo sapiens
tgcattactgcatgc

SEQ ID NO: 2408603 - DNA, 17 bp, Homo sapiens
tgcattactgcatgcac

SEQ ID NO: 2408604 - DNA, 18 bp, Homo sapiens
tgcattactgcatgcact

SEQ ID NO: 2408605 - DNA, 12 bp, Homo sapiens
tgcattgtgctt

SEQ ID NO: 2408606 - DNA, 13 bp, Homo sapiens
tgcattgtgcttc

SEQ ID NO: 2408607 - DNA, 19 bp, Homo sapiens
tgcatttatgagctcttca

SEQ ID NO: 2408608 - DNA, 17 bp, Homo sapiens
tgccaaatataaataaa

SEQ ID NO: 2408609 - DNA, 22 bp, Homo sapiens
tgccaaatataaataaaaataa

SEQ ID NO: 2408610 - DNA, 17 bp, Homo sapiens
tgccaggctggagtgca

SEQ ID NO: 2408611 - DNA, 20 bp, Homo sapiens
tgccaggctggagtgcagtg

SEQ ID NO: 2408612 - DNA, 15 bp, Homo sapiens
tgccagttgtcctcc

SEQ ID NO: 2408613 - DNA, 15 bp, Homo sapiens
tgccatattgcacat

SEQ ID NO: 2408614 - DNA, 20 bp, Homo sapiens
tgccatgtagggttccctta

SEQ ID NO: 2408615 - DNA, 16 bp, Homo sapiens
tgcccccagagccaca

SEQ ID NO: 2408616 - DNA, 23 bp, Homo sapiens
tgccccctaatccccttctcccc

SEQ ID NO: 2408617 - DNA, 22 bp, Homo sapiens
tgccctccccctcctctccacc

SEQ ID NO: 2408618 - DNA, 13 bp, Homo sapiens
tgcctaagccctc

SEQ ID NO: 2408619 - DNA, 12 bp, Homo sapiens
tgcctctctgca

SEQ ID NO: 2408620 - DNA, 18 bp, Homo sapiens
tgcctctctgcaggtccc

SEQ ID NO: 2408621 - DNA, 19 bp, Homo sapiens
tgcctctctgcaggtccct

SEQ ID NO: 2408622 - DNA, 21 bp, Homo sapiens
tgcctctctgcaggtccctaa

SEQ ID NO: 2408623 - DNA, 22 bp, Homo sapiens
tgcctctgagagcatcaggcct

SEQ ID NO: 2408624 - DNA, 21 bp, Homo sapiens
tgcctgctttttatggcctgt

SEQ ID NO: 2408625 - DNA, 20 bp, Homo sapiens
tgcctggaagagcagcccta

SEQ ID NO: 2408626 - DNA, 12 bp, Homo sapiens
tgccttcatttg

SEQ ID NO: 2408627 - DNA, 21 bp, Homo sapiens
tgcctttattgtgtttgtcat

SEQ ID NO: 2408628 - DNA, 15 bp, Homo sapiens
tgctaagccccagca

SEQ ID NO: 2408629 - DNA, 20 bp, Homo sapiens
tgctaagccccagcaagcaa

SEQ ID NO: 2408630 - DNA, 16 bp, Homo sapiens
tgctaagtgtgaactg

SEQ ID NO: 2408631 - DNA, 20 bp, Homo sapiens
tgctaattttgaaaaactgc

SEQ ID NO: 2408632 - DNA, 20 bp, Homo sapiens
tgctatgttttgacattttt

SEQ ID NO: 2408633 - DNA, 20 bp, Homo sapiens
tgctcaggagccctgggagg

SEQ ID NO: 2408634 - DNA, 14 bp, Homo sapiens
tgctcgctgttgct

SEQ ID NO: 2408635 - DNA, 15 bp, Homo sapiens
tgctcgctgttgctg

SEQ ID NO: 2408636 - DNA, 18 bp, Homo sapiens
tgctcgctgttgctgaat

SEQ ID NO: 2408637 - DNA, 20 bp, Homo sapiens
tgctctatgtgcttgtaaaa

SEQ ID NO: 2408638 - DNA, 15 bp, Homo sapiens
tgctgatggagcctt

SEQ ID NO: 2408639 - DNA, 23 bp, Homo sapiens
tgctgccctccccctcctctcca

SEQ ID NO: 2408640 - DNA, 19 bp, Homo sapiens
tgctgctggggaagacagt

SEQ ID NO: 2408641 - DNA, 21 bp, Homo sapiens
tgctgctggggaagacagtgg

SEQ ID NO: 2408642 - DNA, 22 bp, Homo sapiens
tgctgctggggaagacagtggc

SEQ ID NO: 2408643 - DNA, 16 bp, Homo sapiens
tgctgggcccctgcct

SEQ ID NO: 2408644 - DNA, 24 bp, Homo sapiens
tgctgggcccctgcctctctgcag

SEQ ID NO: 2408645 - DNA, 14 bp, Homo sapiens
tgcttcatcccttt

SEQ ID NO: 2408646 - DNA, 22 bp, Homo sapiens
tggaataatcctaaacatatga

SEQ ID NO: 2408647 - DNA, 13 bp, Homo sapiens
tggactaaaagat

SEQ ID NO: 2408648 - DNA, 14 bp, Homo sapiens
tggactaaaagata

SEQ ID NO: 2408649 - DNA, 15 bp, Homo sapiens
tggactaaaagatat

SEQ ID NO: 2408650 - DNA, 16 bp, Homo sapiens
tggagagggaatgtga

SEQ ID NO: 2408651 - DNA, 17 bp, Homo sapiens
tggagagggaatgtgaa

SEQ ID NO: 2408652 - DNA, 18 bp, Homo sapiens
tggagagggaatgtgaaa

SEQ ID NO: 2408653 - DNA, 23 bp, Homo sapiens
tggagatcaccagtgtgtggctt

SEQ ID NO: 2408654 - DNA, 19 bp, Homo sapiens
tggagcccactgtacttgc

SEQ ID NO: 2408655 - DNA, 14 bp, Homo sapiens
tggagttgaaaatc

SEQ ID NO: 2408656 - DNA, 19 bp, Homo sapiens
tggatcaaatccagcctgc

SEQ ID NO: 2408657 - DNA, 17 bp, Homo sapiens
tggatcctgtgtggaga

SEQ ID NO: 2408658 - DNA, 22 bp, Homo sapiens
tggatgatccccacgccacagc

SEQ ID NO: 2408659 - DNA, 13 bp, Homo sapiens
tggatttttacca

SEQ ID NO: 2408660 - DNA, 21 bp, Homo sapiens
tggcaaagccttcattgcctt

SEQ ID NO: 2408661 - DNA, 16 bp, Homo sapiens
tggcaaccagaccatt

SEQ ID NO: 2408662 - DNA, 17 bp, Homo sapiens
tggcaagggttcacctg

SEQ ID NO: 2408663 - DNA, 18 bp, Homo sapiens
tggcatcatctcagctca

SEQ ID NO: 2408664 - DNA, 16 bp, Homo sapiens
tggccatgggaggcct

SEQ ID NO: 2408665 - DNA, 18 bp, Homo sapiens
tggccttgtaagaccctt

SEQ ID NO: 2408666 - DNA, 18 bp, Homo sapiens
tggcgcgatctcagctca

SEQ ID NO: 2408667 - DNA, 18 bp, Homo sapiens
tggctgacatgaagctgt

SEQ ID NO: 2408668 - DNA, 14 bp, Homo sapiens
tgggaatatttgaa

SEQ ID NO: 2408669 - DNA, 15 bp, Homo sapiens
tgggaatatttgaat

SEQ ID NO: 2408670 - DNA, 20 bp, Homo sapiens
tgggaatatttgaatcttgt

SEQ ID NO: 2408671 - DNA, 22 bp, Homo sapiens
tgggaatatttgaatcttgtct

SEQ ID NO: 2408672 - DNA, 12 bp, Homo sapiens
tgggagagactt

SEQ ID NO: 2408673 - DNA, 14 bp, Homo sapiens
tgggagagacttgt

SEQ ID NO: 2408674 - DNA, 15 bp, Homo sapiens
tgggagagacttgtt

SEQ ID NO: 2408675 - DNA, 16 bp, Homo sapiens
tgggagctgccaagag

SEQ ID NO: 2408676 - DNA, 17 bp, Homo sapiens
tgggaggctctggagcc

SEQ ID NO: 2408677 - DNA, 19 bp, Homo sapiens
tgggatgagagttttggat

SEQ ID NO: 2408678 - DNA, 15 bp, Homo sapiens
tgggattatgggtca

SEQ ID NO: 2408679 - DNA, 21 bp, Homo sapiens
tgggcagccagaccagcaggc

SEQ ID NO: 2408680 - DNA, 20 bp, Homo sapiens
tgggcccctgcctctctgca

SEQ ID NO: 2408681 - DNA, 13 bp, Homo sapiens
tggggaagacagt

SEQ ID NO: 2408682 - DNA, 20 bp, Homo sapiens
tggggccaggctgggtcgcc

SEQ ID NO: 2408683 - DNA, 22 bp, Homo sapiens
tgggtctaggacacagttcctg

SEQ ID NO: 2408684 - DNA, 15 bp, Homo sapiens
tggtacatggtgttt

SEQ ID NO: 2408685 - DNA, 13 bp, Homo sapiens
tggtattgtattt

SEQ ID NO: 2408686 - DNA, 23 bp, Homo sapiens
agtaaaattgccatattgcacat

SEQ ID NO: 2408687 - DNA, 21 bp, Homo sapiens
agtacctagctggctctgtga

SEQ ID NO: 2408688 - DNA, 17 bp, Homo sapiens
agtagaaaggcctttaa

SEQ ID NO: 2408689 - DNA, 18 bp, Homo sapiens
agtagcaccctggattga

SEQ ID NO: 2408690 - DNA, 22 bp, Homo sapiens
agtatattgatccagaaagaaa

SEQ ID NO: 2408691 - DNA, 16 bp, Homo sapiens
agtatctttttattca

SEQ ID NO: 2408692 - DNA, 13 bp, Homo sapiens
agtatttaattag

SEQ ID NO: 2408693 - DNA, 23 bp, Homo sapiens
atcctctttagagttagactgtt

SEQ ID NO: 2408694 - DNA, 19 bp, Homo sapiens
atcctgatgaggtttctac

SEQ ID NO: 2408695 - DNA, 22 bp, Homo sapiens
atcctgtgtggagagggaatgt

SEQ ID NO: 2408696 - DNA, 20 bp, Homo sapiens
atcgcaccactgtgtattta

SEQ ID NO: 2408697 - DNA, 12 bp, Homo sapiens
atcgtaaaatta

SEQ ID NO: 2408698 - DNA, 13 bp, Homo sapiens
atcgtaaaattaa

SEQ ID NO: 2408699 - DNA, 11 bp, Homo sapiens
atctcacactc

SEQ ID NO: 2408700 - DNA, 16 bp, Homo sapiens
atctccccatcattgg

SEQ ID NO: 2408701 - DNA, 21 bp, Homo sapiens
atctgaccctatgggtctagg

SEQ ID NO: 2408702 - DNA, 21 bp, Homo sapiens
atctggctgcagttttgctat

SEQ ID NO: 2408703 - DNA, 15 bp, Homo sapiens
atcttataatttaaa

SEQ ID NO: 2408704 - DNA, 16 bp, Homo sapiens
atcttgtcatgtgtat

SEQ ID NO: 2408705 - DNA, 17 bp, Homo sapiens
atcttgtccccaacacc

SEQ ID NO: 2408706 - DNA, 14 bp, Homo sapiens
atcttgtctcaatg

SEQ ID NO: 2408707 - DNA, 23 bp, Homo sapiens
atcttgtctcaatgctcataacg

SEQ ID NO: 2408708 - DNA, 14 bp, Homo sapiens
atctttccctcctt

SEQ ID NO: 2408709 - DNA, 21 bp, Homo sapiens
atctttctttcttagaaattt

SEQ ID NO: 2408710 - DNA, 13 bp, Homo sapiens
atctttttattca

SEQ ID NO: 2408711 - DNA, 14 bp, Homo sapiens
atgaaaaaatatat

SEQ ID NO: 2408712 - DNA, 15 bp, Homo sapiens
atgaagcaatgcttc

SEQ ID NO: 2408713 - DNA, 21 bp, Homo sapiens
atgaagcttttatgtgaaaca

SEQ ID NO: 2408714 - DNA, 22 bp, Homo sapiens
atgaagcttttatgtgaaacat

SEQ ID NO: 2408715 - DNA, 15 bp, Homo sapiens
atgaagttgtaggta

SEQ ID NO: 2408716 - DNA, 14 bp, Homo sapiens
atgaagtttgaatg

SEQ ID NO: 2408717 - DNA, 16 bp, Homo sapiens
atgaagtttgaatgtt

SEQ ID NO: 2408718 - DNA, 19 bp, Homo sapiens
atgaagtttgaatgttaaa

SEQ ID NO: 2408719 - DNA, 13 bp, Homo sapiens
atgaatgtaaatt

SEQ ID NO: 2408720 - DNA, 21 bp, Homo sapiens
atgaatgtaaatttgtactat

SEQ ID NO: 2408721 - DNA, 13 bp, Homo sapiens
atgaattgcattt

SEQ ID NO: 2408722 - DNA, 18 bp, Homo sapiens
atgacatcaccacagttt

SEQ ID NO: 2408723 - DNA, 20 bp, Homo sapiens
atgagagttttggatgcagt

SEQ ID NO: 2408724 - DNA, 19 bp, Homo sapiens
atgagtgcgtggtgcgagt

SEQ ID NO: 2408725 - DNA, 22 bp, Homo sapiens
atgagtgcgtggtgcgagtgcg

SEQ ID NO: 2408726 - DNA, 23 bp, Homo sapiens
atgatccccacgccacagccctt

SEQ ID NO: 2408727 - DNA, 18 bp, Homo sapiens
atgatttagagtgctgtc

SEQ ID NO: 2408728 - DNA, 22 bp, Homo sapiens
atgcaaactttattttgtgttt

SEQ ID NO: 2408729 - DNA, 16 bp, Homo sapiens
atgcactgatgttgtg

SEQ ID NO: 2408730 - DNA, 17 bp, Homo sapiens
atgcagtgcctttcttc

SEQ ID NO: 2408731 - DNA, 24 bp, Homo sapiens
atgcagtgctcgctgttgctgaat

SEQ ID NO: 2408732 - DNA, 20 bp, Homo sapiens
atgcatattattttatgttg

SEQ ID NO: 2408733 - DNA, 24 bp, Homo sapiens
atgcatattattttatgttgcata

SEQ ID NO: 2408734 - DNA, 22 bp, Homo sapiens
atgccccctaatccccttctcc

SEQ ID NO: 2408735 - DNA, 17 bp, Homo sapiens
atgcccggctaattttt

SEQ ID NO: 2408736 - DNA, 18 bp, Homo sapiens
atgccttgtttcatattt

SEQ ID NO: 2408737 - DNA, 21 bp, Homo sapiens
atgcctttgtactttagggaa

SEQ ID NO: 2408738 - DNA, 13 bp, Homo sapiens
atgctgctgggga

SEQ ID NO: 2408739 - DNA, 19 bp, Homo sapiens
atgctgctggggaagacag

SEQ ID NO: 2408740 - DNA, 17 bp, Homo sapiens
atggataggcacaggaa

SEQ ID NO: 2408741 - DNA, 16 bp, Homo sapiens
atggggtctgtaaaat

SEQ ID NO: 2408742 - DNA, 12 bp, Homo sapiens
atgggtcacagg

SEQ ID NO: 2408743 - DNA, 14 bp, Homo sapiens
atgggtcacaggaa

SEQ ID NO: 2408744 - DNA, 23 bp, Homo sapiens
atggtatcaataaatagaccatt

SEQ ID NO: 2408745 - DNA, 15 bp, Homo sapiens
atggtggcaggaaaa

SEQ ID NO: 2408746 - DNA, 13 bp, Homo sapiens
atggttaactaat

SEQ ID NO: 2408747 - DNA, 12 bp, Homo sapiens
atggttgtatta

SEQ ID NO: 2408748 - DNA, 16 bp, Homo sapiens
atggttgtattagatg

SEQ ID NO: 2408749 - DNA, 17 bp, Homo sapiens
atgtaagctgaaaatat

SEQ ID NO: 2408750 - DNA, 21 bp, Homo sapiens
atgtagtttttatatgttgta

SEQ ID NO: 2408751 - DNA, 19 bp, Homo sapiens
atgtatgaggaatttctgt

SEQ ID NO: 2408752 - DNA, 21 bp, Homo sapiens
atgtcatgtgtacaaaagttt

SEQ ID NO: 2408753 - DNA, 23 bp, Homo sapiens
atgtcgtcaaagctgaaatggac

SEQ ID NO: 2408754 - DNA, 12 bp, Homo sapiens
atgtcttaatga

SEQ ID NO: 2408755 - DNA, 16 bp, Homo sapiens
atgtcttaatgaagtt

SEQ ID NO: 2408756 - DNA, 18 bp, Homo sapiens
atgtcttaatgaagtttg

SEQ ID NO: 2408757 - DNA, 18 bp, Homo sapiens
atgtgaaatcattcattt

SEQ ID NO: 2408758 - DNA, 11 bp, Homo sapiens
atgtgaattgt

SEQ ID NO: 2408759 - DNA, 23 bp, Homo sapiens
atgtgaattgttagtttctgagt

SEQ ID NO: 2408760 - DNA, 23 bp, Homo sapiens
atgtgtataaaaataaaaaagat

SEQ ID NO: 2408761 - DNA, 18 bp, Homo sapiens
atgtgtattacaaatatt

SEQ ID NO: 2408762 - DNA, 17 bp, Homo sapiens
atgtgtttactttatgt

SEQ ID NO: 2408763 - DNA, 15 bp, Homo sapiens
atgttaaactagcat

SEQ ID NO: 2408764 - DNA, 24 bp, Homo sapiens
atgttaaactagcatatctgcctt

SEQ ID NO: 2408765 - DNA, 14 bp, Homo sapiens
atgttaaataaatt

SEQ ID NO: 2408766 - DNA, 18 bp, Homo sapiens
atgttaaataaattgtat

SEQ ID NO: 2408767 - DNA, 20 bp, Homo sapiens
atgttaaataaattgtatat

SEQ ID NO: 2408768 - DNA, 15 bp, Homo sapiens
atgttaatattgatt

SEQ ID NO: 2408769 - DNA, 17 bp, Homo sapiens
atgttcccttcaagtat

SEQ ID NO: 2408770 - DNA, 14 bp, Homo sapiens
atgttctctatcat

SEQ ID NO: 2408771 - DNA, 19 bp, Homo sapiens
atgttctctatcatttaat

SEQ ID NO: 2408772 - DNA, 21 bp, Homo sapiens
attaacatgaatatttagtgt

SEQ ID NO: 2408773 - DNA, 16 bp, Homo sapiens
attaatctgcctccct

SEQ ID NO: 2408774 - DNA, 17 bp, Homo sapiens
attactgcatgcacttc

SEQ ID NO: 2408775 - DNA, 14 bp, Homo sapiens
attacttttgctgt

SEQ ID NO: 2408776 - DNA, 13 bp, Homo sapiens
attagatgttctc

SEQ ID NO: 2408777 - DNA, 23 bp, Homo sapiens
attagatgttctctatcatttaa

SEQ ID NO: 2408778 - DNA, 17 bp, Homo sapiens
attagccagtgaaaaac

SEQ ID NO: 2408779 - DNA, 16 bp, Homo sapiens
attagcctgagtagaa

SEQ ID NO: 2408780 - DNA, 17 bp, Homo sapiens
attagtgctaagtgtga

SEQ ID NO: 2408781 - DNA, 20 bp, Homo sapiens
attagtgctaagtgtgaact

SEQ ID NO: 2408782 - DNA, 22 bp, Homo sapiens
attagtgctaagtgtgaactgg

SEQ ID NO: 2408783 - DNA, 14 bp, Homo sapiens
attatattatgaag

SEQ ID NO: 2408784 - DNA, 17 bp, Homo sapiens
attatatttacaaatgg

SEQ ID NO: 2408785 - DNA, 12 bp, Homo sapiens
attatcttaaaa

SEQ ID NO: 2408786 - DNA, 23 bp, Homo sapiens
attatcttttcatacattttcta

SEQ ID NO: 2408787 - DNA, 15 bp, Homo sapiens
attatgggtcacagg

SEQ ID NO: 2408788 - DNA, 16 bp, Homo sapiens
attatgggtcacagga

SEQ ID NO: 2408789 - DNA, 17 bp, Homo sapiens
attatgggtcacaggaa

SEQ ID NO: 2408790 - DNA, 13 bp, Homo sapiens
attatgtgccaga

SEQ ID NO: 2408791 - DNA, 21 bp, Homo sapiens
attatgtgccagatttatgca

SEQ ID NO: 2408792 - DNA, 20 bp, Homo sapiens
attatgtgtgttttaaaatg

SEQ ID NO: 2408793 - DNA, 12 bp, Homo sapiens
attatgttaaac

SEQ ID NO: 2408794 - DNA, 13 bp, Homo sapiens
attatgttaaact

SEQ ID NO: 2408795 - DNA, 13 bp, Homo sapiens
attcacattgtat

SEQ ID NO: 2408796 - DNA, 20 bp, Homo sapiens
attcacattgtattcagagt

SEQ ID NO: 2408797 - DNA, 14 bp, Homo sapiens
attcagctcatgga

SEQ ID NO: 2408798 - DNA, 21 bp, Homo sapiens
attcattttaacatctgagaa

SEQ ID NO: 2408799 - DNA, 17 bp, Homo sapiens
attccaagtgattgaaa

SEQ ID NO: 2408800 - DNA, 13 bp, Homo sapiens
attcccccagtgc

SEQ ID NO: 2408801 - DNA, 19 bp, Homo sapiens
attcctcatgaatgtaaat

SEQ ID NO: 2408802 - DNA, 22 bp, Homo sapiens
attcctcatgaatgtaaatttg

SEQ ID NO: 2408803 - DNA, 15 bp, Homo sapiens
attccttcagcactt

SEQ ID NO: 2408804 - DNA, 20 bp, Homo sapiens
attctcctgcctcagcctcc

SEQ ID NO: 2408805 - DNA, 14 bp, Homo sapiens
attctgtcttgaag

SEQ ID NO: 2408806 - DNA, 12 bp, Homo sapiens
attcttgatgta

SEQ ID NO: 2408807 - DNA, 14 bp, Homo sapiens
attcttgatgtaaa

SEQ ID NO: 2408808 - DNA, 19 bp, Homo sapiens
attgatccagaaagaaaac

SEQ ID NO: 2408809 - DNA, 23 bp, Homo sapiens
attgatcggagcctcctctctca

SEQ ID NO: 2408810 - DNA, 20 bp, Homo sapiens
attgtggggatgatgaaata

SEQ ID NO: 2408811 - DNA, 17 bp, Homo sapiens
attgtgtcccattcccc

SEQ ID NO: 2408812 - DNA, 21 bp, Homo sapiens
attgttctctaatatgtaaaa

SEQ ID NO: 2408813 - DNA, 13 bp, Homo sapiens
atttaaaacatta

SEQ ID NO: 2408814 - DNA, 20 bp, Homo sapiens
atttaattagtgctaagtgt

SEQ ID NO: 2408815 - DNA, 20 bp, Homo sapiens
atttacatgaattgcatttt

SEQ ID NO: 2408816 - DNA, 14 bp, Homo sapiens
atttagatttgtgt

SEQ ID NO: 2408817 - DNA, 17 bp, Homo sapiens
atttaggtttctgagtt

SEQ ID NO: 2408818 - DNA, 21 bp, Homo sapiens
atttagtgatcaaattgtgca

SEQ ID NO: 2408819 - DNA, 19 bp, Homo sapiens
atttatctgagtcaactcc

SEQ ID NO: 2408820 - DNA, 11 bp, Homo sapiens
atttattcaat

SEQ ID NO: 2408821 - DNA, 13 bp, Homo sapiens
atttatttcctag

SEQ ID NO: 2408822 - DNA, 15 bp, Homo sapiens
atttcagatttgtga

SEQ ID NO: 2408823 - DNA, 14 bp, Homo sapiens
atttcctaaatata

SEQ ID NO: 2408824 - DNA, 21 bp, Homo sapiens
atttcctaaatatattttaag

SEQ ID NO: 2408825 - DNA, 20 bp, Homo sapiens
atttcctagttctgtagaaa

SEQ ID NO: 2408826 - DNA, 21 bp, Homo sapiens
atttcgtctgtttataaacat

SEQ ID NO: 2408827 - DNA, 21 bp, Homo sapiens
atttctttttgggagagactt

SEQ ID NO: 2408828 - DNA, 21 bp, Homo sapiens
atttcttttttaaatgaagaa

SEQ ID NO: 2408829 - DNA, 15 bp, Homo sapiens
atttgaatcttgtct

SEQ ID NO: 2408830 - DNA, 16 bp, Homo sapiens
atttgaatcttgtctc

SEQ ID NO: 2408831 - DNA, 20 bp, Homo sapiens
atttgaatcttgtctcaatg

SEQ ID NO: 2408832 - DNA, 21 bp, Homo sapiens
atttgcagctgagagaaaata

SEQ ID NO: 2408833 - DNA, 22 bp, Homo sapiens
atttgtactatttaactgacta

SEQ ID NO: 2408834 - DNA, 13 bp, Homo sapiens
atttgtcaacaaa

SEQ ID NO: 2408835 - DNA, 21 bp, Homo sapiens
atttgtgaaggtggaaataaa

SEQ ID NO: 2408836 - DNA, 17 bp, Homo sapiens
attttacctttgacaaa

SEQ ID NO: 2408837 - DNA, 17 bp, Homo sapiens
attttagccttctctgt

SEQ ID NO: 2408838 - DNA, 14 bp, Homo sapiens
attttatgttgcat

SEQ ID NO: 2408839 - DNA, 21 bp, Homo sapiens
attttctacctggtctctcct

SEQ ID NO: 2408840 - DNA, 18 bp, Homo sapiens
attttctccctggatttt

SEQ ID NO: 2408841 - DNA, 22 bp, Homo sapiens
attttctccctggatttttacc

SEQ ID NO: 2408842 - DNA, 15 bp, Homo sapiens
attttgaaaaactgc

SEQ ID NO: 2408843 - DNA, 20 bp, Homo sapiens
attttgaacctgatgaaaat

SEQ ID NO: 2408844 - DNA, 20 bp, Homo sapiens
attttgccaagggcataaat

SEQ ID NO: 2408845 - DNA, 22 bp, Homo sapiens
attttgtttggtattgtattta

SEQ ID NO: 2408846 - DNA, 18 bp, Homo sapiens
atttttaatatatactat

SEQ ID NO: 2408847 - DNA, 16 bp, Homo sapiens
atttttacattctgaa

SEQ ID NO: 2408848 - DNA, 12 bp, Homo sapiens
atttttaccagt

SEQ ID NO: 2408849 - DNA, 19 bp, Homo sapiens
atttttcatgattttgaaa

SEQ ID NO: 2408850 - DNA, 20 bp, Homo sapiens
atttttcctccactgaacta

SEQ ID NO: 2408851 - DNA, 22 bp, Homo sapiens
atttttgtgattttgtgattga

SEQ ID NO: 2408852 - DNA, 14 bp, Homo sapiens
caaaccaggaccct

SEQ ID NO: 2408853 - DNA, 24 bp, Homo sapiens
caaacccagtgttttaggagcatg

SEQ ID NO: 2408854 - DNA, 17 bp, Homo sapiens
caaactggggcctccct

SEQ ID NO: 2408855 - DNA, 13 bp, Homo sapiens
caaagaaattatg

SEQ ID NO: 2408856 - DNA, 14 bp, Homo sapiens
caaagcaataatag

SEQ ID NO: 2408857 - DNA, 23 bp, Homo sapiens
caaaggctttgccctgctgccct

SEQ ID NO: 2408858 - DNA, 23 bp, Homo sapiens
caaatatattcagcctggcttca

SEQ ID NO: 2408859 - DNA, 14 bp, Homo sapiens
caaattatcttaaa

SEQ ID NO: 2408860 - DNA, 14 bp, Homo sapiens
caacactaacatga

SEQ ID NO: 2408861 - DNA, 19 bp, Homo sapiens
caaccagattgtcagctcc

SEQ ID NO: 2408862 - DNA, 13 bp, Homo sapiens
caaccatttcctc

SEQ ID NO: 2408863 - DNA, 17 bp, Homo sapiens
caaccatttcctcagac

SEQ ID NO: 2408864 - DNA, 17 bp, Homo sapiens
caacgtgcattgtgctt

SEQ ID NO: 2408865 - DNA, 18 bp, Homo sapiens
caacgtgcattgtgcttc

SEQ ID NO: 2408866 - DNA, 19 bp, Homo sapiens
caacgtggcccagagaagc

SEQ ID NO: 2408867 - DNA, 21 bp, Homo sapiens
caacgtggcccagagaagcca

SEQ ID NO: 2408868 - DNA, 11 bp, Homo sapiens
caactacctga

SEQ ID NO: 2408869 - DNA, 15 bp, Homo sapiens
caactacctgagcta

SEQ ID NO: 2408870 - DNA, 21 bp, Homo sapiens
caactctcttattgcctcact

SEQ ID NO: 2408871 - DNA, 22 bp, Homo sapiens
caactctcttattgcctcactt

SEQ ID NO: 2408872 - DNA, 15 bp, Homo sapiens
caactgctaatctac

SEQ ID NO: 2408873 - DNA, 20 bp, Homo sapiens
caagaggctgttcccaccag

SEQ ID NO: 2408874 - DNA, 15 bp, Homo sapiens
caagattgtgtccca

SEQ ID NO: 2408875 - DNA, 14 bp, Homo sapiens
caagccttgattgg

SEQ ID NO: 2408876 - DNA, 14 bp, Homo sapiens
caagctgctgtggc

SEQ ID NO: 2408877 - DNA, 22 bp, Homo sapiens
caagtgcagggcctgtaatccc

SEQ ID NO: 2408878 - DNA, 13 bp, Homo sapiens
caataaagtattt

SEQ ID NO: 2408879 - DNA, 12 bp, Homo sapiens
caatatttttct

SEQ ID NO: 2408880 - DNA, 17 bp, Homo sapiens
caatcctaggtagggtt

SEQ ID NO: 2408881 - DNA, 16 bp, Homo sapiens
caatgcagtgcctttc

SEQ ID NO: 2408882 - DNA, 21 bp, Homo sapiens
caatgctttgcccctgagaca

SEQ ID NO: 2408883 - DNA, 15 bp, Homo sapiens
caattatgttaaact

SEQ ID NO: 2408884 - DNA, 18 bp, Homo sapiens
caattcatcctcactcag

SEQ ID NO: 2408885 - DNA, 17 bp, Homo sapiens
caattgggagctgccaa

SEQ ID NO: 2408886 - DNA, 15 bp, Homo sapiens
cacaataattttcta

SEQ ID NO: 2408887 - DNA, 15 bp, Homo sapiens
cacaatagaattata

SEQ ID NO: 2408888 - DNA, 12 bp, Homo sapiens
cacacacgttat

SEQ ID NO: 2408889 - DNA, 20 bp, Homo sapiens
cacactcagatcctcctcat

SEQ ID NO: 2408890 - DNA, 19 bp, Homo sapiens
cacagatcacagcttcagc

SEQ ID NO: 2408891 - DNA, 22 bp, Homo sapiens
cacagctatgaaggctgtacac

SEQ ID NO: 2408892 - DNA, 14 bp, Homo sapiens
cacagcttcagcca

SEQ ID NO: 2408893 - DNA, 19 bp, Homo sapiens
cacagcttcagccaggagc

SEQ ID NO: 2408894 - DNA, 22 bp, Homo sapiens
cacagcttcagccaggagctgg

SEQ ID NO: 2408895 - DNA, 13 bp, Homo sapiens
cacaggaaaccag

SEQ ID NO: 2408896 - DNA, 19 bp, Homo sapiens
cacagtgggagccagggct

SEQ ID NO: 2408897 - DNA, 15 bp, Homo sapiens
cacatatccaggcac

SEQ ID NO: 2408898 - DNA, 18 bp, Homo sapiens
cacatatccaggcaccag

SEQ ID NO: 2408899 - DNA, 17 bp, Homo sapiens
cacatgtcttaatgaag

SEQ ID NO: 2408900 - DNA, 18 bp, Homo sapiens
cacatgtcttaatgaagt

SEQ ID NO: 2408901 - DNA, 21 bp, Homo sapiens
caccaggctgctcagggctgg

SEQ ID NO: 2408902 - DNA, 20 bp, Homo sapiens
caccaggcttgcctgcaggc

SEQ ID NO: 2408903 - DNA, 19 bp, Homo sapiens
caccatgctgctggggaag

SEQ ID NO: 2408904 - DNA, 20 bp, Homo sapiens
cacccaggttggagtgcagt

SEQ ID NO: 2408905 - DNA, 23 bp, Homo sapiens
cacccctaaaagaaaccctgcac

SEQ ID NO: 2408906 - DNA, 23 bp, Homo sapiens
caccctgtccaaactgcctaagc

SEQ ID NO: 2408907 - DNA, 23 bp, Homo sapiens
cacctatgtcatttcatttccta

SEQ ID NO: 2408908 - DNA, 20 bp, Homo sapiens
cacctcagagacatacacct

SEQ ID NO: 2408909 - DNA, 14 bp, Homo sapiens
cacctgtcccagaa

SEQ ID NO: 2408910 - DNA, 21 bp, Homo sapiens
caccttagaccaccaagcctt

SEQ ID NO: 2408911 - DNA, 13 bp, Homo sapiens
cacgccacagccc

SEQ ID NO: 2408912 - DNA, 16 bp, Homo sapiens
cacgcctggctaattt

SEQ ID NO: 2408913 - DNA, 19 bp, Homo sapiens
cacgctctctccaggcagg

SEQ ID NO: 2408914 - DNA, 17 bp, Homo sapiens
cactcatgcattgtcct

SEQ ID NO: 2408915 - DNA, 18 bp, Homo sapiens
cactcatgcattgtcctc

SEQ ID NO: 2408916 - DNA, 21 bp, Homo sapiens
cactctgttcattcctccagg

SEQ ID NO: 2408917 - DNA, 17 bp, Homo sapiens
cactcttgaaaaatgca

SEQ ID NO: 2408918 - DNA, 19 bp, Homo sapiens
cactgcaacctccacctcc

SEQ ID NO: 2408919 - DNA, 20 bp, Homo sapiens
cacttcaggtatacctcact

SEQ ID NO: 2408920 - DNA, 17 bp, Homo sapiens
ccacgtactgcagcctc

SEQ ID NO: 2408921 - DNA, 14 bp, Homo sapiens
ccactcacaacagc

SEQ ID NO: 2408922 - DNA, 20 bp, Homo sapiens
ccactcacaacagctgcctg

SEQ ID NO: 2408923 - DNA, 18 bp, Homo sapiens
ccactgtacttgctcttg

SEQ ID NO: 2408924 - DNA, 17 bp, Homo sapiens
ccacttgggtcttccct

SEQ ID NO: 2408925 - DNA, 12 bp, Homo sapiens
ccagagccacag

SEQ ID NO: 2408926 - DNA, 14 bp, Homo sapiens
ccagagccacagtt

SEQ ID NO: 2408927 - DNA, 15 bp, Homo sapiens
ccagagccacagttc

SEQ ID NO: 2408928 - DNA, 22 bp, Homo sapiens
ccagatttatgcatattatttt

SEQ ID NO: 2408929 - DNA, 17 bp, Homo sapiens
ccagctgcccccagagc

SEQ ID NO: 2408930 - DNA, 18 bp, Homo sapiens
ccagctggggccaggctg

SEQ ID NO: 2408931 - DNA, 19 bp, Homo sapiens
ccagctggggccaggctgg

SEQ ID NO: 2408932 - DNA, 17 bp, Homo sapiens
ccaggatggcgcaggaa

SEQ ID NO: 2408933 - DNA, 17 bp, Homo sapiens
ccaggcaccaggactag

SEQ ID NO: 2408934 - DNA, 17 bp, Homo sapiens
ccaggcaggtctgaagc

SEQ ID NO: 2408935 - DNA, 21 bp, Homo sapiens
ccaggctgggtcgccctggac

SEQ ID NO: 2408936 - DNA, 18 bp, Homo sapiens
ccaggcttgcctgcaggc

SEQ ID NO: 2408937 - DNA, 22 bp, Homo sapiens
ccaggtatccaaaaatgtgtaa

SEQ ID NO: 2408938 - DNA, 20 bp, Homo sapiens
ccaggtattcgttatctaat

SEQ ID NO: 2408939 - DNA, 21 bp, Homo sapiens
ccaggtattcgttatctaata

SEQ ID NO: 2408940 - DNA, 17 bp, Homo sapiens
ccagtaaaattgccata

SEQ ID NO: 2408941 - DNA, 22 bp, Homo sapiens
ccagtgtgtggctttcagagcc

SEQ ID NO: 2408942 - DNA, 22 bp, Homo sapiens
ccagttagcctctgcaggatgt

SEQ ID NO: 2408943 - DNA, 18 bp, Homo sapiens
ccatcaccttagaccacc

SEQ ID NO: 2408944 - DNA, 14 bp, Homo sapiens
ccatgctgctgggg

SEQ ID NO: 2408945 - DNA, 20 bp, Homo sapiens
ccatgctgctggggaagaca

SEQ ID NO: 2408946 - DNA, 22 bp, Homo sapiens
ccatgctgctggggaagacagt

SEQ ID NO: 2408947 - DNA, 14 bp, Homo sapiens
ccatgggaggcctt

SEQ ID NO: 2408948 - DNA, 19 bp, Homo sapiens
ccatgggaggcctttccct

SEQ ID NO: 2408949 - DNA, 18 bp, Homo sapiens
ccatgttagccaggctgg

SEQ ID NO: 2408950 - DNA, 13 bp, Homo sapiens
ccatgttggctag

SEQ ID NO: 2408951 - DNA, 15 bp, Homo sapiens
ccattcccccagtgc

SEQ ID NO: 2408952 - DNA, 13 bp, Homo sapiens
ccattctcctgag

SEQ ID NO: 2408953 - DNA, 12 bp, Homo sapiens
cccacactcaga

SEQ ID NO: 2408954 - DNA, 19 bp, Homo sapiens
cccactgtacttgctcttg

SEQ ID NO: 2408955 - DNA, 13 bp, Homo sapiens
cccacttcagcct

SEQ ID NO: 2408956 - DNA, 13 bp, Homo sapiens
cccagagaagcca

SEQ ID NO: 2408957 - DNA, 14 bp, Homo sapiens
cccagagccacagt

SEQ ID NO: 2408958 - DNA, 16 bp, Homo sapiens
cccagcggcatcaggc

SEQ ID NO: 2408959 - DNA, 12 bp, Homo sapiens
cccaggacccca

SEQ ID NO: 2408960 - DNA, 15 bp, Homo sapiens
cccagtaactcatct

SEQ ID NO: 2408961 - DNA, 21 bp, Homo sapiens
cccagtacctagctggctctg

SEQ ID NO: 2408962 - DNA, 17 bp, Homo sapiens
cccatgtctacacagat

SEQ ID NO: 2408963 - DNA, 22 bp, Homo sapiens
ccccaaaggctttgccctgctg

SEQ ID NO: 2408964 - DNA, 13 bp, Homo sapiens
ccccacgccacag

SEQ ID NO: 2408965 - DNA, 15 bp, Homo sapiens
ccccacgccacagcc

SEQ ID NO: 2408966 - DNA, 13 bp, Homo sapiens
ccccagtaaaatt

SEQ ID NO: 2408967 - DNA, 15 bp, Homo sapiens
cccccagagccacag

SEQ ID NO: 2408968 - DNA, 20 bp, Homo sapiens
cccctaaaagaaaccctgca

SEQ ID NO: 2408969 - DNA, 11 bp, Homo sapiens
cccctgcactg

SEQ ID NO: 2408970 - DNA, 18 bp, Homo sapiens
cccctgcactgtaaaatg

SEQ ID NO: 2408971 - DNA, 15 bp, Homo sapiens
cccctgcctctctgc

SEQ ID NO: 2408972 - DNA, 17 bp, Homo sapiens
cccctgcctctctgcag

SEQ ID NO: 2408973 - DNA, 12 bp, Homo sapiens
ccccttctcccc

SEQ ID NO: 2408974 - DNA, 13 bp, Homo sapiens
cccgcctcagcct

SEQ ID NO: 2408975 - DNA, 20 bp, Homo sapiens
cccggacgcccaggacccca

SEQ ID NO: 2408976 - DNA, 12 bp, Homo sapiens
ccctaagccagc

SEQ ID NO: 2408977 - DNA, 18 bp, Homo sapiens
ccctaagccagctgcccc

SEQ ID NO: 2408978 - DNA, 12 bp, Homo sapiens
ccctaataaagc

SEQ ID NO: 2408979 - DNA, 14 bp, Homo sapiens
ccctaataaagctg

SEQ ID NO: 2408980 - DNA, 15 bp, Homo sapiens
ccctaataaagctgt

SEQ ID NO: 2408981 - DNA, 17 bp, Homo sapiens
ccctgagacaaatggag

SEQ ID NO: 2408982 - DNA, 19 bp, Homo sapiens
ccctgaggcctagactctg

SEQ ID NO: 2408983 - DNA, 17 bp, Homo sapiens
ccctgcactgtaaaatg

SEQ ID NO: 2408984 - DNA, 11 bp, Homo sapiens
ccctgcctctc

SEQ ID NO: 2408985 - DNA, 18 bp, Homo sapiens
ccctgcctctctgcaggt

SEQ ID NO: 2408986 - DNA, 18 bp, Homo sapiens
ccctggaactgtctctca

SEQ ID NO: 2408987 - DNA, 16 bp, Homo sapiens
ccctgggaggctctgg

SEQ ID NO: 2408988 - DNA, 14 bp, Homo sapiens
ccctgtccaaactg

SEQ ID NO: 2408989 - DNA, 11 bp, Homo sapiens
cccttcttttt

SEQ ID NO: 2408990 - DNA, 15 bp, Homo sapiens
ccgaaaatcatataa

SEQ ID NO: 2408991 - DNA, 16 bp, Homo sapiens
ccgcatgcggcccagg

SEQ ID NO: 2408992 - DNA, 18 bp, Homo sapiens
ccgcctcagcctcccaaa

SEQ ID NO: 2408993 - DNA, 20 bp, Homo sapiens
ccgcctcgacctctctcaaa

SEQ ID NO: 2408994 - DNA, 17 bp, Homo sapiens
ccgcctgggtctcctaa

SEQ ID NO: 2408995 - DNA, 20 bp, Homo sapiens
ccgctcaggctgaccacttt

SEQ ID NO: 2408996 - DNA, 15 bp, Homo sapiens
ccggctaatttttgt

SEQ ID NO: 2408997 - DNA, 16 bp, Homo sapiens
ccgtaggttattttca

SEQ ID NO: 2408998 - DNA, 18 bp, Homo sapiens
cctaaaagaaaccctgca

SEQ ID NO: 2408999 - DNA, 18 bp, Homo sapiens
cctaaatatattttaaga

SEQ ID NO: 2409000 - DNA, 14 bp, Homo sapiens
cctaagccagctgc

SEQ ID NO: 2409001 - DNA, 19 bp, Homo sapiens
cctaagctggagtgcagtg

SEQ ID NO: 2409002 - DNA, 13 bp, Homo sapiens
cctaataaagctg

SEQ ID NO: 2409003 - DNA, 14 bp, Homo sapiens
cctaccctggactt

SEQ ID NO: 2409004 - DNA, 18 bp, Homo sapiens
cctagttctgtagaaatg

SEQ ID NO: 2409005 - DNA, 20 bp, Homo sapiens
cctcaaaaagatttccccat

SEQ ID NO: 2409006 - DNA, 19 bp, Homo sapiens
cctcaacgttgctccccat

SEQ ID NO: 2409007 - DNA, 19 bp, Homo sapiens
cctcagactctaagaaaga

SEQ ID NO: 2409008 - DNA, 22 bp, Homo sapiens
cctcaggcaatctgcccgcctg

SEQ ID NO: 2409009 - DNA, 22 bp, Homo sapiens
cctcatgaatgtaaatttgtac

SEQ ID NO: 2409010 - DNA, 23 bp, Homo sapiens
cctcatgaatgtaaatttgtact

SEQ ID NO: 2409011 - DNA, 14 bp, Homo sapiens
cctcccaagcagtt

SEQ ID NO: 2409012 - DNA, 22 bp, Homo sapiens
cctccctctcgtaagatttcct

SEQ ID NO: 2409013 - DNA, 15 bp, Homo sapiens
cctcctttctggctt

SEQ ID NO: 2409014 - DNA, 21 bp, Homo sapiens
cctcgcccagcggcatcaggc

SEQ ID NO: 2409015 - DNA, 22 bp, Homo sapiens
cctctccaccatcgtcttcttg

SEQ ID NO: 2409016 - DNA, 22 bp, Homo sapiens
cctctcgtaagatttccttctt

SEQ ID NO: 2409017 - DNA, 13 bp, Homo sapiens
cctctctgcaggt

SEQ ID NO: 2409018 - DNA, 18 bp, Homo sapiens
cctctctgcaggtcccta

SEQ ID NO: 2409019 - DNA, 20 bp, Homo sapiens
cctctgcacaccctccagag

SEQ ID NO: 2409020 - DNA, 20 bp, Homo sapiens
cctgaagctatcgtaaaatt

SEQ ID NO: 2409021 - DNA, 22 bp, Homo sapiens
cctgaagctatcgtaaaattaa

SEQ ID NO: 2409022 - DNA, 14 bp, Homo sapiens
cctgacctgtctca

SEQ ID NO: 2409023 - DNA, 18 bp, Homo sapiens
cctgactgccaagccatg

SEQ ID NO: 2409024 - DNA, 13 bp, Homo sapiens
ctcccaattcatc

SEQ ID NO: 2409025 - DNA, 21 bp, Homo sapiens
ctccccaaaggctttgccctg

SEQ ID NO: 2409026 - DNA, 14 bp, Homo sapiens
ctcccctgcactgt

SEQ ID NO: 2409027 - DNA, 15 bp, Homo sapiens
ctcccctgcactgta

SEQ ID NO: 2409028 - DNA, 19 bp, Homo sapiens
ctcccctgcactgtaaaat

SEQ ID NO: 2409029 - DNA, 24 bp, Homo sapiens
ctccctggatttttaccagtctca

SEQ ID NO: 2409030 - DNA, 15 bp, Homo sapiens
ctcctaggaaaatac

SEQ ID NO: 2409031 - DNA, 18 bp, Homo sapiens
ctcctcattcacatcgca

SEQ ID NO: 2409032 - DNA, 13 bp, Homo sapiens
ctcctctccacca

SEQ ID NO: 2409033 - DNA, 14 bp, Homo sapiens
ctcctctccaccat

SEQ ID NO: 2409034 - DNA, 16 bp, Homo sapiens
ctcctgacctcaggca

SEQ ID NO: 2409035 - DNA, 12 bp, Homo sapiens
ctcgctgttgct

SEQ ID NO: 2409036 - DNA, 15 bp, Homo sapiens
ctcgctgttgctgaa

SEQ ID NO: 2409037 - DNA, 12 bp, Homo sapiens
ctctaagaaaga

SEQ ID NO: 2409038 - DNA, 17 bp, Homo sapiens
ctctcaaagcaaataat

SEQ ID NO: 2409039 - DNA, 23 bp, Homo sapiens
ctctcaccatttggatcctgtgt

SEQ ID NO: 2409040 - DNA, 16 bp, Homo sapiens
ctctccccttctctgt

SEQ ID NO: 2409041 - DNA, 13 bp, Homo sapiens
ctctctgcaggtc

SEQ ID NO: 2409042 - DNA, 19 bp, Homo sapiens
ctctctgcaggtccctaat

SEQ ID NO: 2409043 - DNA, 16 bp, Homo sapiens
ctctctgtaataaact

SEQ ID NO: 2409044 - DNA, 22 bp, Homo sapiens
ctctgcaggtccctaataaagc

SEQ ID NO: 2409045 - DNA, 23 bp, Homo sapiens
ctctgcaggtccctaataaagct

SEQ ID NO: 2409046 - DNA, 15 bp, Homo sapiens
ctctgttcattcctc

SEQ ID NO: 2409047 - DNA, 17 bp, Homo sapiens
ctctgttcattcctcca

SEQ ID NO: 2409048 - DNA, 17 bp, Homo sapiens
ctcttattgcctcactt

SEQ ID NO: 2409049 - DNA, 15 bp, Homo sapiens
ctcttgatgcctggc

SEQ ID NO: 2409050 - DNA, 13 bp, Homo sapiens
ctcttgattttca

SEQ ID NO: 2409051 - DNA, 20 bp, Homo sapiens
ctcttgtgaggaaagtcatt

SEQ ID NO: 2409052 - DNA, 19 bp, Homo sapiens
ctgaactgatgggtttctc

SEQ ID NO: 2409053 - DNA, 21 bp, Homo sapiens
ctgaaggggttctcacagtgg

SEQ ID NO: 2409054 - DNA, 15 bp, Homo sapiens
ctgaccctccccaaa

SEQ ID NO: 2409055 - DNA, 21 bp, Homo sapiens
ctgactattcttgatgtaaaa

SEQ ID NO: 2409056 - DNA, 22 bp, Homo sapiens
ctgactattcttgatgtaaaat

SEQ ID NO: 2409057 - DNA, 16 bp, Homo sapiens
ctgactgccaagccat

SEQ ID NO: 2409058 - DNA, 20 bp, Homo sapiens
tcagcctcccgagtagctgg

SEQ ID NO: 2409059 - DNA, 13 bp, Homo sapiens
tcagctccagctg

SEQ ID NO: 2409060 - DNA, 20 bp, Homo sapiens
tcaggagagagttgaaccta

SEQ ID NO: 2409061 - DNA, 14 bp, Homo sapiens
tcaggagccctggg

SEQ ID NO: 2409062 - DNA, 20 bp, Homo sapiens
tcaggagccctgggaggctc

SEQ ID NO: 2409063 - DNA, 23 bp, Homo sapiens
tcaggaggaaggcttacacccac

SEQ ID NO: 2409064 - DNA, 17 bp, Homo sapiens
tcaggcctagaggcctg

SEQ ID NO: 2409065 - DNA, 17 bp, Homo sapiens
tcagtttttgtgaaaag

SEQ ID NO: 2409066 - DNA, 24 bp, Homo sapiens
tcataaagcaggcagaactcatct

SEQ ID NO: 2409067 - DNA, 18 bp, Homo sapiens
tcataacggatcagaaat

SEQ ID NO: 2409068 - DNA, 21 bp, Homo sapiens
tcataagatatttttcatgat

SEQ ID NO: 2409069 - DNA, 16 bp, Homo sapiens
tcataataagttgcat

SEQ ID NO: 2409070 - DNA, 14 bp, Homo sapiens
tcatacattttcta

SEQ ID NO: 2409071 - DNA, 14 bp, Homo sapiens
tcatagctaaaaaa

SEQ ID NO: 2409072 - DNA, 22 bp, Homo sapiens
tcatcatgtatcgcttcatgta

SEQ ID NO: 2409073 - DNA, 19 bp, Homo sapiens
tcatccattctattgttaa

SEQ ID NO: 2409074 - DNA, 13 bp, Homo sapiens
tcatctaggattt

SEQ ID NO: 2409075 - DNA, 16 bp, Homo sapiens
tcatctccccatcatt

SEQ ID NO: 2409076 - DNA, 15 bp, Homo sapiens
tcatctttccctcct

SEQ ID NO: 2409077 - DNA, 16 bp, Homo sapiens
tcatctttccctcctt

SEQ ID NO: 2409078 - DNA, 17 bp, Homo sapiens
tcatctttccctccttg

SEQ ID NO: 2409079 - DNA, 21 bp, Homo sapiens
tcatgaatgtaaatttgtact

SEQ ID NO: 2409080 - DNA, 16 bp, Homo sapiens
tcatgcattgtcctct

SEQ ID NO: 2409081 - DNA, 22 bp, Homo sapiens
tcatgctaattatataatattt

SEQ ID NO: 2409082 - DNA, 20 bp, Homo sapiens
tcatgtaacttccctgaaaa

SEQ ID NO: 2409083 - DNA, 15 bp, Homo sapiens
tcatgtgtataaaaa

SEQ ID NO: 2409084 - DNA, 16 bp, Homo sapiens
tcatgtttaagaaatt

SEQ ID NO: 2409085 - DNA, 14 bp, Homo sapiens
tcattcttatttca

SEQ ID NO: 2409086 - DNA, 20 bp, Homo sapiens
tcattgccttaactggagcc

SEQ ID NO: 2409087 - DNA, 14 bp, Homo sapiens
tcattggctttatc

SEQ ID NO: 2409088 - DNA, 16 bp, Homo sapiens
tcattggctttatcct

SEQ ID NO: 2409089 - DNA, 14 bp, Homo sapiens
tcattgtagaaaag

SEQ ID NO: 2409090 - DNA, 12 bp, Homo sapiens
tcattgtgaaat

SEQ ID NO: 2409091 - DNA, 15 bp, Homo sapiens
tcattgtgaaattat

SEQ ID NO: 2409092 - DNA, 17 bp, Homo sapiens
tcattgtgaaattattc

SEQ ID NO: 2409093 - DNA, 23 bp, Homo sapiens
tcatttctttttgggagagactt

SEQ ID NO: 2409094 - DNA, 20 bp, Homo sapiens
tcattttaacatctgagaaa

SEQ ID NO: 2409095 - DNA, 17 bp, Homo sapiens
tccaaaaatgtgtaaga

SEQ ID NO: 2409096 - DNA, 21 bp, Homo sapiens
tccaaaaatgtgtaagaacaa

SEQ ID NO: 2409097 - DNA, 22 bp, Homo sapiens
tccaaaggaggatggcatataa

SEQ ID NO: 2409098 - DNA, 16 bp, Homo sapiens
tccaacccgaggcccg

SEQ ID NO: 2409099 - DNA, 15 bp, Homo sapiens
tccaagcaaatgtga

SEQ ID NO: 2409100 - DNA, 17 bp, Homo sapiens
tccacgtactgcagcct

SEQ ID NO: 2409101 - DNA, 17 bp, Homo sapiens
tccactttatcttgaat

SEQ ID NO: 2409102 - DNA, 16 bp, Homo sapiens
tccagacctgaagaat

SEQ ID NO: 2409103 - DNA, 20 bp, Homo sapiens
tccagtcaggcctatctaaa

SEQ ID NO: 2409104 - DNA, 12 bp, Homo sapiens
tccatataaata

SEQ ID NO: 2409105 - DNA, 20 bp, Homo sapiens
tcccaattcatcctcactca

SEQ ID NO: 2409106 - DNA, 17 bp, Homo sapiens
tcccactcacaacagct

SEQ ID NO: 2409107 - DNA, 20 bp, Homo sapiens
tcccagcatgctgagattac

SEQ ID NO: 2409108 - DNA, 13 bp, Homo sapiens
tcccattccccca

SEQ ID NO: 2409109 - DNA, 19 bp, Homo sapiens
tcccattcccccagtgcgg

SEQ ID NO: 2409110 - DNA, 22 bp, Homo sapiens
tccccaagtacaaccacaccca

SEQ ID NO: 2409111 - DNA, 19 bp, Homo sapiens
tccccacgccacagccctt

SEQ ID NO: 2409112 - DNA, 14 bp, Homo sapiens
tccccagtaaaatt

SEQ ID NO: 2409113 - DNA, 19 bp, Homo sapiens
tccccatttaggtttctga

SEQ ID NO: 2409114 - DNA, 15 bp, Homo sapiens
tcccctgcactgtaa

SEQ ID NO: 2409115 - DNA, 16 bp, Homo sapiens
tcccctgcactgtaaa

SEQ ID NO: 2409116 - DNA, 19 bp, Homo sapiens
tcccctgcactgtaaaatg

SEQ ID NO: 2409117 - DNA, 18 bp, Homo sapiens
tcccctggaactgtctct

SEQ ID NO: 2409118 - DNA, 20 bp, Homo sapiens
tccccttctcccctgcactg

SEQ ID NO: 2409119 - DNA, 11 bp, Homo sapiens
tccctaagcca

SEQ ID NO: 2409120 - DNA, 14 bp, Homo sapiens
tccctaagccagct

SEQ ID NO: 2409121 - DNA, 11 bp, Homo sapiens
tccctaataaa

SEQ ID NO: 2409122 - DNA, 11 bp, Homo sapiens
tccctcctggg

SEQ ID NO: 2409123 - DNA, 12 bp, Homo sapiens
tccctccttggt

SEQ ID NO: 2409124 - DNA, 17 bp, Homo sapiens
tcccttcaagtataata

SEQ ID NO: 2409125 - DNA, 16 bp, Homo sapiens
tccctttttttaagta

SEQ ID NO: 2409126 - DNA, 21 bp, Homo sapiens
tccctttttttaagtaaggaa

SEQ ID NO: 2409127 - DNA, 17 bp, Homo sapiens
tccgactcttctgagca

SEQ ID NO: 2409128 - DNA, 22 bp, Homo sapiens
tcctaagctggagtgcagtggc

SEQ ID NO: 2409129 - DNA, 13 bp, Homo sapiens
gtcatgtgtataa

SEQ ID NO: 2409130 - DNA, 13 bp, Homo sapiens
gtcattagcctga

SEQ ID NO: 2409131 - DNA, 19 bp, Homo sapiens
gtcattagcctgagtagaa

SEQ ID NO: 2409132 - DNA, 21 bp, Homo sapiens
gtccaaactgcctaagccctc

SEQ ID NO: 2409133 - DNA, 12 bp, Homo sapiens
gtccctaataaa

SEQ ID NO: 2409134 - DNA, 20 bp, Homo sapiens
gtccctaataaagctgtgtg

SEQ ID NO: 2409135 - DNA, 14 bp, Homo sapiens
gtcctggaggggct

SEQ ID NO: 2409136 - DNA, 17 bp, Homo sapiens
gtccttaggcctctgag

SEQ ID NO: 2409137 - DNA, 18 bp, Homo sapiens
gtccttaggcctctgaga

SEQ ID NO: 2409138 - DNA, 17 bp, Homo sapiens
gtcgtgagctcttgtga

SEQ ID NO: 2409139 - DNA, 13 bp, Homo sapiens
gtctattctagtc

SEQ ID NO: 2409140 - DNA, 12 bp, Homo sapiens
gtctcaatgctc

SEQ ID NO: 2409141 - DNA, 17 bp, Homo sapiens
gtctcaatgctcataac

SEQ ID NO: 2409142 - DNA, 15 bp, Homo sapiens
gtctcactgcttgaa

SEQ ID NO: 2409143 - DNA, 18 bp, Homo sapiens
gtctggttgggcagccag

SEQ ID NO: 2409144 - DNA, 12 bp, Homo sapiens
gtctgtaaaatc

SEQ ID NO: 2409145 - DNA, 14 bp, Homo sapiens
gtctgtaaaatctt

SEQ ID NO: 2409146 - DNA, 16 bp, Homo sapiens
gtcttaatgaagtttg

SEQ ID NO: 2409147 - DNA, 20 bp, Homo sapiens
gtcttaatgaagtttgaatg

SEQ ID NO: 2409148 - DNA, 14 bp, Homo sapiens
gtcttcctctgtct

SEQ ID NO: 2409149 - DNA, 16 bp, Homo sapiens
gtctttcacatttaaa

SEQ ID NO: 2409150 - DNA, 18 bp, Homo sapiens
gtgaaacattttctccct

SEQ ID NO: 2409151 - DNA, 19 bp, Homo sapiens
gtgaaagaaaataacaata

SEQ ID NO: 2409152 - DNA, 13 bp, Homo sapiens
gtgaaatcattca

SEQ ID NO: 2409153 - DNA, 20 bp, Homo sapiens
gtgaactggaccctgttgct

SEQ ID NO: 2409154 - DNA, 21 bp, Homo sapiens
gtgaactggaccctgttgcta

SEQ ID NO: 2409155 - DNA, 16 bp, Homo sapiens
gtgagagagtggctgg

SEQ ID NO: 2409156 - DNA, 18 bp, Homo sapiens
gtgagagagtggctgggg

SEQ ID NO: 2409157 - DNA, 24 bp, Homo sapiens
gtgcagtggcgcgatctcagctca

SEQ ID NO: 2409158 - DNA, 20 bp, Homo sapiens
gtgcatcaggctttcttttt

SEQ ID NO: 2409159 - DNA, 13 bp, Homo sapiens
gtgcattgtgctt

SEQ ID NO: 2409160 - DNA, 14 bp, Homo sapiens
gtgccttcatttgg

SEQ ID NO: 2409161 - DNA, 16 bp, Homo sapiens
gtgctaagtgtgaact

SEQ ID NO: 2409162 - DNA, 15 bp, Homo sapiens
gtgctcaggagccct

SEQ ID NO: 2409163 - DNA, 18 bp, Homo sapiens
gtgctcaggagccctggg

SEQ ID NO: 2409164 - DNA, 15 bp, Homo sapiens
gtgctcgctgttgct

SEQ ID NO: 2409165 - DNA, 16 bp, Homo sapiens
gtgctgtataaaatca

SEQ ID NO: 2409166 - DNA, 23 bp, Homo sapiens
gtgctttcttctcccaattcatc

SEQ ID NO: 2409167 - DNA, 18 bp, Homo sapiens
gtggctgggtttacacgc

SEQ ID NO: 2409168 - DNA, 23 bp, Homo sapiens
gtgggaaagattactttttcttt

SEQ ID NO: 2409169 - DNA, 19 bp, Homo sapiens
gtgtaagggccagaaatat

SEQ ID NO: 2409170 - DNA, 14 bp, Homo sapiens
gtgtatctcacact

SEQ ID NO: 2409171 - DNA, 18 bp, Homo sapiens
gtgtgctcaggagccctg

SEQ ID NO: 2409172 - DNA, 18 bp, Homo sapiens
gtgtggagagggaatgtg

SEQ ID NO: 2409173 - DNA, 19 bp, Homo sapiens
gtgtggctttcagagcctc

SEQ ID NO: 2409174 - DNA, 15 bp, Homo sapiens
gtgtgtgtgtgtatg

SEQ ID NO: 2409175 - DNA, 12 bp, Homo sapiens
gtgtgttttaaa

SEQ ID NO: 2409176 - DNA, 13 bp, Homo sapiens
gtgtgttttaaaa

SEQ ID NO: 2409177 - DNA, 19 bp, Homo sapiens
gtgtgttttaaaatgagaa

SEQ ID NO: 2409178 - DNA, 13 bp, Homo sapiens
gtgttctgtgata

SEQ ID NO: 2409179 - DNA, 18 bp, Homo sapiens
gtgtttttcataaagcag

SEQ ID NO: 2409180 - DNA, 15 bp, Homo sapiens
gttaaactagcatat

SEQ ID NO: 2409181 - DNA, 19 bp, Homo sapiens
gttaaactagcatatctgc

SEQ ID NO: 2409182 - DNA, 21 bp, Homo sapiens
gttaaactagcatatctgcct

SEQ ID NO: 2409183 - DNA, 23 bp, Homo sapiens
gttaaactagcatatctgccttt

SEQ ID NO: 2409184 - DNA, 17 bp, Homo sapiens
gttagccaatatttttc

SEQ ID NO: 2409185 - DNA, 18 bp, Homo sapiens
gttagtcgtgagctcttg

SEQ ID NO: 2409186 - DNA, 13 bp, Homo sapiens
gttatataatcat

SEQ ID NO: 2409187 - DNA, 19 bp, Homo sapiens
gttatttttacattctgaa

SEQ ID NO: 2409188 - DNA, 19 bp, Homo sapiens
gttcaacttttcctttgaa

SEQ ID NO: 2409189 - DNA, 21 bp, Homo sapiens
gttcaatataagcttttcttt

SEQ ID NO: 2409190 - DNA, 12 bp, Homo sapiens
gttcacattttt

SEQ ID NO: 2409191 - DNA, 14 bp, Homo sapiens
gttcattcctccag

SEQ ID NO: 2409192 - DNA, 17 bp, Homo sapiens
gttctctatcatttaat

SEQ ID NO: 2409193 - DNA, 21 bp, Homo sapiens
gttgaattttttttaacattc

SEQ ID NO: 2409194 - DNA, 15 bp, Homo sapiens
gttgagacaagaaaa

SEQ ID NO: 2409195 - DNA, 14 bp, Homo sapiens
gttgcaactttgta

SEQ ID NO: 2409196 - DNA, 20 bp, Homo sapiens
gttgcattaaaaatgcatat

SEQ ID NO: 2409197 - DNA, 16 bp, Homo sapiens
gttgccagttgtcctc

SEQ ID NO: 2409198 - DNA, 21 bp, Homo sapiens
gttggggtgggtataaaagat

SEQ ID NO: 2409199 - DNA, 18 bp, Homo sapiens
gttgtgggtagtggggaa

SEQ ID NO: 2409200 - DNA, 16 bp, Homo sapiens
gtttagtaatcatatt

SEQ ID NO: 2409201 - DNA, 21 bp, Homo sapiens
gtttctagcatgaagacagag

SEQ ID NO: 2409202 - DNA, 17 bp, Homo sapiens
gtttctttgtaatgaaa

SEQ ID NO: 2409203 - DNA, 15 bp, Homo sapiens
tagccttctctgttc

SEQ ID NO: 2409204 - DNA, 16 bp, Homo sapiens
tagctactaattttaa

SEQ ID NO: 2409205 - DNA, 22 bp, Homo sapiens
tagctggctctgtgagggtgct

SEQ ID NO: 2409206 - DNA, 19 bp, Homo sapiens
tagcttgataaagggccaa

SEQ ID NO: 2409207 - DNA, 19 bp, Homo sapiens
taggaaagaccatttttcc

SEQ ID NO: 2409208 - DNA, 20 bp, Homo sapiens
taggccttgcggctcctcag

SEQ ID NO: 2409209 - DNA, 24 bp, Homo sapiens
taggccttgcggctcctcagggac

SEQ ID NO: 2409210 - DNA, 18 bp, Homo sapiens
tagggcaattaattcctt

SEQ ID NO: 2409211 - DNA, 23 bp, Homo sapiens
taggttttaataattttttaatt

SEQ ID NO: 2409212 - DNA, 22 bp, Homo sapiens
tagtccagctttgttcttctta

SEQ ID NO: 2409213 - DNA, 23 bp, Homo sapiens
tagtccagctttgttcttcttaa

SEQ ID NO: 2409214 - DNA, 15 bp, Homo sapiens
tagtgctaagtgtga

SEQ ID NO: 2409215 - DNA, 18 bp, Homo sapiens
tagtgctaagtgtgaact

SEQ ID NO: 2409216 - DNA, 13 bp, Homo sapiens
tagtgttcataaa

SEQ ID NO: 2409217 - DNA, 13 bp, Homo sapiens
tagttctgtagaa

SEQ ID NO: 2409218 - DNA, 14 bp, Homo sapiens
tagttctgtagaaa

SEQ ID NO: 2409219 - DNA, 15 bp, Homo sapiens
tagttctgtagaaat

SEQ ID NO: 2409220 - DNA, 20 bp, Homo sapiens
tagttgcaactttgtataaa

SEQ ID NO: 2409221 - DNA, 12 bp, Homo sapiens
tagtttctgagt

SEQ ID NO: 2409222 - DNA, 21 bp, Homo sapiens
tataaaagatggggtctgtaa

SEQ ID NO: 2409223 - DNA, 12 bp, Homo sapiens
tataaaagcctg

SEQ ID NO: 2409224 - DNA, 20 bp, Homo sapiens
tataaaagcctgtttaagag

SEQ ID NO: 2409225 - DNA, 20 bp, Homo sapiens
tataaaatcagccaattatg

SEQ ID NO: 2409226 - DNA, 16 bp, Homo sapiens
tataactggaaagaag

SEQ ID NO: 2409227 - DNA, 19 bp, Homo sapiens
tataagtgattgctggttt

SEQ ID NO: 2409228 - DNA, 14 bp, Homo sapiens
tataagtgctgtat

SEQ ID NO: 2409229 - DNA, 17 bp, Homo sapiens
tataagtgctgtataaa

SEQ ID NO: 2409230 - DNA, 19 bp, Homo sapiens
tataagtgctgtataaaat

SEQ ID NO: 2409231 - DNA, 15 bp, Homo sapiens
tataagtgtgtgttt

SEQ ID NO: 2409232 - DNA, 17 bp, Homo sapiens
tataatcattattactt

SEQ ID NO: 2409233 - DNA, 12 bp, Homo sapiens
tatacctcactt

SEQ ID NO: 2409234 - DNA, 21 bp, Homo sapiens
tatactctcaccatttggatc

SEQ ID NO: 2409235 - DNA, 23 bp, Homo sapiens
tatacttgtggactaaaagatat

SEQ ID NO: 2409236 - DNA, 13 bp, Homo sapiens
tatatatcaaata

SEQ ID NO: 2409237 - DNA, 18 bp, Homo sapiens
tatatattatcttttcat

SEQ ID NO: 2409238 - DNA, 16 bp, Homo sapiens
tatattgatccagaaa

SEQ ID NO: 2409239 - DNA, 12 bp, Homo sapiens
tatatttacaaa

SEQ ID NO: 2409240 - DNA, 16 bp, Homo sapiens
tatatttagtatcttt

SEQ ID NO: 2409241 - DNA, 20 bp, Homo sapiens
tatcatttaataatatactt

SEQ ID NO: 2409242 - DNA, 22 bp, Homo sapiens
tatcatttaataatatacttgt

SEQ ID NO: 2409243 - DNA, 16 bp, Homo sapiens
tatcctctttagagtt

SEQ ID NO: 2409244 - DNA, 17 bp, Homo sapiens
tatcctctttagagtta

SEQ ID NO: 2409245 - DNA, 13 bp, Homo sapiens
tatctgcctttat

SEQ ID NO: 2409246 - DNA, 21 bp, Homo sapiens
tatcttttcatacattttcta

SEQ ID NO: 2409247 - DNA, 21 bp, Homo sapiens
tatgaaggctgtacactgcac

SEQ ID NO: 2409248 - DNA, 14 bp, Homo sapiens
tatgagctcttcat

SEQ ID NO: 2409249 - DNA, 14 bp, Homo sapiens
tatggcctgtggat

SEQ ID NO: 2409250 - DNA, 14 bp, Homo sapiens
tatgtgccagattt

SEQ ID NO: 2409251 - DNA, 20 bp, Homo sapiens
tatgttaaactagcatatct

SEQ ID NO: 2409252 - DNA, 18 bp, Homo sapiens
tatgttactacatgcact

SEQ ID NO: 2409253 - DNA, 18 bp, Homo sapiens
tatgttggtagattctaa

SEQ ID NO: 2409254 - DNA, 22 bp, Homo sapiens
tatgttgtaatatttcttcaaa

SEQ ID NO: 2409255 - DNA, 19 bp, Homo sapiens
tattaataaacattctatc

SEQ ID NO: 2409256 - DNA, 21 bp, Homo sapiens
tattagatgttctctatcatt

SEQ ID NO: 2409257 - DNA, 22 bp, Homo sapiens
tattagatgttctctatcattt

SEQ ID NO: 2409258 - DNA, 20 bp, Homo sapiens
tattatggaggcaggagttt

SEQ ID NO: 2409259 - DNA, 15 bp, Homo sapiens
tattcaataaagtat

SEQ ID NO: 2409260 - DNA, 21 bp, Homo sapiens
tattcatattttctttcaaaa

SEQ ID NO: 2409261 - DNA, 22 bp, Homo sapiens
tattcctgtggatgtaaagtga

SEQ ID NO: 2409262 - DNA, 16 bp, Homo sapiens
tattctagcctgcatt

SEQ ID NO: 2409263 - DNA, 18 bp, Homo sapiens
tattgataagatctttta

SEQ ID NO: 2409264 - DNA, 12 bp, Homo sapiens
tattgcacatgt

SEQ ID NO: 2409265 - DNA, 21 bp, Homo sapiens
tattgcttgcacaaaccaatt

SEQ ID NO: 2409266 - DNA, 10 bp, Homo sapiens
tattgtattt

SEQ ID NO: 2409267 - DNA, 17 bp, Homo sapiens
gggcccctgcctctctg

SEQ ID NO: 2409268 - DNA, 11 bp, Homo sapiens
gggcccggacg

SEQ ID NO: 2409269 - DNA, 12 bp, Homo sapiens
ggggaagacagt

SEQ ID NO: 2409270 - DNA, 23 bp, Homo sapiens
ggggcccggacgcccaggacccc

SEQ ID NO: 2409271 - DNA, 12 bp, Homo sapiens
ggggcctccctg

SEQ ID NO: 2409272 - DNA, 19 bp, Homo sapiens
gggggtgctgggcccctgc

SEQ ID NO: 2409273 - DNA, 20 bp, Homo sapiens
ggggtatttcaattaccttc

SEQ ID NO: 2409274 - DNA, 13 bp, Homo sapiens
gggtcgccctgga

SEQ ID NO: 2409275 - DNA, 16 bp, Homo sapiens
gggtctgtaaaatctt

SEQ ID NO: 2409276 - DNA, 20 bp, Homo sapiens
gggtctgtaaaatctttctt

SEQ ID NO: 2409277 - DNA, 15 bp, Homo sapiens
gggttctcacagtgg

SEQ ID NO: 2409278 - DNA, 21 bp, Homo sapiens
gggttggagcagtagctggag

SEQ ID NO: 2409279 - DNA, 19 bp, Homo sapiens
gggtttaatccccagtaaa

SEQ ID NO: 2409280 - DNA, 22 bp, Homo sapiens
gggtttaatccccagtaaaatt

SEQ ID NO: 2409281 - DNA, 20 bp, Homo sapiens
gggtttcaccatgttagcca

SEQ ID NO: 2409282 - DNA, 20 bp, Homo sapiens
ggtattgtatttattcaata

SEQ ID NO: 2409283 - DNA, 16 bp, Homo sapiens
ggtccctaataaagct

SEQ ID NO: 2409284 - DNA, 21 bp, Homo sapiens
ggtctcccttctctacactct

SEQ ID NO: 2409285 - DNA, 15 bp, Homo sapiens
ggtgctgggcccctg

SEQ ID NO: 2409286 - DNA, 19 bp, Homo sapiens
ggttgtattagatgttctc

SEQ ID NO: 2409287 - DNA, 17 bp, Homo sapiens
ggtttctgagttcctgc

SEQ ID NO: 2409288 - DNA, 14 bp, Homo sapiens
ggttttttagttga

SEQ ID NO: 2409289 - DNA, 18 bp, Homo sapiens
gtaaaaacaaagaaatta

SEQ ID NO: 2409290 - DNA, 20 bp, Homo sapiens
gtaaaacagggccacataga

SEQ ID NO: 2409291 - DNA, 20 bp, Homo sapiens
gtaaaacctggagatggtgg

SEQ ID NO: 2409292 - DNA, 16 bp, Homo sapiens
gtaaaatcttgtcatg

SEQ ID NO: 2409293 - DNA, 15 bp, Homo sapiens
gtaaaattgccatat

SEQ ID NO: 2409294 - DNA, 20 bp, Homo sapiens
gtaaaattgccatattgcac

SEQ ID NO: 2409295 - DNA, 13 bp, Homo sapiens
gtaaagaattatt

SEQ ID NO: 2409296 - DNA, 15 bp, Homo sapiens
gtaaatttgtactat

SEQ ID NO: 2409297 - DNA, 20 bp, Homo sapiens
gtaataggcgtaactaattt

SEQ ID NO: 2409298 - DNA, 20 bp, Homo sapiens
gtactgggattacaggcgtg

SEQ ID NO: 2409299 - DNA, 18 bp, Homo sapiens
gtagaaatggttgtatta

SEQ ID NO: 2409300 - DNA, 18 bp, Homo sapiens
gtagacagtatataacta

SEQ ID NO: 2409301 - DNA, 15 bp, Homo sapiens
gtagggagttgtggg

SEQ ID NO: 2409302 - DNA, 23 bp, Homo sapiens
gtagggtttaatccccagtaaaa

SEQ ID NO: 2409303 - DNA, 19 bp, Homo sapiens
gtagtctcactgcttgaac

SEQ ID NO: 2409304 - DNA, 11 bp, Homo sapiens
gtataaaagat

SEQ ID NO: 2409305 - DNA, 23 bp, Homo sapiens
gtataaaagatggggtctgtaaa

SEQ ID NO: 2409306 - DNA, 12 bp, Homo sapiens
gtatattcactt

SEQ ID NO: 2409307 - DNA, 22 bp, Homo sapiens
gtatattgatccagaaagaaaa

SEQ ID NO: 2409308 - DNA, 14 bp, Homo sapiens
gtattagatgttct

SEQ ID NO: 2409309 - DNA, 15 bp, Homo sapiens
gtattagatgttctc

SEQ ID NO: 2409310 - DNA, 19 bp, Homo sapiens
gtattccagacctgaagaa

SEQ ID NO: 2409311 - DNA, 12 bp, Homo sapiens
gtattgtattta

SEQ ID NO: 2409312 - DNA, 13 bp, Homo sapiens
gtattgtatttat

SEQ ID NO: 2409313 - DNA, 16 bp, Homo sapiens
gtattgtatttattca

SEQ ID NO: 2409314 - DNA, 21 bp, Homo sapiens
gtatttaattagtgctaagtg

SEQ ID NO: 2409315 - DNA, 14 bp, Homo sapiens
gtatttattcaata

SEQ ID NO: 2409316 - DNA, 16 bp, Homo sapiens
gtatttattcaataaa

SEQ ID NO: 2409317 - DNA, 22 bp, Homo sapiens
gtatttattcaataaagtattt

SEQ ID NO: 2409318 - DNA, 23 bp, Homo sapiens
gtatttattcaataaagtattta

SEQ ID NO: 2409319 - DNA, 15 bp, Homo sapiens
gtatttgaatcagcc

SEQ ID NO: 2409320 - DNA, 17 bp, Homo sapiens
gtcaacactaacatgat

SEQ ID NO: 2409321 - DNA, 18 bp, Homo sapiens
gtcacagggcctggggag

SEQ ID NO: 2409322 - DNA, 17 bp, Homo sapiens
gtcagaatagaaattag

SEQ ID NO: 2409323 - DNA, 21 bp, Homo sapiens
gtcagcaagtcctaagcctgt

SEQ ID NO: 2409324 - DNA, 13 bp, Homo sapiens
cttctattctagc

SEQ ID NO: 2409325 - DNA, 15 bp, Homo sapiens
cttctcccaattcat

SEQ ID NO: 2409326 - DNA, 14 bp, Homo sapiens
cttctcccctgcac

SEQ ID NO: 2409327 - DNA, 18 bp, Homo sapiens
cttctcccctgcactgta

SEQ ID NO: 2409328 - DNA, 19 bp, Homo sapiens
cttctcccctgcactgtaa

SEQ ID NO: 2409329 - DNA, 23 bp, Homo sapiens
cttctcccctgcactgtaaaatg

SEQ ID NO: 2409330 - DNA, 22 bp, Homo sapiens
cttctctgtattcctagaaact

SEQ ID NO: 2409331 - DNA, 17 bp, Homo sapiens
cttctctgttcatttcc

SEQ ID NO: 2409332 - DNA, 13 bp, Homo sapiens
cttctggccttgt

SEQ ID NO: 2409333 - DNA, 12 bp, Homo sapiens
cttgaaaattaa

SEQ ID NO: 2409334 - DNA, 13 bp, Homo sapiens
cttgaaaattaac

SEQ ID NO: 2409335 - DNA, 18 bp, Homo sapiens
cttgagccaggaggcctg

SEQ ID NO: 2409336 - DNA, 13 bp, Homo sapiens
cttgatgcctggc

SEQ ID NO: 2409337 - DNA, 15 bp, Homo sapiens
cttgatgtaaaatct

SEQ ID NO: 2409338 - DNA, 21 bp, Homo sapiens
cttgatgtaaaatcttgtcat

SEQ ID NO: 2409339 - DNA, 17 bp, Homo sapiens
cttgcctcaacctccca

SEQ ID NO: 2409340 - DNA, 18 bp, Homo sapiens
cttgcctcaacctcccaa

SEQ ID NO: 2409341 - DNA, 15 bp, Homo sapiens
cttgcctctgcacac

SEQ ID NO: 2409342 - DNA, 24 bp, Homo sapiens
cttgcctctgcacaccctccagag

SEQ ID NO: 2409343 - DNA, 18 bp, Homo sapiens
cttgctcttgatgcctgg

SEQ ID NO: 2409344 - DNA, 20 bp, Homo sapiens
cttggccatgggaggccttt

SEQ ID NO: 2409345 - DNA, 23 bp, Homo sapiens
cttggccatgggaggcctttccc

SEQ ID NO: 2409346 - DNA, 18 bp, Homo sapiens
cttgtaaaggaatttaaa

SEQ ID NO: 2409347 - DNA, 17 bp, Homo sapiens
cttgtactttattttct

SEQ ID NO: 2409348 - DNA, 13 bp, Homo sapiens
cttgtattatgtg

SEQ ID NO: 2409349 - DNA, 15 bp, Homo sapiens
cttgtcatgtgtata

SEQ ID NO: 2409350 - DNA, 16 bp, Homo sapiens
cttgtcatgtgtataa

SEQ ID NO: 2409351 - DNA, 19 bp, Homo sapiens
cttgtcatgtgtataaaaa

SEQ ID NO: 2409352 - DNA, 16 bp, Homo sapiens
cttgtctcaatgctca

SEQ ID NO: 2409353 - DNA, 23 bp, Homo sapiens
cttgtctcaatgctcataacgga

SEQ ID NO: 2409354 - DNA, 13 bp, Homo sapiens
cttgtgaggaaag

SEQ ID NO: 2409355 - DNA, 16 bp, Homo sapiens
cttgtgaggaaagtca

SEQ ID NO: 2409356 - DNA, 17 bp, Homo sapiens
cttgtgaggaaagtcat

SEQ ID NO: 2409357 - DNA, 19 bp, Homo sapiens
cttgtgaggaaagtcattg

SEQ ID NO: 2409358 - DNA, 23 bp, Homo sapiens
cttgtgaggaaagtcattggctt

SEQ ID NO: 2409359 - DNA, 17 bp, Homo sapiens
cttgtggactaaaagat

SEQ ID NO: 2409360 - DNA, 18 bp, Homo sapiens
cttgtggactaaaagata

SEQ ID NO: 2409361 - DNA, 19 bp, Homo sapiens
cttgtggactaaaagatat

SEQ ID NO: 2409362 - DNA, 16 bp, Homo sapiens
cttgtgtcaaacagta

SEQ ID NO: 2409363 - DNA, 15 bp, Homo sapiens
ctttatagatcagcc

SEQ ID NO: 2409364 - DNA, 15 bp, Homo sapiens
cagctcactgcaacc

SEQ ID NO: 2409365 - DNA, 14 bp, Homo sapiens
cagctccagctgct

SEQ ID NO: 2409366 - DNA, 16 bp, Homo sapiens
cagctctccccttctc

SEQ ID NO: 2409367 - DNA, 22 bp, Homo sapiens
cagctgcctggaagagcagccc

SEQ ID NO: 2409368 - DNA, 19 bp, Homo sapiens
cagctggggccaggctggg

SEQ ID NO: 2409369 - DNA, 22 bp, Homo sapiens
cagctggggccaggctgggtcg

SEQ ID NO: 2409370 - DNA, 18 bp, Homo sapiens
cagcttctcatcctgcag

SEQ ID NO: 2409371 - DNA, 21 bp, Homo sapiens
cagcttctcatcctgcaggca

SEQ ID NO: 2409372 - DNA, 23 bp, Homo sapiens
cagcttgatcaaaggcacacagc

SEQ ID NO: 2409373 - DNA, 17 bp, Homo sapiens
cagctttttaccaagtt

SEQ ID NO: 2409374 - DNA, 21 bp, Homo sapiens
caggagccctgggaggctctg

SEQ ID NO: 2409375 - DNA, 20 bp, Homo sapiens
caggatactggcacagaggt

SEQ ID NO: 2409376 - DNA, 22 bp, Homo sapiens
caggatgagggaaaagaaaaag

SEQ ID NO: 2409377 - DNA, 22 bp, Homo sapiens
caggatgatgactatggaaaga

SEQ ID NO: 2409378 - DNA, 21 bp, Homo sapiens
caggatggcaaccagaccatt

SEQ ID NO: 2409379 - DNA, 18 bp, Homo sapiens
caggatggtctccatctc

SEQ ID NO: 2409380 - DNA, 21 bp, Homo sapiens
caggatggtggcaggaaaatg

SEQ ID NO: 2409381 - DNA, 19 bp, Homo sapiens
caggcagctttttctctcc

SEQ ID NO: 2409382 - DNA, 18 bp, Homo sapiens
caggctgctcagggctgg

SEQ ID NO: 2409383 - DNA, 17 bp, Homo sapiens
caggcttgcctgcaggc

SEQ ID NO: 2409384 - DNA, 18 bp, Homo sapiens
caggcttgcctgcaggca

SEQ ID NO: 2409385 - DNA, 17 bp, Homo sapiens
cagggaggtggctgggt

SEQ ID NO: 2409386 - DNA, 23 bp, Homo sapiens
caggtaggaggcaaatatcttga

SEQ ID NO: 2409387 - DNA, 15 bp, Homo sapiens
caggtatacctcact

SEQ ID NO: 2409388 - DNA, 12 bp, Homo sapiens
caggtccctaat

SEQ ID NO: 2409389 - DNA, 20 bp, Homo sapiens
caggtccctaataaagctgt

SEQ ID NO: 2409390 - DNA, 21 bp, Homo sapiens
caggtccctaataaagctgtg

SEQ ID NO: 2409391 - DNA, 15 bp, Homo sapiens
cagtaaaattgccat

SEQ ID NO: 2409392 - DNA, 21 bp, Homo sapiens
cagtaaaattgccatattgca

SEQ ID NO: 2409393 - DNA, 14 bp, Homo sapiens
cagtaactcatctg

SEQ ID NO: 2409394 - DNA, 12 bp, Homo sapiens
cagtaccacatg

SEQ ID NO: 2409395 - DNA, 14 bp, Homo sapiens
cagtgaaaaactat

SEQ ID NO: 2409396 - DNA, 22 bp, Homo sapiens
cagtgagcttggaaaggaccag

SEQ ID NO: 2409397 - DNA, 23 bp, Homo sapiens
cagtgcctttcttctctccagtg

SEQ ID NO: 2409398 - DNA, 12 bp, Homo sapiens
cagtgcggccag

SEQ ID NO: 2409399 - DNA, 14 bp, Homo sapiens
cagtgctcgctgtt

SEQ ID NO: 2409400 - DNA, 22 bp, Homo sapiens
cagtgctcgctgttgctgaata

SEQ ID NO: 2409401 - DNA, 18 bp, Homo sapiens
cagtgggaaaaatgtagg

SEQ ID NO: 2409402 - DNA, 21 bp, Homo sapiens
cagtgtgtggctttcagagcc

SEQ ID NO: 2409403 - DNA, 22 bp, Homo sapiens
cagttattatatttacaaatgg

SEQ ID NO: 2409404 - DNA, 18 bp, Homo sapiens
cagttgagacaagaaaat

SEQ ID NO: 2409405 - DNA, 16 bp, Homo sapiens
cataaagcaggcagaa

SEQ ID NO: 2409406 - DNA, 18 bp, Homo sapiens
cataattattatttggcc

SEQ ID NO: 2409407 - DNA, 20 bp, Homo sapiens
catacacctatgtcatttca

SEQ ID NO: 2409408 - DNA, 20 bp, Homo sapiens
catagcttgataaagggcca

SEQ ID NO: 2409409 - DNA, 16 bp, Homo sapiens
cataggtttaataatt

SEQ ID NO: 2409410 - DNA, 11 bp, Homo sapiens
catatctgcct

SEQ ID NO: 2409411 - DNA, 18 bp, Homo sapiens
catatctgcctttattgt

SEQ ID NO: 2409412 - DNA, 13 bp, Homo sapiens
catattgttactg

SEQ ID NO: 2409413 - DNA, 12 bp, Homo sapiens
catatttataaa

SEQ ID NO: 2409414 - DNA, 13 bp, Homo sapiens
catcaccacagtt

SEQ ID NO: 2409415 - DNA, 15 bp, Homo sapiens
catcaggctttcttt

SEQ ID NO: 2409416 - DNA, 15 bp, Homo sapiens
catcatctcagctca

SEQ ID NO: 2409417 - DNA, 20 bp, Homo sapiens
catcatttctttttgggaga

SEQ ID NO: 2409418 - DNA, 19 bp, Homo sapiens
catctagaggcttccttca

SEQ ID NO: 2409419 - DNA, 20 bp, Homo sapiens
catctagaggcttccttcat

SEQ ID NO: 2409420 - DNA, 19 bp, Homo sapiens
catctcagctcactgcaac

SEQ ID NO: 2409421 - DNA, 18 bp, Homo sapiens
catcttgcccgctcaggc

SEQ ID NO: 2409422 - DNA, 15 bp, Homo sapiens
catctttccctcctt

SEQ ID NO: 2409423 - DNA, 17 bp, Homo sapiens
catctttccctccttgg

SEQ ID NO: 2409424 - DNA, 18 bp, Homo sapiens
catctttccctccttggt

SEQ ID NO: 2409425 - DNA, 21 bp, Homo sapiens
catctttccctccttggtgat

SEQ ID NO: 2409426 - DNA, 19 bp, Homo sapiens
catgaacctcaagctgcat

SEQ ID NO: 2409427 - DNA, 18 bp, Homo sapiens
catgaagagatttttcat

SEQ ID NO: 2409428 - DNA, 15 bp, Homo sapiens
catgaagctgttgtg

SEQ ID NO: 2409429 - DNA, 16 bp, Homo sapiens
catgaaggtgtcatac

SEQ ID NO: 2409430 - DNA, 21 bp, Homo sapiens
catgaatatttagtgttcata

SEQ ID NO: 2409431 - DNA, 16 bp, Homo sapiens
catgaatgtaaatttg

SEQ ID NO: 2409432 - DNA, 17 bp, Homo sapiens
catgaatgtaaatttgt

SEQ ID NO: 2409433 - DNA, 22 bp, Homo sapiens
catgaatgtaaatttgtactat

SEQ ID NO: 2409434 - DNA, 14 bp, Homo sapiens
catgaatttgtgaa

SEQ ID NO: 2409435 - DNA, 18 bp, Homo sapiens
catgagtcactacgcctg

SEQ ID NO: 2409436 - DNA, 14 bp, Homo sapiens
catgattcatttta

SEQ ID NO: 2409437 - DNA, 15 bp, Homo sapiens
catgcattactgcat

SEQ ID NO: 2409438 - DNA, 17 bp, Homo sapiens
catgcattactgcatgc

SEQ ID NO: 2409439 - DNA, 20 bp, Homo sapiens
catgcattactgcatgcact

SEQ ID NO: 2409440 - DNA, 17 bp, Homo sapiens
catgctgctggggaaga

SEQ ID NO: 2409441 - DNA, 22 bp, Homo sapiens
catggacttctgccagcataat

SEQ ID NO: 2409442 - DNA, 12 bp, Homo sapiens
catggcagtggg

SEQ ID NO: 2409443 - DNA, 23 bp, Homo sapiens
catgtaagctgaaaatatggcaa

SEQ ID NO: 2409444 - DNA, 20 bp, Homo sapiens
catgtatctatgcattttct

SEQ ID NO: 2409445 - DNA, 15 bp, Homo sapiens
catgtatttggtgat

SEQ ID NO: 2409446 - DNA, 20 bp, Homo sapiens
catgtatttggtgattacat

SEQ ID NO: 2409447 - DNA, 18 bp, Homo sapiens
catgtcaagggttcaaga

SEQ ID NO: 2409448 - DNA, 14 bp, Homo sapiens
catgtcttaatgaa

SEQ ID NO: 2409449 - DNA, 15 bp, Homo sapiens
catgtcttaatgaag

SEQ ID NO: 2409450 - DNA, 18 bp, Homo sapiens
catgtcttaatgaagttt

SEQ ID NO: 2409451 - DNA, 20 bp, Homo sapiens
catgtcttaatgaagtttga

SEQ ID NO: 2409452 - DNA, 21 bp, Homo sapiens
catgtcttaatgaagtttgaa

SEQ ID NO: 2409453 - DNA, 21 bp, Homo sapiens
catgtgtggtacatggtgttt

SEQ ID NO: 2409454 - DNA, 18 bp, Homo sapiens
catgtgtttactttatgt

SEQ ID NO: 2409455 - DNA, 21 bp, Homo sapiens
catgtttctttgtaatgaaaa

SEQ ID NO: 2409456 - DNA, 22 bp, Homo sapiens
cattaaaaatgcatatacttta

SEQ ID NO: 2409457 - DNA, 18 bp, Homo sapiens
cattaatctgcctccctc

SEQ ID NO: 2409458 - DNA, 23 bp, Homo sapiens
cattactgcatgcacttcttaca

SEQ ID NO: 2409459 - DNA, 18 bp, Homo sapiens
cattcctcatgaatgtaa

SEQ ID NO: 2409460 - DNA, 13 bp, Homo sapiens
cattcctccaggt

SEQ ID NO: 2409461 - DNA, 14 bp, Homo sapiens
cattctattgttaa

SEQ ID NO: 2409462 - DNA, 14 bp, Homo sapiens
cattctcaagccct

SEQ ID NO: 2409463 - DNA, 13 bp, Homo sapiens
cattggctttatc

SEQ ID NO: 2409464 - DNA, 22 bp, Homo sapiens
cattggctttatcctctttaga

SEQ ID NO: 2409465 - DNA, 22 bp, Homo sapiens
cattgtatagttggaatcatat

SEQ ID NO: 2409466 - DNA, 13 bp, Homo sapiens
cattgtcctcttt

SEQ ID NO: 2409467 - DNA, 21 bp, Homo sapiens
cattgttatataatcattatt

SEQ ID NO: 2409468 - DNA, 12 bp, Homo sapiens
catttaataata

SEQ ID NO: 2409469 - DNA, 14 bp, Homo sapiens
catttcatttccta

SEQ ID NO: 2409470 - DNA, 20 bp, Homo sapiens
tgcagctctccccttctctg

SEQ ID NO: 2409471 - DNA, 16 bp, Homo sapiens
tgcaggtccctaataa

SEQ ID NO: 2409472 - DNA, 19 bp, Homo sapiens
tgcaggtccctaataaagc

SEQ ID NO: 2409473 - DNA, 20 bp, Homo sapiens
tgcaggtccctaataaagct

SEQ ID NO: 2409474 - DNA, 22 bp, Homo sapiens
tgcagtggcatcatctcagctc

SEQ ID NO: 2409475 - DNA, 20 bp, Homo sapiens
tgcagttctttggctgaaag

SEQ ID NO: 2409476 - DNA, 20 bp, Homo sapiens
tgcatatttataaaaataaa

SEQ ID NO: 2409477 - DNA, 21 bp, Homo sapiens
tgcatctagaggcttccttca

SEQ ID NO: 2409478 - DNA, 22 bp, Homo sapiens
tgcattatatcaaatctaccac

SEQ ID NO: 2409479 - DNA, 15 bp, Homo sapiens
tgcattgtgcttctt

SEQ ID NO: 2409480 - DNA, 20 bp, Homo sapiens
tgcatttatgagctcttcat

SEQ ID NO: 2409481 - DNA, 22 bp, Homo sapiens
tgcattttgtttggtattgtat

SEQ ID NO: 2409482 - DNA, 23 bp, Homo sapiens
tgcattttgtttggtattgtatt

SEQ ID NO: 2409483 - DNA, 18 bp, Homo sapiens
tgccaaatataaataaaa

SEQ ID NO: 2409484 - DNA, 19 bp, Homo sapiens
tgccaggctggagtgcagt

SEQ ID NO: 2409485 - DNA, 19 bp, Homo sapiens
tgccatattgcacatgtct

SEQ ID NO: 2409486 - DNA, 21 bp, Homo sapiens
tgcccccaaccatttcctcag

SEQ ID NO: 2409487 - DNA, 21 bp, Homo sapiens
tgccccctaatccccttctcc

SEQ ID NO: 2409488 - DNA, 20 bp, Homo sapiens
tgcccgcctgggtctcctaa

SEQ ID NO: 2409489 - DNA, 14 bp, Homo sapiens
tgccctgctgccct

SEQ ID NO: 2409490 - DNA, 16 bp, Homo sapiens
tgccctgctgccctcc

SEQ ID NO: 2409491 - DNA, 16 bp, Homo sapiens
tgcctctctgcaggtc

SEQ ID NO: 2409492 - DNA, 15 bp, Homo sapiens
tgcctgccctattct

SEQ ID NO: 2409493 - DNA, 22 bp, Homo sapiens
tgcctgctttttatggcctgtg

SEQ ID NO: 2409494 - DNA, 19 bp, Homo sapiens
tgccttgtgtacagttatt

SEQ ID NO: 2409495 - DNA, 13 bp, Homo sapiens
tgccttgtttcat

SEQ ID NO: 2409496 - DNA, 20 bp, Homo sapiens
tgcctttattgtgtttgtca

SEQ ID NO: 2409497 - DNA, 17 bp, Homo sapiens
tgcctttggcagagttc

SEQ ID NO: 2409498 - DNA, 15 bp, Homo sapiens
tgcggctcctcaggg

SEQ ID NO: 2409499 - DNA, 13 bp, Homo sapiens
tgctaagtgtgaa

SEQ ID NO: 2409500 - DNA, 15 bp, Homo sapiens
tgctaagtgtgaact

SEQ ID NO: 2409501 - DNA, 17 bp, Homo sapiens
tgctaagtgtgaactgg

SEQ ID NO: 2409502 - DNA, 19 bp, Homo sapiens
tgctaattttgaaaaactg

SEQ ID NO: 2409503 - DNA, 21 bp, Homo sapiens
tgctagggttaggaggtcctt

SEQ ID NO: 2409504 - DNA, 17 bp, Homo sapiens
tgctcagcttctccaac

SEQ ID NO: 2409505 - DNA, 20 bp, Homo sapiens
tgctcagcttctccaacaat

SEQ ID NO: 2409506 - DNA, 23 bp, Homo sapiens
tgctcagggactcatctttccct

SEQ ID NO: 2409507 - DNA, 16 bp, Homo sapiens
tgctcagtagtcagac

SEQ ID NO: 2409508 - DNA, 13 bp, Homo sapiens
tgctgaccctccc

SEQ ID NO: 2409509 - DNA, 17 bp, Homo sapiens
tgctgaccctccccaaa

SEQ ID NO: 2409510 - DNA, 20 bp, Homo sapiens
tgctgagattacaggtgtga

SEQ ID NO: 2409511 - DNA, 17 bp, Homo sapiens
tgctgcctgctttttat

SEQ ID NO: 2409512 - DNA, 13 bp, Homo sapiens
tgctggaaatgga

SEQ ID NO: 2409513 - DNA, 17 bp, Homo sapiens
tgctgggcccctgcctc

SEQ ID NO: 2409514 - DNA, 22 bp, Homo sapiens
tgctgggcccctgcctctctgc

SEQ ID NO: 2409515 - DNA, 17 bp, Homo sapiens
tgctggggaagacagtg

SEQ ID NO: 2409516 - DNA, 22 bp, Homo sapiens
tgctggggaagacagtggcccc

SEQ ID NO: 2409517 - DNA, 18 bp, Homo sapiens
tgctggtgagccaagcag

SEQ ID NO: 2409518 - DNA, 15 bp, Homo sapiens
tgctgtataaaatca

SEQ ID NO: 2409519 - DNA, 18 bp, Homo sapiens
tgctgtataaaatcagcc

SEQ ID NO: 2409520 - DNA, 13 bp, Homo sapiens
tgcttctccagcc

SEQ ID NO: 2409521 - DNA, 19 bp, Homo sapiens
tgcttctttctttgggaat

SEQ ID NO: 2409522 - DNA, 15 bp, Homo sapiens
tgctttgcccctgag

SEQ ID NO: 2409523 - DNA, 17 bp, Homo sapiens
tgctttggaaaacccag

SEQ ID NO: 2409524 - DNA, 23 bp, Homo sapiens
tggaaagacagcttctcatcctg

SEQ ID NO: 2409525 - DNA, 18 bp, Homo sapiens
tggaactaggttttaata

SEQ ID NO: 2409526 - DNA, 20 bp, Homo sapiens
tggaactaggttttaataat

SEQ ID NO: 2409527 - DNA, 13 bp, Homo sapiens
tggaccctgttgc

SEQ ID NO: 2409528 - DNA, 15 bp, Homo sapiens
tggaccctgttgcta

SEQ ID NO: 2409529 - DNA, 14 bp, Homo sapiens
tggacttgcctctg

SEQ ID NO: 2409530 - DNA, 13 bp, Homo sapiens
tggagatgtttag

SEQ ID NO: 2409531 - DNA, 14 bp, Homo sapiens
tggagccccatcag

SEQ ID NO: 2409532 - DNA, 16 bp, Homo sapiens
tggaggggctggggac

SEQ ID NO: 2409533 - DNA, 13 bp, Homo sapiens
tggagtgcagtgg

SEQ ID NO: 2409534 - DNA, 23 bp, Homo sapiens
tggatgcagtgctcgctgttgct

SEQ ID NO: 2409535 - DNA, 14 bp, Homo sapiens
tggatttttaccag

SEQ ID NO: 2409536 - DNA, 22 bp, Homo sapiens
tggatttttaccagtctcacat

SEQ ID NO: 2409537 - DNA, 23 bp, Homo sapiens
tggcacagaggtagtctcactgc

SEQ ID NO: 2409538 - DNA, 19 bp, Homo sapiens
tggcagtgggaaaaatgta

SEQ ID NO: 2409539 - DNA, 12 bp, Homo sapiens
tggcatgtgttt

SEQ ID NO: 2409540 - DNA, 20 bp, Homo sapiens
tggccaggcttgtctcgaac

SEQ ID NO: 2409541 - DNA, 22 bp, Homo sapiens
tggccatgggaggcctttccct

SEQ ID NO: 2409542 - DNA, 23 bp, Homo sapiens
tggccatgggaggcctttcccta

SEQ ID NO: 2409543 - DNA, 16 bp, Homo sapiens
tggcctatgtggtcta

SEQ ID NO: 2409544 - DNA, 19 bp, Homo sapiens
tggcctatgtggtctaagg

SEQ ID NO: 2409545 - DNA, 15 bp, Homo sapiens
tggcggggtggggtg

SEQ ID NO: 2409546 - DNA, 16 bp, Homo sapiens
tggctgaaaggaagct

SEQ ID NO: 2409547 - DNA, 13 bp, Homo sapiens
tggctttggaagc

SEQ ID NO: 2409548 - DNA, 13 bp, Homo sapiens
tgggaatatttga

SEQ ID NO: 2409549 - DNA, 16 bp, Homo sapiens
tgggaatatttgaatc

SEQ ID NO: 2409550 - DNA, 14 bp, Homo sapiens
tgggaggctctgga

SEQ ID NO: 2409551 - DNA, 14 bp, Homo sapiens
tgggagtacaaaag

SEQ ID NO: 2409552 - DNA, 15 bp, Homo sapiens
tgggcagaaggccaa

SEQ ID NO: 2409553 - DNA, 18 bp, Homo sapiens
tgggcagaaggccaagag

SEQ ID NO: 2409554 - DNA, 13 bp, Homo sapiens
tgggcagccagac

SEQ ID NO: 2409555 - DNA, 15 bp, Homo sapiens
tgggcccctgcctct

SEQ ID NO: 2409556 - DNA, 23 bp, Homo sapiens
tgggcccctgcctctctgcaggt

SEQ ID NO: 2409557 - DNA, 13 bp, Homo sapiens
tggggggggtgct

SEQ ID NO: 2409558 - DNA, 16 bp, Homo sapiens
tggggtctgtaaaatc

SEQ ID NO: 2409559 - DNA, 22 bp, Homo sapiens
tggggtggggggggtgctgggc

SEQ ID NO: 2409560 - DNA, 19 bp, Homo sapiens
tggggtgggtataaaagat

SEQ ID NO: 2409561 - DNA, 12 bp, Homo sapiens
tgggtataaaag

SEQ ID NO: 2409562 - DNA, 12 bp, Homo sapiens
tggtattgtatt

SEQ ID NO: 2409563 - DNA, 19 bp, Homo sapiens
tggtattgtatttattcaa

SEQ ID NO: 2409564 - DNA, 16 bp, Homo sapiens
tggtgatttagcagga

SEQ ID NO: 2409565 - DNA, 12 bp, Homo sapiens
tggtgccttcat

SEQ ID NO: 2409566 - DNA, 16 bp, Homo sapiens
tggtgtggcaaagcct

SEQ ID NO: 2409567 - DNA, 12 bp, Homo sapiens
tggttgtattag

SEQ ID NO: 2409568 - DNA, 14 bp, Homo sapiens
tggttgtattagat

SEQ ID NO: 2409569 - DNA, 12 bp, Homo sapiens
tgtaaaatcttg

SEQ ID NO: 2409570 - DNA, 15 bp, Homo sapiens
tgtaaaatcttgtca

SEQ ID NO: 2409571 - DNA, 16 bp, Homo sapiens
tgtaaaatcttgtcat

SEQ ID NO: 2409572 - DNA, 16 bp, Homo sapiens
tgtaaaggaatttaaa

SEQ ID NO: 2409573 - DNA, 17 bp, Homo sapiens
tgtaactttctctatga

SEQ ID NO: 2409574 - DNA, 20 bp, Homo sapiens
tgtaatagggaaaattctaa

SEQ ID NO: 2409575 - DNA, 17 bp, Homo sapiens
tgtaatgaaaaccacat

SEQ ID NO: 2409576 - DNA, 15 bp, Homo sapiens
tgtaatgttaatatt

SEQ ID NO: 2409577 - DNA, 17 bp, Homo sapiens
tgtacagttatttatgc

SEQ ID NO: 2409578 - DNA, 15 bp, Homo sapiens
tgtactatttaactg

SEQ ID NO: 2409579 - DNA, 19 bp, Homo sapiens
tgtacttgctcttgatgcc

SEQ ID NO: 2409580 - DNA, 22 bp, Homo sapiens
tgtacttgctcttgatgcctgg

SEQ ID NO: 2409581 - DNA, 13 bp, Homo sapiens
tgtagaaatggtt

SEQ ID NO: 2409582 - DNA, 17 bp, Homo sapiens
tgtagataatacagttc

SEQ ID NO: 2409583 - DNA, 20 bp, Homo sapiens
tgtagtttttatatgttgta

SEQ ID NO: 2409584 - DNA, 12 bp, Homo sapiens
tgtatattcact

SEQ ID NO: 2409585 - DNA, 19 bp, Homo sapiens
tgtatctatgcattttctg

SEQ ID NO: 2409586 - DNA, 19 bp, Homo sapiens
tgtattagatgttctctat

SEQ ID NO: 2409587 - DNA, 19 bp, Homo sapiens
tgtatttattcaataaagt

SEQ ID NO: 2409588 - DNA, 22 bp, Homo sapiens
tgtatttattcaataaagtatt

SEQ ID NO: 2409589 - DNA, 23 bp, Homo sapiens
tgtatttccccaacatgtaataa

SEQ ID NO: 2409590 - DNA, 14 bp, Homo sapiens
tgtcattagcctga

SEQ ID NO: 2409591 - DNA, 15 bp, Homo sapiens
tgtccaaactgccta

SEQ ID NO: 2409592 - DNA, 22 bp, Homo sapiens
tgtccaaactgcctaagccctc

SEQ ID NO: 2409593 - DNA, 18 bp, Homo sapiens
tgtccaacccgaggcccg

SEQ ID NO: 2409594 - DNA, 14 bp, Homo sapiens
tgtctcaatgctca

SEQ ID NO: 2409595 - DNA, 17 bp, Homo sapiens
tgtctcaatgctcataa

SEQ ID NO: 2409596 - DNA, 18 bp, Homo sapiens
tgtctgtgaagtgagacc

SEQ ID NO: 2409597 - DNA, 14 bp, Homo sapiens
tgtcttaatgaagt

SEQ ID NO: 2409598 - DNA, 20 bp, Homo sapiens
tgtcttaatgaagtttgaat

SEQ ID NO: 2409599 - DNA, 18 bp, Homo sapiens
tgtgaactggaccctgtt

SEQ ID NO: 2409600 - DNA, 16 bp, Homo sapiens
tgtgatataagtgtgt

SEQ ID NO: 2409601 - DNA, 20 bp, Homo sapiens
tgtgccagatttatgcatat

SEQ ID NO: 2409602 - DNA, 18 bp, Homo sapiens
tgtgcccccaaccatttc

SEQ ID NO: 2409603 - DNA, 21 bp, Homo sapiens
tgtgctcaggagccctgggag

SEQ ID NO: 2409604 - DNA, 21 bp, Homo sapiens
tgtgcttctttctttgggaat

SEQ ID NO: 2409605 - DNA, 16 bp, Homo sapiens
tgtggaatttaaatca

SEQ ID NO: 2409606 - DNA, 21 bp, Homo sapiens
tgtggactaaaagatataagt

SEQ ID NO: 2409607 - DNA, 16 bp, Homo sapiens
tgtgggattatgggtc

SEQ ID NO: 2409608 - DNA, 18 bp, Homo sapiens
tgtgggattatgggtcac

SEQ ID NO: 2409609 - DNA, 19 bp, Homo sapiens
tgtgggtagtggggaagag

SEQ ID NO: 2409610 - DNA, 16 bp, Homo sapiens
tgtgtatgtgtgtgtg

SEQ ID NO: 2409611 - DNA, 17 bp, Homo sapiens
tgtgtgcatcaggcttt

SEQ ID NO: 2409612 - DNA, 22 bp, Homo sapiens
tgtgtggagagggaatgtgaaa

SEQ ID NO: 2409613 - DNA, 20 bp, Homo sapiens
tgtgtggctttcagagcctc

SEQ ID NO: 2409614 - DNA, 22 bp, Homo sapiens
tgtgtttaggaactactgagga

SEQ ID NO: 2409615 - DNA, 15 bp, Homo sapiens
tgtgtttttaacatg

SEQ ID NO: 2409616 - DNA, 18 bp, Homo sapiens
tgttaaactagcatatct

SEQ ID NO: 2409617 - DNA, 22 bp, Homo sapiens
tgttaaactagcatatctgcct

SEQ ID NO: 2409618 - DNA, 18 bp, Homo sapiens
tgttaaataaattgtata

SEQ ID NO: 2409619 - DNA, 16 bp, Homo sapiens
tgttataataaatgta

SEQ ID NO: 2409620 - DNA, 21 bp, Homo sapiens
tgttcccaccaggctgctcag

SEQ ID NO: 2409621 - DNA, 12 bp, Homo sapiens
tgttctatagct

SEQ ID NO: 2409622 - DNA, 15 bp, Homo sapiens
tgttctctatcattt

SEQ ID NO: 2409623 - DNA, 18 bp, Homo sapiens
tgttctctatcatttaat

SEQ ID NO: 2409624 - DNA, 20 bp, Homo sapiens
tgttctctatcatttaataa

SEQ ID NO: 2409625 - DNA, 15 bp, Homo sapiens
tgttctgtgatataa

SEQ ID NO: 2409626 - DNA, 17 bp, Homo sapiens
tgttgccagttgtcctc

SEQ ID NO: 2409627 - DNA, 19 bp, Homo sapiens
tgttgccagttgtcctcct

SEQ ID NO: 2409628 - DNA, 11 bp, Homo sapiens
tgttgctaagc

SEQ ID NO: 2409629 - DNA, 17 bp, Homo sapiens
tgttggggtgggtataa

SEQ ID NO: 2409630 - DNA, 20 bp, Homo sapiens
tgttggggtgggtataaaag

SEQ ID NO: 2409631 - DNA, 22 bp, Homo sapiens
tgttggggtgggtataaaagat

SEQ ID NO: 2409632 - DNA, 13 bp, Homo sapiens
tgtttagtaatca

SEQ ID NO: 2409633 - DNA, 14 bp, Homo sapiens
tgtttagtaatcat

SEQ ID NO: 2409634 - DNA, 16 bp, Homo sapiens
tgtttataaacattgt

SEQ ID NO: 2409635 - DNA, 17 bp, Homo sapiens
tgtttggtattgtattt

SEQ ID NO: 2409636 - DNA, 22 bp, Homo sapiens
tgtttggtattgtatttattca

SEQ ID NO: 2409637 - DNA, 15 bp, Homo sapiens
tgtttgtcattagcc

SEQ ID NO: 2409638 - DNA, 17 bp, Homo sapiens
tgtttgtcattagcctg

SEQ ID NO: 2409639 - DNA, 18 bp, Homo sapiens
tgttttaaaatgagaaat

SEQ ID NO: 2409640 - DNA, 23 bp, Homo sapiens
tgttttaaaatgagaaatctaaa

SEQ ID NO: 2409641 - DNA, 14 bp, Homo sapiens
ttaaacctatactc

SEQ ID NO: 2409642 - DNA, 17 bp, Homo sapiens
ttaaacctatactcact

SEQ ID NO: 2409643 - DNA, 19 bp, Homo sapiens
ttaaactagcatatctgcc

SEQ ID NO: 2409644 - DNA, 14 bp, Homo sapiens
ttaaagacttttat

SEQ ID NO: 2409645 - DNA, 23 bp, Homo sapiens
ttaaatgtttttttttaaagact

SEQ ID NO: 2409646 - DNA, 16 bp, Homo sapiens
ttaataatatacttgt

SEQ ID NO: 2409647 - DNA, 18 bp, Homo sapiens
ttaataatatacttgtgg

SEQ ID NO: 2409648 - DNA, 18 bp, Homo sapiens
ttaatccccagtaaaatt

SEQ ID NO: 2409649 - DNA, 17 bp, Homo sapiens
ttaatctttaattttac

SEQ ID NO: 2409650 - DNA, 16 bp, Homo sapiens
ttaatgaagtttgaat

SEQ ID NO: 2409651 - DNA, 22 bp, Homo sapiens
ttaatgaagtttgaatgttaaa

SEQ ID NO: 2409652 - DNA, 17 bp, Homo sapiens
ttaatggtgccttcatt

SEQ ID NO: 2409653 - DNA, 13 bp, Homo sapiens
ttaattagtgcta

SEQ ID NO: 2409654 - DNA, 20 bp, Homo sapiens
ttaattagtgctaagtgtga

SEQ ID NO: 2409655 - DNA, 17 bp, Homo sapiens
ttaattccttcagcact

SEQ ID NO: 2409656 - DNA, 21 bp, Homo sapiens
ttaatttctgcaaatgtaatt

SEQ ID NO: 2409657 - DNA, 14 bp, Homo sapiens
ttacatttcctaaa

SEQ ID NO: 2409658 - DNA, 20 bp, Homo sapiens
ttacctttgacaaaggtaaa

SEQ ID NO: 2409659 - DNA, 23 bp, Homo sapiens
ttactgtacagacagaaaaaact

SEQ ID NO: 2409660 - DNA, 13 bp, Homo sapiens
ttagaaagcattt

SEQ ID NO: 2409661 - DNA, 14 bp, Homo sapiens
ttagaaagcatttg

SEQ ID NO: 2409662 - DNA, 15 bp, Homo sapiens
ttagaaagcatttga

SEQ ID NO: 2409663 - DNA, 16 bp, Homo sapiens
ttagaaagcatttgaa

SEQ ID NO: 2409664 - DNA, 17 bp, Homo sapiens
ttagaaagcatttgaat

SEQ ID NO: 2409665 - DNA, 18 bp, Homo sapiens
ttagaaagcatttgaatg

SEQ ID NO: 2409666 - DNA, 16 bp, Homo sapiens
ttagaccaccaagcct

SEQ ID NO: 2409667 - DNA, 12 bp, Homo sapiens
ttagagttagac

SEQ ID NO: 2409668 - DNA, 15 bp, Homo sapiens
ttagatgttctctat

SEQ ID NO: 2409669 - DNA, 19 bp, Homo sapiens
ttagatgttctctatcatt

SEQ ID NO: 2409670 - DNA, 20 bp, Homo sapiens
ttagatgttctctatcattt

SEQ ID NO: 2409671 - DNA, 21 bp, Homo sapiens
ttagatgttctctatcattta

SEQ ID NO: 2409672 - DNA, 13 bp, Homo sapiens
ttagatttgtgtg

SEQ ID NO: 2409673 - DNA, 19 bp, Homo sapiens
ttagtactcccctccttga

SEQ ID NO: 2409674 - DNA, 12 bp, Homo sapiens
ttagtcacaaag

SEQ ID NO: 2409675 - DNA, 13 bp, Homo sapiens
ttagtcgtgagct

SEQ ID NO: 2409676 - DNA, 12 bp, Homo sapiens
ttagtgctaagt

SEQ ID NO: 2409677 - DNA, 15 bp, Homo sapiens
ttagtgctaagtgtg

SEQ ID NO: 2409678 - DNA, 13 bp, Homo sapiens
ttagtttctgagt

SEQ ID NO: 2409679 - DNA, 20 bp, Homo sapiens
ttagtttctgagttttacca

SEQ ID NO: 2409680 - DNA, 16 bp, Homo sapiens
ttataaacttttttct

SEQ ID NO: 2409681 - DNA, 17 bp, Homo sapiens
ttataactggaaagaag

SEQ ID NO: 2409682 - DNA, 14 bp, Homo sapiens
ttataataaatgta

SEQ ID NO: 2409683 - DNA, 17 bp, Homo sapiens
ttataattttaaatgtt

SEQ ID NO: 2409684 - DNA, 21 bp, Homo sapiens
ttataattttaaatgtttttt

SEQ ID NO: 2409685 - DNA, 18 bp, Homo sapiens
ttatactttgtaaagaca

SEQ ID NO: 2409686 - DNA, 16 bp, Homo sapiens
ttatataatcattatt

SEQ ID NO: 2409687 - DNA, 18 bp, Homo sapiens
ttatatgttgtaatattt

SEQ ID NO: 2409688 - DNA, 16 bp, Homo sapiens
ttatattatgaagctt

SEQ ID NO: 2409689 - DNA, 14 bp, Homo sapiens
ttatcctctttaga

SEQ ID NO: 2409690 - DNA, 15 bp, Homo sapiens
ttatcctctttagag

SEQ ID NO: 2409691 - DNA, 18 bp, Homo sapiens
ttatcctctttagagtta

SEQ ID NO: 2409692 - DNA, 14 bp, Homo sapiens
ttatcgaaactcat

SEQ ID NO: 2409693 - DNA, 22 bp, Homo sapiens
ttatctaatcatgaaactccct

SEQ ID NO: 2409694 - DNA, 20 bp, Homo sapiens
ttatgatacttgaaaattaa

SEQ ID NO: 2409695 - DNA, 11 bp, Homo sapiens
ttatgggtcac

SEQ ID NO: 2409696 - DNA, 22 bp, Homo sapiens
ttatgtgccagatttatgcata

SEQ ID NO: 2409697 - DNA, 14 bp, Homo sapiens
ttatgttaaactag

SEQ ID NO: 2409698 - DNA, 17 bp, Homo sapiens
ttatgttgcatagaata

SEQ ID NO: 2409699 - DNA, 15 bp, Homo sapiens
ttattaataaacatt

SEQ ID NO: 2409700 - DNA, 19 bp, Homo sapiens
ttattaatatatattatct

SEQ ID NO: 2409701 - DNA, 14 bp, Homo sapiens
ttattacttttgct

SEQ ID NO: 2409702 - DNA, 14 bp, Homo sapiens
ttattatgcattat

SEQ ID NO: 2409703 - DNA, 12 bp, Homo sapiens
ttattcaataaa

SEQ ID NO: 2409704 - DNA, 19 bp, Homo sapiens
ttattcaataaagtattta

SEQ ID NO: 2409705 - DNA, 20 bp, Homo sapiens
ttattcaataaagtatttaa

SEQ ID NO: 2409706 - DNA, 12 bp, Homo sapiens
ttattcataatt

SEQ ID NO: 2409707 - DNA, 16 bp, Homo sapiens
ttattgtgtttgtcat

SEQ ID NO: 2409708 - DNA, 17 bp, Homo sapiens
ttattgtgtttgtcatt

SEQ ID NO: 2409709 - DNA, 18 bp, Homo sapiens
ttattgtgtttgtcatta

SEQ ID NO: 2409710 - DNA, 14 bp, Homo sapiens
ttatttatgcctct

SEQ ID NO: 2409711 - DNA, 21 bp, Homo sapiens
ttcaataaagtatttaattag

SEQ ID NO: 2409712 - DNA, 21 bp, Homo sapiens
ttcacatcgcagattctccct

SEQ ID NO: 2409713 - DNA, 19 bp, Homo sapiens
ttcacattgtattcagagt

SEQ ID NO: 2409714 - DNA, 21 bp, Homo sapiens
ttcagagttgatggttgtaca

SEQ ID NO: 2409715 - DNA, 19 bp, Homo sapiens
ttcagcaagttagaactag

SEQ ID NO: 2409716 - DNA, 21 bp, Homo sapiens
ttcaggagagagttgaaccta

SEQ ID NO: 2409717 - DNA, 23 bp, Homo sapiens
ttcagttattatatttacaaatg

SEQ ID NO: 2409718 - DNA, 19 bp, Homo sapiens
ttcataattattatttggc

SEQ ID NO: 2409719 - DNA, 21 bp, Homo sapiens
ttcatatttttcatagctaaa

SEQ ID NO: 2409720 - DNA, 15 bp, Homo sapiens
ttcatctaggatttt

SEQ ID NO: 2409721 - DNA, 17 bp, Homo sapiens
ttcatgattttgaaatc

SEQ ID NO: 2409722 - DNA, 12 bp, Homo sapiens
ttcattcctcca

SEQ ID NO: 2409723 - DNA, 14 bp, Homo sapiens
ttcccttgagccct

SEQ ID NO: 2409724 - DNA, 17 bp, Homo sapiens
ttcctagttctgtagaa

SEQ ID NO: 2409725 - DNA, 23 bp, Homo sapiens
ttcctcagttcatccattctatt

SEQ ID NO: 2409726 - DNA, 18 bp, Homo sapiens
ttcctcatgaatgtaaat

SEQ ID NO: 2409727 - DNA, 22 bp, Homo sapiens
ttcctcatgaatgtaaatttgt

SEQ ID NO: 2409728 - DNA, 21 bp, Homo sapiens
ttcctgcaggcaggaacaaac

SEQ ID NO: 2409729 - DNA, 16 bp, Homo sapiens
ttccttcagcacttta

SEQ ID NO: 2409730 - DNA, 18 bp, Homo sapiens
ttccttttacttttcttc

SEQ ID NO: 2409731 - DNA, 13 bp, Homo sapiens
ttctaaagtaaaa

SEQ ID NO: 2409732 - DNA, 22 bp, Homo sapiens
ttctcacagtgggagccagggc

SEQ ID NO: 2409733 - DNA, 19 bp, Homo sapiens
ttctccctggatttttacc

SEQ ID NO: 2409734 - DNA, 16 bp, Homo sapiens
ttctgataatgaaaat

SEQ ID NO: 2409735 - DNA, 17 bp, Homo sapiens
ttctggccttgtaagac

SEQ ID NO: 2409736 - DNA, 14 bp, Homo sapiens
ttctgtagaaatgg

SEQ ID NO: 2409737 - DNA, 20 bp, Homo sapiens
ttctgtagaaatggttgtat

SEQ ID NO: 2409738 - DNA, 22 bp, Homo sapiens
ttcttaaccagatcattgtgaa

SEQ ID NO: 2409739 - DNA, 13 bp, Homo sapiens
ttcttagaaattt

SEQ ID NO: 2409740 - DNA, 13 bp, Homo sapiens
ttcttccatctga

SEQ ID NO: 2409741 - DNA, 20 bp, Homo sapiens
ttcttgatgtaaaatcttgt

SEQ ID NO: 2409742 - DNA, 15 bp, Homo sapiens
ttctttcttagaaat

SEQ ID NO: 2409743 - DNA, 20 bp, Homo sapiens
ttctttcttagaaatttatt

SEQ ID NO: 2409744 - DNA, 16 bp, Homo sapiens
ttctttctttgggaat

SEQ ID NO: 2409745 - DNA, 18 bp, Homo sapiens
ttctttgggaatatttga

SEQ ID NO: 2409746 - DNA, 16 bp, Homo sapiens
ttctttgtaatgaaaa

SEQ ID NO: 2409747 - DNA, 18 bp, Homo sapiens
ttctttttgggagagact

SEQ ID NO: 2409748 - DNA, 21 bp, Homo sapiens
ttctttttgggagagacttgt

SEQ ID NO: 2409749 - DNA, 16 bp, Homo sapiens
ttctttttttagagaa

SEQ ID NO: 2409750 - DNA, 21 bp, Homo sapiens
ttgaaaatcttataatttaaa

SEQ ID NO: 2409751 - DNA, 18 bp, Homo sapiens
ttgaaaattaacatgaat

SEQ ID NO: 2409752 - DNA, 14 bp, Homo sapiens
ttgaaggatgctgt

SEQ ID NO: 2409753 - DNA, 16 bp, Homo sapiens
ttgaaggatgctgtct

SEQ ID NO: 2409754 - DNA, 15 bp, Homo sapiens
ttgaatcctctctct

SEQ ID NO: 2409755 - DNA, 14 bp, Homo sapiens
ttgaatcttgtctc

SEQ ID NO: 2409756 - DNA, 15 bp, Homo sapiens
ttgaatcttgtctca

SEQ ID NO: 2409757 - DNA, 13 bp, Homo sapiens
ttgaatgcatttt

SEQ ID NO: 2409758 - DNA, 16 bp, Homo sapiens
ttgaatgcattttgtt

SEQ ID NO: 2409759 - DNA, 18 bp, Homo sapiens
ttgaatgttaaataaatt

SEQ ID NO: 2409760 - DNA, 20 bp, Homo sapiens
ttgaatgttaaataaattgt

SEQ ID NO: 2409761 - DNA, 18 bp, Homo sapiens
ttgaattttgatgaacaa

SEQ ID NO: 2409762 - DNA, 22 bp, Homo sapiens
ttgaattttttttaacattcct

SEQ ID NO: 2409763 - DNA, 22 bp, Homo sapiens
ttgactagaaaatttaaaacat

SEQ ID NO: 2409764 - DNA, 16 bp, Homo sapiens
ttgataagatctttta

SEQ ID NO: 2409765 - DNA, 13 bp, Homo sapiens
ttgatagcaaagc

SEQ ID NO: 2409766 - DNA, 14 bp, Homo sapiens
ttgatggagatatt

SEQ ID NO: 2409767 - DNA, 15 bp, Homo sapiens
ttgatgggatttggt

SEQ ID NO: 2409768 - DNA, 16 bp, Homo sapiens
ttgcaactttgtataa

SEQ ID NO: 2409769 - DNA, 17 bp, Homo sapiens
ttgcacatgtcttaatg

SEQ ID NO: 2409770 - DNA, 19 bp, Homo sapiens
ttgcagcgattaataacag

SEQ ID NO: 2409771 - DNA, 23 bp, Homo sapiens
ttgcagctctccccttctctgta

SEQ ID NO: 2409772 - DNA, 16 bp, Homo sapiens
ttgcataacgtataaa

SEQ ID NO: 2409773 - DNA, 13 bp, Homo sapiens
ttgcataagagct

SEQ ID NO: 2409774 - DNA, 19 bp, Homo sapiens
ttgccaggctggagtgcag

SEQ ID NO: 2409775 - DNA, 17 bp, Homo sapiens
ttgccagttgtcctcct

SEQ ID NO: 2409776 - DNA, 13 bp, Homo sapiens
ttgccatattgca

SEQ ID NO: 2409777 - DNA, 13 bp, Homo sapiens
ttgcccctgagac

SEQ ID NO: 2409778 - DNA, 18 bp, Homo sapiens
ttgccctgctgccctccc

SEQ ID NO: 2409779 - DNA, 14 bp, Homo sapiens
ttgctgaccctccc

SEQ ID NO: 2409780 - DNA, 14 bp, Homo sapiens
ttggccatgggagg

SEQ ID NO: 2409781 - DNA, 15 bp, Homo sapiens
ttgggaatatttgaa

SEQ ID NO: 2409782 - DNA, 17 bp, Homo sapiens
ttgggaatatttgaatc

SEQ ID NO: 2409783 - DNA, 23 bp, Homo sapiens
ttggggggagtaaagaattattt

SEQ ID NO: 2409784 - DNA, 14 bp, Homo sapiens
ttggtattgtattt

SEQ ID NO: 2409785 - DNA, 22 bp, Homo sapiens
ttggtctcccttctctacactc

SEQ ID NO: 2409786 - DNA, 20 bp, Homo sapiens
ttggtgattccgcagtgaga

SEQ ID NO: 2409787 - DNA, 13 bp, Homo sapiens
ttgtattagatgt

SEQ ID NO: 2409788 - DNA, 14 bp, Homo sapiens
ttgtatttattcaa

SEQ ID NO: 2409789 - DNA, 13 bp, Homo sapiens
ttgtcatgtgtat

SEQ ID NO: 2409790 - DNA, 15 bp, Homo sapiens
ttgtcattagcctga

SEQ ID NO: 2409791 - DNA, 20 bp, Homo sapiens
ttgtcattagcctgagtaga

SEQ ID NO: 2409792 - DNA, 18 bp, Homo sapiens
ttgtctcaatgctcataa

SEQ ID NO: 2409793 - DNA, 20 bp, Homo sapiens
ttgtctttgttcttctacca

SEQ ID NO: 2409794 - DNA, 22 bp, Homo sapiens
ttgtgaagtacccgttcacatt

SEQ ID NO: 2409795 - DNA, 22 bp, Homo sapiens
ttgtgaggaaagtcattggctt

SEQ ID NO: 2409796 - DNA, 23 bp, Homo sapiens
ttgtgcttctttctttgggaata

SEQ ID NO: 2409797 - DNA, 17 bp, Homo sapiens
ttgtggggatgatgaaa

SEQ ID NO: 2409798 - DNA, 15 bp, Homo sapiens
ttgtgtacagttatt

SEQ ID NO: 2409799 - DNA, 19 bp, Homo sapiens
ttgtgtcatgtttaagaaa

SEQ ID NO: 2409800 - DNA, 9 bp, Homo sapiens
ttgtgtccc

SEQ ID NO: 2409801 - DNA, 13 bp, Homo sapiens
ttgttatataatc

SEQ ID NO: 2409802 - DNA, 21 bp, Homo sapiens
ttgtttggtattgtatttatt

SEQ ID NO: 2409803 - DNA, 18 bp, Homo sapiens
tttaaaaaaattccaagt

SEQ ID NO: 2409804 - DNA, 19 bp, Homo sapiens
tttaaaaaatagcagcttt

SEQ ID NO: 2409805 - DNA, 16 bp, Homo sapiens
tttaaaatgagaaatc

SEQ ID NO: 2409806 - DNA, 13 bp, Homo sapiens
tttaacattcctc

SEQ ID NO: 2409807 - DNA, 11 bp, Homo sapiens
tttaactgact

SEQ ID NO: 2409808 - DNA, 23 bp, Homo sapiens
tttaactgactattcttgatgta

SEQ ID NO: 2409809 - DNA, 17 bp, Homo sapiens
tttaataatatacttgt

SEQ ID NO: 2409810 - DNA, 14 bp, Homo sapiens
tttaattagtgcta

SEQ ID NO: 2409811 - DNA, 19 bp, Homo sapiens
tttaattagtgctaagtgt

SEQ ID NO: 2409812 - DNA, 18 bp, Homo sapiens
tttacacaatagaattat

SEQ ID NO: 2409813 - DNA, 20 bp, Homo sapiens
tttacccttcttttctgact

SEQ ID NO: 2409814 - DNA, 14 bp, Homo sapiens
tttacttttcttct

SEQ ID NO: 2409815 - DNA, 18 bp, Homo sapiens
tttagaaagcatttgaat

SEQ ID NO: 2409816 - DNA, 17 bp, Homo sapiens
tttagagttagactgtt

SEQ ID NO: 2409817 - DNA, 14 bp, Homo sapiens
tttagttgaatttt

SEQ ID NO: 2409818 - DNA, 22 bp, Homo sapiens
tttatattgataagatctttta

SEQ ID NO: 2409819 - DNA, 17 bp, Homo sapiens
tttatcatgtgaaatca

SEQ ID NO: 2409820 - DNA, 18 bp, Homo sapiens
tttatcctctttagagtt

SEQ ID NO: 2409821 - DNA, 22 bp, Homo sapiens
tttatgatacttgaaaattaac

SEQ ID NO: 2409822 - DNA, 22 bp, Homo sapiens
tttatgggtcagagttccgact

SEQ ID NO: 2409823 - DNA, 14 bp, Homo sapiens
tttatgtgaaacat

SEQ ID NO: 2409824 - DNA, 19 bp, Homo sapiens
tttattaatatatattatc

SEQ ID NO: 2409825 - DNA, 16 bp, Homo sapiens
tttattgtgtttgtca

SEQ ID NO: 2409826 - DNA, 22 bp, Homo sapiens
tttattgtgtttgtcattagcc

SEQ ID NO: 2409827 - DNA, 13 bp, Homo sapiens
tttcagagcctcc

SEQ ID NO: 2409828 - DNA, 22 bp, Homo sapiens
tttcagggaggtggctgggttt

SEQ ID NO: 2409829 - DNA, 12 bp, Homo sapiens
tttcataaagca

SEQ ID NO: 2409830 - DNA, 14 bp, Homo sapiens
tttcataaatttga

SEQ ID NO: 2409831 - DNA, 15 bp, Homo sapiens
tttcattgtctgtga

SEQ ID NO: 2409832 - DNA, 16 bp, Homo sapiens
tttcattgtctgtgaa

SEQ ID NO: 2409833 - DNA, 18 bp, Homo sapiens
tttccccctagcctgcct

SEQ ID NO: 2409834 - DNA, 17 bp, Homo sapiens
tttctaaagtaaaaaca

SEQ ID NO: 2409835 - DNA, 22 bp, Homo sapiens
tttctaaagtaaaaacaaagaa

SEQ ID NO: 2409836 - DNA, 16 bp, Homo sapiens
tttctagattaagata

SEQ ID NO: 2409837 - DNA, 12 bp, Homo sapiens
tttctccctgga

SEQ ID NO: 2409838 - DNA, 14 bp, Homo sapiens
tttctccctggatt

SEQ ID NO: 2409839 - DNA, 16 bp, Homo sapiens
tttctgagttcctgca

SEQ ID NO: 2409840 - DNA, 17 bp, Homo sapiens
tttctgagttttaccaa

SEQ ID NO: 2409841 - DNA, 18 bp, Homo sapiens
tttctgagttttaccaaa

SEQ ID NO: 2409842 - DNA, 14 bp, Homo sapiens
tttctgcaaatgta

SEQ ID NO: 2409843 - DNA, 20 bp, Homo sapiens
tttcttactgatttttaagt

SEQ ID NO: 2409844 - DNA, 22 bp, Homo sapiens
tttcttactgtcttttttctaa

SEQ ID NO: 2409845 - DNA, 23 bp, Homo sapiens
tttctttgggaatatttgaatct

SEQ ID NO: 2409846 - DNA, 19 bp, Homo sapiens
tttgaaacactttgcataa

SEQ ID NO: 2409847 - DNA, 20 bp, Homo sapiens
tttgagacagagtcttcctc

SEQ ID NO: 2409848 - DNA, 23 bp, Homo sapiens
tttgcataacgtataaaagcctg

SEQ ID NO: 2409849 - DNA, 22 bp, Homo sapiens
tttgccaagggcataaattatt

SEQ ID NO: 2409850 - DNA, 23 bp, Homo sapiens
tttgccctgctgccctccccctc

SEQ ID NO: 2409851 - DNA, 19 bp, Homo sapiens
tttgctgaccctccccaaa

SEQ ID NO: 2409852 - DNA, 21 bp, Homo sapiens
tttgctgaccctccccaaagg

SEQ ID NO: 2409853 - DNA, 22 bp, Homo sapiens
tttgctgtaatgttaatattga

SEQ ID NO: 2409854 - DNA, 22 bp, Homo sapiens
tttgtaagttaggtaactgtat

SEQ ID NO: 2409855 - DNA, 20 bp, Homo sapiens
tttgtcattagcctgagtag

SEQ ID NO: 2409856 - DNA, 23 bp, Homo sapiens
tttgtctctgcaaactgccttct

SEQ ID NO: 2409857 - DNA, 21 bp, Homo sapiens
tttgtgtcatgtttaagaaat

SEQ ID NO: 2409858 - DNA, 15 bp, Homo sapiens
tttgtttggtattgt

SEQ ID NO: 2409859 - DNA, 18 bp, Homo sapiens
tttgtttggtattgtatt

SEQ ID NO: 2409860 - DNA, 15 bp, Homo sapiens
ttttaaaatgagaaa

SEQ ID NO: 2409861 - DNA, 21 bp, Homo sapiens
ttttaaagtaaccctacaaaa

SEQ ID NO: 2409862 - DNA, 16 bp, Homo sapiens
ttttaagtaaggaatt

SEQ ID NO: 2409863 - DNA, 23 bp, Homo sapiens
ttttaatttctgcaaatgtaatt

SEQ ID NO: 2409864 - DNA, 15 bp, Homo sapiens
ttttacattctgaat

SEQ ID NO: 2409865 - DNA, 14 bp, Homo sapiens
ttttactgtacaga

SEQ ID NO: 2409866 - DNA, 21 bp, Homo sapiens
ttttagaaagcatttgaatgc

SEQ ID NO: 2409867 - DNA, 22 bp, Homo sapiens
ttttagaaagcatttgaatgca

SEQ ID NO: 2409868 - DNA, 16 bp, Homo sapiens
ttttagccttctctgt

SEQ ID NO: 2409869 - DNA, 18 bp, Homo sapiens
ttttagtgattttaataa

SEQ ID NO: 2409870 - DNA, 12 bp, Homo sapiens
ttttagttgaat

SEQ ID NO: 2409871 - DNA, 20 bp, Homo sapiens
ttttagtttaaaaaccttgt

SEQ ID NO: 2409872 - DNA, 19 bp, Homo sapiens
ttttattaataaacattct

SEQ ID NO: 2409873 - DNA, 14 bp, Homo sapiens
ttttattatgcatt

SEQ ID NO: 2409874 - DNA, 18 bp, Homo sapiens
ttttctaaagtaaaaaca

SEQ ID NO: 2409875 - DNA, 18 bp, Homo sapiens
ttttctaagaaacattta

SEQ ID NO: 2409876 - DNA, 13 bp, Homo sapiens
ttttgaaaaactg

SEQ ID NO: 2409877 - DNA, 15 bp, Homo sapiens
ttttgatagcaaagc

SEQ ID NO: 2409878 - DNA, 20 bp, Homo sapiens
ttttggtggttttagtgatt

SEQ ID NO: 2409879 - DNA, 10 bp, Homo sapiens
ttttgtctct

SEQ ID NO: 2409880 - DNA, 14 bp, Homo sapiens
ttttgtttggtatt

SEQ ID NO: 2409881 - DNA, 12 bp, Homo sapiens
tttttaaagact

SEQ ID NO: 2409882 - DNA, 13 bp, Homo sapiens
tttttaaagactt

SEQ ID NO: 2409883 - DNA, 16 bp, Homo sapiens
tttttaataaatttca

SEQ ID NO: 2409884 - DNA, 11 bp, Homo sapiens
tttttcatgat

SEQ ID NO: 2409885 - DNA, 22 bp, Homo sapiens
tttttggaagaggactccttaa

SEQ ID NO: 2409886 - DNA, 23 bp, Homo sapiens
ttttttagaaagcatttgaatgc

SEQ ID NO: 2409887 - DNA, 13 bp, Homo sapiens
ttttttagttgaa

SEQ ID NO: 2409888 - DNA, 20 bp, Homo sapiens
ttttttatacaggatgatga

SEQ ID NO: 2409889 - DNA, 16 bp, Homo sapiens
gcctctgagagcatca

SEQ ID NO: 2409890 - DNA, 17 bp, Homo sapiens
gcctgactgccaagcca

SEQ ID NO: 2409891 - DNA, 16 bp, Homo sapiens
gcctgcagactcactg

SEQ ID NO: 2409892 - DNA, 16 bp, Homo sapiens
gcctgcattgagcttg

SEQ ID NO: 2409893 - DNA, 21 bp, Homo sapiens
gcctgcccctaccctggactt

SEQ ID NO: 2409894 - DNA, 23 bp, Homo sapiens
gcctgtgagctaggaattgtgtt

SEQ ID NO: 2409895 - DNA, 21 bp, Homo sapiens
gcctgttagcatgctggtgag

SEQ ID NO: 2409896 - DNA, 19 bp, Homo sapiens
gccttcccaagttgtgctt

SEQ ID NO: 2409897 - DNA, 21 bp, Homo sapiens
gccttcccaagttgtgcttga

SEQ ID NO: 2409898 - DNA, 19 bp, Homo sapiens
gccttctctaaacatttca

SEQ ID NO: 2409899 - DNA, 16 bp, Homo sapiens
gccttctctgttcatt

SEQ ID NO: 2409900 - DNA, 17 bp, Homo sapiens
gccttgcggctcctcag

SEQ ID NO: 2409901 - DNA, 13 bp, Homo sapiens
gcctttattgtgt

SEQ ID NO: 2409902 - DNA, 20 bp, Homo sapiens
gcctttattgtgtttgtcat

SEQ ID NO: 2409903 - DNA, 16 bp, Homo sapiens
gcctttggcagagttc

SEQ ID NO: 2409904 - DNA, 21 bp, Homo sapiens
gcgacgttagtcgtgagctct

SEQ ID NO: 2409905 - DNA, 22 bp, Homo sapiens
gcgacgttagtcgtgagctctt

SEQ ID NO: 2409906 - DNA, 14 bp, Homo sapiens
gcgccaggatggcg

SEQ ID NO: 2409907 - DNA, 19 bp, Homo sapiens
gcgtcctgtcggagccctg

SEQ ID NO: 2409908 - DNA, 16 bp, Homo sapiens
gctacacagatcacag

SEQ ID NO: 2409909 - DNA, 16 bp, Homo sapiens
gctacccgcagagttc

SEQ ID NO: 2409910 - DNA, 18 bp, Homo sapiens
gctagaggaagcagccaa

SEQ ID NO: 2409911 - DNA, 17 bp, Homo sapiens
gctatcgtaaaattaag

SEQ ID NO: 2409912 - DNA, 18 bp, Homo sapiens
gctcagaagtttcttctt

SEQ ID NO: 2409913 - DNA, 18 bp, Homo sapiens
gctcaggagccctgggag

SEQ ID NO: 2409914 - DNA, 18 bp, Homo sapiens
gctcataacggatcagaa

SEQ ID NO: 2409915 - DNA, 19 bp, Homo sapiens
gctcttgtgaggaaagtca

SEQ ID NO: 2409916 - DNA, 20 bp, Homo sapiens
gctcttgtgaggaaagtcat

SEQ ID NO: 2409917 - DNA, 12 bp, Homo sapiens
gctgaacatcac

SEQ ID NO: 2409918 - DNA, 21 bp, Homo sapiens
gctgacatgaagctgttgtgt

SEQ ID NO: 2409919 - DNA, 15 bp, Homo sapiens
gctgagagaaaataa

SEQ ID NO: 2409920 - DNA, 20 bp, Homo sapiens
gctgctagagtgactcacta

SEQ ID NO: 2409921 - DNA, 19 bp, Homo sapiens
gctgggcagaaggccaaga

SEQ ID NO: 2409922 - DNA, 18 bp, Homo sapiens
gctgggcccctgcctctc

SEQ ID NO: 2409923 - DNA, 16 bp, Homo sapiens
gctggggaagacagtg

SEQ ID NO: 2409924 - DNA, 16 bp, Homo sapiens
gctggggccaggctgg

SEQ ID NO: 2409925 - DNA, 19 bp, Homo sapiens
gctgggtcgccctggactg

SEQ ID NO: 2409926 - DNA, 20 bp, Homo sapiens
gctggtctcaaactcctgac

SEQ ID NO: 2409927 - DNA, 18 bp, Homo sapiens
gctgtataaaatcagcca

SEQ ID NO: 2409928 - DNA, 14 bp, Homo sapiens
gctgttgctgaata

SEQ ID NO: 2409929 - DNA, 15 bp, Homo sapiens
gctgttgctgaatag

SEQ ID NO: 2409930 - DNA, 19 bp, Homo sapiens
gctgttgctgaataggcga

SEQ ID NO: 2409931 - DNA, 16 bp, Homo sapiens
gcttcaaattgtaagc

SEQ ID NO: 2409932 - DNA, 17 bp, Homo sapiens
gcttctcatcctgcagg

SEQ ID NO: 2409933 - DNA, 12 bp, Homo sapiens
gcttctttcttt

SEQ ID NO: 2409934 - DNA, 19 bp, Homo sapiens
gcttgaaacccgtggcgct

SEQ ID NO: 2409935 - DNA, 15 bp, Homo sapiens
gcttgagccaggagg

SEQ ID NO: 2409936 - DNA, 13 bp, Homo sapiens
gcttgcctgcagg

SEQ ID NO: 2409937 - DNA, 14 bp, Homo sapiens
gcttgcctgcaggc

SEQ ID NO: 2409938 - DNA, 22 bp, Homo sapiens
aaaaaccttgtatatcttgttt

SEQ ID NO: 2409939 - DNA, 20 bp, Homo sapiens
aaaaagtgggttttttagtt

SEQ ID NO: 2409940 - DNA, 14 bp, Homo sapiens
aaaaataaaaaaca

SEQ ID NO: 2409941 - DNA, 12 bp, Homo sapiens
aaaaatgtagga

SEQ ID NO: 2409942 - DNA, 18 bp, Homo sapiens
aaaaatgtaggagactgt

SEQ ID NO: 2409943 - DNA, 19 bp, Homo sapiens
aaaactgctcatatgatgt

SEQ ID NO: 2409944 - DNA, 13 bp, Homo sapiens
aaaagaaaaagat

SEQ ID NO: 2409945 - DNA, 19 bp, Homo sapiens
aaaagatggggtctgtaaa

SEQ ID NO: 2409946 - DNA, 17 bp, Homo sapiens
aaaagcgctaatttcta

SEQ ID NO: 2409947 - DNA, 23 bp, Homo sapiens
aaaagtgggttttttagttgaat

SEQ ID NO: 2409948 - DNA, 22 bp, Homo sapiens
aaaagttgctatttgaactttt

SEQ ID NO: 2409949 - DNA, 20 bp, Homo sapiens
aaaagttttttattatgcat

SEQ ID NO: 2409950 - DNA, 20 bp, Homo sapiens
aaaatcagccaattatgtta

SEQ ID NO: 2409951 - DNA, 12 bp, Homo sapiens
aaaatcttgtca

SEQ ID NO: 2409952 - DNA, 17 bp, Homo sapiens
aaaatctttctttctta

SEQ ID NO: 2409953 - DNA, 21 bp, Homo sapiens
aaaatctttctttcttagaaa

SEQ ID NO: 2409954 - DNA, 13 bp, Homo sapiens
aaaattaagaaag

SEQ ID NO: 2409955 - DNA, 13 bp, Homo sapiens
aaaattgccatat

SEQ ID NO: 2409956 - DNA, 16 bp, Homo sapiens
aaaatttttaatcttt

SEQ ID NO: 2409957 - DNA, 13 bp, Homo sapiens
aaacactcttgaa

SEQ ID NO: 2409958 - DNA, 16 bp, Homo sapiens
aaaccaggaccctgtc

SEQ ID NO: 2409959 - DNA, 18 bp, Homo sapiens
aaacctttgtttgcatct

SEQ ID NO: 2409960 - DNA, 16 bp, Homo sapiens
aaactggggcctccct

SEQ ID NO: 2409961 - DNA, 16 bp, Homo sapiens
aaacttgtattatgtg

SEQ ID NO: 2409962 - DNA, 20 bp, Homo sapiens
aaagaagaaggtgggaggat

SEQ ID NO: 2409963 - DNA, 15 bp, Homo sapiens
aaagaattattttgt

SEQ ID NO: 2409964 - DNA, 21 bp, Homo sapiens
aaagataaattatatcaattt

SEQ ID NO: 2409965 - DNA, 22 bp, Homo sapiens
aaagatataagtgctgtataaa

SEQ ID NO: 2409966 - DNA, 22 bp, Homo sapiens
aaagatggggtctgtaaaatct

SEQ ID NO: 2409967 - DNA, 15 bp, Homo sapiens
aaagattgagagaat

SEQ ID NO: 2409968 - DNA, 20 bp, Homo sapiens
aaagcatcatggctatctgt

SEQ ID NO: 2409969 - DNA, 20 bp, Homo sapiens
aaagcatttgaatgcatttt

SEQ ID NO: 2409970 - DNA, 15 bp, Homo sapiens
aaagcccagagacag

SEQ ID NO: 2409971 - DNA, 19 bp, Homo sapiens
aaagcccttaggaagaatt

SEQ ID NO: 2409972 - DNA, 18 bp, Homo sapiens
aaagcctgtttaagagac

SEQ ID NO: 2409973 - DNA, 20 bp, Homo sapiens
aaagcttcagtgctgccgat

SEQ ID NO: 2409974 - DNA, 20 bp, Homo sapiens
aaaggctatgattgtctttg

SEQ ID NO: 2409975 - DNA, 16 bp, Homo sapiens
aaagggactgagaaat

SEQ ID NO: 2409976 - DNA, 18 bp, Homo sapiens
aaagtatttaattagtgc

SEQ ID NO: 2409977 - DNA, 20 bp, Homo sapiens
aaagtatttaattagtgcta

SEQ ID NO: 2409978 - DNA, 21 bp, Homo sapiens
aaagtatttaattagtgctaa

SEQ ID NO: 2409979 - DNA, 13 bp, Homo sapiens
aaagtcattggct

SEQ ID NO: 2409980 - DNA, 14 bp, Homo sapiens
aaagtgagagcacg

SEQ ID NO: 2409981 - DNA, 22 bp, Homo sapiens
aaagttgctatttgaacttttt

SEQ ID NO: 2409982 - DNA, 15 bp, Homo sapiens
aaataaaaaagatcc

SEQ ID NO: 2409983 - DNA, 13 bp, Homo sapiens
aaataaagaatgg

SEQ ID NO: 2409984 - DNA, 18 bp, Homo sapiens
aaataaattgtatattca

SEQ ID NO: 2409985 - DNA, 17 bp, Homo sapiens
aaataagagctcaggat

SEQ ID NO: 2409986 - DNA, 14 bp, Homo sapiens
aaataatcattctt

SEQ ID NO: 2409987 - DNA, 15 bp, Homo sapiens
aaatatcttgaaagg

SEQ ID NO: 2409988 - DNA, 21 bp, Homo sapiens
aaatattttttcttttctatt

SEQ ID NO: 2409989 - DNA, 14 bp, Homo sapiens
aaatcagactatga

SEQ ID NO: 2409990 - DNA, 18 bp, Homo sapiens
aaatcagccaattatgtt

SEQ ID NO: 2409991 - DNA, 14 bp, Homo sapiens
aaatctacagtaca

SEQ ID NO: 2409992 - DNA, 17 bp, Homo sapiens
aaatctatcaaaattac

SEQ ID NO: 2409993 - DNA, 17 bp, Homo sapiens
aaatcttataatttaaa

SEQ ID NO: 2409994 - DNA, 19 bp, Homo sapiens
aaatcttgtcatgtgtata

SEQ ID NO: 2409995 - DNA, 21 bp, Homo sapiens
aaatcttgtcatgtgtataaa

SEQ ID NO: 2409996 - DNA, 20 bp, Homo sapiens
aaatctttctttcttagaaa

SEQ ID NO: 2409997 - DNA, 14 bp, Homo sapiens
aaatgaaaaaatat

SEQ ID NO: 2409998 - DNA, 14 bp, Homo sapiens
aaatgcatttctaa

SEQ ID NO: 2409999 - DNA, 13 bp, Homo sapiens
aaatggttgtatt

SEQ ID NO: 2410000 - DNA, 20 bp, Homo sapiens
aaatgtgggattatgggtca

SEQ ID NO: 2410001 - DNA, 22 bp, Homo sapiens
aaatgtttttttttaaagactt

SEQ ID NO: 2410002 - DNA, 14 bp, Homo sapiens
aaattaagaaagga

SEQ ID NO: 2410003 - DNA, 15 bp, Homo sapiens
aaattatatcaattt

SEQ ID NO: 2410004 - DNA, 16 bp, Homo sapiens
aaattctgtctctgga

SEQ ID NO: 2410005 - DNA, 15 bp, Homo sapiens
aaattgattttgaac

SEQ ID NO: 2410006 - DNA, 14 bp, Homo sapiens
aaattgccatattg

SEQ ID NO: 2410007 - DNA, 16 bp, Homo sapiens
aaattgccatattgca

SEQ ID NO: 2410008 - DNA, 23 bp, Homo sapiens
aaattgccatattgcacatgtct

SEQ ID NO: 2410009 - DNA, 19 bp, Homo sapiens
aaattgtaagcatgcacaa

SEQ ID NO: 2410010 - DNA, 16 bp, Homo sapiens
aaattgtatattcact

SEQ ID NO: 2410011 - DNA, 12 bp, Homo sapiens
aaatttgccaag

SEQ ID NO: 2410012 - DNA, 11 bp, Homo sapiens
aaatttgtact

SEQ ID NO: 2410013 - DNA, 12 bp, Homo sapiens
aaatttgtacta

SEQ ID NO: 2410014 - DNA, 13 bp, Homo sapiens
aaatttgtactat

SEQ ID NO: 2410015 - DNA, 20 bp, Homo sapiens
aaatttgtactatttaactg

SEQ ID NO: 2410016 - DNA, 13 bp, Homo sapiens
aaatttttttaga

SEQ ID NO: 2410017 - DNA, 15 bp, Homo sapiens
aaatttttttagaaa

SEQ ID NO: 2410018 - DNA, 17 bp, Homo sapiens
aacaaagaaattatgtg

SEQ ID NO: 2410019 - DNA, 21 bp, Homo sapiens
aacaagcctccttttaaagta

SEQ ID NO: 2410020 - DNA, 20 bp, Homo sapiens
aacacccagtctgttcccca

SEQ ID NO: 2410021 - DNA, 17 bp, Homo sapiens
aacactaacatgatttg

SEQ ID NO: 2410022 - DNA, 16 bp, Homo sapiens
aacagcttctcaattt

SEQ ID NO: 2410023 - DNA, 23 bp, Homo sapiens
aacaggatggtggcaggaaaatg

SEQ ID NO: 2410024 - DNA, 22 bp, Homo sapiens
aacatagaaattgcctgacgaa

SEQ ID NO: 2410025 - DNA, 19 bp, Homo sapiens
aacatgcactgatgttgtg

SEQ ID NO: 2410026 - DNA, 21 bp, Homo sapiens
aacattactctgaaattgtaa

SEQ ID NO: 2410027 - DNA, 19 bp, Homo sapiens
aacattcctcatgaatgta

SEQ ID NO: 2410028 - DNA, 22 bp, Homo sapiens
aacattcctcatgaatgtaaat

SEQ ID NO: 2410029 - DNA, 20 bp, Homo sapiens
aacatttgttctatagcttt

SEQ ID NO: 2410030 - DNA, 22 bp, Homo sapiens
aaccactggaaagtttatggtt

SEQ ID NO: 2410031 - DNA, 14 bp, Homo sapiens
aaccagatcattgt

SEQ ID NO: 2410032 - DNA, 20 bp, Homo sapiens
aaccatgtaaagaacataaa

SEQ ID NO: 2410033 - DNA, 12 bp, Homo sapiens
aaccatttcctc

SEQ ID NO: 2410034 - DNA, 19 bp, Homo sapiens
aacccacaggcccacagta

SEQ ID NO: 2410035 - DNA, 14 bp, Homo sapiens
aacccagataaagg

SEQ ID NO: 2410036 - DNA, 21 bp, Homo sapiens
aacctgatgaaaataaagaat

SEQ ID NO: 2410037 - DNA, 22 bp, Homo sapiens
aacctgatgaaaataaagaatg

SEQ ID NO: 2410038 - DNA, 18 bp, Homo sapiens
aacggatcagaaatacag

SEQ ID NO: 2410039 - DNA, 11 bp, Homo sapiens
aacgtgcattg

SEQ ID NO: 2410040 - DNA, 14 bp, Homo sapiens
aactagcatatctg

SEQ ID NO: 2410041 - DNA, 19 bp, Homo sapiens
aactagcatatctgccttt

SEQ ID NO: 2410042 - DNA, 18 bp, Homo sapiens
aactagccaaaccaggac

SEQ ID NO: 2410043 - DNA, 17 bp, Homo sapiens
aactcatctgtcaccaa

SEQ ID NO: 2410044 - DNA, 18 bp, Homo sapiens
aactctcttattgcctca

SEQ ID NO: 2410045 - DNA, 19 bp, Homo sapiens
aactctcttattgcctcac

SEQ ID NO: 2410046 - DNA, 12 bp, Homo sapiens
aactggaaagaa

SEQ ID NO: 2410047 - DNA, 17 bp, Homo sapiens
aactggaccctgttgct

SEQ ID NO: 2410048 - DNA, 19 bp, Homo sapiens
aactggaccctgttgctaa

SEQ ID NO: 2410049 - DNA, 20 bp, Homo sapiens
aactggaccctgttgctaag

SEQ ID NO: 2410050 - DNA, 22 bp, Homo sapiens
aacttctcccctggtagaaaga

SEQ ID NO: 2410051 - DNA, 15 bp, Homo sapiens
aacttgtattatgtg

SEQ ID NO: 2410052 - DNA, 14 bp, Homo sapiens
aagaactctctgga

SEQ ID NO: 2410053 - DNA, 11 bp, Homo sapiens
aagaattattt

SEQ ID NO: 2410054 - DNA, 22 bp, Homo sapiens
aagacagagccccaccctcaga

SEQ ID NO: 2410055 - DNA, 22 bp, Homo sapiens
aagacagcttctcatcctgcag

SEQ ID NO: 2410056 - DNA, 13 bp, Homo sapiens
aagaccatttttc

SEQ ID NO: 2410057 - DNA, 15 bp, Homo sapiens
aagagacagcccagg

SEQ ID NO: 2410058 - DNA, 13 bp, Homo sapiens
aagagatttttca

SEQ ID NO: 2410059 - DNA, 14 bp, Homo sapiens
aagagcttaagaac

SEQ ID NO: 2410060 - DNA, 15 bp, Homo sapiens
aagatataagtgctg

SEQ ID NO: 2410061 - DNA, 21 bp, Homo sapiens
aagatataagtgctgtataaa

SEQ ID NO: 2410062 - DNA, 16 bp, Homo sapiens
aagatatgggacattt

SEQ ID NO: 2410063 - DNA, 19 bp, Homo sapiens
aagatatgggacatttttg

SEQ ID NO: 2410064 - DNA, 11 bp, Homo sapiens
aagatctttta

SEQ ID NO: 2410065 - DNA, 15 bp, Homo sapiens
aagatggggtctgta

SEQ ID NO: 2410066 - DNA, 18 bp, Homo sapiens
aagatggggtctgtaaaa

SEQ ID NO: 2410067 - DNA, 14 bp, Homo sapiens
aagcaaatgtgaat

SEQ ID NO: 2410068 - DNA, 15 bp, Homo sapiens
aagcaagatttcaga

SEQ ID NO: 2410069 - DNA, 16 bp, Homo sapiens
aagcaagatttcagat

SEQ ID NO: 2410070 - DNA, 13 bp, Homo sapiens
aagcatttgaatg

SEQ ID NO: 2410071 - DNA, 20 bp, Homo sapiens
aagccagctgcccccagagc

SEQ ID NO: 2410072 - DNA, 16 bp, Homo sapiens
aagccttcattgcctt

SEQ ID NO: 2410073 - DNA, 20 bp, Homo sapiens
aagcgattctcttgcctcaa

SEQ ID NO: 2410074 - DNA, 22 bp, Homo sapiens
aagcgctagaggaagcagccaa

SEQ ID NO: 2410075 - DNA, 13 bp, Homo sapiens
aagctcatctatt

SEQ ID NO: 2410076 - DNA, 16 bp, Homo sapiens
aagcttttatgtgaaa

SEQ ID NO: 2410077 - DNA, 14 bp, Homo sapiens
aaggaaagaaaata

SEQ ID NO: 2410078 - DNA, 23 bp, Homo sapiens
aaggaggatggcatataatacaa

SEQ ID NO: 2410079 - DNA, 13 bp, Homo sapiens
aaggataatgaat

SEQ ID NO: 2410080 - DNA, 14 bp, Homo sapiens
aaggattttgcagt

SEQ ID NO: 2410081 - DNA, 16 bp, Homo sapiens
aaggcctttaaaattt

SEQ ID NO: 2410082 - DNA, 17 bp, Homo sapiens
aaggcctttaaaatttt

SEQ ID NO: 2410083 - DNA, 20 bp, Homo sapiens
aagtacccgttcacattttt

SEQ ID NO: 2410084 - DNA, 15 bp, Homo sapiens
aagtacttttggcat

SEQ ID NO: 2410085 - DNA, 16 bp, Homo sapiens
aagtatttaattagtg

SEQ ID NO: 2410086 - DNA, 18 bp, Homo sapiens
aagtatttaattagtgct

SEQ ID NO: 2410087 - DNA, 19 bp, Homo sapiens
aagtatttaattagtgcta

SEQ ID NO: 2410088 - DNA, 21 bp, Homo sapiens
aagtatttaattagtgctaag

SEQ ID NO: 2410089 - DNA, 13 bp, Homo sapiens
aagtcattggctt

SEQ ID NO: 2410090 - DNA, 14 bp, Homo sapiens
aagtcggttagtgg

SEQ ID NO: 2410091 - DNA, 15 bp, Homo sapiens
aagtctccaaagtct

SEQ ID NO: 2410092 - DNA, 19 bp, Homo sapiens
aagtctctggaatttgaaa

SEQ ID NO: 2410093 - DNA, 22 bp, Homo sapiens
aagtcttatatattgtagataa

SEQ ID NO: 2410094 - DNA, 15 bp, Homo sapiens
aagtgctgtataaaa

SEQ ID NO: 2410095 - DNA, 13 bp, Homo sapiens
aagtgctttcttc

SEQ ID NO: 2410096 - DNA, 23 bp, Homo sapiens
aagtggggcgggcttcatagaga

SEQ ID NO: 2410097 - DNA, 12 bp, Homo sapiens
aagtgtgtgttt

SEQ ID NO: 2410098 - DNA, 16 bp, Homo sapiens
aagtttaccagaaagc

SEQ ID NO: 2410099 - DNA, 13 bp, Homo sapiens
aagtttgaatgtt

SEQ ID NO: 2410100 - DNA, 14 bp, Homo sapiens
aagtttgaatgtta

SEQ ID NO: 2410101 - DNA, 15 bp, Homo sapiens
aagtttgaatgttaa

SEQ ID NO: 2410102 - DNA, 15 bp, Homo sapiens
aataaaaaagatccc

SEQ ID NO: 2410103 - DNA, 11 bp, Homo sapiens
aataaagctgt

SEQ ID NO: 2410104 - DNA, 19 bp, Homo sapiens
aataaagctgtgtggcagt

SEQ ID NO: 2410105 - DNA, 14 bp, Homo sapiens
aataaagtatttaa

SEQ ID NO: 2410106 - DNA, 21 bp, Homo sapiens
aataaagtatttaattagtgc

SEQ ID NO: 2410107 - DNA, 17 bp, Homo sapiens
aataaattgtatattca

SEQ ID NO: 2410108 - DNA, 18 bp, Homo sapiens
aataaattgtatattcac

SEQ ID NO: 2410109 - DNA, 12 bp, Homo sapiens
aataatatactt

SEQ ID NO: 2410110 - DNA, 22 bp, Homo sapiens
aataggcgatcacaacgtgcat

SEQ ID NO: 2410111 - DNA, 13 bp, Homo sapiens
aatatacttgtgg

SEQ ID NO: 2410112 - DNA, 16 bp, Homo sapiens
aatatatatcaaatat

SEQ ID NO: 2410113 - DNA, 16 bp, Homo sapiens
aatatatattatcttt

SEQ ID NO: 2410114 - DNA, 15 bp, Homo sapiens
aatatattttaagac

SEQ ID NO: 2410115 - DNA, 18 bp, Homo sapiens
aatatggtgtacattctt

SEQ ID NO: 2410116 - DNA, 12 bp, Homo sapiens
aatatttcttca

SEQ ID NO: 2410117 - DNA, 12 bp, Homo sapiens
aatatttgaatc

SEQ ID NO: 2410118 - DNA, 18 bp, Homo sapiens
aatattttttcttttcta

SEQ ID NO: 2410119 - DNA, 17 bp, Homo sapiens
aatcactaaaaatgatc

SEQ ID NO: 2410120 - DNA, 17 bp, Homo sapiens
aatcagactatgaagtt

SEQ ID NO: 2410121 - DNA, 17 bp, Homo sapiens
aatcagcctacaggcct

SEQ ID NO: 2410122 - DNA, 20 bp, Homo sapiens
aatcataagatatttttcat

SEQ ID NO: 2410123 - DNA, 13 bp, Homo sapiens
aatccagcctgct

SEQ ID NO: 2410124 - DNA, 17 bp, Homo sapiens
aatccccttctcccctg

SEQ ID NO: 2410125 - DNA, 20 bp, Homo sapiens
aatccccttctcccctgcac

SEQ ID NO: 2410126 - DNA, 14 bp, Homo sapiens
aatcctggggaaca

SEQ ID NO: 2410127 - DNA, 14 bp, Homo sapiens
aatcttataattta

SEQ ID NO: 2410128 - DNA, 16 bp, Homo sapiens
aatcttgtcatgtgta

SEQ ID NO: 2410129 - DNA, 17 bp, Homo sapiens
aatcttgtcatgtgtat

SEQ ID NO: 2410130 - DNA, 19 bp, Homo sapiens
aatcttgtcatgtgtataa

SEQ ID NO: 2410131 - DNA, 13 bp, Homo sapiens
aatcttgtctcaa

SEQ ID NO: 2410132 - DNA, 21 bp, Homo sapiens
aatcttgtctcaatgctcata

SEQ ID NO: 2410133 - DNA, 20 bp, Homo sapiens
aatctttctttcttagaaat

SEQ ID NO: 2410134 - DNA, 16 bp, Homo sapiens
aatgaagtttgaatgt

SEQ ID NO: 2410135 - DNA, 19 bp, Homo sapiens
aatgaagtttgaatgttaa

SEQ ID NO: 2410136 - DNA, 20 bp, Homo sapiens
aatgaagtttgaatgttaaa

SEQ ID NO: 2410137 - DNA, 20 bp, Homo sapiens
aatgaatactttataaagga

SEQ ID NO: 2410138 - DNA, 12 bp, Homo sapiens
aatgcattttgt

SEQ ID NO: 2410139 - DNA, 20 bp, Homo sapiens
aatgcattttgtttggtatt

SEQ ID NO: 2410140 - DNA, 16 bp, Homo sapiens
aatgcttcatcccttt

SEQ ID NO: 2410141 - DNA, 19 bp, Homo sapiens
aatggacttttgtacatag

SEQ ID NO: 2410142 - DNA, 21 bp, Homo sapiens
aatggttgtattagatgttct

SEQ ID NO: 2410143 - DNA, 13 bp, Homo sapiens
aatgtaagacaaa

SEQ ID NO: 2410144 - DNA, 18 bp, Homo sapiens
aatgtaattgatttattt

SEQ ID NO: 2410145 - DNA, 19 bp, Homo sapiens
agtttctgagttttaccaa

SEQ ID NO: 2410146 - DNA, 20 bp, Homo sapiens
agtttctgagttttaccaaa

SEQ ID NO: 2410147 - DNA, 14 bp, Homo sapiens
agtttgaatgttaa

SEQ ID NO: 2410148 - DNA, 21 bp, Homo sapiens
agtttgtccttagtcacaaag

SEQ ID NO: 2410149 - DNA, 17 bp, Homo sapiens
agttttttattatgcat

SEQ ID NO: 2410150 - DNA, 11 bp, Homo sapiens
ataaaaaagat

SEQ ID NO: 2410151 - DNA, 14 bp, Homo sapiens
ataaaaataaaaaa

SEQ ID NO: 2410152 - DNA, 16 bp, Homo sapiens
ataaaagacagtgaaa

SEQ ID NO: 2410153 - DNA, 10 bp, Homo sapiens
ataaaagatg

SEQ ID NO: 2410154 - DNA, 22 bp, Homo sapiens
ataaaagatggggtctgtaaaa

SEQ ID NO: 2410155 - DNA, 13 bp, Homo sapiens
ataaaagcctgtt

SEQ ID NO: 2410156 - DNA, 18 bp, Homo sapiens
ataaaagcctgtttaaga

SEQ ID NO: 2410157 - DNA, 11 bp, Homo sapiens
ataaaatcagc

SEQ ID NO: 2410158 - DNA, 22 bp, Homo sapiens
ataaacatttgtagcatcctct

SEQ ID NO: 2410159 - DNA, 18 bp, Homo sapiens
ataaagctgtgtggcagt

SEQ ID NO: 2410160 - DNA, 14 bp, Homo sapiens
ataaagtatttaat

SEQ ID NO: 2410161 - DNA, 21 bp, Homo sapiens
ataaatatcctttaattgatc

SEQ ID NO: 2410162 - DNA, 16 bp, Homo sapiens
ataaattgtatattca

SEQ ID NO: 2410163 - DNA, 15 bp, Homo sapiens
ataagatatttttca

SEQ ID NO: 2410164 - DNA, 17 bp, Homo sapiens
ataagatcttttatttt

SEQ ID NO: 2410165 - DNA, 14 bp, Homo sapiens
ataagcttttcttt

SEQ ID NO: 2410166 - DNA, 13 bp, Homo sapiens
ataagtgctgtat

SEQ ID NO: 2410167 - DNA, 15 bp, Homo sapiens
ataagtgctgtataa

SEQ ID NO: 2410168 - DNA, 19 bp, Homo sapiens
ataagtgtgtgtttttcat

SEQ ID NO: 2410169 - DNA, 22 bp, Homo sapiens
ataagtgtgtgtttttcataaa

SEQ ID NO: 2410170 - DNA, 12 bp, Homo sapiens
ataagtttattt

SEQ ID NO: 2410171 - DNA, 20 bp, Homo sapiens
ataatatacttgtggactaa

SEQ ID NO: 2410172 - DNA, 12 bp, Homo sapiens
ataattttaaat

SEQ ID NO: 2410173 - DNA, 16 bp, Homo sapiens
atacagattttgatag

SEQ ID NO: 2410174 - DNA, 17 bp, Homo sapiens
atacagattttgatagc

SEQ ID NO: 2410175 - DNA, 13 bp, Homo sapiens
atacagctcagaa

SEQ ID NO: 2410176 - DNA, 12 bp, Homo sapiens
atacctcacttt

SEQ ID NO: 2410177 - DNA, 16 bp, Homo sapiens
atacttgaaaattaac

SEQ ID NO: 2410178 - DNA, 19 bp, Homo sapiens
atagaataaaatttttaat

SEQ ID NO: 2410179 - DNA, 22 bp, Homo sapiens
atagaattataactggaaagaa

SEQ ID NO: 2410180 - DNA, 14 bp, Homo sapiens
atagctactaattt

SEQ ID NO: 2410181 - DNA, 22 bp, Homo sapiens
atagcttttccctttttttaag

SEQ ID NO: 2410182 - DNA, 16 bp, Homo sapiens
atagggaaaattctaa

SEQ ID NO: 2410183 - DNA, 21 bp, Homo sapiens
atagggcaattaattccttca

SEQ ID NO: 2410184 - DNA, 22 bp, Homo sapiens
atagggcaattaattccttcag

SEQ ID NO: 2410185 - DNA, 13 bp, Homo sapiens
atagttgtaacta

SEQ ID NO: 2410186 - DNA, 16 bp, Homo sapiens
atataaatattagaaa

SEQ ID NO: 2410187 - DNA, 12 bp, Homo sapiens
atataagctttt

SEQ ID NO: 2410188 - DNA, 19 bp, Homo sapiens
atatactcactttctagat

SEQ ID NO: 2410189 - DNA, 16 bp, Homo sapiens
atatatattatctttt

SEQ ID NO: 2410190 - DNA, 15 bp, Homo sapiens
atatattatcttttc

SEQ ID NO: 2410191 - DNA, 14 bp, Homo sapiens
atatattttaagac

SEQ ID NO: 2410192 - DNA, 17 bp, Homo sapiens
atatcagtccagtttgt

SEQ ID NO: 2410193 - DNA, 12 bp, Homo sapiens
atatctcatctc

SEQ ID NO: 2410194 - DNA, 16 bp, Homo sapiens
atatctgcctttattg

SEQ ID NO: 2410195 - DNA, 20 bp, Homo sapiens
atatctgcctttattgtgtt

SEQ ID NO: 2410196 - DNA, 17 bp, Homo sapiens
atatgggacatttttga

SEQ ID NO: 2410197 - DNA, 14 bp, Homo sapiens
atatgtaaaattac

SEQ ID NO: 2410198 - DNA, 16 bp, Homo sapiens
atatgttgtaatattt

SEQ ID NO: 2410199 - DNA, 21 bp, Homo sapiens
atatgttgtaatatttcttca

SEQ ID NO: 2410200 - DNA, 14 bp, Homo sapiens
atattattttatgt

SEQ ID NO: 2410201 - DNA, 13 bp, Homo sapiens
atattgcacatgt

SEQ ID NO: 2410202 - DNA, 15 bp, Homo sapiens
atattgcacatgtct

SEQ ID NO: 2410203 - DNA, 19 bp, Homo sapiens
atattgcacatgtcttaat

SEQ ID NO: 2410204 - DNA, 20 bp, Homo sapiens
atattgcacatgtcttaatg

SEQ ID NO: 2410205 - DNA, 21 bp, Homo sapiens
atattgcacatgtcttaatga

SEQ ID NO: 2410206 - DNA, 13 bp, Homo sapiens
atatttacaaatg

SEQ ID NO: 2410207 - DNA, 18 bp, Homo sapiens
atatttagtgttcataaa

SEQ ID NO: 2410208 - DNA, 11 bp, Homo sapiens
atatttgaatc

SEQ ID NO: 2410209 - DNA, 14 bp, Homo sapiens
atatttgaatcttg

SEQ ID NO: 2410210 - DNA, 16 bp, Homo sapiens
atatttgaatcttgtc

SEQ ID NO: 2410211 - DNA, 17 bp, Homo sapiens
atatttgaatcttgtct

SEQ ID NO: 2410212 - DNA, 19 bp, Homo sapiens
atatttgaatcttgtctca

SEQ ID NO: 2410213 - DNA, 12 bp, Homo sapiens
atattttaaata

SEQ ID NO: 2410214 - DNA, 21 bp, Homo sapiens
atatttttcatgattttgaaa

SEQ ID NO: 2410215 - DNA, 22 bp, Homo sapiens
atcaaatatattcagcctggct

SEQ ID NO: 2410216 - DNA, 19 bp, Homo sapiens
atcactctgttcattcctc

SEQ ID NO: 2410217 - DNA, 16 bp, Homo sapiens
atcagcctacaggcct

SEQ ID NO: 2410218 - DNA, 19 bp, Homo sapiens
atcaggcctagaggcctga

SEQ ID NO: 2410219 - DNA, 22 bp, Homo sapiens
atcaggctttcttttttttctt

SEQ ID NO: 2410220 - DNA, 13 bp, Homo sapiens
atcatctcagctc

SEQ ID NO: 2410221 - DNA, 15 bp, Homo sapiens
atcatggctatctgt

SEQ ID NO: 2410222 - DNA, 12 bp, Homo sapiens
atcatgtgaaat

SEQ ID NO: 2410223 - DNA, 13 bp, Homo sapiens
atcattgtgaaat

SEQ ID NO: 2410224 - DNA, 19 bp, Homo sapiens
atcattgtgaaattattca

SEQ ID NO: 2410225 - DNA, 13 bp, Homo sapiens
atcatttaataat

SEQ ID NO: 2410226 - DNA, 18 bp, Homo sapiens
atcatttaataatatact

SEQ ID NO: 2410227 - DNA, 23 bp, Homo sapiens
atcatttctttttgggagagact

SEQ ID NO: 2410228 - DNA, 20 bp, Homo sapiens
atcattttacctttgacaaa

SEQ ID NO: 2410229 - DNA, 16 bp, Homo sapiens
atccaagcaaatgtga

SEQ ID NO: 2410230 - DNA, 18 bp, Homo sapiens
atccaagcaaatgtgaat

SEQ ID NO: 2410231 - DNA, 16 bp, Homo sapiens
atccagaaagaaaact

SEQ ID NO: 2410232 - DNA, 23 bp, Homo sapiens
atccagcctaacttacattctta

SEQ ID NO: 2410233 - DNA, 15 bp, Homo sapiens
atccaggcaccagga

SEQ ID NO: 2410234 - DNA, 16 bp, Homo sapiens
atccaggcaccaggac

SEQ ID NO: 2410235 - DNA, 15 bp, Homo sapiens
atccattctcctgag

SEQ ID NO: 2410236 - DNA, 16 bp, Homo sapiens
atccccacgccacagc

SEQ ID NO: 2410237 - DNA, 21 bp, Homo sapiens
atccccacgccacagcccttt

SEQ ID NO: 2410238 - DNA, 15 bp, Homo sapiens
atccccttctcccct

SEQ ID NO: 2410239 - DNA, 14 bp, Homo sapiens
atccctagctgtga

SEQ ID NO: 2410240 - DNA, 16 bp, Homo sapiens
atcctatctctccaac

SEQ ID NO: 2410241 - DNA, 19 bp, Homo sapiens
atcctcagtttttgtgaaa

SEQ ID NO: 2410242 - DNA, 11 bp, Homo sapiens
atcctcctcat

SEQ ID NO: 2410243 - DNA, 16 bp, Homo sapiens
atcctctttagagtta

SEQ ID NO: 2410244 - DNA, 14 bp, Homo sapiens
atcctgtgtggaga

SEQ ID NO: 2410245 - DNA, 16 bp, Homo sapiens
atcctgtgtggagagg

SEQ ID NO: 2410246 - DNA, 19 bp, Homo sapiens
atcctgtgtggagagggaa

SEQ ID NO: 2410247 - DNA, 15 bp, Homo sapiens
atcggagcctcctct

SEQ ID NO: 2410248 - DNA, 17 bp, Homo sapiens
atctagaggcttccttc

SEQ ID NO: 2410249 - DNA, 11 bp, Homo sapiens
atctaggattt

SEQ ID NO: 2410250 - DNA, 15 bp, Homo sapiens
atctatcaaaattac

SEQ ID NO: 2410251 - DNA, 20 bp, Homo sapiens
atctcacactcatgcattgt

SEQ ID NO: 2410252 - DNA, 11 bp, Homo sapiens
atctcagctca

SEQ ID NO: 2410253 - DNA, 15 bp, Homo sapiens
atctcagctcactac

SEQ ID NO: 2410254 - DNA, 14 bp, Homo sapiens
atctcttcttttaa

SEQ ID NO: 2410255 - DNA, 18 bp, Homo sapiens
atctgagaaaagctttga

SEQ ID NO: 2410256 - DNA, 22 bp, Homo sapiens
atctgagaaaagctttgaaccc

SEQ ID NO: 2410257 - DNA, 12 bp, Homo sapiens
atctgcctccct

SEQ ID NO: 2410258 - DNA, 18 bp, Homo sapiens
atctgggggcctcttctg

SEQ ID NO: 2410259 - DNA, 19 bp, Homo sapiens
atcttgcccgctcaggctg

SEQ ID NO: 2410260 - DNA, 12 bp, Homo sapiens
atcttgtcatgt

SEQ ID NO: 2410261 - DNA, 17 bp, Homo sapiens
atcttgtcatgtgtata

SEQ ID NO: 2410262 - DNA, 19 bp, Homo sapiens
atcttgtcatgtgtataaa

SEQ ID NO: 2410263 - DNA, 13 bp, Homo sapiens
atcttgtctcaat

SEQ ID NO: 2410264 - DNA, 20 bp, Homo sapiens
atcttgtctcaatgctcata

SEQ ID NO: 2410265 - DNA, 22 bp, Homo sapiens
atctttaattttacatttccta

SEQ ID NO: 2410266 - DNA, 14 bp, Homo sapiens
atcttttcatacat

SEQ ID NO: 2410267 - DNA, 17 bp, Homo sapiens
atgaaaaaatatatatc

SEQ ID NO: 2410268 - DNA, 18 bp, Homo sapiens
atgaacttgtaaaggaat

SEQ ID NO: 2410269 - DNA, 22 bp, Homo sapiens
atgaagatatttttccattttt

SEQ ID NO: 2410270 - DNA, 14 bp, Homo sapiens
atgaagcaatgctt

SEQ ID NO: 2410271 - DNA, 13 bp, Homo sapiens
atgaagtttgaat

SEQ ID NO: 2410272 - DNA, 15 bp, Homo sapiens
atgaagtttgaatgt

SEQ ID NO: 2410273 - DNA, 23 bp, Homo sapiens
atgaagttttttttatacaggat

SEQ ID NO: 2410274 - DNA, 16 bp, Homo sapiens
atgaatgtaaatttgt

SEQ ID NO: 2410275 - DNA, 17 bp, Homo sapiens
atgacaggatgtttgct

SEQ ID NO: 2410276 - DNA, 18 bp, Homo sapiens
atgagaaatctaaaaaac

SEQ ID NO: 2410277 - DNA, 16 bp, Homo sapiens
ccacttgggtcttccc

SEQ ID NO: 2410278 - DNA, 13 bp, Homo sapiens
ccagagccacagt

SEQ ID NO: 2410279 - DNA, 21 bp, Homo sapiens
ccagagctacccgcagagttc

SEQ ID NO: 2410280 - DNA, 19 bp, Homo sapiens
ccagctccgcgccaggatg

SEQ ID NO: 2410281 - DNA, 21 bp, Homo sapiens
ccagctgcccccagagccaca

SEQ ID NO: 2410282 - DNA, 23 bp, Homo sapiens
ccagctggggccaggctgggtcg

SEQ ID NO: 2410283 - DNA, 23 bp, Homo sapiens
ccaggagctgggcagaaggccaa

SEQ ID NO: 2410284 - DNA, 20 bp, Homo sapiens
ccaggatactggcacagagg

SEQ ID NO: 2410285 - DNA, 18 bp, Homo sapiens
ccaggatcgttttttccc

SEQ ID NO: 2410286 - DNA, 16 bp, Homo sapiens
ccaggatggcgcagga

SEQ ID NO: 2410287 - DNA, 17 bp, Homo sapiens
ccaggctgctcagggct

SEQ ID NO: 2410288 - DNA, 17 bp, Homo sapiens
ccaggctggagtgcagt

SEQ ID NO: 2410289 - DNA, 12 bp, Homo sapiens
ccaggctgggtc

SEQ ID NO: 2410290 - DNA, 17 bp, Homo sapiens
ccaggcttgcctgcagg

SEQ ID NO: 2410291 - DNA, 11 bp, Homo sapiens
ccagtaaaatt

SEQ ID NO: 2410292 - DNA, 13 bp, Homo sapiens
ccagtaaaattgc

SEQ ID NO: 2410293 - DNA, 16 bp, Homo sapiens
ccagtaactcatctgt

SEQ ID NO: 2410294 - DNA, 16 bp, Homo sapiens
ccagtctgttccccat

SEQ ID NO: 2410295 - DNA, 16 bp, Homo sapiens
ccagtgtgtggctttc

SEQ ID NO: 2410296 - DNA, 23 bp, Homo sapiens
ccagtgtgtggctttcagagcct

SEQ ID NO: 2410297 - DNA, 16 bp, Homo sapiens
ccagttgtcctccttc

SEQ ID NO: 2410298 - DNA, 23 bp, Homo sapiens
ccatattgcacatgtcttaatga

SEQ ID NO: 2410299 - DNA, 13 bp, Homo sapiens
ccatcaacctctg

SEQ ID NO: 2410300 - DNA, 19 bp, Homo sapiens
ccatcttgcccgctcaggc

SEQ ID NO: 2410301 - DNA, 21 bp, Homo sapiens
ccatgcccggctaatttttgt

SEQ ID NO: 2410302 - DNA, 21 bp, Homo sapiens
ccatgctgctggggaagacag

SEQ ID NO: 2410303 - DNA, 23 bp, Homo sapiens
ccatgctgctggggaagacagtg

SEQ ID NO: 2410304 - DNA, 21 bp, Homo sapiens
ccatgggaggcctttccctaa

SEQ ID NO: 2410305 - DNA, 16 bp, Homo sapiens
ccattcccccagtgcg

SEQ ID NO: 2410306 - DNA, 17 bp, Homo sapiens
ccattctcaagccctgc

SEQ ID NO: 2410307 - DNA, 18 bp, Homo sapiens
ccattctcaagccctgca

SEQ ID NO: 2410308 - DNA, 23 bp, Homo sapiens
ccatttggatcctgtgtggagag

SEQ ID NO: 2410309 - DNA, 11 bp, Homo sapiens
ccatttttcct

SEQ ID NO: 2410310 - DNA, 20 bp, Homo sapiens
cccaagcacctgggattaca

SEQ ID NO: 2410311 - DNA, 13 bp, Homo sapiens
cccacgccacagc

SEQ ID NO: 2410312 - DNA, 14 bp, Homo sapiens
cccacgccacagcc

SEQ ID NO: 2410313 - DNA, 20 bp, Homo sapiens
cccagctggggccaggctgg

SEQ ID NO: 2410314 - DNA, 20 bp, Homo sapiens
cccaggaccccatggcagtg

SEQ ID NO: 2410315 - DNA, 17 bp, Homo sapiens
cccaggatactggcaca

SEQ ID NO: 2410316 - DNA, 19 bp, Homo sapiens
cccaggttggagtgcagtg

SEQ ID NO: 2410317 - DNA, 13 bp, Homo sapiens
cccagtaaaattg

SEQ ID NO: 2410318 - DNA, 16 bp, Homo sapiens
cccagtaaaattgcca

SEQ ID NO: 2410319 - DNA, 18 bp, Homo sapiens
cccagtaaaattgccata

SEQ ID NO: 2410320 - DNA, 16 bp, Homo sapiens
cccagtgttttaggag

SEQ ID NO: 2410321 - DNA, 20 bp, Homo sapiens
cccatcataatataaaacag

SEQ ID NO: 2410322 - DNA, 22 bp, Homo sapiens
cccatggcagtgggaaaaatgt

SEQ ID NO: 2410323 - DNA, 23 bp, Homo sapiens
ccccaaccatttcctcagactct

SEQ ID NO: 2410324 - DNA, 14 bp, Homo sapiens
ccccacgccacagc

SEQ ID NO: 2410325 - DNA, 16 bp, Homo sapiens
ccccacgccacagccc

SEQ ID NO: 2410326 - DNA, 13 bp, Homo sapiens
ccccagagccaca

SEQ ID NO: 2410327 - DNA, 15 bp, Homo sapiens
ccccagagccacagt

SEQ ID NO: 2410328 - DNA, 21 bp, Homo sapiens
ccccagctggggccaggctgg

SEQ ID NO: 2410329 - DNA, 14 bp, Homo sapiens
ccccagtaaaattg

SEQ ID NO: 2410330 - DNA, 17 bp, Homo sapiens
ccccatcattggtaccc

SEQ ID NO: 2410331 - DNA, 18 bp, Homo sapiens
ccccatttaggtttctga

SEQ ID NO: 2410332 - DNA, 15 bp, Homo sapiens
cccctagcctgcctc

SEQ ID NO: 2410333 - DNA, 20 bp, Homo sapiens
ccctaaaagaaaccctgcac

SEQ ID NO: 2410334 - DNA, 17 bp, Homo sapiens
ccctaagccagctgccc

SEQ ID NO: 2410335 - DNA, 14 bp, Homo sapiens
ccctaccctggact

SEQ ID NO: 2410336 - DNA, 13 bp, Homo sapiens
ccctccagagaca

SEQ ID NO: 2410337 - DNA, 16 bp, Homo sapiens
ccctgagacaaatgga

SEQ ID NO: 2410338 - DNA, 16 bp, Homo sapiens
ccctgaggcctagact

SEQ ID NO: 2410339 - DNA, 23 bp, Homo sapiens
ccctgcaccatgctgctggggaa

SEQ ID NO: 2410340 - DNA, 15 bp, Homo sapiens
ccctgcctctctgca

SEQ ID NO: 2410341 - DNA, 16 bp, Homo sapiens
ccctgcctctctgcag

SEQ ID NO: 2410342 - DNA, 21 bp, Homo sapiens
ccctgcctctctgcaggtccc

SEQ ID NO: 2410343 - DNA, 15 bp, Homo sapiens
ccctggaactgtctc

SEQ ID NO: 2410344 - DNA, 15 bp, Homo sapiens
ccctggactgtgtgc

SEQ ID NO: 2410345 - DNA, 17 bp, Homo sapiens
ccctggacttgcctctg

SEQ ID NO: 2410346 - DNA, 24 bp, Homo sapiens
ccctggatttttaccagtctcaca

SEQ ID NO: 2410347 - DNA, 15 bp, Homo sapiens
ccctgggaggctctg

SEQ ID NO: 2410348 - DNA, 17 bp, Homo sapiens
ccctgggaggctctgga

SEQ ID NO: 2410349 - DNA, 18 bp, Homo sapiens
ccctgggaggctctggag

SEQ ID NO: 2410350 - DNA, 21 bp, Homo sapiens
ccctgtccaaactgcctaagc

SEQ ID NO: 2410351 - DNA, 11 bp, Homo sapiens
ccctgttgcta

SEQ ID NO: 2410352 - DNA, 19 bp, Homo sapiens
cccttattgctgtcctgga

SEQ ID NO: 2410353 - DNA, 19 bp, Homo sapiens
cccttcccttgagccctct

SEQ ID NO: 2410354 - DNA, 14 bp, Homo sapiens
cccttctcccctgc

SEQ ID NO: 2410355 - DNA, 16 bp, Homo sapiens
cccttctcccctgcac

SEQ ID NO: 2410356 - DNA, 18 bp, Homo sapiens
cccttctcccctgcactg

SEQ ID NO: 2410357 - DNA, 13 bp, Homo sapiens
cccttctctgtat

SEQ ID NO: 2410358 - DNA, 17 bp, Homo sapiens
cccttgagccctctatg

SEQ ID NO: 2410359 - DNA, 13 bp, Homo sapiens
cccttttgtctct

SEQ ID NO: 2410360 - DNA, 19 bp, Homo sapiens
ccgaaggaaaagggctttc

SEQ ID NO: 2410361 - DNA, 17 bp, Homo sapiens
ccgcatgcggcccagga

SEQ ID NO: 2410362 - DNA, 19 bp, Homo sapiens
ccggctaatttttgtattt

SEQ ID NO: 2410363 - DNA, 14 bp, Homo sapiens
ccgttcacattttt

SEQ ID NO: 2410364 - DNA, 13 bp, Homo sapiens
cctaaacatatga

SEQ ID NO: 2410365 - DNA, 17 bp, Homo sapiens
cctaagccagctgcccc

SEQ ID NO: 2410366 - DNA, 14 bp, Homo sapiens
cctaataaagctgt

SEQ ID NO: 2410367 - DNA, 22 bp, Homo sapiens
cctaatgacatcaccacagttt

SEQ ID NO: 2410368 - DNA, 12 bp, Homo sapiens
cctagaggcctg

SEQ ID NO: 2410369 - DNA, 17 bp, Homo sapiens
cctagctggctctgtga

SEQ ID NO: 2410370 - DNA, 21 bp, Homo sapiens
cctagctgtgacctctcccct

SEQ ID NO: 2410371 - DNA, 23 bp, Homo sapiens
cctcacacacaatgtgtctgaga

SEQ ID NO: 2410372 - DNA, 15 bp, Homo sapiens
cctcagactctaaga

SEQ ID NO: 2410373 - DNA, 21 bp, Homo sapiens
cctcagactctaagaaagaac

SEQ ID NO: 2410374 - DNA, 21 bp, Homo sapiens
cctcatctccccatcattggt

SEQ ID NO: 2410375 - DNA, 13 bp, Homo sapiens
cctcatgaatgta

SEQ ID NO: 2410376 - DNA, 15 bp, Homo sapiens
cctcatgaatgtaaa

SEQ ID NO: 2410377 - DNA, 16 bp, Homo sapiens
cctcatgaatgtaaat

SEQ ID NO: 2410378 - DNA, 20 bp, Homo sapiens
cctcatgaatgtaaatttgt

SEQ ID NO: 2410379 - DNA, 17 bp, Homo sapiens
cctccagagacaacagg

SEQ ID NO: 2410380 - DNA, 23 bp, Homo sapiens
cctccgccattctcaagccctgc

SEQ ID NO: 2410381 - DNA, 15 bp, Homo sapiens
cctcctctccaccat

SEQ ID NO: 2410382 - DNA, 20 bp, Homo sapiens
cctcgcccagcggcatcagg

SEQ ID NO: 2410383 - DNA, 23 bp, Homo sapiens
cctctcgtaagatttccttcttt

SEQ ID NO: 2410384 - DNA, 17 bp, Homo sapiens
cctctctgcaggtccct

SEQ ID NO: 2410385 - DNA, 20 bp, Homo sapiens
cctctctgcaggtccctaat

SEQ ID NO: 2410386 - DNA, 21 bp, Homo sapiens
cctctctgcaggtccctaata

SEQ ID NO: 2410387 - DNA, 20 bp, Homo sapiens
cctctgagaagctctgaaga

SEQ ID NO: 2410388 - DNA, 19 bp, Homo sapiens
cctctgcacaccctccaga

SEQ ID NO: 2410389 - DNA, 19 bp, Homo sapiens
cctctgcccttcctgcagg

SEQ ID NO: 2410390 - DNA, 18 bp, Homo sapiens
cctcttaaataaaccttt

SEQ ID NO: 2410391 - DNA, 17 bp, Homo sapiens
cctctttagagttagac

SEQ ID NO: 2410392 - DNA, 19 bp, Homo sapiens
cctgagacaaatggaggcc

SEQ ID NO: 2410393 - DNA, 18 bp, Homo sapiens
cctgaggcctagactctg

SEQ ID NO: 2410394 - DNA, 14 bp, Homo sapiens
cctgagtagaaagg

SEQ ID NO: 2410395 - DNA, 12 bp, Homo sapiens
cctgcactgtaa

SEQ ID NO: 2410396 - DNA, 23 bp, Homo sapiens
cctgcatccattctcctgaggat

SEQ ID NO: 2410397 - DNA, 16 bp, Homo sapiens
cctgcctcagcctccc

SEQ ID NO: 2410398 - DNA, 20 bp, Homo sapiens
cctgcctctctgcaggtccc

SEQ ID NO: 2410399 - DNA, 21 bp, Homo sapiens
cctgcctctctgcaggtccct

SEQ ID NO: 2410400 - DNA, 14 bp, Homo sapiens
cctgcctcttaaat

SEQ ID NO: 2410401 - DNA, 19 bp, Homo sapiens
cctgctcagccctgcacca

SEQ ID NO: 2410402 - DNA, 12 bp, Homo sapiens
cctgctgccctc

SEQ ID NO: 2410403 - DNA, 13 bp, Homo sapiens
cctgctgccctcc

SEQ ID NO: 2410404 - DNA, 20 bp, Homo sapiens
cctggaactgtctctcatga

SEQ ID NO: 2410405 - DNA, 16 bp, Homo sapiens
cctggaagagcagccc

SEQ ID NO: 2410406 - DNA, 17 bp, Homo sapiens
cctggaagagcagccct

SEQ ID NO: 2410407 - DNA, 14 bp, Homo sapiens
gaatgttaaataaa

SEQ ID NO: 2410408 - DNA, 18 bp, Homo sapiens
gaatgttaaataaattgt

SEQ ID NO: 2410409 - DNA, 12 bp, Homo sapiens
gaattattttgt

SEQ ID NO: 2410410 - DNA, 15 bp, Homo sapiens
gaattgttagtttct

SEQ ID NO: 2410411 - DNA, 20 bp, Homo sapiens
gaatttgtgaaggtggaaat

SEQ ID NO: 2410412 - DNA, 20 bp, Homo sapiens
gaattttttttaacattcct

SEQ ID NO: 2410413 - DNA, 21 bp, Homo sapiens
gaattttttttaacattcctc

SEQ ID NO: 2410414 - DNA, 13 bp, Homo sapiens
gacacagttcctg

SEQ ID NO: 2410415 - DNA, 21 bp, Homo sapiens
gacagagccccaccctcagat

SEQ ID NO: 2410416 - DNA, 14 bp, Homo sapiens
gacagtatataact

SEQ ID NO: 2410417 - DNA, 14 bp, Homo sapiens
gacagtgaaagaaa

SEQ ID NO: 2410418 - DNA, 16 bp, Homo sapiens
gacatgaagctgttgt

SEQ ID NO: 2410419 - DNA, 14 bp, Homo sapiens
gaccaccaagcctt

SEQ ID NO: 2410420 - DNA, 22 bp, Homo sapiens
gaccaccaagccttgattggtg

SEQ ID NO: 2410421 - DNA, 18 bp, Homo sapiens
gaccctccccaaaggctt

SEQ ID NO: 2410422 - DNA, 16 bp, Homo sapiens
gaccctgttgctaagc

SEQ ID NO: 2410423 - DNA, 21 bp, Homo sapiens
gaccctgttgctaagccccag

SEQ ID NO: 2410424 - DNA, 21 bp, Homo sapiens
gacctcaccaagctgctgtgg

SEQ ID NO: 2410425 - DNA, 17 bp, Homo sapiens
gacctcctaacaagtag

SEQ ID NO: 2410426 - DNA, 19 bp, Homo sapiens
gactaaaagatataagtgc

SEQ ID NO: 2410427 - DNA, 21 bp, Homo sapiens
gactaaaagatataagtgctg

SEQ ID NO: 2410428 - DNA, 14 bp, Homo sapiens
gactacaggcgtga

SEQ ID NO: 2410429 - DNA, 20 bp, Homo sapiens
gactagaaaatttaaaacat

SEQ ID NO: 2410430 - DNA, 14 bp, Homo sapiens
gactctaagaaaga

SEQ ID NO: 2410431 - DNA, 15 bp, Homo sapiens
gactctaagaaagaa

SEQ ID NO: 2410432 - DNA, 19 bp, Homo sapiens
gactctgtctacctggtct

SEQ ID NO: 2410433 - DNA, 17 bp, Homo sapiens
gactcttctgagcacct

SEQ ID NO: 2410434 - DNA, 16 bp, Homo sapiens
gactgccaagccatgg

SEQ ID NO: 2410435 - DNA, 13 bp, Homo sapiens
gactgtttggaaa

SEQ ID NO: 2410436 - DNA, 18 bp, Homo sapiens
gacttacatgattcattt

SEQ ID NO: 2410437 - DNA, 12 bp, Homo sapiens
gacttgtgtctg

SEQ ID NO: 2410438 - DNA, 17 bp, Homo sapiens
gactttatgtagttttt

SEQ ID NO: 2410439 - DNA, 19 bp, Homo sapiens
gactttttttttttataat

SEQ ID NO: 2410440 - DNA, 12 bp, Homo sapiens
gagaaatgaaaa

SEQ ID NO: 2410441 - DNA, 13 bp, Homo sapiens
gagaagctctgaa

SEQ ID NO: 2410442 - DNA, 16 bp, Homo sapiens
gagacaaatggaggcc

SEQ ID NO: 2410443 - DNA, 16 bp, Homo sapiens
gagacagccaactatg

SEQ ID NO: 2410444 - DNA, 14 bp, Homo sapiens
gagactgtttggaa

SEQ ID NO: 2410445 - DNA, 18 bp, Homo sapiens
gagagcccctcacacagc

SEQ ID NO: 2410446 - DNA, 14 bp, Homo sapiens
gagagttttggatg

SEQ ID NO: 2410447 - DNA, 17 bp, Homo sapiens
gagatacagaattttat

SEQ ID NO: 2410448 - DNA, 18 bp, Homo sapiens
gagcaagcaggaatcaga

SEQ ID NO: 2410449 - DNA, 18 bp, Homo sapiens
gagcccactgtacttgct

SEQ ID NO: 2410450 - DNA, 23 bp, Homo sapiens
gagcccactgtacttgctcttga

SEQ ID NO: 2410451 - DNA, 16 bp, Homo sapiens
gagccctgggaggctc

SEQ ID NO: 2410452 - DNA, 19 bp, Homo sapiens
gagccctgggaggctctgg

SEQ ID NO: 2410453 - DNA, 20 bp, Homo sapiens
gagccctgggaggctctgga

SEQ ID NO: 2410454 - DNA, 18 bp, Homo sapiens
gagcctcctttctggctt

SEQ ID NO: 2410455 - DNA, 13 bp, Homo sapiens
gagctacaaatgc

SEQ ID NO: 2410456 - DNA, 14 bp, Homo sapiens
gagctacaaatgca

SEQ ID NO: 2410457 - DNA, 12 bp, Homo sapiens
gagctgccaaga

SEQ ID NO: 2410458 - DNA, 20 bp, Homo sapiens
gaggaaagtcattggcttta

SEQ ID NO: 2410459 - DNA, 18 bp, Homo sapiens
gaggcctgactgccaagc

SEQ ID NO: 2410460 - DNA, 14 bp, Homo sapiens
gagggaatgtgaaa

SEQ ID NO: 2410461 - DNA, 22 bp, Homo sapiens
gagggtttcattgtctgtgaag

SEQ ID NO: 2410462 - DNA, 17 bp, Homo sapiens
gagtcactacgcctggc

SEQ ID NO: 2410463 - DNA, 20 bp, Homo sapiens
gagtcttgctctgtcgccca

SEQ ID NO: 2410464 - DNA, 17 bp, Homo sapiens
gagtggctggggcatgg

SEQ ID NO: 2410465 - DNA, 14 bp, Homo sapiens
gataagatctttta

SEQ ID NO: 2410466 - DNA, 21 bp, Homo sapiens
gataatgtgatattatacata

SEQ ID NO: 2410467 - DNA, 18 bp, Homo sapiens
gataccatatacagctca

SEQ ID NO: 2410468 - DNA, 16 bp, Homo sapiens
gatacgcatcagacag

SEQ ID NO: 2410469 - DNA, 13 bp, Homo sapiens
gatactggcacag

SEQ ID NO: 2410470 - DNA, 23 bp, Homo sapiens
gatagcaaagcgacgttagtcgt

SEQ ID NO: 2410471 - DNA, 21 bp, Homo sapiens
gatataagtgtgtgtttttca

SEQ ID NO: 2410472 - DNA, 15 bp, Homo sapiens
gatcacaacgtgcat

SEQ ID NO: 2410473 - DNA, 17 bp, Homo sapiens
gatcacaacgtgcattg

SEQ ID NO: 2410474 - DNA, 23 bp, Homo sapiens
gatcacaacgtgcattgtgcttc

SEQ ID NO: 2410475 - DNA, 17 bp, Homo sapiens
gatccccacgccacagc

SEQ ID NO: 2410476 - DNA, 19 bp, Homo sapiens
gatcctgtgtggagaggga

SEQ ID NO: 2410477 - DNA, 20 bp, Homo sapiens
gatcctgtgtggagagggaa

SEQ ID NO: 2410478 - DNA, 17 bp, Homo sapiens
gatcggagcctcctctc

SEQ ID NO: 2410479 - DNA, 13 bp, Homo sapiens
gatctggctgcag

SEQ ID NO: 2410480 - DNA, 15 bp, Homo sapiens
gatcttttattttgc

SEQ ID NO: 2410481 - DNA, 14 bp, Homo sapiens
gatgaaaataaaga

SEQ ID NO: 2410482 - DNA, 21 bp, Homo sapiens
gatgagagttttggatgcagt

SEQ ID NO: 2410483 - DNA, 14 bp, Homo sapiens
gatgatgactatgg

SEQ ID NO: 2410484 - DNA, 20 bp, Homo sapiens
gatggagccagctctgcatt

SEQ ID NO: 2410485 - DNA, 18 bp, Homo sapiens
gatggcaaccagaccatt

SEQ ID NO: 2410486 - DNA, 17 bp, Homo sapiens
gatggggtttcaccatg

SEQ ID NO: 2410487 - DNA, 22 bp, Homo sapiens
gatggtggcaggaaaatggaca

SEQ ID NO: 2410488 - DNA, 13 bp, Homo sapiens
gatgtaaaatctt

SEQ ID NO: 2410489 - DNA, 16 bp, Homo sapiens
gatgtttagtaatcat

SEQ ID NO: 2410490 - DNA, 22 bp, Homo sapiens
gattacaggtgtgagccaccac

SEQ ID NO: 2410491 - DNA, 18 bp, Homo sapiens
gattatgggtcacaggaa

SEQ ID NO: 2410492 - DNA, 16 bp, Homo sapiens
gattccgcagtgagag

SEQ ID NO: 2410493 - DNA, 15 bp, Homo sapiens
gattcctgagccagt

SEQ ID NO: 2410494 - DNA, 14 bp, Homo sapiens
gattcttccatctg

SEQ ID NO: 2410495 - DNA, 16 bp, Homo sapiens
gattgggaatccgccc

SEQ ID NO: 2410496 - DNA, 19 bp, Homo sapiens
gattgtgtcccattccccc

SEQ ID NO: 2410497 - DNA, 15 bp, Homo sapiens
gatttacgctcattg

SEQ ID NO: 2410498 - DNA, 22 bp, Homo sapiens
gatttggtcaacactaacatga

SEQ ID NO: 2410499 - DNA, 15 bp, Homo sapiens
gattttcagccctca

SEQ ID NO: 2410500 - DNA, 19 bp, Homo sapiens
gattttcagccctcagaat

SEQ ID NO: 2410501 - DNA, 23 bp, Homo sapiens
gattttgaacctgatgaaaataa

SEQ ID NO: 2410502 - DNA, 20 bp, Homo sapiens
gattttgcagttctttggct

SEQ ID NO: 2410503 - DNA, 14 bp, Homo sapiens
gcaaagcgacgtta

SEQ ID NO: 2410504 - DNA, 14 bp, Homo sapiens
gcaagattgtgtcc

SEQ ID NO: 2410505 - DNA, 18 bp, Homo sapiens
gcaagtcagaatagaaat

SEQ ID NO: 2410506 - DNA, 13 bp, Homo sapiens
gcaagtcagggtt

SEQ ID NO: 2410507 - DNA, 21 bp, Homo sapiens
gcaagtcctaagcctgttagc

SEQ ID NO: 2410508 - DNA, 13 bp, Homo sapiens
gcacatgtcttaa

SEQ ID NO: 2410509 - DNA, 21 bp, Homo sapiens
gcacatgtcttaatgaagttt

SEQ ID NO: 2410510 - DNA, 16 bp, Homo sapiens
gcaccatgctgctggg

SEQ ID NO: 2410511 - DNA, 20 bp, Homo sapiens
gcaccatgctgctggggaag

SEQ ID NO: 2410512 - DNA, 23 bp, Homo sapiens
gcaccatgctgctggggaagaca

SEQ ID NO: 2410513 - DNA, 15 bp, Homo sapiens
gcacgcacactgtct

SEQ ID NO: 2410514 - DNA, 16 bp, Homo sapiens
gcacgcacactgtctg

SEQ ID NO: 2410515 - DNA, 19 bp, Homo sapiens
gcagccagaccagcaggct

SEQ ID NO: 2410516 - DNA, 16 bp, Homo sapiens
gcaggaacaaacaggg

SEQ ID NO: 2410517 - DNA, 20 bp, Homo sapiens
gcaggagtttcgttttcaaa

SEQ ID NO: 2410518 - DNA, 12 bp, Homo sapiens
gcaggtccctaa

SEQ ID NO: 2410519 - DNA, 16 bp, Homo sapiens
gcaggtccctaataaa

SEQ ID NO: 2410520 - DNA, 18 bp, Homo sapiens
gcaggtccctaataaagc

SEQ ID NO: 2410521 - DNA, 17 bp, Homo sapiens
gcagtgctcgctgttgc

SEQ ID NO: 2410522 - DNA, 19 bp, Homo sapiens
gcagtgctcgctgttgctg

SEQ ID NO: 2410523 - DNA, 20 bp, Homo sapiens
gcagtgtagggagttgtggg

SEQ ID NO: 2410524 - DNA, 17 bp, Homo sapiens
gcagttgagacaagaaa

SEQ ID NO: 2410525 - DNA, 13 bp, Homo sapiens
gcatagaagtaaa

SEQ ID NO: 2410526 - DNA, 14 bp, Homo sapiens
gcatatctgccttt

SEQ ID NO: 2410527 - DNA, 19 bp, Homo sapiens
gcatccattctcctgagga

SEQ ID NO: 2410528 - DNA, 22 bp, Homo sapiens
gcatctagaggcttccttcatt

SEQ ID NO: 2410529 - DNA, 20 bp, Homo sapiens
gcatctagcatgtcgtcaaa

SEQ ID NO: 2410530 - DNA, 10 bp, Homo sapiens
gcatttgaat

SEQ ID NO: 2410531 - DNA, 16 bp, Homo sapiens
gcattttactgtacag

SEQ ID NO: 2410532 - DNA, 15 bp, Homo sapiens
gccaactatggcctg

SEQ ID NO: 2410533 - DNA, 12 bp, Homo sapiens
gccagctgcccc

SEQ ID NO: 2410534 - DNA, 16 bp, Homo sapiens
gccaggatggcgcagg

SEQ ID NO: 2410535 - DNA, 16 bp, Homo sapiens
gccagttgtcctcctt

SEQ ID NO: 2410536 - DNA, 21 bp, Homo sapiens
gccatattgcacatgtcttaa

SEQ ID NO: 2410537 - DNA, 22 bp, Homo sapiens
gccatcaccttagaccaccaag

SEQ ID NO: 2410538 - DNA, 23 bp, Homo sapiens
tattaatatatattatcttttca

SEQ ID NO: 2410539 - DNA, 12 bp, Homo sapiens
tattagatgttc

SEQ ID NO: 2410540 - DNA, 16 bp, Homo sapiens
tattatccccatttct

SEQ ID NO: 2410541 - DNA, 19 bp, Homo sapiens
tattatgcattatatcaaa

SEQ ID NO: 2410542 - DNA, 20 bp, Homo sapiens
tattcaataaagtatttaat

SEQ ID NO: 2410543 - DNA, 21 bp, Homo sapiens
tattcaataaagtatttaatt

SEQ ID NO: 2410544 - DNA, 15 bp, Homo sapiens
tattcagctcatgga

SEQ ID NO: 2410545 - DNA, 21 bp, Homo sapiens
tattcagctcatggacttctg

SEQ ID NO: 2410546 - DNA, 21 bp, Homo sapiens
tattctagcctgcattgagct

SEQ ID NO: 2410547 - DNA, 10 bp, Homo sapiens
tattctagtc

SEQ ID NO: 2410548 - DNA, 16 bp, Homo sapiens
tattcttgatgtaaaa

SEQ ID NO: 2410549 - DNA, 20 bp, Homo sapiens
tattgcacatgtcttaatga

SEQ ID NO: 2410550 - DNA, 22 bp, Homo sapiens
tattgcagcgattaataacagg

SEQ ID NO: 2410551 - DNA, 13 bp, Homo sapiens
tattgcctcactt

SEQ ID NO: 2410552 - DNA, 15 bp, Homo sapiens
tattgcttgcacaaa

SEQ ID NO: 2410553 - DNA, 17 bp, Homo sapiens
tattgtatttattcaat

SEQ ID NO: 2410554 - DNA, 18 bp, Homo sapiens
tattgtatttattcaata

SEQ ID NO: 2410555 - DNA, 14 bp, Homo sapiens
tattgtgtttgtca

SEQ ID NO: 2410556 - DNA, 18 bp, Homo sapiens
tattgtgtttgtcattag

SEQ ID NO: 2410557 - DNA, 19 bp, Homo sapiens
tatttagtgttcataaata

SEQ ID NO: 2410558 - DNA, 13 bp, Homo sapiens
tatttattcaata

SEQ ID NO: 2410559 - DNA, 18 bp, Homo sapiens
tatttattcaataaagta

SEQ ID NO: 2410560 - DNA, 19 bp, Homo sapiens
tatttcttaaatctagtaa

SEQ ID NO: 2410561 - DNA, 20 bp, Homo sapiens
tatttgaatcttgtctcaat

SEQ ID NO: 2410562 - DNA, 14 bp, Homo sapiens
tattttaagacgaa

SEQ ID NO: 2410563 - DNA, 16 bp, Homo sapiens
tattttatgttgcata

SEQ ID NO: 2410564 - DNA, 17 bp, Homo sapiens
tattttgtgtttaggaa

SEQ ID NO: 2410565 - DNA, 20 bp, Homo sapiens
tatttttcatgattttgaaa

SEQ ID NO: 2410566 - DNA, 19 bp, Homo sapiens
tcaaaattgttacaaattg

SEQ ID NO: 2410567 - DNA, 20 bp, Homo sapiens
tcaaactcctgacctcaggc

SEQ ID NO: 2410568 - DNA, 21 bp, Homo sapiens
tcaaactcctgacctcaggca

SEQ ID NO: 2410569 - DNA, 14 bp, Homo sapiens
tcaaagctgaaatg

SEQ ID NO: 2410570 - DNA, 21 bp, Homo sapiens
tcaaatatattcagcctggct

SEQ ID NO: 2410571 - DNA, 15 bp, Homo sapiens
tcaaatctaccactg

SEQ ID NO: 2410572 - DNA, 20 bp, Homo sapiens
tcaaattgtaagcatgcaca

SEQ ID NO: 2410573 - DNA, 22 bp, Homo sapiens
tcaaattgtgcagtactttgtg

SEQ ID NO: 2410574 - DNA, 20 bp, Homo sapiens
tcaactctcttattgcctca

SEQ ID NO: 2410575 - DNA, 23 bp, Homo sapiens
tcaactctcttattgcctcactt

SEQ ID NO: 2410576 - DNA, 12 bp, Homo sapiens
tcaagccctgca

SEQ ID NO: 2410577 - DNA, 20 bp, Homo sapiens
tcaagtcctgcctcttaaat

SEQ ID NO: 2410578 - DNA, 14 bp, Homo sapiens
tcaataaagtattt

SEQ ID NO: 2410579 - DNA, 15 bp, Homo sapiens
tcaataaagtattta

SEQ ID NO: 2410580 - DNA, 17 bp, Homo sapiens
tcaataaagtatttaat

SEQ ID NO: 2410581 - DNA, 18 bp, Homo sapiens
tcaataaagtatttaatt

SEQ ID NO: 2410582 - DNA, 20 bp, Homo sapiens
tcacaaagcccatcataata

SEQ ID NO: 2410583 - DNA, 17 bp, Homo sapiens
tcacaacgtgcattgtg

SEQ ID NO: 2410584 - DNA, 18 bp, Homo sapiens
tcacaacgtgcattgtgc

SEQ ID NO: 2410585 - DNA, 16 bp, Homo sapiens
tcacaataattttcta

SEQ ID NO: 2410586 - DNA, 21 bp, Homo sapiens
tcacaccaggcttgcctgcag

SEQ ID NO: 2410587 - DNA, 15 bp, Homo sapiens
tcacagcttcagcca

SEQ ID NO: 2410588 - DNA, 16 bp, Homo sapiens
tcacagcttcagccag

SEQ ID NO: 2410589 - DNA, 17 bp, Homo sapiens
tcaccatgttagccagg

SEQ ID NO: 2410590 - DNA, 21 bp, Homo sapiens
tcaccatgttagccaggctgg

SEQ ID NO: 2410591 - DNA, 19 bp, Homo sapiens
tcacccaggttggagtgca

SEQ ID NO: 2410592 - DNA, 13 bp, Homo sapiens
tcaccctgtccaa

SEQ ID NO: 2410593 - DNA, 21 bp, Homo sapiens
tcactctgttcattcctccag

SEQ ID NO: 2410594 - DNA, 14 bp, Homo sapiens
tcactgcaacctcc

SEQ ID NO: 2410595 - DNA, 18 bp, Homo sapiens
tcactgcaacctctgcct

SEQ ID NO: 2410596 - DNA, 16 bp, Homo sapiens
tcacttaattgctaca

SEQ ID NO: 2410597 - DNA, 16 bp, Homo sapiens
tcagaatagaaattag

SEQ ID NO: 2410598 - DNA, 19 bp, Homo sapiens
tcagagcaggtgctggctc

SEQ ID NO: 2410599 - DNA, 14 bp, Homo sapiens
tcagagcgcacagg

SEQ ID NO: 2410600 - DNA, 21 bp, Homo sapiens
tcagagtaatccaagcaaatg

SEQ ID NO: 2410601 - DNA, 21 bp, Homo sapiens
tcagcactttagaatatgcct

SEQ ID NO: 2410602 - DNA, 18 bp, Homo sapiens
tcagccaattatgttaaa

SEQ ID NO: 2410603 - DNA, 20 bp, Homo sapiens
tcagccagtgaccaaccttt

SEQ ID NO: 2410604 - DNA, 13 bp, Homo sapiens
tcagccctcagaa

SEQ ID NO: 2410605 - DNA, 14 bp, Homo sapiens
tcagccctgcacca

SEQ ID NO: 2410606 - DNA, 15 bp, Homo sapiens
tcagccctgcaccat

SEQ ID NO: 2410607 - DNA, 12 bp, Homo sapiens
tcagctccagct

SEQ ID NO: 2410608 - DNA, 22 bp, Homo sapiens
tcagctcttctccatcctacca

SEQ ID NO: 2410609 - DNA, 11 bp, Homo sapiens
tcaggagccct

SEQ ID NO: 2410610 - DNA, 15 bp, Homo sapiens
tcaggagccctggga

SEQ ID NO: 2410611 - DNA, 18 bp, Homo sapiens
tcaggagccctgggaggc

SEQ ID NO: 2410612 - DNA, 16 bp, Homo sapiens
tcaggaggaaggctta

SEQ ID NO: 2410613 - DNA, 19 bp, Homo sapiens
tcaggatgagggaaaagaa

SEQ ID NO: 2410614 - DNA, 21 bp, Homo sapiens
tcagggagtgggctaagcacg

SEQ ID NO: 2410615 - DNA, 15 bp, Homo sapiens
tcaggtatacctcac

SEQ ID NO: 2410616 - DNA, 17 bp, Homo sapiens
tcaggtattaagaaaat

SEQ ID NO: 2410617 - DNA, 15 bp, Homo sapiens
tcagtttttgtgaaa

SEQ ID NO: 2410618 - DNA, 14 bp, Homo sapiens
tcataacggatcag

SEQ ID NO: 2410619 - DNA, 23 bp, Homo sapiens
tcataacggatcagaaatacaga

SEQ ID NO: 2410620 - DNA, 18 bp, Homo sapiens
tcataagatatttttcat

SEQ ID NO: 2410621 - DNA, 13 bp, Homo sapiens
tcatagagacttg

SEQ ID NO: 2410622 - DNA, 18 bp, Homo sapiens
tcatattttctttcaaaa

SEQ ID NO: 2410623 - DNA, 12 bp, Homo sapiens
tcatcctgcagg

SEQ ID NO: 2410624 - DNA, 13 bp, Homo sapiens
tcatctcagctca

SEQ ID NO: 2410625 - DNA, 18 bp, Homo sapiens
tcatctcagctcactgca

SEQ ID NO: 2410626 - DNA, 14 bp, Homo sapiens
tcatctcttctttt

SEQ ID NO: 2410627 - DNA, 11 bp, Homo sapiens
tcatgaaaatt

SEQ ID NO: 2410628 - DNA, 12 bp, Homo sapiens
tcatgaatgtaa

SEQ ID NO: 2410629 - DNA, 14 bp, Homo sapiens
tcatgattttgaaa

SEQ ID NO: 2410630 - DNA, 21 bp, Homo sapiens
tcatgattttgaaatcatgaa

SEQ ID NO: 2410631 - DNA, 23 bp, Homo sapiens
tcatgcaaactttattttgtgtt

SEQ ID NO: 2410632 - DNA, 18 bp, Homo sapiens
tcatgtaagctgaaaata

SEQ ID NO: 2410633 - DNA, 14 bp, Homo sapiens
tcatgtgaaatcat

SEQ ID NO: 2410634 - DNA, 17 bp, Homo sapiens
tcatgtgaaatcattca

SEQ ID NO: 2410635 - DNA, 17 bp, Homo sapiens
tcattaatctgcctccc

SEQ ID NO: 2410636 - DNA, 18 bp, Homo sapiens
tcattaatctgcctccct

SEQ ID NO: 2410637 - DNA, 19 bp, Homo sapiens
tcattattacttttgctgt

SEQ ID NO: 2410638 - DNA, 12 bp, Homo sapiens
tcattcctccag

SEQ ID NO: 2410639 - DNA, 17 bp, Homo sapiens
tcattgccttaactgga

SEQ ID NO: 2410640 - DNA, 11 bp, Homo sapiens
tcatttaataa

SEQ ID NO: 2410641 - DNA, 20 bp, Homo sapiens
tcatttaataatatacttgt

SEQ ID NO: 2410642 - DNA, 21 bp, Homo sapiens
tcatttaataatatacttgtg

SEQ ID NO: 2410643 - DNA, 22 bp, Homo sapiens
tcattttaacatctgagaaaag

SEQ ID NO: 2410644 - DNA, 14 bp, Homo sapiens
tccaacgtggccca

SEQ ID NO: 2410645 - DNA, 17 bp, Homo sapiens
tccaagcaaatgtgaat

SEQ ID NO: 2410646 - DNA, 14 bp, Homo sapiens
tccacagtgactcc

SEQ ID NO: 2410647 - DNA, 18 bp, Homo sapiens
tccacatttccccctagc

SEQ ID NO: 2410648 - DNA, 15 bp, Homo sapiens
tccactttatcttga

SEQ ID NO: 2410649 - DNA, 15 bp, Homo sapiens
tccagagacaacagg

SEQ ID NO: 2410650 - DNA, 20 bp, Homo sapiens
tccagcctgctgcctgcttt

SEQ ID NO: 2410651 - DNA, 13 bp, Homo sapiens
tccaggcaccagg

SEQ ID NO: 2410652 - DNA, 20 bp, Homo sapiens
tccatctcttgtttaaattc

SEQ ID NO: 2410653 - DNA, 14 bp, Homo sapiens
tccattctcctgag

SEQ ID NO: 2410654 - DNA, 20 bp, Homo sapiens
tcccaagcacctgggattac

SEQ ID NO: 2410655 - DNA, 17 bp, Homo sapiens
tcccaccaggctgctca

SEQ ID NO: 2410656 - DNA, 22 bp, Homo sapiens
tcccaccaggctgctcagggct

SEQ ID NO: 2410657 - DNA, 13 bp, Homo sapiens
tcccatctaggga

SEQ ID NO: 2410658 - DNA, 14 bp, Homo sapiens
tcccatgttcaagc

SEQ ID NO: 2410659 - DNA, 14 bp, Homo sapiens
tccccaaaggcttt

SEQ ID NO: 2410660 - DNA, 22 bp, Homo sapiens
tccccaaaggctttgccctgct

SEQ ID NO: 2410661 - DNA, 18 bp, Homo sapiens
tccccaacatgtaataag

SEQ ID NO: 2410662 - DNA, 16 bp, Homo sapiens
tccccacgccacagcc

SEQ ID NO: 2410663 - DNA, 22 bp, Homo sapiens
tccccacgccacagcccttttg

SEQ ID NO: 2410664 - DNA, 15 bp, Homo sapiens
tccccagtaaaattg

SEQ ID NO: 2410665 - DNA, 12 bp, Homo sapiens
tcccccagcctc

SEQ ID NO: 2410666 - DNA, 18 bp, Homo sapiens
tccccctcctctccacca

SEQ ID NO: 2410667 - DNA, 14 bp, Homo sapiens
tccccttctcccct

SEQ ID NO: 2410668 - DNA, 18 bp, Homo sapiens
tccccttctcccctgcac

SEQ ID NO: 2410669 - DNA, 24 bp, Homo sapiens
tgctgctggggaagacagtggccc

SEQ ID NO: 2410670 - DNA, 14 bp, Homo sapiens
tgctgggcccctgc

SEQ ID NO: 2410671 - DNA, 18 bp, Homo sapiens
tgctgggcccctgcctct

SEQ ID NO: 2410672 - DNA, 21 bp, Homo sapiens
tgctgggcccctgcctctctg

SEQ ID NO: 2410673 - DNA, 16 bp, Homo sapiens
tgctggggaagacagt

SEQ ID NO: 2410674 - DNA, 13 bp, Homo sapiens
tgctggttttagt

SEQ ID NO: 2410675 - DNA, 17 bp, Homo sapiens
tgctgtataaaatcagc

SEQ ID NO: 2410676 - DNA, 17 bp, Homo sapiens
tgcttgcataagagctt

SEQ ID NO: 2410677 - DNA, 17 bp, Homo sapiens
tggaaattgattttgaa

SEQ ID NO: 2410678 - DNA, 23 bp, Homo sapiens
tggaactgtctctcatgaacctc

SEQ ID NO: 2410679 - DNA, 16 bp, Homo sapiens
tggaagcccctgggcc

SEQ ID NO: 2410680 - DNA, 20 bp, Homo sapiens
tggaagcccctgggcccagt

SEQ ID NO: 2410681 - DNA, 14 bp, Homo sapiens
tggacatcaaaatc

SEQ ID NO: 2410682 - DNA, 16 bp, Homo sapiens
tggaccctgttgctaa

SEQ ID NO: 2410683 - DNA, 18 bp, Homo sapiens
tggacgagaaaacaataa

SEQ ID NO: 2410684 - DNA, 21 bp, Homo sapiens
tggactaaaagatataagtgc

SEQ ID NO: 2410685 - DNA, 23 bp, Homo sapiens
tggactaaaagatataagtgctg

SEQ ID NO: 2410686 - DNA, 15 bp, Homo sapiens
tggactgtgtgctca

SEQ ID NO: 2410687 - DNA, 15 bp, Homo sapiens
tggagagggaatgtg

SEQ ID NO: 2410688 - DNA, 19 bp, Homo sapiens
tggagagggaatgtgaaat

SEQ ID NO: 2410689 - DNA, 14 bp, Homo sapiens
tggagatggtggat

SEQ ID NO: 2410690 - DNA, 16 bp, Homo sapiens
tggagcccactgtact

SEQ ID NO: 2410691 - DNA, 23 bp, Homo sapiens
tggagcccactgtacttgctctt

SEQ ID NO: 2410692 - DNA, 17 bp, Homo sapiens
tggattatattatgaag

SEQ ID NO: 2410693 - DNA, 22 bp, Homo sapiens
tggcagtgggaaaaatgtagga

SEQ ID NO: 2410694 - DNA, 23 bp, Homo sapiens
tggcagtgggaaaaatgtaggag

SEQ ID NO: 2410695 - DNA, 21 bp, Homo sapiens
tggccacttgggtcttccctg

SEQ ID NO: 2410696 - DNA, 14 bp, Homo sapiens
tggccatgggaggc

SEQ ID NO: 2410697 - DNA, 23 bp, Homo sapiens
tggccttgtaagacccttattgc

SEQ ID NO: 2410698 - DNA, 15 bp, Homo sapiens
tggcgcaggaactca

SEQ ID NO: 2410699 - DNA, 21 bp, Homo sapiens
tggcgcgatctcggctcactg

SEQ ID NO: 2410700 - DNA, 19 bp, Homo sapiens
tggctgcataaatgtggta

SEQ ID NO: 2410701 - DNA, 14 bp, Homo sapiens
tggctggggcatgg

SEQ ID NO: 2410702 - DNA, 20 bp, Homo sapiens
tggctttatcctctttagag

SEQ ID NO: 2410703 - DNA, 21 bp, Homo sapiens
tggctttatcctctttagagt

SEQ ID NO: 2410704 - DNA, 17 bp, Homo sapiens
tgggaaaaatgtaggag

SEQ ID NO: 2410705 - DNA, 18 bp, Homo sapiens
tgggaaacaaaaggataa

SEQ ID NO: 2410706 - DNA, 20 bp, Homo sapiens
tgggaaagggattttcagcc

SEQ ID NO: 2410707 - DNA, 18 bp, Homo sapiens
tgggaatatttgaatctt

SEQ ID NO: 2410708 - DNA, 19 bp, Homo sapiens
tgggaatatttgaatcttg

SEQ ID NO: 2410709 - DNA, 14 bp, Homo sapiens
tgggaatgaagcaa

SEQ ID NO: 2410710 - DNA, 16 bp, Homo sapiens
tgggagaaatgaaaaa

SEQ ID NO: 2410711 - DNA, 21 bp, Homo sapiens
tgggagagacttgttttggat

SEQ ID NO: 2410712 - DNA, 12 bp, Homo sapiens
tgggagccaggg

SEQ ID NO: 2410713 - DNA, 23 bp, Homo sapiens
tgggaggctctggagcccactgt

SEQ ID NO: 2410714 - DNA, 18 bp, Homo sapiens
tgggattatgggtcacag

SEQ ID NO: 2410715 - DNA, 20 bp, Homo sapiens
tgggattatgggtcacagga

SEQ ID NO: 2410716 - DNA, 16 bp, Homo sapiens
tgggcagaaggccaag

SEQ ID NO: 2410717 - DNA, 21 bp, Homo sapiens
tgggcccctgcctctctgcag

SEQ ID NO: 2410718 - DNA, 17 bp, Homo sapiens
tggggaagacagtggcc

SEQ ID NO: 2410719 - DNA, 16 bp, Homo sapiens
tggggacttgtgtctg

SEQ ID NO: 2410720 - DNA, 17 bp, Homo sapiens
tggggccaggctgggtc

SEQ ID NO: 2410721 - DNA, 21 bp, Homo sapiens
tgggggacttacatgattcat

SEQ ID NO: 2410722 - DNA, 21 bp, Homo sapiens
tgggggcggggtgggaaagat

SEQ ID NO: 2410723 - DNA, 21 bp, Homo sapiens
tggggtggggggggtgctggg

SEQ ID NO: 2410724 - DNA, 15 bp, Homo sapiens
tgggtataaaagatg

SEQ ID NO: 2410725 - DNA, 17 bp, Homo sapiens
tgggtataaaagatggg

SEQ ID NO: 2410726 - DNA, 22 bp, Homo sapiens
tgggtatcaccactggagatca

SEQ ID NO: 2410727 - DNA, 13 bp, Homo sapiens
tgggtcacaggaa

SEQ ID NO: 2410728 - DNA, 16 bp, Homo sapiens
tgggtcgccctggact

SEQ ID NO: 2410729 - DNA, 18 bp, Homo sapiens
tgggtcgccctggactgt

SEQ ID NO: 2410730 - DNA, 21 bp, Homo sapiens
tgggtctaggacacagttcct

SEQ ID NO: 2410731 - DNA, 14 bp, Homo sapiens
tggtaaaacacttg

SEQ ID NO: 2410732 - DNA, 23 bp, Homo sapiens
tggtattgtatttattcaataaa

SEQ ID NO: 2410733 - DNA, 23 bp, Homo sapiens
tggtctcaaactcctgacctcag

SEQ ID NO: 2410734 - DNA, 15 bp, Homo sapiens
tggtctcccttctct

SEQ ID NO: 2410735 - DNA, 18 bp, Homo sapiens
tggttttagttgcaactt

SEQ ID NO: 2410736 - DNA, 18 bp, Homo sapiens
tgtaaaatcttgtcatgt

SEQ ID NO: 2410737 - DNA, 13 bp, Homo sapiens
tgtaaaatctttc

SEQ ID NO: 2410738 - DNA, 14 bp, Homo sapiens
tgtaaaatctttct

SEQ ID NO: 2410739 - DNA, 22 bp, Homo sapiens
tgtaaaatctttctttcttaga

SEQ ID NO: 2410740 - DNA, 23 bp, Homo sapiens
tgtaaaatctttctttcttagaa

SEQ ID NO: 2410741 - DNA, 21 bp, Homo sapiens
tgtaactatagtccagctttg

SEQ ID NO: 2410742 - DNA, 21 bp, Homo sapiens
tgtaagaacaactacctgagc

SEQ ID NO: 2410743 - DNA, 14 bp, Homo sapiens
tgtaagctgaaaat

SEQ ID NO: 2410744 - DNA, 18 bp, Homo sapiens
tgtaagggccagaaatat

SEQ ID NO: 2410745 - DNA, 20 bp, Homo sapiens
tgtaataaactcatttctag

SEQ ID NO: 2410746 - DNA, 17 bp, Homo sapiens
tgtaatatttcttcaaa

SEQ ID NO: 2410747 - DNA, 14 bp, Homo sapiens
tgtaatgttaatat

SEQ ID NO: 2410748 - DNA, 18 bp, Homo sapiens
tgtaatgttaatattgat

SEQ ID NO: 2410749 - DNA, 23 bp, Homo sapiens
tgtacttgctcttgatgcctggc

SEQ ID NO: 2410750 - DNA, 18 bp, Homo sapiens
tgtagcccctctcctgga

SEQ ID NO: 2410751 - DNA, 19 bp, Homo sapiens
tgtagtttttatatgttgt

SEQ ID NO: 2410752 - DNA, 14 bp, Homo sapiens
tgtataaaaataaa

SEQ ID NO: 2410753 - DNA, 22 bp, Homo sapiens
tgtataaaaataaaaaagatcc

SEQ ID NO: 2410754 - DNA, 22 bp, Homo sapiens
tgtataaaagggactgagaaat

SEQ ID NO: 2410755 - DNA, 13 bp, Homo sapiens
tgtattacaaatc

SEQ ID NO: 2410756 - DNA, 14 bp, Homo sapiens
tgtattcagcttta

SEQ ID NO: 2410757 - DNA, 17 bp, Homo sapiens
tgtcactgacacacacg

SEQ ID NO: 2410758 - DNA, 13 bp, Homo sapiens
tgtcatgtgtata

SEQ ID NO: 2410759 - DNA, 14 bp, Homo sapiens
tgtcatgtgtataa

SEQ ID NO: 2410760 - DNA, 17 bp, Homo sapiens
tgtcattagcctgagta

SEQ ID NO: 2410761 - DNA, 20 bp, Homo sapiens
tgtcattagcctgagtagaa

SEQ ID NO: 2410762 - DNA, 12 bp, Homo sapiens
tgtcattgttat

SEQ ID NO: 2410763 - DNA, 14 bp, Homo sapiens
tgtcattgttatat

SEQ ID NO: 2410764 - DNA, 20 bp, Homo sapiens
tgtcattgttatataatcat

SEQ ID NO: 2410765 - DNA, 23 bp, Homo sapiens
tgtcattgttatataatcattat

SEQ ID NO: 2410766 - DNA, 14 bp, Homo sapiens
tgtcatttcatttc

SEQ ID NO: 2410767 - DNA, 16 bp, Homo sapiens
tgtcatttcatttcct

SEQ ID NO: 2410768 - DNA, 23 bp, Homo sapiens
tgtctacacagatgttcacccaa

SEQ ID NO: 2410769 - DNA, 15 bp, Homo sapiens
tgtctcaatgctcat

SEQ ID NO: 2410770 - DNA, 22 bp, Homo sapiens
tgtctcaatgctcataacggat

SEQ ID NO: 2410771 - DNA, 12 bp, Homo sapiens
tgtctctcatga

SEQ ID NO: 2410772 - DNA, 18 bp, Homo sapiens
tgtctctgcaaactgcct

SEQ ID NO: 2410773 - DNA, 19 bp, Homo sapiens
tgtcttaatgaagtttgaa

SEQ ID NO: 2410774 - DNA, 21 bp, Homo sapiens
tgtcttaatgaagtttgaatg

SEQ ID NO: 2410775 - DNA, 22 bp, Homo sapiens
tgtcttaatgaagtttgaatgt

SEQ ID NO: 2410776 - DNA, 14 bp, Homo sapiens
tgtcttttttctaa

SEQ ID NO: 2410777 - DNA, 12 bp, Homo sapiens
tgtgaaattatt

SEQ ID NO: 2410778 - DNA, 14 bp, Homo sapiens
tgtgaaatttacat

SEQ ID NO: 2410779 - DNA, 22 bp, Homo sapiens
tgtgaactggaccctgttgcta

SEQ ID NO: 2410780 - DNA, 23 bp, Homo sapiens
tgtgaggaaagtcattggcttta

SEQ ID NO: 2410781 - DNA, 15 bp, Homo sapiens
tgtgagggtgctgac

SEQ ID NO: 2410782 - DNA, 18 bp, Homo sapiens
tgtgccagatttatgcat

SEQ ID NO: 2410783 - DNA, 23 bp, Homo sapiens
tgtgcccccaaccatttcctcag

SEQ ID NO: 2410784 - DNA, 16 bp, Homo sapiens
tgtggactaaaagata

SEQ ID NO: 2410785 - DNA, 19 bp, Homo sapiens
tgtggactaaaagatataa

SEQ ID NO: 2410786 - DNA, 22 bp, Homo sapiens
tgtggcaaagccttcattgcct

SEQ ID NO: 2410787 - DNA, 23 bp, Homo sapiens
tgtgggattatgggtcacaggaa

SEQ ID NO: 2410788 - DNA, 19 bp, Homo sapiens
tgtggtacatggtgtttgt

SEQ ID NO: 2410789 - DNA, 22 bp, Homo sapiens
tgtgtgcatcaggctttctttt

SEQ ID NO: 2410790 - DNA, 18 bp, Homo sapiens
tgtgtttttcataaagca

SEQ ID NO: 2410791 - DNA, 14 bp, Homo sapiens
tgttacaaattgta

SEQ ID NO: 2410792 - DNA, 18 bp, Homo sapiens
tgttacaaattgtagaag

SEQ ID NO: 2410793 - DNA, 21 bp, Homo sapiens
tgttacccagtaactcatctg

SEQ ID NO: 2410794 - DNA, 11 bp, Homo sapiens
tgttcatttcc

SEQ ID NO: 2410795 - DNA, 14 bp, Homo sapiens
tgttcatttcctca

SEQ ID NO: 2410796 - DNA, 20 bp, Homo sapiens
tgttcccaccaggctgctca

SEQ ID NO: 2410797 - DNA, 15 bp, Homo sapiens
tgttctgataatgaa

SEQ ID NO: 2410798 - DNA, 15 bp, Homo sapiens
aatttgaaacacttt

SEQ ID NO: 2410799 - DNA, 20 bp, Homo sapiens
aatttgaaacactttgcata

SEQ ID NO: 2410800 - DNA, 12 bp, Homo sapiens
aattttacattt

SEQ ID NO: 2410801 - DNA, 18 bp, Homo sapiens
aattttttttaacattcc

SEQ ID NO: 2410802 - DNA, 18 bp, Homo sapiens
acaaaaggataatgaata

SEQ ID NO: 2410803 - DNA, 18 bp, Homo sapiens
acaaaggcttattaattt

SEQ ID NO: 2410804 - DNA, 19 bp, Homo sapiens
acaaagtttaccagaaagc

SEQ ID NO: 2410805 - DNA, 15 bp, Homo sapiens
acaaattatcttaaa

SEQ ID NO: 2410806 - DNA, 18 bp, Homo sapiens
acaaattctgtctctgga

SEQ ID NO: 2410807 - DNA, 22 bp, Homo sapiens
acaacttgtctattacctgtta

SEQ ID NO: 2410808 - DNA, 19 bp, Homo sapiens
acaatggataggcacagga

SEQ ID NO: 2410809 - DNA, 16 bp, Homo sapiens
acaattaaagctgtta

SEQ ID NO: 2410810 - DNA, 19 bp, Homo sapiens
acaattaaagctgttattt

SEQ ID NO: 2410811 - DNA, 16 bp, Homo sapiens
acacattaggaaaagt

SEQ ID NO: 2410812 - DNA, 15 bp, Homo sapiens
acacccacactcaga

SEQ ID NO: 2410813 - DNA, 17 bp, Homo sapiens
acacctatgtcatttca

SEQ ID NO: 2410814 - DNA, 24 bp, Homo sapiens
acagaggtagtctcactgcttgaa

SEQ ID NO: 2410815 - DNA, 17 bp, Homo sapiens
acagccaactatggcct

SEQ ID NO: 2410816 - DNA, 19 bp, Homo sapiens
acagccaactatggcctgt

SEQ ID NO: 2410817 - DNA, 21 bp, Homo sapiens
acagcccaggatactggcaca

SEQ ID NO: 2410818 - DNA, 15 bp, Homo sapiens
acagcccttttgtct

SEQ ID NO: 2410819 - DNA, 13 bp, Homo sapiens
acagctacacaga

SEQ ID NO: 2410820 - DNA, 17 bp, Homo sapiens
acagcttcagccaggag

SEQ ID NO: 2410821 - DNA, 21 bp, Homo sapiens
acagcttctcatcctgcaggc

SEQ ID NO: 2410822 - DNA, 19 bp, Homo sapiens
acaggcctcacacacaatg

SEQ ID NO: 2410823 - DNA, 23 bp, Homo sapiens
acagtgagcttggaaaggaccag

SEQ ID NO: 2410824 - DNA, 14 bp, Homo sapiens
acagtgggagccag

SEQ ID NO: 2410825 - DNA, 15 bp, Homo sapiens
acagtgggagccagg

SEQ ID NO: 2410826 - DNA, 13 bp, Homo sapiens
acagttcctggga

SEQ ID NO: 2410827 - DNA, 21 bp, Homo sapiens
acatagaaattgcctgacgaa

SEQ ID NO: 2410828 - DNA, 22 bp, Homo sapiens
acatagcttgataaagggccaa

SEQ ID NO: 2410829 - DNA, 11 bp, Homo sapiens
acatcatttct

SEQ ID NO: 2410830 - DNA, 21 bp, Homo sapiens
acatcatttctttttgggaga

SEQ ID NO: 2410831 - DNA, 20 bp, Homo sapiens
acatgaatatttagtgttca

SEQ ID NO: 2410832 - DNA, 16 bp, Homo sapiens
acatgcattactgcat

SEQ ID NO: 2410833 - DNA, 14 bp, Homo sapiens
acatgctgaacatc

SEQ ID NO: 2410834 - DNA, 21 bp, Homo sapiens
acatgtatctatgcattttct

SEQ ID NO: 2410835 - DNA, 20 bp, Homo sapiens
acatgtcttaatgaagtttg

SEQ ID NO: 2410836 - DNA, 22 bp, Homo sapiens
acatgtcttaatgaagtttgaa

SEQ ID NO: 2410837 - DNA, 19 bp, Homo sapiens
acatgtttctttgtaatga

SEQ ID NO: 2410838 - DNA, 22 bp, Homo sapiens
acatgtttctttgtaatgaaaa

SEQ ID NO: 2410839 - DNA, 19 bp, Homo sapiens
acattaggaaaagttgcta

SEQ ID NO: 2410840 - DNA, 22 bp, Homo sapiens
acattcctcatgaatgtaaatt

SEQ ID NO: 2410841 - DNA, 17 bp, Homo sapiens
acatttcctaaatatat

SEQ ID NO: 2410842 - DNA, 16 bp, Homo sapiens
acattttaaacacatt

SEQ ID NO: 2410843 - DNA, 12 bp, Homo sapiens
accaagccttga

SEQ ID NO: 2410844 - DNA, 19 bp, Homo sapiens
accaccaagccttgattgg

SEQ ID NO: 2410845 - DNA, 21 bp, Homo sapiens
accaccgcgcccagccttttt

SEQ ID NO: 2410846 - DNA, 13 bp, Homo sapiens
accacgcctggct

SEQ ID NO: 2410847 - DNA, 19 bp, Homo sapiens
accaggctgctcagggctg

SEQ ID NO: 2410848 - DNA, 20 bp, Homo sapiens
accatgaagagatttttcat

SEQ ID NO: 2410849 - DNA, 24 bp, Homo sapiens
accatgaagagatttttcatgatt

SEQ ID NO: 2410850 - DNA, 22 bp, Homo sapiens
accatgcccggctaatttttgt

SEQ ID NO: 2410851 - DNA, 14 bp, Homo sapiens
accatgctgctggg

SEQ ID NO: 2410852 - DNA, 17 bp, Homo sapiens
accatgctgctggggaa

SEQ ID NO: 2410853 - DNA, 18 bp, Homo sapiens
accatgctgctggggaag

SEQ ID NO: 2410854 - DNA, 19 bp, Homo sapiens
accatgctgctggggaaga

SEQ ID NO: 2410855 - DNA, 21 bp, Homo sapiens
accatgctgctggggaagaca

SEQ ID NO: 2410856 - DNA, 21 bp, Homo sapiens
accatgtaaagaacataaata

SEQ ID NO: 2410857 - DNA, 22 bp, Homo sapiens
accatgtcaagggttcaagatt

SEQ ID NO: 2410858 - DNA, 23 bp, Homo sapiens
accatgttggccaggcttgtctc

SEQ ID NO: 2410859 - DNA, 13 bp, Homo sapiens
accatttcctcag

SEQ ID NO: 2410860 - DNA, 19 bp, Homo sapiens
accatttcctcagactcta

SEQ ID NO: 2410861 - DNA, 23 bp, Homo sapiens
accatttcttgaggtaaaagcat

SEQ ID NO: 2410862 - DNA, 16 bp, Homo sapiens
acccaccagttgaatt

SEQ ID NO: 2410863 - DNA, 19 bp, Homo sapiens
acccaggttggagtgcagt

SEQ ID NO: 2410864 - DNA, 22 bp, Homo sapiens
accccagctggggccaggctgg

SEQ ID NO: 2410865 - DNA, 21 bp, Homo sapiens
acccgttcaacttttcctttg

SEQ ID NO: 2410866 - DNA, 19 bp, Homo sapiens
accctatgggtctaggaca

SEQ ID NO: 2410867 - DNA, 15 bp, Homo sapiens
accctccagagacaa

SEQ ID NO: 2410868 - DNA, 19 bp, Homo sapiens
acccttattgctgtcctgg

SEQ ID NO: 2410869 - DNA, 12 bp, Homo sapiens
acccttcttttc

SEQ ID NO: 2410870 - DNA, 23 bp, Homo sapiens
acctaaacatagaaattgcctga

SEQ ID NO: 2410871 - DNA, 15 bp, Homo sapiens
acctatgtcatttca

SEQ ID NO: 2410872 - DNA, 18 bp, Homo sapiens
acctatgtcatttcattt

SEQ ID NO: 2410873 - DNA, 14 bp, Homo sapiens
acctcaagctgcat

SEQ ID NO: 2410874 - DNA, 16 bp, Homo sapiens
acctcaagctgcatct

SEQ ID NO: 2410875 - DNA, 23 bp, Homo sapiens
acctcgcccagcggcatcaggct

SEQ ID NO: 2410876 - DNA, 21 bp, Homo sapiens
acctctgtatttgaatcagcc

SEQ ID NO: 2410877 - DNA, 14 bp, Homo sapiens
acctgatgaaaata

SEQ ID NO: 2410878 - DNA, 15 bp, Homo sapiens
acctgatgaaaataa

SEQ ID NO: 2410879 - DNA, 22 bp, Homo sapiens
acctgatgaaaataaagaatgg

SEQ ID NO: 2410880 - DNA, 19 bp, Homo sapiens
accttagaccaccaagcct

SEQ ID NO: 2410881 - DNA, 22 bp, Homo sapiens
accttagaccaccaagccttga

SEQ ID NO: 2410882 - DNA, 20 bp, Homo sapiens
accttccttttacttttctt

SEQ ID NO: 2410883 - DNA, 14 bp, Homo sapiens
acgcacactgtctg

SEQ ID NO: 2410884 - DNA, 15 bp, Homo sapiens
acgcccaggacccca

SEQ ID NO: 2410885 - DNA, 16 bp, Homo sapiens
acggatcagaaataca

SEQ ID NO: 2410886 - DNA, 15 bp, Homo sapiens
acggggactcagccc

SEQ ID NO: 2410887 - DNA, 15 bp, Homo sapiens
acgtgcattgtgctt

SEQ ID NO: 2410888 - DNA, 16 bp, Homo sapiens
acgtgcattgtgcttc

SEQ ID NO: 2410889 - DNA, 22 bp, Homo sapiens
acgtgcattgtgcttctttctt

SEQ ID NO: 2410890 - DNA, 16 bp, Homo sapiens
acgttagtcgtgagct

SEQ ID NO: 2410891 - DNA, 21 bp, Homo sapiens
acgttagtcgtgagctcttgt

SEQ ID NO: 2410892 - DNA, 16 bp, Homo sapiens
actaaaagatataagt

SEQ ID NO: 2410893 - DNA, 21 bp, Homo sapiens
actaaaagatataagtgctgt

SEQ ID NO: 2410894 - DNA, 15 bp, Homo sapiens
actaattttaaaatg

SEQ ID NO: 2410895 - DNA, 17 bp, Homo sapiens
actacaggcgtgagcca

SEQ ID NO: 2410896 - DNA, 12 bp, Homo sapiens
actacatgcact

SEQ ID NO: 2410897 - DNA, 13 bp, Homo sapiens
actacgcctggct

SEQ ID NO: 2410898 - DNA, 13 bp, Homo sapiens
actagcatatctg

SEQ ID NO: 2410899 - DNA, 14 bp, Homo sapiens
actagccaaaccag

SEQ ID NO: 2410900 - DNA, 23 bp, Homo sapiens
actaggccttgcggctcctcagg

SEQ ID NO: 2410901 - DNA, 23 bp, Homo sapiens
actaggctgagcaatctgaccct

SEQ ID NO: 2410902 - DNA, 17 bp, Homo sapiens
actattcttgatgtaaa

SEQ ID NO: 2410903 - DNA, 19 bp, Homo sapiens
actattcttgatgtaaaat

SEQ ID NO: 2410904 - DNA, 17 bp, Homo sapiens
actatttaactgactat

SEQ ID NO: 2410905 - DNA, 15 bp, Homo sapiens
actcactttctagat

SEQ ID NO: 2410906 - DNA, 17 bp, Homo sapiens
actcagatcctcctcat

SEQ ID NO: 2410907 - DNA, 15 bp, Homo sapiens
actcaggtggcccta

SEQ ID NO: 2410908 - DNA, 16 bp, Homo sapiens
actcatctttccctcc

SEQ ID NO: 2410909 - DNA, 18 bp, Homo sapiens
actcatctttccctcctt

SEQ ID NO: 2410910 - DNA, 16 bp, Homo sapiens
actcatgcattgtcct

SEQ ID NO: 2410911 - DNA, 14 bp, Homo sapiens
actccatgttggct

SEQ ID NO: 2410912 - DNA, 18 bp, Homo sapiens
actcctgacctcaagtga

SEQ ID NO: 2410913 - DNA, 14 bp, Homo sapiens
actcctgacctcag

SEQ ID NO: 2410914 - DNA, 13 bp, Homo sapiens
actctaagaaaga

SEQ ID NO: 2410915 - DNA, 14 bp, Homo sapiens
actctaagaaagaa

SEQ ID NO: 2410916 - DNA, 20 bp, Homo sapiens
actctcttattgcctcactt

SEQ ID NO: 2410917 - DNA, 16 bp, Homo sapiens
actctgttcattcctc

SEQ ID NO: 2410918 - DNA, 15 bp, Homo sapiens
actcttgtttcctta

SEQ ID NO: 2410919 - DNA, 13 bp, Homo sapiens
actgacacatgct

SEQ ID NO: 2410920 - DNA, 18 bp, Homo sapiens
actgactattcttgatgt

SEQ ID NO: 2410921 - DNA, 18 bp, Homo sapiens
actgatgttgtgttttta

SEQ ID NO: 2410922 - DNA, 14 bp, Homo sapiens
actgattactgcct

SEQ ID NO: 2410923 - DNA, 18 bp, Homo sapiens
actgcatgcacttcttac

SEQ ID NO: 2410924 - DNA, 12 bp, Homo sapiens
actgccaagcca

SEQ ID NO: 2410925 - DNA, 21 bp, Homo sapiens
actgcctattttaataaacac

SEQ ID NO: 2410926 - DNA, 23 bp, Homo sapiens
actgcttgaactaggctgagcaa

SEQ ID NO: 2410927 - DNA, 17 bp, Homo sapiens
agctatcgtaaaattaa

SEQ ID NO: 2410928 - DNA, 19 bp, Homo sapiens
agctatggtgtcataggct

SEQ ID NO: 2410929 - DNA, 21 bp, Homo sapiens
agctccttgagggcaagagcc

SEQ ID NO: 2410930 - DNA, 13 bp, Homo sapiens
agctcttgtgagg

SEQ ID NO: 2410931 - DNA, 17 bp, Homo sapiens
agctcttgtgaggaaag

SEQ ID NO: 2410932 - DNA, 12 bp, Homo sapiens
agctgaaaatat

SEQ ID NO: 2410933 - DNA, 16 bp, Homo sapiens
agctgagagaaaataa

SEQ ID NO: 2410934 - DNA, 21 bp, Homo sapiens
agctgcccccagagccacagt

SEQ ID NO: 2410935 - DNA, 20 bp, Homo sapiens
agctgcctggaagagcagcc

SEQ ID NO: 2410936 - DNA, 21 bp, Homo sapiens
agctgcctggaagagcagccc

SEQ ID NO: 2410937 - DNA, 18 bp, Homo sapiens
agctggctctgtgagggt

SEQ ID NO: 2410938 - DNA, 22 bp, Homo sapiens
agctggctctgtgagggtgctg

SEQ ID NO: 2410939 - DNA, 17 bp, Homo sapiens
agctggggccaggctgg

SEQ ID NO: 2410940 - DNA, 16 bp, Homo sapiens
agctgtgcgtgtgtgt

SEQ ID NO: 2410941 - DNA, 17 bp, Homo sapiens
agctgtgcgtgtgtgtg

SEQ ID NO: 2410942 - DNA, 14 bp, Homo sapiens
agctgtgtggcagt

SEQ ID NO: 2410943 - DNA, 16 bp, Homo sapiens
agctgtgtggcagtct

SEQ ID NO: 2410944 - DNA, 17 bp, Homo sapiens
agcttcagccaggagct

SEQ ID NO: 2410945 - DNA, 19 bp, Homo sapiens
agcttctcatcctgcaggc

SEQ ID NO: 2410946 - DNA, 18 bp, Homo sapiens
agcttgataaagggccaa

SEQ ID NO: 2410947 - DNA, 17 bp, Homo sapiens
agcttggaaaggaccag

SEQ ID NO: 2410948 - DNA, 22 bp, Homo sapiens
agcttgtccaacccgaggcccg

SEQ ID NO: 2410949 - DNA, 21 bp, Homo sapiens
agcttttatgtgaaacatgtt

SEQ ID NO: 2410950 - DNA, 21 bp, Homo sapiens
agcttttccctttttttaagt

SEQ ID NO: 2410951 - DNA, 13 bp, Homo sapiens
aggaaagaaaata

SEQ ID NO: 2410952 - DNA, 13 bp, Homo sapiens
aggaaagtcattg

SEQ ID NO: 2410953 - DNA, 17 bp, Homo sapiens
aggaaagtcattggctt

SEQ ID NO: 2410954 - DNA, 15 bp, Homo sapiens
aggaactactgagga

SEQ ID NO: 2410955 - DNA, 18 bp, Homo sapiens
aggaagctgtgagagcag

SEQ ID NO: 2410956 - DNA, 15 bp, Homo sapiens
aggacacagttcctg

SEQ ID NO: 2410957 - DNA, 12 bp, Homo sapiens
aggacccttccc

SEQ ID NO: 2410958 - DNA, 13 bp, Homo sapiens
aggacccttccct

SEQ ID NO: 2410959 - DNA, 17 bp, Homo sapiens
aggactccttaaatttg

SEQ ID NO: 2410960 - DNA, 20 bp, Homo sapiens
aggactttatagatcagcca

SEQ ID NO: 2410961 - DNA, 14 bp, Homo sapiens
aggagagagttgaa

SEQ ID NO: 2410962 - DNA, 18 bp, Homo sapiens
aggatactggcacagagg

SEQ ID NO: 2410963 - DNA, 22 bp, Homo sapiens
aggatgagggaaaagaaaaaga

SEQ ID NO: 2410964 - DNA, 18 bp, Homo sapiens
aggatggctttgaatgcg

SEQ ID NO: 2410965 - DNA, 14 bp, Homo sapiens
aggatgtgaattgt

SEQ ID NO: 2410966 - DNA, 20 bp, Homo sapiens
aggcaggagtttcgttttca

SEQ ID NO: 2410967 - DNA, 18 bp, Homo sapiens
aggcatccttcctcacac

SEQ ID NO: 2410968 - DNA, 14 bp, Homo sapiens
aggccaagaggctg

SEQ ID NO: 2410969 - DNA, 21 bp, Homo sapiens
aggcccctgtctcagggtgag

SEQ ID NO: 2410970 - DNA, 14 bp, Homo sapiens
aggcctagactctg

SEQ ID NO: 2410971 - DNA, 21 bp, Homo sapiens
aggcctagactctgtctacct

SEQ ID NO: 2410972 - DNA, 21 bp, Homo sapiens
aggcctgactgccaagccatg

SEQ ID NO: 2410973 - DNA, 22 bp, Homo sapiens
aggcctgactgccaagccatgg

SEQ ID NO: 2410974 - DNA, 22 bp, Homo sapiens
aggcctgtcctgacctgtctca

SEQ ID NO: 2410975 - DNA, 20 bp, Homo sapiens
aggccttgcggctcctcagg

SEQ ID NO: 2410976 - DNA, 15 bp, Homo sapiens
aggcctttaaaattt

SEQ ID NO: 2410977 - DNA, 14 bp, Homo sapiens
aggcctttccctaa

SEQ ID NO: 2410978 - DNA, 16 bp, Homo sapiens
aggcctttccctaagc

SEQ ID NO: 2410979 - DNA, 16 bp, Homo sapiens
aggctgctcagggctg

SEQ ID NO: 2410980 - DNA, 10 bp, Homo sapiens
aggctgggtc

SEQ ID NO: 2410981 - DNA, 15 bp, Homo sapiens
aggctgggtcgccct

SEQ ID NO: 2410982 - DNA, 14 bp, Homo sapiens
aggcttacacccac

SEQ ID NO: 2410983 - DNA, 23 bp, Homo sapiens
aggcttccacgtactgcagcctc

SEQ ID NO: 2410984 - DNA, 18 bp, Homo sapiens
aggcttccttcatttcct

SEQ ID NO: 2410985 - DNA, 19 bp, Homo sapiens
aggcttccttcatttcctc

SEQ ID NO: 2410986 - DNA, 20 bp, Homo sapiens
aggctttgccctgctgccct

SEQ ID NO: 2410987 - DNA, 13 bp, Homo sapiens
agggaatgtgaaa

SEQ ID NO: 2410988 - DNA, 20 bp, Homo sapiens
agggactcatcatttccatt

SEQ ID NO: 2410989 - DNA, 17 bp, Homo sapiens
agggactcatctttccc

SEQ ID NO: 2410990 - DNA, 18 bp, Homo sapiens
agggactcatctttccct

SEQ ID NO: 2410991 - DNA, 14 bp, Homo sapiens
agggactgagaaat

SEQ ID NO: 2410992 - DNA, 21 bp, Homo sapiens
agggagcaagtccttcccttt

SEQ ID NO: 2410993 - DNA, 18 bp, Homo sapiens
agggcaattaattccttc

SEQ ID NO: 2410994 - DNA, 18 bp, Homo sapiens
agggccacatagatgctg

SEQ ID NO: 2410995 - DNA, 18 bp, Homo sapiens
aggggctggggacttgtg

SEQ ID NO: 2410996 - DNA, 14 bp, Homo sapiens
agggttggagcagt

SEQ ID NO: 2410997 - DNA, 22 bp, Homo sapiens
agggtttaatccccagtaaaat

SEQ ID NO: 2410998 - DNA, 20 bp, Homo sapiens
aggtaaaagcatcacatgaa

SEQ ID NO: 2410999 - DNA, 18 bp, Homo sapiens
aggtaaatcagactatga

SEQ ID NO: 2411000 - DNA, 10 bp, Homo sapiens
aggtccctaa

SEQ ID NO: 2411001 - DNA, 12 bp, Homo sapiens
aggtccctaata

SEQ ID NO: 2411002 - DNA, 16 bp, Homo sapiens
aggtccctaataaagc

SEQ ID NO: 2411003 - DNA, 18 bp, Homo sapiens
aggtccctaataaagctg

SEQ ID NO: 2411004 - DNA, 19 bp, Homo sapiens
aggtccctaataaagctgt

SEQ ID NO: 2411005 - DNA, 23 bp, Homo sapiens
aggtccctaataaagctgtgtgg

SEQ ID NO: 2411006 - DNA, 20 bp, Homo sapiens
aggtccttaggcctctgaga

SEQ ID NO: 2411007 - DNA, 16 bp, Homo sapiens
aggtgaaacattttct

SEQ ID NO: 2411008 - DNA, 21 bp, Homo sapiens
aggtgcttcaggataccatat

SEQ ID NO: 2411009 - DNA, 15 bp, Homo sapiens
aggtggaaataaact

SEQ ID NO: 2411010 - DNA, 21 bp, Homo sapiens
aggtgtcatacagatttgcaa

SEQ ID NO: 2411011 - DNA, 12 bp, Homo sapiens
aggttgtctgtg

SEQ ID NO: 2411012 - DNA, 20 bp, Homo sapiens
aggtttcactgtgttggcca

SEQ ID NO: 2411013 - DNA, 17 bp, Homo sapiens
agtaaaattgccatatt

SEQ ID NO: 2411014 - DNA, 21 bp, Homo sapiens
agtaaaattgccatattgcac

SEQ ID NO: 2411015 - DNA, 22 bp, Homo sapiens
agtaaaattgccatattgcaca

SEQ ID NO: 2411016 - DNA, 16 bp, Homo sapiens
agtaaagaattatttt

SEQ ID NO: 2411017 - DNA, 23 bp, Homo sapiens
agtaaggaattttatttttttct

SEQ ID NO: 2411018 - DNA, 20 bp, Homo sapiens
agtactggctgatggagtaa

SEQ ID NO: 2411019 - DNA, 15 bp, Homo sapiens
agtactttgtgcatt

SEQ ID NO: 2411020 - DNA, 12 bp, Homo sapiens
agtatgaaaata

SEQ ID NO: 2411021 - DNA, 13 bp, Homo sapiens
agtatgaaaataa

SEQ ID NO: 2411022 - DNA, 20 bp, Homo sapiens
agtattccagacctgaagaa

SEQ ID NO: 2411023 - DNA, 11 bp, Homo sapiens
agtatttaatt

SEQ ID NO: 2411024 - DNA, 15 bp, Homo sapiens
agtatttaattagtg

SEQ ID NO: 2411025 - DNA, 16 bp, Homo sapiens
agtatttaattagtgc

SEQ ID NO: 2411026 - DNA, 17 bp, Homo sapiens
agtatttaattagtgct

SEQ ID NO: 2411027 - DNA, 21 bp, Homo sapiens
agtatttaattagtgctaagt

SEQ ID NO: 2411028 - DNA, 21 bp, Homo sapiens
agtatttaattcatgttgcct

SEQ ID NO: 2411029 - DNA, 23 bp, Homo sapiens
agtcaatgttttcagttctcttg

SEQ ID NO: 2411030 - DNA, 23 bp, Homo sapiens
agtcagactggatagtccgtctc

SEQ ID NO: 2411031 - DNA, 20 bp, Homo sapiens
agtcatgtaagctgaaaata

SEQ ID NO: 2411032 - DNA, 14 bp, Homo sapiens
agtcattggcttta

SEQ ID NO: 2411033 - DNA, 20 bp, Homo sapiens
agtcattggctttatcctct

SEQ ID NO: 2411034 - DNA, 21 bp, Homo sapiens
agtcattggctttatcctctt

SEQ ID NO: 2411035 - DNA, 12 bp, Homo sapiens
agtcctgtaatg

SEQ ID NO: 2411036 - DNA, 18 bp, Homo sapiens
agtctcactgcttgaact

SEQ ID NO: 2411037 - DNA, 13 bp, Homo sapiens
agtcttttccatg

SEQ ID NO: 2411038 - DNA, 15 bp, Homo sapiens
agtcttttccatgaa

SEQ ID NO: 2411039 - DNA, 23 bp, Homo sapiens
agtgcagtggcatcatctcagct

SEQ ID NO: 2411040 - DNA, 14 bp, Homo sapiens
agtgctaagtgtga

SEQ ID NO: 2411041 - DNA, 15 bp, Homo sapiens
agtgctaattttgaa

SEQ ID NO: 2411042 - DNA, 20 bp, Homo sapiens
agtgctcgctgttgctgaat

SEQ ID NO: 2411043 - DNA, 12 bp, Homo sapiens
agtgctgtataa

SEQ ID NO: 2411044 - DNA, 15 bp, Homo sapiens
agtgctgtataaaat

SEQ ID NO: 2411045 - DNA, 20 bp, Homo sapiens
agtggcgtgatctcagctca

SEQ ID NO: 2411046 - DNA, 16 bp, Homo sapiens
agtggctggggcatgg

SEQ ID NO: 2411047 - DNA, 22 bp, Homo sapiens
agtggctggggcatggaaggca

SEQ ID NO: 2411048 - DNA, 14 bp, Homo sapiens
agtgtgaactggac

SEQ ID NO: 2411049 - DNA, 23 bp, Homo sapiens
agtgtgaactggaccctgttgct

SEQ ID NO: 2411050 - DNA, 19 bp, Homo sapiens
agtgtgtgtttttcataaa

SEQ ID NO: 2411051 - DNA, 13 bp, Homo sapiens
agttagactgttg

SEQ ID NO: 2411052 - DNA, 19 bp, Homo sapiens
agttatgccgctagataca

SEQ ID NO: 2411053 - DNA, 22 bp, Homo sapiens
agttatttatgcctctgtattt

SEQ ID NO: 2411054 - DNA, 17 bp, Homo sapiens
agttcatccattctatt

SEQ ID NO: 2411055 - DNA, 20 bp, Homo sapiens
agttcggtgagctacaaatg

SEQ ID NO: 2411056 - DNA, 17 bp, Homo sapiens
agttctgtagaaatggt

SEQ ID NO: 2411057 - DNA, 12 bp, Homo sapiens
caggagctgggc

SEQ ID NO: 2411058 - DNA, 15 bp, Homo sapiens
caggagctgggcaga

SEQ ID NO: 2411059 - DNA, 23 bp, Homo sapiens
caggagctgggcagaaggccaag

SEQ ID NO: 2411060 - DNA, 19 bp, Homo sapiens
caggagtttcgttttcaaa

SEQ ID NO: 2411061 - DNA, 18 bp, Homo sapiens
caggatgagggaaaagaa

SEQ ID NO: 2411062 - DNA, 23 bp, Homo sapiens
caggatggcgcaggaactcaata

SEQ ID NO: 2411063 - DNA, 20 bp, Homo sapiens
caggcaccaggactagggct

SEQ ID NO: 2411064 - DNA, 22 bp, Homo sapiens
caggcagctttttctctcccac

SEQ ID NO: 2411065 - DNA, 13 bp, Homo sapiens
caggcaggaacaa

SEQ ID NO: 2411066 - DNA, 20 bp, Homo sapiens
caggcaggaacaaacagggc

SEQ ID NO: 2411067 - DNA, 13 bp, Homo sapiens
caggcccacagta

SEQ ID NO: 2411068 - DNA, 20 bp, Homo sapiens
caggcctagaggcctgactg

SEQ ID NO: 2411069 - DNA, 16 bp, Homo sapiens
caggctggagtgcagt

SEQ ID NO: 2411070 - DNA, 23 bp, Homo sapiens
caggctgggtcgccctggactgt

SEQ ID NO: 2411071 - DNA, 22 bp, Homo sapiens
cagggactcatctttccctcct

SEQ ID NO: 2411072 - DNA, 22 bp, Homo sapiens
cagggcctggggagatggagga

SEQ ID NO: 2411073 - DNA, 23 bp, Homo sapiens
cagggggcccctttgctgaccct

SEQ ID NO: 2411074 - DNA, 15 bp, Homo sapiens
caggtaaaacagggc

SEQ ID NO: 2411075 - DNA, 11 bp, Homo sapiens
caggtccctaa

SEQ ID NO: 2411076 - DNA, 13 bp, Homo sapiens
caggtccctaata

SEQ ID NO: 2411077 - DNA, 18 bp, Homo sapiens
caggtccctaataaagct

SEQ ID NO: 2411078 - DNA, 11 bp, Homo sapiens
cagtaaaattg

SEQ ID NO: 2411079 - DNA, 16 bp, Homo sapiens
cagtaactcatctgtc

SEQ ID NO: 2411080 - DNA, 20 bp, Homo sapiens
cagtacctagctggctctgt

SEQ ID NO: 2411081 - DNA, 16 bp, Homo sapiens
cagtactttgtgcatt

SEQ ID NO: 2411082 - DNA, 22 bp, Homo sapiens
cagtgagagagtggctggggca

SEQ ID NO: 2411083 - DNA, 17 bp, Homo sapiens
cagtgcacctgtcatat

SEQ ID NO: 2411084 - DNA, 17 bp, Homo sapiens
cagtgctcgctgttgct

SEQ ID NO: 2411085 - DNA, 21 bp, Homo sapiens
cagtgctcgctgttgctgaat

SEQ ID NO: 2411086 - DNA, 19 bp, Homo sapiens
cagtgggaaaaatgtagga

SEQ ID NO: 2411087 - DNA, 16 bp, Homo sapiens
cagtgttttaggagca

SEQ ID NO: 2411088 - DNA, 17 bp, Homo sapiens
cagttattatatttaca

SEQ ID NO: 2411089 - DNA, 16 bp, Homo sapiens
cagttgagacaagaaa

SEQ ID NO: 2411090 - DNA, 14 bp, Homo sapiens
cataaagtcttgcc

SEQ ID NO: 2411091 - DNA, 11 bp, Homo sapiens
cataaattatt

SEQ ID NO: 2411092 - DNA, 21 bp, Homo sapiens
cataacggatcagaaatacag

SEQ ID NO: 2411093 - DNA, 22 bp, Homo sapiens
cataacggatcagaaatacaga

SEQ ID NO: 2411094 - DNA, 17 bp, Homo sapiens
cataagatatttttcat

SEQ ID NO: 2411095 - DNA, 14 bp, Homo sapiens
catacattttctaa

SEQ ID NO: 2411096 - DNA, 14 bp, Homo sapiens
catagaataaaatt

SEQ ID NO: 2411097 - DNA, 20 bp, Homo sapiens
catagaataaaatttttaat

SEQ ID NO: 2411098 - DNA, 21 bp, Homo sapiens
catagcttgataaagggccaa

SEQ ID NO: 2411099 - DNA, 23 bp, Homo sapiens
catagtcatgtaagctgaaaata

SEQ ID NO: 2411100 - DNA, 21 bp, Homo sapiens
catatgatgtacatgtactga

SEQ ID NO: 2411101 - DNA, 21 bp, Homo sapiens
catattattttatgttgcata

SEQ ID NO: 2411102 - DNA, 15 bp, Homo sapiens
catattgcacatgtc

SEQ ID NO: 2411103 - DNA, 16 bp, Homo sapiens
catattgcacatgtct

SEQ ID NO: 2411104 - DNA, 19 bp, Homo sapiens
catattgcacatgtcttaa

SEQ ID NO: 2411105 - DNA, 22 bp, Homo sapiens
catcaccttagaccaccaagcc

SEQ ID NO: 2411106 - DNA, 15 bp, Homo sapiens
catcaggctttctta

SEQ ID NO: 2411107 - DNA, 14 bp, Homo sapiens
catcatctcagctc

SEQ ID NO: 2411108 - DNA, 16 bp, Homo sapiens
catccattctcctgag

SEQ ID NO: 2411109 - DNA, 23 bp, Homo sapiens
catcccaaaatcataagatattt

SEQ ID NO: 2411110 - DNA, 23 bp, Homo sapiens
catcctaccacaatgcagtgcct

SEQ ID NO: 2411111 - DNA, 21 bp, Homo sapiens
catctagaggcttccttcatt

SEQ ID NO: 2411112 - DNA, 22 bp, Homo sapiens
catctagaggcttccttcattt

SEQ ID NO: 2411113 - DNA, 18 bp, Homo sapiens
catctaggtaaattacag

SEQ ID NO: 2411114 - DNA, 14 bp, Homo sapiens
catctgagaaaagc

SEQ ID NO: 2411115 - DNA, 23 bp, Homo sapiens
catctgagaaaagctttgaaccc

SEQ ID NO: 2411116 - DNA, 19 bp, Homo sapiens
catcttgcccgctcaggct

SEQ ID NO: 2411117 - DNA, 20 bp, Homo sapiens
catcttgcccgctcaggctg

SEQ ID NO: 2411118 - DNA, 14 bp, Homo sapiens
catctttccctcct

SEQ ID NO: 2411119 - DNA, 20 bp, Homo sapiens
catgaacctcaagctgcatc

SEQ ID NO: 2411120 - DNA, 15 bp, Homo sapiens
catgattccagccat

SEQ ID NO: 2411121 - DNA, 24 bp, Homo sapiens
catgattttgaaatcatgaagata

SEQ ID NO: 2411122 - DNA, 15 bp, Homo sapiens
catgcatacactctc

SEQ ID NO: 2411123 - DNA, 22 bp, Homo sapiens
catgctgctggggaagacagtg

SEQ ID NO: 2411124 - DNA, 23 bp, Homo sapiens
catggcagtgggaaaaatgtagg

SEQ ID NO: 2411125 - DNA, 12 bp, Homo sapiens
catggctatctg

SEQ ID NO: 2411126 - DNA, 15 bp, Homo sapiens
catgggtagcctggg

SEQ ID NO: 2411127 - DNA, 16 bp, Homo sapiens
catgggtagcctgggt

SEQ ID NO: 2411128 - DNA, 17 bp, Homo sapiens
catgtcttaatgaagtt

SEQ ID NO: 2411129 - DNA, 22 bp, Homo sapiens
catgtcttaatgaagtttgaat

SEQ ID NO: 2411130 - DNA, 15 bp, Homo sapiens
catgtgaaatcattc

SEQ ID NO: 2411131 - DNA, 17 bp, Homo sapiens
catgtgtataaaaataa

SEQ ID NO: 2411132 - DNA, 22 bp, Homo sapiens
catgtttctttgtaatgaaaac

SEQ ID NO: 2411133 - DNA, 9 bp, Homo sapiens
cattagcct

SEQ ID NO: 2411134 - DNA, 14 bp, Homo sapiens
cattagcctgagta

SEQ ID NO: 2411135 - DNA, 17 bp, Homo sapiens
cattagcctgagtagaa

SEQ ID NO: 2411136 - DNA, 23 bp, Homo sapiens
cattagcctgagtagaaaggcct

SEQ ID NO: 2411137 - DNA, 23 bp, Homo sapiens
cattattacttttgctgtaatgt

SEQ ID NO: 2411138 - DNA, 13 bp, Homo sapiens
cattcccccagtg

SEQ ID NO: 2411139 - DNA, 21 bp, Homo sapiens
cattcctcatgaatgtaaatt

SEQ ID NO: 2411140 - DNA, 19 bp, Homo sapiens
cattgagcttgcatgcttg

SEQ ID NO: 2411141 - DNA, 21 bp, Homo sapiens
cattgccttaactggagcccc

SEQ ID NO: 2411142 - DNA, 16 bp, Homo sapiens
cattggagatgtttag

SEQ ID NO: 2411143 - DNA, 14 bp, Homo sapiens
cattgtagaaaagc

SEQ ID NO: 2411144 - DNA, 13 bp, Homo sapiens
catttaataatat

SEQ ID NO: 2411145 - DNA, 17 bp, Homo sapiens
catttaataatatactt

SEQ ID NO: 2411146 - DNA, 20 bp, Homo sapiens
catttaataatatacttgtg

SEQ ID NO: 2411147 - DNA, 13 bp, Homo sapiens
catttatattgat

SEQ ID NO: 2411148 - DNA, 20 bp, Homo sapiens
catttatgagctcttcatgt

SEQ ID NO: 2411149 - DNA, 15 bp, Homo sapiens
catttctttttggga

SEQ ID NO: 2411150 - DNA, 14 bp, Homo sapiens
catttgaatgcatt

SEQ ID NO: 2411151 - DNA, 23 bp, Homo sapiens
catttgaatgcattttgtttggt

SEQ ID NO: 2411152 - DNA, 21 bp, Homo sapiens
catttggatcctgtgtggaga

SEQ ID NO: 2411153 - DNA, 19 bp, Homo sapiens
cattttgtttggtattgta

SEQ ID NO: 2411154 - DNA, 23 bp, Homo sapiens
cattttgtttggtattgtattta

SEQ ID NO: 2411155 - DNA, 13 bp, Homo sapiens
catttttgtattt

SEQ ID NO: 2411156 - DNA, 20 bp, Homo sapiens
ccaaaatcataagatatttt

SEQ ID NO: 2411157 - DNA, 17 bp, Homo sapiens
ccaacatgcactgatgt

SEQ ID NO: 2411158 - DNA, 13 bp, Homo sapiens
ccaaccatttcct

SEQ ID NO: 2411159 - DNA, 17 bp, Homo sapiens
ccaaccatttcctcaga

SEQ ID NO: 2411160 - DNA, 21 bp, Homo sapiens
ccaagcagttgggactacagg

SEQ ID NO: 2411161 - DNA, 20 bp, Homo sapiens
ccaagccatgggtagcctgg

SEQ ID NO: 2411162 - DNA, 22 bp, Homo sapiens
ccaagccttggggattcttcca

SEQ ID NO: 2411163 - DNA, 19 bp, Homo sapiens
ccaagggcataaattattg

SEQ ID NO: 2411164 - DNA, 20 bp, Homo sapiens
ccaagtagctgagactacag

SEQ ID NO: 2411165 - DNA, 16 bp, Homo sapiens
ccacacccacactcag

SEQ ID NO: 2411166 - DNA, 18 bp, Homo sapiens
ccacagcccttttgtctc

SEQ ID NO: 2411167 - DNA, 20 bp, Homo sapiens
ccacagcccttttgtctctg

SEQ ID NO: 2411168 - DNA, 16 bp, Homo sapiens
ccacaggcccacagta

SEQ ID NO: 2411169 - DNA, 20 bp, Homo sapiens
ccacagtgcctaataatact

SEQ ID NO: 2411170 - DNA, 20 bp, Homo sapiens
ccaccaggctgctcagggct

SEQ ID NO: 2411171 - DNA, 20 bp, Homo sapiens
ccacctcgcaggttcaagca

SEQ ID NO: 2411172 - DNA, 13 bp, Homo sapiens
ccacgccacagcc

SEQ ID NO: 2411173 - DNA, 13 bp, Homo sapiens
ccacgtactgcag

SEQ ID NO: 2411174 - DNA, 21 bp, Homo sapiens
ccagaaagcagttgagacaag

SEQ ID NO: 2411175 - DNA, 21 bp, Homo sapiens
ccagaccattgtctcagagca

SEQ ID NO: 2411176 - DNA, 13 bp, Homo sapiens
ccagatttatgca

SEQ ID NO: 2411177 - DNA, 23 bp, Homo sapiens
ccagcataatacttgctttggaa

SEQ ID NO: 2411178 - DNA, 15 bp, Homo sapiens
ccagctaatttttgt

SEQ ID NO: 2411179 - DNA, 22 bp, Homo sapiens
ccagctgcccccagagccacag

SEQ ID NO: 2411180 - DNA, 23 bp, Homo sapiens
ccagctgcccccagagccacagt

SEQ ID NO: 2411181 - DNA, 20 bp, Homo sapiens
ccagctggggccaggctggg

SEQ ID NO: 2411182 - DNA, 22 bp, Homo sapiens
ccagctggggccaggctgggtc

SEQ ID NO: 2411183 - DNA, 16 bp, Homo sapiens
ccaggagctgggcaga

SEQ ID NO: 2411184 - DNA, 21 bp, Homo sapiens
ccaggagctgggcagaaggcc

SEQ ID NO: 2411185 - DNA, 21 bp, Homo sapiens
gagtgctcagtagtcagactg

SEQ ID NO: 2411186 - DNA, 14 bp, Homo sapiens
gagttagactgttg

SEQ ID NO: 2411187 - DNA, 12 bp, Homo sapiens
gagttcctgcat

SEQ ID NO: 2411188 - DNA, 16 bp, Homo sapiens
gagtttaaattgtaat

SEQ ID NO: 2411189 - DNA, 16 bp, Homo sapiens
gagttttggatgcagt

SEQ ID NO: 2411190 - DNA, 19 bp, Homo sapiens
gataaagttggtaaacctt

SEQ ID NO: 2411191 - DNA, 17 bp, Homo sapiens
gataggtcagtgcaaat

SEQ ID NO: 2411192 - DNA, 16 bp, Homo sapiens
gatataagtgctgtat

SEQ ID NO: 2411193 - DNA, 21 bp, Homo sapiens
gatataagtgctgtataaaat

SEQ ID NO: 2411194 - DNA, 23 bp, Homo sapiens
gatataagtgctgtataaaatca

SEQ ID NO: 2411195 - DNA, 17 bp, Homo sapiens
gatataagtgtgtgttt

SEQ ID NO: 2411196 - DNA, 18 bp, Homo sapiens
gatcacaacgtgcattgt

SEQ ID NO: 2411197 - DNA, 22 bp, Homo sapiens
gatcacaacgtgcattgtgctt

SEQ ID NO: 2411198 - DNA, 15 bp, Homo sapiens
gatcagaaatacaga

SEQ ID NO: 2411199 - DNA, 20 bp, Homo sapiens
gatcattgtgaaattattca

SEQ ID NO: 2411200 - DNA, 12 bp, Homo sapiens
gatccacccgcc

SEQ ID NO: 2411201 - DNA, 21 bp, Homo sapiens
gatccccacgccacagccctt

SEQ ID NO: 2411202 - DNA, 15 bp, Homo sapiens
gatccctagctgtga

SEQ ID NO: 2411203 - DNA, 21 bp, Homo sapiens
gatccctagctgtgacctctc

SEQ ID NO: 2411204 - DNA, 12 bp, Homo sapiens
gatcctcctcat

SEQ ID NO: 2411205 - DNA, 12 bp, Homo sapiens
gatctcagctca

SEQ ID NO: 2411206 - DNA, 17 bp, Homo sapiens
gatctcagctcactaca

SEQ ID NO: 2411207 - DNA, 17 bp, Homo sapiens
gatctcagctcactgca

SEQ ID NO: 2411208 - DNA, 11 bp, Homo sapiens
gatgaaaataa

SEQ ID NO: 2411209 - DNA, 16 bp, Homo sapiens
gatgaaaataaagaat

SEQ ID NO: 2411210 - DNA, 18 bp, Homo sapiens
gatgaaaataaagaatgg

SEQ ID NO: 2411211 - DNA, 21 bp, Homo sapiens
gatgagggaaaagaaaaagat

SEQ ID NO: 2411212 - DNA, 16 bp, Homo sapiens
gatgatccccacgcca

SEQ ID NO: 2411213 - DNA, 21 bp, Homo sapiens
gatgatccccacgccacagcc

SEQ ID NO: 2411214 - DNA, 21 bp, Homo sapiens
gatgctgtcttcgtactggga

SEQ ID NO: 2411215 - DNA, 16 bp, Homo sapiens
gatggggtctgtaaaa

SEQ ID NO: 2411216 - DNA, 14 bp, Homo sapiens
gatgtaaaatcttg

SEQ ID NO: 2411217 - DNA, 15 bp, Homo sapiens
gatgttctctatcat

SEQ ID NO: 2411218 - DNA, 19 bp, Homo sapiens
gatgttctctatcatttaa

SEQ ID NO: 2411219 - DNA, 21 bp, Homo sapiens
gattaacaggtatgaaccacc

SEQ ID NO: 2411220 - DNA, 18 bp, Homo sapiens
gattactgcctattttaa

SEQ ID NO: 2411221 - DNA, 14 bp, Homo sapiens
gattatattatgaa

SEQ ID NO: 2411222 - DNA, 17 bp, Homo sapiens
gattatgggtcacagga

SEQ ID NO: 2411223 - DNA, 21 bp, Homo sapiens
gattattttctacacatacat

SEQ ID NO: 2411224 - DNA, 14 bp, Homo sapiens
gattctcttgcctc

SEQ ID NO: 2411225 - DNA, 16 bp, Homo sapiens
gattctcttgcctcaa

SEQ ID NO: 2411226 - DNA, 22 bp, Homo sapiens
gattggatacgcatcagacaga

SEQ ID NO: 2411227 - DNA, 12 bp, Homo sapiens
gatttccttctt

SEQ ID NO: 2411228 - DNA, 18 bp, Homo sapiens
gattttacatgtggccca

SEQ ID NO: 2411229 - DNA, 11 bp, Homo sapiens
gattttcagcc

SEQ ID NO: 2411230 - DNA, 18 bp, Homo sapiens
gattttgatagcaaagcg

SEQ ID NO: 2411231 - DNA, 12 bp, Homo sapiens
gatttttaccag

SEQ ID NO: 2411232 - DNA, 18 bp, Homo sapiens
gcaaactttattttgtgt

SEQ ID NO: 2411233 - DNA, 20 bp, Homo sapiens
gcaaactttattttgtgttt

SEQ ID NO: 2411234 - DNA, 21 bp, Homo sapiens
gcaaagactattcccttctaa

SEQ ID NO: 2411235 - DNA, 12 bp, Homo sapiens
gcaaatgtgaat

SEQ ID NO: 2411236 - DNA, 23 bp, Homo sapiens
gcaaatgtgaatcattttacctt

SEQ ID NO: 2411237 - DNA, 13 bp, Homo sapiens
gcaacctccacct

SEQ ID NO: 2411238 - DNA, 23 bp, Homo sapiens
gcaatcctcccacttcagcctcc

SEQ ID NO: 2411239 - DNA, 22 bp, Homo sapiens
gcaatctgaccctatgggtcta

SEQ ID NO: 2411240 - DNA, 16 bp, Homo sapiens
gcaattaattccttca

SEQ ID NO: 2411241 - DNA, 19 bp, Homo sapiens
gcaattaattccttcagca

SEQ ID NO: 2411242 - DNA, 22 bp, Homo sapiens
gcacacaccaccacgcctggct

SEQ ID NO: 2411243 - DNA, 13 bp, Homo sapiens
gcacactgtctgc

SEQ ID NO: 2411244 - DNA, 13 bp, Homo sapiens
gcacagctatgaa

SEQ ID NO: 2411245 - DNA, 17 bp, Homo sapiens
gcacagggagtgcacat

SEQ ID NO: 2411246 - DNA, 21 bp, Homo sapiens
gcacatgagctggcgggattg

SEQ ID NO: 2411247 - DNA, 15 bp, Homo sapiens
gcacatgtcttaatg

SEQ ID NO: 2411248 - DNA, 22 bp, Homo sapiens
gcaccccagctggggccaggct

SEQ ID NO: 2411249 - DNA, 15 bp, Homo sapiens
gcacctgtcccagaa

SEQ ID NO: 2411250 - DNA, 13 bp, Homo sapiens
gcactgtaaaatg

SEQ ID NO: 2411251 - DNA, 15 bp, Homo sapiens
gcacttggctgcata

SEQ ID NO: 2411252 - DNA, 18 bp, Homo sapiens
gcactttagaatatgcct

SEQ ID NO: 2411253 - DNA, 19 bp, Homo sapiens
gcactttagaatatgcctt

SEQ ID NO: 2411254 - DNA, 13 bp, Homo sapiens
gcaggaaaatgga

SEQ ID NO: 2411255 - DNA, 16 bp, Homo sapiens
gcaggaagctgtgaga

SEQ ID NO: 2411256 - DNA, 21 bp, Homo sapiens
gcaggagtttcgttttcaaaa

SEQ ID NO: 2411257 - DNA, 22 bp, Homo sapiens
gcaggcaggaacaaacagggct

SEQ ID NO: 2411258 - DNA, 17 bp, Homo sapiens
gcaggctggcctatgtg

SEQ ID NO: 2411259 - DNA, 11 bp, Homo sapiens
gcaggtcccta

SEQ ID NO: 2411260 - DNA, 17 bp, Homo sapiens
gcaggtccctaataaag

SEQ ID NO: 2411261 - DNA, 20 bp, Homo sapiens
gcaggtccctaataaagctg

SEQ ID NO: 2411262 - DNA, 21 bp, Homo sapiens
gcaggtccctaataaagctgt

SEQ ID NO: 2411263 - DNA, 23 bp, Homo sapiens
gcaggtccctaataaagctgtgt

SEQ ID NO: 2411264 - DNA, 15 bp, Homo sapiens
gcagtatgaaaataa

SEQ ID NO: 2411265 - DNA, 22 bp, Homo sapiens
gcagtgagagagtggctggggc

SEQ ID NO: 2411266 - DNA, 23 bp, Homo sapiens
gcagtgagagagtggctggggca

SEQ ID NO: 2411267 - DNA, 18 bp, Homo sapiens
gcagtggcgcgatctcag

SEQ ID NO: 2411268 - DNA, 22 bp, Homo sapiens
gcagtggcgcgatctcagctca

SEQ ID NO: 2411269 - DNA, 22 bp, Homo sapiens
gcagtggcgtgatctcagctca

SEQ ID NO: 2411270 - DNA, 19 bp, Homo sapiens
gcagtgggaaaaatgtagg

SEQ ID NO: 2411271 - DNA, 17 bp, Homo sapiens
gcataggtttaataatt

SEQ ID NO: 2411272 - DNA, 16 bp, Homo sapiens
gcatatctgcctttat

SEQ ID NO: 2411273 - DNA, 21 bp, Homo sapiens
gcatatctgcctttattgtgt

SEQ ID NO: 2411274 - DNA, 22 bp, Homo sapiens
gcatatctgcctttattgtgtt

SEQ ID NO: 2411275 - DNA, 18 bp, Homo sapiens
gcatattattttatgttg

SEQ ID NO: 2411276 - DNA, 19 bp, Homo sapiens
gcatcaggcctagaggcct

SEQ ID NO: 2411277 - DNA, 23 bp, Homo sapiens
gcatctagaggcttccttcattt

SEQ ID NO: 2411278 - DNA, 16 bp, Homo sapiens
gcatctgaaaattgat

SEQ ID NO: 2411279 - DNA, 15 bp, Homo sapiens
gcatgcggcccagga

SEQ ID NO: 2411280 - DNA, 23 bp, Homo sapiens
gcattaaattttagcaaagatat

SEQ ID NO: 2411281 - DNA, 15 bp, Homo sapiens
gcatttgaatgcatt

SEQ ID NO: 2411282 - DNA, 21 bp, Homo sapiens
gcattttgtttggtattgtat

SEQ ID NO: 2411283 - DNA, 18 bp, Homo sapiens
gccaaaccaggaccctgt

SEQ ID NO: 2411284 - DNA, 21 bp, Homo sapiens
gccaaaccaggaccctgtcca

SEQ ID NO: 2411285 - DNA, 19 bp, Homo sapiens
gccaagggcataaattatt

SEQ ID NO: 2411286 - DNA, 15 bp, Homo sapiens
gccaattatgttaaa

SEQ ID NO: 2411287 - DNA, 20 bp, Homo sapiens
gccaattatgttaaactagc

SEQ ID NO: 2411288 - DNA, 20 bp, Homo sapiens
gccacagcccttttgtctct

SEQ ID NO: 2411289 - DNA, 14 bp, Homo sapiens
gccacagttcccct

SEQ ID NO: 2411290 - DNA, 18 bp, Homo sapiens
gccaggctggagtgcagt

SEQ ID NO: 2411291 - DNA, 17 bp, Homo sapiens
gccaggctgggtcgccc

SEQ ID NO: 2411292 - DNA, 14 bp, Homo sapiens
gccagggagcgagt

SEQ ID NO: 2411293 - DNA, 17 bp, Homo sapiens
gccagtgaccaaccttt

SEQ ID NO: 2411294 - DNA, 14 bp, Homo sapiens
gccatcaccttaga

SEQ ID NO: 2411295 - DNA, 17 bp, Homo sapiens
gccatgggtagcctggg

SEQ ID NO: 2411296 - DNA, 16 bp, Homo sapiens
gccattctcaagccct

SEQ ID NO: 2411297 - DNA, 18 bp, Homo sapiens
gccattctcaagccctgc

SEQ ID NO: 2411298 - DNA, 13 bp, Homo sapiens
gcccaggacccca

SEQ ID NO: 2411299 - DNA, 15 bp, Homo sapiens
gccccaccctcagat

SEQ ID NO: 2411300 - DNA, 16 bp, Homo sapiens
gccccatcagctccag

SEQ ID NO: 2411301 - DNA, 18 bp, Homo sapiens
gcccctaccctggacttg

SEQ ID NO: 2411302 - DNA, 22 bp, Homo sapiens
gcccctgagacaaatggaggcc

SEQ ID NO: 2411303 - DNA, 15 bp, Homo sapiens
gcccctgcctctctg

SEQ ID NO: 2411304 - DNA, 20 bp, Homo sapiens
gcccctgcctctctgcaggt

SEQ ID NO: 2411305 - DNA, 16 bp, Homo sapiens
gcccctttgctgaccc

SEQ ID NO: 2411306 - DNA, 17 bp, Homo sapiens
gcccctttgctgaccct

SEQ ID NO: 2411307 - DNA, 21 bp, Homo sapiens
gcccggacgcccaggacccca

SEQ ID NO: 2411308 - DNA, 14 bp, Homo sapiens
gccctgctgccctc

SEQ ID NO: 2411309 - DNA, 17 bp, Homo sapiens
gccctgggaggctctgg

SEQ ID NO: 2411310 - DNA, 15 bp, Homo sapiens
gcctcaacctcccaa

SEQ ID NO: 2411311 - DNA, 19 bp, Homo sapiens
gcctcaccagccctggcaa

SEQ ID NO: 2411312 - DNA, 14 bp, Homo sapiens
gcctcccaggttca

SEQ ID NO: 2411313 - DNA, 10 bp, Homo sapiens
gcctctctgc

SEQ ID NO: 2411314 - DNA, 16 bp, Homo sapiens
gcctctctgcaggtcc

SEQ ID NO: 2411315 - DNA, 19 bp, Homo sapiens
tattgataagatcttttat

SEQ ID NO: 2411316 - DNA, 23 bp, Homo sapiens
tattgataagatcttttattttg

SEQ ID NO: 2411317 - DNA, 14 bp, Homo sapiens
tattgcacatgtct

SEQ ID NO: 2411318 - DNA, 16 bp, Homo sapiens
tattgcacatgtctta

SEQ ID NO: 2411319 - DNA, 22 bp, Homo sapiens
tattgcacatgtcttaatgaag

SEQ ID NO: 2411320 - DNA, 23 bp, Homo sapiens
tattgcacatgtcttaatgaagt

SEQ ID NO: 2411321 - DNA, 15 bp, Homo sapiens
tattgcctctgagag

SEQ ID NO: 2411322 - DNA, 13 bp, Homo sapiens
tatttaactgact

SEQ ID NO: 2411323 - DNA, 21 bp, Homo sapiens
tatttaactgccttgtgtaca

SEQ ID NO: 2411324 - DNA, 17 bp, Homo sapiens
tatttaattagtgctaa

SEQ ID NO: 2411325 - DNA, 19 bp, Homo sapiens
tatttaattagtgctaagt

SEQ ID NO: 2411326 - DNA, 21 bp, Homo sapiens
tatttaattagtgctaagtgt

SEQ ID NO: 2411327 - DNA, 21 bp, Homo sapiens
tatttacatgaattgcatttt

SEQ ID NO: 2411328 - DNA, 24 bp, Homo sapiens
tatttataaaaataaaaaacactg

SEQ ID NO: 2411329 - DNA, 19 bp, Homo sapiens
tatttattcaataaagtat

SEQ ID NO: 2411330 - DNA, 14 bp, Homo sapiens
tatttgaatcttgt

SEQ ID NO: 2411331 - DNA, 19 bp, Homo sapiens
tatttgaatcttgtctcaa

SEQ ID NO: 2411332 - DNA, 22 bp, Homo sapiens
tatttggtgattacattttaaa

SEQ ID NO: 2411333 - DNA, 15 bp, Homo sapiens
tattttatgttgcat

SEQ ID NO: 2411334 - DNA, 17 bp, Homo sapiens
tattttatgttgcatag

SEQ ID NO: 2411335 - DNA, 23 bp, Homo sapiens
tattttgccaagggcataaatta

SEQ ID NO: 2411336 - DNA, 20 bp, Homo sapiens
tattttgtgtttaggaacta

SEQ ID NO: 2411337 - DNA, 18 bp, Homo sapiens
tatttttacattctgaat

SEQ ID NO: 2411338 - DNA, 19 bp, Homo sapiens
tcaaactggggcctccctg

SEQ ID NO: 2411339 - DNA, 13 bp, Homo sapiens
tcaaatatattca

SEQ ID NO: 2411340 - DNA, 20 bp, Homo sapiens
tcaaatctaccactgtatga

SEQ ID NO: 2411341 - DNA, 24 bp, Homo sapiens
tcaactctcttattgcctcacttc

SEQ ID NO: 2411342 - DNA, 16 bp, Homo sapiens
tcaagattgttcctgc

SEQ ID NO: 2411343 - DNA, 16 bp, Homo sapiens
tcaataaagtatttaa

SEQ ID NO: 2411344 - DNA, 22 bp, Homo sapiens
tcaataaagtatttaattagtg

SEQ ID NO: 2411345 - DNA, 22 bp, Homo sapiens
tcaataagcctcagctttctaa

SEQ ID NO: 2411346 - DNA, 13 bp, Homo sapiens
tcaatgctcataa

SEQ ID NO: 2411347 - DNA, 14 bp, Homo sapiens
tcaatgctcataac

SEQ ID NO: 2411348 - DNA, 19 bp, Homo sapiens
tcacaacgtgcattgtgct

SEQ ID NO: 2411349 - DNA, 20 bp, Homo sapiens
tcacaacgtgcattgtgctt

SEQ ID NO: 2411350 - DNA, 16 bp, Homo sapiens
tcacagccacttggga

SEQ ID NO: 2411351 - DNA, 17 bp, Homo sapiens
tcacagtgggagccagg

SEQ ID NO: 2411352 - DNA, 18 bp, Homo sapiens
tcacagtgggagccaggg

SEQ ID NO: 2411353 - DNA, 18 bp, Homo sapiens
tcaccagtgtgtggcttt

SEQ ID NO: 2411354 - DNA, 23 bp, Homo sapiens
tcaccagtgtgtggctttcagag

SEQ ID NO: 2411355 - DNA, 21 bp, Homo sapiens
tcaccctgtccaaactgccta

SEQ ID NO: 2411356 - DNA, 19 bp, Homo sapiens
tcaccttagaccaccaagc

SEQ ID NO: 2411357 - DNA, 18 bp, Homo sapiens
tcactgcaacctccacct

SEQ ID NO: 2411358 - DNA, 14 bp, Homo sapiens
tcactgctcacact

SEQ ID NO: 2411359 - DNA, 19 bp, Homo sapiens
tcactgcttgaactaggct

SEQ ID NO: 2411360 - DNA, 21 bp, Homo sapiens
tcacttcaggtatacctcact

SEQ ID NO: 2411361 - DNA, 16 bp, Homo sapiens
tcagaaatacagattt

SEQ ID NO: 2411362 - DNA, 20 bp, Homo sapiens
tcagaaatacagattttgat

SEQ ID NO: 2411363 - DNA, 18 bp, Homo sapiens
tcagactctaagaaagaa

SEQ ID NO: 2411364 - DNA, 21 bp, Homo sapiens
tcagagcctcctttctggctt

SEQ ID NO: 2411365 - DNA, 15 bp, Homo sapiens
tcagatcctcctcat

SEQ ID NO: 2411366 - DNA, 18 bp, Homo sapiens
tcagatgcacatgagctg

SEQ ID NO: 2411367 - DNA, 12 bp, Homo sapiens
tcagccaggagc

SEQ ID NO: 2411368 - DNA, 14 bp, Homo sapiens
tcagccctcagaat

SEQ ID NO: 2411369 - DNA, 19 bp, Homo sapiens
tcagcctggcttcaaattg

SEQ ID NO: 2411370 - DNA, 12 bp, Homo sapiens
tcagctcatgga

SEQ ID NO: 2411371 - DNA, 18 bp, Homo sapiens
tcaggatgagggaaaaga

SEQ ID NO: 2411372 - DNA, 17 bp, Homo sapiens
tcaggtatacctcactt

SEQ ID NO: 2411373 - DNA, 15 bp, Homo sapiens
tcaggtattaagaaa

SEQ ID NO: 2411374 - DNA, 16 bp, Homo sapiens
tcataacggatcagaa

SEQ ID NO: 2411375 - DNA, 19 bp, Homo sapiens
tcataacggatcagaaata

SEQ ID NO: 2411376 - DNA, 21 bp, Homo sapiens
tcataacggatcagaaataca

SEQ ID NO: 2411377 - DNA, 15 bp, Homo sapiens
tcataattattattt

SEQ ID NO: 2411378 - DNA, 14 bp, Homo sapiens
tcatatatatacat

SEQ ID NO: 2411379 - DNA, 22 bp, Homo sapiens
tcatatttttcatagctaaaaa

SEQ ID NO: 2411380 - DNA, 13 bp, Homo sapiens
tcatcctgcaggc

SEQ ID NO: 2411381 - DNA, 14 bp, Homo sapiens
tcatctaggatttt

SEQ ID NO: 2411382 - DNA, 18 bp, Homo sapiens
tcatctaggtaaattaca

SEQ ID NO: 2411383 - DNA, 19 bp, Homo sapiens
tcatctcagctcactgcaa

SEQ ID NO: 2411384 - DNA, 14 bp, Homo sapiens
tcatctttccctcc

SEQ ID NO: 2411385 - DNA, 22 bp, Homo sapiens
tcatgaacctcaagctgcatct

SEQ ID NO: 2411386 - DNA, 19 bp, Homo sapiens
tcatgaagatatttttcca

SEQ ID NO: 2411387 - DNA, 13 bp, Homo sapiens
tcatgaatgtaaa

SEQ ID NO: 2411388 - DNA, 14 bp, Homo sapiens
tcatgaatgtaaat

SEQ ID NO: 2411389 - DNA, 20 bp, Homo sapiens
tcatgaatgtaaatttgtac

SEQ ID NO: 2411390 - DNA, 24 bp, Homo sapiens
tcatggacttctgccagcataata

SEQ ID NO: 2411391 - DNA, 14 bp, Homo sapiens
tcatggtgctcaga

SEQ ID NO: 2411392 - DNA, 19 bp, Homo sapiens
tcatgtaagctgaaaatat

SEQ ID NO: 2411393 - DNA, 20 bp, Homo sapiens
tcatgtgtacaaaagtttca

SEQ ID NO: 2411394 - DNA, 14 bp, Homo sapiens
tcatgtgtataaaa

SEQ ID NO: 2411395 - DNA, 14 bp, Homo sapiens
tcatgtttaagaaa

SEQ ID NO: 2411396 - DNA, 18 bp, Homo sapiens
tcattagcctgagtagaa

SEQ ID NO: 2411397 - DNA, 20 bp, Homo sapiens
tcattagcctgagtagaaag

SEQ ID NO: 2411398 - DNA, 14 bp, Homo sapiens
tcattcctccaggt

SEQ ID NO: 2411399 - DNA, 17 bp, Homo sapiens
tcattggctttatcctc

SEQ ID NO: 2411400 - DNA, 23 bp, Homo sapiens
tcattgtctgtgaagtgagacct

SEQ ID NO: 2411401 - DNA, 18 bp, Homo sapiens
tcattgtgaaattattca

SEQ ID NO: 2411402 - DNA, 14 bp, Homo sapiens
tcatttaataatat

SEQ ID NO: 2411403 - DNA, 13 bp, Homo sapiens
tcatttcctcaaa

SEQ ID NO: 2411404 - DNA, 22 bp, Homo sapiens
tcatttctttttgggagagact

SEQ ID NO: 2411405 - DNA, 20 bp, Homo sapiens
tccaaactgcctaagccctc

SEQ ID NO: 2411406 - DNA, 17 bp, Homo sapiens
tccaaattctcacagaa

SEQ ID NO: 2411407 - DNA, 16 bp, Homo sapiens
tccaacgtggcccaga

SEQ ID NO: 2411408 - DNA, 14 bp, Homo sapiens
tccagagacaacag

SEQ ID NO: 2411409 - DNA, 21 bp, Homo sapiens
tccagctttgttcttcttaaa

SEQ ID NO: 2411410 - DNA, 21 bp, Homo sapiens
tccaggcaccaggactagggc

SEQ ID NO: 2411411 - DNA, 21 bp, Homo sapiens
tccaggtattcgttatctaat

SEQ ID NO: 2411412 - DNA, 19 bp, Homo sapiens
tccatataaatattagaaa

SEQ ID NO: 2411413 - DNA, 20 bp, Homo sapiens
tccatgggccatatgaaaag

SEQ ID NO: 2411414 - DNA, 21 bp, Homo sapiens
tcccaaagtcctgggattaca

SEQ ID NO: 2411415 - DNA, 21 bp, Homo sapiens
tcccaagcacctgggattaca

SEQ ID NO: 2411416 - DNA, 22 bp, Homo sapiens
tcccactcacaacagctgcctg

SEQ ID NO: 2411417 - DNA, 17 bp, Homo sapiens
tccccacgccacagccc

SEQ ID NO: 2411418 - DNA, 12 bp, Homo sapiens
tcccccagtgcg

SEQ ID NO: 2411419 - DNA, 17 bp, Homo sapiens
tcccctgcactgtaaaa

SEQ ID NO: 2411420 - DNA, 18 bp, Homo sapiens
tcccctgcactgtaaaat

SEQ ID NO: 2411421 - DNA, 19 bp, Homo sapiens
tcccgattcaccctgtcca

SEQ ID NO: 2411422 - DNA, 13 bp, Homo sapiens
tccctaagccagc

SEQ ID NO: 2411423 - DNA, 14 bp, Homo sapiens
tccctaataaagct

SEQ ID NO: 2411424 - DNA, 16 bp, Homo sapiens
tccctaataaagctgt

SEQ ID NO: 2411425 - DNA, 18 bp, Homo sapiens
tccctagctgtgacctct

SEQ ID NO: 2411426 - DNA, 11 bp, Homo sapiens
tccctccttgg

SEQ ID NO: 2411427 - DNA, 17 bp, Homo sapiens
tccctggatttttacca

SEQ ID NO: 2411428 - DNA, 18 bp, Homo sapiens
tccctggatttttaccag

SEQ ID NO: 2411429 - DNA, 20 bp, Homo sapiens
tccctggatttttaccagtc

SEQ ID NO: 2411430 - DNA, 13 bp, Homo sapiens
tccctggtccctt

SEQ ID NO: 2411431 - DNA, 14 bp, Homo sapiens
tccctggtcccttg

SEQ ID NO: 2411432 - DNA, 19 bp, Homo sapiens
tccctggtcccttggagac

SEQ ID NO: 2411433 - DNA, 13 bp, Homo sapiens
tccctttttttaa

SEQ ID NO: 2411434 - DNA, 14 bp, Homo sapiens
tccgcagtgagaga

SEQ ID NO: 2411435 - DNA, 20 bp, Homo sapiens
tcctacattaattatctagt

SEQ ID NO: 2411436 - DNA, 13 bp, Homo sapiens
tcctagatgctct

SEQ ID NO: 2411437 - DNA, 17 bp, Homo sapiens
tcctagttctgtagaaa

SEQ ID NO: 2411438 - DNA, 20 bp, Homo sapiens
tcctccttccggggaaggat

SEQ ID NO: 2411439 - DNA, 16 bp, Homo sapiens
tcctgaaagacaatat

SEQ ID NO: 2411440 - DNA, 20 bp, Homo sapiens
tcctgacctgtctcaccatg

SEQ ID NO: 2411441 - DNA, 14 bp, Homo sapiens
tcctgcctcagcct

SEQ ID NO: 2411442 - DNA, 22 bp, Homo sapiens
tcctgtcggagccctgtctcct

SEQ ID NO: 2411443 - DNA, 15 bp, Homo sapiens
tcctgtgtggagagg

SEQ ID NO: 2411444 - DNA, 19 bp, Homo sapiens
ttatttcctagttctgtag

SEQ ID NO: 2411445 - DNA, 22 bp, Homo sapiens
ttattttgccaagggcataaat

SEQ ID NO: 2411446 - DNA, 22 bp, Homo sapiens
ttattttgtgatgcaaataaat

SEQ ID NO: 2411447 - DNA, 23 bp, Homo sapiens
ttcaaattgtaagcatgcacaaa

SEQ ID NO: 2411448 - DNA, 12 bp, Homo sapiens
ttcaacttttcc

SEQ ID NO: 2411449 - DNA, 14 bp, Homo sapiens
ttcaataaagtatt

SEQ ID NO: 2411450 - DNA, 19 bp, Homo sapiens
ttcaataaagtatttaatt

SEQ ID NO: 2411451 - DNA, 18 bp, Homo sapiens
ttcaatataagcttttct

SEQ ID NO: 2411452 - DNA, 22 bp, Homo sapiens
ttcaccctgtccaaactgccta

SEQ ID NO: 2411453 - DNA, 22 bp, Homo sapiens
ttcagagttgatggttgtacat

SEQ ID NO: 2411454 - DNA, 12 bp, Homo sapiens
ttcagccaggag

SEQ ID NO: 2411455 - DNA, 17 bp, Homo sapiens
ttcagccaggagctggg

SEQ ID NO: 2411456 - DNA, 18 bp, Homo sapiens
ttcatagagacttgggaa

SEQ ID NO: 2411457 - DNA, 15 bp, Homo sapiens
ttcatgattttgaaa

SEQ ID NO: 2411458 - DNA, 22 bp, Homo sapiens
ttcattcatgtcatgtgtacaa

SEQ ID NO: 2411459 - DNA, 14 bp, Homo sapiens
ttcattgtctgtga

SEQ ID NO: 2411460 - DNA, 13 bp, Homo sapiens
ttcatttcctcaa

SEQ ID NO: 2411461 - DNA, 16 bp, Homo sapiens
ttcatttcctcaaaaa

SEQ ID NO: 2411462 - DNA, 16 bp, Homo sapiens
ttcatttcctccgtca

SEQ ID NO: 2411463 - DNA, 18 bp, Homo sapiens
ttcattttaacatctgag

SEQ ID NO: 2411464 - DNA, 12 bp, Homo sapiens
ttccctccttgg

SEQ ID NO: 2411465 - DNA, 20 bp, Homo sapiens
ttcctaaatatattttaaga

SEQ ID NO: 2411466 - DNA, 13 bp, Homo sapiens
ttcctaagtgatt

SEQ ID NO: 2411467 - DNA, 14 bp, Homo sapiens
ttcctcagactcta

SEQ ID NO: 2411468 - DNA, 18 bp, Homo sapiens
ttcctcagactctaagaa

SEQ ID NO: 2411469 - DNA, 14 bp, Homo sapiens
ttcctcatgaatgt

SEQ ID NO: 2411470 - DNA, 17 bp, Homo sapiens
ttcctcatgaatgtaaa

SEQ ID NO: 2411471 - DNA, 21 bp, Homo sapiens
ttcctcatgaatgtaaatttg

SEQ ID NO: 2411472 - DNA, 20 bp, Homo sapiens
ttcctctgcccttcctgcag

SEQ ID NO: 2411473 - DNA, 15 bp, Homo sapiens
ttccttcagcacttt

SEQ ID NO: 2411474 - DNA, 23 bp, Homo sapiens
ttcggaaagaagaaggtgggagg

SEQ ID NO: 2411475 - DNA, 14 bp, Homo sapiens
ttctaatagtttta

SEQ ID NO: 2411476 - DNA, 17 bp, Homo sapiens
ttctaattggcatgaag

SEQ ID NO: 2411477 - DNA, 15 bp, Homo sapiens
ttctagtgtagaatt

SEQ ID NO: 2411478 - DNA, 13 bp, Homo sapiens
ttctataatttaa

SEQ ID NO: 2411479 - DNA, 14 bp, Homo sapiens
ttctattgcctctg

SEQ ID NO: 2411480 - DNA, 15 bp, Homo sapiens
ttctattgttgtaca

SEQ ID NO: 2411481 - DNA, 14 bp, Homo sapiens
ttctcaagccctgc

SEQ ID NO: 2411482 - DNA, 19 bp, Homo sapiens
ttctcacagtgggagccag

SEQ ID NO: 2411483 - DNA, 15 bp, Homo sapiens
ttctcatcctgcagg

SEQ ID NO: 2411484 - DNA, 15 bp, Homo sapiens
ttctcccctgcactg

SEQ ID NO: 2411485 - DNA, 21 bp, Homo sapiens
ttctcctgaggatgtgtccca

SEQ ID NO: 2411486 - DNA, 13 bp, Homo sapiens
ttctctatcattt

SEQ ID NO: 2411487 - DNA, 16 bp, Homo sapiens
ttctctatcatttaat

SEQ ID NO: 2411488 - DNA, 14 bp, Homo sapiens
ttctgagcctgcct

SEQ ID NO: 2411489 - DNA, 15 bp, Homo sapiens
ttctgagttcctgca

SEQ ID NO: 2411490 - DNA, 13 bp, Homo sapiens
ttctgtagaaatg

SEQ ID NO: 2411491 - DNA, 15 bp, Homo sapiens
ttctgtagaaatggt

SEQ ID NO: 2411492 - DNA, 18 bp, Homo sapiens
ttctgtagaaatggttgt

SEQ ID NO: 2411493 - DNA, 17 bp, Homo sapiens
ttcttaaagtcaagatt

SEQ ID NO: 2411494 - DNA, 23 bp, Homo sapiens
ttcttaaccagatcattgtgaaa

SEQ ID NO: 2411495 - DNA, 18 bp, Homo sapiens
ttcttatgccatataatt

SEQ ID NO: 2411496 - DNA, 22 bp, Homo sapiens
ttcttcttccaacgtggcccag

SEQ ID NO: 2411497 - DNA, 14 bp, Homo sapiens
ttcttgatgtaaaa

SEQ ID NO: 2411498 - DNA, 22 bp, Homo sapiens
ttctttgggaatatttgaatct

SEQ ID NO: 2411499 - DNA, 15 bp, Homo sapiens
ttctttgtaatgaaa

SEQ ID NO: 2411500 - DNA, 17 bp, Homo sapiens
ttgaaattgtattacaa

SEQ ID NO: 2411501 - DNA, 18 bp, Homo sapiens
ttgaacctgatgaaaata

SEQ ID NO: 2411502 - DNA, 19 bp, Homo sapiens
ttgaacctgatgaaaataa

SEQ ID NO: 2411503 - DNA, 16 bp, Homo sapiens
ttgaatcttgtctcaa

SEQ ID NO: 2411504 - DNA, 23 bp, Homo sapiens
ttgaatgcattttgtttggtatt

SEQ ID NO: 2411505 - DNA, 16 bp, Homo sapiens
ttgacaattgggagct

SEQ ID NO: 2411506 - DNA, 16 bp, Homo sapiens
ttgagatgtgttcaca

SEQ ID NO: 2411507 - DNA, 18 bp, Homo sapiens
ttgataagatcttttatt

SEQ ID NO: 2411508 - DNA, 13 bp, Homo sapiens
ttgatgtaaaatc

SEQ ID NO: 2411509 - DNA, 17 bp, Homo sapiens
ttgcaactttgtataaa

SEQ ID NO: 2411510 - DNA, 18 bp, Homo sapiens
ttgcaactttgtataaaa

SEQ ID NO: 2411511 - DNA, 19 bp, Homo sapiens
ttgcacaaaccaattaaac

SEQ ID NO: 2411512 - DNA, 13 bp, Homo sapiens
ttgcacatgtctt

SEQ ID NO: 2411513 - DNA, 15 bp, Homo sapiens
ttgcacatgtcttaa

SEQ ID NO: 2411514 - DNA, 16 bp, Homo sapiens
ttgcacatgtcttaat

SEQ ID NO: 2411515 - DNA, 21 bp, Homo sapiens
ttgcacatgtcttaatgaagt

SEQ ID NO: 2411516 - DNA, 14 bp, Homo sapiens
ttgcatctgaaaat

SEQ ID NO: 2411517 - DNA, 17 bp, Homo sapiens
ttgccatattgcacatg

SEQ ID NO: 2411518 - DNA, 16 bp, Homo sapiens
ttgccctgctgccctc

SEQ ID NO: 2411519 - DNA, 19 bp, Homo sapiens
ttgcctctgagagcatcag

SEQ ID NO: 2411520 - DNA, 12 bp, Homo sapiens
ttgcctgcaggc

SEQ ID NO: 2411521 - DNA, 16 bp, Homo sapiens
ttgccttaactggagc

SEQ ID NO: 2411522 - DNA, 21 bp, Homo sapiens
ttgctaagccccagcaagcaa

SEQ ID NO: 2411523 - DNA, 15 bp, Homo sapiens
ttgctgaccctcccc

SEQ ID NO: 2411524 - DNA, 18 bp, Homo sapiens
ttgctgcagtatgaaaat

SEQ ID NO: 2411525 - DNA, 13 bp, Homo sapiens
ttggatcctgtgt

SEQ ID NO: 2411526 - DNA, 24 bp, Homo sapiens
ttggatgcagtgctcgctgttgct

SEQ ID NO: 2411527 - DNA, 14 bp, Homo sapiens
ttggctttatcctc

SEQ ID NO: 2411528 - DNA, 19 bp, Homo sapiens
ttgggaatatttgaatctt

SEQ ID NO: 2411529 - DNA, 23 bp, Homo sapiens
ttgggagagacttgttttggatg

SEQ ID NO: 2411530 - DNA, 23 bp, Homo sapiens
ttgggcagccagaccagcaggct

SEQ ID NO: 2411531 - DNA, 20 bp, Homo sapiens
ttggggtgggtataaaagat

SEQ ID NO: 2411532 - DNA, 12 bp, Homo sapiens
ttggtaaacctt

SEQ ID NO: 2411533 - DNA, 12 bp, Homo sapiens
ttggtattgtat

SEQ ID NO: 2411534 - DNA, 13 bp, Homo sapiens
ttggtattgtatt

SEQ ID NO: 2411535 - DNA, 16 bp, Homo sapiens
ttgtaaaggaatttaa

SEQ ID NO: 2411536 - DNA, 22 bp, Homo sapiens
ttgtaagcatgcacaaattctg

SEQ ID NO: 2411537 - DNA, 22 bp, Homo sapiens
ttgtactatttaactgactatt

SEQ ID NO: 2411538 - DNA, 17 bp, Homo sapiens
ttgtagcatcctcttta

SEQ ID NO: 2411539 - DNA, 15 bp, Homo sapiens
ttgtattagatgttc

SEQ ID NO: 2411540 - DNA, 17 bp, Homo sapiens
ttgtattagatgttctc

SEQ ID NO: 2411541 - DNA, 21 bp, Homo sapiens
ttgtattcagagttgatggtt

SEQ ID NO: 2411542 - DNA, 14 bp, Homo sapiens
ttgtcattagcctg

SEQ ID NO: 2411543 - DNA, 17 bp, Homo sapiens
ttgtcattagcctgagt

SEQ ID NO: 2411544 - DNA, 18 bp, Homo sapiens
ttgtcattagcctgagta

SEQ ID NO: 2411545 - DNA, 20 bp, Homo sapiens
ttgtctctgcaaactgcctt

SEQ ID NO: 2411546 - DNA, 22 bp, Homo sapiens
ttgtctctgcaaactgccttct

SEQ ID NO: 2411547 - DNA, 11 bp, Homo sapiens
ttgtgaagagg

SEQ ID NO: 2411548 - DNA, 17 bp, Homo sapiens
ttgtgaggaaagtcatt

SEQ ID NO: 2411549 - DNA, 22 bp, Homo sapiens
ttgtgcccccaaccatttcctc

SEQ ID NO: 2411550 - DNA, 13 bp, Homo sapiens
ttgtggactaaaa

SEQ ID NO: 2411551 - DNA, 16 bp, Homo sapiens
ttgtggactaaaagat

SEQ ID NO: 2411552 - DNA, 22 bp, Homo sapiens
ttgtggactaaaagatataagt

SEQ ID NO: 2411553 - DNA, 14 bp, Homo sapiens
ttgttcttcttaaa

SEQ ID NO: 2411554 - DNA, 18 bp, Homo sapiens
tttaaatatatgctaagt

SEQ ID NO: 2411555 - DNA, 14 bp, Homo sapiens
tttaaatgaagaaa

SEQ ID NO: 2411556 - DNA, 19 bp, Homo sapiens
tttaactctataatgtgtt

SEQ ID NO: 2411557 - DNA, 20 bp, Homo sapiens
tttaagacgaaacatttgtt

SEQ ID NO: 2411558 - DNA, 22 bp, Homo sapiens
tttaataaacactcttgaaaaa

SEQ ID NO: 2411559 - DNA, 15 bp, Homo sapiens
tttaataatatactt

SEQ ID NO: 2411560 - DNA, 16 bp, Homo sapiens
tttaatccccagtaaa

SEQ ID NO: 2411561 - DNA, 22 bp, Homo sapiens
tttaatccccagtaaaattgcc

SEQ ID NO: 2411562 - DNA, 21 bp, Homo sapiens
tttaattagtgctaagtgtga

SEQ ID NO: 2411563 - DNA, 14 bp, Homo sapiens
tttagaaagcattt

SEQ ID NO: 2411564 - DNA, 16 bp, Homo sapiens
tttagaaagcatttga

SEQ ID NO: 2411565 - DNA, 17 bp, Homo sapiens
tttagaatatgccttgt

SEQ ID NO: 2411566 - DNA, 16 bp, Homo sapiens
tttagagttagactgt

SEQ ID NO: 2411567 - DNA, 21 bp, Homo sapiens
tttagtagatattaccagttt

SEQ ID NO: 2411568 - DNA, 23 bp, Homo sapiens
tttagtagatattaccagttttc

SEQ ID NO: 2411569 - DNA, 23 bp, Homo sapiens
tttagttgaattttttttaacat

SEQ ID NO: 2411570 - DNA, 18 bp, Homo sapiens
tttagttgcaactttgta

SEQ ID NO: 2411571 - DNA, 23 bp, Homo sapiens
tttataaaaataaaaaacactgg

SEQ ID NO: 2411572 - DNA, 18 bp, Homo sapiens
tttatcatgtgaaatcat

SEQ ID NO: 2411573 - DNA, 16 bp, Homo sapiens
tttatcctatctctcc

SEQ ID NO: 2411574 - DNA, 14 bp, Homo sapiens
attactgcatgcac

SEQ ID NO: 2411575 - DNA, 18 bp, Homo sapiens
attagcagtccctccaca

SEQ ID NO: 2411576 - DNA, 14 bp, Homo sapiens
attagcctgagtag

SEQ ID NO: 2411577 - DNA, 17 bp, Homo sapiens
attagcctgagtagaaa

SEQ ID NO: 2411578 - DNA, 15 bp, Homo sapiens
attagtgctaagtgt

SEQ ID NO: 2411579 - DNA, 17 bp, Homo sapiens
attataactggaaagaa

SEQ ID NO: 2411580 - DNA, 19 bp, Homo sapiens
attatatcaatttcctcat

SEQ ID NO: 2411581 - DNA, 15 bp, Homo sapiens
attatatttacaaat

SEQ ID NO: 2411582 - DNA, 22 bp, Homo sapiens
attatcttttcatacattttct

SEQ ID NO: 2411583 - DNA, 21 bp, Homo sapiens
attatgtgtgttttaaaatga

SEQ ID NO: 2411584 - DNA, 14 bp, Homo sapiens
attattacttttgc

SEQ ID NO: 2411585 - DNA, 15 bp, Homo sapiens
attattatttggccc

SEQ ID NO: 2411586 - DNA, 18 bp, Homo sapiens
attattttatgttgcata

SEQ ID NO: 2411587 - DNA, 12 bp, Homo sapiens
attattttgtga

SEQ ID NO: 2411588 - DNA, 18 bp, Homo sapiens
attcaataaagtatttaa

SEQ ID NO: 2411589 - DNA, 20 bp, Homo sapiens
attcaataaagtatttaatt

SEQ ID NO: 2411590 - DNA, 14 bp, Homo sapiens
attcagcctggctt

SEQ ID NO: 2411591 - DNA, 16 bp, Homo sapiens
atatgttctgacataa

SEQ ID NO: 2411592 - DNA, 13 bp, Homo sapiens
atattatcttttc

SEQ ID NO: 2411593 - DNA, 18 bp, Homo sapiens
atattgataagatctttt

SEQ ID NO: 2411594 - DNA, 16 bp, Homo sapiens
atattgcacatgtctt

SEQ ID NO: 2411595 - DNA, 17 bp, Homo sapiens
atattgcacatgtctta

SEQ ID NO: 2411596 - DNA, 13 bp, Homo sapiens
atatttgaatctt

SEQ ID NO: 2411597 - DNA, 15 bp, Homo sapiens
atatttgaatcttgt

SEQ ID NO: 2411598 - DNA, 21 bp, Homo sapiens
atatttgaatcttgtctcaat

SEQ ID NO: 2411599 - DNA, 14 bp, Homo sapiens
atattttaagacga

SEQ ID NO: 2411600 - DNA, 20 bp, Homo sapiens
atcaaatctaccactgtatg

SEQ ID NO: 2411601 - DNA, 15 bp, Homo sapiens
atcacaacgtgcatt

SEQ ID NO: 2411602 - DNA, 18 bp, Homo sapiens
atcacaacgtgcattgtg

SEQ ID NO: 2411603 - DNA, 14 bp, Homo sapiens
atcacagcttcagc

SEQ ID NO: 2411604 - DNA, 18 bp, Homo sapiens
atcacagcttcagccagg

SEQ ID NO: 2411605 - DNA, 21 bp, Homo sapiens
atcacagcttcagccaggagc

SEQ ID NO: 2411606 - DNA, 22 bp, Homo sapiens
atcacagcttcagccaggagct

SEQ ID NO: 2411607 - DNA, 21 bp, Homo sapiens
atcactctgttcattcctcca

SEQ ID NO: 2411608 - DNA, 22 bp, Homo sapiens
atcactctgttcattcctccag

SEQ ID NO: 2411609 - DNA, 19 bp, Homo sapiens
atcagaaatacagattttg

SEQ ID NO: 2411610 - DNA, 19 bp, Homo sapiens
atcagactatgaagttttt

SEQ ID NO: 2411611 - DNA, 17 bp, Homo sapiens
atcagagcgcacaggga

SEQ ID NO: 2411612 - DNA, 16 bp, Homo sapiens
atcagccaattatgtt

SEQ ID NO: 2411613 - DNA, 14 bp, Homo sapiens
atcaggcctagagg

SEQ ID NO: 2411614 - DNA, 18 bp, Homo sapiens
atcagtagccagcatctg

SEQ ID NO: 2411615 - DNA, 21 bp, Homo sapiens
aggcttccttcatttcctccg

SEQ ID NO: 2411616 - DNA, 16 bp, Homo sapiens
aggcttgcctgcaggc

SEQ ID NO: 2411617 - DNA, 17 bp, Homo sapiens
aggcttgcctgcaggca

SEQ ID NO: 2411618 - DNA, 18 bp, Homo sapiens
aggctttgccctgctgcc

SEQ ID NO: 2411619 - DNA, 18 bp, Homo sapiens
aggcttttttatcatgtg

SEQ ID NO: 2411620 - DNA, 19 bp, Homo sapiens
agggaaggctggactaggc

SEQ ID NO: 2411621 - DNA, 14 bp, Homo sapiens
agggaatgtgaaat

SEQ ID NO: 2411622 - DNA, 22 bp, Homo sapiens
agggactcatctttccctcctt

SEQ ID NO: 2411623 - DNA, 17 bp, Homo sapiens
agggactgagaaattta

SEQ ID NO: 2411624 - DNA, 17 bp, Homo sapiens
agggattttcagccctc

SEQ ID NO: 2411625 - DNA, 19 bp, Homo sapiens
agggcaattaattccttca

SEQ ID NO: 2411626 - DNA, 16 bp, Homo sapiens
agggcagggggcccct

SEQ ID NO: 2411627 - DNA, 16 bp, Homo sapiens
agggcaggtgcttcag

SEQ ID NO: 2411628 - DNA, 16 bp, Homo sapiens
agggcataaattattg

SEQ ID NO: 2411629 - DNA, 20 bp, Homo sapiens
agggctgccttctggccttg

SEQ ID NO: 2411630 - DNA, 23 bp, Homo sapiens
agggggcccctttgctgaccctc

SEQ ID NO: 2411631 - DNA, 23 bp, Homo sapiens
aggggggggtatttcaattacct

SEQ ID NO: 2411632 - DNA, 14 bp, Homo sapiens
agggtgctgactgg

SEQ ID NO: 2411633 - DNA, 14 bp, Homo sapiens
aggtaaaacagggc

SEQ ID NO: 2411634 - DNA, 23 bp, Homo sapiens
aggtaaatcagactatgaagttt

SEQ ID NO: 2411635 - DNA, 12 bp, Homo sapiens
aggtactattat

SEQ ID NO: 2411636 - DNA, 15 bp, Homo sapiens
aggtagggtttaatc

SEQ ID NO: 2411637 - DNA, 18 bp, Homo sapiens
aggtattcgttatctaat

SEQ ID NO: 2411638 - DNA, 15 bp, Homo sapiens
aggtccctaataaag

SEQ ID NO: 2411639 - DNA, 17 bp, Homo sapiens
aggtgaaacattttctc

SEQ ID NO: 2411640 - DNA, 19 bp, Homo sapiens
aggtttctgagttcctgca

SEQ ID NO: 2411641 - DNA, 14 bp, Homo sapiens
agtaaaattgccat

SEQ ID NO: 2411642 - DNA, 16 bp, Homo sapiens
agtaaaattgccatat

SEQ ID NO: 2411643 - DNA, 20 bp, Homo sapiens
agtaaaattgccatattgca

SEQ ID NO: 2411644 - DNA, 15 bp, Homo sapiens
agtaatccaagcaaa

SEQ ID NO: 2411645 - DNA, 19 bp, Homo sapiens
agtacaccacaagggtcac

SEQ ID NO: 2411646 - DNA, 13 bp, Homo sapiens
agtactttgtgca

SEQ ID NO: 2411647 - DNA, 14 bp, Homo sapiens
agtagaaaggcctt

SEQ ID NO: 2411648 - DNA, 21 bp, Homo sapiens
acccagataaaggttcatgca

SEQ ID NO: 2411649 - DNA, 20 bp, Homo sapiens
acccaggttggagtgcagtg

SEQ ID NO: 2411650 - DNA, 18 bp, Homo sapiens
acccagtaactcatctgt

SEQ ID NO: 2411651 - DNA, 23 bp, Homo sapiens
accccagctggggccaggctggg

SEQ ID NO: 2411652 - DNA, 22 bp, Homo sapiens
acccctaaaagaaaccctgcac

SEQ ID NO: 2411653 - DNA, 13 bp, Homo sapiens
acccctgtttctg

SEQ ID NO: 2411654 - DNA, 16 bp, Homo sapiens
acccgttcacattttt

SEQ ID NO: 2411655 - DNA, 14 bp, Homo sapiens
accctatgggtcta

SEQ ID NO: 2411656 - DNA, 22 bp, Homo sapiens
accctccccaaaggctttgccc

SEQ ID NO: 2411657 - DNA, 14 bp, Homo sapiens
accctgttgctaag

SEQ ID NO: 2411658 - DNA, 17 bp, Homo sapiens
acccttattgctgtcct

SEQ ID NO: 2411659 - DNA, 20 bp, Homo sapiens
acccttcccttgagccctct

SEQ ID NO: 2411660 - DNA, 16 bp, Homo sapiens
acctatgtcatttcat

SEQ ID NO: 2411661 - DNA, 17 bp, Homo sapiens
acctcgtgatccacccg

SEQ ID NO: 2411662 - DNA, 21 bp, Homo sapiens
acctctcccctggaactgtct

SEQ ID NO: 2411663 - DNA, 11 bp, Homo sapiens
acctgaagaat

SEQ ID NO: 2411664 - DNA, 12 bp, Homo sapiens
acctgagctaaa

SEQ ID NO: 2411665 - DNA, 19 bp, Homo sapiens
acctgatgaaaataaagaa

SEQ ID NO: 2411666 - DNA, 16 bp, Homo sapiens
acctggagatggtgga

SEQ ID NO: 2411667 - DNA, 20 bp, Homo sapiens
accttagaccaccaagcctt

SEQ ID NO: 2411668 - DNA, 23 bp, Homo sapiens
accttaggaataatctcctgtta

SEQ ID NO: 2411669 - DNA, 23 bp, Homo sapiens
accttccagaaatactactgtgt

SEQ ID NO: 2411670 - DNA, 21 bp, Homo sapiens
accttccttttacttttcttc

SEQ ID NO: 2411671 - DNA, 22 bp, Homo sapiens
acctttgtttgcatctgaaaat

SEQ ID NO: 2411672 - DNA, 14 bp, Homo sapiens
acgagaaaacaata

SEQ ID NO: 2411673 - DNA, 17 bp, Homo sapiens
acgccacagcccttttg

SEQ ID NO: 2411674 - DNA, 12 bp, Homo sapiens
acgtgcattgtg

SEQ ID NO: 2411675 - DNA, 22 bp, Homo sapiens
acgttagtcgtgagctcttgtg

SEQ ID NO: 2411676 - DNA, 11 bp, Homo sapiens
actaaaagata

SEQ ID NO: 2411677 - DNA, 20 bp, Homo sapiens
actaactcctaggaaaatac

SEQ ID NO: 2411678 - DNA, 20 bp, Homo sapiens
actacaggcacacaccacca

SEQ ID NO: 2411679 - DNA, 14 bp, Homo sapiens
actacatgcacttg

SEQ ID NO: 2411680 - DNA, 14 bp, Homo sapiens
actactagggaaat

SEQ ID NO: 2411681 - DNA, 15 bp, Homo sapiens
actagcatatctgcc

SEQ ID NO: 2411682 - DNA, 17 bp, Homo sapiens
actagcatatctgcctt

SEQ ID NO: 2411683 - DNA, 18 bp, Homo sapiens
actagccaaaccaggacc

SEQ ID NO: 2411684 - DNA, 14 bp, Homo sapiens
actagctatggtgt

SEQ ID NO: 2411685 - DNA, 22 bp, Homo sapiens
actaggccttgcggctcctcag

SEQ ID NO: 2411686 - DNA, 21 bp, Homo sapiens
actatagtccagctttgttct

SEQ ID NO: 2411687 - DNA, 22 bp, Homo sapiens
actatgaagttttttttataca

SEQ ID NO: 2411688 - DNA, 18 bp, Homo sapiens
actattatccccatttct

SEQ ID NO: 2411689 - DNA, 22 bp, Homo sapiens
actattcttgatgtaaaatctt

SEQ ID NO: 2411690 - DNA, 17 bp, Homo sapiens
actattgcttgcacaaa

SEQ ID NO: 2411691 - DNA, 13 bp, Homo sapiens
actatttaactga

SEQ ID NO: 2411692 - DNA, 13 bp, Homo sapiens
actcatctttccc

SEQ ID NO: 2411693 - DNA, 12 bp, Homo sapiens
actcccctcctt

SEQ ID NO: 2411694 - DNA, 16 bp, Homo sapiens
actcctaggaaaatac

SEQ ID NO: 2411695 - DNA, 21 bp, Homo sapiens
actctcttattgcctcacttc

SEQ ID NO: 2411696 - DNA, 15 bp, Homo sapiens
actctgttcattcct

SEQ ID NO: 2411697 - DNA, 19 bp, Homo sapiens
actctgttcattcctccag

SEQ ID NO: 2411698 - DNA, 13 bp, Homo sapiens
actcttgaaaaat

SEQ ID NO: 2411699 - DNA, 14 bp, Homo sapiens
actcttgaaaaatg

SEQ ID NO: 2411700 - DNA, 13 bp, Homo sapiens
actgacacacacg

SEQ ID NO: 2411701 - DNA, 23 bp, Homo sapiens
actgactattcttgatgtaaaat

SEQ ID NO: 2411702 - DNA, 24 bp, Homo sapiens
actgactattcttgatgtaaaatc

SEQ ID NO: 2411703 - DNA, 12 bp, Homo sapiens
actgagaaattt

SEQ ID NO: 2411704 - DNA, 17 bp, Homo sapiens
actgagaaatttataaa

SEQ ID NO: 2411705 - DNA, 21 bp, Homo sapiens
actgagaaatttataaacttt

SEQ ID NO: 2411706 - DNA, 13 bp, Homo sapiens
actgatgttgtgt

SEQ ID NO: 2411707 - DNA, 17 bp, Homo sapiens
actgatgttgtgttttt

SEQ ID NO: 2411708 - DNA, 12 bp, Homo sapiens
actgcatgcact

SEQ ID NO: 2411709 - DNA, 14 bp, Homo sapiens
actgcatgcacttc

SEQ ID NO: 2411710 - DNA, 15 bp, Homo sapiens
actgccaagccatgg

SEQ ID NO: 2411711 - DNA, 15 bp, Homo sapiens
actgcctattttaat

SEQ ID NO: 2411712 - DNA, 16 bp, Homo sapiens
actgcctttggcagag

SEQ ID NO: 2411713 - DNA, 15 bp, Homo sapiens
actggaccctgttgc

SEQ ID NO: 2411714 - DNA, 11 bp, Homo sapiens
actggagcccc

SEQ ID NO: 2411715 - DNA, 14 bp, Homo sapiens
actggcacagaggt

SEQ ID NO: 2411716 - DNA, 16 bp, Homo sapiens
actgggagaaatgaaa

SEQ ID NO: 2411717 - DNA, 16 bp, Homo sapiens
actgtaaaatgtggga

SEQ ID NO: 2411718 - DNA, 22 bp, Homo sapiens
actgtaaaatgtgggattatgg

SEQ ID NO: 2411719 - DNA, 23 bp, Homo sapiens
actgtacttgctcttgatgcctg

SEQ ID NO: 2411720 - DNA, 18 bp, Homo sapiens
actgttggggtgggtata

SEQ ID NO: 2411721 - DNA, 14 bp, Homo sapiens
acttacatgattca

SEQ ID NO: 2411722 - DNA, 17 bp, Homo sapiens
acttacatgattcattt

SEQ ID NO: 2411723 - DNA, 19 bp, Homo sapiens
acttacatgattcatttta

SEQ ID NO: 2411724 - DNA, 14 bp, Homo sapiens
acttgccaaattta

SEQ ID NO: 2411725 - DNA, 13 bp, Homo sapiens
acttgcctctgca

SEQ ID NO: 2411726 - DNA, 14 bp, Homo sapiens
acttgctcttgatg

SEQ ID NO: 2411727 - DNA, 16 bp, Homo sapiens
acttgctcttgatgcc

SEQ ID NO: 2411728 - DNA, 18 bp, Homo sapiens
acttgctcttgatgcctg

SEQ ID NO: 2411729 - DNA, 20 bp, Homo sapiens
acttgctcttgatgcctggc

SEQ ID NO: 2411730 - DNA, 19 bp, Homo sapiens
acttgtaaaggaatttaaa

SEQ ID NO: 2411731 - DNA, 13 bp, Homo sapiens
acttgtattatgt

SEQ ID NO: 2411732 - DNA, 23 bp, Homo sapiens
acttgtcattgttatataatcat

SEQ ID NO: 2411733 - DNA, 18 bp, Homo sapiens
acttgtggactaaaagat

SEQ ID NO: 2411734 - DNA, 20 bp, Homo sapiens
acttgtggactaaaagatat

SEQ ID NO: 2411735 - DNA, 20 bp, Homo sapiens
actttacacaatagaattat

SEQ ID NO: 2411736 - DNA, 13 bp, Homo sapiens
actttagggaagt

SEQ ID NO: 2411737 - DNA, 14 bp, Homo sapiens
catattgcacatgt

SEQ ID NO: 2411738 - DNA, 18 bp, Homo sapiens
catattgcacatgtctta

SEQ ID NO: 2411739 - DNA, 20 bp, Homo sapiens
catattgcacatgtcttaat

SEQ ID NO: 2411740 - DNA, 22 bp, Homo sapiens
catattgcacatgtcttaatga

SEQ ID NO: 2411741 - DNA, 14 bp, Homo sapiens
catattgtgtgtaa

SEQ ID NO: 2411742 - DNA, 13 bp, Homo sapiens
caactctcttatt

SEQ ID NO: 2411743 - DNA, 12 bp, Homo sapiens
caactttgtata

SEQ ID NO: 2411744 - DNA, 18 bp, Homo sapiens
caagaaaataagagctca

SEQ ID NO: 2411745 - DNA, 13 bp, Homo sapiens
caagagccacagt

SEQ ID NO: 2411746 - DNA, 20 bp, Homo sapiens
caagattgtgtcccattccc

SEQ ID NO: 2411747 - DNA, 12 bp, Homo sapiens
caagatttcaga

SEQ ID NO: 2411748 - DNA, 19 bp, Homo sapiens
caagcaaatgtgaatcatt

SEQ ID NO: 2411749 - DNA, 14 bp, Homo sapiens
caagcaatcctccc

SEQ ID NO: 2411750 - DNA, 17 bp, Homo sapiens
caagcactaaacaaaga

SEQ ID NO: 2411751 - DNA, 21 bp, Homo sapiens
caagccatgggtagcctgggt

SEQ ID NO: 2411752 - DNA, 21 bp, Homo sapiens
caagcgattctcttgcctcaa

SEQ ID NO: 2411753 - DNA, 16 bp, Homo sapiens
agatatttttcatgat

SEQ ID NO: 2411754 - DNA, 21 bp, Homo sapiens
agatcaccagtgtgtggcttt

SEQ ID NO: 2411755 - DNA, 12 bp, Homo sapiens
agatcattgtga

SEQ ID NO: 2411756 - DNA, 10 bp, Homo sapiens
agatcccaaa

SEQ ID NO: 2411757 - DNA, 13 bp, Homo sapiens
agatcctcctcat

SEQ ID NO: 2411758 - DNA, 15 bp, Homo sapiens
agatcctcctcattc

SEQ ID NO: 2411759 - DNA, 22 bp, Homo sapiens
agatgtagcccctctcctggaa

SEQ ID NO: 2411760 - DNA, 18 bp, Homo sapiens
agatgtgttcacaatgga

SEQ ID NO: 2411761 - DNA, 15 bp, Homo sapiens
agatgttcacccaac

SEQ ID NO: 2411762 - DNA, 15 bp, Homo sapiens
agatgttctctatca

SEQ ID NO: 2411763 - DNA, 19 bp, Homo sapiens
agatgttctctatcattta

SEQ ID NO: 2411764 - DNA, 17 bp, Homo sapiens
agattctcccttgctct

SEQ ID NO: 2411765 - DNA, 15 bp, Homo sapiens
agattgagagaattt

SEQ ID NO: 2411766 - DNA, 17 bp, Homo sapiens
agattgagatgtgttca

SEQ ID NO: 2411767 - DNA, 14 bp, Homo sapiens
agatttatgcatat

SEQ ID NO: 2411768 - DNA, 16 bp, Homo sapiens
agatttccttcttttt

SEQ ID NO: 2411769 - DNA, 14 bp, Homo sapiens
agcaagatttcaga

SEQ ID NO: 2411770 - DNA, 19 bp, Homo sapiens
agcaatcctaggtagggtt

SEQ ID NO: 2411771 - DNA, 15 bp, Homo sapiens
agcaatcctcccact

SEQ ID NO: 2411772 - DNA, 17 bp, Homo sapiens
agcacgtggtaaaacac

SEQ ID NO: 2411773 - DNA, 20 bp, Homo sapiens
agcactttagaatatgcctt

SEQ ID NO: 2411774 - DNA, 20 bp, Homo sapiens
agcagttgagacaagaaaat

SEQ ID NO: 2411775 - DNA, 22 bp, Homo sapiens
agcagtttggtttctagcatga

SEQ ID NO: 2411776 - DNA, 21 bp, Homo sapiens
agcataatacttgctttggaa

SEQ ID NO: 2411777 - DNA, 13 bp, Homo sapiens
agcatatctgcct

SEQ ID NO: 2411778 - DNA, 20 bp, Homo sapiens
agcatatctgcctttattgt

SEQ ID NO: 2411779 - DNA, 16 bp, Homo sapiens
agcatcaggcctagag

SEQ ID NO: 2411780 - DNA, 17 bp, Homo sapiens
agcatgtcgtcaaagct

SEQ ID NO: 2411781 - DNA, 20 bp, Homo sapiens
agcatgtcgtcaaagctgaa

SEQ ID NO: 2411782 - DNA, 11 bp, Homo sapiens
agcatttgaat

SEQ ID NO: 2411783 - DNA, 17 bp, Homo sapiens
agcatttgaatgcattt

SEQ ID NO: 2411784 - DNA, 19 bp, Homo sapiens
agccacggggactcagccc

SEQ ID NO: 2411785 - DNA, 19 bp, Homo sapiens
agccagctgcccccagagc

SEQ ID NO: 2411786 - DNA, 19 bp, Homo sapiens
agcccaggatactggcaca

SEQ ID NO: 2411787 - DNA, 21 bp, Homo sapiens
agcccaggatactggcacaga

SEQ ID NO: 2411788 - DNA, 16 bp, Homo sapiens
agcccctgggcccagt

SEQ ID NO: 2411789 - DNA, 24 bp, Homo sapiens
agccctccgccattctcaagccct

SEQ ID NO: 2411790 - DNA, 14 bp, Homo sapiens
agcctacaggcctc

SEQ ID NO: 2411791 - DNA, 17 bp, Homo sapiens
agcctgagtagaaaggc

SEQ ID NO: 2411792 - DNA, 22 bp, Homo sapiens
agcctgcattgagcttgcatgc

SEQ ID NO: 2411793 - DNA, 23 bp, Homo sapiens
agcctgcattgagcttgcatgct

SEQ ID NO: 2411794 - DNA, 18 bp, Homo sapiens
agcctggcttcaaattgt

SEQ ID NO: 2411795 - DNA, 12 bp, Homo sapiens
agccttctctgt

SEQ ID NO: 2411796 - DNA, 23 bp, Homo sapiens
agccttctctgttcatttcctca

SEQ ID NO: 2411797 - DNA, 12 bp, Homo sapiens
agctacaaatgc

SEQ ID NO: 2411798 - DNA, 13 bp, Homo sapiens
agctacaaatgca

SEQ ID NO: 2411799 - DNA, 22 bp, Homo sapiens
agctacctgctcagccctgcac

SEQ ID NO: 2411800 - DNA, 18 bp, Homo sapiens
agctataaaatgaataca

SEQ ID NO: 2411801 - DNA, 23 bp, Homo sapiens
agctcaactctcttattgcctca

SEQ ID NO: 2411802 - DNA, 22 bp, Homo sapiens
agctccttgagggcaagagcca

SEQ ID NO: 2411803 - DNA, 12 bp, Homo sapiens
agctctgcatta

SEQ ID NO: 2411804 - DNA, 16 bp, Homo sapiens
agctcttcatgtttca

SEQ ID NO: 2411805 - DNA, 14 bp, Homo sapiens
agctgcccccagag

SEQ ID NO: 2411806 - DNA, 20 bp, Homo sapiens
agctgcccccagagccacag

SEQ ID NO: 2411807 - DNA, 15 bp, Homo sapiens
agctggacctcacca

SEQ ID NO: 2411808 - DNA, 14 bp, Homo sapiens
agctggctctgtga

SEQ ID NO: 2411809 - DNA, 16 bp, Homo sapiens
agctgggcagaaggcc

SEQ ID NO: 2411810 - DNA, 17 bp, Homo sapiens
agctgtgacctctcccc

SEQ ID NO: 2411811 - DNA, 20 bp, Homo sapiens
agcttatttcctcattttta

SEQ ID NO: 2411812 - DNA, 15 bp, Homo sapiens
agcttcagccaggag

SEQ ID NO: 2411813 - DNA, 20 bp, Homo sapiens
agcttcagccaggagctggg

SEQ ID NO: 2411814 - DNA, 18 bp, Homo sapiens
agctttgttcttcttaaa

SEQ ID NO: 2411815 - DNA, 18 bp, Homo sapiens
aggaaaaaataacaatga

SEQ ID NO: 2411816 - DNA, 22 bp, Homo sapiens
aggaaagtcattggctttatcc

SEQ ID NO: 2411817 - DNA, 14 bp, Homo sapiens
aggaacaaacaggg

SEQ ID NO: 2411818 - DNA, 23 bp, Homo sapiens
aggaattgtgtttataattttaa

SEQ ID NO: 2411819 - DNA, 11 bp, Homo sapiens
aggaatttaaa

SEQ ID NO: 2411820 - DNA, 16 bp, Homo sapiens
aggacacagttcctgg

SEQ ID NO: 2411821 - DNA, 20 bp, Homo sapiens
aggacccttcccttgagccc

SEQ ID NO: 2411822 - DNA, 18 bp, Homo sapiens
aggagccctgggaggctc

SEQ ID NO: 2411823 - DNA, 23 bp, Homo sapiens
aggagccctgggaggctctggag

SEQ ID NO: 2411824 - DNA, 18 bp, Homo sapiens
aggaggtccttaggcctc

SEQ ID NO: 2411825 - DNA, 23 bp, Homo sapiens
aggaggtccttaggcctctgaga

SEQ ID NO: 2411826 - DNA, 24 bp, Homo sapiens
aggatggtggcaggaaaatggaca

SEQ ID NO: 2411827 - DNA, 20 bp, Homo sapiens
aggatgtggaaacctccttc

SEQ ID NO: 2411828 - DNA, 21 bp, Homo sapiens
aggatgtgtcccatctaggga

SEQ ID NO: 2411829 - DNA, 13 bp, Homo sapiens
aggcaatcatggt

SEQ ID NO: 2411830 - DNA, 22 bp, Homo sapiens
aggcagaactcatctaggtaaa

SEQ ID NO: 2411831 - DNA, 20 bp, Homo sapiens
aggcagctttttctctccca

SEQ ID NO: 2411832 - DNA, 19 bp, Homo sapiens
aggcaggaacaaacagggc

SEQ ID NO: 2411833 - DNA, 22 bp, Homo sapiens
aggccaacccaaaataagcagg

SEQ ID NO: 2411834 - DNA, 19 bp, Homo sapiens
aggcccgcatgcggcccag

SEQ ID NO: 2411835 - DNA, 18 bp, Homo sapiens
aggcctgactgccaagcc

SEQ ID NO: 2411836 - DNA, 19 bp, Homo sapiens
aggccttgcggctcctcag

SEQ ID NO: 2411837 - DNA, 22 bp, Homo sapiens
aggccttgcggctcctcaggga

SEQ ID NO: 2411838 - DNA, 18 bp, Homo sapiens
aggcctttccctaagcca

SEQ ID NO: 2411839 - DNA, 17 bp, Homo sapiens
aggcgtgagccacctcg

SEQ ID NO: 2411840 - DNA, 18 bp, Homo sapiens
aggctaaagcccagagac

SEQ ID NO: 2411841 - DNA, 21 bp, Homo sapiens
aggctaaagcccagagacagc

SEQ ID NO: 2411842 - DNA, 13 bp, Homo sapiens
aggctctggagcc

SEQ ID NO: 2411843 - DNA, 14 bp, Homo sapiens
aggctctggagccc

SEQ ID NO: 2411844 - DNA, 19 bp, Homo sapiens
aggctctggagcccactgt

SEQ ID NO: 2411845 - DNA, 21 bp, Homo sapiens
aggctggcctatgtggtctaa

SEQ ID NO: 2411846 - DNA, 22 bp, Homo sapiens
aggctggtctcaaactcctgac

SEQ ID NO: 2411847 - DNA, 14 bp, Homo sapiens
aggcttccttcatt

SEQ ID NO: 2411848 - DNA, 16 bp, Homo sapiens
aggcttccttcatttc

SEQ ID NO: 2411849 - DNA, 13 bp, Homo sapiens
aggctttgccctg

SEQ ID NO: 2411850 - DNA, 15 bp, Homo sapiens
aggcttttttatcat

SEQ ID NO: 2411851 - DNA, 19 bp, Homo sapiens
agggaagagacagcccagg

SEQ ID NO: 2411852 - DNA, 19 bp, Homo sapiens
agggactcatctttccctc

SEQ ID NO: 2411853 - DNA, 23 bp, Homo sapiens
agggactcatctttccctccttg

SEQ ID NO: 2411854 - DNA, 13 bp, Homo sapiens
agggactgagaaa

SEQ ID NO: 2411855 - DNA, 19 bp, Homo sapiens
agggagcaagtccttccct

SEQ ID NO: 2411856 - DNA, 22 bp, Homo sapiens
agggcaattaattccttcagca

SEQ ID NO: 2411857 - DNA, 19 bp, Homo sapiens
agggcgtggaaaggggcag

SEQ ID NO: 2411858 - DNA, 14 bp, Homo sapiens
aggggctggggact

SEQ ID NO: 2411859 - DNA, 22 bp, Homo sapiens
agggtcatatcactcaggccct

SEQ ID NO: 2411860 - DNA, 15 bp, Homo sapiens
agggtttcaccatgt

SEQ ID NO: 2411861 - DNA, 15 bp, Homo sapiens
agggtttcattgtct

SEQ ID NO: 2411862 - DNA, 12 bp, Homo sapiens
aggtagggttta

SEQ ID NO: 2411863 - DNA, 15 bp, Homo sapiens
aggtagtctcactgc

SEQ ID NO: 2411864 - DNA, 23 bp, Homo sapiens
aggtataattcacattgtattca

SEQ ID NO: 2411865 - DNA, 13 bp, Homo sapiens
aggtatacctcac

SEQ ID NO: 2411866 - DNA, 20 bp, Homo sapiens
aggtattcgttatctaatag

SEQ ID NO: 2411867 - DNA, 15 bp, Homo sapiens
aggtcagtgcaaata

SEQ ID NO: 2411868 - DNA, 13 bp, Homo sapiens
aggtccctaataa

SEQ ID NO: 2411869 - DNA, 20 bp, Homo sapiens
aggtccctaataaagctgtg

SEQ ID NO: 2411870 - DNA, 14 bp, Homo sapiens
aggtggccctactg

SEQ ID NO: 2411871 - DNA, 11 bp, Homo sapiens
aggtgggagga

SEQ ID NO: 2411872 - DNA, 13 bp, Homo sapiens
aggtgggaggatg

SEQ ID NO: 2411873 - DNA, 15 bp, Homo sapiens
aggtgtcatacagat

SEQ ID NO: 2411874 - DNA, 19 bp, Homo sapiens
aggttcaagcaatcctccc

SEQ ID NO: 2411875 - DNA, 21 bp, Homo sapiens
aggtttctgagttcctgcatg

SEQ ID NO: 2411876 - DNA, 16 bp, Homo sapiens
agtaaaaacaaagaaa

SEQ ID NO: 2411877 - DNA, 13 bp, Homo sapiens
agtaaaatccaca

SEQ ID NO: 2411878 - DNA, 19 bp, Homo sapiens
agtaaaattgccatattgc

SEQ ID NO: 2411879 - DNA, 13 bp, Homo sapiens
accttccttttac

SEQ ID NO: 2411880 - DNA, 19 bp, Homo sapiens
accttgctttgatggaata

SEQ ID NO: 2411881 - DNA, 17 bp, Homo sapiens
acctttgacaaaggtaa

SEQ ID NO: 2411882 - DNA, 12 bp, Homo sapiens
acgccacagccc

SEQ ID NO: 2411883 - DNA, 22 bp, Homo sapiens
acgccacagcccttttgtctct

SEQ ID NO: 2411884 - DNA, 22 bp, Homo sapiens
acgtataaaagcctgtttaaga

SEQ ID NO: 2411885 - DNA, 16 bp, Homo sapiens
acgtgcacgcacactg

SEQ ID NO: 2411886 - DNA, 19 bp, Homo sapiens
actaaaagatataagtgct

SEQ ID NO: 2411887 - DNA, 22 bp, Homo sapiens
actaaagttagaaagttgattt

SEQ ID NO: 2411888 - DNA, 18 bp, Homo sapiens
actaacaaccaaagacta

SEQ ID NO: 2411889 - DNA, 16 bp, Homo sapiens
actagagcaagcagga

SEQ ID NO: 2411890 - DNA, 19 bp, Homo sapiens
actagcatatctgccttta

SEQ ID NO: 2411891 - DNA, 14 bp, Homo sapiens
actaggctgagcaa

SEQ ID NO: 2411892 - DNA, 20 bp, Homo sapiens
actattcttgatgtaaaatc

SEQ ID NO: 2411893 - DNA, 23 bp, Homo sapiens
actattcttgatgtaaaatcttg

SEQ ID NO: 2411894 - DNA, 14 bp, Homo sapiens
actatttaactgac

SEQ ID NO: 2411895 - DNA, 15 bp, Homo sapiens
actatttaactgact

SEQ ID NO: 2411896 - DNA, 14 bp, Homo sapiens
actatttttcagaa

SEQ ID NO: 2411897 - DNA, 18 bp, Homo sapiens
actatttttcagaatctc

SEQ ID NO: 2411898 - DNA, 20 bp, Homo sapiens
actcactaattcattaatct

SEQ ID NO: 2411899 - DNA, 16 bp, Homo sapiens
actcagatcctcctca

SEQ ID NO: 2411900 - DNA, 21 bp, Homo sapiens
actcatctaggtaaattacag

SEQ ID NO: 2411901 - DNA, 23 bp, Homo sapiens
actcatctaggtaaattacagtt

SEQ ID NO: 2411902 - DNA, 20 bp, Homo sapiens
actcatctttccctccttgg

SEQ ID NO: 2411903 - DNA, 21 bp, Homo sapiens
actcatctttccctccttggt

SEQ ID NO: 2411904 - DNA, 17 bp, Homo sapiens
actcatgcattgtcctc

SEQ ID NO: 2411905 - DNA, 20 bp, Homo sapiens
actccatgttggctagcctc

SEQ ID NO: 2411906 - DNA, 15 bp, Homo sapiens
actcctgacctcagg

SEQ ID NO: 2411907 - DNA, 16 bp, Homo sapiens
actcctgacctcaggc

SEQ ID NO: 2411908 - DNA, 17 bp, Homo sapiens
actcctgacctcaggca

SEQ ID NO: 2411909 - DNA, 23 bp, Homo sapiens
actccttgattttagccttctct

SEQ ID NO: 2411910 - DNA, 15 bp, Homo sapiens
actctaagaaagaac

SEQ ID NO: 2411911 - DNA, 22 bp, Homo sapiens
actctctggaagcccctgggcc

SEQ ID NO: 2411912 - DNA, 18 bp, Homo sapiens
actctgttcattcctcca

SEQ ID NO: 2411913 - DNA, 20 bp, Homo sapiens
actctgttcattcctccagg

SEQ ID NO: 2411914 - DNA, 21 bp, Homo sapiens
actctgttcattcctccaggt

SEQ ID NO: 2411915 - DNA, 23 bp, Homo sapiens
actcttctgagcacctacttaca

SEQ ID NO: 2411916 - DNA, 21 bp, Homo sapiens
actcttgaaaaatgcatgttg

SEQ ID NO: 2411917 - DNA, 14 bp, Homo sapiens
actgaggatcagag

SEQ ID NO: 2411918 - DNA, 17 bp, Homo sapiens
actgcaacctccacctc

SEQ ID NO: 2411919 - DNA, 20 bp, Homo sapiens
actgcaacctccacctcgca

SEQ ID NO: 2411920 - DNA, 16 bp, Homo sapiens
actgcaacctctgcct

SEQ ID NO: 2411921 - DNA, 15 bp, Homo sapiens
actgcctaagccctc

SEQ ID NO: 2411922 - DNA, 16 bp, Homo sapiens
actgcctattttaata

SEQ ID NO: 2411923 - DNA, 19 bp, Homo sapiens
actggaccctgttgctaag

SEQ ID NO: 2411924 - DNA, 20 bp, Homo sapiens
actggaccctgttgctaagc

SEQ ID NO: 2411925 - DNA, 14 bp, Homo sapiens
actggatgaaaatg

SEQ ID NO: 2411926 - DNA, 12 bp, Homo sapiens
actggcacagag

SEQ ID NO: 2411927 - DNA, 15 bp, Homo sapiens
actggcttcagcaag

SEQ ID NO: 2411928 - DNA, 18 bp, Homo sapiens
actggtaggaaactaggt

SEQ ID NO: 2411929 - DNA, 17 bp, Homo sapiens
actgtctctcatgaacc

SEQ ID NO: 2411930 - DNA, 16 bp, Homo sapiens
actgtcttttttctaa

SEQ ID NO: 2411931 - DNA, 22 bp, Homo sapiens
actgtcttttttctaaagtaaa

SEQ ID NO: 2411932 - DNA, 12 bp, Homo sapiens
actgtgtgctca

SEQ ID NO: 2411933 - DNA, 20 bp, Homo sapiens
actgtgtgctcaggagccct

SEQ ID NO: 2411934 - DNA, 12 bp, Homo sapiens
acttacatgatt

SEQ ID NO: 2411935 - DNA, 16 bp, Homo sapiens
acttattatcttcagg

SEQ ID NO: 2411936 - DNA, 16 bp, Homo sapiens
acttcaaactgagatc

SEQ ID NO: 2411937 - DNA, 18 bp, Homo sapiens
acttcaggtatacctcac

SEQ ID NO: 2411938 - DNA, 14 bp, Homo sapiens
acttgaaaattaac

SEQ ID NO: 2411939 - DNA, 17 bp, Homo sapiens
acttgaaaattaacatg

SEQ ID NO: 2411940 - DNA, 19 bp, Homo sapiens
acttgccaaatttagattt

SEQ ID NO: 2411941 - DNA, 14 bp, Homo sapiens
acttgcttttaaaa

SEQ ID NO: 2411942 - DNA, 18 bp, Homo sapiens
acttgtaaaggaatttaa

SEQ ID NO: 2411943 - DNA, 20 bp, Homo sapiens
acttgtaaaggaatttaaaa

SEQ ID NO: 2411944 - DNA, 16 bp, Homo sapiens
acttgttttggatgcc

SEQ ID NO: 2411945 - DNA, 22 bp, Homo sapiens
actttattttctataatttaaa

SEQ ID NO: 2411946 - DNA, 15 bp, Homo sapiens
actttctagattaag

SEQ ID NO: 2411947 - DNA, 16 bp, Homo sapiens
acttttatgatacttg

SEQ ID NO: 2411948 - DNA, 19 bp, Homo sapiens
agaaaacttgtattatgtg

SEQ ID NO: 2411949 - DNA, 21 bp, Homo sapiens
agaaaagctataaaatgaata

SEQ ID NO: 2411950 - DNA, 14 bp, Homo sapiens
agaaaagctttgaa

SEQ ID NO: 2411951 - DNA, 14 bp, Homo sapiens
agaaaataacaata

SEQ ID NO: 2411952 - DNA, 14 bp, Homo sapiens
agaaagcatttgaa

SEQ ID NO: 2411953 - DNA, 17 bp, Homo sapiens
agaaagcatttgaatgc

SEQ ID NO: 2411954 - DNA, 18 bp, Homo sapiens
agaaagcatttgaatgca

SEQ ID NO: 2411955 - DNA, 20 bp, Homo sapiens
agaaagcccttaggaagaat

SEQ ID NO: 2411956 - DNA, 22 bp, Homo sapiens
agaaagcccttaggaagaattt

SEQ ID NO: 2411957 - DNA, 13 bp, Homo sapiens
agaaatatcttca

SEQ ID NO: 2411958 - DNA, 12 bp, Homo sapiens
agaaatctaaaa

SEQ ID NO: 2411959 - DNA, 12 bp, Homo sapiens
agaaatgaaaaa

SEQ ID NO: 2411960 - DNA, 13 bp, Homo sapiens
agaaatgaaaaaa

SEQ ID NO: 2411961 - DNA, 16 bp, Homo sapiens
agaaatgaaaaaatat

SEQ ID NO: 2411962 - DNA, 23 bp, Homo sapiens
agaaatgaaaaaatatatatcaa

SEQ ID NO: 2411963 - DNA, 16 bp, Homo sapiens
agaaatggttgtatta

SEQ ID NO: 2411964 - DNA, 21 bp, Homo sapiens
agaaatggttgtattagatgt

SEQ ID NO: 2411965 - DNA, 23 bp, Homo sapiens
agaaatggttgtattagatgttc

SEQ ID NO: 2411966 - DNA, 21 bp, Homo sapiens
agaaattatgtgccagattta

SEQ ID NO: 2411967 - DNA, 15 bp, Homo sapiens
agaaatttatttcct

SEQ ID NO: 2411968 - DNA, 17 bp, Homo sapiens
agaacatccctcctggg

SEQ ID NO: 2411969 - DNA, 16 bp, Homo sapiens
agaactctctggaagc

SEQ ID NO: 2411970 - DNA, 21 bp, Homo sapiens
agaactctctggaagcccctg

SEQ ID NO: 2411971 - DNA, 17 bp, Homo sapiens
agaagccaaaagattgg

SEQ ID NO: 2411972 - DNA, 13 bp, Homo sapiens
agaaggccaagag

SEQ ID NO: 2411973 - DNA, 17 bp, Homo sapiens
agaaggccaagaggctg

SEQ ID NO: 2411974 - DNA, 13 bp, Homo sapiens
agaattattttgt

SEQ ID NO: 2411975 - DNA, 15 bp, Homo sapiens
agaattattttgtga

SEQ ID NO: 2411976 - DNA, 23 bp, Homo sapiens
agacaacaggtaaaacagggcca

SEQ ID NO: 2411977 - DNA, 19 bp, Homo sapiens
agacaaggaaaaaataaca

SEQ ID NO: 2411978 - DNA, 12 bp, Homo sapiens
agacagaaaaaa

SEQ ID NO: 2411979 - DNA, 19 bp, Homo sapiens
agacagagtcttactctgt

SEQ ID NO: 2411980 - DNA, 22 bp, Homo sapiens
agacagccaactatggcctgtg

SEQ ID NO: 2411981 - DNA, 22 bp, Homo sapiens
agacagcttctcatcctgcagg

SEQ ID NO: 2411982 - DNA, 19 bp, Homo sapiens
agacctaacgagaaataga

SEQ ID NO: 2411983 - DNA, 13 bp, Homo sapiens
agacctgaagaat

SEQ ID NO: 2411984 - DNA, 17 bp, Homo sapiens
agactctaagaaagaac

SEQ ID NO: 2411985 - DNA, 16 bp, Homo sapiens
agactggatagtccgt

SEQ ID NO: 2411986 - DNA, 20 bp, Homo sapiens
agactggatagtccgtctct

SEQ ID NO: 2411987 - DNA, 11 bp, Homo sapiens
agactgttggg

SEQ ID NO: 2411988 - DNA, 23 bp, Homo sapiens
agactgttggggtgggtataaaa

SEQ ID NO: 2411989 - DNA, 16 bp, Homo sapiens
agactttatgtagttt

SEQ ID NO: 2411990 - DNA, 17 bp, Homo sapiens
agactttatgtagtttt

SEQ ID NO: 2411991 - DNA, 18 bp, Homo sapiens
agagacagcccaggatac

SEQ ID NO: 2411992 - DNA, 16 bp, Homo sapiens
agagacttgttttgga

SEQ ID NO: 2411993 - DNA, 13 bp, Homo sapiens
agagagtggctgg

SEQ ID NO: 2411994 - DNA, 13 bp, Homo sapiens
agagatttttcat

SEQ ID NO: 2411995 - DNA, 18 bp, Homo sapiens
agagccctgaggcctaga

SEQ ID NO: 2411996 - DNA, 22 bp, Homo sapiens
agagccctgaggcctagactct

SEQ ID NO: 2411997 - DNA, 10 bp, Homo sapiens
agagctcagg

SEQ ID NO: 2411998 - DNA, 12 bp, Homo sapiens
agagggaatgtg

SEQ ID NO: 2411999 - DNA, 20 bp, Homo sapiens
agagtaatccaagcaaatgt

SEQ ID NO: 2412000 - DNA, 14 bp, Homo sapiens
agagtgaagggaag

SEQ ID NO: 2412001 - DNA, 22 bp, Homo sapiens
agagtgaagggaagagacagcc

SEQ ID NO: 2412002 - DNA, 13 bp, Homo sapiens
agagtggctgggg

SEQ ID NO: 2412003 - DNA, 12 bp, Homo sapiens
agagttagactg

SEQ ID NO: 2412004 - DNA, 15 bp, Homo sapiens
agagttagactgttg

SEQ ID NO: 2412005 - DNA, 17 bp, Homo sapiens
agagttttggatgcagt

SEQ ID NO: 2412006 - DNA, 19 bp, Homo sapiens
agagttttggatgcagtgc

SEQ ID NO: 2412007 - DNA, 20 bp, Homo sapiens
agagttttggatgcagtgct

SEQ ID NO: 2412008 - DNA, 19 bp, Homo sapiens
agataatgtgatattatac

SEQ ID NO: 2412009 - DNA, 21 bp, Homo sapiens
agatataagtgctgtataaaa

SEQ ID NO: 2412010 - DNA, 22 bp, Homo sapiens
agatataagtgctgtataaaat

SEQ ID NO: 2412011 - DNA, 23 bp, Homo sapiens
agatataagtgctgtataaaatc

SEQ ID NO: 2412012 - DNA, 16 bp, Homo sapiens
tcctaattttgagaaa

SEQ ID NO: 2412013 - DNA, 18 bp, Homo sapiens
tcctaggtagggtttaat

SEQ ID NO: 2412014 - DNA, 17 bp, Homo sapiens
tcctcatgaatgtaaat

SEQ ID NO: 2412015 - DNA, 17 bp, Homo sapiens
tcctccgtcacctcaga

SEQ ID NO: 2412016 - DNA, 21 bp, Homo sapiens
tcctctttagagttagactgt

SEQ ID NO: 2412017 - DNA, 17 bp, Homo sapiens
tcctgcaggcaggaaca

SEQ ID NO: 2412018 - DNA, 19 bp, Homo sapiens
tcctgtcggagccctgtct

SEQ ID NO: 2412019 - DNA, 11 bp, Homo sapiens
tccttcatttc

SEQ ID NO: 2412020 - DNA, 16 bp, Homo sapiens
tccttgttgtgatttt

SEQ ID NO: 2412021 - DNA, 13 bp, Homo sapiens
tcctttctggctt

SEQ ID NO: 2412022 - DNA, 19 bp, Homo sapiens
tcgcccatgctggagtgca

SEQ ID NO: 2412023 - DNA, 18 bp, Homo sapiens
tcgctccaccttgcagct

SEQ ID NO: 2412024 - DNA, 12 bp, Homo sapiens
tcgctgttgctg

SEQ ID NO: 2412025 - DNA, 15 bp, Homo sapiens
tcgtcttcttggcca

SEQ ID NO: 2412026 - DNA, 16 bp, Homo sapiens
tcgtgagctcttgtga

SEQ ID NO: 2412027 - DNA, 22 bp, Homo sapiens
tcgtgagctcttgtgaggaaag

SEQ ID NO: 2412028 - DNA, 14 bp, Homo sapiens
tcgttatctaatag

SEQ ID NO: 2412029 - DNA, 22 bp, Homo sapiens
tcgttttcaaaattgttacaaa

SEQ ID NO: 2412030 - DNA, 18 bp, Homo sapiens
tctaagtgtttcataaat

SEQ ID NO: 2412031 - DNA, 16 bp, Homo sapiens
tctaatagggcaatta

SEQ ID NO: 2412032 - DNA, 21 bp, Homo sapiens
tctagaggcttccttcatttc

SEQ ID NO: 2412033 - DNA, 17 bp, Homo sapiens
tctatcatttaataata

SEQ ID NO: 2412034 - DNA, 23 bp, Homo sapiens
tctatgaactctgttttctttct

SEQ ID NO: 2412035 - DNA, 19 bp, Homo sapiens
tctattgcctctgagagca

SEQ ID NO: 2412036 - DNA, 22 bp, Homo sapiens
tctattgcctctgagagcatca

SEQ ID NO: 2412037 - DNA, 16 bp, Homo sapiens
tctcaaactcctgacc

SEQ ID NO: 2412038 - DNA, 21 bp, Homo sapiens
tctcacagtgggagccagggc

SEQ ID NO: 2412039 - DNA, 19 bp, Homo sapiens
tctcacatgattccagcca

SEQ ID NO: 2412040 - DNA, 16 bp, Homo sapiens
tctcaccatttggatc

SEQ ID NO: 2412041 - DNA, 15 bp, Homo sapiens
tctcagtctgtcacc

SEQ ID NO: 2412042 - DNA, 15 bp, Homo sapiens
tctcatcctgcaggc

SEQ ID NO: 2412043 - DNA, 14 bp, Homo sapiens
tctcatgaacctca

SEQ ID NO: 2412044 - DNA, 14 bp, Homo sapiens
tctcccctgcactg

SEQ ID NO: 2412045 - DNA, 15 bp, Homo sapiens
tctcctctctctgta

SEQ ID NO: 2412046 - DNA, 21 bp, Homo sapiens
tctcctggaagtgctaatttt

SEQ ID NO: 2412047 - DNA, 16 bp, Homo sapiens
tctccttgttctgata

SEQ ID NO: 2412048 - DNA, 18 bp, Homo sapiens
tctctaatatgtaaaatt

SEQ ID NO: 2412049 - DNA, 17 bp, Homo sapiens
tctctatcatttaataa

SEQ ID NO: 2412050 - DNA, 20 bp, Homo sapiens
tctctatcatttaataatat

SEQ ID NO: 2412051 - DNA, 12 bp, Homo sapiens
tctctcatgaac

SEQ ID NO: 2412052 - DNA, 15 bp, Homo sapiens
tctctcatgaacctc

SEQ ID NO: 2412053 - DNA, 17 bp, Homo sapiens
tctctcatgaacctcaa

SEQ ID NO: 2412054 - DNA, 15 bp, Homo sapiens
tctctccttgttctg

SEQ ID NO: 2412055 - DNA, 15 bp, Homo sapiens
tctctcgtgagtata

SEQ ID NO: 2412056 - DNA, 17 bp, Homo sapiens
tctctgcaaactgcctt

SEQ ID NO: 2412057 - DNA, 13 bp, Homo sapiens
tctctgcaggtcc

SEQ ID NO: 2412058 - DNA, 22 bp, Homo sapiens
tctctgcaggtccctaataaag

SEQ ID NO: 2412059 - DNA, 19 bp, Homo sapiens
tctctggaatttgaaacac

SEQ ID NO: 2412060 - DNA, 18 bp, Homo sapiens
tctctgtaataaactcat

SEQ ID NO: 2412061 - DNA, 14 bp, Homo sapiens
tctctgttcatttc

SEQ ID NO: 2412062 - DNA, 15 bp, Homo sapiens
tctcttattgcctca

SEQ ID NO: 2412063 - DNA, 22 bp, Homo sapiens
tctcttattgcctcacttcagg

SEQ ID NO: 2412064 - DNA, 12 bp, Homo sapiens
tctcttgatttt

SEQ ID NO: 2412065 - DNA, 12 bp, Homo sapiens
tctcttgcctca

SEQ ID NO: 2412066 - DNA, 13 bp, Homo sapiens
tctcttgcctcaa

SEQ ID NO: 2412067 - DNA, 22 bp, Homo sapiens
tctgaaaattgatgggatttgg

SEQ ID NO: 2412068 - DNA, 14 bp, Homo sapiens
tctgagttttacca

SEQ ID NO: 2412069 - DNA, 11 bp, Homo sapiens
tctgcaggtcc

SEQ ID NO: 2412070 - DNA, 18 bp, Homo sapiens
tctgcaggtccctaataa

SEQ ID NO: 2412071 - DNA, 19 bp, Homo sapiens
tctgcaggtccctaataaa

SEQ ID NO: 2412072 - DNA, 21 bp, Homo sapiens
tctgcaggtccctaataaagc

SEQ ID NO: 2412073 - DNA, 16 bp, Homo sapiens
tctgcctttattgtgt

SEQ ID NO: 2412074 - DNA, 18 bp, Homo sapiens
tctgcctttattgtgttt

SEQ ID NO: 2412075 - DNA, 23 bp, Homo sapiens
tctgcctttattgtgtttgtcat

SEQ ID NO: 2412076 - DNA, 14 bp, Homo sapiens
tctggaatttgaaa

SEQ ID NO: 2412077 - DNA, 12 bp, Homo sapiens
tctggagcccac

SEQ ID NO: 2412078 - DNA, 22 bp, Homo sapiens
tctggagcccactgtacttgct

SEQ ID NO: 2412079 - DNA, 18 bp, Homo sapiens
tctggattatattatgaa

SEQ ID NO: 2412080 - DNA, 17 bp, Homo sapiens
tctgtaaaatctttctt

SEQ ID NO: 2412081 - DNA, 23 bp, Homo sapiens
tctgtaaaatctttctttcttag

SEQ ID NO: 2412082 - DNA, 12 bp, Homo sapiens
tctgtagaaatg

SEQ ID NO: 2412083 - DNA, 21 bp, Homo sapiens
tctgtagaaatggttgtatta

SEQ ID NO: 2412084 - DNA, 23 bp, Homo sapiens
tctgtatttccccaacatgtaat

SEQ ID NO: 2412085 - DNA, 23 bp, Homo sapiens
tctgtatttgaatcagcctacag

SEQ ID NO: 2412086 - DNA, 13 bp, Homo sapiens
tctgtcacttaat

SEQ ID NO: 2412087 - DNA, 17 bp, Homo sapiens
tctgtcgcccatgctgg

SEQ ID NO: 2412088 - DNA, 19 bp, Homo sapiens
tctgtgaagtgagaccttc

SEQ ID NO: 2412089 - DNA, 20 bp, Homo sapiens
tctgttccccatggccactt

SEQ ID NO: 2412090 - DNA, 23 bp, Homo sapiens
tctgttttctttctaatgagata

SEQ ID NO: 2412091 - DNA, 20 bp, Homo sapiens
tcttaaaacattatgagttt

SEQ ID NO: 2412092 - DNA, 17 bp, Homo sapiens
tcttaaccagatcattg

SEQ ID NO: 2412093 - DNA, 20 bp, Homo sapiens
tcttaatgaagtttgaatgt

SEQ ID NO: 2412094 - DNA, 22 bp, Homo sapiens
tcttaatgaagtttgaatgtta

SEQ ID NO: 2412095 - DNA, 19 bp, Homo sapiens
tcttactgtcttttttcta

SEQ ID NO: 2412096 - DNA, 11 bp, Homo sapiens
tcttagaaatt

SEQ ID NO: 2412097 - DNA, 14 bp, Homo sapiens
tcttatttcatgaa

SEQ ID NO: 2412098 - DNA, 21 bp, Homo sapiens
tcttcttttaaaccattttct

SEQ ID NO: 2412099 - DNA, 19 bp, Homo sapiens
tcttgatgtaaaatcttgt

SEQ ID NO: 2412100 - DNA, 17 bp, Homo sapiens
tcttgtcatgtgtataa

SEQ ID NO: 2412101 - DNA, 21 bp, Homo sapiens
tcttgtccccaacaccccaca

SEQ ID NO: 2412102 - DNA, 17 bp, Homo sapiens
tcttgtctcaatgctca

SEQ ID NO: 2412103 - DNA, 13 bp, Homo sapiens
tcttgtgaggaaa

SEQ ID NO: 2412104 - DNA, 14 bp, Homo sapiens
tctttaattttaca

SEQ ID NO: 2412105 - DNA, 14 bp, Homo sapiens
tctttagagttaga

SEQ ID NO: 2412106 - DNA, 16 bp, Homo sapiens
tctttagagttagact

SEQ ID NO: 2412107 - DNA, 18 bp, Homo sapiens
tctttagagttagactgt

SEQ ID NO: 2412108 - DNA, 19 bp, Homo sapiens
tctttagagttagactgtt

SEQ ID NO: 2412109 - DNA, 15 bp, Homo sapiens
tctttcttagaaatt

SEQ ID NO: 2412110 - DNA, 22 bp, Homo sapiens
tctttctttgggaatatttgaa

SEQ ID NO: 2412111 - DNA, 23 bp, Homo sapiens
tctttctttgggaatatttgaat

SEQ ID NO: 2412112 - DNA, 18 bp, Homo sapiens
tctttgggaatatttgaa

SEQ ID NO: 2412113 - DNA, 20 bp, Homo sapiens
tctttgggaatatttgaatc

SEQ ID NO: 2412114 - DNA, 12 bp, Homo sapiens
tctttgtaatga

SEQ ID NO: 2412115 - DNA, 15 bp, Homo sapiens
tctttgtttctttct

SEQ ID NO: 2412116 - DNA, 19 bp, Homo sapiens
tctttttgggagagacttg

SEQ ID NO: 2412117 - DNA, 23 bp, Homo sapiens
tgaaaaaatatatatcaaatata

SEQ ID NO: 2412118 - DNA, 15 bp, Homo sapiens
tgaaaataaagaatg

SEQ ID NO: 2412119 - DNA, 17 bp, Homo sapiens
tgaaaataaagaatgga

SEQ ID NO: 2412120 - DNA, 13 bp, Homo sapiens
tgaaacatgtttc

SEQ ID NO: 2412121 - DNA, 16 bp, Homo sapiens
tgaaacattttctccc

SEQ ID NO: 2412122 - DNA, 19 bp, Homo sapiens
tgaaactcatagacactga

SEQ ID NO: 2412123 - DNA, 13 bp, Homo sapiens
tgaaagaaaataa

SEQ ID NO: 2412124 - DNA, 15 bp, Homo sapiens
tgaaatcattcattt

SEQ ID NO: 2412125 - DNA, 12 bp, Homo sapiens
tgaaattattca

SEQ ID NO: 2412126 - DNA, 12 bp, Homo sapiens
tgaaccaccgcg

SEQ ID NO: 2412127 - DNA, 18 bp, Homo sapiens
tgaacctgatgaaaataa

SEQ ID NO: 2412128 - DNA, 18 bp, Homo sapiens
tgaactaggctgagcaat

SEQ ID NO: 2412129 - DNA, 23 bp, Homo sapiens
tgaactagggtggtgcatttttg

SEQ ID NO: 2412130 - DNA, 17 bp, Homo sapiens
tgaactggaccctgttg

SEQ ID NO: 2412131 - DNA, 20 bp, Homo sapiens
tgaagctatcgtaaaattaa

SEQ ID NO: 2412132 - DNA, 15 bp, Homo sapiens
tgaagctgttgtgtg

SEQ ID NO: 2412133 - DNA, 23 bp, Homo sapiens
tgaagtacccgttcacatttttg

SEQ ID NO: 2412134 - DNA, 17 bp, Homo sapiens
tgaagtttgaatgttaa

SEQ ID NO: 2412135 - DNA, 18 bp, Homo sapiens
tgaagtttgaatgttaaa

SEQ ID NO: 2412136 - DNA, 23 bp, Homo sapiens
tgaataatgtaagacaaatatgt

SEQ ID NO: 2412137 - DNA, 17 bp, Homo sapiens
tgaataggcgatcacaa

SEQ ID NO: 2412138 - DNA, 19 bp, Homo sapiens
tgaataggcgatcacaacg

SEQ ID NO: 2412139 - DNA, 18 bp, Homo sapiens
tgaatatttagtgttcat

SEQ ID NO: 2412140 - DNA, 22 bp, Homo sapiens
tgaatcattttacctttgacaa

SEQ ID NO: 2412141 - DNA, 13 bp, Homo sapiens
tgaatcttgtctc

SEQ ID NO: 2412142 - DNA, 13 bp, Homo sapiens
tgaatgcggccca

SEQ ID NO: 2412143 - DNA, 16 bp, Homo sapiens
tgaatgtaaatttgta

SEQ ID NO: 2412144 - DNA, 18 bp, Homo sapiens
tgaatgtaaatttgtact

SEQ ID NO: 2412145 - DNA, 20 bp, Homo sapiens
tgaatgtaaatttgtactat

SEQ ID NO: 2412146 - DNA, 20 bp, Homo sapiens
tattgtatttattcaataaa

SEQ ID NO: 2412147 - DNA, 17 bp, Homo sapiens
tattgtgtttgtcatta

SEQ ID NO: 2412148 - DNA, 21 bp, Homo sapiens
tattgtgtttgtcattagcct

SEQ ID NO: 2412149 - DNA, 11 bp, Homo sapiens
tatttaactga

SEQ ID NO: 2412150 - DNA, 16 bp, Homo sapiens
tatttaattagtgcta

SEQ ID NO: 2412151 - DNA, 14 bp, Homo sapiens
tatttaattcatgt

SEQ ID NO: 2412152 - DNA, 20 bp, Homo sapiens
tatttatgcctctgtattta

SEQ ID NO: 2412153 - DNA, 12 bp, Homo sapiens
tatttattcaat

SEQ ID NO: 2412154 - DNA, 14 bp, Homo sapiens
tatttattcaataa

SEQ ID NO: 2412155 - DNA, 16 bp, Homo sapiens
tatttattcaataaag

SEQ ID NO: 2412156 - DNA, 20 bp, Homo sapiens
tatttattcaataaagtatt

SEQ ID NO: 2412157 - DNA, 17 bp, Homo sapiens
tatttcatgaaaattgt

SEQ ID NO: 2412158 - DNA, 21 bp, Homo sapiens
tatttccccaacatgtaataa

SEQ ID NO: 2412159 - DNA, 16 bp, Homo sapiens
tatttgaatcttgtct

SEQ ID NO: 2412160 - DNA, 18 bp, Homo sapiens
tatttgaatcttgtctca

SEQ ID NO: 2412161 - DNA, 17 bp, Homo sapiens
tatttggtgattacatt

SEQ ID NO: 2412162 - DNA, 22 bp, Homo sapiens
tattttaagacgaaacatttgt

SEQ ID NO: 2412163 - DNA, 12 bp, Homo sapiens
tatttttcatga

SEQ ID NO: 2412164 - DNA, 22 bp, Homo sapiens
tatttttttctgaattattttc

SEQ ID NO: 2412165 - DNA, 24 bp, Homo sapiens
tcaaaattagtgctttttgtgtca

SEQ ID NO: 2412166 - DNA, 16 bp, Homo sapiens
tcaaaattgttacaaa

SEQ ID NO: 2412167 - DNA, 21 bp, Homo sapiens
tcaactctcttattgcctcac

SEQ ID NO: 2412168 - DNA, 15 bp, Homo sapiens
tcaacttttcctttg

SEQ ID NO: 2412169 - DNA, 21 bp, Homo sapiens
tcaacttttcctttgaatcct

SEQ ID NO: 2412170 - DNA, 21 bp, Homo sapiens
tcaagcaaacagcttcacaaa

SEQ ID NO: 2412171 - DNA, 17 bp, Homo sapiens
tcaagcaagatttcaga

SEQ ID NO: 2412172 - DNA, 13 bp, Homo sapiens
tcaagccctgcag

SEQ ID NO: 2412173 - DNA, 20 bp, Homo sapiens
tcaataaagtatttaattag

SEQ ID NO: 2412174 - DNA, 18 bp, Homo sapiens
tcaatataagcttttctt

SEQ ID NO: 2412175 - DNA, 13 bp, Homo sapiens
tcaattaccacac

SEQ ID NO: 2412176 - DNA, 16 bp, Homo sapiens
tcaattcttgccaaat

SEQ ID NO: 2412177 - DNA, 16 bp, Homo sapiens
tcacaacgtgcattgt

SEQ ID NO: 2412178 - DNA, 22 bp, Homo sapiens
tcacagcttatttcctcatttt

SEQ ID NO: 2412179 - DNA, 17 bp, Homo sapiens
tcacagcttcagccagg

SEQ ID NO: 2412180 - DNA, 19 bp, Homo sapiens
tcacagcttcagccaggag

SEQ ID NO: 2412181 - DNA, 23 bp, Homo sapiens
tcacaggtagacagtatataact

SEQ ID NO: 2412182 - DNA, 17 bp, Homo sapiens
tcacatgattccagcca

SEQ ID NO: 2412183 - DNA, 22 bp, Homo sapiens
tcacattcctctgcccttcctg

SEQ ID NO: 2412184 - DNA, 22 bp, Homo sapiens
tcacattgtattcagagttgat

SEQ ID NO: 2412185 - DNA, 12 bp, Homo sapiens
tcacatttaaat

SEQ ID NO: 2412186 - DNA, 16 bp, Homo sapiens
tcaccagccctggcaa

SEQ ID NO: 2412187 - DNA, 16 bp, Homo sapiens
tcaccatttggatcct

SEQ ID NO: 2412188 - DNA, 20 bp, Homo sapiens
tcaccatttggatcctgtgt

SEQ ID NO: 2412189 - DNA, 15 bp, Homo sapiens
tcacccctgtttctg

SEQ ID NO: 2412190 - DNA, 21 bp, Homo sapiens
tcaccttagaccaccaagcct

SEQ ID NO: 2412191 - DNA, 22 bp, Homo sapiens
tcaccttagaccaccaagcctt

SEQ ID NO: 2412192 - DNA, 15 bp, Homo sapiens
tcactaattcattaa

SEQ ID NO: 2412193 - DNA, 18 bp, Homo sapiens
tcactaattcattaatct

SEQ ID NO: 2412194 - DNA, 20 bp, Homo sapiens
tcactctgttcattcctcca

SEQ ID NO: 2412195 - DNA, 22 bp, Homo sapiens
tcactctgttcattcctccagg

SEQ ID NO: 2412196 - DNA, 17 bp, Homo sapiens
tcagaatctctcttctt

SEQ ID NO: 2412197 - DNA, 17 bp, Homo sapiens
tcagactctaagaaaga

SEQ ID NO: 2412198 - DNA, 22 bp, Homo sapiens
tcagagtaatccaagcaaatgt

SEQ ID NO: 2412199 - DNA, 14 bp, Homo sapiens
tcagatcctcctca

SEQ ID NO: 2412200 - DNA, 19 bp, Homo sapiens
tcagcaagttagaactagc

SEQ ID NO: 2412201 - DNA, 13 bp, Homo sapiens
tcagccaattatg

SEQ ID NO: 2412202 - DNA, 15 bp, Homo sapiens
tcagccaattatgtt

SEQ ID NO: 2412203 - DNA, 17 bp, Homo sapiens
tcagccaattatgttaa

SEQ ID NO: 2412204 - DNA, 13 bp, Homo sapiens
tcagccaggagct

SEQ ID NO: 2412205 - DNA, 19 bp, Homo sapiens
tcagccaggagctgggcag

SEQ ID NO: 2412206 - DNA, 14 bp, Homo sapiens
tcagccatgtattt

SEQ ID NO: 2412207 - DNA, 12 bp, Homo sapiens
tcagccctcaga

SEQ ID NO: 2412208 - DNA, 19 bp, Homo sapiens
tcagcctacaggcctcaca

SEQ ID NO: 2412209 - DNA, 13 bp, Homo sapiens
taataaacattct

SEQ ID NO: 2412210 - DNA, 11 bp, Homo sapiens
taataaagctg

SEQ ID NO: 2412211 - DNA, 16 bp, Homo sapiens
taataatatacttgtg

SEQ ID NO: 2412212 - DNA, 16 bp, Homo sapiens
taataccacagctttt

SEQ ID NO: 2412213 - DNA, 20 bp, Homo sapiens
taatagggcaattaattcct

SEQ ID NO: 2412214 - DNA, 14 bp, Homo sapiens
taatgaagtttgaa

SEQ ID NO: 2412215 - DNA, 18 bp, Homo sapiens
taatgaagtttgaatgtt

SEQ ID NO: 2412216 - DNA, 20 bp, Homo sapiens
taatgaagtttgaatgttaa

SEQ ID NO: 2412217 - DNA, 21 bp, Homo sapiens
taatgaagtttgaatgttaaa

SEQ ID NO: 2412218 - DNA, 15 bp, Homo sapiens
taatgtaagacaaat

SEQ ID NO: 2412219 - DNA, 21 bp, Homo sapiens
taatgttgtatgtcttgttta

SEQ ID NO: 2412220 - DNA, 12 bp, Homo sapiens
taattagtgcta

SEQ ID NO: 2412221 - DNA, 14 bp, Homo sapiens
taattagtgctaag

SEQ ID NO: 2412222 - DNA, 20 bp, Homo sapiens
taattcttcaccttaggaat

SEQ ID NO: 2412223 - DNA, 15 bp, Homo sapiens
tacaacctccgcctc

SEQ ID NO: 2412224 - DNA, 23 bp, Homo sapiens
tacaatgaaaaggactttataga

SEQ ID NO: 2412225 - DNA, 17 bp, Homo sapiens
tacacctatgtcatttc

SEQ ID NO: 2412226 - DNA, 13 bp, Homo sapiens
tacactatcttaa

SEQ ID NO: 2412227 - DNA, 15 bp, Homo sapiens
tacagattttgatag

SEQ ID NO: 2412228 - DNA, 21 bp, Homo sapiens
tacagattttgatagcaaagc

SEQ ID NO: 2412229 - DNA, 23 bp, Homo sapiens
tacagattttgatagcaaagcga

SEQ ID NO: 2412230 - DNA, 21 bp, Homo sapiens
tacagctcagaagtttcttct

SEQ ID NO: 2412231 - DNA, 20 bp, Homo sapiens
tacaggatgatgactatgga

SEQ ID NO: 2412232 - DNA, 19 bp, Homo sapiens
tacatataagtgattgctg

SEQ ID NO: 2412233 - DNA, 22 bp, Homo sapiens
tacatataagtgattgctggtt

SEQ ID NO: 2412234 - DNA, 13 bp, Homo sapiens
tacatcatttctt

SEQ ID NO: 2412235 - DNA, 14 bp, Homo sapiens
tacatgattcattt

SEQ ID NO: 2412236 - DNA, 16 bp, Homo sapiens
taccaagtttcaggta

SEQ ID NO: 2412237 - DNA, 19 bp, Homo sapiens
tacccatgtctacacagat

SEQ ID NO: 2412238 - DNA, 15 bp, Homo sapiens
tacctagctggctct

SEQ ID NO: 2412239 - DNA, 17 bp, Homo sapiens
tactactgaatctctaa

SEQ ID NO: 2412240 - DNA, 14 bp, Homo sapiens
tactactgtgtaag

SEQ ID NO: 2412241 - DNA, 18 bp, Homo sapiens
tactagggaaatgccttt

SEQ ID NO: 2412242 - DNA, 13 bp, Homo sapiens
tactatttaactg

SEQ ID NO: 2412243 - DNA, 16 bp, Homo sapiens
tactatttaactgact

SEQ ID NO: 2412244 - DNA, 21 bp, Homo sapiens
tactctgaaattgtaactaaa

SEQ ID NO: 2412245 - DNA, 17 bp, Homo sapiens
tactgcagcctccagag

SEQ ID NO: 2412246 - DNA, 14 bp, Homo sapiens
tactgcctatttta

SEQ ID NO: 2412247 - DNA, 18 bp, Homo sapiens
tactgtaaggcaatcatg

SEQ ID NO: 2412248 - DNA, 19 bp, Homo sapiens
tacttacatgcattactgc

SEQ ID NO: 2412249 - DNA, 15 bp, Homo sapiens
tacttgaaaattaac

SEQ ID NO: 2412250 - DNA, 13 bp, Homo sapiens
tacttgctcttga

SEQ ID NO: 2412251 - DNA, 14 bp, Homo sapiens
tacttgctcttgat

SEQ ID NO: 2412252 - DNA, 19 bp, Homo sapiens
tacttgtggactaaaagat

SEQ ID NO: 2412253 - DNA, 20 bp, Homo sapiens
tacttgtggactaaaagata

SEQ ID NO: 2412254 - DNA, 21 bp, Homo sapiens
tacttttcttctattgcctct

SEQ ID NO: 2412255 - DNA, 22 bp, Homo sapiens
tacttttcttctattgcctctg

SEQ ID NO: 2412256 - DNA, 18 bp, Homo sapiens
tagaaagcatttgaatgc

SEQ ID NO: 2412257 - DNA, 13 bp, Homo sapiens
tagaaaggccttt

SEQ ID NO: 2412258 - DNA, 15 bp, Homo sapiens
tagaaatggttgtat

SEQ ID NO: 2412259 - DNA, 17 bp, Homo sapiens
tagaaatggttgtatta

SEQ ID NO: 2412260 - DNA, 19 bp, Homo sapiens
tagaaatggttgtattaga

SEQ ID NO: 2412261 - DNA, 20 bp, Homo sapiens
tagaaatggttgtattagat

SEQ ID NO: 2412262 - DNA, 17 bp, Homo sapiens
tagaccaccaagccttg

SEQ ID NO: 2412263 - DNA, 19 bp, Homo sapiens
tagaccaccaagccttgat

SEQ ID NO: 2412264 - DNA, 21 bp, Homo sapiens
tagaggcctgactgccaagcc

SEQ ID NO: 2412265 - DNA, 22 bp, Homo sapiens
tagaggcctgactgccaagcca

SEQ ID NO: 2412266 - DNA, 18 bp, Homo sapiens
tagaggcttccttcattt

SEQ ID NO: 2412267 - DNA, 18 bp, Homo sapiens
tagatacatgctttttaa

SEQ ID NO: 2412268 - DNA, 19 bp, Homo sapiens
tagatatccacttgagaca

SEQ ID NO: 2412269 - DNA, 19 bp, Homo sapiens
tagatttgtgtgcatcagg

SEQ ID NO: 2412270 - DNA, 19 bp, Homo sapiens
tagcaaagatatctcatct

SEQ ID NO: 2412271 - DNA, 17 bp, Homo sapiens
tagcatatctgccttta

SEQ ID NO: 2412272 - DNA, 21 bp, Homo sapiens
tagcatatctgcctttattgt

SEQ ID NO: 2412273 - DNA, 23 bp, Homo sapiens
tagcatatctgcctttattgtgt

SEQ ID NO: 2412274 - DNA, 16 bp, Homo sapiens
tagcatgaagacagag

SEQ ID NO: 2412275 - DNA, 18 bp, Homo sapiens
tagcatgtcgtcaaagct

SEQ ID NO: 2412276 - DNA, 21 bp, Homo sapiens
tagcatgtcgtcaaagctgaa

SEQ ID NO: 2412277 - DNA, 15 bp, Homo sapiens
tagcctgagtagaaa

SEQ ID NO: 2412278 - DNA, 15 bp, Homo sapiens
gctttatcctcttta

SEQ ID NO: 2412279 - DNA, 19 bp, Homo sapiens
gctttgccctgctgccctc

SEQ ID NO: 2412280 - DNA, 15 bp, Homo sapiens
gcttttatgtgaaac

SEQ ID NO: 2412281 - DNA, 19 bp, Homo sapiens
gcttttatgtgaaacatgt

SEQ ID NO: 2412282 - DNA, 21 bp, Homo sapiens
gcttttatgtgaaacatgttt

SEQ ID NO: 2412283 - DNA, 20 bp, Homo sapiens
gcttttccctttttttaagt

SEQ ID NO: 2412284 - DNA, 21 bp, Homo sapiens
gcttttccctttttttaagta

SEQ ID NO: 2412285 - DNA, 20 bp, Homo sapiens
gcttttttatcatgtgaaat

SEQ ID NO: 2412286 - DNA, 16 bp, Homo sapiens
ggaaaaaataacaatg

SEQ ID NO: 2412287 - DNA, 19 bp, Homo sapiens
ggaaaaagtgggtttttta

SEQ ID NO: 2412288 - DNA, 15 bp, Homo sapiens
ggaaaaatgtaggag

SEQ ID NO: 2412289 - DNA, 15 bp, Homo sapiens
ggaagcccctgggcc

SEQ ID NO: 2412290 - DNA, 20 bp, Homo sapiens
ggaagctgtgcgtgtgtgtg

SEQ ID NO: 2412291 - DNA, 11 bp, Homo sapiens
ggaatatttga

SEQ ID NO: 2412292 - DNA, 14 bp, Homo sapiens
ggaatatttgaatc

SEQ ID NO: 2412293 - DNA, 16 bp, Homo sapiens
ggacacagttcctggg

SEQ ID NO: 2412294 - DNA, 19 bp, Homo sapiens
ggacacagttcctgggaac

SEQ ID NO: 2412295 - DNA, 12 bp, Homo sapiens
ggactaaaagat

SEQ ID NO: 2412296 - DNA, 14 bp, Homo sapiens
ggactaaaagatat

SEQ ID NO: 2412297 - DNA, 19 bp, Homo sapiens
ggactaaaagatataagtg

SEQ ID NO: 2412298 - DNA, 20 bp, Homo sapiens
ggactcaggtggccctactg

SEQ ID NO: 2412299 - DNA, 20 bp, Homo sapiens
ggactcatctttccctcctt

SEQ ID NO: 2412300 - DNA, 22 bp, Homo sapiens
ggactcatctttccctccttgg

SEQ ID NO: 2412301 - DNA, 17 bp, Homo sapiens
ggactgtgtgctcagga

SEQ ID NO: 2412302 - DNA, 23 bp, Homo sapiens
ggactgtgtgctcaggagccctg

SEQ ID NO: 2412303 - DNA, 20 bp, Homo sapiens
ggactttatagatcagccag

SEQ ID NO: 2412304 - DNA, 18 bp, Homo sapiens
ggagaaatgaaaaaatat

SEQ ID NO: 2412305 - DNA, 15 bp, Homo sapiens
ggagcccactgtact

SEQ ID NO: 2412306 - DNA, 18 bp, Homo sapiens
ggagcccactgtacttgc

SEQ ID NO: 2412307 - DNA, 20 bp, Homo sapiens
ggagccctgggaggctctgg

SEQ ID NO: 2412308 - DNA, 18 bp, Homo sapiens
ggagctgggcagaaggcc

SEQ ID NO: 2412309 - DNA, 13 bp, Homo sapiens
ggaggatgtgaat

SEQ ID NO: 2412310 - DNA, 20 bp, Homo sapiens
ggaggtccttaggcctctga

SEQ ID NO: 2412311 - DNA, 13 bp, Homo sapiens
ggaggtggctggg

SEQ ID NO: 2412312 - DNA, 19 bp, Homo sapiens
ggatcagagcgcacaggga

SEQ ID NO: 2412313 - DNA, 22 bp, Homo sapiens
ggatgagagttttggatgcagt

SEQ ID NO: 2412314 - DNA, 22 bp, Homo sapiens
ggatgcagtgctcgctgttgct

SEQ ID NO: 2412315 - DNA, 19 bp, Homo sapiens
ggattatgggtcacaggaa

SEQ ID NO: 2412316 - DNA, 16 bp, Homo sapiens
ggattcttccatctga

SEQ ID NO: 2412317 - DNA, 23 bp, Homo sapiens
ggcatcatctcagctcactgcaa

SEQ ID NO: 2412318 - DNA, 16 bp, Homo sapiens
ggccacatagatgctg

SEQ ID NO: 2412319 - DNA, 22 bp, Homo sapiens
ggccagagctacccgcagagtt

SEQ ID NO: 2412320 - DNA, 12 bp, Homo sapiens
ggccagctccgc

SEQ ID NO: 2412321 - DNA, 18 bp, Homo sapiens
ggccaggctgggtcgccc

SEQ ID NO: 2412322 - DNA, 22 bp, Homo sapiens
ggccaggctgggtcgccctgga

SEQ ID NO: 2412323 - DNA, 13 bp, Homo sapiens
ggccatgggaggc

SEQ ID NO: 2412324 - DNA, 22 bp, Homo sapiens
ggcccagtacctagctggctct

SEQ ID NO: 2412325 - DNA, 13 bp, Homo sapiens
ggcccctgcctct

SEQ ID NO: 2412326 - DNA, 18 bp, Homo sapiens
ggcctagactctgtctac

SEQ ID NO: 2412327 - DNA, 14 bp, Homo sapiens
ggcctatgtggtct

SEQ ID NO: 2412328 - DNA, 19 bp, Homo sapiens
ggcctcaaatgcaccatgt

SEQ ID NO: 2412329 - DNA, 17 bp, Homo sapiens
ggcctgactgccaagcc

SEQ ID NO: 2412330 - DNA, 20 bp, Homo sapiens
ggcctgtggatcaaatccag

SEQ ID NO: 2412331 - DNA, 17 bp, Homo sapiens
ggccttgcggctcctca

SEQ ID NO: 2412332 - DNA, 19 bp, Homo sapiens
ggccttgcggctcctcagg

SEQ ID NO: 2412333 - DNA, 22 bp, Homo sapiens
ggcgcgatctcggctcactgca

SEQ ID NO: 2412334 - DNA, 17 bp, Homo sapiens
ggctagactagtctcaa

SEQ ID NO: 2412335 - DNA, 23 bp, Homo sapiens
ggctcactgcaacctccacctcc

SEQ ID NO: 2412336 - DNA, 21 bp, Homo sapiens
ggctgaaaggaagctgtgcgt

SEQ ID NO: 2412337 - DNA, 15 bp, Homo sapiens
ggctgctcagggctg

SEQ ID NO: 2412338 - DNA, 13 bp, Homo sapiens
ggcttgcctgcag

SEQ ID NO: 2412339 - DNA, 14 bp, Homo sapiens
ggctttatcctctt

SEQ ID NO: 2412340 - DNA, 14 bp, Homo sapiens
gggaagacagtggc

SEQ ID NO: 2412341 - DNA, 16 bp, Homo sapiens
gggaagacagtggccc

SEQ ID NO: 2412342 - DNA, 20 bp, Homo sapiens
gggactacaggcgtgagcca

SEQ ID NO: 2412343 - DNA, 19 bp, Homo sapiens
gggactcatctttccctcc

SEQ ID NO: 2412344 - DNA, 13 bp, Homo sapiens
gggacttgtgtct

SEQ ID NO: 2412345 - DNA, 14 bp, Homo sapiens
gggacttgtgtctg

SEQ ID NO: 2412346 - DNA, 22 bp, Homo sapiens
gggaggctctggagcccactgt

SEQ ID NO: 2412347 - DNA, 14 bp, Homo sapiens
gggatcctgcctgc

SEQ ID NO: 2412348 - DNA, 20 bp, Homo sapiens
gggattacaggcgtgagcca

SEQ ID NO: 2412349 - DNA, 17 bp, Homo sapiens
gggattatgggtcacag

SEQ ID NO: 2412350 - DNA, 21 bp, Homo sapiens
gggcaagcctaagggatcctg

SEQ ID NO: 2412351 - DNA, 15 bp, Homo sapiens
gggcaggccagagct

SEQ ID NO: 2412352 - DNA, 19 bp, Homo sapiens
gggccacatagatgctgat

SEQ ID NO: 2412353 - DNA, 15 bp, Homo sapiens
gggccaggctgggtc

SEQ ID NO: 2412354 - DNA, 15 bp, Homo sapiens
gggcccctgcctctc

SEQ ID NO: 2412355 - DNA, 13 bp, Homo sapiens
gtttgtcattagc

SEQ ID NO: 2412356 - DNA, 15 bp, Homo sapiens
gtttgtcattagcct

SEQ ID NO: 2412357 - DNA, 17 bp, Homo sapiens
gttttaaaatgagaaat

SEQ ID NO: 2412358 - DNA, 20 bp, Homo sapiens
gttttcttaaccagatcatt

SEQ ID NO: 2412359 - DNA, 11 bp, Homo sapiens
taaaaaacact

SEQ ID NO: 2412360 - DNA, 17 bp, Homo sapiens
taaaaacaaagaaatta

SEQ ID NO: 2412361 - DNA, 19 bp, Homo sapiens
taaaaataaaaaacactgg

SEQ ID NO: 2412362 - DNA, 21 bp, Homo sapiens
taaaaataaaaaagatcccaa

SEQ ID NO: 2412363 - DNA, 11 bp, Homo sapiens
taaaacacttg

SEQ ID NO: 2412364 - DNA, 13 bp, Homo sapiens
taaaacctggaga

SEQ ID NO: 2412365 - DNA, 18 bp, Homo sapiens
taaaagatataagtgctg

SEQ ID NO: 2412366 - DNA, 21 bp, Homo sapiens
taaaagatataagtgctgtat

SEQ ID NO: 2412367 - DNA, 22 bp, Homo sapiens
taaaagatggggtctgtaaaat

SEQ ID NO: 2412368 - DNA, 15 bp, Homo sapiens
taaaatcagccaatt

SEQ ID NO: 2412369 - DNA, 20 bp, Homo sapiens
taaaatctttctttcttaga

SEQ ID NO: 2412370 - DNA, 21 bp, Homo sapiens
taaaatctttctttcttagaa

SEQ ID NO: 2412371 - DNA, 15 bp, Homo sapiens
taaaatgagaaatct

SEQ ID NO: 2412372 - DNA, 19 bp, Homo sapiens
taaaattgccatattgcac

SEQ ID NO: 2412373 - DNA, 18 bp, Homo sapiens
taaaatttttttagaaag

SEQ ID NO: 2412374 - DNA, 21 bp, Homo sapiens
taaacactcttgaaaaatgca

SEQ ID NO: 2412375 - DNA, 17 bp, Homo sapiens
taaactagcatatctgc

SEQ ID NO: 2412376 - DNA, 22 bp, Homo sapiens
taaactagcatatctgccttta

SEQ ID NO: 2412377 - DNA, 12 bp, Homo sapiens
taaactcatttc

SEQ ID NO: 2412378 - DNA, 22 bp, Homo sapiens
taaaggttcatgcaaactttat

SEQ ID NO: 2412379 - DNA, 19 bp, Homo sapiens
taaagtaaaaacaaagaaa

SEQ ID NO: 2412380 - DNA, 21 bp, Homo sapiens
taaagtaaaaacaaagaaatt

SEQ ID NO: 2412381 - DNA, 12 bp, Homo sapiens
taaagtatttaa

SEQ ID NO: 2412382 - DNA, 16 bp, Homo sapiens
taaagtatttaattag

SEQ ID NO: 2412383 - DNA, 17 bp, Homo sapiens
taaagtatttaattagt

SEQ ID NO: 2412384 - DNA, 21 bp, Homo sapiens
taaagtatttaattagtgcta

SEQ ID NO: 2412385 - DNA, 22 bp, Homo sapiens
taaagtatttaattagtgctaa

SEQ ID NO: 2412386 - DNA, 14 bp, Homo sapiens
taaagtttgttgaa

SEQ ID NO: 2412387 - DNA, 15 bp, Homo sapiens
taaataaattgtata

SEQ ID NO: 2412388 - DNA, 21 bp, Homo sapiens
taaataaattgtatattcact

SEQ ID NO: 2412389 - DNA, 14 bp, Homo sapiens
taaattgtatattc

SEQ ID NO: 2412390 - DNA, 19 bp, Homo sapiens
taaattgtatattcacttt

SEQ ID NO: 2412391 - DNA, 13 bp, Homo sapiens
taaatttgtacta

SEQ ID NO: 2412392 - DNA, 14 bp, Homo sapiens
taaatttgtactat

SEQ ID NO: 2412393 - DNA, 21 bp, Homo sapiens
taacatgaatatttagtgttc

SEQ ID NO: 2412394 - DNA, 20 bp, Homo sapiens
taacattcctcatgaatgta

SEQ ID NO: 2412395 - DNA, 21 bp, Homo sapiens
taacattcctcatgaatgtaa

SEQ ID NO: 2412396 - DNA, 13 bp, Homo sapiens
taacggatcagaa

SEQ ID NO: 2412397 - DNA, 18 bp, Homo sapiens
taactggagccccatcag

SEQ ID NO: 2412398 - DNA, 21 bp, Homo sapiens
taacttccctgaaaaatctaa

SEQ ID NO: 2412399 - DNA, 16 bp, Homo sapiens
taagaacaactacctg

SEQ ID NO: 2412400 - DNA, 18 bp, Homo sapiens
taagaaccattgatttaa

SEQ ID NO: 2412401 - DNA, 23 bp, Homo sapiens
taagaagcacgtggtaaaacact

SEQ ID NO: 2412402 - DNA, 17 bp, Homo sapiens
taagatatttttcatga

SEQ ID NO: 2412403 - DNA, 15 bp, Homo sapiens
taagatttccttctt

SEQ ID NO: 2412404 - DNA, 16 bp, Homo sapiens
taagatttccttcttt

SEQ ID NO: 2412405 - DNA, 19 bp, Homo sapiens
taaggatggagccagctct

SEQ ID NO: 2412406 - DNA, 15 bp, Homo sapiens
taaggcaatcatggt

SEQ ID NO: 2412407 - DNA, 16 bp, Homo sapiens
taagtgattgtatgaa

SEQ ID NO: 2412408 - DNA, 12 bp, Homo sapiens
taagtgctgtat

SEQ ID NO: 2412409 - DNA, 14 bp, Homo sapiens
taagtgctgtataa

SEQ ID NO: 2412410 - DNA, 17 bp, Homo sapiens
taagtgctgtataaaat

SEQ ID NO: 2412411 - DNA, 19 bp, Homo sapiens
taagtgctgtataaaatca

SEQ ID NO: 2412412 - DNA, 20 bp, Homo sapiens
taagtgctgtataaaatcag

SEQ ID NO: 2412413 - DNA, 12 bp, Homo sapiens
taagtgtgaact

SEQ ID NO: 2412414 - DNA, 14 bp, Homo sapiens
taagtgtgaactgg

SEQ ID NO: 2412415 - DNA, 17 bp, Homo sapiens
taagtgtgtgtttttca

SEQ ID NO: 2412416 - DNA, 14 bp, Homo sapiens
ctttatcctcttta

SEQ ID NO: 2412417 - DNA, 21 bp, Homo sapiens
ctttatcttgaataatgtaag

SEQ ID NO: 2412418 - DNA, 23 bp, Homo sapiens
ctttatcttgaataatgtaagac

SEQ ID NO: 2412419 - DNA, 20 bp, Homo sapiens
ctttatgttactacatgcac

SEQ ID NO: 2412420 - DNA, 20 bp, Homo sapiens
ctttattgtgtttgtcatta

SEQ ID NO: 2412421 - DNA, 19 bp, Homo sapiens
ctttattttgtgtttagga

SEQ ID NO: 2412422 - DNA, 12 bp, Homo sapiens
ctttcagagcct

SEQ ID NO: 2412423 - DNA, 13 bp, Homo sapiens
ctttccctccttg

SEQ ID NO: 2412424 - DNA, 15 bp, Homo sapiens
ctttccctccttggt

SEQ ID NO: 2412425 - DNA, 15 bp, Homo sapiens
ctttctttattttga

SEQ ID NO: 2412426 - DNA, 21 bp, Homo sapiens
ctttctttgggaatatttgaa

SEQ ID NO: 2412427 - DNA, 23 bp, Homo sapiens
ctttctttgggaatatttgaatc

SEQ ID NO: 2412428 - DNA, 19 bp, Homo sapiens
ctttgaatcctctctctgt

SEQ ID NO: 2412429 - DNA, 16 bp, Homo sapiens
ctttgaatgcggccca

SEQ ID NO: 2412430 - DNA, 14 bp, Homo sapiens
ctttgcccacaatg

SEQ ID NO: 2412431 - DNA, 23 bp, Homo sapiens
ctttgcttcattcaagtcagctc

SEQ ID NO: 2412432 - DNA, 17 bp, Homo sapiens
ctttgggaatatttgaa

SEQ ID NO: 2412433 - DNA, 23 bp, Homo sapiens
ctttgggaatatttgaatcttgt

SEQ ID NO: 2412434 - DNA, 17 bp, Homo sapiens
cttttaggacccttccc

SEQ ID NO: 2412435 - DNA, 18 bp, Homo sapiens
cttttcatacattttcta

SEQ ID NO: 2412436 - DNA, 14 bp, Homo sapiens
cttttcccaaccat

SEQ ID NO: 2412437 - DNA, 20 bp, Homo sapiens
ctttttgggagagacttgtt

SEQ ID NO: 2412438 - DNA, 14 bp, Homo sapiens
gaaaaaatatatat

SEQ ID NO: 2412439 - DNA, 12 bp, Homo sapiens
gaaaaatgtagg

SEQ ID NO: 2412440 - DNA, 18 bp, Homo sapiens
gaaaacttgtattatgtg

SEQ ID NO: 2412441 - DNA, 13 bp, Homo sapiens
gaaaataaagaat

SEQ ID NO: 2412442 - DNA, 19 bp, Homo sapiens
gaaaataacaataaaagac

SEQ ID NO: 2412443 - DNA, 19 bp, Homo sapiens
gaaaataacgataaaagac

SEQ ID NO: 2412444 - DNA, 17 bp, Homo sapiens
gaaaataagagctcagg

SEQ ID NO: 2412445 - DNA, 19 bp, Homo sapiens
gaaaatcttataatttaaa

SEQ ID NO: 2412446 - DNA, 20 bp, Homo sapiens
gaaaatcttataatttaaaa

SEQ ID NO: 2412447 - DNA, 11 bp, Homo sapiens
gaaaatgctga

SEQ ID NO: 2412448 - DNA, 16 bp, Homo sapiens
gaaacactttgcataa

SEQ ID NO: 2412449 - DNA, 20 bp, Homo sapiens
gaaactaggtgcatatttat

SEQ ID NO: 2412450 - DNA, 16 bp, Homo sapiens
gaaagacagcttctca

SEQ ID NO: 2412451 - DNA, 17 bp, Homo sapiens
gaaagcatttgaatgca

SEQ ID NO: 2412452 - DNA, 16 bp, Homo sapiens
gaaaggaagctgtgcg

SEQ ID NO: 2412453 - DNA, 12 bp, Homo sapiens
gaaagggatttt

SEQ ID NO: 2412454 - DNA, 17 bp, Homo sapiens
gaaatactactgtgtaa

SEQ ID NO: 2412455 - DNA, 15 bp, Homo sapiens
gaaatggttgtatta

SEQ ID NO: 2412456 - DNA, 17 bp, Homo sapiens
gaaatggttgtattaga

SEQ ID NO: 2412457 - DNA, 18 bp, Homo sapiens
gaaatggttgtattagat

SEQ ID NO: 2412458 - DNA, 23 bp, Homo sapiens
gaaattagtactcccctccttga

SEQ ID NO: 2412459 - DNA, 14 bp, Homo sapiens
gaacatcacagctt

SEQ ID NO: 2412460 - DNA, 17 bp, Homo sapiens
gaacatcacattcctct

SEQ ID NO: 2412461 - DNA, 17 bp, Homo sapiens
gaactaggctgagcaat

SEQ ID NO: 2412462 - DNA, 17 bp, Homo sapiens
gaactgtctctcatgaa

SEQ ID NO: 2412463 - DNA, 24 bp, Homo sapiens
gaactttccacattcagagcttac

SEQ ID NO: 2412464 - DNA, 10 bp, Homo sapiens
gaagacagtg

SEQ ID NO: 2412465 - DNA, 15 bp, Homo sapiens
gaagagatttttcat

SEQ ID NO: 2412466 - DNA, 18 bp, Homo sapiens
gaagagatttttcatgat

SEQ ID NO: 2412467 - DNA, 17 bp, Homo sapiens
gaagattgagatgtgtt

SEQ ID NO: 2412468 - DNA, 20 bp, Homo sapiens
gaagcaatgcttcatccctt

SEQ ID NO: 2412469 - DNA, 14 bp, Homo sapiens
gaagcccctgggcc

SEQ ID NO: 2412470 - DNA, 19 bp, Homo sapiens
gaagctgtgcgtgtgtgtg

SEQ ID NO: 2412471 - DNA, 18 bp, Homo sapiens
gaagcttttatgtgaaac

SEQ ID NO: 2412472 - DNA, 15 bp, Homo sapiens
gaagggaagagacag

SEQ ID NO: 2412473 - DNA, 20 bp, Homo sapiens
gaaggtgaaacattttctcc

SEQ ID NO: 2412474 - DNA, 21 bp, Homo sapiens
gaaggtgaggagcttgaaacc

SEQ ID NO: 2412475 - DNA, 14 bp, Homo sapiens
gaagtttgaatgtt

SEQ ID NO: 2412476 - DNA, 16 bp, Homo sapiens
gaagtttgaatgttaa

SEQ ID NO: 2412477 - DNA, 17 bp, Homo sapiens
gaagtttgaatgttaaa

SEQ ID NO: 2412478 - DNA, 16 bp, Homo sapiens
gaataggcgatcacaa

SEQ ID NO: 2412479 - DNA, 23 bp, Homo sapiens
gaataggcgatcacaacgtgcat

SEQ ID NO: 2412480 - DNA, 10 bp, Homo sapiens
gaatatttga

SEQ ID NO: 2412481 - DNA, 11 bp, Homo sapiens
gaatatttgaa

SEQ ID NO: 2412482 - DNA, 18 bp, Homo sapiens
gaatatttgaatcttgtc

SEQ ID NO: 2412483 - DNA, 22 bp, Homo sapiens
gaatatttgaatcttgtctcaa

SEQ ID NO: 2412484 - DNA, 15 bp, Homo sapiens
gaatcttgtctcaat

SEQ ID NO: 2412485 - DNA, 21 bp, Homo sapiens
gaatcttgtctcaatgctcat

SEQ ID NO: 2412486 - DNA, 22 bp, Homo sapiens
gaatcttgtctcaatgctcata

SEQ ID NO: 2412487 - DNA, 17 bp, Homo sapiens
gaatgtaaatttgtact

SEQ ID NO: 2412488 - DNA, 19 bp, Homo sapiens
gaattataactggaaagaa

SEQ ID NO: 2412489 - DNA, 16 bp, Homo sapiens
gaatttaaatcactca

SEQ ID NO: 2412490 - DNA, 15 bp, Homo sapiens
gaattttttttaaca

SEQ ID NO: 2412491 - DNA, 14 bp, Homo sapiens
gacacagttcctgg

SEQ ID NO: 2412492 - DNA, 19 bp, Homo sapiens
gacagccaactatggcctg

SEQ ID NO: 2412493 - DNA, 22 bp, Homo sapiens
gacagccaactatggcctgtgg

SEQ ID NO: 2412494 - DNA, 22 bp, Homo sapiens
gacagcccaggatactggcaca

SEQ ID NO: 2412495 - DNA, 23 bp, Homo sapiens
gacagcccaggatactggcacag

SEQ ID NO: 2412496 - DNA, 21 bp, Homo sapiens
gacagcttctcatcctgcagg

SEQ ID NO: 2412497 - DNA, 22 bp, Homo sapiens
gacagcttctcatcctgcaggc

SEQ ID NO: 2412498 - DNA, 17 bp, Homo sapiens
gacagggtttcaccatg

SEQ ID NO: 2412499 - DNA, 16 bp, Homo sapiens
gaccattgtctcagag

SEQ ID NO: 2412500 - DNA, 22 bp, Homo sapiens
gacccgttcaacttttcctttg

SEQ ID NO: 2412501 - DNA, 18 bp, Homo sapiens
gaccctatgggtctagga

SEQ ID NO: 2412502 - DNA, 20 bp, Homo sapiens
gacccttattgctgtcctgg

SEQ ID NO: 2412503 - DNA, 19 bp, Homo sapiens
gacccttcccttgagccct

SEQ ID NO: 2412504 - DNA, 12 bp, Homo sapiens
gacctgaagaat

SEQ ID NO: 2412505 - DNA, 23 bp, Homo sapiens
gacctgatttctgagcatttaat

SEQ ID NO: 2412506 - DNA, 17 bp, Homo sapiens
gactaaaagatataagt

SEQ ID NO: 2412507 - DNA, 20 bp, Homo sapiens
gactaaaagatataagtgct

SEQ ID NO: 2412508 - DNA, 22 bp, Homo sapiens
gactaaaagatataagtgctgt

SEQ ID NO: 2412509 - DNA, 23 bp, Homo sapiens
gactaggccttgcggctcctcag

SEQ ID NO: 2412510 - DNA, 19 bp, Homo sapiens
gactcaggtggccctactg

SEQ ID NO: 2412511 - DNA, 17 bp, Homo sapiens
gactcatctttccctcc

SEQ ID NO: 2412512 - DNA, 19 bp, Homo sapiens
gactcatctttccctcctt

SEQ ID NO: 2412513 - DNA, 13 bp, Homo sapiens
gactgagaaattt

SEQ ID NO: 2412514 - DNA, 12 bp, Homo sapiens
gactgccaagcc

SEQ ID NO: 2412515 - DNA, 16 bp, Homo sapiens
gactggatagtccgtc

SEQ ID NO: 2412516 - DNA, 17 bp, Homo sapiens
gactggatagtccgtct

SEQ ID NO: 2412517 - DNA, 22 bp, Homo sapiens
gactggatagtccgtctctgct

SEQ ID NO: 2412518 - DNA, 14 bp, Homo sapiens
gactgtgtgctcag

SEQ ID NO: 2412519 - DNA, 16 bp, Homo sapiens
gactgtgtgctcagga

SEQ ID NO: 2412520 - DNA, 22 bp, Homo sapiens
gactgtgtgctcaggagccctg

SEQ ID NO: 2412521 - DNA, 18 bp, Homo sapiens
gagaagccaaaagattgg

SEQ ID NO: 2412522 - DNA, 13 bp, Homo sapiens
gagacagcccagg

SEQ ID NO: 2412523 - DNA, 19 bp, Homo sapiens
gagacagcttgatcaaagg

SEQ ID NO: 2412524 - DNA, 16 bp, Homo sapiens
gagactgtttggaaat

SEQ ID NO: 2412525 - DNA, 11 bp, Homo sapiens
gagacttgttt

SEQ ID NO: 2412526 - DNA, 14 bp, Homo sapiens
gagagcatcaggcc

SEQ ID NO: 2412527 - DNA, 19 bp, Homo sapiens
gagagccctgaggcctaga

SEQ ID NO: 2412528 - DNA, 20 bp, Homo sapiens
gagagtggctggggcatgga

SEQ ID NO: 2412529 - DNA, 21 bp, Homo sapiens
gagccagcagcctggctctcc

SEQ ID NO: 2412530 - DNA, 16 bp, Homo sapiens
gagccccaccctcaga

SEQ ID NO: 2412531 - DNA, 17 bp, Homo sapiens
gagccctgaggcctaga

SEQ ID NO: 2412532 - DNA, 11 bp, Homo sapiens
gagctcaggat

SEQ ID NO: 2412533 - DNA, 17 bp, Homo sapiens
gagctcttcatgtttca

SEQ ID NO: 2412534 - DNA, 17 bp, Homo sapiens
gagctcttgtgaggaaa

SEQ ID NO: 2412535 - DNA, 17 bp, Homo sapiens
gagctggacctcaccaa

SEQ ID NO: 2412536 - DNA, 19 bp, Homo sapiens
gagctgggcagaaggccaa

SEQ ID NO: 2412537 - DNA, 17 bp, Homo sapiens
gaggcacatgtcagcaa

SEQ ID NO: 2412538 - DNA, 20 bp, Homo sapiens
gaggcccctgtctcagggtg

SEQ ID NO: 2412539 - DNA, 20 bp, Homo sapiens
gaggcccgcatgcggcccag

SEQ ID NO: 2412540 - DNA, 19 bp, Homo sapiens
gaggcctgactgccaagcc

SEQ ID NO: 2412541 - DNA, 22 bp, Homo sapiens
gaggcctttccctaagccagct

SEQ ID NO: 2412542 - DNA, 21 bp, Homo sapiens
gaggcgcatgaatttgtgaag

SEQ ID NO: 2412543 - DNA, 20 bp, Homo sapiens
gaggctctggagcccactgt

SEQ ID NO: 2412544 - DNA, 22 bp, Homo sapiens
gagggagcaagtccttcccttt

SEQ ID NO: 2412545 - DNA, 19 bp, Homo sapiens
gaggtccttaggcctctga

SEQ ID NO: 2412546 - DNA, 21 bp, Homo sapiens
gaggtccttaggcctctgaga

SEQ ID NO: 2412547 - DNA, 18 bp, Homo sapiens
gagtaaagaattattttg

SEQ ID NO: 2412548 - DNA, 13 bp, Homo sapiens
gagtggctggggc

SEQ ID NO: 2412549 - DNA, 14 bp, Homo sapiens
gagttcctgcatgc

SEQ ID NO: 2412550 - DNA, 15 bp, Homo sapiens
gagttgtgggtagtg

SEQ ID NO: 2412551 - DNA, 20 bp, Homo sapiens
gataagatcttttattttgc

SEQ ID NO: 2412552 - DNA, 16 bp, Homo sapiens
gatactggcacagagg

SEQ ID NO: 2412553 - DNA, 14 bp, Homo sapiens
gatataagtgctgt

SEQ ID NO: 2412554 - DNA, 14 bp, Homo sapiens
gatatctcatctct

SEQ ID NO: 2412555 - DNA, 18 bp, Homo sapiens
gatatttttccatttttt

SEQ ID NO: 2412556 - DNA, 17 bp, Homo sapiens
gatcaaaggcacacagc

SEQ ID NO: 2412557 - DNA, 16 bp, Homo sapiens
gatcacaacgtgcatt

SEQ ID NO: 2412558 - DNA, 20 bp, Homo sapiens
gatcacaacgtgcattgtgc

SEQ ID NO: 2412559 - DNA, 18 bp, Homo sapiens
gatcagccagtgaccaac

SEQ ID NO: 2412560 - DNA, 14 bp, Homo sapiens
gatcattgtgaaat

SEQ ID NO: 2412561 - DNA, 21 bp, Homo sapiens
gatccacccgcctcagcctcc

SEQ ID NO: 2412562 - DNA, 18 bp, Homo sapiens
gatccccacgccacagcc

SEQ ID NO: 2412563 - DNA, 15 bp, Homo sapiens
gatgaaaataaagaa

SEQ ID NO: 2412564 - DNA, 14 bp, Homo sapiens
gatgactatggaaa

SEQ ID NO: 2412565 - DNA, 20 bp, Homo sapiens
gatgatccccacgccacagc

SEQ ID NO: 2412566 - DNA, 22 bp, Homo sapiens
gatgcagtgctcgctgttgctg

SEQ ID NO: 2412567 - DNA, 21 bp, Homo sapiens
gatgcctggcggggtggggtg

SEQ ID NO: 2412568 - DNA, 12 bp, Homo sapiens
gatgtaaagtga

SEQ ID NO: 2412569 - DNA, 21 bp, Homo sapiens
gatgttctctatcatttaata

SEQ ID NO: 2412570 - DNA, 14 bp, Homo sapiens
gattacaggcgtga

SEQ ID NO: 2412571 - DNA, 14 bp, Homo sapiens
gattacattttaaa

SEQ ID NO: 2412572 - DNA, 13 bp, Homo sapiens
gattatgggtcac

SEQ ID NO: 2412573 - DNA, 17 bp, Homo sapiens
gattgtgtcccattccc

SEQ ID NO: 2412574 - DNA, 20 bp, Homo sapiens
gattgtgtcccattccccca

SEQ ID NO: 2412575 - DNA, 15 bp, Homo sapiens
gattgttcctgcttt

SEQ ID NO: 2412576 - DNA, 14 bp, Homo sapiens
gatttttacacatg

SEQ ID NO: 2412577 - DNA, 16 bp, Homo sapiens
gcaaagatatctcatc

SEQ ID NO: 2412578 - DNA, 17 bp, Homo sapiens
gcaacctccacctcctg

SEQ ID NO: 2412579 - DNA, 22 bp, Homo sapiens
gcaactttgtataaaagggact

SEQ ID NO: 2412580 - DNA, 19 bp, Homo sapiens
gcaagcctaagggatcctg

SEQ ID NO: 2412581 - DNA, 17 bp, Homo sapiens
gcacatgtcttaatgaa

SEQ ID NO: 2412582 - DNA, 20 bp, Homo sapiens
gcacatgtcttaatgaagtt

SEQ ID NO: 2412583 - DNA, 22 bp, Homo sapiens
gcacatgtcttaatgaagtttg

SEQ ID NO: 2412584 - DNA, 18 bp, Homo sapiens
gcaccactgtgtatttaa

SEQ ID NO: 2412585 - DNA, 18 bp, Homo sapiens
gcaccatgctgctgggga

SEQ ID NO: 2412586 - DNA, 19 bp, Homo sapiens
gcacctgtcccagaaaaag

SEQ ID NO: 2412587 - DNA, 17 bp, Homo sapiens
gcactgatgttgtgttt

SEQ ID NO: 2412588 - DNA, 18 bp, Homo sapiens
gcactgatgttgtgtttt

SEQ ID NO: 2412589 - DNA, 14 bp, Homo sapiens
gcactgtaaaatgt

SEQ ID NO: 2412590 - DNA, 20 bp, Homo sapiens
gcactttagaatatgccttg

SEQ ID NO: 2412591 - DNA, 15 bp, Homo sapiens
gcagctctccccttc

SEQ ID NO: 2412592 - DNA, 10 bp, Homo sapiens
gcaggtccct

SEQ ID NO: 2412593 - DNA, 19 bp, Homo sapiens
gcaggtccctaataaagct

SEQ ID NO: 2412594 - DNA, 13 bp, Homo sapiens
gcataaattattg

SEQ ID NO: 2412595 - DNA, 15 bp, Homo sapiens
gcatatctgccttta

SEQ ID NO: 2412596 - DNA, 23 bp, Homo sapiens
gcatattattttatgttgcatag

SEQ ID NO: 2412597 - DNA, 13 bp, Homo sapiens
gcatcatggctat

SEQ ID NO: 2412598 - DNA, 16 bp, Homo sapiens
gcatccattctcctga

SEQ ID NO: 2412599 - DNA, 17 bp, Homo sapiens
gcatccattctcctgag

SEQ ID NO: 2412600 - DNA, 15 bp, Homo sapiens
gcatgaatttgtgaa

SEQ ID NO: 2412601 - DNA, 21 bp, Homo sapiens
gcatggaaggcaagattgtgt

SEQ ID NO: 2412602 - DNA, 16 bp, Homo sapiens
gcattgagcttgcatg

SEQ ID NO: 2412603 - DNA, 12 bp, Homo sapiens
gcatttgaatgc

SEQ ID NO: 2412604 - DNA, 13 bp, Homo sapiens
gcatttgaatgca

SEQ ID NO: 2412605 - DNA, 21 bp, Homo sapiens
gccaagccatgggtagcctgg

SEQ ID NO: 2412606 - DNA, 14 bp, Homo sapiens
gccaattatgttaa

SEQ ID NO: 2412607 - DNA, 17 bp, Homo sapiens
gccaattatgttaaact

SEQ ID NO: 2412608 - DNA, 19 bp, Homo sapiens
gccaattatgttaaactag

SEQ ID NO: 2412609 - DNA, 21 bp, Homo sapiens
gccagccacggggactcagcc

SEQ ID NO: 2412610 - DNA, 23 bp, Homo sapiens
gccaggctgggtcgccctggact

SEQ ID NO: 2412611 - DNA, 13 bp, Homo sapiens
gccagttgtcctc

SEQ ID NO: 2412612 - DNA, 22 bp, Homo sapiens
gccatattgcacatgtcttaat

SEQ ID NO: 2412613 - DNA, 15 bp, Homo sapiens
gcccactgtacttgc

SEQ ID NO: 2412614 - DNA, 20 bp, Homo sapiens
gcccactgtacttgctcttg

SEQ ID NO: 2412615 - DNA, 15 bp, Homo sapiens
gcccaggatactggc

SEQ ID NO: 2412616 - DNA, 20 bp, Homo sapiens
gcccaggatactggcacaga

SEQ ID NO: 2412617 - DNA, 22 bp, Homo sapiens
gcccatctgggggcctcttctg

SEQ ID NO: 2412618 - DNA, 17 bp, Homo sapiens
gccccatcagctccagc

SEQ ID NO: 2412619 - DNA, 22 bp, Homo sapiens
gcccccaaccatttcctcagac

SEQ ID NO: 2412620 - DNA, 18 bp, Homo sapiens
gcccctgcctctctgcag

SEQ ID NO: 2412621 - DNA, 18 bp, Homo sapiens
gcccctttgctgaccctc

SEQ ID NO: 2412622 - DNA, 20 bp, Homo sapiens
gccctgaggcctagactctg

SEQ ID NO: 2412623 - DNA, 21 bp, Homo sapiens
gccctgcaccatgctgctggg

SEQ ID NO: 2412624 - DNA, 13 bp, Homo sapiens
gccctgctgccct

SEQ ID NO: 2412625 - DNA, 15 bp, Homo sapiens
gccctgctgccctcc

SEQ ID NO: 2412626 - DNA, 13 bp, Homo sapiens
gccctgggaggct

SEQ ID NO: 2412627 - DNA, 13 bp, Homo sapiens
gcctagactctgt

SEQ ID NO: 2412628 - DNA, 13 bp, Homo sapiens
gcctagaggcctg

SEQ ID NO: 2412629 - DNA, 14 bp, Homo sapiens
gcctctctgcaggt

SEQ ID NO: 2412630 - DNA, 18 bp, Homo sapiens
gcctctctgcaggtccct

SEQ ID NO: 2412631 - DNA, 19 bp, Homo sapiens
gcctctctgcaggtcccta

SEQ ID NO: 2412632 - DNA, 21 bp, Homo sapiens
gcctctctgcaggtccctaat

SEQ ID NO: 2412633 - DNA, 13 bp, Homo sapiens
gcctctgagagca

SEQ ID NO: 2412634 - DNA, 11 bp, Homo sapiens
ctgagaaattt

SEQ ID NO: 2412635 - DNA, 14 bp, Homo sapiens
ctgagaaatttata

SEQ ID NO: 2412636 - DNA, 20 bp, Homo sapiens
ctgagacaaatggaggcctg

SEQ ID NO: 2412637 - DNA, 22 bp, Homo sapiens
ctgagagcatcaggcctagagg

SEQ ID NO: 2412638 - DNA, 17 bp, Homo sapiens
ctgagcaatctgaccct

SEQ ID NO: 2412639 - DNA, 16 bp, Homo sapiens
ctgagccagtgtcagg

SEQ ID NO: 2412640 - DNA, 13 bp, Homo sapiens
ctgatgaaaataa

SEQ ID NO: 2412641 - DNA, 16 bp, Homo sapiens
ctgatgaaaataaaga

SEQ ID NO: 2412642 - DNA, 19 bp, Homo sapiens
ctgatgaaaataaagaatg

SEQ ID NO: 2412643 - DNA, 20 bp, Homo sapiens
ctgcaccatgctgctgggga

SEQ ID NO: 2412644 - DNA, 16 bp, Homo sapiens
ctgcactgtaaaatgt

SEQ ID NO: 2412645 - DNA, 18 bp, Homo sapiens
ctgcactgtaaaatgtgg

SEQ ID NO: 2412646 - DNA, 15 bp, Homo sapiens
ctgcaggcaggaaca

SEQ ID NO: 2412647 - DNA, 19 bp, Homo sapiens
ctgcaggtccctaataaag

SEQ ID NO: 2412648 - DNA, 21 bp, Homo sapiens
ctgcaggtccctaataaagct

SEQ ID NO: 2412649 - DNA, 22 bp, Homo sapiens
ctgcaggtccctaataaagctg

SEQ ID NO: 2412650 - DNA, 23 bp, Homo sapiens
ctgcaggtccctaataaagctgt

SEQ ID NO: 2412651 - DNA, 21 bp, Homo sapiens
ctgcagttttgctatctgggc

SEQ ID NO: 2412652 - DNA, 22 bp, Homo sapiens
ctgcagttttgctatctgggct

SEQ ID NO: 2412653 - DNA, 21 bp, Homo sapiens
ctgcatctagaggcttccttc

SEQ ID NO: 2412654 - DNA, 14 bp, Homo sapiens
ctgcctctctgcag

SEQ ID NO: 2412655 - DNA, 16 bp, Homo sapiens
ctgcctctctgcaggt

SEQ ID NO: 2412656 - DNA, 19 bp, Homo sapiens
ctgcctctctgcaggtccc

SEQ ID NO: 2412657 - DNA, 22 bp, Homo sapiens
ctgcctgctttttatggcctgt

SEQ ID NO: 2412658 - DNA, 17 bp, Homo sapiens
ctgcctttattgtgttt

SEQ ID NO: 2412659 - DNA, 24 bp, Homo sapiens
ctgcctttattgtgtttgtcatta

SEQ ID NO: 2412660 - DNA, 15 bp, Homo sapiens
ctgctcagccctgca

SEQ ID NO: 2412661 - DNA, 20 bp, Homo sapiens
ctgctggggaagacagtggc

SEQ ID NO: 2412662 - DNA, 22 bp, Homo sapiens
ctgctggggaagacagtggccc

SEQ ID NO: 2412663 - DNA, 16 bp, Homo sapiens
ctggaactgtctctca

SEQ ID NO: 2412664 - DNA, 18 bp, Homo sapiens
ctggaactgtctctcatg

SEQ ID NO: 2412665 - DNA, 16 bp, Homo sapiens
ctggaagagcagccct

SEQ ID NO: 2412666 - DNA, 20 bp, Homo sapiens
ctggaagtgctaattttgaa

SEQ ID NO: 2412667 - DNA, 21 bp, Homo sapiens
ctggaagtgctaattttgaaa

SEQ ID NO: 2412668 - DNA, 13 bp, Homo sapiens
ctggaatttgaaa

SEQ ID NO: 2412669 - DNA, 16 bp, Homo sapiens
ctggacttgcctctgc

SEQ ID NO: 2412670 - DNA, 15 bp, Homo sapiens
ctggagatcaccagt

SEQ ID NO: 2412671 - DNA, 13 bp, Homo sapiens
ctggagcccactg

SEQ ID NO: 2412672 - DNA, 20 bp, Homo sapiens
ctggagcccactgtacttgc

SEQ ID NO: 2412673 - DNA, 21 bp, Homo sapiens
ctggagcccactgtacttgct

SEQ ID NO: 2412674 - DNA, 14 bp, Homo sapiens
ctggagtgcagtgg

SEQ ID NO: 2412675 - DNA, 17 bp, Homo sapiens
ctggattatattatgaa

SEQ ID NO: 2412676 - DNA, 15 bp, Homo sapiens
ctggatttttaccag

SEQ ID NO: 2412677 - DNA, 23 bp, Homo sapiens
ctgggaacatcacattcctctgc

SEQ ID NO: 2412678 - DNA, 17 bp, Homo sapiens
ctgggagaaatgaaaaa

SEQ ID NO: 2412679 - DNA, 15 bp, Homo sapiens
ctgggaggctctgga

SEQ ID NO: 2412680 - DNA, 14 bp, Homo sapiens
ctgggcagaaggcc

SEQ ID NO: 2412681 - DNA, 16 bp, Homo sapiens
ctgggcagaaggccaa

SEQ ID NO: 2412682 - DNA, 12 bp, Homo sapiens
ctgggcccctgc

SEQ ID NO: 2412683 - DNA, 16 bp, Homo sapiens
ctggggaagacagtgg

SEQ ID NO: 2412684 - DNA, 15 bp, Homo sapiens
ctggggccaggctgg

SEQ ID NO: 2412685 - DNA, 16 bp, Homo sapiens
ctgggggcctcttctg

SEQ ID NO: 2412686 - DNA, 16 bp, Homo sapiens
ctgggtcgccctggac

SEQ ID NO: 2412687 - DNA, 19 bp, Homo sapiens
ctggtctcaaactcctgac

SEQ ID NO: 2412688 - DNA, 17 bp, Homo sapiens
ctggttgggcagccaga

SEQ ID NO: 2412689 - DNA, 18 bp, Homo sapiens
ctgtaaggcaatcatggt

SEQ ID NO: 2412690 - DNA, 14 bp, Homo sapiens
ctgtaatgttaata

SEQ ID NO: 2412691 - DNA, 19 bp, Homo sapiens
ctgtaatgttaatattgat

SEQ ID NO: 2412692 - DNA, 21 bp, Homo sapiens
ctgtacttgctcttgatgcct

SEQ ID NO: 2412693 - DNA, 19 bp, Homo sapiens
ctgtagaaatggttgtatt

SEQ ID NO: 2412694 - DNA, 17 bp, Homo sapiens
ctgtataaaatcagcca

SEQ ID NO: 2412695 - DNA, 22 bp, Homo sapiens
ctgtcatatgctctgatttatc

SEQ ID NO: 2412696 - DNA, 15 bp, Homo sapiens
ctgtccaaactgcct

SEQ ID NO: 2412697 - DNA, 20 bp, Homo sapiens
ctgtccaaactgcctaagcc

SEQ ID NO: 2412698 - DNA, 18 bp, Homo sapiens
ctgtcctgacctgtctca

SEQ ID NO: 2412699 - DNA, 16 bp, Homo sapiens
ctgtgtgctcaggagc

SEQ ID NO: 2412700 - DNA, 15 bp, Homo sapiens
ctgtgtggcagtctg

SEQ ID NO: 2412701 - DNA, 17 bp, Homo sapiens
ctgttcatttcctcaaa

SEQ ID NO: 2412702 - DNA, 21 bp, Homo sapiens
ctgttgctaagccccagcaag

SEQ ID NO: 2412703 - DNA, 18 bp, Homo sapiens
ctgttggggtgggtataa

SEQ ID NO: 2412704 - DNA, 12 bp, Homo sapiens
ctgtttaagaga

SEQ ID NO: 2412705 - DNA, 14 bp, Homo sapiens
ctgtttaagagaca

SEQ ID NO: 2412706 - DNA, 22 bp, Homo sapiens
ctgtttggaaattgattttgaa

SEQ ID NO: 2412707 - DNA, 23 bp, Homo sapiens
ctgtttggaaattgattttgaac

SEQ ID NO: 2412708 - DNA, 21 bp, Homo sapiens
ctgtttttcagggaggtggct

SEQ ID NO: 2412709 - DNA, 12 bp, Homo sapiens
cttaaaactcct

SEQ ID NO: 2412710 - DNA, 18 bp, Homo sapiens
cttaatgaagtttgaatg

SEQ ID NO: 2412711 - DNA, 23 bp, Homo sapiens
cttaatgaagtttgaatgttaaa

SEQ ID NO: 2412712 - DNA, 12 bp, Homo sapiens
cttacatgattc

SEQ ID NO: 2412713 - DNA, 18 bp, Homo sapiens
cttacttattatcttcag

SEQ ID NO: 2412714 - DNA, 14 bp, Homo sapiens
cttagaaatttatt

SEQ ID NO: 2412715 - DNA, 20 bp, Homo sapiens
cttagaccaccaagccttga

SEQ ID NO: 2412716 - DNA, 23 bp, Homo sapiens
cttagttcaagtcctgcctctta

SEQ ID NO: 2412717 - DNA, 15 bp, Homo sapiens
cttatcgaaactcat

SEQ ID NO: 2412718 - DNA, 16 bp, Homo sapiens
cttattatttttgaga

SEQ ID NO: 2412719 - DNA, 14 bp, Homo sapiens
cttcagcactttag

SEQ ID NO: 2412720 - DNA, 17 bp, Homo sapiens
cttcagccaggagctgg

SEQ ID NO: 2412721 - DNA, 19 bp, Homo sapiens
cttcaggacactcactaca

SEQ ID NO: 2412722 - DNA, 21 bp, Homo sapiens
cttcattcaagtcagctcttc

SEQ ID NO: 2412723 - DNA, 19 bp, Homo sapiens
cttcattgccttaactgga

SEQ ID NO: 2412724 - DNA, 24 bp, Homo sapiens
cttcatttgggatgctactctagt

SEQ ID NO: 2412725 - DNA, 20 bp, Homo sapiens
cttcctgcaggcaggaacaa

SEQ ID NO: 2412726 - DNA, 16 bp, Homo sapiens
cttccttcatttcctc

SEQ ID NO: 2412727 - DNA, 19 bp, Homo sapiens
agtatttaattagtgctaa

SEQ ID NO: 2412728 - DNA, 15 bp, Homo sapiens
agtcattggctttat

SEQ ID NO: 2412729 - DNA, 22 bp, Homo sapiens
agtccaggcttttttatcatgt

SEQ ID NO: 2412730 - DNA, 21 bp, Homo sapiens
agtcgtgagctcttgtgagga

SEQ ID NO: 2412731 - DNA, 21 bp, Homo sapiens
agtctcacatgattccagcca

SEQ ID NO: 2412732 - DNA, 24 bp, Homo sapiens
agtctcacatgattccagccatca

SEQ ID NO: 2412733 - DNA, 19 bp, Homo sapiens
agtctccaaagtctctgga

SEQ ID NO: 2412734 - DNA, 18 bp, Homo sapiens
agtctgtgagattcattc

SEQ ID NO: 2412735 - DNA, 21 bp, Homo sapiens
agtctgtgagattcattcatg

SEQ ID NO: 2412736 - DNA, 16 bp, Homo sapiens
agtctttcacatttaa

SEQ ID NO: 2412737 - DNA, 20 bp, Homo sapiens
agtgagaccttccttttact

SEQ ID NO: 2412738 - DNA, 17 bp, Homo sapiens
agtgctaagtgtgaact

SEQ ID NO: 2412739 - DNA, 15 bp, Homo sapiens
agtgctcgctgttgc

SEQ ID NO: 2412740 - DNA, 17 bp, Homo sapiens
agtgctcgctgttgctg

SEQ ID NO: 2412741 - DNA, 18 bp, Homo sapiens
agtgctcgctgttgctga

SEQ ID NO: 2412742 - DNA, 17 bp, Homo sapiens
agtgctgtataaaatca

SEQ ID NO: 2412743 - DNA, 15 bp, Homo sapiens
agtggcatcatctca

SEQ ID NO: 2412744 - DNA, 19 bp, Homo sapiens
agtggcatcatctcagctc

SEQ ID NO: 2412745 - DNA, 19 bp, Homo sapiens
agtggcgtgatctcagctc

SEQ ID NO: 2412746 - DNA, 14 bp, Homo sapiens
agtgggagccaggg

SEQ ID NO: 2412747 - DNA, 21 bp, Homo sapiens
agtgggttttttagttgaatt

SEQ ID NO: 2412748 - DNA, 22 bp, Homo sapiens
agtgggttttttagttgaattt

SEQ ID NO: 2412749 - DNA, 23 bp, Homo sapiens
agtgggttttttagttgaatttt

SEQ ID NO: 2412750 - DNA, 14 bp, Homo sapiens
agtgtcaggaggaa

SEQ ID NO: 2412751 - DNA, 21 bp, Homo sapiens
agtgtgtggctttcagagcct

SEQ ID NO: 2412752 - DNA, 21 bp, Homo sapiens
agtgttcataaataaagtttg

SEQ ID NO: 2412753 - DNA, 20 bp, Homo sapiens
agttaacacctttaaagtgt

SEQ ID NO: 2412754 - DNA, 14 bp, Homo sapiens
agttcccctatgtg

SEQ ID NO: 2412755 - DNA, 12 bp, Homo sapiens
agttctgtagaa

SEQ ID NO: 2412756 - DNA, 17 bp, Homo sapiens
agttctttggctgaaag

SEQ ID NO: 2412757 - DNA, 14 bp, Homo sapiens
agttgagacaagaa

SEQ ID NO: 2412758 - DNA, 17 bp, Homo sapiens
agttgagacaagaaaat

SEQ ID NO: 2412759 - DNA, 16 bp, Homo sapiens
agttgcacagctatga

SEQ ID NO: 2412760 - DNA, 18 bp, Homo sapiens
agttgggactacaggcgt

SEQ ID NO: 2412761 - DNA, 16 bp, Homo sapiens
agttggggacacatgt

SEQ ID NO: 2412762 - DNA, 22 bp, Homo sapiens
agtttaatggtgccttcatttg

SEQ ID NO: 2412763 - DNA, 16 bp, Homo sapiens
agtttcgttttcaaaa

SEQ ID NO: 2412764 - DNA, 16 bp, Homo sapiens
agtttgaatgttaaat

SEQ ID NO: 2412765 - DNA, 19 bp, Homo sapiens
agttttggatgcagtgctc

SEQ ID NO: 2412766 - DNA, 16 bp, Homo sapiens
ataaaaaagatcccaa

SEQ ID NO: 2412767 - DNA, 17 bp, Homo sapiens
ataaaaaagatcccaaa

SEQ ID NO: 2412768 - DNA, 16 bp, Homo sapiens
ataaaatcagccaatt

SEQ ID NO: 2412769 - DNA, 15 bp, Homo sapiens
ataaactcatttcta

SEQ ID NO: 2412770 - DNA, 15 bp, Homo sapiens
ataaagcaggcagaa

SEQ ID NO: 2412771 - DNA, 15 bp, Homo sapiens
ataaaggttcatgca

SEQ ID NO: 2412772 - DNA, 21 bp, Homo sapiens
ataaagtatttaattagtgct

SEQ ID NO: 2412773 - DNA, 13 bp, Homo sapiens
ataaataaaaata

SEQ ID NO: 2412774 - DNA, 19 bp, Homo sapiens
ataaataaagtttgttgaa

SEQ ID NO: 2412775 - DNA, 19 bp, Homo sapiens
ataaattattgtttttctt

SEQ ID NO: 2412776 - DNA, 13 bp, Homo sapiens
ataaattgtatat

SEQ ID NO: 2412777 - DNA, 19 bp, Homo sapiens
ataaattgtatattcactt

SEQ ID NO: 2412778 - DNA, 14 bp, Homo sapiens
ataacgtataaaag

SEQ ID NO: 2412779 - DNA, 17 bp, Homo sapiens
ataagacggatttattt

SEQ ID NO: 2412780 - DNA, 21 bp, Homo sapiens
ataagacggatttatttttcc

SEQ ID NO: 2412781 - DNA, 20 bp, Homo sapiens
ataagatcttttattttgcc

SEQ ID NO: 2412782 - DNA, 19 bp, Homo sapiens
ataagtatttaattcatgt

SEQ ID NO: 2412783 - DNA, 14 bp, Homo sapiens
ataagtgctgtata

SEQ ID NO: 2412784 - DNA, 16 bp, Homo sapiens
ataagtgctgtataaa

SEQ ID NO: 2412785 - DNA, 17 bp, Homo sapiens
ataagtgctgtataaaa

SEQ ID NO: 2412786 - DNA, 18 bp, Homo sapiens
ataagtgctgtataaaat

SEQ ID NO: 2412787 - DNA, 14 bp, Homo sapiens
ataagtttatttct

SEQ ID NO: 2412788 - DNA, 22 bp, Homo sapiens
ataagtttatttcttaaatcta

SEQ ID NO: 2412789 - DNA, 19 bp, Homo sapiens
ataatacttgctttggaaa

SEQ ID NO: 2412790 - DNA, 13 bp, Homo sapiens
ataatatacttgt

SEQ ID NO: 2412791 - DNA, 14 bp, Homo sapiens
ataatatacttgtg

SEQ ID NO: 2412792 - DNA, 18 bp, Homo sapiens
ataatatttttaatatat

SEQ ID NO: 2412793 - DNA, 18 bp, Homo sapiens
ataatcctaaacatatga

SEQ ID NO: 2412794 - DNA, 14 bp, Homo sapiens
ataatgaatacttt

SEQ ID NO: 2412795 - DNA, 22 bp, Homo sapiens
atacagattttgatagcaaagc

SEQ ID NO: 2412796 - DNA, 21 bp, Homo sapiens
atacagttcggtgagctacaa

SEQ ID NO: 2412797 - DNA, 15 bp, Homo sapiens
atactatattttagg

SEQ ID NO: 2412798 - DNA, 20 bp, Homo sapiens
atactctcaccatttggatc

SEQ ID NO: 2412799 - DNA, 13 bp, Homo sapiens
atactggcacaga

SEQ ID NO: 2412800 - DNA, 15 bp, Homo sapiens
atactggcacagagg

SEQ ID NO: 2412801 - DNA, 15 bp, Homo sapiens
atactgttgtgcgca

SEQ ID NO: 2412802 - DNA, 19 bp, Homo sapiens
atacttgaaaattaacatg

SEQ ID NO: 2412803 - DNA, 13 bp, Homo sapiens
atacttgtggact

SEQ ID NO: 2412804 - DNA, 14 bp, Homo sapiens
atacttgtggacta

SEQ ID NO: 2412805 - DNA, 21 bp, Homo sapiens
atacttgtggactaaaagata

SEQ ID NO: 2412806 - DNA, 13 bp, Homo sapiens
atagaagtaaaaa

SEQ ID NO: 2412807 - DNA, 14 bp, Homo sapiens
atagaataaaattt

SEQ ID NO: 2412808 - DNA, 22 bp, Homo sapiens
atagaataaaatttttaatctt

SEQ ID NO: 2412809 - DNA, 16 bp, Homo sapiens
atagagacttgggaat

SEQ ID NO: 2412810 - DNA, 17 bp, Homo sapiens
atagctactaattttaa

SEQ ID NO: 2412811 - DNA, 15 bp, Homo sapiens
ataggtttaataatt

SEQ ID NO: 2412812 - DNA, 16 bp, Homo sapiens
atagttttattaataa

SEQ ID NO: 2412813 - DNA, 15 bp, Homo sapiens
atataagtgattgct

SEQ ID NO: 2412814 - DNA, 20 bp, Homo sapiens
atataagtgctgtataaaat

SEQ ID NO: 2412815 - DNA, 15 bp, Homo sapiens
atataagtgtgtgtt

SEQ ID NO: 2412816 - DNA, 12 bp, Homo sapiens
atataattctta

SEQ ID NO: 2412817 - DNA, 15 bp, Homo sapiens
atatacagctcagaa

SEQ ID NO: 2412818 - DNA, 21 bp, Homo sapiens
atatacttgtggactaaaaga

SEQ ID NO: 2412819 - DNA, 14 bp, Homo sapiens
atatattatctttt

SEQ ID NO: 2412820 - DNA, 16 bp, Homo sapiens
atatattatcttttca

SEQ ID NO: 2412821 - DNA, 18 bp, Homo sapiens
atatattcagcctggctt

SEQ ID NO: 2412822 - DNA, 12 bp, Homo sapiens
atatattttaag

SEQ ID NO: 2412823 - DNA, 13 bp, Homo sapiens
atatattttaaga

SEQ ID NO: 2412824 - DNA, 15 bp, Homo sapiens
atatattttaagacg

SEQ ID NO: 2412825 - DNA, 15 bp, Homo sapiens
atatgggacattttt

SEQ ID NO: 2412826 - DNA, 23 bp, Homo sapiens
atattatgaagcttttatgtgaa

SEQ ID NO: 2412827 - DNA, 15 bp, Homo sapiens
atattattttatgtt

SEQ ID NO: 2412828 - DNA, 19 bp, Homo sapiens
atattgataagatctttta

SEQ ID NO: 2412829 - DNA, 22 bp, Homo sapiens
atattgatccagaaagaaaact

SEQ ID NO: 2412830 - DNA, 16 bp, Homo sapiens
atatttataaaaataa

SEQ ID NO: 2412831 - DNA, 18 bp, Homo sapiens
atatttgaatcttgtctc

SEQ ID NO: 2412832 - DNA, 14 bp, Homo sapiens
atcaaatatattca

SEQ ID NO: 2412833 - DNA, 21 bp, Homo sapiens
atcacaacgtgcattgtgctt

SEQ ID NO: 2412834 - DNA, 13 bp, Homo sapiens
atcaccacagttt

SEQ ID NO: 2412835 - DNA, 23 bp, Homo sapiens
atcactctgttcattcctccagg

SEQ ID NO: 2412836 - DNA, 16 bp, Homo sapiens
atcactgctcacactg

SEQ ID NO: 2412837 - DNA, 15 bp, Homo sapiens
atcagaaatacagat

SEQ ID NO: 2412838 - DNA, 23 bp, Homo sapiens
atcagaaatacagattttgatag

SEQ ID NO: 2412839 - DNA, 15 bp, Homo sapiens
atcagccaattatgt

SEQ ID NO: 2412840 - DNA, 18 bp, Homo sapiens
atcagccaattatgttaa

SEQ ID NO: 2412841 - DNA, 19 bp, Homo sapiens
atcagccaattatgttaaa

SEQ ID NO: 2412842 - DNA, 13 bp, Homo sapiens
atcagccagtgac

SEQ ID NO: 2412843 - DNA, 14 bp, Homo sapiens
atcaggctttctta

SEQ ID NO: 2412844 - DNA, 22 bp, Homo sapiens
atcaggctttcttaaagtgaga

SEQ ID NO: 2412845 - DNA, 19 bp, Homo sapiens
atcatctcagctcactgca

SEQ ID NO: 2412846 - DNA, 14 bp, Homo sapiens
atcattcattttct

SEQ ID NO: 2412847 - DNA, 11 bp, Homo sapiens
tgaatgttaaa

SEQ ID NO: 2412848 - DNA, 15 bp, Homo sapiens
tgaatgttaaataaa

SEQ ID NO: 2412849 - DNA, 22 bp, Homo sapiens
tgaattttttttaacattcctc

SEQ ID NO: 2412850 - DNA, 17 bp, Homo sapiens
tgacatcaccacagttt

SEQ ID NO: 2412851 - DNA, 15 bp, Homo sapiens
tgacatgaagctgtt

SEQ ID NO: 2412852 - DNA, 20 bp, Homo sapiens
tgacctcaagtgatctgccc

SEQ ID NO: 2412853 - DNA, 20 bp, Homo sapiens
tgacctcaggcaatctgccc

SEQ ID NO: 2412854 - DNA, 21 bp, Homo sapiens
tgacctcaggcaatctgcccg

SEQ ID NO: 2412855 - DNA, 20 bp, Homo sapiens
tgactattcttgatgtaaaa

SEQ ID NO: 2412856 - DNA, 16 bp, Homo sapiens
tgactgccaagccatg

SEQ ID NO: 2412857 - DNA, 17 bp, Homo sapiens
tgactggcttcagcaag

SEQ ID NO: 2412858 - DNA, 23 bp, Homo sapiens
tgagacaagaaaataagagctca

SEQ ID NO: 2412859 - DNA, 21 bp, Homo sapiens
tgagagcatcaggcctagagg

SEQ ID NO: 2412860 - DNA, 22 bp, Homo sapiens
tgagagttttggatgcagtgct

SEQ ID NO: 2412861 - DNA, 14 bp, Homo sapiens
tgagatgtgttcac

SEQ ID NO: 2412862 - DNA, 14 bp, Homo sapiens
tgagctacaaatgc

SEQ ID NO: 2412863 - DNA, 18 bp, Homo sapiens
tgagctcttgtgaggaaa

SEQ ID NO: 2412864 - DNA, 17 bp, Homo sapiens
tgaggaaagtcattggc

SEQ ID NO: 2412865 - DNA, 16 bp, Homo sapiens
tgaggcctagactctg

SEQ ID NO: 2412866 - DNA, 17 bp, Homo sapiens
tgagtagaaaggccttt

SEQ ID NO: 2412867 - DNA, 23 bp, Homo sapiens
tgagtagaaaggcctttaaaatt

SEQ ID NO: 2412868 - DNA, 13 bp, Homo sapiens
tgatagcaaagcg

SEQ ID NO: 2412869 - DNA, 17 bp, Homo sapiens
tgatataagtgtgtgtt

SEQ ID NO: 2412870 - DNA, 23 bp, Homo sapiens
tgatataagtgtgtgtttttcat

SEQ ID NO: 2412871 - DNA, 19 bp, Homo sapiens
tgatatgttggtagattct

SEQ ID NO: 2412872 - DNA, 19 bp, Homo sapiens
tgatatttccccatggttt

SEQ ID NO: 2412873 - DNA, 23 bp, Homo sapiens
tgatccagaaagaaaacttgtat

SEQ ID NO: 2412874 - DNA, 11 bp, Homo sapiens
tgatgcctggc

SEQ ID NO: 2412875 - DNA, 20 bp, Homo sapiens
tgatgctacaggatttgaaa

SEQ ID NO: 2412876 - DNA, 23 bp, Homo sapiens
tgatgctacaggatttgaaattg

SEQ ID NO: 2412877 - DNA, 15 bp, Homo sapiens
tgatgtaaaatcttg

SEQ ID NO: 2412878 - DNA, 19 bp, Homo sapiens
tgatgtaaaatcttgtcat

SEQ ID NO: 2412879 - DNA, 21 bp, Homo sapiens
tgatgtaaaatcttgtcatgt

SEQ ID NO: 2412880 - DNA, 19 bp, Homo sapiens
tgattccagccatcacctt

SEQ ID NO: 2412881 - DNA, 16 bp, Homo sapiens
tgattttaataatata

SEQ ID NO: 2412882 - DNA, 11 bp, Homo sapiens
tgattttgaac

SEQ ID NO: 2412883 - DNA, 13 bp, Homo sapiens
tgcaaataaatat

SEQ ID NO: 2412884 - DNA, 23 bp, Homo sapiens
tgcaaataaatatcctttaattg

SEQ ID NO: 2412885 - DNA, 13 bp, Homo sapiens
tgcaacctccacc

SEQ ID NO: 2412886 - DNA, 15 bp, Homo sapiens
tgcaacctccacctc

SEQ ID NO: 2412887 - DNA, 20 bp, Homo sapiens
tgcaacctccacctcctggg

SEQ ID NO: 2412888 - DNA, 21 bp, Homo sapiens
tgcaacctccacctcctgggt

SEQ ID NO: 2412889 - DNA, 20 bp, Homo sapiens
tgcacaccctccagagacaa

SEQ ID NO: 2412890 - DNA, 12 bp, Homo sapiens
tgcacatgtctt

SEQ ID NO: 2412891 - DNA, 14 bp, Homo sapiens
tgcacatgtcttaa

SEQ ID NO: 2412892 - DNA, 13 bp, Homo sapiens
tgcactgatgttg

SEQ ID NO: 2412893 - DNA, 13 bp, Homo sapiens
tgcactgtaaaat

SEQ ID NO: 2412894 - DNA, 15 bp, Homo sapiens
tgcactgtaaaatgt

SEQ ID NO: 2412895 - DNA, 16 bp, Homo sapiens
tgcacttggctgcata

SEQ ID NO: 2412896 - DNA, 20 bp, Homo sapiens
agccctgggaggctctggag

SEQ ID NO: 2412897 - DNA, 18 bp, Homo sapiens
agccctgtctcctctctc

SEQ ID NO: 2412898 - DNA, 14 bp, Homo sapiens
agcccttttgtctc

SEQ ID NO: 2412899 - DNA, 12 bp, Homo sapiens
agcctaagggat

SEQ ID NO: 2412900 - DNA, 13 bp, Homo sapiens
agcctacaggcct

SEQ ID NO: 2412901 - DNA, 23 bp, Homo sapiens
agcctgagtagaaaggcctttaa

SEQ ID NO: 2412902 - DNA, 17 bp, Homo sapiens
agcctggcttcaaattg

SEQ ID NO: 2412903 - DNA, 12 bp, Homo sapiens
agcctgggtgta

SEQ ID NO: 2412904 - DNA, 22 bp, Homo sapiens
agcctgggtgtaaaacctggag

SEQ ID NO: 2412905 - DNA, 13 bp, Homo sapiens
agcctgtttaaga

SEQ ID NO: 2412906 - DNA, 15 bp, Homo sapiens
agcctgtttaagaga

SEQ ID NO: 2412907 - DNA, 14 bp, Homo sapiens
agccttctctgttc

SEQ ID NO: 2412908 - DNA, 19 bp, Homo sapiens
agccttgattggtgttgcc

SEQ ID NO: 2412909 - DNA, 24 bp, Homo sapiens
agcgattctcctgcctcagcctcc

SEQ ID NO: 2412910 - DNA, 20 bp, Homo sapiens
agcgctagaggaagcagcca

SEQ ID NO: 2412911 - DNA, 15 bp, Homo sapiens
agcggcatcaggctt

SEQ ID NO: 2412912 - DNA, 19 bp, Homo sapiens
agctactaattttaaaatg

SEQ ID NO: 2412913 - DNA, 18 bp, Homo sapiens
agctaggaattgtgttta

SEQ ID NO: 2412914 - DNA, 22 bp, Homo sapiens
agctcaactctcttattgcctc

SEQ ID NO: 2412915 - DNA, 22 bp, Homo sapiens
agctcaggatgagggaaaagaa

SEQ ID NO: 2412916 - DNA, 22 bp, Homo sapiens
agctctgaagaactctctggaa

SEQ ID NO: 2412917 - DNA, 13 bp, Homo sapiens
agctcttcatgtt

SEQ ID NO: 2412918 - DNA, 14 bp, Homo sapiens
agctcttctccatc

SEQ ID NO: 2412919 - DNA, 21 bp, Homo sapiens
agctcttgtgaggaaagtcat

SEQ ID NO: 2412920 - DNA, 14 bp, Homo sapiens
agctgccaagagtg

SEQ ID NO: 2412921 - DNA, 16 bp, Homo sapiens
agctgctctgtcttct

SEQ ID NO: 2412922 - DNA, 14 bp, Homo sapiens
agctggagtgcagt

SEQ ID NO: 2412923 - DNA, 15 bp, Homo sapiens
agctggagtgcagtg

SEQ ID NO: 2412924 - DNA, 21 bp, Homo sapiens
agctggctctgtgagggtgct

SEQ ID NO: 2412925 - DNA, 20 bp, Homo sapiens
agctggggccaggctgggtc

SEQ ID NO: 2412926 - DNA, 18 bp, Homo sapiens
agcttcactgtaaaataa

SEQ ID NO: 2412927 - DNA, 19 bp, Homo sapiens
agcttcagccaggagctgg

SEQ ID NO: 2412928 - DNA, 17 bp, Homo sapiens
agcttcagtgctgccga

SEQ ID NO: 2412929 - DNA, 12 bp, Homo sapiens
agcttctccaac

SEQ ID NO: 2412930 - DNA, 15 bp, Homo sapiens
agcttttatgtgaaa

SEQ ID NO: 2412931 - DNA, 23 bp, Homo sapiens
aggaaaccagttaggtctcaata

SEQ ID NO: 2412932 - DNA, 16 bp, Homo sapiens
aggaaagtcattggct

SEQ ID NO: 2412933 - DNA, 19 bp, Homo sapiens
aggaaagtcattggcttta

SEQ ID NO: 2412934 - DNA, 23 bp, Homo sapiens
aggaaagtcattggctttatcct

SEQ ID NO: 2412935 - DNA, 14 bp, Homo sapiens
aggaagcagccaag

SEQ ID NO: 2412936 - DNA, 20 bp, Homo sapiens
aggaattttatttttttctg

SEQ ID NO: 2412937 - DNA, 21 bp, Homo sapiens
aggacacagttcctgggaaca

SEQ ID NO: 2412938 - DNA, 22 bp, Homo sapiens
aggacccttcccttgagccctc

SEQ ID NO: 2412939 - DNA, 21 bp, Homo sapiens
aggactttatagatcagccag

SEQ ID NO: 2412940 - DNA, 20 bp, Homo sapiens
aggagactgtttggaaattg

SEQ ID NO: 2412941 - DNA, 19 bp, Homo sapiens
aggagccctgggaggctct

SEQ ID NO: 2412942 - DNA, 20 bp, Homo sapiens
aggagctgggcagaaggcca

SEQ ID NO: 2412943 - DNA, 17 bp, Homo sapiens
aggatggagccagctct

SEQ ID NO: 2412944 - DNA, 16 bp, Homo sapiens
aggcacatgtcagcaa

SEQ ID NO: 2412945 - DNA, 14 bp, Homo sapiens
aggcattaaatttt

SEQ ID NO: 2412946 - DNA, 15 bp, Homo sapiens
aggcctagaggcctg

SEQ ID NO: 2412947 - DNA, 16 bp, Homo sapiens
aggcctgactgccaag

SEQ ID NO: 2412948 - DNA, 19 bp, Homo sapiens
aggcctgactgccaagcca

SEQ ID NO: 2412949 - DNA, 14 bp, Homo sapiens
aggcctttaaaatt

SEQ ID NO: 2412950 - DNA, 20 bp, Homo sapiens
aggcctttccctaagccagc

SEQ ID NO: 2412951 - DNA, 19 bp, Homo sapiens
aggcgatcacaacgtgcat

SEQ ID NO: 2412952 - DNA, 20 bp, Homo sapiens
aggcgatcacaacgtgcatt

SEQ ID NO: 2412953 - DNA, 18 bp, Homo sapiens
aggcgtgagccaccatgc

SEQ ID NO: 2412954 - DNA, 18 bp, Homo sapiens
aggcgtgagccacctcgc

SEQ ID NO: 2412955 - DNA, 23 bp, Homo sapiens
aggctactgtaaggcaatcatgg

SEQ ID NO: 2412956 - DNA, 13 bp, Homo sapiens
aggctcaaaacag

SEQ ID NO: 2412957 - DNA, 18 bp, Homo sapiens
aggctctggagcccactg

SEQ ID NO: 2412958 - DNA, 22 bp, Homo sapiens
aggctctggagcccactgtact

SEQ ID NO: 2412959 - DNA, 15 bp, Homo sapiens
aggctgctcagggct

SEQ ID NO: 2412960 - DNA, 15 bp, Homo sapiens
aggcttgcctgcagg

SEQ ID NO: 2412961 - DNA, 21 bp, Homo sapiens
aggcttttttatcatgtgaaa

SEQ ID NO: 2412962 - DNA, 13 bp, Homo sapiens
agggaaatttcag

SEQ ID NO: 2412963 - DNA, 14 bp, Homo sapiens
agggaagagacagc

SEQ ID NO: 2412964 - DNA, 16 bp, Homo sapiens
agggaattgcagagta

SEQ ID NO: 2412965 - DNA, 21 bp, Homo sapiens
agggactcatctttccctcct

SEQ ID NO: 2412966 - DNA, 15 bp, Homo sapiens
agggactgagaaatt

SEQ ID NO: 2412967 - DNA, 22 bp, Homo sapiens
agggattttcagccctcagaat

SEQ ID NO: 2412968 - DNA, 21 bp, Homo sapiens
aggggctggggacttgtgtct

SEQ ID NO: 2412969 - DNA, 21 bp, Homo sapiens
agggtttaatccccagtaaaa

SEQ ID NO: 2412970 - DNA, 15 bp, Homo sapiens
aggtatacctcactt

SEQ ID NO: 2412971 - DNA, 11 bp, Homo sapiens
aggtccctaat

SEQ ID NO: 2412972 - DNA, 17 bp, Homo sapiens
aggtccctaataaagct

SEQ ID NO: 2412973 - DNA, 20 bp, Homo sapiens
aggtgcatatttataaaaat

SEQ ID NO: 2412974 - DNA, 20 bp, Homo sapiens
aggtgggaggatgtgaattg

SEQ ID NO: 2412975 - DNA, 17 bp, Homo sapiens
aggttcatgcaaacttt

SEQ ID NO: 2412976 - DNA, 23 bp, Homo sapiens
agtaaaaacaaagaaattatgtg

SEQ ID NO: 2412977 - DNA, 15 bp, Homo sapiens
agtaaagaattattt

SEQ ID NO: 2412978 - DNA, 14 bp, Homo sapiens
agtaactcatctgt

SEQ ID NO: 2412979 - DNA, 21 bp, Homo sapiens
agtaatccaagcaaatgtgaa

SEQ ID NO: 2412980 - DNA, 15 bp, Homo sapiens
agtaatttgtagatt

SEQ ID NO: 2412981 - DNA, 19 bp, Homo sapiens
agtacccgttcacattttt

SEQ ID NO: 2412982 - DNA, 23 bp, Homo sapiens
agtactaactcctaggaaaatac

SEQ ID NO: 2412983 - DNA, 16 bp, Homo sapiens
agtactgggattacag

SEQ ID NO: 2412984 - DNA, 20 bp, Homo sapiens
agtactgggattacaggcgt

SEQ ID NO: 2412985 - DNA, 16 bp, Homo sapiens
agtactttgtgcattc

SEQ ID NO: 2412986 - DNA, 19 bp, Homo sapiens
agtacttttggcattttac

SEQ ID NO: 2412987 - DNA, 13 bp, Homo sapiens
agtagagacaggg

SEQ ID NO: 2412988 - DNA, 22 bp, Homo sapiens
agtcacaaagcccatcataata

SEQ ID NO: 2412989 - DNA, 19 bp, Homo sapiens
agtcctgggattacaggtg

SEQ ID NO: 2412990 - DNA, 22 bp, Homo sapiens
agtctcacatgattccagccat

SEQ ID NO: 2412991 - DNA, 18 bp, Homo sapiens
agtctttcacatttaaat

SEQ ID NO: 2412992 - DNA, 17 bp, Homo sapiens
agtgaaagaaaataaca

SEQ ID NO: 2412993 - DNA, 23 bp, Homo sapiens
agtgaagggaagagacagcccag

SEQ ID NO: 2412994 - DNA, 15 bp, Homo sapiens
agtgctaagtgtgaa

SEQ ID NO: 2412995 - DNA, 18 bp, Homo sapiens
agtgctaagtgtgaactg

SEQ ID NO: 2412996 - DNA, 22 bp, Homo sapiens
agtgctaagtgtgaactggacc

SEQ ID NO: 2412997 - DNA, 20 bp, Homo sapiens
agtgctaattttgaaaaact

SEQ ID NO: 2412998 - DNA, 14 bp, Homo sapiens
agtgctcgctgttg

SEQ ID NO: 2412999 - DNA, 13 bp, Homo sapiens
agtgctgtataaa

SEQ ID NO: 2413000 - DNA, 14 bp, Homo sapiens
agtgctgtataaaa

SEQ ID NO: 2413001 - DNA, 16 bp, Homo sapiens
agtgctgtataaaatc

SEQ ID NO: 2413002 - DNA, 22 bp, Homo sapiens
agtgctgtataaaatcagccaa

SEQ ID NO: 2413003 - DNA, 22 bp, Homo sapiens
agtggaaagacagcttctcatc

SEQ ID NO: 2413004 - DNA, 20 bp, Homo sapiens
agtggcatcatctcagctca

SEQ ID NO: 2413005 - DNA, 19 bp, Homo sapiens
agtggcgcgatctcagctc

SEQ ID NO: 2413006 - DNA, 14 bp, Homo sapiens
agtgggaaaaatgt

SEQ ID NO: 2413007 - DNA, 17 bp, Homo sapiens
agtgggaaaaatgtagg

SEQ ID NO: 2413008 - DNA, 18 bp, Homo sapiens
agtgggaaaaatgtagga

SEQ ID NO: 2413009 - DNA, 19 bp, Homo sapiens
agtgggaaaaatgtaggag

SEQ ID NO: 2413010 - DNA, 12 bp, Homo sapiens
agtgggtttttt

SEQ ID NO: 2413011 - DNA, 22 bp, Homo sapiens
agtgtgaactggaccctgttgc

SEQ ID NO: 2413012 - DNA, 18 bp, Homo sapiens
agtgtgtgtttttcataa

SEQ ID NO: 2413013 - DNA, 12 bp, Homo sapiens
agttagactgtt

SEQ ID NO: 2413014 - DNA, 20 bp, Homo sapiens
agttattatatttacaaatg

SEQ ID NO: 2413015 - DNA, 13 bp, Homo sapiens
agttcctgggaac

SEQ ID NO: 2413016 - DNA, 13 bp, Homo sapiens
agttctgtagaaa

SEQ ID NO: 2413017 - DNA, 15 bp, Homo sapiens
agttctgtagaaatg

SEQ ID NO: 2413018 - DNA, 16 bp, Homo sapiens
agttctgtagaaatgg

SEQ ID NO: 2413019 - DNA, 18 bp, Homo sapiens
agttctgtagaaatggtt

SEQ ID NO: 2413020 - DNA, 22 bp, Homo sapiens
agttgaaaatcttataatttaa

SEQ ID NO: 2413021 - DNA, 10 bp, Homo sapiens
agttgaattt

SEQ ID NO: 2413022 - DNA, 13 bp, Homo sapiens
agttgaatttttt

SEQ ID NO: 2413023 - DNA, 21 bp, Homo sapiens
agttgaattttttttaacatt

SEQ ID NO: 2413024 - DNA, 14 bp, Homo sapiens
agtttaaattgtaa

SEQ ID NO: 2413025 - DNA, 20 bp, Homo sapiens
agtttaaattgtaataggcg

SEQ ID NO: 2413026 - DNA, 15 bp, Homo sapiens
atgagggaaaagaaa

SEQ ID NO: 2413027 - DNA, 17 bp, Homo sapiens
atgatacttgaaaatta

SEQ ID NO: 2413028 - DNA, 19 bp, Homo sapiens
atgatccccacgccacagc

SEQ ID NO: 2413029 - DNA, 13 bp, Homo sapiens
atgattcatttta

SEQ ID NO: 2413030 - DNA, 15 bp, Homo sapiens
atgcacaaattctgt

SEQ ID NO: 2413031 - DNA, 23 bp, Homo sapiens
atgcacaaattctgtctctggat

SEQ ID NO: 2413032 - DNA, 23 bp, Homo sapiens
atgcagtgctcgctgttgctgaa

SEQ ID NO: 2413033 - DNA, 17 bp, Homo sapiens
atgcatacactctcaaa

SEQ ID NO: 2413034 - DNA, 11 bp, Homo sapiens
atgcatatact

SEQ ID NO: 2413035 - DNA, 16 bp, Homo sapiens
atgcatattattttat

SEQ ID NO: 2413036 - DNA, 18 bp, Homo sapiens
atgcattatatcaaatct

SEQ ID NO: 2413037 - DNA, 14 bp, Homo sapiens
atgcattgtcctct

SEQ ID NO: 2413038 - DNA, 22 bp, Homo sapiens
atgcattttgtttggtattgta

SEQ ID NO: 2413039 - DNA, 18 bp, Homo sapiens
atgctacaggatttgaaa

SEQ ID NO: 2413040 - DNA, 16 bp, Homo sapiens
atgctcataacggatc

SEQ ID NO: 2413041 - DNA, 13 bp, Homo sapiens
atgctgatggagc

SEQ ID NO: 2413042 - DNA, 16 bp, Homo sapiens
atgctgctggggaaga

SEQ ID NO: 2413043 - DNA, 17 bp, Homo sapiens
atgctgctggggaagac

SEQ ID NO: 2413044 - DNA, 18 bp, Homo sapiens
atgcttgcataagagctt

SEQ ID NO: 2413045 - DNA, 18 bp, Homo sapiens
atggggtctgtaaaatct

SEQ ID NO: 2413046 - DNA, 22 bp, Homo sapiens
atggtggatgatccccacgcca

SEQ ID NO: 2413047 - DNA, 13 bp, Homo sapiens
atggttgtacata

SEQ ID NO: 2413048 - DNA, 13 bp, Homo sapiens
atggttgtattag

SEQ ID NO: 2413049 - DNA, 15 bp, Homo sapiens
atgtaaaatcttgtc

SEQ ID NO: 2413050 - DNA, 20 bp, Homo sapiens
atgtaaaatcttgtcatgtg

SEQ ID NO: 2413051 - DNA, 22 bp, Homo sapiens
atgtaaaatcttgtcatgtgta

SEQ ID NO: 2413052 - DNA, 23 bp, Homo sapiens
atgtaaaatcttgtcatgtgtat

SEQ ID NO: 2413053 - DNA, 12 bp, Homo sapiens
atgtaaatttgt

SEQ ID NO: 2413054 - DNA, 14 bp, Homo sapiens
atgtaaatttgtac

SEQ ID NO: 2413055 - DNA, 17 bp, Homo sapiens
atgtacatgtactgatt

SEQ ID NO: 2413056 - DNA, 19 bp, Homo sapiens
atgtagcccctctcctgga

SEQ ID NO: 2413057 - DNA, 24 bp, Homo sapiens
atgtattcagctttagtagatatt

SEQ ID NO: 2413058 - DNA, 13 bp, Homo sapiens
atgtcttaatgaa

SEQ ID NO: 2413059 - DNA, 15 bp, Homo sapiens
atgtgaaacatgttt

SEQ ID NO: 2413060 - DNA, 20 bp, Homo sapiens
atgtgaaatttacatcattt

SEQ ID NO: 2413061 - DNA, 14 bp, Homo sapiens
atgtgggattatgg

SEQ ID NO: 2413062 - DNA, 22 bp, Homo sapiens
atgtgggattatgggtcacagg

SEQ ID NO: 2413063 - DNA, 21 bp, Homo sapiens
atgttaaactagcatatctgc

SEQ ID NO: 2413064 - DNA, 13 bp, Homo sapiens
atgttaaataaat

SEQ ID NO: 2413065 - DNA, 17 bp, Homo sapiens
atgttaaataaattgta

SEQ ID NO: 2413066 - DNA, 19 bp, Homo sapiens
atgttaaataaattgtata

SEQ ID NO: 2413067 - DNA, 22 bp, Homo sapiens
atgttaaataaattgtatattc

SEQ ID NO: 2413068 - DNA, 16 bp, Homo sapiens
atgttctctatcattt

SEQ ID NO: 2413069 - DNA, 18 bp, Homo sapiens
atgttctctatcatttaa

SEQ ID NO: 2413070 - DNA, 21 bp, Homo sapiens
atgttctctatcatttaataa

SEQ ID NO: 2413071 - DNA, 15 bp, Homo sapiens
atgttgcatagaata

SEQ ID NO: 2413072 - DNA, 18 bp, Homo sapiens
atgttgcatagaataaaa

SEQ ID NO: 2413073 - DNA, 20 bp, Homo sapiens
atgttgccctgttgctgcct

SEQ ID NO: 2413074 - DNA, 17 bp, Homo sapiens
atgttgtaatatttctt

SEQ ID NO: 2413075 - DNA, 15 bp, Homo sapiens
atgttgtgtttttaa

SEQ ID NO: 2413076 - DNA, 17 bp, Homo sapiens
atgtttagtaatcatat

SEQ ID NO: 2413077 - DNA, 15 bp, Homo sapiens
atgtttttttttaaa

SEQ ID NO: 2413078 - DNA, 17 bp, Homo sapiens
attaatatatattatct

SEQ ID NO: 2413079 - DNA, 17 bp, Homo sapiens
attaatattcctcagtt

SEQ ID NO: 2413080 - DNA, 16 bp, Homo sapiens
attagatgttctctat

SEQ ID NO: 2413081 - DNA, 19 bp, Homo sapiens
attatcaattaccacacca

SEQ ID NO: 2413082 - DNA, 16 bp, Homo sapiens
attatgcattatatca

SEQ ID NO: 2413083 - DNA, 23 bp, Homo sapiens
attatgtgccagatttatgcata

SEQ ID NO: 2413084 - DNA, 15 bp, Homo sapiens
attatgtgtgtttta

SEQ ID NO: 2413085 - DNA, 22 bp, Homo sapiens
attatgttaaactagcatatct

SEQ ID NO: 2413086 - DNA, 15 bp, Homo sapiens
attattacttttgct

SEQ ID NO: 2413087 - DNA, 16 bp, Homo sapiens
attattttatgttgca

SEQ ID NO: 2413088 - DNA, 12 bp, Homo sapiens
attcaataaagt

SEQ ID NO: 2413089 - DNA, 13 bp, Homo sapiens
attcaataaagta

SEQ ID NO: 2413090 - DNA, 14 bp, Homo sapiens
attcaataaagtat

SEQ ID NO: 2413091 - DNA, 17 bp, Homo sapiens
attcaataaagtattta

SEQ ID NO: 2413092 - DNA, 22 bp, Homo sapiens
attcaataaagtatttaattag

SEQ ID NO: 2413093 - DNA, 18 bp, Homo sapiens
attcacatcgcagattct

SEQ ID NO: 2413094 - DNA, 20 bp, Homo sapiens
attcatattttctttcaaaa

SEQ ID NO: 2413095 - DNA, 18 bp, Homo sapiens
attcattttaacatctga

SEQ ID NO: 2413096 - DNA, 17 bp, Homo sapiens
attccagccatcacctt

SEQ ID NO: 2413097 - DNA, 17 bp, Homo sapiens
attccttcagcacttta

SEQ ID NO: 2413098 - DNA, 15 bp, Homo sapiens
attctcaagccctgc

SEQ ID NO: 2413099 - DNA, 24 bp, Homo sapiens
attctgtctctggattatattatg

SEQ ID NO: 2413100 - DNA, 17 bp, Homo sapiens
attcttatttcatgaaa

SEQ ID NO: 2413101 - DNA, 22 bp, Homo sapiens
attcttcttccaacgtggccca

SEQ ID NO: 2413102 - DNA, 16 bp, Homo sapiens
attcttgatgtaaaat

SEQ ID NO: 2413103 - DNA, 21 bp, Homo sapiens
attgagctggacctcaccaag

SEQ ID NO: 2413104 - DNA, 19 bp, Homo sapiens
attgatcggagcctcctct

SEQ ID NO: 2413105 - DNA, 13 bp, Homo sapiens
attgattttgaac

SEQ ID NO: 2413106 - DNA, 16 bp, Homo sapiens
attgcacatgtcttaa

SEQ ID NO: 2413107 - DNA, 20 bp, Homo sapiens
attgcacatgtcttaatgaa

SEQ ID NO: 2413108 - DNA, 14 bp, Homo sapiens
attgctgtcctgga

SEQ ID NO: 2413109 - DNA, 21 bp, Homo sapiens
attggtgttgccagttgtcct

SEQ ID NO: 2413110 - DNA, 15 bp, Homo sapiens
attgtatattcactt

SEQ ID NO: 2413111 - DNA, 11 bp, Homo sapiens
attgtatttat

SEQ ID NO: 2413112 - DNA, 15 bp, Homo sapiens
attgtctgtgaagtg

SEQ ID NO: 2413113 - DNA, 21 bp, Homo sapiens
attgtggggatgatgaaataa

SEQ ID NO: 2413114 - DNA, 16 bp, Homo sapiens
attgtgtttgtcatta

SEQ ID NO: 2413115 - DNA, 22 bp, Homo sapiens
attgtgtttgtcattagcctga

SEQ ID NO: 2413116 - DNA, 15 bp, Homo sapiens
attgttagtttctga

SEQ ID NO: 2413117 - DNA, 12 bp, Homo sapiens
attgttgcatta

SEQ ID NO: 2413118 - DNA, 13 bp, Homo sapiens
atttaactgcctt

SEQ ID NO: 2413119 - DNA, 16 bp, Homo sapiens
atttaataatatactt

SEQ ID NO: 2413120 - DNA, 15 bp, Homo sapiens
atttaattagtgcta

SEQ ID NO: 2413121 - DNA, 16 bp, Homo sapiens
atttaattagtgctaa

SEQ ID NO: 2413122 - DNA, 18 bp, Homo sapiens
atttaattagtgctaagt

SEQ ID NO: 2413123 - DNA, 16 bp, Homo sapiens
atttacaaatgggaaa

SEQ ID NO: 2413124 - DNA, 18 bp, Homo sapiens
atttacatgaattgcatt

SEQ ID NO: 2413125 - DNA, 17 bp, Homo sapiens
atttataaaaataaaaa

SEQ ID NO: 2413126 - DNA, 15 bp, Homo sapiens
atttataaacttttt

SEQ ID NO: 2413127 - DNA, 16 bp, Homo sapiens
atttatgcatattatt

SEQ ID NO: 2413128 - DNA, 12 bp, Homo sapiens
atttattaatat

SEQ ID NO: 2413129 - DNA, 15 bp, Homo sapiens
atttattcaataaag

SEQ ID NO: 2413130 - DNA, 17 bp, Homo sapiens
atttattcatattttct

SEQ ID NO: 2413131 - DNA, 23 bp, Homo sapiens
atttatttcctagttctgtagaa

SEQ ID NO: 2413132 - DNA, 19 bp, Homo sapiens
atttcctatttttggaaga

SEQ ID NO: 2413133 - DNA, 20 bp, Homo sapiens
atttcttgaggtaaaagcat

SEQ ID NO: 2413134 - DNA, 20 bp, Homo sapiens
atttctttttgggagagact

SEQ ID NO: 2413135 - DNA, 18 bp, Homo sapiens
atttcttttttaaatgaa

SEQ ID NO: 2413136 - DNA, 22 bp, Homo sapiens
atttcttttttaaatgaagaaa

SEQ ID NO: 2413137 - DNA, 18 bp, Homo sapiens
atttgaaacactttgcat

SEQ ID NO: 2413138 - DNA, 14 bp, Homo sapiens
atttgaatcagcct

SEQ ID NO: 2413139 - DNA, 14 bp, Homo sapiens
atttgaatcttgtc

SEQ ID NO: 2413140 - DNA, 18 bp, Homo sapiens
atttgaatcttgtctcaa

SEQ ID NO: 2413141 - DNA, 12 bp, Homo sapiens
atttgaatgcat

SEQ ID NO: 2413142 - DNA, 15 bp, Homo sapiens
atttgaatgcatttt

SEQ ID NO: 2413143 - DNA, 15 bp, Homo sapiens
atttggatcctgtgt

SEQ ID NO: 2413144 - DNA, 15 bp, Homo sapiens
atttgtcaacaaagt

SEQ ID NO: 2413145 - DNA, 18 bp, Homo sapiens
atttgtgaaggtggaaat

SEQ ID NO: 2413146 - DNA, 23 bp, Homo sapiens
atttgtgaaggtggaaataaact

SEQ ID NO: 2413147 - DNA, 15 bp, Homo sapiens
attttaataaacact

SEQ ID NO: 2413148 - DNA, 17 bp, Homo sapiens
attttaataaacactct

SEQ ID NO: 2413149 - DNA, 13 bp, Homo sapiens
attttaataatat

SEQ ID NO: 2413150 - DNA, 21 bp, Homo sapiens
attttagccttctctgttcat

SEQ ID NO: 2413151 - DNA, 17 bp, Homo sapiens
attttatagctactaat

SEQ ID NO: 2413152 - DNA, 19 bp, Homo sapiens
attttatagctactaattt

SEQ ID NO: 2413153 - DNA, 22 bp, Homo sapiens
attttcagttattatatttaca

SEQ ID NO: 2413154 - DNA, 16 bp, Homo sapiens
attttctaagaaacat

SEQ ID NO: 2413155 - DNA, 22 bp, Homo sapiens
attttctaagaaacatttatat

SEQ ID NO: 2413156 - DNA, 13 bp, Homo sapiens
cctgggaggctct

SEQ ID NO: 2413157 - DNA, 21 bp, Homo sapiens
cctgggaggctctggagccca

SEQ ID NO: 2413158 - DNA, 22 bp, Homo sapiens
cctggtctggttgggcagccag

SEQ ID NO: 2413159 - DNA, 23 bp, Homo sapiens
cctgtccaaactgcctaagccct

SEQ ID NO: 2413160 - DNA, 16 bp, Homo sapiens
cctgtcggagccctgt

SEQ ID NO: 2413161 - DNA, 17 bp, Homo sapiens
cctgtcggagccctgtc

SEQ ID NO: 2413162 - DNA, 21 bp, Homo sapiens
cctgtcggagccctgtctcct

SEQ ID NO: 2413163 - DNA, 18 bp, Homo sapiens
cctgtggatcaaatccag

SEQ ID NO: 2413164 - DNA, 18 bp, Homo sapiens
cctgtggatgtaaagtga

SEQ ID NO: 2413165 - DNA, 13 bp, Homo sapiens
cctgtgtggagag

SEQ ID NO: 2413166 - DNA, 13 bp, Homo sapiens
cctgttgctaagc

SEQ ID NO: 2413167 - DNA, 14 bp, Homo sapiens
cctgttgctaagcc

SEQ ID NO: 2413168 - DNA, 12 bp, Homo sapiens
cctgtttaagag

SEQ ID NO: 2413169 - DNA, 15 bp, Homo sapiens
cctgtttaagagaca

SEQ ID NO: 2413170 - DNA, 12 bp, Homo sapiens
cctgtttcttcc

SEQ ID NO: 2413171 - DNA, 14 bp, Homo sapiens
ccttaactggagcc

SEQ ID NO: 2413172 - DNA, 17 bp, Homo sapiens
ccttaactggagcccca

SEQ ID NO: 2413173 - DNA, 23 bp, Homo sapiens
ccttaactggagccccatcagct

SEQ ID NO: 2413174 - DNA, 15 bp, Homo sapiens
ccttagaccaccaag

SEQ ID NO: 2413175 - DNA, 18 bp, Homo sapiens
ccttagaccaccaagcct

SEQ ID NO: 2413176 - DNA, 14 bp, Homo sapiens
ccttaggcctctga

SEQ ID NO: 2413177 - DNA, 14 bp, Homo sapiens
ccttagtcacaaag

SEQ ID NO: 2413178 - DNA, 23 bp, Homo sapiens
ccttcattgccttaactggagcc

SEQ ID NO: 2413179 - DNA, 12 bp, Homo sapiens
ccttcatttcct

SEQ ID NO: 2413180 - DNA, 16 bp, Homo sapiens
ccttcccttgagccct

SEQ ID NO: 2413181 - DNA, 20 bp, Homo sapiens
ccttctctacactcttgtaa

SEQ ID NO: 2413182 - DNA, 13 bp, Homo sapiens
ccttctctgttca

SEQ ID NO: 2413183 - DNA, 18 bp, Homo sapiens
ccttctctgttcatttcc

SEQ ID NO: 2413184 - DNA, 21 bp, Homo sapiens
ccttctctgttcatttcctca

SEQ ID NO: 2413185 - DNA, 13 bp, Homo sapiens
ccttgaactagga

SEQ ID NO: 2413186 - DNA, 20 bp, Homo sapiens
ccttgattttagccttctct

SEQ ID NO: 2413187 - DNA, 22 bp, Homo sapiens
ccttggggattcttccatctga

SEQ ID NO: 2413188 - DNA, 20 bp, Homo sapiens
cctttaaaatttttttagaa

SEQ ID NO: 2413189 - DNA, 15 bp, Homo sapiens
cctttattgtgtttg

SEQ ID NO: 2413190 - DNA, 20 bp, Homo sapiens
cctttattgtgtttgtcatt

SEQ ID NO: 2413191 - DNA, 21 bp, Homo sapiens
cctttattgtgtttgtcatta

SEQ ID NO: 2413192 - DNA, 17 bp, Homo sapiens
cctttccctaagccagc

SEQ ID NO: 2413193 - DNA, 16 bp, Homo sapiens
cctttgaatcctctct

SEQ ID NO: 2413194 - DNA, 14 bp, Homo sapiens
cctttgacaaaggt

SEQ ID NO: 2413195 - DNA, 15 bp, Homo sapiens
cctttggcagagttc

SEQ ID NO: 2413196 - DNA, 12 bp, Homo sapiens
ccttttgtctct

SEQ ID NO: 2413197 - DNA, 22 bp, Homo sapiens
cgaaaatcatataatcttacaa

SEQ ID NO: 2413198 - DNA, 15 bp, Homo sapiens
cgaactccttgattt

SEQ ID NO: 2413199 - DNA, 16 bp, Homo sapiens
cgattcaccctgtcca

SEQ ID NO: 2413200 - DNA, 21 bp, Homo sapiens
cgattcaccctgtccaaactg

SEQ ID NO: 2413201 - DNA, 16 bp, Homo sapiens
cgattctcttgcctca

SEQ ID NO: 2413202 - DNA, 13 bp, Homo sapiens
cgcatcagacaga

SEQ ID NO: 2413203 - DNA, 20 bp, Homo sapiens
cgccacagcccttttgtctc

SEQ ID NO: 2413204 - DNA, 16 bp, Homo sapiens
cgccaggatggcgcag

SEQ ID NO: 2413205 - DNA, 14 bp, Homo sapiens
cgcccaggacccca

SEQ ID NO: 2413206 - DNA, 14 bp, Homo sapiens
cgcgatctcagctc

SEQ ID NO: 2413207 - DNA, 16 bp, Homo sapiens
cggatttatttttcca

SEQ ID NO: 2413208 - DNA, 18 bp, Homo sapiens
cgggaattttcatctagg

SEQ ID NO: 2413209 - DNA, 14 bp, Homo sapiens
cgtaaaattaagaa

SEQ ID NO: 2413210 - DNA, 14 bp, Homo sapiens
cgtaagatttcctt

SEQ ID NO: 2413211 - DNA, 15 bp, Homo sapiens
cgtactgcagcctcc

SEQ ID NO: 2413212 - DNA, 21 bp, Homo sapiens
cgtcacccctgtttctggcac

SEQ ID NO: 2413213 - DNA, 15 bp, Homo sapiens
cgtgatctcagctca

SEQ ID NO: 2413214 - DNA, 15 bp, Homo sapiens
cgtgcattgtgcttc

SEQ ID NO: 2413215 - DNA, 15 bp, Homo sapiens
cgtggcccagagaag

SEQ ID NO: 2413216 - DNA, 16 bp, Homo sapiens
cgtggcccagagaagc

SEQ ID NO: 2413217 - DNA, 18 bp, Homo sapiens
cgtggtgcgagtgcgtga

SEQ ID NO: 2413218 - DNA, 17 bp, Homo sapiens
cgtgtccgactcttctg

SEQ ID NO: 2413219 - DNA, 23 bp, Homo sapiens
cgttatctaatagggcaattaat

SEQ ID NO: 2413220 - DNA, 13 bp, Homo sapiens
cgttttcaaaatt

SEQ ID NO: 2413221 - DNA, 23 bp, Homo sapiens
ctaaagtaaaaacaaagaaatta

SEQ ID NO: 2413222 - DNA, 16 bp, Homo sapiens
ctaaataaagatattg

SEQ ID NO: 2413223 - DNA, 20 bp, Homo sapiens
ctaaatatattttaagacga

SEQ ID NO: 2413224 - DNA, 19 bp, Homo sapiens
ctaagaaacatttatattg

SEQ ID NO: 2413225 - DNA, 22 bp, Homo sapiens
ctaagaaacatttatattgata

SEQ ID NO: 2413226 - DNA, 23 bp, Homo sapiens
ctaagcacgggccatatgaataa

SEQ ID NO: 2413227 - DNA, 15 bp, Homo sapiens
ctaagccagctgccc

SEQ ID NO: 2413228 - DNA, 15 bp, Homo sapiens
ctaagccccagcaag

SEQ ID NO: 2413229 - DNA, 17 bp, Homo sapiens
ctaagccccagcaagca

SEQ ID NO: 2413230 - DNA, 19 bp, Homo sapiens
ctaagccccagcaagcaat

SEQ ID NO: 2413231 - DNA, 13 bp, Homo sapiens
ctaataaagctgt

SEQ ID NO: 2413232 - DNA, 17 bp, Homo sapiens
ctaatatgtaaaattac

SEQ ID NO: 2413233 - DNA, 18 bp, Homo sapiens
ctaatcccgattcaccct

SEQ ID NO: 2413234 - DNA, 16 bp, Homo sapiens
ctaattatataatatt

SEQ ID NO: 2413235 - DNA, 11 bp, Homo sapiens
ctaatttttgt

SEQ ID NO: 2413236 - DNA, 23 bp, Homo sapiens
ctacactcttgtaataaaatgtc

SEQ ID NO: 2413237 - DNA, 12 bp, Homo sapiens
ctacaggcctca

SEQ ID NO: 2413238 - DNA, 22 bp, Homo sapiens
ctacatgatctagagccagtta

SEQ ID NO: 2413239 - DNA, 16 bp, Homo sapiens
ctacctggtctctcct

SEQ ID NO: 2413240 - DNA, 12 bp, Homo sapiens
ctactagaaaat

SEQ ID NO: 2413241 - DNA, 21 bp, Homo sapiens
ctactgtaaggcaatcatggt

SEQ ID NO: 2413242 - DNA, 22 bp, Homo sapiens
ctactttctgtgtctatggatt

SEQ ID NO: 2413243 - DNA, 19 bp, Homo sapiens
ctagaggcttccttcattt

SEQ ID NO: 2413244 - DNA, 23 bp, Homo sapiens
ctagaggcttccttcatttcctc

SEQ ID NO: 2413245 - DNA, 15 bp, Homo sapiens
ctaggacacagttcc

SEQ ID NO: 2413246 - DNA, 20 bp, Homo sapiens
ctaggacacagttcctggga

SEQ ID NO: 2413247 - DNA, 21 bp, Homo sapiens
ctaggccttgcggctcctcag

SEQ ID NO: 2413248 - DNA, 13 bp, Homo sapiens
ctagtgtagaatt

SEQ ID NO: 2413249 - DNA, 17 bp, Homo sapiens
ctagttctgtagaaatg

SEQ ID NO: 2413250 - DNA, 23 bp, Homo sapiens
ctagttctgtagaaatggttgta

SEQ ID NO: 2413251 - DNA, 21 bp, Homo sapiens
ctatagtccagctttgttctt

SEQ ID NO: 2413252 - DNA, 21 bp, Homo sapiens
ctatatactcactttctagat

SEQ ID NO: 2413253 - DNA, 13 bp, Homo sapiens
ctatcatttaata

SEQ ID NO: 2413254 - DNA, 21 bp, Homo sapiens
ctatcatttaataatatactt

SEQ ID NO: 2413255 - DNA, 18 bp, Homo sapiens
ctatgttttgacattttt

SEQ ID NO: 2413256 - DNA, 19 bp, Homo sapiens
ctatgttttgacattttta

SEQ ID NO: 2413257 - DNA, 15 bp, Homo sapiens
ctattctagcctgca

SEQ ID NO: 2413258 - DNA, 17 bp, Homo sapiens
ctattctagcctgcatt

SEQ ID NO: 2413259 - DNA, 18 bp, Homo sapiens
ctattcttgatgtaaaat

SEQ ID NO: 2413260 - DNA, 20 bp, Homo sapiens
ctattcttgatgtaaaatct

SEQ ID NO: 2413261 - DNA, 11 bp, Homo sapiens
ctattgcctct

SEQ ID NO: 2413262 - DNA, 13 bp, Homo sapiens
ctattgcctctga

SEQ ID NO: 2413263 - DNA, 14 bp, Homo sapiens
ctatttaactgact

SEQ ID NO: 2413264 - DNA, 22 bp, Homo sapiens
ctatttgttgatgcttgtgtca

SEQ ID NO: 2413265 - DNA, 22 bp, Homo sapiens
ctattttaataaacactcttga

SEQ ID NO: 2413266 - DNA, 19 bp, Homo sapiens
ctcaaactcctgacctcag

SEQ ID NO: 2413267 - DNA, 18 bp, Homo sapiens
ctcaaagagggagtgcat

SEQ ID NO: 2413268 - DNA, 12 bp, Homo sapiens
ctcaatgctcat

SEQ ID NO: 2413269 - DNA, 17 bp, Homo sapiens
ctcacaacagctgcctg

SEQ ID NO: 2413270 - DNA, 23 bp, Homo sapiens
ctcacaccaggcttgcctgcagg

SEQ ID NO: 2413271 - DNA, 18 bp, Homo sapiens
ctcacagtgggagccagg

SEQ ID NO: 2413272 - DNA, 22 bp, Homo sapiens
ctcacagtgggagccagggctg

SEQ ID NO: 2413273 - DNA, 16 bp, Homo sapiens
ctcagaagtttcttct

SEQ ID NO: 2413274 - DNA, 19 bp, Homo sapiens
ctcagactctaagaaagaa

SEQ ID NO: 2413275 - DNA, 16 bp, Homo sapiens
ctcagatcctcctcat

SEQ ID NO: 2413276 - DNA, 14 bp, Homo sapiens
ctcagctttctaag

SEQ ID NO: 2413277 - DNA, 20 bp, Homo sapiens
ctcaggagccctgggaggct

SEQ ID NO: 2413278 - DNA, 21 bp, Homo sapiens
ctcaggatgagggaaaagaaa

SEQ ID NO: 2413279 - DNA, 20 bp, Homo sapiens
ctcagttcatccattctatt

SEQ ID NO: 2413280 - DNA, 21 bp, Homo sapiens
ctcataacggatcagaaatac

SEQ ID NO: 2413281 - DNA, 13 bp, Homo sapiens
ctcatcctgcagg

SEQ ID NO: 2413282 - DNA, 14 bp, Homo sapiens
ctcatcctgcaggc

SEQ ID NO: 2413283 - DNA, 15 bp, Homo sapiens
ctcatctttccctcc

SEQ ID NO: 2413284 - DNA, 18 bp, Homo sapiens
ctcatctttccctccttg

SEQ ID NO: 2413285 - DNA, 12 bp, Homo sapiens
ctcatgaacctc

SEQ ID NO: 2413286 - DNA, 14 bp, Homo sapiens
gccatgggaggcct

SEQ ID NO: 2413287 - DNA, 22 bp, Homo sapiens
gcccactgtacttgctcttgat

SEQ ID NO: 2413288 - DNA, 15 bp, Homo sapiens
gcccagagaagccaa

SEQ ID NO: 2413289 - DNA, 22 bp, Homo sapiens
gcccaggatactggcacagagg

SEQ ID NO: 2413290 - DNA, 22 bp, Homo sapiens
gcccatcataatataaaacagg

SEQ ID NO: 2413291 - DNA, 16 bp, Homo sapiens
gcccccagagccacag

SEQ ID NO: 2413292 - DNA, 16 bp, Homo sapiens
gcccctgcctctctgc

SEQ ID NO: 2413293 - DNA, 17 bp, Homo sapiens
gcccgcatgcggcccag

SEQ ID NO: 2413294 - DNA, 17 bp, Homo sapiens
gccctgctgccctcccc

SEQ ID NO: 2413295 - DNA, 12 bp, Homo sapiens
gccctggactgt

SEQ ID NO: 2413296 - DNA, 22 bp, Homo sapiens
gccctggactgtgtgctcagga

SEQ ID NO: 2413297 - DNA, 14 bp, Homo sapiens
gccctgggaggctc

SEQ ID NO: 2413298 - DNA, 21 bp, Homo sapiens
gccctgggaggctctggagcc

SEQ ID NO: 2413299 - DNA, 23 bp, Homo sapiens
gccctgggaggctctggagccca

SEQ ID NO: 2413300 - DNA, 14 bp, Homo sapiens
gcccttttgtctct

SEQ ID NO: 2413301 - DNA, 22 bp, Homo sapiens
gccgtgtgtgtgcgtcctgtcg

SEQ ID NO: 2413302 - DNA, 18 bp, Homo sapiens
gcctatgtggtctaaggt

SEQ ID NO: 2413303 - DNA, 23 bp, Homo sapiens
gcctctctgcaggtccctaataa

SEQ ID NO: 2413304 - DNA, 19 bp, Homo sapiens
gcctctgagaagctctgaa

SEQ ID NO: 2413305 - DNA, 22 bp, Homo sapiens
gcctgcatccattctcctgagg

SEQ ID NO: 2413306 - DNA, 22 bp, Homo sapiens
gcctgcctcccctgcctcacca

SEQ ID NO: 2413307 - DNA, 18 bp, Homo sapiens
gcctgctttttatggcct

SEQ ID NO: 2413308 - DNA, 19 bp, Homo sapiens
gcctgctttttatggcctg

SEQ ID NO: 2413309 - DNA, 15 bp, Homo sapiens
gcctggaagagcagc

SEQ ID NO: 2413310 - DNA, 18 bp, Homo sapiens
gcctggcaagtgggtgaa

SEQ ID NO: 2413311 - DNA, 19 bp, Homo sapiens
gcctgggtgtaaaacctgg

SEQ ID NO: 2413312 - DNA, 12 bp, Homo sapiens
gcctgtttaaga

SEQ ID NO: 2413313 - DNA, 13 bp, Homo sapiens
gcctgtttaagag

SEQ ID NO: 2413314 - DNA, 20 bp, Homo sapiens
gccttggctgacatgaagct

SEQ ID NO: 2413315 - DNA, 13 bp, Homo sapiens
gcctttaaaattt

SEQ ID NO: 2413316 - DNA, 14 bp, Homo sapiens
gcctttattgtgtt

SEQ ID NO: 2413317 - DNA, 17 bp, Homo sapiens
gcctttcttctctccag

SEQ ID NO: 2413318 - DNA, 17 bp, Homo sapiens
gcgatctcggctcactg

SEQ ID NO: 2413319 - DNA, 13 bp, Homo sapiens
gcgtggtgcgagt

SEQ ID NO: 2413320 - DNA, 16 bp, Homo sapiens
gctaaagcccagagac

SEQ ID NO: 2413321 - DNA, 18 bp, Homo sapiens
gctaagccccagcaagca

SEQ ID NO: 2413322 - DNA, 20 bp, Homo sapiens
gctaagccccagcaagcaat

SEQ ID NO: 2413323 - DNA, 20 bp, Homo sapiens
gctaatttttgtatttttag

SEQ ID NO: 2413324 - DNA, 19 bp, Homo sapiens
gctacctgctcagccctgc

SEQ ID NO: 2413325 - DNA, 20 bp, Homo sapiens
gctactctagtattccagac

SEQ ID NO: 2413326 - DNA, 21 bp, Homo sapiens
gctactctagtattccagacc

SEQ ID NO: 2413327 - DNA, 23 bp, Homo sapiens
gctcaactctcttattgcctcac

SEQ ID NO: 2413328 - DNA, 20 bp, Homo sapiens
gctcactgcaacctctgcct

SEQ ID NO: 2413329 - DNA, 16 bp, Homo sapiens
gctcagagcagtgttt

SEQ ID NO: 2413330 - DNA, 12 bp, Homo sapiens
gctcagccctgc

SEQ ID NO: 2413331 - DNA, 15 bp, Homo sapiens
gctcaggagccctgg

SEQ ID NO: 2413332 - DNA, 22 bp, Homo sapiens
gctcaggagccctgggaggctc

SEQ ID NO: 2413333 - DNA, 20 bp, Homo sapiens
gctcaggatgagggaaaaga

SEQ ID NO: 2413334 - DNA, 20 bp, Homo sapiens
gctccatttttagtgaaata

SEQ ID NO: 2413335 - DNA, 15 bp, Homo sapiens
gctctggagcccact

SEQ ID NO: 2413336 - DNA, 16 bp, Homo sapiens
gctctggagcccactg

SEQ ID NO: 2413337 - DNA, 17 bp, Homo sapiens
gctctggagcccactgt

SEQ ID NO: 2413338 - DNA, 14 bp, Homo sapiens
gctcttgatgcctg

SEQ ID NO: 2413339 - DNA, 15 bp, Homo sapiens
gctcttgatgcctgg

SEQ ID NO: 2413340 - DNA, 18 bp, Homo sapiens
gctgcagtatgaaaataa

SEQ ID NO: 2413341 - DNA, 21 bp, Homo sapiens
gctgcagttttgctatctggg

SEQ ID NO: 2413342 - DNA, 20 bp, Homo sapiens
gctgccaagagtgaagggaa

SEQ ID NO: 2413343 - DNA, 20 bp, Homo sapiens
gctgcccccagagccacagt

SEQ ID NO: 2413344 - DNA, 19 bp, Homo sapiens
gctgctggggaagacagtg

SEQ ID NO: 2413345 - DNA, 20 bp, Homo sapiens
gctgctgtggccatcaacct

SEQ ID NO: 2413346 - DNA, 20 bp, Homo sapiens
gctggagtgcagtggcgcga

SEQ ID NO: 2413347 - DNA, 16 bp, Homo sapiens
gctggcattacaggtg

SEQ ID NO: 2413348 - DNA, 12 bp, Homo sapiens
gctgggcccctg

SEQ ID NO: 2413349 - DNA, 12 bp, Homo sapiens
gctgggtcgccc

SEQ ID NO: 2413350 - DNA, 16 bp, Homo sapiens
gctgggtcgccctgga

SEQ ID NO: 2413351 - DNA, 12 bp, Homo sapiens
gctgtacactgc

SEQ ID NO: 2413352 - DNA, 16 bp, Homo sapiens
gctgtgcgtgtgtgtg

SEQ ID NO: 2413353 - DNA, 18 bp, Homo sapiens
gctgtgggcaagcctaag

SEQ ID NO: 2413354 - DNA, 13 bp, Homo sapiens
gctgttgctgaat

SEQ ID NO: 2413355 - DNA, 14 bp, Homo sapiens
gcttcagccaggag

SEQ ID NO: 2413356 - DNA, 22 bp, Homo sapiens
gcttcattcaagtcagctcttc

SEQ ID NO: 2413357 - DNA, 13 bp, Homo sapiens
gcttccttcattt

SEQ ID NO: 2413358 - DNA, 14 bp, Homo sapiens
gcttccttcatttc

SEQ ID NO: 2413359 - DNA, 22 bp, Homo sapiens
gcttctcatcctgcaggcagct

SEQ ID NO: 2413360 - DNA, 18 bp, Homo sapiens
gcttctttctttgggaat

SEQ ID NO: 2413361 - DNA, 21 bp, Homo sapiens
gcttgagagccctgaggccta

SEQ ID NO: 2413362 - DNA, 16 bp, Homo sapiens
gctttatcctctttag

SEQ ID NO: 2413363 - DNA, 20 bp, Homo sapiens
ggaaaaaataacaatgaaag

SEQ ID NO: 2413364 - DNA, 18 bp, Homo sapiens
ggaaaattctaacccagg

SEQ ID NO: 2413365 - DNA, 23 bp, Homo sapiens
ggaaagggattttcagccctcag

SEQ ID NO: 2413366 - DNA, 21 bp, Homo sapiens
ggaaaggggcaggccagagct

SEQ ID NO: 2413367 - DNA, 15 bp, Homo sapiens
ggaagacagtggccc

SEQ ID NO: 2413368 - DNA, 17 bp, Homo sapiens
ggaagagacagcccagg

SEQ ID NO: 2413369 - DNA, 14 bp, Homo sapiens
ggaagcccctgggc

SEQ ID NO: 2413370 - DNA, 18 bp, Homo sapiens
ggaagtgctaattttgaa

SEQ ID NO: 2413371 - DNA, 20 bp, Homo sapiens
ggaatatttgaatcttgtct

SEQ ID NO: 2413372 - DNA, 18 bp, Homo sapiens
ggaatgaagcaatgcttc

SEQ ID NO: 2413373 - DNA, 19 bp, Homo sapiens
ggaattttcatctaggatt

SEQ ID NO: 2413374 - DNA, 18 bp, Homo sapiens
ggacacagttcctgggaa

SEQ ID NO: 2413375 - DNA, 13 bp, Homo sapiens
ggaccctgtccaa

SEQ ID NO: 2413376 - DNA, 16 bp, Homo sapiens
ggactcatctttccct

SEQ ID NO: 2413377 - DNA, 19 bp, Homo sapiens
ggactcatctttccctcct

SEQ ID NO: 2413378 - DNA, 23 bp, Homo sapiens
ggactcatctttccctccttggt

SEQ ID NO: 2413379 - DNA, 14 bp, Homo sapiens
ggactgagaaattt

SEQ ID NO: 2413380 - DNA, 18 bp, Homo sapiens
ggactgagaaatttataa

SEQ ID NO: 2413381 - DNA, 17 bp, Homo sapiens
ggagagagttgaaccta

SEQ ID NO: 2413382 - DNA, 19 bp, Homo sapiens
ggagagggaatgtgaaatt

SEQ ID NO: 2413383 - DNA, 16 bp, Homo sapiens
ggagaggttgtctgtg

SEQ ID NO: 2413384 - DNA, 22 bp, Homo sapiens
ggagcccactgtacttgctctt

SEQ ID NO: 2413385 - DNA, 13 bp, Homo sapiens
ggagccctgggag

SEQ ID NO: 2413386 - DNA, 23 bp, Homo sapiens
ggagccctgtctcctctctctgt

SEQ ID NO: 2413387 - DNA, 13 bp, Homo sapiens
ggagccttcccaa

SEQ ID NO: 2413388 - DNA, 21 bp, Homo sapiens
ggagccttcccaagttgtgct

SEQ ID NO: 2413389 - DNA, 21 bp, Homo sapiens
ggaggaaggcttacacccaca

SEQ ID NO: 2413390 - DNA, 17 bp, Homo sapiens
ggaggcaggagtttcgt

SEQ ID NO: 2413391 - DNA, 23 bp, Homo sapiens
ggaggcctttccctaagccagct

SEQ ID NO: 2413392 - DNA, 15 bp, Homo sapiens
ggaggctctggagcc

SEQ ID NO: 2413393 - DNA, 20 bp, Homo sapiens
ggaggctctggagcccactg

SEQ ID NO: 2413394 - DNA, 21 bp, Homo sapiens
ggaggctctggagcccactgt

SEQ ID NO: 2413395 - DNA, 21 bp, Homo sapiens
ggagggtttcattgtctgtga

SEQ ID NO: 2413396 - DNA, 13 bp, Homo sapiens
ggagttgtgggta

SEQ ID NO: 2413397 - DNA, 16 bp, Homo sapiens
ggatgatccccacgcc

SEQ ID NO: 2413398 - DNA, 22 bp, Homo sapiens
ggatgatccccacgccacagcc

SEQ ID NO: 2413399 - DNA, 14 bp, Homo sapiens
ggatgcagtgctcg

SEQ ID NO: 2413400 - DNA, 14 bp, Homo sapiens
ggattgtagtccca

SEQ ID NO: 2413401 - DNA, 19 bp, Homo sapiens
ggcaatcatggtgctcaga

SEQ ID NO: 2413402 - DNA, 19 bp, Homo sapiens
ggcaattaattccttcagc

SEQ ID NO: 2413403 - DNA, 20 bp, Homo sapiens
ggcaattaattccttcagca

SEQ ID NO: 2413404 - DNA, 11 bp, Homo sapiens
ggcagccagac

SEQ ID NO: 2413405 - DNA, 13 bp, Homo sapiens
ggcagtgggaaaa

SEQ ID NO: 2413406 - DNA, 15 bp, Homo sapiens
ggcagtgggaaaaat

SEQ ID NO: 2413407 - DNA, 20 bp, Homo sapiens
ggcatccttcctcacaccag

SEQ ID NO: 2413408 - DNA, 18 bp, Homo sapiens
ggccaggcttgtctcgaa

SEQ ID NO: 2413409 - DNA, 21 bp, Homo sapiens
ggccatgggaggcctttccct

SEQ ID NO: 2413410 - DNA, 23 bp, Homo sapiens
ggcccaacacaattcttcttcca

SEQ ID NO: 2413411 - DNA, 19 bp, Homo sapiens
ggcccctgcctctctgcag

SEQ ID NO: 2413412 - DNA, 21 bp, Homo sapiens
ggcccctgcctctctgcaggt

SEQ ID NO: 2413413 - DNA, 13 bp, Homo sapiens
ggcctagactctg

SEQ ID NO: 2413414 - DNA, 13 bp, Homo sapiens
ggcctagaggcct

SEQ ID NO: 2413415 - DNA, 16 bp, Homo sapiens
taataattttttaatt

SEQ ID NO: 2413416 - DNA, 14 bp, Homo sapiens
taatacaaaggctt

SEQ ID NO: 2413417 - DNA, 15 bp, Homo sapiens
taatacacacagtta

SEQ ID NO: 2413418 - DNA, 18 bp, Homo sapiens
taatagggaaaattctaa

SEQ ID NO: 2413419 - DNA, 16 bp, Homo sapiens
taatatatattatctt

SEQ ID NO: 2413420 - DNA, 16 bp, Homo sapiens
taatattgatttatta

SEQ ID NO: 2413421 - DNA, 17 bp, Homo sapiens
taatccccagtaaaatt

SEQ ID NO: 2413422 - DNA, 15 bp, Homo sapiens
taatccccttctccc

SEQ ID NO: 2413423 - DNA, 21 bp, Homo sapiens
taatccccttctcccctgcac

SEQ ID NO: 2413424 - DNA, 17 bp, Homo sapiens
taatctttaattttaca

SEQ ID NO: 2413425 - DNA, 16 bp, Homo sapiens
taatgaagtttgaatg

SEQ ID NO: 2413426 - DNA, 22 bp, Homo sapiens
taatgaagtttgaatgttaaat

SEQ ID NO: 2413427 - DNA, 13 bp, Homo sapiens
taatgttaatatt

SEQ ID NO: 2413428 - DNA, 23 bp, Homo sapiens
taattataccgctatcattccaa

SEQ ID NO: 2413429 - DNA, 20 bp, Homo sapiens
taattccttcagcactttag

SEQ ID NO: 2413430 - DNA, 18 bp, Homo sapiens
taatttctgcaaatgtaa

SEQ ID NO: 2413431 - DNA, 15 bp, Homo sapiens
taatttgactagaaa

SEQ ID NO: 2413432 - DNA, 16 bp, Homo sapiens
taatttgactagaaaa

SEQ ID NO: 2413433 - DNA, 13 bp, Homo sapiens
taattttgaaaaa

SEQ ID NO: 2413434 - DNA, 18 bp, Homo sapiens
tacaaaggcttattaatt

SEQ ID NO: 2413435 - DNA, 14 bp, Homo sapiens
tacacctatgtcat

SEQ ID NO: 2413436 - DNA, 21 bp, Homo sapiens
tacactctcaaagcaaataat

SEQ ID NO: 2413437 - DNA, 16 bp, Homo sapiens
tacagattttgatagc

SEQ ID NO: 2413438 - DNA, 14 bp, Homo sapiens
tacaggatttgaaa

SEQ ID NO: 2413439 - DNA, 18 bp, Homo sapiens
tacagttcctaggtataa

SEQ ID NO: 2413440 - DNA, 23 bp, Homo sapiens
tacagttcggtgagctacaaatg

SEQ ID NO: 2413441 - DNA, 12 bp, Homo sapiens
tacatcatttct

SEQ ID NO: 2413442 - DNA, 15 bp, Homo sapiens
tacatgattcatttt

SEQ ID NO: 2413443 - DNA, 21 bp, Homo sapiens
tacatgcacttggctgcataa

SEQ ID NO: 2413444 - DNA, 21 bp, Homo sapiens
tacatgcatacactctcaaag

SEQ ID NO: 2413445 - DNA, 20 bp, Homo sapiens
tacatgcattactgcatgca

SEQ ID NO: 2413446 - DNA, 13 bp, Homo sapiens
tacatttcctaaa

SEQ ID NO: 2413447 - DNA, 19 bp, Homo sapiens
tacattttctaagaaacat

SEQ ID NO: 2413448 - DNA, 20 bp, Homo sapiens
tacattttctaagaaacatt

SEQ ID NO: 2413449 - DNA, 19 bp, Homo sapiens
tacccagtaactcatctgt

SEQ ID NO: 2413450 - DNA, 22 bp, Homo sapiens
tacccagtaactcatctgtcac

SEQ ID NO: 2413451 - DNA, 23 bp, Homo sapiens
tacctgaagctatcgtaaaatta

SEQ ID NO: 2413452 - DNA, 19 bp, Homo sapiens
tacctttgacaaaggtaaa

SEQ ID NO: 2413453 - DNA, 13 bp, Homo sapiens
tactacatgcact

SEQ ID NO: 2413454 - DNA, 12 bp, Homo sapiens
tactatttaact

SEQ ID NO: 2413455 - DNA, 14 bp, Homo sapiens
tactatttaactga

SEQ ID NO: 2413456 - DNA, 15 bp, Homo sapiens
tactcccctccttga

SEQ ID NO: 2413457 - DNA, 12 bp, Homo sapiens
tactgcagcctc

SEQ ID NO: 2413458 - DNA, 21 bp, Homo sapiens
tactgcctattttaataaaca

SEQ ID NO: 2413459 - DNA, 18 bp, Homo sapiens
tacttgctcttgatgcct

SEQ ID NO: 2413460 - DNA, 15 bp, Homo sapiens
tacttgtggactaaa

SEQ ID NO: 2413461 - DNA, 22 bp, Homo sapiens
tacttgtggactaaaagatata

SEQ ID NO: 2413462 - DNA, 14 bp, Homo sapiens
tacttgtttcagag

SEQ ID NO: 2413463 - DNA, 17 bp, Homo sapiens
tagaaaatttaaaacat

SEQ ID NO: 2413464 - DNA, 17 bp, Homo sapiens
tagaaagcatttgaatg

SEQ ID NO: 2413465 - DNA, 20 bp, Homo sapiens
tagaaagcatttgaatgcat

SEQ ID NO: 2413466 - DNA, 21 bp, Homo sapiens
tagaaagcatttgaatgcatt

SEQ ID NO: 2413467 - DNA, 22 bp, Homo sapiens
tagaaagcatttgaatgcattt

SEQ ID NO: 2413468 - DNA, 14 bp, Homo sapiens
tagaaaggccttta

SEQ ID NO: 2413469 - DNA, 16 bp, Homo sapiens
tagaaaggcctttaaa

SEQ ID NO: 2413470 - DNA, 16 bp, Homo sapiens
tagaaatggttgtatt

SEQ ID NO: 2413471 - DNA, 23 bp, Homo sapiens
tagaaatggttgtattagatgtt

SEQ ID NO: 2413472 - DNA, 22 bp, Homo sapiens
tagaagccccgttataactcct

SEQ ID NO: 2413473 - DNA, 21 bp, Homo sapiens
tagaattataactggaaagaa

SEQ ID NO: 2413474 - DNA, 22 bp, Homo sapiens
tagacaagtccagcctggcaag

SEQ ID NO: 2413475 - DNA, 17 bp, Homo sapiens
tagactctgtctacctg

SEQ ID NO: 2413476 - DNA, 22 bp, Homo sapiens
tagactctgtctacctggtctg

SEQ ID NO: 2413477 - DNA, 15 bp, Homo sapiens
tagaggaagcagcca

SEQ ID NO: 2413478 - DNA, 16 bp, Homo sapiens
tagaggcttccttcat

SEQ ID NO: 2413479 - DNA, 13 bp, Homo sapiens
tagagttagactg

SEQ ID NO: 2413480 - DNA, 14 bp, Homo sapiens
tagagttagactgt

SEQ ID NO: 2413481 - DNA, 16 bp, Homo sapiens
tagagttagactgttg

SEQ ID NO: 2413482 - DNA, 22 bp, Homo sapiens
tagataggtcagtgcaaatact

SEQ ID NO: 2413483 - DNA, 19 bp, Homo sapiens
tagatgttctctatcattt

SEQ ID NO: 2413484 - DNA, 14 bp, Homo sapiens
tagcatatctgcct

SEQ ID NO: 2413485 - DNA, 18 bp, Homo sapiens
tagcatatctgcctttat

SEQ ID NO: 2413486 - DNA, 22 bp, Homo sapiens
tagcatatctgcctttattgtg

SEQ ID NO: 2413487 - DNA, 16 bp, Homo sapiens
tagcccctctcctgga

SEQ ID NO: 2413488 - DNA, 13 bp, Homo sapiens
tagccttctctgt

SEQ ID NO: 2413489 - DNA, 14 bp, Homo sapiens
tagccttctctgtt

SEQ ID NO: 2413490 - DNA, 14 bp, Homo sapiens
taggaattgtgttt

SEQ ID NO: 2413491 - DNA, 16 bp, Homo sapiens
taggaattgtgtttat

SEQ ID NO: 2413492 - DNA, 13 bp, Homo sapiens
taggacccttccc

SEQ ID NO: 2413493 - DNA, 21 bp, Homo sapiens
taggccttgcggctcctcagg

SEQ ID NO: 2413494 - DNA, 13 bp, Homo sapiens
taggcgatcacaa

SEQ ID NO: 2413495 - DNA, 23 bp, Homo sapiens
tagggcaattaattccttcagca

SEQ ID NO: 2413496 - DNA, 12 bp, Homo sapiens
tagggtttaatc

SEQ ID NO: 2413497 - DNA, 21 bp, Homo sapiens
tagggtttaatccccagtaaa

SEQ ID NO: 2413498 - DNA, 21 bp, Homo sapiens
tagtcgtgagctcttgtgagg

SEQ ID NO: 2413499 - DNA, 17 bp, Homo sapiens
tagtgctaagtgtgaac

SEQ ID NO: 2413500 - DNA, 19 bp, Homo sapiens
tagtgctaagtgtgaactg

SEQ ID NO: 2413501 - DNA, 22 bp, Homo sapiens
tagttgaattttttttaacatt

SEQ ID NO: 2413502 - DNA, 23 bp, Homo sapiens
tagttgaattttttttaacattc

SEQ ID NO: 2413503 - DNA, 19 bp, Homo sapiens
tataaaaataaaaaacact

SEQ ID NO: 2413504 - DNA, 21 bp, Homo sapiens
tataaaaataaaaaacactgg

SEQ ID NO: 2413505 - DNA, 11 bp, Homo sapiens
tataaaagatg

SEQ ID NO: 2413506 - DNA, 23 bp, Homo sapiens
tataaaagatggggtctgtaaaa

SEQ ID NO: 2413507 - DNA, 14 bp, Homo sapiens
tataaaagcctgtt

SEQ ID NO: 2413508 - DNA, 17 bp, Homo sapiens
tataaaatcagccaatt

SEQ ID NO: 2413509 - DNA, 21 bp, Homo sapiens
tataaaatcagccaattatgt

SEQ ID NO: 2413510 - DNA, 20 bp, Homo sapiens
tataagtgctgtataaaatc

SEQ ID NO: 2413511 - DNA, 13 bp, Homo sapiens
tataataaatgta

SEQ ID NO: 2413512 - DNA, 23 bp, Homo sapiens
tataatcattattacttttgctg

SEQ ID NO: 2413513 - DNA, 15 bp, Homo sapiens
tataattcaccttct

SEQ ID NO: 2413514 - DNA, 21 bp, Homo sapiens
tatacttgtggactaaaagat

SEQ ID NO: 2413515 - DNA, 13 bp, Homo sapiens
tatagatcagcca

SEQ ID NO: 2413516 - DNA, 14 bp, Homo sapiens
tatatattatcttt

SEQ ID NO: 2413517 - DNA, 12 bp, Homo sapiens
tatatcttgttt

SEQ ID NO: 2413518 - DNA, 13 bp, Homo sapiens
tatattatctttt

SEQ ID NO: 2413519 - DNA, 14 bp, Homo sapiens
tatatttacaaatg

SEQ ID NO: 2413520 - DNA, 13 bp, Homo sapiens
tatattttaagac

SEQ ID NO: 2413521 - DNA, 15 bp, Homo sapiens
tatcaaatctaccac

SEQ ID NO: 2413522 - DNA, 19 bp, Homo sapiens
tatcaattaccacaccatc

SEQ ID NO: 2413523 - DNA, 19 bp, Homo sapiens
tatcagtccagtttgtcct

SEQ ID NO: 2413524 - DNA, 22 bp, Homo sapiens
tatcatgtgaaatcattcattt

SEQ ID NO: 2413525 - DNA, 16 bp, Homo sapiens
tatcatttaataatat

SEQ ID NO: 2413526 - DNA, 18 bp, Homo sapiens
tatccaggcaccaggact

SEQ ID NO: 2413527 - DNA, 16 bp, Homo sapiens
tatccccatttctttt

SEQ ID NO: 2413528 - DNA, 16 bp, Homo sapiens
tatcctatctctccaa

SEQ ID NO: 2413529 - DNA, 20 bp, Homo sapiens
tatcgcaccactgtgtattt

SEQ ID NO: 2413530 - DNA, 18 bp, Homo sapiens
tatcgcttcatgtaacta

SEQ ID NO: 2413531 - DNA, 17 bp, Homo sapiens
tatctagtttaattaat

SEQ ID NO: 2413532 - DNA, 14 bp, Homo sapiens
tatctgcctttatt

SEQ ID NO: 2413533 - DNA, 14 bp, Homo sapiens
tatcttcacttgtc

SEQ ID NO: 2413534 - DNA, 20 bp, Homo sapiens
tatgcatattattttatgtt

SEQ ID NO: 2413535 - DNA, 14 bp, Homo sapiens
tatgcattatatca

SEQ ID NO: 2413536 - DNA, 16 bp, Homo sapiens
tatgcattatatcaaa

SEQ ID NO: 2413537 - DNA, 14 bp, Homo sapiens
tatggaggcaggag

SEQ ID NO: 2413538 - DNA, 13 bp, Homo sapiens
tatgggtcacagg

SEQ ID NO: 2413539 - DNA, 15 bp, Homo sapiens
tatgggtcacaggaa

SEQ ID NO: 2413540 - DNA, 16 bp, Homo sapiens
tatgtcatttcatttc

SEQ ID NO: 2413541 - DNA, 14 bp, Homo sapiens
tatgtgaaacatgt

SEQ ID NO: 2413542 - DNA, 21 bp, Homo sapiens
tatgttaaactagcatatctg

SEQ ID NO: 2413543 - DNA, 22 bp, Homo sapiens
tatgttttgacatttttagttt

SEQ ID NO: 2413544 - DNA, 18 bp, Homo sapiens
tattaatatatattatct

SEQ ID NO: 2413545 - DNA, 13 bp, Homo sapiens
tgaaaataaagaa

SEQ ID NO: 2413546 - DNA, 15 bp, Homo sapiens
tgaaacactttgcat

SEQ ID NO: 2413547 - DNA, 19 bp, Homo sapiens
tgaaacattttctccctgg

SEQ ID NO: 2413548 - DNA, 19 bp, Homo sapiens
tgaaatggacttttgtaca

SEQ ID NO: 2413549 - DNA, 23 bp, Homo sapiens
tgaacaaagtttaccagaaagca

SEQ ID NO: 2413550 - DNA, 23 bp, Homo sapiens
tgaacctgatgaaaataaagaat

SEQ ID NO: 2413551 - DNA, 15 bp, Homo sapiens
tgaagagatttttca

SEQ ID NO: 2413552 - DNA, 16 bp, Homo sapiens
tgaagagatttttcat

SEQ ID NO: 2413553 - DNA, 19 bp, Homo sapiens
tgaagctgttgtgtgaggt

SEQ ID NO: 2413554 - DNA, 16 bp, Homo sapiens
tgaagcttttatgtga

SEQ ID NO: 2413555 - DNA, 21 bp, Homo sapiens
tgaagcttttatgtgaaacat

SEQ ID NO: 2413556 - DNA, 18 bp, Homo sapiens
tgaagtacccgttcacat

SEQ ID NO: 2413557 - DNA, 13 bp, Homo sapiens
tgaagtttgaatg

SEQ ID NO: 2413558 - DNA, 14 bp, Homo sapiens
tgaagtttgaatgt

SEQ ID NO: 2413559 - DNA, 15 bp, Homo sapiens
tgaagtttgaatgtt

SEQ ID NO: 2413560 - DNA, 16 bp, Homo sapiens
tgaagtttgaatgtta

SEQ ID NO: 2413561 - DNA, 21 bp, Homo sapiens
tgaagtttgaatgttaaataa

SEQ ID NO: 2413562 - DNA, 15 bp, Homo sapiens
tgaatactttataaa

SEQ ID NO: 2413563 - DNA, 23 bp, Homo sapiens
tgaatcattttacctttgacaaa

SEQ ID NO: 2413564 - DNA, 21 bp, Homo sapiens
tgaatcctctctctgtgttac

SEQ ID NO: 2413565 - DNA, 15 bp, Homo sapiens
tgaatcttgtctcaa

SEQ ID NO: 2413566 - DNA, 20 bp, Homo sapiens
tgaatcttgtctcaatgctc

SEQ ID NO: 2413567 - DNA, 23 bp, Homo sapiens
tgaatcttgtctcaatgctcata

SEQ ID NO: 2413568 - DNA, 13 bp, Homo sapiens
tgaatgcattttg

SEQ ID NO: 2413569 - DNA, 15 bp, Homo sapiens
tgaatgtaaatttgt

SEQ ID NO: 2413570 - DNA, 19 bp, Homo sapiens
tgaatgtaaatttgtacta

SEQ ID NO: 2413571 - DNA, 13 bp, Homo sapiens
tgaatgttaaata

SEQ ID NO: 2413572 - DNA, 18 bp, Homo sapiens
tgaatgttaaataaattg

SEQ ID NO: 2413573 - DNA, 20 bp, Homo sapiens
tgaatgttaaataaattgta

SEQ ID NO: 2413574 - DNA, 11 bp, Homo sapiens
tgaatttcatc

SEQ ID NO: 2413575 - DNA, 13 bp, Homo sapiens
tgaatttgtgaag

SEQ ID NO: 2413576 - DNA, 16 bp, Homo sapiens
tgaattttttttaaca

SEQ ID NO: 2413577 - DNA, 18 bp, Homo sapiens
tgaattttttttaacatt

SEQ ID NO: 2413578 - DNA, 20 bp, Homo sapiens
tgacaaaggtaaatcagact

SEQ ID NO: 2413579 - DNA, 14 bp, Homo sapiens
tgacaattgggagc

SEQ ID NO: 2413580 - DNA, 23 bp, Homo sapiens
tgacataagtatttaattcatgt

SEQ ID NO: 2413581 - DNA, 21 bp, Homo sapiens
tgaccctatgggtctaggaca

SEQ ID NO: 2413582 - DNA, 14 bp, Homo sapiens
tgaccctccccaaa

SEQ ID NO: 2413583 - DNA, 22 bp, Homo sapiens
tgacctccatgactgcacagta

SEQ ID NO: 2413584 - DNA, 17 bp, Homo sapiens
tgactattcttgatgta

SEQ ID NO: 2413585 - DNA, 21 bp, Homo sapiens
tgactattcttgatgtaaaat

SEQ ID NO: 2413586 - DNA, 22 bp, Homo sapiens
tgactattcttgatgtaaaatc

SEQ ID NO: 2413587 - DNA, 19 bp, Homo sapiens
tgagaaaagctttgaaccc

SEQ ID NO: 2413588 - DNA, 17 bp, Homo sapiens
tgagaaatctaaaaaac

SEQ ID NO: 2413589 - DNA, 21 bp, Homo sapiens
tgagacaagaaaataagagct

SEQ ID NO: 2413590 - DNA, 19 bp, Homo sapiens
tgagaccttccttttactt

SEQ ID NO: 2413591 - DNA, 22 bp, Homo sapiens
tgagagagtggctggggcatgg

SEQ ID NO: 2413592 - DNA, 23 bp, Homo sapiens
tgagagcagtttggtttctagca

SEQ ID NO: 2413593 - DNA, 19 bp, Homo sapiens
tgagagttttggatgcagt

SEQ ID NO: 2413594 - DNA, 17 bp, Homo sapiens
tgagatggagtcttgct

SEQ ID NO: 2413595 - DNA, 13 bp, Homo sapiens
tgagctacaaatg

SEQ ID NO: 2413596 - DNA, 14 bp, Homo sapiens
tgagctaggaattg

SEQ ID NO: 2413597 - DNA, 15 bp, Homo sapiens
tgagctcttcatgtt

SEQ ID NO: 2413598 - DNA, 13 bp, Homo sapiens
tgagctcttgtga

SEQ ID NO: 2413599 - DNA, 21 bp, Homo sapiens
tgaggaaagtcattggcttta

SEQ ID NO: 2413600 - DNA, 22 bp, Homo sapiens
tgaggaaagtcattggctttat

SEQ ID NO: 2413601 - DNA, 17 bp, Homo sapiens
tgaggatcagagtaatc

SEQ ID NO: 2413602 - DNA, 19 bp, Homo sapiens
tgaggatcagagtaatcca

SEQ ID NO: 2413603 - DNA, 20 bp, Homo sapiens
tgaggcacatgtcagcaagt

SEQ ID NO: 2413604 - DNA, 17 bp, Homo sapiens
tgagggaaaagaaaaag

SEQ ID NO: 2413605 - DNA, 18 bp, Homo sapiens
tgagtagaaaggccttta

SEQ ID NO: 2413606 - DNA, 12 bp, Homo sapiens
tgagttttacca

SEQ ID NO: 2413607 - DNA, 16 bp, Homo sapiens
tgatatcccccagcct

SEQ ID NO: 2413608 - DNA, 18 bp, Homo sapiens
tgatccccacgccacagc

SEQ ID NO: 2413609 - DNA, 18 bp, Homo sapiens
tgatcggagcctcctctc

SEQ ID NO: 2413610 - DNA, 17 bp, Homo sapiens
tgatctagagccagtta

SEQ ID NO: 2413611 - DNA, 19 bp, Homo sapiens
tgatctcagctcactgcaa

SEQ ID NO: 2413612 - DNA, 13 bp, Homo sapiens
tgatgaaaataaa

SEQ ID NO: 2413613 - DNA, 17 bp, Homo sapiens
tgatgaaaataaagaat

SEQ ID NO: 2413614 - DNA, 19 bp, Homo sapiens
tgatgaaaataaagaatgg

SEQ ID NO: 2413615 - DNA, 13 bp, Homo sapiens
tgatggttgtaca

SEQ ID NO: 2413616 - DNA, 13 bp, Homo sapiens
tgatgtacatgta

SEQ ID NO: 2413617 - DNA, 22 bp, Homo sapiens
tgattccttgatggagatattt

SEQ ID NO: 2413618 - DNA, 23 bp, Homo sapiens
tgatttattaatatatattatct

SEQ ID NO: 2413619 - DNA, 15 bp, Homo sapiens
tgattttgaaaccat

SEQ ID NO: 2413620 - DNA, 15 bp, Homo sapiens
tgattttgaaatcat

SEQ ID NO: 2413621 - DNA, 18 bp, Homo sapiens
tgcaacctccacctcctg

SEQ ID NO: 2413622 - DNA, 18 bp, Homo sapiens
tgcaactttgtataaaag

SEQ ID NO: 2413623 - DNA, 15 bp, Homo sapiens
tgcacatgtcttaat

SEQ ID NO: 2413624 - DNA, 19 bp, Homo sapiens
tgcaccatgctgctgggga

SEQ ID NO: 2413625 - DNA, 14 bp, Homo sapiens
tgcactgatgttgt

SEQ ID NO: 2413626 - DNA, 12 bp, Homo sapiens
tgcactgtaaaa

SEQ ID NO: 2413627 - DNA, 17 bp, Homo sapiens
tgcactgtaaaatgtgg

SEQ ID NO: 2413628 - DNA, 20 bp, Homo sapiens
tgcaggcaggaacaaacagg

SEQ ID NO: 2413629 - DNA, 14 bp, Homo sapiens
tgcaggtccctaat

SEQ ID NO: 2413630 - DNA, 15 bp, Homo sapiens
tgcaggtccctaata

SEQ ID NO: 2413631 - DNA, 21 bp, Homo sapiens
tgcaggtccctaataaagctg

SEQ ID NO: 2413632 - DNA, 22 bp, Homo sapiens
tgcaggtccctaataaagctgt

SEQ ID NO: 2413633 - DNA, 18 bp, Homo sapiens
tgcagtactttgtgcatt

SEQ ID NO: 2413634 - DNA, 19 bp, Homo sapiens
tgcagtgctcgctgttgct

SEQ ID NO: 2413635 - DNA, 20 bp, Homo sapiens
tgcagtgctcgctgttgctg

SEQ ID NO: 2413636 - DNA, 22 bp, Homo sapiens
tgcagtggcgcgatctcagctc

SEQ ID NO: 2413637 - DNA, 22 bp, Homo sapiens
tgcagtggcgtgatctcagctc

SEQ ID NO: 2413638 - DNA, 18 bp, Homo sapiens
tgcatattattttatgtt

SEQ ID NO: 2413639 - DNA, 21 bp, Homo sapiens
tgcatatttataaaaataaaa

SEQ ID NO: 2413640 - DNA, 16 bp, Homo sapiens
tgcattctggatttta

SEQ ID NO: 2413641 - DNA, 18 bp, Homo sapiens
tgcattttgtttggtatt

SEQ ID NO: 2413642 - DNA, 19 bp, Homo sapiens
tgccaaatataaataaaaa

SEQ ID NO: 2413643 - DNA, 17 bp, Homo sapiens
tgccaagagtgaaggga

SEQ ID NO: 2413644 - DNA, 23 bp, Homo sapiens
tgccaagccatgggtagcctggg

SEQ ID NO: 2413645 - DNA, 16 bp, Homo sapiens
tgccatattgcacatg

SEQ ID NO: 2413646 - DNA, 20 bp, Homo sapiens
tgccatattgcacatgtctt

SEQ ID NO: 2413647 - DNA, 16 bp, Homo sapiens
tgcccccaaccatttc

SEQ ID NO: 2413648 - DNA, 14 bp, Homo sapiens
tgcccccagagcca

SEQ ID NO: 2413649 - DNA, 17 bp, Homo sapiens
tgcccctaccctggact

SEQ ID NO: 2413650 - DNA, 11 bp, Homo sapiens
tgcctctctgc

SEQ ID NO: 2413651 - DNA, 23 bp, Homo sapiens
tgcctctctgcaggtccctaata

SEQ ID NO: 2413652 - DNA, 21 bp, Homo sapiens
tgcctgcccctaccctggact

SEQ ID NO: 2413653 - DNA, 22 bp, Homo sapiens
tgcctgcccctaccctggactt

SEQ ID NO: 2413654 - DNA, 20 bp, Homo sapiens
tgcctgctttttatggcctg

SEQ ID NO: 2413655 - DNA, 19 bp, Homo sapiens
tgcctggaagagcagccct

SEQ ID NO: 2413656 - DNA, 14 bp, Homo sapiens
tgcctttattgtgt

SEQ ID NO: 2413657 - DNA, 19 bp, Homo sapiens
tgctaagtgtgaactggac

SEQ ID NO: 2413658 - DNA, 16 bp, Homo sapiens
tgctaattttgaaaaa

SEQ ID NO: 2413659 - DNA, 18 bp, Homo sapiens
tgctaattttgaaaaact

SEQ ID NO: 2413660 - DNA, 20 bp, Homo sapiens
tgctagggttaggaggtcct

SEQ ID NO: 2413661 - DNA, 17 bp, Homo sapiens
tgctcagagcagtgttt

SEQ ID NO: 2413662 - DNA, 15 bp, Homo sapiens
tgctcaggagccctg

SEQ ID NO: 2413663 - DNA, 19 bp, Homo sapiens
tgctcaggagccctgggag

SEQ ID NO: 2413664 - DNA, 14 bp, Homo sapiens
tgctcataacggat

SEQ ID NO: 2413665 - DNA, 16 bp, Homo sapiens
tgctcataacggatca

SEQ ID NO: 2413666 - DNA, 17 bp, Homo sapiens
tgctcgctgttgctgaa

SEQ ID NO: 2413667 - DNA, 22 bp, Homo sapiens
tgctctgtcttctttgcccaca

SEQ ID NO: 2413668 - DNA, 17 bp, Homo sapiens
tgctcttgatgcctggc

SEQ ID NO: 2413669 - DNA, 11 bp, Homo sapiens
tgctgaatagg

SEQ ID NO: 2413670 - DNA, 18 bp, Homo sapiens
tgctgaataggcgatcac

SEQ ID NO: 2413671 - DNA, 18 bp, Homo sapiens
tgctgactggcttcagca

SEQ ID NO: 2413672 - DNA, 17 bp, Homo sapiens
tgctgatggagccttcc

SEQ ID NO: 2413673 - DNA, 14 bp, Homo sapiens
tgctgctggggaag

SEQ ID NO: 2413674 - DNA, 12 bp, Homo sapiens
ttgaatgcattt

SEQ ID NO: 2413675 - DNA, 13 bp, Homo sapiens
ttgaatgttaaat

SEQ ID NO: 2413676 - DNA, 15 bp, Homo sapiens
ttgaatgttaaataa

SEQ ID NO: 2413677 - DNA, 19 bp, Homo sapiens
ttgaattttttttaacatt

SEQ ID NO: 2413678 - DNA, 16 bp, Homo sapiens
ttgagagaatttgtgc

SEQ ID NO: 2413679 - DNA, 21 bp, Homo sapiens
ttgagatggagtcttgctctg

SEQ ID NO: 2413680 - DNA, 12 bp, Homo sapiens
ttgatgcctggc

SEQ ID NO: 2413681 - DNA, 18 bp, Homo sapiens
ttgatgtaaaatcttgtc

SEQ ID NO: 2413682 - DNA, 20 bp, Homo sapiens
ttgattttagccttctctgt

SEQ ID NO: 2413683 - DNA, 16 bp, Homo sapiens
ttgcacagctatgaag

SEQ ID NO: 2413684 - DNA, 22 bp, Homo sapiens
ttgcacatgtcttaatgaagtt

SEQ ID NO: 2413685 - DNA, 14 bp, Homo sapiens
ttgcatagaataaa

SEQ ID NO: 2413686 - DNA, 21 bp, Homo sapiens
ttgccaagggcataaattatt

SEQ ID NO: 2413687 - DNA, 20 bp, Homo sapiens
ttgccagttgtcctccttcc

SEQ ID NO: 2413688 - DNA, 23 bp, Homo sapiens
ttgccatattgcacatgtcttaa

SEQ ID NO: 2413689 - DNA, 17 bp, Homo sapiens
ttgctcctaatgttgaa

SEQ ID NO: 2413690 - DNA, 17 bp, Homo sapiens
ttgctcttgatgcctgg

SEQ ID NO: 2413691 - DNA, 18 bp, Homo sapiens
ttgctcttgatgcctggc

SEQ ID NO: 2413692 - DNA, 11 bp, Homo sapiens
ttgctgaatag

SEQ ID NO: 2413693 - DNA, 14 bp, Homo sapiens
ttggaaaggaccag

SEQ ID NO: 2413694 - DNA, 15 bp, Homo sapiens
ttggagtgcagtggc

SEQ ID NO: 2413695 - DNA, 20 bp, Homo sapiens
ttggctttatcctctttaga

SEQ ID NO: 2413696 - DNA, 16 bp, Homo sapiens
ttgggaatatttgaat

SEQ ID NO: 2413697 - DNA, 13 bp, Homo sapiens
ttgggagagactt

SEQ ID NO: 2413698 - DNA, 14 bp, Homo sapiens
ttggggacacatgt

SEQ ID NO: 2413699 - DNA, 20 bp, Homo sapiens
ttggggacacatgtatttgg

SEQ ID NO: 2413700 - DNA, 18 bp, Homo sapiens
ttggggtgggtataaaag

SEQ ID NO: 2413701 - DNA, 14 bp, Homo sapiens
ttgtaataaaatgt

SEQ ID NO: 2413702 - DNA, 13 bp, Homo sapiens
ttgtaatgaaaac

SEQ ID NO: 2413703 - DNA, 16 bp, Homo sapiens
ttgtactatttaactg

SEQ ID NO: 2413704 - DNA, 13 bp, Homo sapiens
ttgtatattcact

SEQ ID NO: 2413705 - DNA, 14 bp, Homo sapiens
ttgtattacaaatc

SEQ ID NO: 2413706 - DNA, 14 bp, Homo sapiens
ttgtattcagagtt

SEQ ID NO: 2413707 - DNA, 20 bp, Homo sapiens
ttgtatttattcaataaagt

SEQ ID NO: 2413708 - DNA, 14 bp, Homo sapiens
ttgtcatgtgtata

SEQ ID NO: 2413709 - DNA, 17 bp, Homo sapiens
ttgtctcaatgctcata

SEQ ID NO: 2413710 - DNA, 13 bp, Homo sapiens
ttgtctcagagca

SEQ ID NO: 2413711 - DNA, 13 bp, Homo sapiens
ttgtgaaattatt

SEQ ID NO: 2413712 - DNA, 16 bp, Homo sapiens
ttgtgaggaaagtcat

SEQ ID NO: 2413713 - DNA, 14 bp, Homo sapiens
ttgtgcattctgga

SEQ ID NO: 2413714 - DNA, 18 bp, Homo sapiens
ttgtggactaaaagatat

SEQ ID NO: 2413715 - DNA, 18 bp, Homo sapiens
ttgtgtcccattccccca

SEQ ID NO: 2413716 - DNA, 22 bp, Homo sapiens
ttgtgtcccattcccccagtgc

SEQ ID NO: 2413717 - DNA, 15 bp, Homo sapiens
ttgtgtttgtcatta

SEQ ID NO: 2413718 - DNA, 20 bp, Homo sapiens
ttgtgtttgtcattagcctg

SEQ ID NO: 2413719 - DNA, 16 bp, Homo sapiens
ttgttatataatcatt

SEQ ID NO: 2413720 - DNA, 15 bp, Homo sapiens
ttgtttggtattgta

SEQ ID NO: 2413721 - DNA, 19 bp, Homo sapiens
ttgtttggtattgtattta

SEQ ID NO: 2413722 - DNA, 14 bp, Homo sapiens
ttgttttggatgcc

SEQ ID NO: 2413723 - DNA, 15 bp, Homo sapiens
tttaaaaaccttgta

SEQ ID NO: 2413724 - DNA, 18 bp, Homo sapiens
tttaaaatttttttagaa

SEQ ID NO: 2413725 - DNA, 19 bp, Homo sapiens
tttaaaatttttttagaaa

SEQ ID NO: 2413726 - DNA, 18 bp, Homo sapiens
tttaaacctatactcact

SEQ ID NO: 2413727 - DNA, 14 bp, Homo sapiens
tttaaatgtttttt

SEQ ID NO: 2413728 - DNA, 22 bp, Homo sapiens
tttaacattcctcatgaatgta

SEQ ID NO: 2413729 - DNA, 14 bp, Homo sapiens
tttaactgccttgt

SEQ ID NO: 2413730 - DNA, 14 bp, Homo sapiens
tttaagagacagcc

SEQ ID NO: 2413731 - DNA, 15 bp, Homo sapiens
tttaataaacactct

SEQ ID NO: 2413732 - DNA, 21 bp, Homo sapiens
tttaatgtaatagggaaaatt

SEQ ID NO: 2413733 - DNA, 15 bp, Homo sapiens
tttaattagtgctaa

SEQ ID NO: 2413734 - DNA, 20 bp, Homo sapiens
tttaattagtgctaagtgtg

SEQ ID NO: 2413735 - DNA, 12 bp, Homo sapiens
tttaattttaca

SEQ ID NO: 2413736 - DNA, 19 bp, Homo sapiens
tttacacaatagaattata

SEQ ID NO: 2413737 - DNA, 18 bp, Homo sapiens
tttacatgaattgcattt

SEQ ID NO: 2413738 - DNA, 12 bp, Homo sapiens
tttaccaagttt

SEQ ID NO: 2413739 - DNA, 13 bp, Homo sapiens
tttagaaagcatt

SEQ ID NO: 2413740 - DNA, 16 bp, Homo sapiens
tttagccttctctgtt

SEQ ID NO: 2413741 - DNA, 11 bp, Homo sapiens
tttagttgaat

SEQ ID NO: 2413742 - DNA, 17 bp, Homo sapiens
tttagttgcaactttgt

SEQ ID NO: 2413743 - DNA, 21 bp, Homo sapiens
tttataaaaataaaaaacact

SEQ ID NO: 2413744 - DNA, 13 bp, Homo sapiens
tttatatgttgta

SEQ ID NO: 2413745 - DNA, 15 bp, Homo sapiens
tttatgtgaaacatg

SEQ ID NO: 2413746 - DNA, 21 bp, Homo sapiens
tttattaataaacattctatc

SEQ ID NO: 2413747 - DNA, 17 bp, Homo sapiens
tttattatgcattatat

SEQ ID NO: 2413748 - DNA, 22 bp, Homo sapiens
tttcaggagagagttgaaccta

SEQ ID NO: 2413749 - DNA, 14 bp, Homo sapiens
tttcattgtctgtg

SEQ ID NO: 2413750 - DNA, 23 bp, Homo sapiens
tttccccatttaggtttctgagt

SEQ ID NO: 2413751 - DNA, 11 bp, Homo sapiens
tttccctcctt

SEQ ID NO: 2413752 - DNA, 19 bp, Homo sapiens
tttcctaagtgattgtatg

SEQ ID NO: 2413753 - DNA, 19 bp, Homo sapiens
tttcctcagactctaagaa

SEQ ID NO: 2413754 - DNA, 21 bp, Homo sapiens
tttcgtctgtttataaacatt

SEQ ID NO: 2413755 - DNA, 14 bp, Homo sapiens
tttctaagaaacat

SEQ ID NO: 2413756 - DNA, 17 bp, Homo sapiens
tttctaagaaacattta

SEQ ID NO: 2413757 - DNA, 23 bp, Homo sapiens
tttctccctggatttttaccagt

SEQ ID NO: 2413758 - DNA, 15 bp, Homo sapiens
tttctgagttttacc

SEQ ID NO: 2413759 - DNA, 21 bp, Homo sapiens
tttctgggctgtctattctag

SEQ ID NO: 2413760 - DNA, 22 bp, Homo sapiens
tttcttagaaatttatttccta

SEQ ID NO: 2413761 - DNA, 19 bp, Homo sapiens
tttcttctattgcctctga

SEQ ID NO: 2413762 - DNA, 13 bp, Homo sapiens
tttctttcttaga

SEQ ID NO: 2413763 - DNA, 21 bp, Homo sapiens
tttctttgggaatatttgaat

SEQ ID NO: 2413764 - DNA, 17 bp, Homo sapiens
tttgaaacactttgcat

SEQ ID NO: 2413765 - DNA, 14 bp, Homo sapiens
tttgaactttttat

SEQ ID NO: 2413766 - DNA, 19 bp, Homo sapiens
tttgaatcctctctctgtg

SEQ ID NO: 2413767 - DNA, 18 bp, Homo sapiens
tttgaatgttaaataaat

SEQ ID NO: 2413768 - DNA, 21 bp, Homo sapiens
tttgaatgttaaataaattgt

SEQ ID NO: 2413769 - DNA, 22 bp, Homo sapiens
tttgaatgttaaataaattgta

SEQ ID NO: 2413770 - DNA, 19 bp, Homo sapiens
tttgacgggaaacaaaact

SEQ ID NO: 2413771 - DNA, 17 bp, Homo sapiens
tttgcagttctttggct

SEQ ID NO: 2413772 - DNA, 23 bp, Homo sapiens
tttgccaagggcataaattattg

SEQ ID NO: 2413773 - DNA, 16 bp, Homo sapiens
tttgggaatatttgaa

SEQ ID NO: 2413774 - DNA, 14 bp, Homo sapiens
tttgggagagactt

SEQ ID NO: 2413775 - DNA, 23 bp, Homo sapiens
tttgggagagacttgttttggat

SEQ ID NO: 2413776 - DNA, 13 bp, Homo sapiens
tttgtaatgaaaa

SEQ ID NO: 2413777 - DNA, 14 bp, Homo sapiens
tttgtgtgtagtct

SEQ ID NO: 2413778 - DNA, 22 bp, Homo sapiens
tttgtgtttcagccatgtattt

SEQ ID NO: 2413779 - DNA, 15 bp, Homo sapiens
tttgttcttcttaaa

SEQ ID NO: 2413780 - DNA, 22 bp, Homo sapiens
ttttaaaatgagaaatctaaaa

SEQ ID NO: 2413781 - DNA, 14 bp, Homo sapiens
ttttaacattcctc

SEQ ID NO: 2413782 - DNA, 14 bp, Homo sapiens
ttttaataaacact

SEQ ID NO: 2413783 - DNA, 12 bp, Homo sapiens
ttttaataaatt

SEQ ID NO: 2413784 - DNA, 19 bp, Homo sapiens
ttttagaaagcatttgaat

SEQ ID NO: 2413785 - DNA, 23 bp, Homo sapiens
ttttagccttctctgttcatttc

SEQ ID NO: 2413786 - DNA, 19 bp, Homo sapiens
ttttagttgcaactttgta

SEQ ID NO: 2413787 - DNA, 16 bp, Homo sapiens
ttttatgatacttgaa

SEQ ID NO: 2413788 - DNA, 19 bp, Homo sapiens
ttttatgtgaaacatgttt

SEQ ID NO: 2413789 - DNA, 12 bp, Homo sapiens
ttttattaataa

SEQ ID NO: 2413790 - DNA, 16 bp, Homo sapiens
ttttcatacattttct

SEQ ID NO: 2413791 - DNA, 21 bp, Homo sapiens
ttttcatgattttgaaaccat

SEQ ID NO: 2413792 - DNA, 21 bp, Homo sapiens
ttttcatgattttgaaatcat

SEQ ID NO: 2413793 - DNA, 20 bp, Homo sapiens
ttttcctaagtgattgtatg

SEQ ID NO: 2413794 - DNA, 16 bp, Homo sapiens
ttttctaagaaacatt

SEQ ID NO: 2413795 - DNA, 22 bp, Homo sapiens
ttttctccctggatttttacca

SEQ ID NO: 2413796 - DNA, 23 bp, Homo sapiens
ttttctccctggatttttaccag

SEQ ID NO: 2413797 - DNA, 21 bp, Homo sapiens
ttttcttaaccagatcattgt

SEQ ID NO: 2413798 - DNA, 13 bp, Homo sapiens
ttttcttttctat

SEQ ID NO: 2413799 - DNA, 11 bp, Homo sapiens
ttttgagaaag

SEQ ID NO: 2413800 - DNA, 23 bp, Homo sapiens
ttttgatgaacaaaatttcctaa

SEQ ID NO: 2413801 - DNA, 22 bp, Homo sapiens
ttttgctgtaatgttaatattg

SEQ ID NO: 2413802 - DNA, 11 bp, Homo sapiens
ttttggatgcc

SEQ ID NO: 2413803 - DNA, 12 bp, Homo sapiens
ttttgtctctgc

SEQ ID NO: 2413804 - DNA, 20 bp, Homo sapiens
ttttgtgatgcaaataaata

SEQ ID NO: 2413805 - DNA, 23 bp, Homo sapiens
aaaaagtgggttttttagttgaa

SEQ ID NO: 2413806 - DNA, 14 bp, Homo sapiens
aaaaataacaatga

SEQ ID NO: 2413807 - DNA, 20 bp, Homo sapiens
aaaaatgttctattttaatt

SEQ ID NO: 2413808 - DNA, 20 bp, Homo sapiens
aaaagacaaggaaaaaataa

SEQ ID NO: 2413809 - DNA, 19 bp, Homo sapiens
aaaagatataagtgctgta

SEQ ID NO: 2413810 - DNA, 18 bp, Homo sapiens
aaaagcctgtttaagaga

SEQ ID NO: 2413811 - DNA, 21 bp, Homo sapiens
aaaagctttgaaccctgggac

SEQ ID NO: 2413812 - DNA, 16 bp, Homo sapiens
aaaagggactgagaaa

SEQ ID NO: 2413813 - DNA, 16 bp, Homo sapiens
aaaataaaaaagatcc

SEQ ID NO: 2413814 - DNA, 21 bp, Homo sapiens
aaaataaaaaagatcccaaat

SEQ ID NO: 2413815 - DNA, 15 bp, Homo sapiens
aaaataaagaatgga

SEQ ID NO: 2413816 - DNA, 15 bp, Homo sapiens
aaaatactattctga

SEQ ID NO: 2413817 - DNA, 14 bp, Homo sapiens
aaaatcagccaatt

SEQ ID NO: 2413818 - DNA, 19 bp, Homo sapiens
aaaatcagccaattatgtt

SEQ ID NO: 2413819 - DNA, 20 bp, Homo sapiens
aaaatctattttgtaacttt

SEQ ID NO: 2413820 - DNA, 19 bp, Homo sapiens
aaaatcttgtcatgtgtat

SEQ ID NO: 2413821 - DNA, 21 bp, Homo sapiens
aaaattgatgggatttggtca

SEQ ID NO: 2413822 - DNA, 14 bp, Homo sapiens
aaaattgccatatt

SEQ ID NO: 2413823 - DNA, 17 bp, Homo sapiens
aaaattgccatattgca

SEQ ID NO: 2413824 - DNA, 19 bp, Homo sapiens
aaaatttttaatctttaat

SEQ ID NO: 2413825 - DNA, 14 bp, Homo sapiens
aaaatttttttaga

SEQ ID NO: 2413826 - DNA, 16 bp, Homo sapiens
aaaatttttttagaaa

SEQ ID NO: 2413827 - DNA, 22 bp, Homo sapiens
aaacactgggagaaatgaaaaa

SEQ ID NO: 2413828 - DNA, 15 bp, Homo sapiens
aaacagggctgcctt

SEQ ID NO: 2413829 - DNA, 23 bp, Homo sapiens
aaacatgtttctttgtaatgaaa

SEQ ID NO: 2413830 - DNA, 23 bp, Homo sapiens
aaaccatgaagagatttttcatg

SEQ ID NO: 2413831 - DNA, 18 bp, Homo sapiens
aaactaaggccctcttga

SEQ ID NO: 2413832 - DNA, 14 bp, Homo sapiens
aaactagcatatct

SEQ ID NO: 2413833 - DNA, 18 bp, Homo sapiens
aaactaggtgcatattta

SEQ ID NO: 2413834 - DNA, 12 bp, Homo sapiens
aaagaaaacttg

SEQ ID NO: 2413835 - DNA, 20 bp, Homo sapiens
aaagaaaacttgtattatgt

SEQ ID NO: 2413836 - DNA, 15 bp, Homo sapiens
aaagaaatataccta

SEQ ID NO: 2413837 - DNA, 17 bp, Homo sapiens
aaagaaatatacctaaa

SEQ ID NO: 2413838 - DNA, 13 bp, Homo sapiens
aaagaaattatgt

SEQ ID NO: 2413839 - DNA, 11 bp, Homo sapiens
aaagaacatcc

SEQ ID NO: 2413840 - DNA, 12 bp, Homo sapiens
aaagagtactct

SEQ ID NO: 2413841 - DNA, 17 bp, Homo sapiens
aaagatggggtctgtaa

SEQ ID NO: 2413842 - DNA, 19 bp, Homo sapiens
aaagatggggtctgtaaaa

SEQ ID NO: 2413843 - DNA, 23 bp, Homo sapiens
aaagatggggtctgtaaaatctt

SEQ ID NO: 2413844 - DNA, 17 bp, Homo sapiens
aaagcagcctggccaac

SEQ ID NO: 2413845 - DNA, 17 bp, Homo sapiens
aaagcaggcagaactca

SEQ ID NO: 2413846 - DNA, 15 bp, Homo sapiens
aaagcatttgaatgc

SEQ ID NO: 2413847 - DNA, 22 bp, Homo sapiens
aaagcatttgaatgcattttgt

SEQ ID NO: 2413848 - DNA, 23 bp, Homo sapiens
aaagcatttgaatgcattttgtt

SEQ ID NO: 2413849 - DNA, 14 bp, Homo sapiens
aaaggtaaatcaga

SEQ ID NO: 2413850 - DNA, 18 bp, Homo sapiens
aaaggttcatgcaaactt

SEQ ID NO: 2413851 - DNA, 17 bp, Homo sapiens
aaagtatttaattagtg

SEQ ID NO: 2413852 - DNA, 19 bp, Homo sapiens
aaagtatttaattagtgct

SEQ ID NO: 2413853 - DNA, 15 bp, Homo sapiens
aaagtcattggcttt

SEQ ID NO: 2413854 - DNA, 20 bp, Homo sapiens
aaagtctctggaatttgaaa

SEQ ID NO: 2413855 - DNA, 22 bp, Homo sapiens
aaagtctctggaatttgaaaca

SEQ ID NO: 2413856 - DNA, 17 bp, Homo sapiens
aaagtgggttttttagt

SEQ ID NO: 2413857 - DNA, 16 bp, Homo sapiens
aaagtttgttgaaaca

SEQ ID NO: 2413858 - DNA, 11 bp, Homo sapiens
aaagtttttta

SEQ ID NO: 2413859 - DNA, 22 bp, Homo sapiens
aaagttttttattatgcattat

SEQ ID NO: 2413860 - DNA, 16 bp, Homo sapiens
aaataaaaaagatccc

SEQ ID NO: 2413861 - DNA, 14 bp, Homo sapiens
aaataaagaatgga

SEQ ID NO: 2413862 - DNA, 13 bp, Homo sapiens
aaataaattgtat

SEQ ID NO: 2413863 - DNA, 14 bp, Homo sapiens
aaataaattgtata

SEQ ID NO: 2413864 - DNA, 19 bp, Homo sapiens
aaataaattgtatattcac

SEQ ID NO: 2413865 - DNA, 21 bp, Homo sapiens
aaataaattgtatattcactt

SEQ ID NO: 2413866 - DNA, 23 bp, Homo sapiens
aaataacaaatctcaagcaaaca

SEQ ID NO: 2413867 - DNA, 12 bp, Homo sapiens
aaataacaatga

SEQ ID NO: 2413868 - DNA, 18 bp, Homo sapiens
aaatatatgctaagtctt

SEQ ID NO: 2413869 - DNA, 16 bp, Homo sapiens
aaatatattttaagac

SEQ ID NO: 2413870 - DNA, 22 bp, Homo sapiens
aaatatattttaagacgaaaca

SEQ ID NO: 2413871 - DNA, 17 bp, Homo sapiens
aaatattagaaacagct

SEQ ID NO: 2413872 - DNA, 16 bp, Homo sapiens
aaatattttgctagtt

SEQ ID NO: 2413873 - DNA, 15 bp, Homo sapiens
aaatcactcaaattg

SEQ ID NO: 2413874 - DNA, 21 bp, Homo sapiens
aaatcagactatgaagttttt

SEQ ID NO: 2413875 - DNA, 21 bp, Homo sapiens
aaatcagccaattatgttaaa

SEQ ID NO: 2413876 - DNA, 23 bp, Homo sapiens
aaatcagccaattatgttaaact

SEQ ID NO: 2413877 - DNA, 21 bp, Homo sapiens
aaatcatgaagatatttttcc

SEQ ID NO: 2413878 - DNA, 16 bp, Homo sapiens
aaatcattcattttct

SEQ ID NO: 2413879 - DNA, 17 bp, Homo sapiens
aaatcttgtcatgtgta

SEQ ID NO: 2413880 - DNA, 18 bp, Homo sapiens
aaatcttgtcatgtgtat

SEQ ID NO: 2413881 - DNA, 11 bp, Homo sapiens
aaatgaagaaa

SEQ ID NO: 2413882 - DNA, 11 bp, Homo sapiens
aaatgagaaat

SEQ ID NO: 2413883 - DNA, 13 bp, Homo sapiens
aaatgagaaatct

SEQ ID NO: 2413884 - DNA, 16 bp, Homo sapiens
aaatgagaaatctaaa

SEQ ID NO: 2413885 - DNA, 19 bp, Homo sapiens
aaatggttgtattagatgt

SEQ ID NO: 2413886 - DNA, 20 bp, Homo sapiens
aaatggttgtattagatgtt

SEQ ID NO: 2413887 - DNA, 22 bp, Homo sapiens
aaatgtgggattatgggtcaca

SEQ ID NO: 2413888 - DNA, 21 bp, Homo sapiens
aaatgtttttttttaaagact

SEQ ID NO: 2413889 - DNA, 13 bp, Homo sapiens
aaattaagacttt

SEQ ID NO: 2413890 - DNA, 21 bp, Homo sapiens
aaattagttagccaatatttt

SEQ ID NO: 2413891 - DNA, 20 bp, Homo sapiens
aaattattgtttttcttttt

SEQ ID NO: 2413892 - DNA, 18 bp, Homo sapiens
aaattctgtctctggatt

SEQ ID NO: 2413893 - DNA, 15 bp, Homo sapiens
aaattgccatattgc

SEQ ID NO: 2413894 - DNA, 19 bp, Homo sapiens
aaattgccatattgcacat

SEQ ID NO: 2413895 - DNA, 21 bp, Homo sapiens
aaattgccatattgcacatgt

SEQ ID NO: 2413896 - DNA, 17 bp, Homo sapiens
aaattgtattacaaatc

SEQ ID NO: 2413897 - DNA, 17 bp, Homo sapiens
aaatttacatcatttct

SEQ ID NO: 2413898 - DNA, 17 bp, Homo sapiens
aaatttcagcagctgca

SEQ ID NO: 2413899 - DNA, 18 bp, Homo sapiens
aaatttcagcagctgcag

SEQ ID NO: 2413900 - DNA, 19 bp, Homo sapiens
aaatttgtactatttaact

SEQ ID NO: 2413901 - DNA, 18 bp, Homo sapiens
aacagccactacattact

SEQ ID NO: 2413902 - DNA, 14 bp, Homo sapiens
aacagggctgcctt

SEQ ID NO: 2413903 - DNA, 21 bp, Homo sapiens
aacatctgagaaaagctttga

SEQ ID NO: 2413904 - DNA, 13 bp, Homo sapiens
aacatgatttggg

SEQ ID NO: 2413905 - DNA, 20 bp, Homo sapiens
aacattcctcatgaatgtaa

SEQ ID NO: 2413906 - DNA, 12 bp, Homo sapiens
aaccagatcatt

SEQ ID NO: 2413907 - DNA, 22 bp, Homo sapiens
aaccatacaaaaattccttttc

SEQ ID NO: 2413908 - DNA, 21 bp, Homo sapiens
aaccatgaagagatttttcat

SEQ ID NO: 2413909 - DNA, 24 bp, Homo sapiens
aaccatgaagagatttttcatgat

SEQ ID NO: 2413910 - DNA, 16 bp, Homo sapiens
aacccgaggcccgcat

SEQ ID NO: 2413911 - DNA, 13 bp, Homo sapiens
aacctccacctcc

SEQ ID NO: 2413912 - DNA, 19 bp, Homo sapiens
aacctgatgaaaataaaga

SEQ ID NO: 2413913 - DNA, 23 bp, Homo sapiens
aacctgatgaaaataaagaatgg

SEQ ID NO: 2413914 - DNA, 17 bp, Homo sapiens
aacggatcagaaataca

SEQ ID NO: 2413915 - DNA, 21 bp, Homo sapiens
aactagccaaaccaggaccct

SEQ ID NO: 2413916 - DNA, 22 bp, Homo sapiens
aactcatctaggtaaattacag

SEQ ID NO: 2413917 - DNA, 20 bp, Homo sapiens
aactctctggaagcccctgg

SEQ ID NO: 2413918 - DNA, 23 bp, Homo sapiens
aactgacacatgctgaacatcac

SEQ ID NO: 2413919 - DNA, 22 bp, Homo sapiens
aactgactattcttgatgtaaa

SEQ ID NO: 2413920 - DNA, 19 bp, Homo sapiens
aactgctaatctactttct

SEQ ID NO: 2413921 - DNA, 13 bp, Homo sapiens
aactggaaagaag

SEQ ID NO: 2413922 - DNA, 18 bp, Homo sapiens
aactggaccctgttgcta

SEQ ID NO: 2413923 - DNA, 21 bp, Homo sapiens
aactggaccctgttgctaagc

SEQ ID NO: 2413924 - DNA, 20 bp, Homo sapiens
aacttgctgcagtatgaaaa

SEQ ID NO: 2413925 - DNA, 22 bp, Homo sapiens
aacttgctgcagtatgaaaata

SEQ ID NO: 2413926 - DNA, 16 bp, Homo sapiens
aacttgtattatgtgt

SEQ ID NO: 2413927 - DNA, 13 bp, Homo sapiens
aagaaattatgtg

SEQ ID NO: 2413928 - DNA, 22 bp, Homo sapiens
aagaaattatgtgccagattta

SEQ ID NO: 2413929 - DNA, 12 bp, Homo sapiens
actggaaagaag

SEQ ID NO: 2413930 - DNA, 18 bp, Homo sapiens
actggaccctgttgctaa

SEQ ID NO: 2413931 - DNA, 17 bp, Homo sapiens
actgggagaaatgaaaa

SEQ ID NO: 2413932 - DNA, 21 bp, Homo sapiens
actgtaaaatgtgggattatg

SEQ ID NO: 2413933 - DNA, 18 bp, Homo sapiens
actgtacagacagaaaaa

SEQ ID NO: 2413934 - DNA, 15 bp, Homo sapiens
actgtacttgctctt

SEQ ID NO: 2413935 - DNA, 18 bp, Homo sapiens
actgtctctcatgaacct

SEQ ID NO: 2413936 - DNA, 19 bp, Homo sapiens
actgtgtaagggccagaaa

SEQ ID NO: 2413937 - DNA, 20 bp, Homo sapiens
actgttggggtgggtataaa

SEQ ID NO: 2413938 - DNA, 21 bp, Homo sapiens
actgttggggtgggtataaaa

SEQ ID NO: 2413939 - DNA, 22 bp, Homo sapiens
actgttggggtgggtataaaag

SEQ ID NO: 2413940 - DNA, 23 bp, Homo sapiens
actgtttggaaattgattttgaa

SEQ ID NO: 2413941 - DNA, 14 bp, Homo sapiens
acttaattgctaca

SEQ ID NO: 2413942 - DNA, 20 bp, Homo sapiens
acttcaggtatacctcactt

SEQ ID NO: 2413943 - DNA, 12 bp, Homo sapiens
acttgaaaatta

SEQ ID NO: 2413944 - DNA, 16 bp, Homo sapiens
acttgaaaattaacat

SEQ ID NO: 2413945 - DNA, 17 bp, Homo sapiens
acttgctcttgatgcct

SEQ ID NO: 2413946 - DNA, 15 bp, Homo sapiens
acttgggtcttccct

SEQ ID NO: 2413947 - DNA, 14 bp, Homo sapiens
acttgtattatgtg

SEQ ID NO: 2413948 - DNA, 15 bp, Homo sapiens
acttgtattatgtgt

SEQ ID NO: 2413949 - DNA, 18 bp, Homo sapiens
acttgtattatgtgtgtt

SEQ ID NO: 2413950 - DNA, 24 bp, Homo sapiens
acttgtcattgttatataatcatt

SEQ ID NO: 2413951 - DNA, 19 bp, Homo sapiens
acttgtggactaaaagata

SEQ ID NO: 2413952 - DNA, 11 bp, Homo sapiens
acttgtgtctg

SEQ ID NO: 2413953 - DNA, 18 bp, Homo sapiens
actttacacaatagaatt

SEQ ID NO: 2413954 - DNA, 23 bp, Homo sapiens
actttagggaagtacttttggca

SEQ ID NO: 2413955 - DNA, 22 bp, Homo sapiens
actttatcttgaataatgtaag

SEQ ID NO: 2413956 - DNA, 13 bp, Homo sapiens
actttatgtagtt

SEQ ID NO: 2413957 - DNA, 23 bp, Homo sapiens
actttgaactactagaaaattgt

SEQ ID NO: 2413958 - DNA, 19 bp, Homo sapiens
actttgtataaaagggact

SEQ ID NO: 2413959 - DNA, 23 bp, Homo sapiens
acttttatgatacttgaaaatta

SEQ ID NO: 2413960 - DNA, 19 bp, Homo sapiens
acttttcctttgaatcctc

SEQ ID NO: 2413961 - DNA, 12 bp, Homo sapiens
acttttcttcta

SEQ ID NO: 2413962 - DNA, 18 bp, Homo sapiens
acttttcttctattgcct

SEQ ID NO: 2413963 - DNA, 15 bp, Homo sapiens
actttttattgattt

SEQ ID NO: 2413964 - DNA, 22 bp, Homo sapiens
actttttttttttaagagtaaa

SEQ ID NO: 2413965 - DNA, 13 bp, Homo sapiens
agaaaagctataa

SEQ ID NO: 2413966 - DNA, 12 bp, Homo sapiens
agaaacatttat

SEQ ID NO: 2413967 - DNA, 15 bp, Homo sapiens
agaaacatttatatt

SEQ ID NO: 2413968 - DNA, 15 bp, Homo sapiens
agaaagcatttgaat

SEQ ID NO: 2413969 - DNA, 20 bp, Homo sapiens
agaaagcatttgaatgcatt

SEQ ID NO: 2413970 - DNA, 16 bp, Homo sapiens
agaaaggataaagttg

SEQ ID NO: 2413971 - DNA, 14 bp, Homo sapiens
agaaaggcctttaa

SEQ ID NO: 2413972 - DNA, 15 bp, Homo sapiens
agaaaggcctttaaa

SEQ ID NO: 2413973 - DNA, 16 bp, Homo sapiens
agaaaggcctttaaaa

SEQ ID NO: 2413974 - DNA, 17 bp, Homo sapiens
agaaaggcctttaaaat

SEQ ID NO: 2413975 - DNA, 19 bp, Homo sapiens
agaaaggcctttaaaattt

SEQ ID NO: 2413976 - DNA, 12 bp, Homo sapiens
agaaagttgatt

SEQ ID NO: 2413977 - DNA, 16 bp, Homo sapiens
agaaatacagattttg

SEQ ID NO: 2413978 - DNA, 17 bp, Homo sapiens
agaaatgaaaaaatata

SEQ ID NO: 2413979 - DNA, 15 bp, Homo sapiens
agaaatggttgtatt

SEQ ID NO: 2413980 - DNA, 17 bp, Homo sapiens
agaaatggttgtattag

SEQ ID NO: 2413981 - DNA, 19 bp, Homo sapiens
agaaatggttgtattagat

SEQ ID NO: 2413982 - DNA, 16 bp, Homo sapiens
agaaatttataaactt

SEQ ID NO: 2413983 - DNA, 13 bp, Homo sapiens
agaaatttatttc

SEQ ID NO: 2413984 - DNA, 23 bp, Homo sapiens
agaaatttatttcctagttctgt

SEQ ID NO: 2413985 - DNA, 22 bp, Homo sapiens
agaactgcctttggcagagttc

SEQ ID NO: 2413986 - DNA, 19 bp, Homo sapiens
agaagctctgaagaactct

SEQ ID NO: 2413987 - DNA, 14 bp, Homo sapiens
agaataaaattttt

SEQ ID NO: 2413988 - DNA, 18 bp, Homo sapiens
agacactgatctggctgc

SEQ ID NO: 2413989 - DNA, 20 bp, Homo sapiens
agacagagtcttcctctgtc

SEQ ID NO: 2413990 - DNA, 22 bp, Homo sapiens
agacagcccaggatactggcac

SEQ ID NO: 2413991 - DNA, 22 bp, Homo sapiens
agacccttattgctgtcctgga

SEQ ID NO: 2413992 - DNA, 21 bp, Homo sapiens
agacgtgcacgcacactgtct

SEQ ID NO: 2413993 - DNA, 22 bp, Homo sapiens
agacgtgcacgcacactgtctg

SEQ ID NO: 2413994 - DNA, 23 bp, Homo sapiens
agactacaggcacacaccaccac

SEQ ID NO: 2413995 - DNA, 16 bp, Homo sapiens
agactctaagaaagaa

SEQ ID NO: 2413996 - DNA, 23 bp, Homo sapiens
agactgtttttcagggaggtggc

SEQ ID NO: 2413997 - DNA, 14 bp, Homo sapiens
agagacagcccagg

SEQ ID NO: 2413998 - DNA, 12 bp, Homo sapiens
agagacttgttt

SEQ ID NO: 2413999 - DNA, 18 bp, Homo sapiens
agagacttgttttggatg

SEQ ID NO: 2414000 - DNA, 14 bp, Homo sapiens
agagagtggctggg

SEQ ID NO: 2414001 - DNA, 20 bp, Homo sapiens
agagcacgcctgtactagag

SEQ ID NO: 2414002 - DNA, 23 bp, Homo sapiens
agagcagtttggtttctagcatg

SEQ ID NO: 2414003 - DNA, 19 bp, Homo sapiens
agagcatcaggcctagagg

SEQ ID NO: 2414004 - DNA, 11 bp, Homo sapiens
agagccacagt

SEQ ID NO: 2414005 - DNA, 14 bp, Homo sapiens
agagcgcacaggga

SEQ ID NO: 2414006 - DNA, 20 bp, Homo sapiens
agaggcttccttcatttcct

SEQ ID NO: 2414007 - DNA, 18 bp, Homo sapiens
agagggaatgtgaaattt

SEQ ID NO: 2414008 - DNA, 14 bp, Homo sapiens
agaggttgtctgtg

SEQ ID NO: 2414009 - DNA, 13 bp, Homo sapiens
agagttagactgt

SEQ ID NO: 2414010 - DNA, 14 bp, Homo sapiens
agagttagactgtt

SEQ ID NO: 2414011 - DNA, 17 bp, Homo sapiens
agagttagactgttggg

SEQ ID NO: 2414012 - DNA, 13 bp, Homo sapiens
agagttttggatg

SEQ ID NO: 2414013 - DNA, 21 bp, Homo sapiens
agataggtcagtgcaaatact

SEQ ID NO: 2414014 - DNA, 16 bp, Homo sapiens
agatataagtgctgta

SEQ ID NO: 2414015 - DNA, 18 bp, Homo sapiens
agatataagtgctgtata

SEQ ID NO: 2414016 - DNA, 16 bp, Homo sapiens
agatcttttattttgc

SEQ ID NO: 2414017 - DNA, 21 bp, Homo sapiens
agatgtagcccctctcctgga

SEQ ID NO: 2414018 - DNA, 12 bp, Homo sapiens
agatgttctcta

SEQ ID NO: 2414019 - DNA, 21 bp, Homo sapiens
agatttccttctttttttctt

SEQ ID NO: 2414020 - DNA, 15 bp, Homo sapiens
agattttgatagcaa

SEQ ID NO: 2414021 - DNA, 19 bp, Homo sapiens
agattttgatagcaaagcg

SEQ ID NO: 2414022 - DNA, 21 bp, Homo sapiens
agcaaaaccaaatattccaga

SEQ ID NO: 2414023 - DNA, 14 bp, Homo sapiens
agcaagtcagggtt

SEQ ID NO: 2414024 - DNA, 16 bp, Homo sapiens
agcaatctgaccctat

SEQ ID NO: 2414025 - DNA, 15 bp, Homo sapiens
agcaatgcctgccca

SEQ ID NO: 2414026 - DNA, 14 bp, Homo sapiens
agcactttagaata

SEQ ID NO: 2414027 - DNA, 19 bp, Homo sapiens
agcagttgagacaagaaaa

SEQ ID NO: 2414028 - DNA, 22 bp, Homo sapiens
agcagttgagacaagaaaataa

SEQ ID NO: 2414029 - DNA, 20 bp, Homo sapiens
agcagtttggtttctagcat

SEQ ID NO: 2414030 - DNA, 14 bp, Homo sapiens
agcatgcacaaatt

SEQ ID NO: 2414031 - DNA, 13 bp, Homo sapiens
agcatttgaatgc

SEQ ID NO: 2414032 - DNA, 16 bp, Homo sapiens
agcatttgtcaacaaa

SEQ ID NO: 2414033 - DNA, 13 bp, Homo sapiens
agccaagtgcagg

SEQ ID NO: 2414034 - DNA, 14 bp, Homo sapiens
agccaatatttttc

SEQ ID NO: 2414035 - DNA, 17 bp, Homo sapiens
agccaattatgttaaac

SEQ ID NO: 2414036 - DNA, 20 bp, Homo sapiens
agccaattatgttaaactag

SEQ ID NO: 2414037 - DNA, 16 bp, Homo sapiens
agccaggaggcctgct

SEQ ID NO: 2414038 - DNA, 19 bp, Homo sapiens
agccaggaggcctgctagg

SEQ ID NO: 2414039 - DNA, 18 bp, Homo sapiens
agccatgggtagcctggg

SEQ ID NO: 2414040 - DNA, 16 bp, Homo sapiens
agcccactgtacttgc

SEQ ID NO: 2414041 - DNA, 19 bp, Homo sapiens
agccccaccctcagatgca

SEQ ID NO: 2414042 - DNA, 13 bp, Homo sapiens
agccctgcaccat

SEQ ID NO: 2414043 - DNA, 11 bp, Homo sapiens
agccctgtctc

SEQ ID NO: 2414044 - DNA, 21 bp, Homo sapiens
agccctttacttgacctccta

SEQ ID NO: 2414045 - DNA, 15 bp, Homo sapiens
agcccttttgtctct

SEQ ID NO: 2414046 - DNA, 21 bp, Homo sapiens
agcctaagggatcctgcctgc

SEQ ID NO: 2414047 - DNA, 21 bp, Homo sapiens
agcctcaagtcttatttcctc

SEQ ID NO: 2414048 - DNA, 16 bp, Homo sapiens
agcctcctttctggct

SEQ ID NO: 2414049 - DNA, 13 bp, Homo sapiens
agcctgagtagaa

SEQ ID NO: 2414050 - DNA, 17 bp, Homo sapiens
agcctgctgcctgcttt

SEQ ID NO: 2414051 - DNA, 20 bp, Homo sapiens
agcctgggtgtaaaacctgg

SEQ ID NO: 2414052 - DNA, 19 bp, Homo sapiens
agccttctctgttcatttc

SEQ ID NO: 2414053 - DNA, 20 bp, Homo sapiens
agccttctctgttcatttcc

SEQ ID NO: 2414054 - DNA, 22 bp, Homo sapiens
agccttctctgttcatttcctc

SEQ ID NO: 2414055 - DNA, 16 bp, Homo sapiens
agccttggggattctt

SEQ ID NO: 2414056 - DNA, 19 bp, Homo sapiens
agcgctagaggaagcagcc

SEQ ID NO: 2414057 - DNA, 13 bp, Homo sapiens
agcggcatcaggc

SEQ ID NO: 2414058 - DNA, 17 bp, Homo sapiens
agctacccgcagagttc

SEQ ID NO: 2414059 - DNA, 13 bp, Homo sapiens
attttaaacacat

SEQ ID NO: 2414060 - DNA, 21 bp, Homo sapiens
attttatgttgcatagaataa

SEQ ID NO: 2414061 - DNA, 21 bp, Homo sapiens
attttatttttttctgaatta

SEQ ID NO: 2414062 - DNA, 17 bp, Homo sapiens
attttctaagaaacatt

SEQ ID NO: 2414063 - DNA, 14 bp, Homo sapiens
attttctccctgga

SEQ ID NO: 2414064 - DNA, 23 bp, Homo sapiens
attttctccctggatttttacca

SEQ ID NO: 2414065 - DNA, 13 bp, Homo sapiens
attttgaaaaact

SEQ ID NO: 2414066 - DNA, 20 bp, Homo sapiens
attttgaaatcatgaagata

SEQ ID NO: 2414067 - DNA, 18 bp, Homo sapiens
attttgtgatgcaaataa

SEQ ID NO: 2414068 - DNA, 17 bp, Homo sapiens
attttgtgtttaggaac

SEQ ID NO: 2414069 - DNA, 15 bp, Homo sapiens
attttgtttaaatta

SEQ ID NO: 2414070 - DNA, 14 bp, Homo sapiens
attttgtttggtat

SEQ ID NO: 2414071 - DNA, 18 bp, Homo sapiens
attttgtttggtattgta

SEQ ID NO: 2414072 - DNA, 19 bp, Homo sapiens
attttgtttggtattgtat

SEQ ID NO: 2414073 - DNA, 11 bp, Homo sapiens
atttttaccag

SEQ ID NO: 2414074 - DNA, 21 bp, Homo sapiens
caaaacagtattgacttgtat

SEQ ID NO: 2414075 - DNA, 18 bp, Homo sapiens
caaactcctgacctcagg

SEQ ID NO: 2414076 - DNA, 17 bp, Homo sapiens
caaactgcctaagccct

SEQ ID NO: 2414077 - DNA, 18 bp, Homo sapiens
caaactgcctaagccctc

SEQ ID NO: 2414078 - DNA, 12 bp, Homo sapiens
caaagaaattat

SEQ ID NO: 2414079 - DNA, 17 bp, Homo sapiens
caaagatatctcatctc

SEQ ID NO: 2414080 - DNA, 16 bp, Homo sapiens
caaagcaataatagta

SEQ ID NO: 2414081 - DNA, 19 bp, Homo sapiens
caaagtcctgggattacag

SEQ ID NO: 2414082 - DNA, 21 bp, Homo sapiens
caaagtctctggaatttgaaa

SEQ ID NO: 2414083 - DNA, 22 bp, Homo sapiens
caaatccagcctgctgcctgct

SEQ ID NO: 2414084 - DNA, 15 bp, Homo sapiens
caaattctgtctctg

SEQ ID NO: 2414085 - DNA, 17 bp, Homo sapiens
caaattgtaagcatgca

SEQ ID NO: 2414086 - DNA, 18 bp, Homo sapiens
caaattgtgcagtacttt

SEQ ID NO: 2414087 - DNA, 15 bp, Homo sapiens
caacatgcactgatg

SEQ ID NO: 2414088 - DNA, 21 bp, Homo sapiens
caaccagaccattgtctcaga

SEQ ID NO: 2414089 - DNA, 20 bp, Homo sapiens
caaccagattgtcagctcct

SEQ ID NO: 2414090 - DNA, 20 bp, Homo sapiens
caacctctgcctcccaggtt

SEQ ID NO: 2414091 - DNA, 13 bp, Homo sapiens
caacgtggcccag

SEQ ID NO: 2414092 - DNA, 23 bp, Homo sapiens
caacgtggctttttttttttccc

SEQ ID NO: 2414093 - DNA, 14 bp, Homo sapiens
caactatggcctgt

SEQ ID NO: 2414094 - DNA, 20 bp, Homo sapiens
caagaaaataagagctcagg

SEQ ID NO: 2414095 - DNA, 15 bp, Homo sapiens
caagcaaatgtgaat

SEQ ID NO: 2414096 - DNA, 17 bp, Homo sapiens
caagcaaatgtgaatca

SEQ ID NO: 2414097 - DNA, 22 bp, Homo sapiens
caagcagttgggactacaggcg

SEQ ID NO: 2414098 - DNA, 14 bp, Homo sapiens
caagcattctgtct

SEQ ID NO: 2414099 - DNA, 19 bp, Homo sapiens
caagtacaaccacacccac

SEQ ID NO: 2414100 - DNA, 24 bp, Homo sapiens
caagtacaaccacacccacactca

SEQ ID NO: 2414101 - DNA, 16 bp, Homo sapiens
caataaagtatttaat

SEQ ID NO: 2414102 - DNA, 17 bp, Homo sapiens
caataaagtatttaatt

SEQ ID NO: 2414103 - DNA, 16 bp, Homo sapiens
caatataagcttttct

SEQ ID NO: 2414104 - DNA, 18 bp, Homo sapiens
caatcctcccacttcagc

SEQ ID NO: 2414105 - DNA, 22 bp, Homo sapiens
caatcctcccacttcagcctcc

SEQ ID NO: 2414106 - DNA, 14 bp, Homo sapiens
caattaattttaga

SEQ ID NO: 2414107 - DNA, 20 bp, Homo sapiens
caattgggagctgccaagag

SEQ ID NO: 2414108 - DNA, 14 bp, Homo sapiens
cacaacgtgcattg

SEQ ID NO: 2414109 - DNA, 21 bp, Homo sapiens
cacacaaattatcttaaaact

SEQ ID NO: 2414110 - DNA, 21 bp, Homo sapiens
cacaccaggcttgcctgcagg

SEQ ID NO: 2414111 - DNA, 19 bp, Homo sapiens
cacactcatgcattgtcct

SEQ ID NO: 2414112 - DNA, 20 bp, Homo sapiens
cacactcatgcattgtcctc

SEQ ID NO: 2414113 - DNA, 19 bp, Homo sapiens
cacagaagtgctttcttct

SEQ ID NO: 2414114 - DNA, 14 bp, Homo sapiens
cacagatcacagct

SEQ ID NO: 2414115 - DNA, 22 bp, Homo sapiens
cacagatcacagcttcagccag

SEQ ID NO: 2414116 - DNA, 17 bp, Homo sapiens
cacagcttcagccagga

SEQ ID NO: 2414117 - DNA, 20 bp, Homo sapiens
cacagggagtgcacatatcc

SEQ ID NO: 2414118 - DNA, 13 bp, Homo sapiens
cacagttccccta

SEQ ID NO: 2414119 - DNA, 14 bp, Homo sapiens
cacagttcctggga

SEQ ID NO: 2414120 - DNA, 17 bp, Homo sapiens
cacatgtatctatgcat

SEQ ID NO: 2414121 - DNA, 21 bp, Homo sapiens
cacatgtcagcaagtcctaag

SEQ ID NO: 2414122 - DNA, 12 bp, Homo sapiens
cacatgtcttaa

SEQ ID NO: 2414123 - DNA, 21 bp, Homo sapiens
cacattaggaaaagttgctat

SEQ ID NO: 2414124 - DNA, 23 bp, Homo sapiens
cacattcagggctattttttccc

SEQ ID NO: 2414125 - DNA, 13 bp, Homo sapiens
caccaagctgctg

SEQ ID NO: 2414126 - DNA, 16 bp, Homo sapiens
caccaggactagggct

SEQ ID NO: 2414127 - DNA, 14 bp, Homo sapiens
caccaggctgctca

SEQ ID NO: 2414128 - DNA, 17 bp, Homo sapiens
caccatgctgctgggga

SEQ ID NO: 2414129 - DNA, 22 bp, Homo sapiens
caccatgctgctggggaagaca

SEQ ID NO: 2414130 - DNA, 17 bp, Homo sapiens
caccatttggatcctgt

SEQ ID NO: 2414131 - DNA, 16 bp, Homo sapiens
caccctccagagacaa

SEQ ID NO: 2414132 - DNA, 15 bp, Homo sapiens
cacctgtcccagaaa

SEQ ID NO: 2414133 - DNA, 14 bp, Homo sapiens
caccttagaccacc

SEQ ID NO: 2414134 - DNA, 19 bp, Homo sapiens
caccttagaccaccaagcc

SEQ ID NO: 2414135 - DNA, 23 bp, Homo sapiens
caccttagaccaccaagccttga

SEQ ID NO: 2414136 - DNA, 15 bp, Homo sapiens
caccttgcagctctc

SEQ ID NO: 2414137 - DNA, 14 bp, Homo sapiens
cacctttaaagtgt

SEQ ID NO: 2414138 - DNA, 12 bp, Homo sapiens
cacgccacagcc

SEQ ID NO: 2414139 - DNA, 14 bp, Homo sapiens
cacgccacagccct

SEQ ID NO: 2414140 - DNA, 22 bp, Homo sapiens
cacgctaatcccgattcaccct

SEQ ID NO: 2414141 - DNA, 23 bp, Homo sapiens
cacgctctctccaggcaggtctg

SEQ ID NO: 2414142 - DNA, 18 bp, Homo sapiens
cacgtggtaaaacacttg

SEQ ID NO: 2414143 - DNA, 22 bp, Homo sapiens
cactaattcattaatctgcctc

SEQ ID NO: 2414144 - DNA, 14 bp, Homo sapiens
cactacaacctccg

SEQ ID NO: 2414145 - DNA, 17 bp, Homo sapiens
cactcacaacagctgcc

SEQ ID NO: 2414146 - DNA, 19 bp, Homo sapiens
cactcatgcattgtcctct

SEQ ID NO: 2414147 - DNA, 18 bp, Homo sapiens
cactctgttcattcctcc

SEQ ID NO: 2414148 - DNA, 14 bp, Homo sapiens
cactgcaacctctg

SEQ ID NO: 2414149 - DNA, 13 bp, Homo sapiens
cactgctcacact

SEQ ID NO: 2414150 - DNA, 15 bp, Homo sapiens
cactggatgaaaatg

SEQ ID NO: 2414151 - DNA, 15 bp, Homo sapiens
cactgtacttgctct

SEQ ID NO: 2414152 - DNA, 16 bp, Homo sapiens
cacttgggtcttccct

SEQ ID NO: 2414153 - DNA, 23 bp, Homo sapiens
cagaaagcagttgagacaagaaa

SEQ ID NO: 2414154 - DNA, 15 bp, Homo sapiens
cagaaatacagattt

SEQ ID NO: 2414155 - DNA, 23 bp, Homo sapiens
cagaaatacagattttgatagca

SEQ ID NO: 2414156 - DNA, 21 bp, Homo sapiens
cagacagatggaaaagggaga

SEQ ID NO: 2414157 - DNA, 23 bp, Homo sapiens
cagagacaacaggtaaaacaggg

SEQ ID NO: 2414158 - DNA, 23 bp, Homo sapiens
cagaggcgcatgaatttgtgaag

SEQ ID NO: 2414159 - DNA, 22 bp, Homo sapiens
cagataaaggttcatgcaaact

SEQ ID NO: 2414160 - DNA, 18 bp, Homo sapiens
cagatcacagcttcagcc

SEQ ID NO: 2414161 - DNA, 22 bp, Homo sapiens
cagatcacagcttcagccagga

SEQ ID NO: 2414162 - DNA, 16 bp, Homo sapiens
cagatcattgtgaaat

SEQ ID NO: 2414163 - DNA, 22 bp, Homo sapiens
cagatcattgtgaaattattca

SEQ ID NO: 2414164 - DNA, 17 bp, Homo sapiens
cagatgcacatgagctg

SEQ ID NO: 2414165 - DNA, 16 bp, Homo sapiens
cagatttttacacatg

SEQ ID NO: 2414166 - DNA, 23 bp, Homo sapiens
cagcaagttagaactagccaaac

SEQ ID NO: 2414167 - DNA, 14 bp, Homo sapiens
cagcactttagaat

SEQ ID NO: 2414168 - DNA, 22 bp, Homo sapiens
cagcactttagaatatgccttg

SEQ ID NO: 2414169 - DNA, 18 bp, Homo sapiens
cagccaactatggcctgt

SEQ ID NO: 2414170 - DNA, 18 bp, Homo sapiens
cagccaattatgttaaac

SEQ ID NO: 2414171 - DNA, 13 bp, Homo sapiens
cagccctcagaat

SEQ ID NO: 2414172 - DNA, 13 bp, Homo sapiens
cagccctgcacca

SEQ ID NO: 2414173 - DNA, 14 bp, Homo sapiens
cagcccttttgtct

SEQ ID NO: 2414174 - DNA, 16 bp, Homo sapiens
cagcccttttgtctct

SEQ ID NO: 2414175 - DNA, 14 bp, Homo sapiens
cagcctacaggcct

SEQ ID NO: 2414176 - DNA, 18 bp, Homo sapiens
cagcctgcagactcactg

SEQ ID NO: 2414177 - DNA, 14 bp, Homo sapiens
cagcggcatcaggc

SEQ ID NO: 2414178 - DNA, 21 bp, Homo sapiens
cagctcagaagtttcttcttt

SEQ ID NO: 2414179 - DNA, 22 bp, Homo sapiens
cagctcagaagtttcttcttta

SEQ ID NO: 2414180 - DNA, 18 bp, Homo sapiens
cagctgcccccagagcca

SEQ ID NO: 2414181 - DNA, 20 bp, Homo sapiens
cagctgcccccagagccaca

SEQ ID NO: 2414182 - DNA, 15 bp, Homo sapiens
cagcttcagccagga

SEQ ID NO: 2414183 - DNA, 14 bp, Homo sapiens
cagctttagccaag

SEQ ID NO: 2414184 - DNA, 21 bp, Homo sapiens
cagctttatggagatataatt

SEQ ID NO: 2414185 - DNA, 13 bp, Homo sapiens
caggaagctgtga

SEQ ID NO: 2414186 - DNA, 18 bp, Homo sapiens
caggagccctgggaggct

SEQ ID NO: 2414187 - DNA, 19 bp, Homo sapiens
caggagccctgggaggctc

SEQ ID NO: 2414188 - DNA, 15 bp, Homo sapiens
ctgcaaactgccttc

SEQ ID NO: 2414189 - DNA, 18 bp, Homo sapiens
ctgcacaccctccagaga

SEQ ID NO: 2414190 - DNA, 15 bp, Homo sapiens
ctgcagactcactgt

SEQ ID NO: 2414191 - DNA, 11 bp, Homo sapiens
ctgcagcctcc

SEQ ID NO: 2414192 - DNA, 14 bp, Homo sapiens
ctgcaggcaggaac

SEQ ID NO: 2414193 - DNA, 11 bp, Homo sapiens
ctgcaggtccc

SEQ ID NO: 2414194 - DNA, 12 bp, Homo sapiens
ctgcaggtccct

SEQ ID NO: 2414195 - DNA, 13 bp, Homo sapiens
ctgcaggtcccta

SEQ ID NO: 2414196 - DNA, 14 bp, Homo sapiens
ctgcaggtccctaa

SEQ ID NO: 2414197 - DNA, 20 bp, Homo sapiens
ctgcaggtccctaataaagc

SEQ ID NO: 2414198 - DNA, 17 bp, Homo sapiens
ctgcagtatgaaaataa

SEQ ID NO: 2414199 - DNA, 19 bp, Homo sapiens
ctgcatccattctcctgag

SEQ ID NO: 2414200 - DNA, 21 bp, Homo sapiens
ctgcatccattctcctgagga

SEQ ID NO: 2414201 - DNA, 17 bp, Homo sapiens
ctgcattgagcttgcat

SEQ ID NO: 2414202 - DNA, 14 bp, Homo sapiens
ctgcccccagagcc

SEQ ID NO: 2414203 - DNA, 18 bp, Homo sapiens
ctgcccccagagccacag

SEQ ID NO: 2414204 - DNA, 21 bp, Homo sapiens
ctgcccctaccctggacttgc

SEQ ID NO: 2414205 - DNA, 15 bp, Homo sapiens
ctgcccttcctgcag

SEQ ID NO: 2414206 - DNA, 13 bp, Homo sapiens
ctgcctctctgca

SEQ ID NO: 2414207 - DNA, 17 bp, Homo sapiens
ctgcctctctgcaggtc

SEQ ID NO: 2414208 - DNA, 21 bp, Homo sapiens
ctgcctctctgcaggtcccta

SEQ ID NO: 2414209 - DNA, 22 bp, Homo sapiens
ctgcctctctgcaggtccctaa

SEQ ID NO: 2414210 - DNA, 19 bp, Homo sapiens
ctgcctggaagagcagccc

SEQ ID NO: 2414211 - DNA, 14 bp, Homo sapiens
ctgccttgtgtaca

SEQ ID NO: 2414212 - DNA, 15 bp, Homo sapiens
ctgcctttattgtgt

SEQ ID NO: 2414213 - DNA, 18 bp, Homo sapiens
ctgcctttattgtgtttg

SEQ ID NO: 2414214 - DNA, 14 bp, Homo sapiens
ctgctcagccctgc

SEQ ID NO: 2414215 - DNA, 18 bp, Homo sapiens
ctgctcagccctgcacca

SEQ ID NO: 2414216 - DNA, 15 bp, Homo sapiens
ctgctggggaagaca

SEQ ID NO: 2414217 - DNA, 19 bp, Homo sapiens
ctgctggggaagacagtgg

SEQ ID NO: 2414218 - DNA, 20 bp, Homo sapiens
ctgcttatccgttagccgtg

SEQ ID NO: 2414219 - DNA, 19 bp, Homo sapiens
ctggaactgtctctcatga

SEQ ID NO: 2414220 - DNA, 17 bp, Homo sapiens
ctggaagcccctgggcc

SEQ ID NO: 2414221 - DNA, 21 bp, Homo sapiens
ctggaagcccctgggcccagt

SEQ ID NO: 2414222 - DNA, 16 bp, Homo sapiens
ctggactgtgtgctca

SEQ ID NO: 2414223 - DNA, 23 bp, Homo sapiens
ctggactgtgtgctcaggagccc

SEQ ID NO: 2414224 - DNA, 15 bp, Homo sapiens
ctggacttgcctctg

SEQ ID NO: 2414225 - DNA, 16 bp, Homo sapiens
ctggagcccactgtac

SEQ ID NO: 2414226 - DNA, 17 bp, Homo sapiens
ctggagcccactgtact

SEQ ID NO: 2414227 - DNA, 13 bp, Homo sapiens
ctggagccccatc

SEQ ID NO: 2414228 - DNA, 18 bp, Homo sapiens
ctggatagtccgtctctg

SEQ ID NO: 2414229 - DNA, 22 bp, Homo sapiens
ctggattgatcggagcctcctc

SEQ ID NO: 2414230 - DNA, 14 bp, Homo sapiens
ctggatttttacca

SEQ ID NO: 2414231 - DNA, 12 bp, Homo sapiens
ctggcacagagg

SEQ ID NO: 2414232 - DNA, 13 bp, Homo sapiens
ctggcacagaggt

SEQ ID NO: 2414233 - DNA, 23 bp, Homo sapiens
ctggcattacaggtgtgagccac

SEQ ID NO: 2414234 - DNA, 12 bp, Homo sapiens
ctggctctgtga

SEQ ID NO: 2414235 - DNA, 17 bp, Homo sapiens
ctgggcagaaggccaag

SEQ ID NO: 2414236 - DNA, 18 bp, Homo sapiens
ctggggaagacagtggcc

SEQ ID NO: 2414237 - DNA, 17 bp, Homo sapiens
ctggggacttgtgtctg

SEQ ID NO: 2414238 - DNA, 18 bp, Homo sapiens
ctggggccaggctgggtc

SEQ ID NO: 2414239 - DNA, 15 bp, Homo sapiens
ctgggtcgccctgga

SEQ ID NO: 2414240 - DNA, 18 bp, Homo sapiens
ctgggtcgccctggactg

SEQ ID NO: 2414241 - DNA, 20 bp, Homo sapiens
ctgggtgtaaaacctggaga

SEQ ID NO: 2414242 - DNA, 10 bp, Homo sapiens
ctgtaaaatc

SEQ ID NO: 2414243 - DNA, 22 bp, Homo sapiens
ctgtaaaatctttctttcttag

SEQ ID NO: 2414244 - DNA, 21 bp, Homo sapiens
ctgtaaaatgtgggattatgg

SEQ ID NO: 2414245 - DNA, 20 bp, Homo sapiens
ctgtacttgctcttgatgcc

SEQ ID NO: 2414246 - DNA, 23 bp, Homo sapiens
ctgtacttgctcttgatgcctgg

SEQ ID NO: 2414247 - DNA, 20 bp, Homo sapiens
ctgtagaaatggttgtatta

SEQ ID NO: 2414248 - DNA, 19 bp, Homo sapiens
ctgtataaaatcagccaat

SEQ ID NO: 2414249 - DNA, 21 bp, Homo sapiens
ctgtccgttcacatgtgtggt

SEQ ID NO: 2414250 - DNA, 17 bp, Homo sapiens
ctgtcggagccctgtct

SEQ ID NO: 2414251 - DNA, 13 bp, Homo sapiens
ctgtctcagggtg

SEQ ID NO: 2414252 - DNA, 22 bp, Homo sapiens
ctgtctcctaagctggagtgca

SEQ ID NO: 2414253 - DNA, 17 bp, Homo sapiens
ctgtctctcatgaacct

SEQ ID NO: 2414254 - DNA, 21 bp, Homo sapiens
ctgtcttttttctaaagtaaa

SEQ ID NO: 2414255 - DNA, 17 bp, Homo sapiens
ctgtgaagtgagacctt

SEQ ID NO: 2414256 - DNA, 24 bp, Homo sapiens
ctgtggatcaaatccagcctgctg

SEQ ID NO: 2414257 - DNA, 23 bp, Homo sapiens
ctgtgtaagggccagaaatatct

SEQ ID NO: 2414258 - DNA, 12 bp, Homo sapiens
ctgtgtggagag

SEQ ID NO: 2414259 - DNA, 15 bp, Homo sapiens
ctgtgtggagaggga

SEQ ID NO: 2414260 - DNA, 23 bp, Homo sapiens
ctgtgtggagagggaatgtgaaa

SEQ ID NO: 2414261 - DNA, 16 bp, Homo sapiens
ctgttcattcctccag

SEQ ID NO: 2414262 - DNA, 14 bp, Homo sapiens
ctgttcatttcctc

SEQ ID NO: 2414263 - DNA, 16 bp, Homo sapiens
ctgttgctgaataggc

SEQ ID NO: 2414264 - DNA, 22 bp, Homo sapiens
ctgttggggtgggtataaaaga

SEQ ID NO: 2414265 - DNA, 17 bp, Homo sapiens
cttaaccagatcattgt

SEQ ID NO: 2414266 - DNA, 16 bp, Homo sapiens
cttaactggagcccca

SEQ ID NO: 2414267 - DNA, 15 bp, Homo sapiens
cttaatgaagtttga

SEQ ID NO: 2414268 - DNA, 20 bp, Homo sapiens
cttacacccacagtggaaag

SEQ ID NO: 2414269 - DNA, 21 bp, Homo sapiens
cttactgatttttaagttatt

SEQ ID NO: 2414270 - DNA, 15 bp, Homo sapiens
cttagaaatttattt

SEQ ID NO: 2414271 - DNA, 17 bp, Homo sapiens
cttagaccaccaagcct

SEQ ID NO: 2414272 - DNA, 19 bp, Homo sapiens
cttagaccaccaagccttg

SEQ ID NO: 2414273 - DNA, 15 bp, Homo sapiens
cttaggaagaatttt

SEQ ID NO: 2414274 - DNA, 13 bp, Homo sapiens
cttatattatgga

SEQ ID NO: 2414275 - DNA, 21 bp, Homo sapiens
cttatttattcatattttctt

SEQ ID NO: 2414276 - DNA, 17 bp, Homo sapiens
cttatttcatgaaaatt

SEQ ID NO: 2414277 - DNA, 13 bp, Homo sapiens
cttcaagtataat

SEQ ID NO: 2414278 - DNA, 15 bp, Homo sapiens
cttcacaaattctca

SEQ ID NO: 2414279 - DNA, 20 bp, Homo sapiens
cttcagcaagttagaactag

SEQ ID NO: 2414280 - DNA, 18 bp, Homo sapiens
cttcagccaggagctggg

SEQ ID NO: 2414281 - DNA, 18 bp, Homo sapiens
cttcatttgggatgctac

SEQ ID NO: 2414282 - DNA, 21 bp, Homo sapiens
cttccaggggaggttcagtga

SEQ ID NO: 2414283 - DNA, 15 bp, Homo sapiens
cttcccttgagccct

SEQ ID NO: 2414284 - DNA, 21 bp, Homo sapiens
cttcctgcaggcaggaacaaa

SEQ ID NO: 2414285 - DNA, 13 bp, Homo sapiens
cttccttcatttc

SEQ ID NO: 2414286 - DNA, 17 bp, Homo sapiens
cttccttgcttaaggta

SEQ ID NO: 2414287 - DNA, 21 bp, Homo sapiens
cttctattctagcctgcattg

SEQ ID NO: 2414288 - DNA, 13 bp, Homo sapiens
cttctattgcctc

SEQ ID NO: 2414289 - DNA, 14 bp, Homo sapiens
cttctattgcctct

SEQ ID NO: 2414290 - DNA, 16 bp, Homo sapiens
cttctattgcctctga

SEQ ID NO: 2414291 - DNA, 18 bp, Homo sapiens
cttctattgcctctgaga

SEQ ID NO: 2414292 - DNA, 14 bp, Homo sapiens
cttctattggtctc

SEQ ID NO: 2414293 - DNA, 20 bp, Homo sapiens
cttctcacatttatattttt

SEQ ID NO: 2414294 - DNA, 16 bp, Homo sapiens
cttctcatcctgcagg

SEQ ID NO: 2414295 - DNA, 17 bp, Homo sapiens
cttctcatcctgcaggc

SEQ ID NO: 2414296 - DNA, 13 bp, Homo sapiens
cttctcccctgca

SEQ ID NO: 2414297 - DNA, 16 bp, Homo sapiens
cttctcccctgcactg

SEQ ID NO: 2414298 - DNA, 14 bp, Homo sapiens
cttctctccagtgc

SEQ ID NO: 2414299 - DNA, 14 bp, Homo sapiens
cttctctgttcatt

SEQ ID NO: 2414300 - DNA, 21 bp, Homo sapiens
cttctttctttgggaatattt

SEQ ID NO: 2414301 - DNA, 14 bp, Homo sapiens
cttgatgtaaaatc

SEQ ID NO: 2414302 - DNA, 20 bp, Homo sapiens
cttgatgtaaaatcttgtca

SEQ ID NO: 2414303 - DNA, 22 bp, Homo sapiens
cttgatgtaaaatcttgtcatg

SEQ ID NO: 2414304 - DNA, 22 bp, Homo sapiens
cttgcagctctccccttctctg

SEQ ID NO: 2414305 - DNA, 13 bp, Homo sapiens
cttgcatgcttgc

SEQ ID NO: 2414306 - DNA, 17 bp, Homo sapiens
cttgccaaatataaata

SEQ ID NO: 2414307 - DNA, 12 bp, Homo sapiens
cttgcctgcagg

SEQ ID NO: 2414308 - DNA, 19 bp, Homo sapiens
cttgctcttgatgcctggc

SEQ ID NO: 2414309 - DNA, 15 bp, Homo sapiens
cttgcttttaaaatc

SEQ ID NO: 2414310 - DNA, 16 bp, Homo sapiens
cttggccatgggaggc

SEQ ID NO: 2414311 - DNA, 19 bp, Homo sapiens
cttggggattcttccatct

SEQ ID NO: 2414312 - DNA, 19 bp, Homo sapiens
cttgtaaaggaatttaaaa

SEQ ID NO: 2414313 - DNA, 17 bp, Homo sapiens
cttgtatatcttgtttt

SEQ ID NO: 2414314 - DNA, 20 bp, Homo sapiens
cttgtccaacccgaggcccg

SEQ ID NO: 2414315 - DNA, 14 bp, Homo sapiens
cttgtctcaatgct

SEQ ID NO: 2414316 - DNA, 18 bp, Homo sapiens
cttgtctcaatgctcata

SEQ ID NO: 2414317 - DNA, 15 bp, Homo sapiens
cttgtggactaaaag

SEQ ID NO: 2414318 - DNA, 16 bp, Homo sapiens
cttgtggactaaaaga

SEQ ID NO: 2414319 - DNA, 16 bp, Homo sapiens
ggctctggagcccact

SEQ ID NO: 2414320 - DNA, 22 bp, Homo sapiens
ggcttgagtttaaattgtaata

SEQ ID NO: 2414321 - DNA, 15 bp, Homo sapiens
ggcttgcctgcaggc

SEQ ID NO: 2414322 - DNA, 18 bp, Homo sapiens
ggctttatcctctttaga

SEQ ID NO: 2414323 - DNA, 23 bp, Homo sapiens
gggaagagggttaggagggtttc

SEQ ID NO: 2414324 - DNA, 13 bp, Homo sapiens
gggaatatttgaa

SEQ ID NO: 2414325 - DNA, 18 bp, Homo sapiens
gggaatatttgaatcttg

SEQ ID NO: 2414326 - DNA, 19 bp, Homo sapiens
gggactacaggcgtgagcc

SEQ ID NO: 2414327 - DNA, 12 bp, Homo sapiens
gggactcagccc

SEQ ID NO: 2414328 - DNA, 15 bp, Homo sapiens
gggactgagaaattt

SEQ ID NO: 2414329 - DNA, 15 bp, Homo sapiens
gggacttgtgtctgc

SEQ ID NO: 2414330 - DNA, 17 bp, Homo sapiens
gggagaggggcctcaaa

SEQ ID NO: 2414331 - DNA, 12 bp, Homo sapiens
gggagctgccaa

SEQ ID NO: 2414332 - DNA, 15 bp, Homo sapiens
gggatgagagttttg

SEQ ID NO: 2414333 - DNA, 21 bp, Homo sapiens
gggccaggctgggtcgccctg

SEQ ID NO: 2414334 - DNA, 18 bp, Homo sapiens
gggcccctgcctctctgc

SEQ ID NO: 2414335 - DNA, 21 bp, Homo sapiens
gggcccctgcctctctgcagg

SEQ ID NO: 2414336 - DNA, 16 bp, Homo sapiens
ggggaagacagtggcc

SEQ ID NO: 2414337 - DNA, 20 bp, Homo sapiens
ggggattcttccatctgatt

SEQ ID NO: 2414338 - DNA, 17 bp, Homo sapiens
ggggcccatgaaagagg

SEQ ID NO: 2414339 - DNA, 21 bp, Homo sapiens
gggggacttacatgattcatt

SEQ ID NO: 2414340 - DNA, 15 bp, Homo sapiens
ggggtctgtaaaatc

SEQ ID NO: 2414341 - DNA, 21 bp, Homo sapiens
gggtagccactggactgacga

SEQ ID NO: 2414342 - DNA, 13 bp, Homo sapiens
gggtctgtaaaat

SEQ ID NO: 2414343 - DNA, 15 bp, Homo sapiens
gggtctgtaaaatct

SEQ ID NO: 2414344 - DNA, 19 bp, Homo sapiens
gggtgctgggcccctgcct

SEQ ID NO: 2414345 - DNA, 15 bp, Homo sapiens
gggtggggggggtgc

SEQ ID NO: 2414346 - DNA, 20 bp, Homo sapiens
gggttcacctgggctgaggc

SEQ ID NO: 2414347 - DNA, 20 bp, Homo sapiens
gggtttcaccatgttggcca

SEQ ID NO: 2414348 - DNA, 13 bp, Homo sapiens
ggtaaaacacttg

SEQ ID NO: 2414349 - DNA, 13 bp, Homo sapiens
ggtataaaagatg

SEQ ID NO: 2414350 - DNA, 16 bp, Homo sapiens
ggtataaaagatgggg

SEQ ID NO: 2414351 - DNA, 12 bp, Homo sapiens
ggtattgtattt

SEQ ID NO: 2414352 - DNA, 17 bp, Homo sapiens
ggtattgtatttattca

SEQ ID NO: 2414353 - DNA, 14 bp, Homo sapiens
ggtcagtgcaaata

SEQ ID NO: 2414354 - DNA, 12 bp, Homo sapiens
ggtccctaataa

SEQ ID NO: 2414355 - DNA, 17 bp, Homo sapiens
ggtccctaataaagctg

SEQ ID NO: 2414356 - DNA, 14 bp, Homo sapiens
ggtcgccctggact

SEQ ID NO: 2414357 - DNA, 20 bp, Homo sapiens
ggtcgccctggactgtgtgc

SEQ ID NO: 2414358 - DNA, 14 bp, Homo sapiens
ggtctaggacacag

SEQ ID NO: 2414359 - DNA, 18 bp, Homo sapiens
ggtgattccgcagtgaga

SEQ ID NO: 2414360 - DNA, 20 bp, Homo sapiens
ggtgatttagcaggaagctg

SEQ ID NO: 2414361 - DNA, 19 bp, Homo sapiens
ggtgctgactggcttcagc

SEQ ID NO: 2414362 - DNA, 16 bp, Homo sapiens
ggtgctgggcccctgc

SEQ ID NO: 2414363 - DNA, 19 bp, Homo sapiens
ggtgctgggcccctgcctc

SEQ ID NO: 2414364 - DNA, 20 bp, Homo sapiens
ggtggatgatccccacgcca

SEQ ID NO: 2414365 - DNA, 17 bp, Homo sapiens
ggtgggaggatgtgaat

SEQ ID NO: 2414366 - DNA, 17 bp, Homo sapiens
ggtggggggggtgctgg

SEQ ID NO: 2414367 - DNA, 23 bp, Homo sapiens
ggttctcacagtgggagccaggg

SEQ ID NO: 2414368 - DNA, 20 bp, Homo sapiens
gtaaaaacaaagaaattatg

SEQ ID NO: 2414369 - DNA, 18 bp, Homo sapiens
gtaaaatcttgtcatgtg

SEQ ID NO: 2414370 - DNA, 21 bp, Homo sapiens
gtaaaatcttgtcatgtgtat

SEQ ID NO: 2414371 - DNA, 15 bp, Homo sapiens
gtaaaatctttcttt

SEQ ID NO: 2414372 - DNA, 14 bp, Homo sapiens
gtaaaattgccata

SEQ ID NO: 2414373 - DNA, 21 bp, Homo sapiens
gtaaaattgccatattgcaca

SEQ ID NO: 2414374 - DNA, 13 bp, Homo sapiens
gtaaaccttttat

SEQ ID NO: 2414375 - DNA, 15 bp, Homo sapiens
gtaaagaattatttt

SEQ ID NO: 2414376 - DNA, 13 bp, Homo sapiens
gtaaatttgtact

SEQ ID NO: 2414377 - DNA, 22 bp, Homo sapiens
gtaaatttgtactatttaactg

SEQ ID NO: 2414378 - DNA, 13 bp, Homo sapiens
gtaactcatctgt

SEQ ID NO: 2414379 - DNA, 13 bp, Homo sapiens
gtaatgaaaacca

SEQ ID NO: 2414380 - DNA, 18 bp, Homo sapiens
gtaatgttaatattgatt

SEQ ID NO: 2414381 - DNA, 22 bp, Homo sapiens
gtaatgttaatattgatttatt

SEQ ID NO: 2414382 - DNA, 17 bp, Homo sapiens
gtacctagctggctctg

SEQ ID NO: 2414383 - DNA, 16 bp, Homo sapiens
gtacttgctcttgatg

SEQ ID NO: 2414384 - DNA, 22 bp, Homo sapiens
gtacttgctcttgatgcctggc

SEQ ID NO: 2414385 - DNA, 23 bp, Homo sapiens
gtactttattttctataatttaa

SEQ ID NO: 2414386 - DNA, 13 bp, Homo sapiens
gtagaaaagctat

SEQ ID NO: 2414387 - DNA, 14 bp, Homo sapiens
gtagaaaggccttt

SEQ ID NO: 2414388 - DNA, 22 bp, Homo sapiens
gtagaaatggttgtattagatg

SEQ ID NO: 2414389 - DNA, 20 bp, Homo sapiens
gtagacgtgcacgcacactg

SEQ ID NO: 2414390 - DNA, 13 bp, Homo sapiens
gtataaaagatgg

SEQ ID NO: 2414391 - DNA, 21 bp, Homo sapiens
gtataaaagcctgtttaagag

SEQ ID NO: 2414392 - DNA, 23 bp, Homo sapiens
gtataaaatcagccaattatgtt

SEQ ID NO: 2414393 - DNA, 17 bp, Homo sapiens
gtataattcacattgta

SEQ ID NO: 2414394 - DNA, 13 bp, Homo sapiens
gtatacctcactt

SEQ ID NO: 2414395 - DNA, 17 bp, Homo sapiens
gtatctatgcattttct

SEQ ID NO: 2414396 - DNA, 17 bp, Homo sapiens
gtatgaaccaccgcgcc

SEQ ID NO: 2414397 - DNA, 19 bp, Homo sapiens
gtatgtgtatctcacactc

SEQ ID NO: 2414398 - DNA, 13 bp, Homo sapiens
gtattagatgttc

SEQ ID NO: 2414399 - DNA, 17 bp, Homo sapiens
gtattagatgttctcta

SEQ ID NO: 2414400 - DNA, 18 bp, Homo sapiens
gtattagatgttctctat

SEQ ID NO: 2414401 - DNA, 21 bp, Homo sapiens
gtattagatgttctctatcat

SEQ ID NO: 2414402 - DNA, 16 bp, Homo sapiens
gtattcgttatctaat

SEQ ID NO: 2414403 - DNA, 12 bp, Homo sapiens
gtatttaattag

SEQ ID NO: 2414404 - DNA, 18 bp, Homo sapiens
gtatttaattagtgctaa

SEQ ID NO: 2414405 - DNA, 20 bp, Homo sapiens
gtatttaattagtgctaagt

SEQ ID NO: 2414406 - DNA, 11 bp, Homo sapiens
gtatttattca

SEQ ID NO: 2414407 - DNA, 21 bp, Homo sapiens
gtattttagtaagagattcct

SEQ ID NO: 2414408 - DNA, 15 bp, Homo sapiens
gtcacaggaaaaagt

SEQ ID NO: 2414409 - DNA, 21 bp, Homo sapiens
gtcacctcagagacatacacc

SEQ ID NO: 2414410 - DNA, 20 bp, Homo sapiens
gtcatgtaagctgaaaatat

SEQ ID NO: 2414411 - DNA, 12 bp, Homo sapiens
gtcatgtgtata

SEQ ID NO: 2414412 - DNA, 14 bp, Homo sapiens
gtcatgtgtataaa

SEQ ID NO: 2414413 - DNA, 15 bp, Homo sapiens
gtcatgtttaagaaa

SEQ ID NO: 2414414 - DNA, 14 bp, Homo sapiens
gtcattggctttat

SEQ ID NO: 2414415 - DNA, 17 bp, Homo sapiens
gtcattggctttatcct

SEQ ID NO: 2414416 - DNA, 21 bp, Homo sapiens
gtcattgttatataatcatta

SEQ ID NO: 2414417 - DNA, 15 bp, Homo sapiens
gtcatttcatttcct

SEQ ID NO: 2414418 - DNA, 14 bp, Homo sapiens
gtccaaactgccta

SEQ ID NO: 2414419 - DNA, 16 bp, Homo sapiens
gtccctaataaagctg

SEQ ID NO: 2414420 - DNA, 17 bp, Homo sapiens
gtccctaataaagctgt

SEQ ID NO: 2414421 - DNA, 18 bp, Homo sapiens
gtccctaataaagctgtg

SEQ ID NO: 2414422 - DNA, 19 bp, Homo sapiens
gtccgttcacatgtgtggt

SEQ ID NO: 2414423 - DNA, 20 bp, Homo sapiens
gtcctggaggggctggggac

SEQ ID NO: 2414424 - DNA, 18 bp, Homo sapiens
gtcgccctggactgtgtg

SEQ ID NO: 2414425 - DNA, 16 bp, Homo sapiens
gtcggagccctgtctc

SEQ ID NO: 2414426 - DNA, 18 bp, Homo sapiens
gtcgtcaaagctgaaatg

SEQ ID NO: 2414427 - DNA, 22 bp, Homo sapiens
gtctcaaactcctgacctcagg

SEQ ID NO: 2414428 - DNA, 14 bp, Homo sapiens
gtctcaatgctcat

SEQ ID NO: 2414429 - DNA, 23 bp, Homo sapiens
gtctcacatgattccagccatca

SEQ ID NO: 2414430 - DNA, 17 bp, Homo sapiens
gtctctggaatttgaaa

SEQ ID NO: 2414431 - DNA, 21 bp, Homo sapiens
gtctctggattatattatgaa

SEQ ID NO: 2414432 - DNA, 11 bp, Homo sapiens
gtctgtaaaat

SEQ ID NO: 2414433 - DNA, 13 bp, Homo sapiens
gtctgtaaaatct

SEQ ID NO: 2414434 - DNA, 22 bp, Homo sapiens
gtctgtgaagtgagaccttcct

SEQ ID NO: 2414435 - DNA, 14 bp, Homo sapiens
gtcttatttcctca

SEQ ID NO: 2414436 - DNA, 12 bp, Homo sapiens
gtcttcttggcc

SEQ ID NO: 2414437 - DNA, 17 bp, Homo sapiens
gtcttctttgcccacaa

SEQ ID NO: 2414438 - DNA, 18 bp, Homo sapiens
gtgaaattattcataatt

SEQ ID NO: 2414439 - DNA, 20 bp, Homo sapiens
gtgaaattattcataattat

SEQ ID NO: 2414440 - DNA, 22 bp, Homo sapiens
gtgaaatttacatcatttcttt

SEQ ID NO: 2414441 - DNA, 18 bp, Homo sapiens
gtgaagggaagagacagc

SEQ ID NO: 2414442 - DNA, 19 bp, Homo sapiens
gtgagagagtggctggggc

SEQ ID NO: 2414443 - DNA, 14 bp, Homo sapiens
gtgagctacaaatg

SEQ ID NO: 2414444 - DNA, 16 bp, Homo sapiens
gtgagctcctaagcca

SEQ ID NO: 2414445 - DNA, 11 bp, Homo sapiens
gtgcatcaggc

SEQ ID NO: 2414446 - DNA, 19 bp, Homo sapiens
gtgccagatttatgcatat

SEQ ID NO: 2414447 - DNA, 13 bp, Homo sapiens
gtgcgtcctgtcg

SEQ ID NO: 2414448 - DNA, 18 bp, Homo sapiens
gtgctaagtgtgaactgg

SEQ ID NO: 2414449 - DNA, 16 bp, Homo sapiens
gtgctcaggagccctg

SEQ ID NO: 2414450 - DNA, 22 bp, Homo sapiens
tcctgtgtggagagggaatgtg

SEQ ID NO: 2414451 - DNA, 15 bp, Homo sapiens
tccttcagcacttta

SEQ ID NO: 2414452 - DNA, 15 bp, Homo sapiens
tccttcatttcctcc

SEQ ID NO: 2414453 - DNA, 16 bp, Homo sapiens
tccttcctcacaccag

SEQ ID NO: 2414454 - DNA, 15 bp, Homo sapiens
tccttctattctagc

SEQ ID NO: 2414455 - DNA, 22 bp, Homo sapiens
tccttgattttagccttctctg

SEQ ID NO: 2414456 - DNA, 18 bp, Homo sapiens
tcgccctggactgtgtgc

SEQ ID NO: 2414457 - DNA, 15 bp, Homo sapiens
tcgctgttgctgaat

SEQ ID NO: 2414458 - DNA, 16 bp, Homo sapiens
tcgcttcatgtaacta

SEQ ID NO: 2414459 - DNA, 17 bp, Homo sapiens
tctaagaaacatttata

SEQ ID NO: 2414460 - DNA, 12 bp, Homo sapiens
tctaagaaagaa

SEQ ID NO: 2414461 - DNA, 16 bp, Homo sapiens
tctagaggcttccttc

SEQ ID NO: 2414462 - DNA, 21 bp, Homo sapiens
tctaggacacagttcctggga

SEQ ID NO: 2414463 - DNA, 24 bp, Homo sapiens
tctagtattccagacctgaagaat

SEQ ID NO: 2414464 - DNA, 22 bp, Homo sapiens
tctagtttaattaatctgtaat

SEQ ID NO: 2414465 - DNA, 13 bp, Homo sapiens
tctatcatttaat

SEQ ID NO: 2414466 - DNA, 14 bp, Homo sapiens
tctatcatttaata

SEQ ID NO: 2414467 - DNA, 15 bp, Homo sapiens
tctatgcattttctg

SEQ ID NO: 2414468 - DNA, 17 bp, Homo sapiens
tctatgtgcttgtaaaa

SEQ ID NO: 2414469 - DNA, 12 bp, Homo sapiens
tctattgcctct

SEQ ID NO: 2414470 - DNA, 12 bp, Homo sapiens
tctattggtctc

SEQ ID NO: 2414471 - DNA, 22 bp, Homo sapiens
tctattgttgtacacagaaata

SEQ ID NO: 2414472 - DNA, 24 bp, Homo sapiens
tctattttgtaactttctctatga

SEQ ID NO: 2414473 - DNA, 13 bp, Homo sapiens
tctcaagccctgc

SEQ ID NO: 2414474 - DNA, 13 bp, Homo sapiens
tctcaatgctcat

SEQ ID NO: 2414475 - DNA, 16 bp, Homo sapiens
tctcactgcttgaact

SEQ ID NO: 2414476 - DNA, 13 bp, Homo sapiens
tctcatgaacctc

SEQ ID NO: 2414477 - DNA, 16 bp, Homo sapiens
tctccagcctcagcct

SEQ ID NO: 2414478 - DNA, 15 bp, Homo sapiens
tctccaggcaggtct

SEQ ID NO: 2414479 - DNA, 19 bp, Homo sapiens
tctcccactagacaagtcc

SEQ ID NO: 2414480 - DNA, 15 bp, Homo sapiens
tctcccctgcactgt

SEQ ID NO: 2414481 - DNA, 16 bp, Homo sapiens
tctcccctgcactgta

SEQ ID NO: 2414482 - DNA, 21 bp, Homo sapiens
tctcccctgcactgtaaaatg

SEQ ID NO: 2414483 - DNA, 19 bp, Homo sapiens
tctcctaagctggagtgca

SEQ ID NO: 2414484 - DNA, 19 bp, Homo sapiens
tctcctgcctcagcctccc

SEQ ID NO: 2414485 - DNA, 14 bp, Homo sapiens
tctccttgttctga

SEQ ID NO: 2414486 - DNA, 16 bp, Homo sapiens
tctctatcatttaata

SEQ ID NO: 2414487 - DNA, 22 bp, Homo sapiens
tctctatcatttaataatatac

SEQ ID NO: 2414488 - DNA, 19 bp, Homo sapiens
tctctccttgttctgataa

SEQ ID NO: 2414489 - DNA, 19 bp, Homo sapiens
tctctgcaaactgccttct

SEQ ID NO: 2414490 - DNA, 15 bp, Homo sapiens
tctctgcaggtccct

SEQ ID NO: 2414491 - DNA, 19 bp, Homo sapiens
tctctgcaggtccctaata

SEQ ID NO: 2414492 - DNA, 20 bp, Homo sapiens
tctctgcaggtccctaataa

SEQ ID NO: 2414493 - DNA, 21 bp, Homo sapiens
tctctgcaggtccctaataaa

SEQ ID NO: 2414494 - DNA, 19 bp, Homo sapiens
tctctggaagcccctgggc

SEQ ID NO: 2414495 - DNA, 20 bp, Homo sapiens
tctctggaagcccctgggcc

SEQ ID NO: 2414496 - DNA, 22 bp, Homo sapiens
tctctgtaataaactcatttct

SEQ ID NO: 2414497 - DNA, 16 bp, Homo sapiens
tctctgttcatttcct

SEQ ID NO: 2414498 - DNA, 21 bp, Homo sapiens
tctcttgcctcaacctcccaa

SEQ ID NO: 2414499 - DNA, 14 bp, Homo sapiens
tctgaaaattgatg

SEQ ID NO: 2414500 - DNA, 21 bp, Homo sapiens
tctgaagctcaactctcttat

SEQ ID NO: 2414501 - DNA, 10 bp, Homo sapiens
tctgaattat

SEQ ID NO: 2414502 - DNA, 22 bp, Homo sapiens
tctgagaaaagctttgaaccct

SEQ ID NO: 2414503 - DNA, 16 bp, Homo sapiens
tctgagaagctctgaa

SEQ ID NO: 2414504 - DNA, 17 bp, Homo sapiens
tctgagttcctgcatgc

SEQ ID NO: 2414505 - DNA, 15 bp, Homo sapiens
tctgataatgaaaat

SEQ ID NO: 2414506 - DNA, 16 bp, Homo sapiens
tctgcaggtccctaat

SEQ ID NO: 2414507 - DNA, 17 bp, Homo sapiens
tctgcaggtccctaata

SEQ ID NO: 2414508 - DNA, 23 bp, Homo sapiens
tctgcaggtccctaataaagctg

SEQ ID NO: 2414509 - DNA, 20 bp, Homo sapiens
tctgcctttattgtgtttgt

SEQ ID NO: 2414510 - DNA, 18 bp, Homo sapiens
tctggaagcccctgggcc

SEQ ID NO: 2414511 - DNA, 23 bp, Homo sapiens
tctggagcccactgtacttgctc

SEQ ID NO: 2414512 - DNA, 14 bp, Homo sapiens
tctgggctgtgggc

SEQ ID NO: 2414513 - DNA, 13 bp, Homo sapiens
tctgtaaaatctt

SEQ ID NO: 2414514 - DNA, 22 bp, Homo sapiens
tctgtagaaatggttgtattag

SEQ ID NO: 2414515 - DNA, 20 bp, Homo sapiens
tctgtccgttcacatgtgtg

SEQ ID NO: 2414516 - DNA, 20 bp, Homo sapiens
tctgtgaagtgagaccttcc

SEQ ID NO: 2414517 - DNA, 13 bp, Homo sapiens
tcttaaaactcct

SEQ ID NO: 2414518 - DNA, 18 bp, Homo sapiens
tcttaatgaagtttgaat

SEQ ID NO: 2414519 - DNA, 23 bp, Homo sapiens
tcttaatgaagtttgaatgttaa

SEQ ID NO: 2414520 - DNA, 19 bp, Homo sapiens
tcttacaataattctatga

SEQ ID NO: 2414521 - DNA, 15 bp, Homo sapiens
tcttagaaatttatt

SEQ ID NO: 2414522 - DNA, 16 bp, Homo sapiens
tcttatttcatgaaaa

SEQ ID NO: 2414523 - DNA, 16 bp, Homo sapiens
tcttcatgtttcagga

SEQ ID NO: 2414524 - DNA, 16 bp, Homo sapiens
tcttctcccaattcat

SEQ ID NO: 2414525 - DNA, 22 bp, Homo sapiens
tcttcttttaaaccattttctt

SEQ ID NO: 2414526 - DNA, 14 bp, Homo sapiens
tcttgatgcctggc

SEQ ID NO: 2414527 - DNA, 16 bp, Homo sapiens
tcttgatgtaaaatct

SEQ ID NO: 2414528 - DNA, 13 bp, Homo sapiens
tcttgtcatgtgt

SEQ ID NO: 2414529 - DNA, 15 bp, Homo sapiens
tcttgtctcaatgct

SEQ ID NO: 2414530 - DNA, 20 bp, Homo sapiens
tcttgtctcaatgctcataa

SEQ ID NO: 2414531 - DNA, 12 bp, Homo sapiens
tctttagagtta

SEQ ID NO: 2414532 - DNA, 17 bp, Homo sapiens
tctttagagttagactg

SEQ ID NO: 2414533 - DNA, 17 bp, Homo sapiens
tctttcacatttaaata

SEQ ID NO: 2414534 - DNA, 12 bp, Homo sapiens
tctttccctcct

SEQ ID NO: 2414535 - DNA, 13 bp, Homo sapiens
tctttccctcctt

SEQ ID NO: 2414536 - DNA, 12 bp, Homo sapiens
tctttgccaagt

SEQ ID NO: 2414537 - DNA, 15 bp, Homo sapiens
tctttgggaatattt

SEQ ID NO: 2414538 - DNA, 13 bp, Homo sapiens
tctttgtaatgaa

SEQ ID NO: 2414539 - DNA, 16 bp, Homo sapiens
tctttgtaatgaaaac

SEQ ID NO: 2414540 - DNA, 13 bp, Homo sapiens
tcttttcatacat

SEQ ID NO: 2414541 - DNA, 23 bp, Homo sapiens
tcttttcatacattttctaagaa

SEQ ID NO: 2414542 - DNA, 19 bp, Homo sapiens
tcttttttaaatgaagaaa

SEQ ID NO: 2414543 - DNA, 22 bp, Homo sapiens
tcttttttctaaagtaaaaaca

SEQ ID NO: 2414544 - DNA, 23 bp, Homo sapiens
tctttttttttttttaataaatt

SEQ ID NO: 2414545 - DNA, 20 bp, Homo sapiens
tgaaaagctccatttttagt

SEQ ID NO: 2414546 - DNA, 14 bp, Homo sapiens
tgaaaataaagaat

SEQ ID NO: 2414547 - DNA, 20 bp, Homo sapiens
tgaaaatcttataatttaaa

SEQ ID NO: 2414548 - DNA, 16 bp, Homo sapiens
tgaaacactttgcata

SEQ ID NO: 2414549 - DNA, 18 bp, Homo sapiens
tgaaacattttctccctg

SEQ ID NO: 2414550 - DNA, 19 bp, Homo sapiens
tgaaatgcagagtcaatga

SEQ ID NO: 2414551 - DNA, 19 bp, Homo sapiens
tgaactggaccctgttgct

SEQ ID NO: 2414552 - DNA, 21 bp, Homo sapiens
tgaactggaccctgttgctaa

SEQ ID NO: 2414553 - DNA, 17 bp, Homo sapiens
tgaactttttattgatt

SEQ ID NO: 2414554 - DNA, 15 bp, Homo sapiens
tgaagggaagagaca

SEQ ID NO: 2414555 - DNA, 15 bp, Homo sapiens
tgaagggcaggtgct

SEQ ID NO: 2414556 - DNA, 19 bp, Homo sapiens
tgaagggcaggtgcttcag

SEQ ID NO: 2414557 - DNA, 21 bp, Homo sapiens
tgaaggtgaaacattttctcc

SEQ ID NO: 2414558 - DNA, 18 bp, Homo sapiens
tgaaggtggaaataaact

SEQ ID NO: 2414559 - DNA, 20 bp, Homo sapiens
tgaagtttgaatgttaaata

SEQ ID NO: 2414560 - DNA, 14 bp, Homo sapiens
tgaatcctctctct

SEQ ID NO: 2414561 - DNA, 16 bp, Homo sapiens
tgaatcctctctctgt

SEQ ID NO: 2414562 - DNA, 16 bp, Homo sapiens
tgaatcttgtctcaat

SEQ ID NO: 2414563 - DNA, 24 bp, Homo sapiens
tgaatcttgtctcaatgctcataa

SEQ ID NO: 2414564 - DNA, 12 bp, Homo sapiens
tgaatgcatttt

SEQ ID NO: 2414565 - DNA, 14 bp, Homo sapiens
tgaatgcattttgt

SEQ ID NO: 2414566 - DNA, 21 bp, Homo sapiens
tgaatgcattttgtttggtat

SEQ ID NO: 2414567 - DNA, 22 bp, Homo sapiens
tgaatgcattttgtttggtatt

SEQ ID NO: 2414568 - DNA, 21 bp, Homo sapiens
tgaatgtaaatttgtactatt

SEQ ID NO: 2414569 - DNA, 17 bp, Homo sapiens
tgaattttttttaacat

SEQ ID NO: 2414570 - DNA, 20 bp, Homo sapiens
tgaattttttttaacattcc

SEQ ID NO: 2414571 - DNA, 21 bp, Homo sapiens
tgaattttttttaacattcct

SEQ ID NO: 2414572 - DNA, 22 bp, Homo sapiens
tgaccaaccttttcccaaccat

SEQ ID NO: 2414573 - DNA, 18 bp, Homo sapiens
tgacctcgtgatccaccc

SEQ ID NO: 2414574 - DNA, 16 bp, Homo sapiens
tgacctgccaggcaca

SEQ ID NO: 2414575 - DNA, 19 bp, Homo sapiens
tgactatttttcagaatct

SEQ ID NO: 2414576 - DNA, 19 bp, Homo sapiens
tgactcttggcacagcatg

SEQ ID NO: 2414577 - DNA, 13 bp, Homo sapiens
tgagaaatctaaa

SEQ ID NO: 2414578 - DNA, 12 bp, Homo sapiens
tgagaagctctg

SEQ ID NO: 2414579 - DNA, 18 bp, Homo sapiens
tgagacaaatggaggcct

SEQ ID NO: 2414580 - DNA, 14 bp, Homo sapiens
tttatgcatattat

SEQ ID NO: 2414581 - DNA, 16 bp, Homo sapiens
tttattaataaacatt

SEQ ID NO: 2414582 - DNA, 17 bp, Homo sapiens
tttattaatatatatta

SEQ ID NO: 2414583 - DNA, 16 bp, Homo sapiens
tttattatgcattata

SEQ ID NO: 2414584 - DNA, 21 bp, Homo sapiens
tttattgtgtttgtcattagc

SEQ ID NO: 2414585 - DNA, 16 bp, Homo sapiens
tttattttgtgtttag

SEQ ID NO: 2414586 - DNA, 20 bp, Homo sapiens
tttattttgtgtttaggaac

SEQ ID NO: 2414587 - DNA, 22 bp, Homo sapiens
tttatttttccatttacaacaa

SEQ ID NO: 2414588 - DNA, 22 bp, Homo sapiens
tttcaaaattgttacaaattgt

SEQ ID NO: 2414589 - DNA, 20 bp, Homo sapiens
tttcatacattttctaagaa

SEQ ID NO: 2414590 - DNA, 14 bp, Homo sapiens
tttcatagctaaaa

SEQ ID NO: 2414591 - DNA, 15 bp, Homo sapiens
tttcatagctaaaaa

SEQ ID NO: 2414592 - DNA, 16 bp, Homo sapiens
tttcatgattttgaaa

SEQ ID NO: 2414593 - DNA, 22 bp, Homo sapiens
tttccctaagccagctgccccc

SEQ ID NO: 2414594 - DNA, 14 bp, Homo sapiens
tttccctccttggt

SEQ ID NO: 2414595 - DNA, 20 bp, Homo sapiens
tttcctaaatatattttaag

SEQ ID NO: 2414596 - DNA, 22 bp, Homo sapiens
tttcctccgtcacctcagagac

SEQ ID NO: 2414597 - DNA, 12 bp, Homo sapiens
tttctaaagtaa

SEQ ID NO: 2414598 - DNA, 14 bp, Homo sapiens
tttctaatgagata

SEQ ID NO: 2414599 - DNA, 20 bp, Homo sapiens
tttctccctggatttttacc

SEQ ID NO: 2414600 - DNA, 19 bp, Homo sapiens
tttctgggctgtctattct

SEQ ID NO: 2414601 - DNA, 14 bp, Homo sapiens
tttcttagaaattt

SEQ ID NO: 2414602 - DNA, 17 bp, Homo sapiens
tttcttctattgcctct

SEQ ID NO: 2414603 - DNA, 15 bp, Homo sapiens
tttctttcttagaaa

SEQ ID NO: 2414604 - DNA, 17 bp, Homo sapiens
tttctttgggaatattt

SEQ ID NO: 2414605 - DNA, 18 bp, Homo sapiens
tttctttgtttctttctt

SEQ ID NO: 2414606 - DNA, 19 bp, Homo sapiens
tttctttgtttctttcttt

SEQ ID NO: 2414607 - DNA, 21 bp, Homo sapiens
tttgaaattgtattacaaatc

SEQ ID NO: 2414608 - DNA, 18 bp, Homo sapiens
tttgaacctgatgaaaat

SEQ ID NO: 2414609 - DNA, 20 bp, Homo sapiens
tttgaacctgatgaaaataa

SEQ ID NO: 2414610 - DNA, 18 bp, Homo sapiens
tttgaatcatcaagtctt

SEQ ID NO: 2414611 - DNA, 16 bp, Homo sapiens
tttgaatcttgtctca

SEQ ID NO: 2414612 - DNA, 18 bp, Homo sapiens
tttgaatcttgtctcaat

SEQ ID NO: 2414613 - DNA, 21 bp, Homo sapiens
tttgaatcttgtctcaatgct

SEQ ID NO: 2414614 - DNA, 13 bp, Homo sapiens
tttgaatgttaaa

SEQ ID NO: 2414615 - DNA, 18 bp, Homo sapiens
tttgacaaaggtaaatca

SEQ ID NO: 2414616 - DNA, 19 bp, Homo sapiens
tttgcataacgtataaaag

SEQ ID NO: 2414617 - DNA, 17 bp, Homo sapiens
tttgccctgctgccctc

SEQ ID NO: 2414618 - DNA, 13 bp, Homo sapiens
tttgctagttttt

SEQ ID NO: 2414619 - DNA, 16 bp, Homo sapiens
tttgctatctgggctg

SEQ ID NO: 2414620 - DNA, 18 bp, Homo sapiens
tttgctcagcttctccaa

SEQ ID NO: 2414621 - DNA, 13 bp, Homo sapiens
tttggcagagttc

SEQ ID NO: 2414622 - DNA, 17 bp, Homo sapiens
tttgggaatatttgaat

SEQ ID NO: 2414623 - DNA, 13 bp, Homo sapiens
tttggtattgtat

SEQ ID NO: 2414624 - DNA, 14 bp, Homo sapiens
tttgtaatgaaaac

SEQ ID NO: 2414625 - DNA, 20 bp, Homo sapiens
tttgtgaaggtggaaataaa

SEQ ID NO: 2414626 - DNA, 13 bp, Homo sapiens
tttgtgcattctg

SEQ ID NO: 2414627 - DNA, 13 bp, Homo sapiens
ttttaaacacatt

SEQ ID NO: 2414628 - DNA, 18 bp, Homo sapiens
ttttaaacacattaggaa

SEQ ID NO: 2414629 - DNA, 18 bp, Homo sapiens
ttttaaagacttttatga

SEQ ID NO: 2414630 - DNA, 18 bp, Homo sapiens
ttttaaatattttttctt

SEQ ID NO: 2414631 - DNA, 14 bp, Homo sapiens
ttttaataaatttc

SEQ ID NO: 2414632 - DNA, 19 bp, Homo sapiens
ttttacgtccatctcttgt

SEQ ID NO: 2414633 - DNA, 14 bp, Homo sapiens
ttttagaaagcatt

SEQ ID NO: 2414634 - DNA, 20 bp, Homo sapiens
ttttagaaagcatttgaatg

SEQ ID NO: 2414635 - DNA, 23 bp, Homo sapiens
ttttagaaagcatttgaatgcat

SEQ ID NO: 2414636 - DNA, 23 bp, Homo sapiens
ttttagcaaagatatctcatctc

SEQ ID NO: 2414637 - DNA, 18 bp, Homo sapiens
ttttatgtgaaacatgtt

SEQ ID NO: 2414638 - DNA, 21 bp, Homo sapiens
ttttcatacattttctaagaa

SEQ ID NO: 2414639 - DNA, 17 bp, Homo sapiens
ttttcctttgaatcctc

SEQ ID NO: 2414640 - DNA, 21 bp, Homo sapiens
ttttgaaaccatgaagagatt

SEQ ID NO: 2414641 - DNA, 11 bp, Homo sapiens
ttttgtctctg

SEQ ID NO: 2414642 - DNA, 18 bp, Homo sapiens
tttttaaagacttttatg

SEQ ID NO: 2414643 - DNA, 12 bp, Homo sapiens
tttttatcatgt

SEQ ID NO: 2414644 - DNA, 14 bp, Homo sapiens
tttttattatgcat

SEQ ID NO: 2414645 - DNA, 15 bp, Homo sapiens
tttttattatgcatt

SEQ ID NO: 2414646 - DNA, 18 bp, Homo sapiens
tttttcatgattttgaaa

SEQ ID NO: 2414647 - DNA, 19 bp, Homo sapiens
tttttgtgaaaagctccat

SEQ ID NO: 2414648 - DNA, 12 bp, Homo sapiens
ttttttaattga

SEQ ID NO: 2414649 - DNA, 13 bp, Homo sapiens
ttttttcttactg

SEQ ID NO: 2414650 - DNA, 21 bp, Homo sapiens
cagactagatgtagtattttt

SEQ ID NO: 2414651 - DNA, 13 bp, Homo sapiens
cagagttacagtt

SEQ ID NO: 2414652 - DNA, 19 bp, Homo sapiens
cagagttacagttctgtgg

SEQ ID NO: 2414653 - DNA, 19 bp, Homo sapiens
cagatggaaaattcatttt

SEQ ID NO: 2414654 - DNA, 19 bp, Homo sapiens
cagctgcaaggtactctgg

SEQ ID NO: 2414655 - DNA, 12 bp, Homo sapiens
cagctgtggcag

SEQ ID NO: 2414656 - DNA, 16 bp, Homo sapiens
cagctgtggcagagtt

SEQ ID NO: 2414657 - DNA, 17 bp, Homo sapiens
cagctgtggcagagtta

SEQ ID NO: 2414658 - DNA, 15 bp, Homo sapiens
caggcgctaattcaa

SEQ ID NO: 2414659 - DNA, 19 bp, Homo sapiens
cagggtccttttgacactg

SEQ ID NO: 2414660 - DNA, 22 bp, Homo sapiens
cagggtccttttgacactgctc

SEQ ID NO: 2414661 - DNA, 23 bp, Homo sapiens
cagggtccttttgacactgctct

SEQ ID NO: 2414662 - DNA, 16 bp, Homo sapiens
caggttccctcccaga

SEQ ID NO: 2414663 - DNA, 23 bp, Homo sapiens
caggttccctcccagaggagcca

SEQ ID NO: 2414664 - DNA, 22 bp, Homo sapiens
cagtctctcttctctccagctg

SEQ ID NO: 2414665 - DNA, 13 bp, Homo sapiens
cagttaatttttc

SEQ ID NO: 2414666 - DNA, 14 bp, Homo sapiens
cagttggtaacttt

SEQ ID NO: 2414667 - DNA, 13 bp, Homo sapiens
catagctctgggg

SEQ ID NO: 2414668 - DNA, 14 bp, Homo sapiens
catcctcaaagaaa

SEQ ID NO: 2414669 - DNA, 18 bp, Homo sapiens
catctggctctaattcac

SEQ ID NO: 2414670 - DNA, 12 bp, Homo sapiens
catcttgctacc

SEQ ID NO: 2414671 - DNA, 17 bp, Homo sapiens
catcttgctaccagtat

SEQ ID NO: 2414672 - DNA, 14 bp, Homo sapiens
catgttagttacct

SEQ ID NO: 2414673 - DNA, 21 bp, Homo sapiens
catttatctataatttaccta

SEQ ID NO: 2414674 - DNA, 19 bp, Homo sapiens
catttgtgtacacagtcag

SEQ ID NO: 2414675 - DNA, 14 bp, Homo sapiens
ccaactactaatag

SEQ ID NO: 2414676 - DNA, 16 bp, Homo sapiens
ccacctgacacaccag

SEQ ID NO: 2414677 - DNA, 23 bp, Homo sapiens
ccacctgacacaccaggcgctaa

SEQ ID NO: 2414678 - DNA, 20 bp, Homo sapiens
ccacttaatgtatgttacca

SEQ ID NO: 2414679 - DNA, 14 bp, Homo sapiens
ccagctgactaaac

SEQ ID NO: 2414680 - DNA, 16 bp, Homo sapiens
ccaggcgctaattcaa

SEQ ID NO: 2414681 - DNA, 19 bp, Homo sapiens
gaaataaagtcagatggaa

SEQ ID NO: 2414682 - DNA, 18 bp, Homo sapiens
gaagtcatcttgctacca

SEQ ID NO: 2414683 - DNA, 20 bp, Homo sapiens
gaagtgctgtttattaatct

SEQ ID NO: 2414684 - DNA, 19 bp, Homo sapiens
gaataaaggcagttttcta

SEQ ID NO: 2414685 - DNA, 14 bp, Homo sapiens
gaatttcttaactt

SEQ ID NO: 2414686 - DNA, 15 bp, Homo sapiens
gaatttcttaacttc

SEQ ID NO: 2414687 - DNA, 18 bp, Homo sapiens
gacacaccaggcgctaat

SEQ ID NO: 2414688 - DNA, 18 bp, Homo sapiens
gagaaacagttggtaact

SEQ ID NO: 2414689 - DNA, 21 bp, Homo sapiens
gagaaacagttggtaactttt

SEQ ID NO: 2414690 - DNA, 16 bp, Homo sapiens
gaggagccaccagttc

SEQ ID NO: 2414691 - DNA, 18 bp, Homo sapiens
gaggagccaccagttctc

SEQ ID NO: 2414692 - DNA, 16 bp, Homo sapiens
gagttacagttctgtg

SEQ ID NO: 2414693 - DNA, 13 bp, Homo sapiens
gatgtagtatttt

SEQ ID NO: 2414694 - DNA, 19 bp, Homo sapiens
gattacaaatcagaagtca

SEQ ID NO: 2414695 - DNA, 19 bp, Homo sapiens
gattattaacgatgtccaa

SEQ ID NO: 2414696 - DNA, 15 bp, Homo sapiens
gcaaggtactctggt

SEQ ID NO: 2414697 - DNA, 20 bp, Homo sapiens
gcagagttacagttctgtgg

SEQ ID NO: 2414698 - DNA, 13 bp, Homo sapiens
gccaccagttctc

SEQ ID NO: 2414699 - DNA, 18 bp, Homo sapiens
gccacttaatgtatgtta

SEQ ID NO: 2414700 - DNA, 19 bp, Homo sapiens
gccacttaatgtatgttac

SEQ ID NO: 2414701 - DNA, 19 bp, Homo sapiens
gcccaagttcatgcagctg

SEQ ID NO: 2414702 - DNA, 20 bp, Homo sapiens
gcccaagttcatgcagctgt

SEQ ID NO: 2414703 - DNA, 16 bp, Homo sapiens
gccctcctctgcactc

SEQ ID NO: 2414704 - DNA, 15 bp, Homo sapiens
gcctttttcatttat

SEQ ID NO: 2414705 - DNA, 17 bp, Homo sapiens
gcctttttcatttatct

SEQ ID NO: 2414706 - DNA, 22 bp, Homo sapiens
gcctttttcatttatctataat

SEQ ID NO: 2414707 - DNA, 22 bp, Homo sapiens
gctaattcaaggaatttcttaa

SEQ ID NO: 2414708 - DNA, 14 bp, Homo sapiens
gctaccagtattta

SEQ ID NO: 2414709 - DNA, 15 bp, Homo sapiens
gctctaattcacagt

SEQ ID NO: 2414710 - DNA, 19 bp, Homo sapiens
gctctggggtgggcagttt

SEQ ID NO: 2414711 - DNA, 22 bp, Homo sapiens
tccaacccgtctggcccaccag

SEQ ID NO: 2414712 - DNA, 21 bp, Homo sapiens
tccaactactaatagaataaa

SEQ ID NO: 2414713 - DNA, 17 bp, Homo sapiens
tccaggttccctcccag

SEQ ID NO: 2414714 - DNA, 20 bp, Homo sapiens
tccaggttccctcccagagg

SEQ ID NO: 2414715 - DNA, 13 bp, Homo sapiens
tcccacctgacac

SEQ ID NO: 2414716 - DNA, 16 bp, Homo sapiens
tcccagaggagccacc

SEQ ID NO: 2414717 - DNA, 22 bp, Homo sapiens
tccctcccagaggagccaccag

SEQ ID NO: 2414718 - DNA, 14 bp, Homo sapiens
tcctcactgtatcc

SEQ ID NO: 2414719 - DNA, 12 bp, Homo sapiens
tcctctgcactc

SEQ ID NO: 2414720 - DNA, 20 bp, Homo sapiens
tccttttgacactgctctaa

SEQ ID NO: 2414721 - DNA, 22 bp, Homo sapiens
tccttttgacactgctctaaca

SEQ ID NO: 2414722 - DNA, 21 bp, Homo sapiens
tctaacagccctcctctgcac

SEQ ID NO: 2414723 - DNA, 16 bp, Homo sapiens
tctaccccagactaga

SEQ ID NO: 2414724 - DNA, 18 bp, Homo sapiens
tctaccccagactagatg

SEQ ID NO: 2414725 - DNA, 12 bp, Homo sapiens
tctccagctgac

SEQ ID NO: 2414726 - DNA, 18 bp, Homo sapiens
tctctccagctgactaaa

SEQ ID NO: 2414727 - DNA, 19 bp, Homo sapiens
tctctccagctgactaaac

SEQ ID NO: 2414728 - DNA, 14 bp, Homo sapiens
tctggcccaccagg

SEQ ID NO: 2414729 - DNA, 15 bp, Homo sapiens
tctggctctaattca

SEQ ID NO: 2414730 - DNA, 16 bp, Homo sapiens
tctggctctaattcac

SEQ ID NO: 2414731 - DNA, 20 bp, Homo sapiens
tctggctctaattcacagtg

SEQ ID NO: 2414732 - DNA, 20 bp, Homo sapiens
tctggtgagtcaccacttca

SEQ ID NO: 2414733 - DNA, 14 bp, Homo sapiens
tcttagtgtatgat

SEQ ID NO: 2414734 - DNA, 16 bp, Homo sapiens
tgaaaatgggctcaac

SEQ ID NO: 2414735 - DNA, 17 bp, Homo sapiens
tgaattaggctgtaact

SEQ ID NO: 2414736 - DNA, 22 bp, Homo sapiens
tgaattaggctgtaactacttt

SEQ ID NO: 2414737 - DNA, 22 bp, Homo sapiens
tgacacaccaggcgctaattca

SEQ ID NO: 2414738 - DNA, 15 bp, Homo sapiens
tgacactgctctaac

SEQ ID NO: 2414739 - DNA, 21 bp, Homo sapiens
tgactaaactttttttctgta

SEQ ID NO: 2414740 - DNA, 21 bp, Homo sapiens
tgattactggcctttttcatt

SEQ ID NO: 2414741 - DNA, 20 bp, Homo sapiens
tgattattaacgatgtccaa

SEQ ID NO: 2414742 - DNA, 20 bp, Homo sapiens
tgcagctgtggcagagttac

SEQ ID NO: 2414743 - DNA, 16 bp, Homo sapiens
tgcggttaattttgaa

SEQ ID NO: 2414744 - DNA, 16 bp, Homo sapiens
tgctctaacagccctc

SEQ ID NO: 2414745 - DNA, 23 bp, Homo sapiens
tgctcttttctcctcactgtatc

SEQ ID NO: 2414746 - DNA, 19 bp, Homo sapiens
tgctgcaagcacagccctt

SEQ ID NO: 2414747 - DNA, 17 bp, Homo sapiens
tgctgtttattaatctt

SEQ ID NO: 2414748 - DNA, 23 bp, Homo sapiens
tgctgtttattaatcttagtgta

SEQ ID NO: 2414749 - DNA, 15 bp, Homo sapiens
tgcttctttctagaa

SEQ ID NO: 2414750 - DNA, 16 bp, Homo sapiens
tggaaataaagtcaga

SEQ ID NO: 2414751 - DNA, 15 bp, Homo sapiens
tggatttcctaatac

SEQ ID NO: 2414752 - DNA, 17 bp, Homo sapiens
tggcagagttacagttc

SEQ ID NO: 2414753 - DNA, 20 bp, Homo sapiens
tggcagagttacagttctgt

SEQ ID NO: 2414754 - DNA, 16 bp, Homo sapiens
tggcatagctctgggg

SEQ ID NO: 2414755 - DNA, 19 bp, Homo sapiens
tggctctaattcacagtgc

SEQ ID NO: 2414756 - DNA, 15 bp, Homo sapiens
tgggcagttttttga

SEQ ID NO: 2414757 - DNA, 19 bp, Homo sapiens
tggtttaaagaaagtgtat

SEQ ID NO: 2414758 - DNA, 21 bp, Homo sapiens
tggtttaaagaaagtgtattt

SEQ ID NO: 2414759 - DNA, 22 bp, Homo sapiens
tgtaccagttaatttttccaac

SEQ ID NO: 2414760 - DNA, 18 bp, Homo sapiens
tgtagtattttttgtata

SEQ ID NO: 2414761 - DNA, 20 bp, Homo sapiens
tgtagtattttttgtataat

SEQ ID NO: 2414762 - DNA, 18 bp, Homo sapiens
tgtataattggatttcct

SEQ ID NO: 2414763 - DNA, 22 bp, Homo sapiens
tgtatgattactggcctttttc

SEQ ID NO: 2414764 - DNA, 12 bp, Homo sapiens
tgtatttggaaa

SEQ ID NO: 2414765 - DNA, 22 bp, Homo sapiens
tgtcagctgcaaggtactctgg

SEQ ID NO: 2414766 - DNA, 23 bp, Homo sapiens
tgtcagctgcaaggtactctggt

SEQ ID NO: 2414767 - DNA, 22 bp, Homo sapiens
tgtcatcctcaaagaaagtgta

SEQ ID NO: 2414768 - DNA, 24 bp, Homo sapiens
tgtcctgcctattatctgtcagct

SEQ ID NO: 2414769 - DNA, 23 bp, Homo sapiens
tgtgaattaggctgtaactactt

SEQ ID NO: 2414770 - DNA, 24 bp, Homo sapiens
tgtgaattaggctgtaactacttt

SEQ ID NO: 2414771 - DNA, 14 bp, Homo sapiens
tgtttattaatctt

SEQ ID NO: 2414772 - DNA, 12 bp, Homo sapiens
ttaaagaaagtg

SEQ ID NO: 2414773 - DNA, 18 bp, Homo sapiens
ttaacgatgtccaacccg

SEQ ID NO: 2414774 - DNA, 17 bp, Homo sapiens
ttaacttcttgcttctt

SEQ ID NO: 2414775 - DNA, 21 bp, Homo sapiens
ttaacttcttgcttctttcta

SEQ ID NO: 2414776 - DNA, 19 bp, Homo sapiens
ttaatcttagtgtatgatt

SEQ ID NO: 2414777 - DNA, 13 bp, Homo sapiens
ttaatgtatgtta

SEQ ID NO: 2414778 - DNA, 18 bp, Homo sapiens
ttaatgtatgttaccaaa

SEQ ID NO: 2414779 - DNA, 14 bp, Homo sapiens
ttacagttctgtgg

SEQ ID NO: 2414780 - DNA, 16 bp, Homo sapiens
ttactggcctttttca

SEQ ID NO: 2414781 - DNA, 18 bp, Homo sapiens
ttactggcctttttcatt

SEQ ID NO: 2414782 - DNA, 20 bp, Homo sapiens
ttactgtgtaattagtgcca

SEQ ID NO: 2414783 - DNA, 14 bp, Homo sapiens
tttcatttatctat

SEQ ID NO: 2414784 - DNA, 18 bp, Homo sapiens
tttccaactactaataga

SEQ ID NO: 2414785 - DNA, 12 bp, Homo sapiens
tttcctaatact

SEQ ID NO: 2414786 - DNA, 13 bp, Homo sapiens
tttctagaaagag

SEQ ID NO: 2414787 - DNA, 21 bp, Homo sapiens
tttgtataattggatttccta

SEQ ID NO: 2414788 - DNA, 15 bp, Homo sapiens
tttgtcactttttct

SEQ ID NO: 2414789 - DNA, 13 bp, Homo sapiens
ttttcatttatct

SEQ ID NO: 2414790 - DNA, 23 bp, Homo sapiens
ttttctaacagaaagcatgattt

SEQ ID NO: 2414791 - DNA, 14 bp, Homo sapiens
ttttctgtaccagt

SEQ ID NO: 2414792 - DNA, 16 bp, Homo sapiens
aaacagttggtaactt

SEQ ID NO: 2414793 - DNA, 18 bp, Homo sapiens
aaacagttggtaactttt

SEQ ID NO: 2414794 - DNA, 12 bp, Homo sapiens
aaagaaagtgta

SEQ ID NO: 2414795 - DNA, 16 bp, Homo sapiens
aaaggcagttttctaa

SEQ ID NO: 2414796 - DNA, 14 bp, Homo sapiens
aaagtgtatttgga

SEQ ID NO: 2414797 - DNA, 23 bp, Homo sapiens
aaagtgtatttggaaataaagtc

SEQ ID NO: 2414798 - DNA, 13 bp, Homo sapiens
aaattcatttttt

SEQ ID NO: 2414799 - DNA, 19 bp, Homo sapiens
aaattcattttttaaattc

SEQ ID NO: 2414800 - DNA, 17 bp, Homo sapiens
aacagccctcctctgca

SEQ ID NO: 2414801 - DNA, 19 bp, Homo sapiens
aacagccctcctctgcact

SEQ ID NO: 2414802 - DNA, 14 bp, Homo sapiens
aacagttggtaact

SEQ ID NO: 2414803 - DNA, 21 bp, Homo sapiens
aacagttggtaacttttgtga

SEQ ID NO: 2414804 - DNA, 22 bp, Homo sapiens
aacagttggtaacttttgtgaa

SEQ ID NO: 2414805 - DNA, 11 bp, Homo sapiens
aactaacatgt

SEQ ID NO: 2414806 - DNA, 17 bp, Homo sapiens
aactactttataactaa

SEQ ID NO: 2414807 - DNA, 18 bp, Homo sapiens
aacttcttgcttctttct

SEQ ID NO: 2414808 - DNA, 19 bp, Homo sapiens
aacttcttgcttctttcta

SEQ ID NO: 2414809 - DNA, 20 bp, Homo sapiens
aacttcttgcttctttctag

SEQ ID NO: 2414810 - DNA, 19 bp, Homo sapiens
aacttttctaacagaaagc

SEQ ID NO: 2414811 - DNA, 15 bp, Homo sapiens
aagaaagtgtatttg

SEQ ID NO: 2414812 - DNA, 18 bp, Homo sapiens
aagaaagtgtatttggaa

SEQ ID NO: 2414813 - DNA, 13 bp, Homo sapiens
aagcacagccctt

SEQ ID NO: 2414814 - DNA, 17 bp, Homo sapiens
aagcatctggctctaat

SEQ ID NO: 2414815 - DNA, 19 bp, Homo sapiens
aagcatctggctctaattc

SEQ ID NO: 2414816 - DNA, 23 bp, Homo sapiens
aaggaatttcttaacttcttgct

SEQ ID NO: 2414817 - DNA, 13 bp, Homo sapiens
aagtcatcttgct

SEQ ID NO: 2414818 - DNA, 14 bp, Homo sapiens
aagtcatcttgcta

SEQ ID NO: 2414819 - DNA, 21 bp, Homo sapiens
aagtgctgtttattaatctta

SEQ ID NO: 2414820 - DNA, 15 bp, Homo sapiens
aagtgtatttggaaa

SEQ ID NO: 2414821 - DNA, 18 bp, Homo sapiens
aataaaggcagttttcta

SEQ ID NO: 2414822 - DNA, 17 bp, Homo sapiens
aataaagtcagatggaa

SEQ ID NO: 2414823 - DNA, 15 bp, Homo sapiens
aataaatatatctac

SEQ ID NO: 2414824 - DNA, 17 bp, Homo sapiens
aattagacactttggaa

SEQ ID NO: 2414825 - DNA, 16 bp, Homo sapiens
aattaggctgtaacta

SEQ ID NO: 2414826 - DNA, 18 bp, Homo sapiens
aattaggctgtaactact

SEQ ID NO: 2414827 - DNA, 19 bp, Homo sapiens
aattaggctgtaactactt

SEQ ID NO: 2414828 - DNA, 21 bp, Homo sapiens
aattaggctgtaactacttta

SEQ ID NO: 2414829 - DNA, 20 bp, Homo sapiens
aattcccgttttgtcacttt

SEQ ID NO: 2414830 - DNA, 11 bp, Homo sapiens
aattggatttc

SEQ ID NO: 2414831 - DNA, 15 bp, Homo sapiens
aattggatttcctaa

SEQ ID NO: 2414832 - DNA, 16 bp, Homo sapiens
aatttcttaacttctt

SEQ ID NO: 2414833 - DNA, 14 bp, Homo sapiens
aattttgaagtgct

SEQ ID NO: 2414834 - DNA, 14 bp, Homo sapiens
aatttttccaacta

SEQ ID NO: 2414835 - DNA, 20 bp, Homo sapiens
aatttttccaactactaata

SEQ ID NO: 2414836 - DNA, 15 bp, Homo sapiens
acaaatcagaagtca

SEQ ID NO: 2414837 - DNA, 13 bp, Homo sapiens
acactgctctaac

SEQ ID NO: 2414838 - DNA, 16 bp, Homo sapiens
acagtgctcttttctc

SEQ ID NO: 2414839 - DNA, 12 bp, Homo sapiens
acagttctgtgg

SEQ ID NO: 2414840 - DNA, 15 bp, Homo sapiens
tagatgtagtatttt

SEQ ID NO: 2414841 - DNA, 17 bp, Homo sapiens
tagatgtagtatttttt

SEQ ID NO: 2414842 - DNA, 22 bp, Homo sapiens
tagctctggggtgggcagtttt

SEQ ID NO: 2414843 - DNA, 12 bp, Homo sapiens
tagttaccttat

SEQ ID NO: 2414844 - DNA, 19 bp, Homo sapiens
tataattggatttcctaat

SEQ ID NO: 2414845 - DNA, 20 bp, Homo sapiens
tataattggatttcctaata

SEQ ID NO: 2414846 - DNA, 22 bp, Homo sapiens
tataattggatttcctaatact

SEQ ID NO: 2414847 - DNA, 17 bp, Homo sapiens
tataatttacctaagat

SEQ ID NO: 2414848 - DNA, 20 bp, Homo sapiens
tataatttacctaagattac

SEQ ID NO: 2414849 - DNA, 16 bp, Homo sapiens
tatagttactgtgtaa

SEQ ID NO: 2414850 - DNA, 18 bp, Homo sapiens
tatagttactgtgtaatt

SEQ ID NO: 2414851 - DNA, 20 bp, Homo sapiens
tatagttactgtgtaattag

SEQ ID NO: 2414852 - DNA, 12 bp, Homo sapiens
tatgattattaa

SEQ ID NO: 2414853 - DNA, 21 bp, Homo sapiens
tatgattattaacgatgtcca

SEQ ID NO: 2414854 - DNA, 14 bp, Homo sapiens
tattaatcttagtg

SEQ ID NO: 2414855 - DNA, 18 bp, Homo sapiens
tattaatcttagtgtatg

SEQ ID NO: 2414856 - DNA, 17 bp, Homo sapiens
tatttggaaataaagtc

SEQ ID NO: 2414857 - DNA, 16 bp, Homo sapiens
tattttttgtataatt

SEQ ID NO: 2414858 - DNA, 14 bp, Homo sapiens
tcaaagaaagtgta

SEQ ID NO: 2414859 - DNA, 15 bp, Homo sapiens
tcaaagaaagtgtat

SEQ ID NO: 2414860 - DNA, 16 bp, Homo sapiens
tcaaagaaagtgtatt

SEQ ID NO: 2414861 - DNA, 23 bp, Homo sapiens
tcaaggaatttcttaacttcttg

SEQ ID NO: 2414862 - DNA, 13 bp, Homo sapiens
tcactttttctga

SEQ ID NO: 2414863 - DNA, 16 bp, Homo sapiens
tcactttttctgataa

SEQ ID NO: 2414864 - DNA, 12 bp, Homo sapiens
tcagatggaaaa

SEQ ID NO: 2414865 - DNA, 19 bp, Homo sapiens
tcagatggaaaattcattt

SEQ ID NO: 2414866 - DNA, 18 bp, Homo sapiens
tcatcctcaaagaaagtg

SEQ ID NO: 2414867 - DNA, 12 bp, Homo sapiens
tcatgcagctgt

SEQ ID NO: 2414868 - DNA, 21 bp, Homo sapiens
tccagctgactaaactttttt

SEQ ID NO: 2414869 - DNA, 18 bp, Homo sapiens
tccaggttccctcccaga

SEQ ID NO: 2414870 - DNA, 19 bp, Homo sapiens
tcccacctgacacaccagg

SEQ ID NO: 2414871 - DNA, 20 bp, Homo sapiens
tcccagaggagccaccagtt

SEQ ID NO: 2414872 - DNA, 21 bp, Homo sapiens
tcccagaggagccaccagttc

SEQ ID NO: 2414873 - DNA, 15 bp, Homo sapiens
tcctaatactgtcat

SEQ ID NO: 2414874 - DNA, 18 bp, Homo sapiens
tcctcaaagaaagtgtat

SEQ ID NO: 2414875 - DNA, 19 bp, Homo sapiens
tcctcaaagaaagtgtatt

SEQ ID NO: 2414876 - DNA, 18 bp, Homo sapiens
tccttttgacactgctct

SEQ ID NO: 2414877 - DNA, 12 bp, Homo sapiens
tctaacagccct

SEQ ID NO: 2414878 - DNA, 23 bp, Homo sapiens
tctaacagccctcctctgcactc

SEQ ID NO: 2414879 - DNA, 21 bp, Homo sapiens
tctaccccagactagatgtag

SEQ ID NO: 2414880 - DNA, 16 bp, Homo sapiens
tctataatttacctaa

SEQ ID NO: 2414881 - DNA, 15 bp, Homo sapiens
tctcctcactgtatc

SEQ ID NO: 2414882 - DNA, 12 bp, Homo sapiens
tctctcttctct

SEQ ID NO: 2414883 - DNA, 14 bp, Homo sapiens
tctcttctctccag

SEQ ID NO: 2414884 - DNA, 15 bp, Homo sapiens
tctcttctctccagc

SEQ ID NO: 2414885 - DNA, 16 bp, Homo sapiens
tctcttctctccagct

SEQ ID NO: 2414886 - DNA, 18 bp, Homo sapiens
tctgcactcccacctgac

SEQ ID NO: 2414887 - DNA, 12 bp, Homo sapiens
tctggctctaat

SEQ ID NO: 2414888 - DNA, 17 bp, Homo sapiens
tctggggtgggcagttt

SEQ ID NO: 2414889 - DNA, 12 bp, Homo sapiens
tctgtaccagtt

SEQ ID NO: 2414890 - DNA, 13 bp, Homo sapiens
tctgtcagctgca

SEQ ID NO: 2414891 - DNA, 18 bp, Homo sapiens
tcttctctccagctgact

SEQ ID NO: 2414892 - DNA, 16 bp, Homo sapiens
tcttgcttctttctag

SEQ ID NO: 2414893 - DNA, 16 bp, Homo sapiens
tgacactgctctaaca

SEQ ID NO: 2414894 - DNA, 16 bp, Homo sapiens
tgcaagcacagccctt

SEQ ID NO: 2414895 - DNA, 20 bp, Homo sapiens
tgccacttaatgtatgttac

SEQ ID NO: 2414896 - DNA, 22 bp, Homo sapiens
tgccagaggctgatgtcaagca

SEQ ID NO: 2414897 - DNA, 18 bp, Homo sapiens
tgctaccagtatttagaa

SEQ ID NO: 2414898 - DNA, 22 bp, Homo sapiens
tgctaccagtatttagaagcca

SEQ ID NO: 2414899 - DNA, 13 bp, Homo sapiens
tgctcttttctcc

SEQ ID NO: 2414900 - DNA, 15 bp, Homo sapiens
tggaaaattcatttt

SEQ ID NO: 2414901 - DNA, 12 bp, Homo sapiens
tggaaataaagt

SEQ ID NO: 2414902 - DNA, 14 bp, Homo sapiens
tggaaataaagtca

SEQ ID NO: 2414903 - DNA, 12 bp, Homo sapiens
tggcagagttac

SEQ ID NO: 2414904 - DNA, 19 bp, Homo sapiens
tggcagagttacagttctg

SEQ ID NO: 2414905 - DNA, 20 bp, Homo sapiens
tggcctttttcatttatcta

SEQ ID NO: 2414906 - DNA, 16 bp, Homo sapiens
tgggcagttttttgaa

SEQ ID NO: 2414907 - DNA, 18 bp, Homo sapiens
tgggctcaaccagaaaag

SEQ ID NO: 2414908 - DNA, 24 bp, Homo sapiens
tggtaacttttgtgaattaggctg

SEQ ID NO: 2414909 - DNA, 12 bp, Homo sapiens
tggtttcatgtt

SEQ ID NO: 2414910 - DNA, 15 bp, Homo sapiens
tggtttcatgttagt

SEQ ID NO: 2414911 - DNA, 16 bp, Homo sapiens
tgtaactactttataa

SEQ ID NO: 2414912 - DNA, 21 bp, Homo sapiens
tgtaattagtgccacttaatg

SEQ ID NO: 2414913 - DNA, 12 bp, Homo sapiens
tgtacacagtca

SEQ ID NO: 2414914 - DNA, 14 bp, Homo sapiens
tgtaccagttaatt

SEQ ID NO: 2414915 - DNA, 23 bp, Homo sapiens
tgtaccagttaatttttccaact

SEQ ID NO: 2414916 - DNA, 19 bp, Homo sapiens
tgtagtattttttgtataa

SEQ ID NO: 2414917 - DNA, 19 bp, Homo sapiens
tgtataattggatttccta

SEQ ID NO: 2414918 - DNA, 19 bp, Homo sapiens
tgtcatcctcaaagaaagt

SEQ ID NO: 2414919 - DNA, 23 bp, Homo sapiens
tgtcatcctcaaagaaagtgtat

SEQ ID NO: 2414920 - DNA, 16 bp, Homo sapiens
tgtctcacctggactt

SEQ ID NO: 2414921 - DNA, 19 bp, Homo sapiens
tgtgaattaggctgtaact

SEQ ID NO: 2414922 - DNA, 22 bp, Homo sapiens
tgtgaattaggctgtaactact

SEQ ID NO: 2414923 - DNA, 20 bp, Homo sapiens
tgtggcagagttacagttct

SEQ ID NO: 2414924 - DNA, 17 bp, Homo sapiens
tgtggtttcatgttagt

SEQ ID NO: 2414925 - DNA, 23 bp, Homo sapiens
tgttaccaaaaataaatatatct

SEQ ID NO: 2414926 - DNA, 17 bp, Homo sapiens
ttaaagaaagtgtattt

SEQ ID NO: 2414927 - DNA, 15 bp, Homo sapiens
ttaatgtatgttacc

SEQ ID NO: 2414928 - DNA, 17 bp, Homo sapiens
ttaatgtatgttaccaa

SEQ ID NO: 2414929 - DNA, 15 bp, Homo sapiens
ttaatttttccaact

SEQ ID NO: 2414930 - DNA, 18 bp, Homo sapiens
ttaatttttccaactact

SEQ ID NO: 2414931 - DNA, 22 bp, Homo sapiens
ttacaaatcagaagtcatcttg

SEQ ID NO: 2414932 - DNA, 11 bp, Homo sapiens
ttacagttctg

SEQ ID NO: 2414933 - DNA, 22 bp, Homo sapiens
ttacagttctgtggtttcatgt

SEQ ID NO: 2414934 - DNA, 21 bp, Homo sapiens
ttaccaaaaataaatatatct

SEQ ID NO: 2414935 - DNA, 14 bp, Homo sapiens
ttacctaagattac

SEQ ID NO: 2414936 - DNA, 18 bp, Homo sapiens
ttacctaagattacaaat

SEQ ID NO: 2414937 - DNA, 13 bp, Homo sapiens
ttactgtgtaatt

SEQ ID NO: 2414938 - DNA, 17 bp, Homo sapiens
ttaggctgtaactactt

SEQ ID NO: 2414939 - DNA, 18 bp, Homo sapiens
ttagtgccacttaatgta

SEQ ID NO: 2414940 - DNA, 19 bp, Homo sapiens
ttagtgccacttaatgtat

SEQ ID NO: 2414941 - DNA, 19 bp, Homo sapiens
ttagttaccttatagttac

SEQ ID NO: 2414942 - DNA, 20 bp, Homo sapiens
ttagttaccttatagttact

SEQ ID NO: 2414943 - DNA, 14 bp, Homo sapiens
taatttttccaact

SEQ ID NO: 2414944 - DNA, 21 bp, Homo sapiens
tacaaatcagaagtcatcttg

SEQ ID NO: 2414945 - DNA, 22 bp, Homo sapiens
tacaaatcagaagtcatcttgc

SEQ ID NO: 2414946 - DNA, 18 bp, Homo sapiens
taccagttaatttttcca

SEQ ID NO: 2414947 - DNA, 20 bp, Homo sapiens
tacctaagattacaaatcag

SEQ ID NO: 2414948 - DNA, 16 bp, Homo sapiens
taccttatagttactg

SEQ ID NO: 2414949 - DNA, 20 bp, Homo sapiens
tactaatagaataaaggcag

SEQ ID NO: 2414950 - DNA, 23 bp, Homo sapiens
tactaatagaataaaggcagttt

SEQ ID NO: 2414951 - DNA, 18 bp, Homo sapiens
tactggcctttttcattt

SEQ ID NO: 2414952 - DNA, 19 bp, Homo sapiens
tagaataaaggcagttttc

SEQ ID NO: 2414953 - DNA, 21 bp, Homo sapiens
tagaataaaggcagttttcta

SEQ ID NO: 2414954 - DNA, 11 bp, Homo sapiens
tagctctgggg

SEQ ID NO: 2414955 - DNA, 23 bp, Homo sapiens
tagctctggggtgggcagttttt

SEQ ID NO: 2414956 - DNA, 21 bp, Homo sapiens
taggctgtaactactttataa

SEQ ID NO: 2414957 - DNA, 19 bp, Homo sapiens
tagtgtatgattactggcc

SEQ ID NO: 2414958 - DNA, 18 bp, Homo sapiens
tagttaccttatagttac

SEQ ID NO: 2414959 - DNA, 14 bp, Homo sapiens
tataatttacctaa

SEQ ID NO: 2414960 - DNA, 16 bp, Homo sapiens
tataatttacctaaga

SEQ ID NO: 2414961 - DNA, 14 bp, Homo sapiens
tatctataatttac

SEQ ID NO: 2414962 - DNA, 16 bp, Homo sapiens
tatctataatttacct

SEQ ID NO: 2414963 - DNA, 19 bp, Homo sapiens
tatctataatttacctaag

SEQ ID NO: 2414964 - DNA, 15 bp, Homo sapiens
tatgattactggcct

SEQ ID NO: 2414965 - DNA, 15 bp, Homo sapiens
tattaacgatgtcca

SEQ ID NO: 2414966 - DNA, 15 bp, Homo sapiens
tattaccccttttcg

SEQ ID NO: 2414967 - DNA, 16 bp, Homo sapiens
tattagtgctttgcca

SEQ ID NO: 2414968 - DNA, 21 bp, Homo sapiens
tcaaggaatttcttaacttct

SEQ ID NO: 2414969 - DNA, 17 bp, Homo sapiens
tcacagtgctcttttct

SEQ ID NO: 2414970 - DNA, 22 bp, Homo sapiens
tcacctggacttaagcatctgg

SEQ ID NO: 2414971 - DNA, 15 bp, Homo sapiens
tcagaagtcatcttg

SEQ ID NO: 2414972 - DNA, 18 bp, Homo sapiens
tcagaagtcatcttgcta

SEQ ID NO: 2414973 - DNA, 22 bp, Homo sapiens
tcagaagtcatcttgctaccag

SEQ ID NO: 2414974 - DNA, 20 bp, Homo sapiens
tcagatggaaaattcatttt

SEQ ID NO: 2414975 - DNA, 20 bp, Homo sapiens
tcagctgcaaggtactctgg

SEQ ID NO: 2414976 - DNA, 20 bp, Homo sapiens
tcagtctctcttctctccag

SEQ ID NO: 2414977 - DNA, 21 bp, Homo sapiens
tcatcttgctaccagtattta

SEQ ID NO: 2414978 - DNA, 14 bp, Homo sapiens
tcatgcagctgtgg

SEQ ID NO: 2414979 - DNA, 23 bp, Homo sapiens
tcatgttagttaccttatagtta

SEQ ID NO: 2414980 - DNA, 12 bp, Homo sapiens
tcatttatctat

SEQ ID NO: 2414981 - DNA, 16 bp, Homo sapiens
tcatttatctataatt

SEQ ID NO: 2414982 - DNA, 23 bp, Homo sapiens
tccaacccgtctggcccaccagg

SEQ ID NO: 2414983 - DNA, 20 bp, Homo sapiens
tccaactactaatagaataa

SEQ ID NO: 2414984 - DNA, 13 bp, Homo sapiens
tccagtctattca

SEQ ID NO: 2414985 - DNA, 23 bp, Homo sapiens
tcccagaggagccaccagttctc

SEQ ID NO: 2414986 - DNA, 23 bp, Homo sapiens
tccctcccagaggagccaccagt

SEQ ID NO: 2414987 - DNA, 14 bp, Homo sapiens
tcctaatactgtca

SEQ ID NO: 2414988 - DNA, 15 bp, Homo sapiens
tcctcaaagaaagtg

SEQ ID NO: 2414989 - DNA, 16 bp, Homo sapiens
tcctctgcactcccac

SEQ ID NO: 2414990 - DNA, 19 bp, Homo sapiens
tcctgcctattatctgtca

SEQ ID NO: 2414991 - DNA, 13 bp, Homo sapiens
tctaacagccctc

SEQ ID NO: 2414992 - DNA, 16 bp, Homo sapiens
tctaattcacagtgct

SEQ ID NO: 2414993 - DNA, 23 bp, Homo sapiens
tctaccccagactagatgtagta

SEQ ID NO: 2414994 - DNA, 19 bp, Homo sapiens
tctagaaagagaaacagtt

SEQ ID NO: 2414995 - DNA, 24 bp, Homo sapiens
tctcacctggacttaagcatctgg

SEQ ID NO: 2414996 - DNA, 14 bp, Homo sapiens
tctccagctgacta

SEQ ID NO: 2414997 - DNA, 15 bp, Homo sapiens
tctccagctgactaa

SEQ ID NO: 2414998 - DNA, 15 bp, Homo sapiens
tctctccagctgact

SEQ ID NO: 2414999 - DNA, 23 bp, Homo sapiens
tctcttctctccagctgactaaa

SEQ ID NO: 2415000 - DNA, 22 bp, Homo sapiens
tctggctctaattcacagtgct

SEQ ID NO: 2415001 - DNA, 22 bp, Homo sapiens
tctgtaccagttaatttttcca

SEQ ID NO: 2415002 - DNA, 23 bp, Homo sapiens
tcttaacttcttgcttctttcta

SEQ ID NO: 2415003 - DNA, 14 bp, Homo sapiens
tcttctctccagct

SEQ ID NO: 2415004 - DNA, 14 bp, Homo sapiens
tcttgctaccagta

SEQ ID NO: 2415005 - DNA, 20 bp, Homo sapiens
tcttgctaccagtatttaga

SEQ ID NO: 2415006 - DNA, 11 bp, Homo sapiens
tcttgcttctt

SEQ ID NO: 2415007 - DNA, 17 bp, Homo sapiens
tcttgcttctttctaga

SEQ ID NO: 2415008 - DNA, 18 bp, Homo sapiens
tcttgcttctttctagaa

SEQ ID NO: 2415009 - DNA, 22 bp, Homo sapiens
tgaagtgctgtttattaatctt

SEQ ID NO: 2415010 - DNA, 21 bp, Homo sapiens
tgaattaggctgtaactactt

SEQ ID NO: 2415011 - DNA, 23 bp, Homo sapiens
tgacacaccaggcgctaattcaa

SEQ ID NO: 2415012 - DNA, 13 bp, Homo sapiens
tgacactgctcta

SEQ ID NO: 2415013 - DNA, 19 bp, Homo sapiens
tgacactgctctaacagcc

SEQ ID NO: 2415014 - DNA, 19 bp, Homo sapiens
tgactaaactttttttctg

SEQ ID NO: 2415015 - DNA, 20 bp, Homo sapiens
tgattactggcctttttcat

SEQ ID NO: 2415016 - DNA, 23 bp, Homo sapiens
tgattactggcctttttcattta

SEQ ID NO: 2415017 - DNA, 14 bp, Homo sapiens
tgcactcccacctg

SEQ ID NO: 2415018 - DNA, 14 bp, Homo sapiens
tgccacttaatgta

SEQ ID NO: 2415019 - DNA, 18 bp, Homo sapiens
tgccacttaatgtatgtt

SEQ ID NO: 2415020 - DNA, 21 bp, Homo sapiens
tgcggttaattttgaagtgct

SEQ ID NO: 2415021 - DNA, 21 bp, Homo sapiens
tgctcttttctcctcactgta

SEQ ID NO: 2415022 - DNA, 14 bp, Homo sapiens
tgctgtttattaat

SEQ ID NO: 2415023 - DNA, 19 bp, Homo sapiens
tggacttaagcatctggct

SEQ ID NO: 2415024 - DNA, 21 bp, Homo sapiens
tggatttcctaatactgtcat

SEQ ID NO: 2415025 - DNA, 15 bp, Homo sapiens
tggcatagctctggg

SEQ ID NO: 2415026 - DNA, 19 bp, Homo sapiens
tggcctttttcatttatct

SEQ ID NO: 2415027 - DNA, 14 bp, Homo sapiens
tggtaacttttgtg

SEQ ID NO: 2415028 - DNA, 16 bp, Homo sapiens
tggtttaaagaaagtg

SEQ ID NO: 2415029 - DNA, 18 bp, Homo sapiens
tgtaactactttataact

SEQ ID NO: 2415030 - DNA, 11 bp, Homo sapiens
tgtaccagtta

SEQ ID NO: 2415031 - DNA, 12 bp, Homo sapiens
tgtaccagttaa

SEQ ID NO: 2415032 - DNA, 15 bp, Homo sapiens
tgtaccagttaattt

SEQ ID NO: 2415033 - DNA, 21 bp, Homo sapiens
tgtaccagttaatttttccaa

SEQ ID NO: 2415034 - DNA, 14 bp, Homo sapiens
tgtataattggatt

SEQ ID NO: 2415035 - DNA, 21 bp, Homo sapiens
tgtataattggatttcctaat

SEQ ID NO: 2415036 - DNA, 13 bp, Homo sapiens
tgtatttggaaat

SEQ ID NO: 2415037 - DNA, 16 bp, Homo sapiens
tgtcactttttctgat

SEQ ID NO: 2415038 - DNA, 20 bp, Homo sapiens
tgtcatcctcaaagaaagtg

SEQ ID NO: 2415039 - DNA, 17 bp, Homo sapiens
tgtcctgcctattatct

SEQ ID NO: 2415040 - DNA, 15 bp, Homo sapiens
tgtggcagagttaca

SEQ ID NO: 2415041 - DNA, 22 bp, Homo sapiens
tgtggtttcatgttagttacct

SEQ ID NO: 2415042 - DNA, 21 bp, Homo sapiens
tgtgtaattagtgccacttaa

SEQ ID NO: 2415043 - DNA, 19 bp, Homo sapiens
tgttaccaaaaataaatat

SEQ ID NO: 2415044 - DNA, 23 bp, Homo sapiens
tgttagttaccttatagttactg

SEQ ID NO: 2415045 - DNA, 18 bp, Homo sapiens
aaaaataaatatatctac

SEQ ID NO: 2415046 - DNA, 17 bp, Homo sapiens
aaaataaatatatctac

SEQ ID NO: 2415047 - DNA, 12 bp, Homo sapiens
aaaattcatttt

SEQ ID NO: 2415048 - DNA, 23 bp, Homo sapiens
aaactttttttctgtaccagtta

SEQ ID NO: 2415049 - DNA, 10 bp, Homo sapiens
aaagaaagtg

SEQ ID NO: 2415050 - DNA, 22 bp, Homo sapiens
aaagagaaacagttggtaactt

SEQ ID NO: 2415051 - DNA, 13 bp, Homo sapiens
aaaggcagttttc

SEQ ID NO: 2415052 - DNA, 10 bp, Homo sapiens
aaagtgtatt

SEQ ID NO: 2415053 - DNA, 12 bp, Homo sapiens
aaatcagaagtc

SEQ ID NO: 2415054 - DNA, 17 bp, Homo sapiens
aaattcccgttttgtca

SEQ ID NO: 2415055 - DNA, 17 bp, Homo sapiens
aacagttggtaactttt

SEQ ID NO: 2415056 - DNA, 19 bp, Homo sapiens
aacatgtcctgcctattat

SEQ ID NO: 2415057 - DNA, 14 bp, Homo sapiens
aactaacatgtcct

SEQ ID NO: 2415058 - DNA, 17 bp, Homo sapiens
aactactaatagaataa

SEQ ID NO: 2415059 - DNA, 13 bp, Homo sapiens
aactactttataa

SEQ ID NO: 2415060 - DNA, 20 bp, Homo sapiens
aagattacaaatcagaagtc

SEQ ID NO: 2415061 - DNA, 21 bp, Homo sapiens
aagattacaaatcagaagtca

SEQ ID NO: 2415062 - DNA, 15 bp, Homo sapiens
aaggcagttttctaa

SEQ ID NO: 2415063 - DNA, 23 bp, Homo sapiens
aagtcagatggaaaattcatttt

SEQ ID NO: 2415064 - DNA, 20 bp, Homo sapiens
aagtcatcttgctaccagta

SEQ ID NO: 2415065 - DNA, 23 bp, Homo sapiens
aagtcatcttgctaccagtattt

SEQ ID NO: 2415066 - DNA, 14 bp, Homo sapiens
aagtgctgtttatt

SEQ ID NO: 2415067 - DNA, 18 bp, Homo sapiens
aagtgctgtttattaatc

SEQ ID NO: 2415068 - DNA, 20 bp, Homo sapiens
aagtgctgtttattaatctt

SEQ ID NO: 2415069 - DNA, 13 bp, Homo sapiens
aagtgtatttgga

SEQ ID NO: 2415070 - DNA, 16 bp, Homo sapiens
aatagaataaaggcag

SEQ ID NO: 2415071 - DNA, 24 bp, Homo sapiens
aatcagaagtcatcttgctaccag

SEQ ID NO: 2415072 - DNA, 18 bp, Homo sapiens
aatcttagtgtatgatta

SEQ ID NO: 2415073 - DNA, 13 bp, Homo sapiens
aatgtatgttacc

SEQ ID NO: 2415074 - DNA, 17 bp, Homo sapiens
aatgtatgttaccaaaa

SEQ ID NO: 2415075 - DNA, 22 bp, Homo sapiens
aattaggctgtaactactttat

SEQ ID NO: 2415076 - DNA, 15 bp, Homo sapiens
aattagtgccactta

SEQ ID NO: 2415077 - DNA, 16 bp, Homo sapiens
aattcaaggaatttct

SEQ ID NO: 2415078 - DNA, 21 bp, Homo sapiens
aatttacctaagattacaaat

SEQ ID NO: 2415079 - DNA, 12 bp, Homo sapiens
aatttcttaact

SEQ ID NO: 2415080 - DNA, 15 bp, Homo sapiens
aatttcttaacttct

SEQ ID NO: 2415081 - DNA, 23 bp, Homo sapiens
acaaatcagaagtcatcttgcta

SEQ ID NO: 2415082 - DNA, 22 bp, Homo sapiens
acagcccttatgcggttaattt

SEQ ID NO: 2415083 - DNA, 21 bp, Homo sapiens
acagtgctcttttctcctcac

SEQ ID NO: 2415084 - DNA, 23 bp, Homo sapiens
acatgtcctgcctattatctgtc

SEQ ID NO: 2415085 - DNA, 15 bp, Homo sapiens
accacttcagggctt

SEQ ID NO: 2415086 - DNA, 21 bp, Homo sapiens
accagggtccttttgacactg

SEQ ID NO: 2415087 - DNA, 11 bp, Homo sapiens
accagtattta

SEQ ID NO: 2415088 - DNA, 18 bp, Homo sapiens
accagtatttagaagcca

SEQ ID NO: 2415089 - DNA, 16 bp, Homo sapiens
accagttctcatgggt

SEQ ID NO: 2415090 - DNA, 19 bp, Homo sapiens
accccagactagatgtagt

SEQ ID NO: 2415091 - DNA, 18 bp, Homo sapiens
acctgtctcacctggact

SEQ ID NO: 2415092 - DNA, 19 bp, Homo sapiens
accttatagttactgtgta

SEQ ID NO: 2415093 - DNA, 23 bp, Homo sapiens
accttatagttactgtgtaatta

SEQ ID NO: 2415094 - DNA, 17 bp, Homo sapiens
actaaactttttttctg

SEQ ID NO: 2415095 - DNA, 22 bp, Homo sapiens
actaaactttttttctgtacca

SEQ ID NO: 2415096 - DNA, 13 bp, Homo sapiens
actagatgtagta

SEQ ID NO: 2415097 - DNA, 17 bp, Homo sapiens
ccagtatttagaagcca

SEQ ID NO: 2415098 - DNA, 18 bp, Homo sapiens
cccacctgacacaccagg

SEQ ID NO: 2415099 - DNA, 20 bp, Homo sapiens
cccagactagatgtagtatt

SEQ ID NO: 2415100 - DNA, 23 bp, Homo sapiens
cccagactagatgtagtattttt

SEQ ID NO: 2415101 - DNA, 20 bp, Homo sapiens
cccagaggagccaccagttc

SEQ ID NO: 2415102 - DNA, 19 bp, Homo sapiens
cccttatgcggttaatttt

SEQ ID NO: 2415103 - DNA, 16 bp, Homo sapiens
ccgtctggcccaccag

SEQ ID NO: 2415104 - DNA, 19 bp, Homo sapiens
ccgttttgtcactttttct

SEQ ID NO: 2415105 - DNA, 20 bp, Homo sapiens
cctcactgtatccaggttcc

SEQ ID NO: 2415106 - DNA, 14 bp, Homo sapiens
cctgacacaccagg

SEQ ID NO: 2415107 - DNA, 15 bp, Homo sapiens
cctgacacaccaggc

SEQ ID NO: 2415108 - DNA, 17 bp, Homo sapiens
cctgacacaccaggcgc

SEQ ID NO: 2415109 - DNA, 19 bp, Homo sapiens
cctgcctattatctgtcag

SEQ ID NO: 2415110 - DNA, 20 bp, Homo sapiens
cctggacttaagcatctggc

SEQ ID NO: 2415111 - DNA, 13 bp, Homo sapiens
ccttttgacactg

SEQ ID NO: 2415112 - DNA, 18 bp, Homo sapiens
ccttttgacactgctcta

SEQ ID NO: 2415113 - DNA, 17 bp, Homo sapiens
cgcctgaggcaattaga

SEQ ID NO: 2415114 - DNA, 17 bp, Homo sapiens
ctaaactttttttctgt

SEQ ID NO: 2415115 - DNA, 12 bp, Homo sapiens
ctaacagccctc

SEQ ID NO: 2415116 - DNA, 21 bp, Homo sapiens
ctaagattacaaatcagaagt

SEQ ID NO: 2415117 - DNA, 22 bp, Homo sapiens
ctaagattacaaatcagaagtc

SEQ ID NO: 2415118 - DNA, 20 bp, Homo sapiens
ctaatagaataaaggcagtt

SEQ ID NO: 2415119 - DNA, 16 bp, Homo sapiens
ctaattcaaggaattt

SEQ ID NO: 2415120 - DNA, 18 bp, Homo sapiens
ctaattcaaggaatttct

SEQ ID NO: 2415121 - DNA, 16 bp, Homo sapiens
ctaattcacagtgctc

SEQ ID NO: 2415122 - DNA, 20 bp, Homo sapiens
ctaccagtatttagaagcca

SEQ ID NO: 2415123 - DNA, 18 bp, Homo sapiens
ctactaatagaataaagg

SEQ ID NO: 2415124 - DNA, 22 bp, Homo sapiens
ctagatgtagtattttttgtat

SEQ ID NO: 2415125 - DNA, 17 bp, Homo sapiens
ctcaaagaaagtgtatt

SEQ ID NO: 2415126 - DNA, 12 bp, Homo sapiens
ctcacctggact

SEQ ID NO: 2415127 - DNA, 15 bp, Homo sapiens
ctcatgggtggcact

SEQ ID NO: 2415128 - DNA, 15 bp, Homo sapiens
ctcccagaggagcca

SEQ ID NO: 2415129 - DNA, 19 bp, Homo sapiens
ctcccagaggagccaccag

SEQ ID NO: 2415130 - DNA, 22 bp, Homo sapiens
ctcccagaggagccaccagttc

SEQ ID NO: 2415131 - DNA, 13 bp, Homo sapiens
ctcctctgcactc

SEQ ID NO: 2415132 - DNA, 14 bp, Homo sapiens
ctctaacagccctc

SEQ ID NO: 2415133 - DNA, 15 bp, Homo sapiens
ctctaattcacagtg

SEQ ID NO: 2415134 - DNA, 16 bp, Homo sapiens
ctctaattcacagtgc

SEQ ID NO: 2415135 - DNA, 15 bp, Homo sapiens
ctctccagctgacta

SEQ ID NO: 2415136 - DNA, 20 bp, Homo sapiens
ctctgcactcccacctgaca

SEQ ID NO: 2415137 - DNA, 14 bp, Homo sapiens
ctcttctctccagc

SEQ ID NO: 2415138 - DNA, 22 bp, Homo sapiens
ctgactaaactttttttctgta

SEQ ID NO: 2415139 - DNA, 17 bp, Homo sapiens
ctgcaagcacagccctt

SEQ ID NO: 2415140 - DNA, 17 bp, Homo sapiens
ctgcaaggtactctggt

SEQ ID NO: 2415141 - DNA, 18 bp, Homo sapiens
ctgcaaggtactctggtg

SEQ ID NO: 2415142 - DNA, 22 bp, Homo sapiens
ctgcactcccacctgacacacc

SEQ ID NO: 2415143 - DNA, 19 bp, Homo sapiens
ctggcctttttcatttatc

SEQ ID NO: 2415144 - DNA, 19 bp, Homo sapiens
ctggctctaattcacagtg

SEQ ID NO: 2415145 - DNA, 16 bp, Homo sapiens
ctgtaactactttata

SEQ ID NO: 2415146 - DNA, 23 bp, Homo sapiens
ctgtatccaggttccctcccaga

SEQ ID NO: 2415147 - DNA, 20 bp, Homo sapiens
ctgtcatcctcaaagaaagt

SEQ ID NO: 2415148 - DNA, 12 bp, Homo sapiens
ctgtctcacctg

SEQ ID NO: 2415149 - DNA, 17 bp, Homo sapiens
ctgtggcagagttacag

SEQ ID NO: 2415150 - DNA, 14 bp, Homo sapiens
ctgtttattaatct

SEQ ID NO: 2415151 - DNA, 18 bp, Homo sapiens
cttaacttcttgcttctt

SEQ ID NO: 2415152 - DNA, 21 bp, Homo sapiens
cttaacttcttgcttctttct

SEQ ID NO: 2415153 - DNA, 18 bp, Homo sapiens
cttaagcatctggctcta

SEQ ID NO: 2415154 - DNA, 17 bp, Homo sapiens
cttaatgtatgttacca

SEQ ID NO: 2415155 - DNA, 21 bp, Homo sapiens
cttaatgtatgttaccaaaaa

SEQ ID NO: 2415156 - DNA, 14 bp, Homo sapiens
cttatagttactgt

SEQ ID NO: 2415157 - DNA, 14 bp, Homo sapiens
cttctctccagctg

SEQ ID NO: 2415158 - DNA, 16 bp, Homo sapiens
cttctttctagaaaga

SEQ ID NO: 2415159 - DNA, 13 bp, Homo sapiens
cttgctaccagta

SEQ ID NO: 2415160 - DNA, 18 bp, Homo sapiens
cttgctaccagtatttag

SEQ ID NO: 2415161 - DNA, 21 bp, Homo sapiens
cttgctgcaagcacagccctt

SEQ ID NO: 2415162 - DNA, 17 bp, Homo sapiens
cttttctcctcactgta

SEQ ID NO: 2415163 - DNA, 12 bp, Homo sapiens
ctttttcattta

SEQ ID NO: 2415164 - DNA, 14 bp, Homo sapiens
ctttttttctgtac

SEQ ID NO: 2415165 - DNA, 16 bp, Homo sapiens
ctttttttctgtacca

SEQ ID NO: 2415166 - DNA, 20 bp, Homo sapiens
ctttttttctgtaccagtta

SEQ ID NO: 2415167 - DNA, 14 bp, Homo sapiens
gaaaattcattttt

SEQ ID NO: 2415168 - DNA, 11 bp, Homo sapiens
gaaagtgtatt

SEQ ID NO: 2415169 - DNA, 20 bp, Homo sapiens
tttgaagtgctgtttattaa

SEQ ID NO: 2415170 - DNA, 22 bp, Homo sapiens
tttgtgaattaggctgtaacta

SEQ ID NO: 2415171 - DNA, 14 bp, Homo sapiens
ttttccaactacta

SEQ ID NO: 2415172 - DNA, 21 bp, Homo sapiens
ttttctgtaccagttaatttt

SEQ ID NO: 2415173 - DNA, 16 bp, Homo sapiens
ttttgtataattggat

SEQ ID NO: 2415174 - DNA, 23 bp, Homo sapiens
ttttgtataattggatttcctaa

SEQ ID NO: 2415175 - DNA, 24 bp, Homo sapiens
ttttgtataattggatttcctaat

SEQ ID NO: 2415176 - DNA, 18 bp, Homo sapiens
ttttgtcactttttctga

SEQ ID NO: 2415177 - DNA, 14 bp, Homo sapiens
ttttgtgaattagg

SEQ ID NO: 2415178 - DNA, 17 bp, Homo sapiens
tttttctgataaaagat

SEQ ID NO: 2415179 - DNA, 16 bp, Homo sapiens
tttttctgtaccagtt

SEQ ID NO: 2415180 - DNA, 18 bp, Homo sapiens
atttacctaagattacaa

SEQ ID NO: 2415181 - DNA, 12 bp, Homo sapiens
atttagaagcca

SEQ ID NO: 2415182 - DNA, 13 bp, Homo sapiens
atttagaagccaa

SEQ ID NO: 2415183 - DNA, 22 bp, Homo sapiens
atttagaagccaactatgatta

SEQ ID NO: 2415184 - DNA, 15 bp, Homo sapiens
atttatctataattt

SEQ ID NO: 2415185 - DNA, 17 bp, Homo sapiens
atttcctaatactgtca

SEQ ID NO: 2415186 - DNA, 17 bp, Homo sapiens
atttcttaacttcttgc

SEQ ID NO: 2415187 - DNA, 15 bp, Homo sapiens
atttggaaataaagt

SEQ ID NO: 2415188 - DNA, 13 bp, Homo sapiens
attttgaagtgct

SEQ ID NO: 2415189 - DNA, 19 bp, Homo sapiens
attttgaagtgctgtttat

SEQ ID NO: 2415190 - DNA, 13 bp, Homo sapiens
atttttccaacta

SEQ ID NO: 2415191 - DNA, 21 bp, Homo sapiens
atttttccaactactaataga

SEQ ID NO: 2415192 - DNA, 13 bp, Homo sapiens
attttttaaattc

SEQ ID NO: 2415193 - DNA, 16 bp, Homo sapiens
attttttgtataattg

SEQ ID NO: 2415194 - DNA, 16 bp, Homo sapiens
caaagaaagtgtattg

SEQ ID NO: 2415195 - DNA, 21 bp, Homo sapiens
caacccgtctggcccaccagg

SEQ ID NO: 2415196 - DNA, 13 bp, Homo sapiens
caactactaatag

SEQ ID NO: 2415197 - DNA, 15 bp, Homo sapiens
caactactaatagaa

SEQ ID NO: 2415198 - DNA, 16 bp, Homo sapiens
caaggaatttcttaac

SEQ ID NO: 2415199 - DNA, 18 bp, Homo sapiens
caaggaatttcttaactt

SEQ ID NO: 2415200 - DNA, 14 bp, Homo sapiens
caaggtactctggt

SEQ ID NO: 2415201 - DNA, 18 bp, Homo sapiens
cacaccaggcgctaattc

SEQ ID NO: 2415202 - DNA, 18 bp, Homo sapiens
cacagtgctcttttctcc

SEQ ID NO: 2415203 - DNA, 17 bp, Homo sapiens
cactcccacctgacaca

SEQ ID NO: 2415204 - DNA, 19 bp, Homo sapiens
cacttcagggctttactcc

SEQ ID NO: 2415205 - DNA, 16 bp, Homo sapiens
cagaagtcatcttgct

SEQ ID NO: 2415206 - DNA, 19 bp, Homo sapiens
cagactagatgtagtattt

SEQ ID NO: 2415207 - DNA, 14 bp, Homo sapiens
cagagttacagttc

SEQ ID NO: 2415208 - DNA, 15 bp, Homo sapiens
cagagttacagttct

SEQ ID NO: 2415209 - DNA, 17 bp, Homo sapiens
cagagttacagttctgt

SEQ ID NO: 2415210 - DNA, 18 bp, Homo sapiens
cagagttacagttctgtg

SEQ ID NO: 2415211 - DNA, 23 bp, Homo sapiens
cagattttgttggcatagctctg

SEQ ID NO: 2415212 - DNA, 23 bp, Homo sapiens
cagcccttatgcggttaattttg

SEQ ID NO: 2415213 - DNA, 22 bp, Homo sapiens
cagctgcaaggtactctggtga

SEQ ID NO: 2415214 - DNA, 23 bp, Homo sapiens
cagctgtggcagagttacagttc

SEQ ID NO: 2415215 - DNA, 14 bp, Homo sapiens
cagggtccttttga

SEQ ID NO: 2415216 - DNA, 18 bp, Homo sapiens
caggttccctcccagagg

SEQ ID NO: 2415217 - DNA, 16 bp, Homo sapiens
cagtatttagaagcca

SEQ ID NO: 2415218 - DNA, 19 bp, Homo sapiens
cagttaatttttccaacta

SEQ ID NO: 2415219 - DNA, 17 bp, Homo sapiens
cagttggtaacttttgt

SEQ ID NO: 2415220 - DNA, 14 bp, Homo sapiens
catccagtctattc

SEQ ID NO: 2415221 - DNA, 20 bp, Homo sapiens
catcctcaaagaaagtgtat

SEQ ID NO: 2415222 - DNA, 14 bp, Homo sapiens
catctggctctaat

SEQ ID NO: 2415223 - DNA, 16 bp, Homo sapiens
catcttgctaccagta

SEQ ID NO: 2415224 - DNA, 20 bp, Homo sapiens
catcttgctaccagtattta

SEQ ID NO: 2415225 - DNA, 22 bp, Homo sapiens
catcttgctaccagtatttaga

SEQ ID NO: 2415226 - DNA, 15 bp, Homo sapiens
catggagctgggcta

SEQ ID NO: 2415227 - DNA, 13 bp, Homo sapiens
catgtcctgccta

SEQ ID NO: 2415228 - DNA, 22 bp, Homo sapiens
catgttagttaccttatagtta

SEQ ID NO: 2415229 - DNA, 24 bp, Homo sapiens
catgttagttaccttatagttact

SEQ ID NO: 2415230 - DNA, 14 bp, Homo sapiens
catttatctataat

SEQ ID NO: 2415231 - DNA, 16 bp, Homo sapiens
catttatctataattt

SEQ ID NO: 2415232 - DNA, 22 bp, Homo sapiens
ccaacccgtctggcccaccagg

SEQ ID NO: 2415233 - DNA, 22 bp, Homo sapiens
ccaactactaatagaataaagg

SEQ ID NO: 2415234 - DNA, 17 bp, Homo sapiens
ccacttaatgtatgtta

SEQ ID NO: 2415235 - DNA, 22 bp, Homo sapiens
ccagactagatgtagtattttt

SEQ ID NO: 2415236 - DNA, 17 bp, Homo sapiens
ccagaggagccaccagt

SEQ ID NO: 2415237 - DNA, 23 bp, Homo sapiens
ccagctgactaaactttttttct

SEQ ID NO: 2415238 - DNA, 16 bp, Homo sapiens
ccagttaatttttcca

SEQ ID NO: 2415239 - DNA, 13 bp, Homo sapiens
cccaccagggtcc

SEQ ID NO: 2415240 - DNA, 22 bp, Homo sapiens
ccccttttcggccccatgtatc

SEQ ID NO: 2415241 - DNA, 17 bp, Homo sapiens
ccgtctggcccaccagg

SEQ ID NO: 2415242 - DNA, 20 bp, Homo sapiens
cctcccagaggagccaccag

SEQ ID NO: 2415243 - DNA, 21 bp, Homo sapiens
cctcccagaggagccaccagt

SEQ ID NO: 2415244 - DNA, 21 bp, Homo sapiens
cctcctctgcactcccacctg

SEQ ID NO: 2415245 - DNA, 16 bp, Homo sapiens
cctctgcactcccacc

SEQ ID NO: 2415246 - DNA, 18 bp, Homo sapiens
cctgacacaccaggcgct

SEQ ID NO: 2415247 - DNA, 24 bp, Homo sapiens
cctggacttaagcatctggctcta

SEQ ID NO: 2415248 - DNA, 23 bp, Homo sapiens
cgctaattcaaggaatttcttaa

SEQ ID NO: 2415249 - DNA, 17 bp, Homo sapiens
cgtctggcccaccaggg

SEQ ID NO: 2415250 - DNA, 15 bp, Homo sapiens
ctaaactttttttct

SEQ ID NO: 2415251 - DNA, 23 bp, Homo sapiens
ctaagattacaaatcagaagtca

SEQ ID NO: 2415252 - DNA, 23 bp, Homo sapiens
ctaatagaataaaggcagttttc

SEQ ID NO: 2415253 - DNA, 20 bp, Homo sapiens
ctaattcaaggaatttctta

SEQ ID NO: 2415254 - DNA, 19 bp, Homo sapiens
ctaccagtatttagaagcc

SEQ ID NO: 2415255 - DNA, 17 bp, Homo sapiens
ctactaatagaataaag

SEQ ID NO: 2415256 - DNA, 16 bp, Homo sapiens
ctagatgtagtatttt

SEQ ID NO: 2415257 - DNA, 16 bp, Homo sapiens
ctcaaagaaagtgtat

SEQ ID NO: 2415258 - DNA, 13 bp, Homo sapiens
ctcacctggactt

SEQ ID NO: 2415259 - DNA, 14 bp, Homo sapiens
ctcatgggtggcac

SEQ ID NO: 2415260 - DNA, 19 bp, Homo sapiens
ctcatgggtggcactcagt

SEQ ID NO: 2415261 - DNA, 14 bp, Homo sapiens
ctcctcactgtatc

SEQ ID NO: 2415262 - DNA, 20 bp, Homo sapiens
ctctaattcacagtgctctt

SEQ ID NO: 2415263 - DNA, 18 bp, Homo sapiens
ctctccagctgactaaac

SEQ ID NO: 2415264 - DNA, 16 bp, Homo sapiens
ctctcttctctccagc

SEQ ID NO: 2415265 - DNA, 15 bp, Homo sapiens
ctctggggtgggcag

SEQ ID NO: 2415266 - DNA, 23 bp, Homo sapiens
ctctggtgagtcaccacttcagg

SEQ ID NO: 2415267 - DNA, 15 bp, Homo sapiens
ctcttctctccagct

SEQ ID NO: 2415268 - DNA, 22 bp, Homo sapiens
ctcttctctccagctgactaaa

SEQ ID NO: 2415269 - DNA, 14 bp, Homo sapiens
ctgacacaccaggc

SEQ ID NO: 2415270 - DNA, 14 bp, Homo sapiens
ctgactaaactttt

SEQ ID NO: 2415271 - DNA, 16 bp, Homo sapiens
ctgcaaggtactctgg

SEQ ID NO: 2415272 - DNA, 19 bp, Homo sapiens
ctgcaaggtactctggtga

SEQ ID NO: 2415273 - DNA, 18 bp, Homo sapiens
ctggacttaagcatctgg

SEQ ID NO: 2415274 - DNA, 23 bp, Homo sapiens
ctggacttaagcatctggctcta

SEQ ID NO: 2415275 - DNA, 20 bp, Homo sapiens
ctggcctttttcatttatct

SEQ ID NO: 2415276 - DNA, 21 bp, Homo sapiens
ctggcctttttcatttatcta

SEQ ID NO: 2415277 - DNA, 16 bp, Homo sapiens
ctggggtgggcagttt

SEQ ID NO: 2415278 - DNA, 12 bp, Homo sapiens
ctgtaccagtta

SEQ ID NO: 2415279 - DNA, 12 bp, Homo sapiens
ctgtcagctgca

SEQ ID NO: 2415280 - DNA, 18 bp, Homo sapiens
ctgtggcagagttacagt

SEQ ID NO: 2415281 - DNA, 23 bp, Homo sapiens
ctgtggcagagttacagttctgt

SEQ ID NO: 2415282 - DNA, 15 bp, Homo sapiens
ttatagttactgtgt

SEQ ID NO: 2415283 - DNA, 14 bp, Homo sapiens
ttatctataattta

SEQ ID NO: 2415284 - DNA, 17 bp, Homo sapiens
ttatctataatttacct

SEQ ID NO: 2415285 - DNA, 16 bp, Homo sapiens
ttatgcggttaatttt

SEQ ID NO: 2415286 - DNA, 17 bp, Homo sapiens
ttcaaggaatttcttaa

SEQ ID NO: 2415287 - DNA, 19 bp, Homo sapiens
ttcacgcctgaggcaatta

SEQ ID NO: 2415288 - DNA, 13 bp, Homo sapiens
ttcatgcagctgt

SEQ ID NO: 2415289 - DNA, 14 bp, Homo sapiens
ttcatgcagctgtg

SEQ ID NO: 2415290 - DNA, 18 bp, Homo sapiens
ttcatgttagttacctta

SEQ ID NO: 2415291 - DNA, 18 bp, Homo sapiens
ttcatttatctataattt

SEQ ID NO: 2415292 - DNA, 17 bp, Homo sapiens
ttcggccccatgtatct

SEQ ID NO: 2415293 - DNA, 22 bp, Homo sapiens
ttctagaaagagaaacagttgg

SEQ ID NO: 2415294 - DNA, 11 bp, Homo sapiens
ttctgtaccag

SEQ ID NO: 2415295 - DNA, 13 bp, Homo sapiens
ttctgtaccagtt

SEQ ID NO: 2415296 - DNA, 14 bp, Homo sapiens
ttctgtaccagtta

SEQ ID NO: 2415297 - DNA, 21 bp, Homo sapiens
ttctgtaccagttaatttttc

SEQ ID NO: 2415298 - DNA, 18 bp, Homo sapiens
ttctgtggtttcatgtta

SEQ ID NO: 2415299 - DNA, 16 bp, Homo sapiens
ttcttaacttcttgct

SEQ ID NO: 2415300 - DNA, 17 bp, Homo sapiens
ttcttaacttcttgctt

SEQ ID NO: 2415301 - DNA, 17 bp, Homo sapiens
ttcttgcttctttctag

SEQ ID NO: 2415302 - DNA, 19 bp, Homo sapiens
ttcttgcttctttctagaa

SEQ ID NO: 2415303 - DNA, 14 bp, Homo sapiens
ttgacactgctcta

SEQ ID NO: 2415304 - DNA, 15 bp, Homo sapiens
ttgctaccagtattt

SEQ ID NO: 2415305 - DNA, 12 bp, Homo sapiens
ttgcttctttct

SEQ ID NO: 2415306 - DNA, 17 bp, Homo sapiens
ttgcttctttctagaaa

SEQ ID NO: 2415307 - DNA, 12 bp, Homo sapiens
ttggtaactttt

SEQ ID NO: 2415308 - DNA, 12 bp, Homo sapiens
ttgtataattgg

SEQ ID NO: 2415309 - DNA, 14 bp, Homo sapiens
ttgtcactttttct

SEQ ID NO: 2415310 - DNA, 16 bp, Homo sapiens
ttgtcactttttctga

SEQ ID NO: 2415311 - DNA, 19 bp, Homo sapiens
ttgtgaattaggctgtaac

SEQ ID NO: 2415312 - DNA, 15 bp, Homo sapiens
tttacctaagattac

SEQ ID NO: 2415313 - DNA, 14 bp, Homo sapiens
tttagaagccaact

SEQ ID NO: 2415314 - DNA, 14 bp, Homo sapiens
tttatctataattt

SEQ ID NO: 2415315 - DNA, 17 bp, Homo sapiens
tttcatttatctataat

SEQ ID NO: 2415316 - DNA, 20 bp, Homo sapiens
tttcatttatctataattta

SEQ ID NO: 2415317 - DNA, 15 bp, Homo sapiens
tttctgtaccagtta

SEQ ID NO: 2415318 - DNA, 14 bp, Homo sapiens
tttcttaacttctt

SEQ ID NO: 2415319 - DNA, 17 bp, Homo sapiens
tttcttaacttcttgct

SEQ ID NO: 2415320 - DNA, 11 bp, Homo sapiens
tttgaaaatgg

SEQ ID NO: 2415321 - DNA, 15 bp, Homo sapiens
tttgaagtgctgttt

SEQ ID NO: 2415322 - DNA, 13 bp, Homo sapiens
tttgtataattgg

SEQ ID NO: 2415323 - DNA, 14 bp, Homo sapiens
tttgtcactttttc

SEQ ID NO: 2415324 - DNA, 20 bp, Homo sapiens
ttttaaattcccgttttgtc

SEQ ID NO: 2415325 - DNA, 19 bp, Homo sapiens
ttttcggccccatgtatct

SEQ ID NO: 2415326 - DNA, 21 bp, Homo sapiens
tttttccaactactaatagaa

SEQ ID NO: 2415327 - DNA, 14 bp, Homo sapiens
tttttctgtaccag

SEQ ID NO: 2415328 - DNA, 24 bp, Homo sapiens
atatatctaccccagactagatgt

SEQ ID NO: 2415329 - DNA, 15 bp, Homo sapiens
atccaggttccctcc

SEQ ID NO: 2415330 - DNA, 19 bp, Homo sapiens
atcctcaaagaaagtgtat

SEQ ID NO: 2415331 - DNA, 22 bp, Homo sapiens
atctaccccagactagatgtag

SEQ ID NO: 2415332 - DNA, 23 bp, Homo sapiens
atctataatttacctaagattac

SEQ ID NO: 2415333 - DNA, 14 bp, Homo sapiens
atcttgctaccagt

SEQ ID NO: 2415334 - DNA, 16 bp, Homo sapiens
atcttgctaccagtat

SEQ ID NO: 2415335 - DNA, 19 bp, Homo sapiens
atcttgctaccagtattta

SEQ ID NO: 2415336 - DNA, 23 bp, Homo sapiens
atcttgctaccagtatttagaag

SEQ ID NO: 2415337 - DNA, 16 bp, Homo sapiens
atggcataacctgtct

SEQ ID NO: 2415338 - DNA, 13 bp, Homo sapiens
atgtatgttacca

SEQ ID NO: 2415339 - DNA, 20 bp, Homo sapiens
atgtcctgcctattatctgt

SEQ ID NO: 2415340 - DNA, 21 bp, Homo sapiens
attaatcttagtgtatgatta

SEQ ID NO: 2415341 - DNA, 14 bp, Homo sapiens
attacaaatcagaa

SEQ ID NO: 2415342 - DNA, 21 bp, Homo sapiens
attacaaatcagaagtcatct

SEQ ID NO: 2415343 - DNA, 15 bp, Homo sapiens
attaggctgtaacta

SEQ ID NO: 2415344 - DNA, 21 bp, Homo sapiens
attaggctgtaactactttat

SEQ ID NO: 2415345 - DNA, 22 bp, Homo sapiens
attaggctgtaactactttata

SEQ ID NO: 2415346 - DNA, 20 bp, Homo sapiens
attagtgccacttaatgtat

SEQ ID NO: 2415347 - DNA, 16 bp, Homo sapiens
attcaaggaatttctt

SEQ ID NO: 2415348 - DNA, 20 bp, Homo sapiens
attcaaggaatttcttaact

SEQ ID NO: 2415349 - DNA, 19 bp, Homo sapiens
attcacagtgctcttttct

SEQ ID NO: 2415350 - DNA, 18 bp, Homo sapiens
attcccgttttgtcactt

SEQ ID NO: 2415351 - DNA, 23 bp, Homo sapiens
attcccgttttgtcactttttct

SEQ ID NO: 2415352 - DNA, 14 bp, Homo sapiens
atttacctaagatt

SEQ ID NO: 2415353 - DNA, 21 bp, Homo sapiens
atttcctaatactgtcatcct

SEQ ID NO: 2415354 - DNA, 17 bp, Homo sapiens
atttggaaataaagtca

SEQ ID NO: 2415355 - DNA, 22 bp, Homo sapiens
attttgaagtgctgtttattaa

SEQ ID NO: 2415356 - DNA, 15 bp, Homo sapiens
attttgttggcatag

SEQ ID NO: 2415357 - DNA, 13 bp, Homo sapiens
caaagaaagtgta

SEQ ID NO: 2415358 - DNA, 21 bp, Homo sapiens
caactactaatagaataaagg

SEQ ID NO: 2415359 - DNA, 12 bp, Homo sapiens
caaggaatttct

SEQ ID NO: 2415360 - DNA, 21 bp, Homo sapiens
caaggaatttcttaacttctt

SEQ ID NO: 2415361 - DNA, 23 bp, Homo sapiens
caccaggcgctaattcaaggaat

SEQ ID NO: 2415362 - DNA, 11 bp, Homo sapiens
caccagttctc

SEQ ID NO: 2415363 - DNA, 20 bp, Homo sapiens
caccagttctcatgggtggc

SEQ ID NO: 2415364 - DNA, 17 bp, Homo sapiens
cacctgacacaccaggc

SEQ ID NO: 2415365 - DNA, 23 bp, Homo sapiens
cactcccacctgacacaccaggc

SEQ ID NO: 2415366 - DNA, 18 bp, Homo sapiens
cactgctctaacagccct

SEQ ID NO: 2415367 - DNA, 12 bp, Homo sapiens
cacttaatgtat

SEQ ID NO: 2415368 - DNA, 15 bp, Homo sapiens
cacttaatgtatgtt

SEQ ID NO: 2415369 - DNA, 20 bp, Homo sapiens
cagaagtcatcttgctacca

SEQ ID NO: 2415370 - DNA, 22 bp, Homo sapiens
cagaagtcatcttgctaccagt

SEQ ID NO: 2415371 - DNA, 17 bp, Homo sapiens
cagacatccaaactaaa

SEQ ID NO: 2415372 - DNA, 22 bp, Homo sapiens
cagacatccaaactaaaaggaa

SEQ ID NO: 2415373 - DNA, 20 bp, Homo sapiens
cagactagatgtagtatttt

SEQ ID NO: 2415374 - DNA, 18 bp, Homo sapiens
cagaggagccaccagttc

SEQ ID NO: 2415375 - DNA, 19 bp, Homo sapiens
cagaggagccaccagttct

SEQ ID NO: 2415376 - DNA, 12 bp, Homo sapiens
cagagttacagt

SEQ ID NO: 2415377 - DNA, 16 bp, Homo sapiens
cagagttacagttctg

SEQ ID NO: 2415378 - DNA, 21 bp, Homo sapiens
cagatggaaaattcatttttt

SEQ ID NO: 2415379 - DNA, 17 bp, Homo sapiens
cagccctcctctgcact

SEQ ID NO: 2415380 - DNA, 18 bp, Homo sapiens
cagctgactaaacttttt

SEQ ID NO: 2415381 - DNA, 20 bp, Homo sapiens
cagctgcaaggtactctggt

SEQ ID NO: 2415382 - DNA, 21 bp, Homo sapiens
cagggtccttttgacactgct

SEQ ID NO: 2415383 - DNA, 15 bp, Homo sapiens
caggttccctcccag

SEQ ID NO: 2415384 - DNA, 17 bp, Homo sapiens
cagtctattcacagaag

SEQ ID NO: 2415385 - DNA, 17 bp, Homo sapiens
cagtctctcttctctcc

SEQ ID NO: 2415386 - DNA, 23 bp, Homo sapiens
cagtgctcttttctcctcactgt

SEQ ID NO: 2415387 - DNA, 14 bp, Homo sapiens
cagttaatttttcc

SEQ ID NO: 2415388 - DNA, 20 bp, Homo sapiens
cagttctgtggtttcatgtt

SEQ ID NO: 2415389 - DNA, 23 bp, Homo sapiens
cataacctgtctcacctggactt

SEQ ID NO: 2415390 - DNA, 20 bp, Homo sapiens
catagctctggggtgggcag

SEQ ID NO: 2415391 - DNA, 22 bp, Homo sapiens
catgtcctgcctattatctgtc

SEQ ID NO: 2415392 - DNA, 21 bp, Homo sapiens
catgttagttaccttatagtt

SEQ ID NO: 2415393 - DNA, 12 bp, Homo sapiens
catttctattaa

SEQ ID NO: 2415394 - DNA, 17 bp, Homo sapiens
ccacctgacacaccagg

SEQ ID NO: 2415395 - DNA, 18 bp, Homo sapiens
ccagactagatgtagtat

SEQ ID NO: 2415396 - DNA, 17 bp, Homo sapiens
ccagctgactaaacttt

SEQ ID NO: 2415397 - DNA, 18 bp, Homo sapiens
ccagttaatttttccaac

SEQ ID NO: 2415398 - DNA, 15 bp, Homo sapiens
ccccagactagatgt

SEQ ID NO: 2415399 - DNA, 13 bp, Homo sapiens
cccgttttgtcac

SEQ ID NO: 2415400 - DNA, 18 bp, Homo sapiens
ccgtctggcccaccaggg

SEQ ID NO: 2415401 - DNA, 14 bp, Homo sapiens
cctcaaagaaagtg

SEQ ID NO: 2415402 - DNA, 15 bp, Homo sapiens
cctgtctcacctgga

SEQ ID NO: 2415403 - DNA, 15 bp, Homo sapiens
ccttttgacactgct

SEQ ID NO: 2415404 - DNA, 18 bp, Homo sapiens
ctaaactttttttctgta

SEQ ID NO: 2415405 - DNA, 22 bp, Homo sapiens
ctaacagccctcctctgcactc

SEQ ID NO: 2415406 - DNA, 17 bp, Homo sapiens
ctaagtaaataggaatt

SEQ ID NO: 2415407 - DNA, 22 bp, Homo sapiens
ctaattcacagtgctcttttct

SEQ ID NO: 2415408 - DNA, 23 bp, Homo sapiens
ctagatgtagtattttttgtata

SEQ ID NO: 2415409 - DNA, 19 bp, Homo sapiens
ctattatctgtcagctgca

SEQ ID NO: 2415410 - DNA, 13 bp, Homo sapiens
ctcagtaccccat

SEQ ID NO: 2415411 - DNA, 17 bp, Homo sapiens
ctcagtctctcttctct

SEQ ID NO: 2415412 - DNA, 23 bp, Homo sapiens
ctcatgggtggcactcagtctct

SEQ ID NO: 2415413 - DNA, 14 bp, Homo sapiens
ctcccacctgacac

SEQ ID NO: 2415414 - DNA, 21 bp, Homo sapiens
ctcccacctgacacaccaggc

SEQ ID NO: 2415415 - DNA, 16 bp, Homo sapiens
ctcctcactgtatcca

SEQ ID NO: 2415416 - DNA, 19 bp, Homo sapiens
ctctgcactcccacctgac

SEQ ID NO: 2415417 - DNA, 23 bp, Homo sapiens
ctctgcactcccacctgacacac

SEQ ID NO: 2415418 - DNA, 19 bp, Homo sapiens
ctcttctctccagctgact

SEQ ID NO: 2415419 - DNA, 17 bp, Homo sapiens
ctgacacaccaggcgct

SEQ ID NO: 2415420 - DNA, 19 bp, Homo sapiens
ctgactaaactttttttct

SEQ ID NO: 2415421 - DNA, 18 bp, Homo sapiens
ctgataaaagatggccat

SEQ ID NO: 2415422 - DNA, 14 bp, Homo sapiens
ctgcaagcacagcc

SEQ ID NO: 2415423 - DNA, 16 bp, Homo sapiens
ctgcactcccacctga

SEQ ID NO: 2415424 - DNA, 19 bp, Homo sapiens
ctgcactcccacctgacac

SEQ ID NO: 2415425 - DNA, 17 bp, Homo sapiens
ctgcctattatctgtca

SEQ ID NO: 2415426 - DNA, 17 bp, Homo sapiens
ctgctctaacagccctc

SEQ ID NO: 2415427 - DNA, 13 bp, Homo sapiens
ctggcccaccagg

SEQ ID NO: 2415428 - DNA, 17 bp, Homo sapiens
ctggcctttttcattta

SEQ ID NO: 2415429 - DNA, 15 bp, Homo sapiens
ctggctctaattcac

SEQ ID NO: 2415430 - DNA, 14 bp, Homo sapiens
ttatagttactgtg

SEQ ID NO: 2415431 - DNA, 16 bp, Homo sapiens
ttatctgtcagctgca

SEQ ID NO: 2415432 - DNA, 19 bp, Homo sapiens
ttatgcggttaattttgaa

SEQ ID NO: 2415433 - DNA, 21 bp, Homo sapiens
ttattaacgatgtccaacccg

SEQ ID NO: 2415434 - DNA, 16 bp, Homo sapiens
ttcaaggaatttctta

SEQ ID NO: 2415435 - DNA, 22 bp, Homo sapiens
ttcatgttagttaccttatagt

SEQ ID NO: 2415436 - DNA, 19 bp, Homo sapiens
ttccctcccagaggagcca

SEQ ID NO: 2415437 - DNA, 19 bp, Homo sapiens
ttctagaaagagaaacagt

SEQ ID NO: 2415438 - DNA, 18 bp, Homo sapiens
ttctcctcactgtatcca

SEQ ID NO: 2415439 - DNA, 19 bp, Homo sapiens
ttctctccagctgactaaa

SEQ ID NO: 2415440 - DNA, 22 bp, Homo sapiens
ttctgtggtttcatgttagtta

SEQ ID NO: 2415441 - DNA, 15 bp, Homo sapiens
ttgacactgctctaa

SEQ ID NO: 2415442 - DNA, 22 bp, Homo sapiens
ttgctaccagtatttagaagcc

SEQ ID NO: 2415443 - DNA, 20 bp, Homo sapiens
ttgcttctttctagaaagag

SEQ ID NO: 2415444 - DNA, 13 bp, Homo sapiens
ttggaaataaagt

SEQ ID NO: 2415445 - DNA, 12 bp, Homo sapiens
ttggatttccta

SEQ ID NO: 2415446 - DNA, 21 bp, Homo sapiens
ttggatttcctaatactgtca

SEQ ID NO: 2415447 - DNA, 16 bp, Homo sapiens
ttggcatagctctggg

SEQ ID NO: 2415448 - DNA, 15 bp, Homo sapiens
ttggtaacttttgtg

SEQ ID NO: 2415449 - DNA, 11 bp, Homo sapiens
ttgtataattg

SEQ ID NO: 2415450 - DNA, 20 bp, Homo sapiens
ttgtataattggatttccta

SEQ ID NO: 2415451 - DNA, 21 bp, Homo sapiens
ttgtataattggatttcctaa

SEQ ID NO: 2415452 - DNA, 23 bp, Homo sapiens
ttgtgaattaggctgtaactact

SEQ ID NO: 2415453 - DNA, 16 bp, Homo sapiens
ttgttggcatagctct

SEQ ID NO: 2415454 - DNA, 22 bp, Homo sapiens
tttagaagccaactatgattat

SEQ ID NO: 2415455 - DNA, 19 bp, Homo sapiens
tttatctataatttaccta

SEQ ID NO: 2415456 - DNA, 20 bp, Homo sapiens
tttatctataatttacctaa

SEQ ID NO: 2415457 - DNA, 13 bp, Homo sapiens
tttattaatctta

SEQ ID NO: 2415458 - DNA, 19 bp, Homo sapiens
tttattaatcttagtgtat

SEQ ID NO: 2415459 - DNA, 14 bp, Homo sapiens
tttctgtaccagtt

SEQ ID NO: 2415460 - DNA, 18 bp, Homo sapiens
tttcttaacttcttgctt

SEQ ID NO: 2415461 - DNA, 20 bp, Homo sapiens
agtcagatggaaaattcatt

SEQ ID NO: 2415462 - DNA, 16 bp, Homo sapiens
agtctctcttctctcc

SEQ ID NO: 2415463 - DNA, 16 bp, Homo sapiens
agtgccacttaatgta

SEQ ID NO: 2415464 - DNA, 21 bp, Homo sapiens
agtgccacttaatgtatgtta

SEQ ID NO: 2415465 - DNA, 23 bp, Homo sapiens
agtgtatttggaaataaagtcag

SEQ ID NO: 2415466 - DNA, 15 bp, Homo sapiens
agttaatttttccaa

SEQ ID NO: 2415467 - DNA, 15 bp, Homo sapiens
agttacagttctgtg

SEQ ID NO: 2415468 - DNA, 17 bp, Homo sapiens
agttaccttatagttac

SEQ ID NO: 2415469 - DNA, 20 bp, Homo sapiens
agttaccttatagttactgt

SEQ ID NO: 2415470 - DNA, 11 bp, Homo sapiens
agttactgtgt

SEQ ID NO: 2415471 - DNA, 16 bp, Homo sapiens
agttggtaacttttgt

SEQ ID NO: 2415472 - DNA, 15 bp, Homo sapiens
ataactaacatgtcc

SEQ ID NO: 2415473 - DNA, 18 bp, Homo sapiens
ataattggatttcctaat

SEQ ID NO: 2415474 - DNA, 20 bp, Homo sapiens
atagaataaaggcagttttc

SEQ ID NO: 2415475 - DNA, 21 bp, Homo sapiens
atatctaccccagactagatg

SEQ ID NO: 2415476 - DNA, 19 bp, Homo sapiens
atcagaagtcatcttgcta

SEQ ID NO: 2415477 - DNA, 18 bp, Homo sapiens
atcatttctattaaatga

SEQ ID NO: 2415478 - DNA, 19 bp, Homo sapiens
atccaggttccctcccaga

SEQ ID NO: 2415479 - DNA, 14 bp, Homo sapiens
atctaccccagact

SEQ ID NO: 2415480 - DNA, 20 bp, Homo sapiens
atctaccccagactagatgt

SEQ ID NO: 2415481 - DNA, 13 bp, Homo sapiens
atctataatttac

SEQ ID NO: 2415482 - DNA, 13 bp, Homo sapiens
atcttagtgtatg

SEQ ID NO: 2415483 - DNA, 14 bp, Homo sapiens
atcttagtgtatga

SEQ ID NO: 2415484 - DNA, 16 bp, Homo sapiens
atcttagtgtatgatt

SEQ ID NO: 2415485 - DNA, 19 bp, Homo sapiens
atgattactggcctttttc

SEQ ID NO: 2415486 - DNA, 15 bp, Homo sapiens
atgcagctgtggcag

SEQ ID NO: 2415487 - DNA, 19 bp, Homo sapiens
atgcggttaattttgaagt

SEQ ID NO: 2415488 - DNA, 14 bp, Homo sapiens
atggagctgggcta

SEQ ID NO: 2415489 - DNA, 22 bp, Homo sapiens
atgtagtattttttgtataatt

SEQ ID NO: 2415490 - DNA, 12 bp, Homo sapiens
atgtatgttacc

SEQ ID NO: 2415491 - DNA, 14 bp, Homo sapiens
atgtatgttaccaa

SEQ ID NO: 2415492 - DNA, 16 bp, Homo sapiens
atgtccaacccgtctg

SEQ ID NO: 2415493 - DNA, 16 bp, Homo sapiens
atgtcctgcctattat

SEQ ID NO: 2415494 - DNA, 21 bp, Homo sapiens
atgtgtaaacaattttatata

SEQ ID NO: 2415495 - DNA, 20 bp, Homo sapiens
atgttagttaccttatagtt

SEQ ID NO: 2415496 - DNA, 21 bp, Homo sapiens
atgttagttaccttatagtta

SEQ ID NO: 2415497 - DNA, 15 bp, Homo sapiens
attaacgatgtccaa

SEQ ID NO: 2415498 - DNA, 19 bp, Homo sapiens
attaatcttagtgtatgat

SEQ ID NO: 2415499 - DNA, 22 bp, Homo sapiens
attaatcttagtgtatgattac

SEQ ID NO: 2415500 - DNA, 16 bp, Homo sapiens
attacaaatcagaagt

SEQ ID NO: 2415501 - DNA, 18 bp, Homo sapiens
attacaaatcagaagtca

SEQ ID NO: 2415502 - DNA, 23 bp, Homo sapiens
attacaaatcagaagtcatcttg

SEQ ID NO: 2415503 - DNA, 16 bp, Homo sapiens
attagtgccacttaat

SEQ ID NO: 2415504 - DNA, 19 bp, Homo sapiens
attagtgccacttaatgta

SEQ ID NO: 2415505 - DNA, 21 bp, Homo sapiens
attagtgccacttaatgtatg

SEQ ID NO: 2415506 - DNA, 22 bp, Homo sapiens
attagtgccacttaatgtatgt

SEQ ID NO: 2415507 - DNA, 17 bp, Homo sapiens
attcaaggaatttctta

SEQ ID NO: 2415508 - DNA, 20 bp, Homo sapiens
attcacagtgctcttttctc

SEQ ID NO: 2415509 - DNA, 21 bp, Homo sapiens
attcacagtgctcttttctcc

SEQ ID NO: 2415510 - DNA, 22 bp, Homo sapiens
attggatttcctaatactgtca

SEQ ID NO: 2415511 - DNA, 15 bp, Homo sapiens
attggtttaaagaaa

SEQ ID NO: 2415512 - DNA, 23 bp, Homo sapiens
atttagaagccaactatgattat

SEQ ID NO: 2415513 - DNA, 10 bp, Homo sapiens
atttatctat

SEQ ID NO: 2415514 - DNA, 11 bp, Homo sapiens
atttatctata

SEQ ID NO: 2415515 - DNA, 14 bp, Homo sapiens
atttcttaacttct

SEQ ID NO: 2415516 - DNA, 14 bp, Homo sapiens
attttttgtataat

SEQ ID NO: 2415517 - DNA, 15 bp, Homo sapiens
attttttgtataatt

SEQ ID NO: 2415518 - DNA, 14 bp, Homo sapiens
caaagaaagtgtat

SEQ ID NO: 2415519 - DNA, 14 bp, Homo sapiens
caaatcagaagtca

SEQ ID NO: 2415520 - DNA, 15 bp, Homo sapiens
caaatcagaagtcat

SEQ ID NO: 2415521 - DNA, 22 bp, Homo sapiens
caaatcagaagtcatcttgcta

SEQ ID NO: 2415522 - DNA, 20 bp, Homo sapiens
caacccgtctggcccaccag

SEQ ID NO: 2415523 - DNA, 22 bp, Homo sapiens
caacccgtctggcccaccaggg

SEQ ID NO: 2415524 - DNA, 15 bp, Homo sapiens
caaggaatttcttaa

SEQ ID NO: 2415525 - DNA, 23 bp, Homo sapiens
caaggaatttcttaacttcttgc

SEQ ID NO: 2415526 - DNA, 16 bp, Homo sapiens
caaggtactctggtga

SEQ ID NO: 2415527 - DNA, 17 bp, Homo sapiens
caagttcatgcagctgt

SEQ ID NO: 2415528 - DNA, 23 bp, Homo sapiens
cacagcccttatgcggttaattt

SEQ ID NO: 2415529 - DNA, 22 bp, Homo sapiens
caccagggtccttttgacactg

SEQ ID NO: 2415530 - DNA, 20 bp, Homo sapiens
cacctgacacaccaggcgct

SEQ ID NO: 2415531 - DNA, 19 bp, Homo sapiens
cactgctctaacagccctc

SEQ ID NO: 2415532 - DNA, 17 bp, Homo sapiens
cagaagtcatcttgcta

SEQ ID NO: 2415533 - DNA, 20 bp, Homo sapiens
ttaggctgtaactactttat

SEQ ID NO: 2415534 - DNA, 15 bp, Homo sapiens
ttataactaacatgt

SEQ ID NO: 2415535 - DNA, 19 bp, Homo sapiens
ttataactaacatgtcctg

SEQ ID NO: 2415536 - DNA, 19 bp, Homo sapiens
ttatagttactgtgtaatt

SEQ ID NO: 2415537 - DNA, 19 bp, Homo sapiens
ttcaaggaatttcttaact

SEQ ID NO: 2415538 - DNA, 15 bp, Homo sapiens
ttcatgcagctgtgg

SEQ ID NO: 2415539 - DNA, 13 bp, Homo sapiens
ttcatgttagtta

SEQ ID NO: 2415540 - DNA, 16 bp, Homo sapiens
ttcatgttagttacct

SEQ ID NO: 2415541 - DNA, 17 bp, Homo sapiens
ttcatttatctataatt

SEQ ID NO: 2415542 - DNA, 18 bp, Homo sapiens
ttcggccccatgtatctc

SEQ ID NO: 2415543 - DNA, 18 bp, Homo sapiens
ttctgataaaagatggcc

SEQ ID NO: 2415544 - DNA, 12 bp, Homo sapiens
ttctgtaccagt

SEQ ID NO: 2415545 - DNA, 12 bp, Homo sapiens
ttctttctagaa

SEQ ID NO: 2415546 - DNA, 13 bp, Homo sapiens
ttctttctagaaa

SEQ ID NO: 2415547 - DNA, 22 bp, Homo sapiens
ttgacactgctctaacagccct

SEQ ID NO: 2415548 - DNA, 12 bp, Homo sapiens
ttgctaccagta

SEQ ID NO: 2415549 - DNA, 20 bp, Homo sapiens
ttgctaccagtatttagaag

SEQ ID NO: 2415550 - DNA, 21 bp, Homo sapiens
ttggaaataaagtcagatgga

SEQ ID NO: 2415551 - DNA, 14 bp, Homo sapiens
ttggatttcctaat

SEQ ID NO: 2415552 - DNA, 18 bp, Homo sapiens
ttggtttaaagaaagtgt

SEQ ID NO: 2415553 - DNA, 22 bp, Homo sapiens
ttggtttaaagaaagtgtattt

SEQ ID NO: 2415554 - DNA, 23 bp, Homo sapiens
ttggtttaaagaaagtgtatttg

SEQ ID NO: 2415555 - DNA, 12 bp, Homo sapiens
tttaaagaaagt

SEQ ID NO: 2415556 - DNA, 13 bp, Homo sapiens
tttaaagaaagtg

SEQ ID NO: 2415557 - DNA, 14 bp, Homo sapiens
tttaaagaaagtgt

SEQ ID NO: 2415558 - DNA, 17 bp, Homo sapiens
tttactccgtaacagat

SEQ ID NO: 2415559 - DNA, 19 bp, Homo sapiens
tttcatgttagttacctta

SEQ ID NO: 2415560 - DNA, 18 bp, Homo sapiens
gctgcaagcacagccctt

SEQ ID NO: 2415561 - DNA, 16 bp, Homo sapiens
gctgtttattaatctt

SEQ ID NO: 2415562 - DNA, 19 bp, Homo sapiens
gctttactccgtaacagat

SEQ ID NO: 2415563 - DNA, 14 bp, Homo sapiens
ggaaaattcatttt

SEQ ID NO: 2415564 - DNA, 22 bp, Homo sapiens
ggaatttcttaacttcttgctt

SEQ ID NO: 2415565 - DNA, 23 bp, Homo sapiens
ggacttaagcatctggctctaat

SEQ ID NO: 2415566 - DNA, 10 bp, Homo sapiens
ggcagttttt

SEQ ID NO: 2415567 - DNA, 15 bp, Homo sapiens
ggcatagctctgggg

SEQ ID NO: 2415568 - DNA, 19 bp, Homo sapiens
ggctctaattcacagtgct

SEQ ID NO: 2415569 - DNA, 22 bp, Homo sapiens
gggtccttttgacactgctcta

SEQ ID NO: 2415570 - DNA, 18 bp, Homo sapiens
ggtccttttgacactgct

SEQ ID NO: 2415571 - DNA, 14 bp, Homo sapiens
gtaaataggaattg

SEQ ID NO: 2415572 - DNA, 14 bp, Homo sapiens
gtaactactttata

SEQ ID NO: 2415573 - DNA, 21 bp, Homo sapiens
gtaattagtgccacttaatgt

SEQ ID NO: 2415574 - DNA, 15 bp, Homo sapiens
gtagtattttttgta

SEQ ID NO: 2415575 - DNA, 19 bp, Homo sapiens
gtagtattttttgtataat

SEQ ID NO: 2415576 - DNA, 23 bp, Homo sapiens
gtagtattttttgtataattgga

SEQ ID NO: 2415577 - DNA, 20 bp, Homo sapiens
gtatccaggttccctcccag

SEQ ID NO: 2415578 - DNA, 21 bp, Homo sapiens
gtatgattactggcctttttc

SEQ ID NO: 2415579 - DNA, 14 bp, Homo sapiens
gtatttagaagcca

SEQ ID NO: 2415580 - DNA, 19 bp, Homo sapiens
gtatttggaaataaagtca

SEQ ID NO: 2415581 - DNA, 21 bp, Homo sapiens
gtatttggaaataaagtcaga

SEQ ID NO: 2415582 - DNA, 14 bp, Homo sapiens
gtcactttttctga

SEQ ID NO: 2415583 - DNA, 18 bp, Homo sapiens
gtcatcttgctaccagta

SEQ ID NO: 2415584 - DNA, 19 bp, Homo sapiens
gtccttttgacactgctct

SEQ ID NO: 2415585 - DNA, 23 bp, Homo sapiens
gtctctcttctctccagctgact

SEQ ID NO: 2415586 - DNA, 18 bp, Homo sapiens
gtgaattaggctgtaact

SEQ ID NO: 2415587 - DNA, 14 bp, Homo sapiens
gtgagtcaccactt

SEQ ID NO: 2415588 - DNA, 14 bp, Homo sapiens
gtgctcttttctcc

SEQ ID NO: 2415589 - DNA, 16 bp, Homo sapiens
gtgctcttttctcctc

SEQ ID NO: 2415590 - DNA, 15 bp, Homo sapiens
gtggcagagttacag

SEQ ID NO: 2415591 - DNA, 21 bp, Homo sapiens
gtgtatttggaaataaagtca

SEQ ID NO: 2415592 - DNA, 20 bp, Homo sapiens
gttaatttttccaactacta

SEQ ID NO: 2415593 - DNA, 20 bp, Homo sapiens
gttaccttatagttactgtg

SEQ ID NO: 2415594 - DNA, 15 bp, Homo sapiens
gttcatgcagctgtg

SEQ ID NO: 2415595 - DNA, 19 bp, Homo sapiens
gttctgtggtttcatgtta

SEQ ID NO: 2415596 - DNA, 20 bp, Homo sapiens
gtttattaatcttagtgtat

SEQ ID NO: 2415597 - DNA, 21 bp, Homo sapiens
gtttattaatcttagtgtatg

SEQ ID NO: 2415598 - DNA, 23 bp, Homo sapiens
gtttattaatcttagtgtatgat

SEQ ID NO: 2415599 - DNA, 17 bp, Homo sapiens
gtttcatgttagttacc

SEQ ID NO: 2415600 - DNA, 18 bp, Homo sapiens
taaactttttttctgtac

SEQ ID NO: 2415601 - DNA, 14 bp, Homo sapiens
taaagaaagtgtat

SEQ ID NO: 2415602 - DNA, 17 bp, Homo sapiens
taaagaaagtgtatttg

SEQ ID NO: 2415603 - DNA, 23 bp, Homo sapiens
taaagaaagtgtatttggaaata

SEQ ID NO: 2415604 - DNA, 13 bp, Homo sapiens
taaagtcagatgg

SEQ ID NO: 2415605 - DNA, 15 bp, Homo sapiens
taaagtcagatggaa

SEQ ID NO: 2415606 - DNA, 14 bp, Homo sapiens
taaatatatctacc

SEQ ID NO: 2415607 - DNA, 17 bp, Homo sapiens
taacagccctcctctgc

SEQ ID NO: 2415608 - DNA, 13 bp, Homo sapiens
taactactttata

SEQ ID NO: 2415609 - DNA, 13 bp, Homo sapiens
taacttcttgctt

SEQ ID NO: 2415610 - DNA, 15 bp, Homo sapiens
taacttcttgcttct

SEQ ID NO: 2415611 - DNA, 19 bp, Homo sapiens
taacttcttgcttctttct

SEQ ID NO: 2415612 - DNA, 22 bp, Homo sapiens
taacttttgtgaattaggctgt

SEQ ID NO: 2415613 - DNA, 22 bp, Homo sapiens
taagattacaaatcagaagtca

SEQ ID NO: 2415614 - DNA, 20 bp, Homo sapiens
taatagaataaaggcagttt

SEQ ID NO: 2415615 - DNA, 22 bp, Homo sapiens
taatagaataaaggcagttttc

SEQ ID NO: 2415616 - DNA, 18 bp, Homo sapiens
taatcttagtgtatgatt

SEQ ID NO: 2415617 - DNA, 17 bp, Homo sapiens
taatgtatgttaccaaa

SEQ ID NO: 2415618 - DNA, 14 bp, Homo sapiens
taattagtgccact

SEQ ID NO: 2415619 - DNA, 20 bp, Homo sapiens
taattcaaggaatttcttaa

SEQ ID NO: 2415620 - DNA, 14 bp, Homo sapiens
taattcacagtgct

SEQ ID NO: 2415621 - DNA, 21 bp, Homo sapiens
taatttacctaagattacaaa

SEQ ID NO: 2415622 - DNA, 22 bp, Homo sapiens
taatttacctaagattacaaat

SEQ ID NO: 2415623 - DNA, 22 bp, Homo sapiens
taattttgaagtgctgtttatt

SEQ ID NO: 2415624 - DNA, 16 bp, Homo sapiens
tacaaatcagaagtca

SEQ ID NO: 2415625 - DNA, 17 bp, Homo sapiens
tacaaatcagaagtcat

SEQ ID NO: 2415626 - DNA, 19 bp, Homo sapiens
tacaaatcagaagtcatct

SEQ ID NO: 2415627 - DNA, 14 bp, Homo sapiens
tacagttctgtggt

SEQ ID NO: 2415628 - DNA, 15 bp, Homo sapiens
tacagttctgtggtt

SEQ ID NO: 2415629 - DNA, 15 bp, Homo sapiens
taccagtatttagaa

SEQ ID NO: 2415630 - DNA, 22 bp, Homo sapiens
taccccagactagatgtagtat

SEQ ID NO: 2415631 - DNA, 13 bp, Homo sapiens
tactgtgtaatta

SEQ ID NO: 2415632 - DNA, 19 bp, Homo sapiens
taggctgtaactactttat

SEQ ID NO: 2415633 - DNA, 19 bp, Homo sapiens
aaacagttggtaacttttg

SEQ ID NO: 2415634 - DNA, 15 bp, Homo sapiens
aaactttttttctgt

SEQ ID NO: 2415635 - DNA, 13 bp, Homo sapiens
aaagaaagtgtat

SEQ ID NO: 2415636 - DNA, 14 bp, Homo sapiens
aaaggcagttttct

SEQ ID NO: 2415637 - DNA, 15 bp, Homo sapiens
aaagtgtatttggaa

SEQ ID NO: 2415638 - DNA, 18 bp, Homo sapiens
aaatcagaagtcatcttg

SEQ ID NO: 2415639 - DNA, 21 bp, Homo sapiens
aaatcagaagtcatcttgcta

SEQ ID NO: 2415640 - DNA, 15 bp, Homo sapiens
aactaacatgtcctg

SEQ ID NO: 2415641 - DNA, 15 bp, Homo sapiens
aactactttataact

SEQ ID NO: 2415642 - DNA, 16 bp, Homo sapiens
aactatgattattaac

SEQ ID NO: 2415643 - DNA, 22 bp, Homo sapiens
aacttcttgcttctttctagaa

SEQ ID NO: 2415644 - DNA, 16 bp, Homo sapiens
aacttttctaacagaa

SEQ ID NO: 2415645 - DNA, 13 bp, Homo sapiens
aacttttgtgaat

SEQ ID NO: 2415646 - DNA, 19 bp, Homo sapiens
aacttttgtgaattaggct

SEQ ID NO: 2415647 - DNA, 21 bp, Homo sapiens
aactttttttctgtaccagtt

SEQ ID NO: 2415648 - DNA, 13 bp, Homo sapiens
aagcatctggctc

SEQ ID NO: 2415649 - DNA, 20 bp, Homo sapiens
aagtcagatggaaaattcat

SEQ ID NO: 2415650 - DNA, 15 bp, Homo sapiens
aataaaggcagtttt

SEQ ID NO: 2415651 - DNA, 16 bp, Homo sapiens
aataaaggcagttttc

SEQ ID NO: 2415652 - DNA, 23 bp, Homo sapiens
aataaatatatctaccccagact

SEQ ID NO: 2415653 - DNA, 15 bp, Homo sapiens
aatagaataaaggca

SEQ ID NO: 2415654 - DNA, 16 bp, Homo sapiens
aataggaattggtttc

SEQ ID NO: 2415655 - DNA, 20 bp, Homo sapiens
aatcagaagtcatcttgcta

SEQ ID NO: 2415656 - DNA, 21 bp, Homo sapiens
aatcttagtgtatgattactg

SEQ ID NO: 2415657 - DNA, 15 bp, Homo sapiens
aattaggctgtaact

SEQ ID NO: 2415658 - DNA, 17 bp, Homo sapiens
aattaggctgtaactac

SEQ ID NO: 2415659 - DNA, 17 bp, Homo sapiens
aattagtgccacttaat

SEQ ID NO: 2415660 - DNA, 20 bp, Homo sapiens
aattagtgccacttaatgta

SEQ ID NO: 2415661 - DNA, 23 bp, Homo sapiens
aattcaaggaatttcttaacttc

SEQ ID NO: 2415662 - DNA, 20 bp, Homo sapiens
aattcacagtgctcttttct

SEQ ID NO: 2415663 - DNA, 20 bp, Homo sapiens
acaaatcagaagtcatcttg

SEQ ID NO: 2415664 - DNA, 14 bp, Homo sapiens
acacaccaggcgct

SEQ ID NO: 2415665 - DNA, 17 bp, Homo sapiens
acactgctctaacagcc

SEQ ID NO: 2415666 - DNA, 19 bp, Homo sapiens
acactgctctaacagccct

SEQ ID NO: 2415667 - DNA, 23 bp, Homo sapiens
acagcccttatgcggttaatttt

SEQ ID NO: 2415668 - DNA, 15 bp, Homo sapiens
acagtgctcttttct

SEQ ID NO: 2415669 - DNA, 17 bp, Homo sapiens
acagtgctcttttctcc

SEQ ID NO: 2415670 - DNA, 14 bp, Homo sapiens
acagttggtaactt

SEQ ID NO: 2415671 - DNA, 24 bp, Homo sapiens
acagttggtaacttttgtgaatta

SEQ ID NO: 2415672 - DNA, 14 bp, Homo sapiens
accagttaattttt

SEQ ID NO: 2415673 - DNA, 21 bp, Homo sapiens
acctaagattacaaatcagaa

SEQ ID NO: 2415674 - DNA, 19 bp, Homo sapiens
acctgacacaccaggcgct

SEQ ID NO: 2415675 - DNA, 12 bp, Homo sapiens
accttatagtta

SEQ ID NO: 2415676 - DNA, 14 bp, Homo sapiens
accttatagttact

SEQ ID NO: 2415677 - DNA, 18 bp, Homo sapiens
accttatagttactgtgt

SEQ ID NO: 2415678 - DNA, 22 bp, Homo sapiens
accttatagttactgtgtaatt

SEQ ID NO: 2415679 - DNA, 18 bp, Homo sapiens
actaaactttttttctgt

SEQ ID NO: 2415680 - DNA, 20 bp, Homo sapiens
actaatagaataaaggcagt

SEQ ID NO: 2415681 - DNA, 12 bp, Homo sapiens
actagatgtagt

SEQ ID NO: 2415682 - DNA, 16 bp, Homo sapiens
actcccacctgacaca

SEQ ID NO: 2415683 - DNA, 18 bp, Homo sapiens
actgctctaacagccctc

SEQ ID NO: 2415684 - DNA, 18 bp, Homo sapiens
actggcctttttcattta

SEQ ID NO: 2415685 - DNA, 21 bp, Homo sapiens
actgtcatcctcaaagaaagt

SEQ ID NO: 2415686 - DNA, 16 bp, Homo sapiens
acttaatgtatgttac

SEQ ID NO: 2415687 - DNA, 18 bp, Homo sapiens
acttcttgcttctttcta

SEQ ID NO: 2415688 - DNA, 16 bp, Homo sapiens
actttataactaacat

SEQ ID NO: 2415689 - DNA, 18 bp, Homo sapiens
actttataactaacatgt

SEQ ID NO: 2415690 - DNA, 11 bp, Homo sapiens
actttttctga

SEQ ID NO: 2415691 - DNA, 21 bp, Homo sapiens
agaaacagttggtaacttttg

SEQ ID NO: 2415692 - DNA, 13 bp, Homo sapiens
agaaagtgtattt

SEQ ID NO: 2415693 - DNA, 13 bp, Homo sapiens
agactagatgtag

SEQ ID NO: 2415694 - DNA, 16 bp, Homo sapiens
agagaaacagttggta

SEQ ID NO: 2415695 - DNA, 17 bp, Homo sapiens
agagttacagttctgtg

SEQ ID NO: 2415696 - DNA, 22 bp, Homo sapiens
agagttacagttctgtggtttc

SEQ ID NO: 2415697 - DNA, 21 bp, Homo sapiens
agatggcataacctgtctcac

SEQ ID NO: 2415698 - DNA, 14 bp, Homo sapiens
agccaccagttctc

SEQ ID NO: 2415699 - DNA, 21 bp, Homo sapiens
agcccaagttcatgcagctgt

SEQ ID NO: 2415700 - DNA, 14 bp, Homo sapiens
agctctggggtggg

SEQ ID NO: 2415701 - DNA, 20 bp, Homo sapiens
agctctggggtgggcagttt

SEQ ID NO: 2415702 - DNA, 21 bp, Homo sapiens
agctgcaaggtactctggtga

SEQ ID NO: 2415703 - DNA, 18 bp, Homo sapiens
agctgtggcagagttaca

SEQ ID NO: 2415704 - DNA, 21 bp, Homo sapiens
agctgtggcagagttacagtt

SEQ ID NO: 2415705 - DNA, 15 bp, Homo sapiens
aggaatttcttaact

SEQ ID NO: 2415706 - DNA, 17 bp, Homo sapiens
aggagccaccagttctc

SEQ ID NO: 2415707 - DNA, 13 bp, Homo sapiens
aggcagttttcta

SEQ ID NO: 2415708 - DNA, 12 bp, Homo sapiens
aggctgtaacta

SEQ ID NO: 2415709 - DNA, 15 bp, Homo sapiens
aggctgtaactactt

SEQ ID NO: 2415710 - DNA, 15 bp, Homo sapiens
agtatttagaagcca

SEQ ID NO: 2415711 - DNA, 13 bp, Homo sapiens
agtattttttgta

SEQ ID NO: 2415712 - DNA, 22 bp, Homo sapiens
agtattttttgtataattggat

SEQ ID NO: 2415713 - DNA, 23 bp, Homo sapiens
agtcagatggaaaattcattttt

SEQ ID NO: 2415714 - DNA, 13 bp, Homo sapiens
agtcatccagtct

SEQ ID NO: 2415715 - DNA, 11 bp, Homo sapiens
agtcatcttgc

SEQ ID NO: 2415716 - DNA, 13 bp, Homo sapiens
agtcatcttgcta

SEQ ID NO: 2415717 - DNA, 19 bp, Homo sapiens
agtcatcttgctaccagta

SEQ ID NO: 2415718 - DNA, 17 bp, Homo sapiens
agtgctcttttctcctc

SEQ ID NO: 2415719 - DNA, 15 bp, Homo sapiens
agtgtatgattactg

SEQ ID NO: 2415720 - DNA, 21 bp, Homo sapiens
agttaccttatagttactgtg

SEQ ID NO: 2415721 - DNA, 16 bp, Homo sapiens
agttactgtgtaatta

SEQ ID NO: 2415722 - DNA, 23 bp, Homo sapiens
agttctgtggtttcatgttagtt

SEQ ID NO: 2415723 - DNA, 15 bp, Homo sapiens
agttggtaacttttg

SEQ ID NO: 2415724 - DNA, 16 bp, Homo sapiens
ataaaggcagttttct

SEQ ID NO: 2415725 - DNA, 17 bp, Homo sapiens
ataattggatttcctaa

SEQ ID NO: 2415726 - DNA, 20 bp, Homo sapiens
ataattggatttcctaatac

SEQ ID NO: 2415727 - DNA, 13 bp, Homo sapiens
ataatttacctaa

SEQ ID NO: 2415728 - DNA, 17 bp, Homo sapiens
atagaataaaggcagtt

SEQ ID NO: 2415729 - DNA, 12 bp, Homo sapiens
atagctctgggg

SEQ ID NO: 2415730 - DNA, 13 bp, Homo sapiens
atagctctggggt

SEQ ID NO: 2415731 - DNA, 14 bp, Homo sapiens
atagttactgtgta

SEQ ID NO: 2415732 - DNA, 17 bp, Homo sapiens
tgtttattaatcttagt

SEQ ID NO: 2415733 - DNA, 14 bp, Homo sapiens
ttaacgatgtccaa

SEQ ID NO: 2415734 - DNA, 14 bp, Homo sapiens
ttaatcttagtgta

SEQ ID NO: 2415735 - DNA, 16 bp, Homo sapiens
ttaatcttagtgtatg

SEQ ID NO: 2415736 - DNA, 21 bp, Homo sapiens
ttaatcttagtgtatgattac

SEQ ID NO: 2415737 - DNA, 19 bp, Homo sapiens
ttaattttgaagtgctgtt

SEQ ID NO: 2415738 - DNA, 23 bp, Homo sapiens
ttaattttgaagtgctgtttatt

SEQ ID NO: 2415739 - DNA, 13 bp, Homo sapiens
ttaatttttccaa

SEQ ID NO: 2415740 - DNA, 17 bp, Homo sapiens
ttacaaatcagaagtca

SEQ ID NO: 2415741 - DNA, 13 bp, Homo sapiens
ttacagttctgtg

SEQ ID NO: 2415742 - DNA, 20 bp, Homo sapiens
ttactggcctttttcattta

SEQ ID NO: 2415743 - DNA, 16 bp, Homo sapiens
ttactgtgtaattagt

SEQ ID NO: 2415744 - DNA, 18 bp, Homo sapiens
ttagtgtatgattactgg

SEQ ID NO: 2415745 - DNA, 13 bp, Homo sapiens
ttagttaccttat

SEQ ID NO: 2415746 - DNA, 16 bp, Homo sapiens
ttagttaccttatagt

SEQ ID NO: 2415747 - DNA, 18 bp, Homo sapiens
ttagttaccttatagtta

SEQ ID NO: 2415748 - DNA, 21 bp, Homo sapiens
ttagttaccttatagttactg

SEQ ID NO: 2415749 - DNA, 22 bp, Homo sapiens
ttagttaccttatagttactgt

SEQ ID NO: 2415750 - DNA, 15 bp, Homo sapiens
ttatctataatttac

SEQ ID NO: 2415751 - DNA, 22 bp, Homo sapiens
ttatctataatttacctaagat

SEQ ID NO: 2415752 - DNA, 17 bp, Homo sapiens
ttattaatcttagtgta

SEQ ID NO: 2415753 - DNA, 15 bp, Homo sapiens
ttcacagtgctcttt

SEQ ID NO: 2415754 - DNA, 18 bp, Homo sapiens
ttccaactactaatagaa

SEQ ID NO: 2415755 - DNA, 12 bp, Homo sapiens
ttctctccagct

SEQ ID NO: 2415756 - DNA, 19 bp, Homo sapiens
ttctgataaaagatggcca

SEQ ID NO: 2415757 - DNA, 13 bp, Homo sapiens
ttcttaacttctt

SEQ ID NO: 2415758 - DNA, 16 bp, Homo sapiens
ttgacactgctctaac

SEQ ID NO: 2415759 - DNA, 23 bp, Homo sapiens
ttgacactgctctaacagccctc

SEQ ID NO: 2415760 - DNA, 16 bp, Homo sapiens
ttgctaccagtattta

SEQ ID NO: 2415761 - DNA, 23 bp, Homo sapiens
ttgctaccagtatttagaagcca

SEQ ID NO: 2415762 - DNA, 20 bp, Homo sapiens
ttgctgcaagcacagccctt

SEQ ID NO: 2415763 - DNA, 22 bp, Homo sapiens
ttggaagatggcataacctgtc

SEQ ID NO: 2415764 - DNA, 14 bp, Homo sapiens
ttggtaacttttgt

SEQ ID NO: 2415765 - DNA, 17 bp, Homo sapiens
ttggtttaaagaaagtg

SEQ ID NO: 2415766 - DNA, 18 bp, Homo sapiens
ttgtgaattaggctgtaa

SEQ ID NO: 2415767 - DNA, 16 bp, Homo sapiens
tttaaagaaagtgtat

SEQ ID NO: 2415768 - DNA, 14 bp, Homo sapiens
tttataactaacat

SEQ ID NO: 2415769 - DNA, 20 bp, Homo sapiens
tttcacgcctgaggcaatta

SEQ ID NO: 2415770 - DNA, 12 bp, Homo sapiens
tttccaactact

SEQ ID NO: 2415771 - DNA, 19 bp, Homo sapiens
tttccaactactaatagaa

SEQ ID NO: 2415772 - DNA, 13 bp, Homo sapiens
tttcttaacttct

SEQ ID NO: 2415773 - DNA, 21 bp, Homo sapiens
tttcttaacttcttgcttctt

SEQ ID NO: 2415774 - DNA, 16 bp, Homo sapiens
tttgaagtgctgttta

SEQ ID NO: 2415775 - DNA, 15 bp, Homo sapiens
tttgacactgctcta

SEQ ID NO: 2415776 - DNA, 15 bp, Homo sapiens
tttgtgaattaggct

SEQ ID NO: 2415777 - DNA, 18 bp, Homo sapiens
ttttccaactactaatag

SEQ ID NO: 2415778 - DNA, 21 bp, Homo sapiens
ttttctcctcactgtatccag

SEQ ID NO: 2415779 - DNA, 14 bp, Homo sapiens
ttttgtataattgg

SEQ ID NO: 2415780 - DNA, 13 bp, Homo sapiens
ttttgttggcata

SEQ ID NO: 2415781 - DNA, 21 bp, Homo sapiens
ttttgttggcatagctctggg

SEQ ID NO: 2415782 - DNA, 23 bp, Homo sapiens
tttttccaactactaatagaata

SEQ ID NO: 2415783 - DNA, 13 bp, Homo sapiens
tttttctgataaa

SEQ ID NO: 2415784 - DNA, 17 bp, Homo sapiens
accagaaaagcccaagt

SEQ ID NO: 2415785 - DNA, 19 bp, Homo sapiens
accagtatttagaagccaa

SEQ ID NO: 2415786 - DNA, 12 bp, Homo sapiens
accagttaattt

SEQ ID NO: 2415787 - DNA, 16 bp, Homo sapiens
accagttaatttttcc

SEQ ID NO: 2415788 - DNA, 21 bp, Homo sapiens
accagttctcatgggtggcac

SEQ ID NO: 2415789 - DNA, 22 bp, Homo sapiens
acctggacttaagcatctggct

SEQ ID NO: 2415790 - DNA, 20 bp, Homo sapiens
accttatagttactgtgtaa

SEQ ID NO: 2415791 - DNA, 22 bp, Homo sapiens
accttgctgcaagcacagccct

SEQ ID NO: 2415792 - DNA, 23 bp, Homo sapiens
accttgctgcaagcacagccctt

SEQ ID NO: 2415793 - DNA, 15 bp, Homo sapiens
acgcctgaggcaatt

SEQ ID NO: 2415794 - DNA, 19 bp, Homo sapiens
acgcctgaggcaattagac

SEQ ID NO: 2415795 - DNA, 19 bp, Homo sapiens
actaaactttttttctgta

SEQ ID NO: 2415796 - DNA, 20 bp, Homo sapiens
actaaactttttttctgtac

SEQ ID NO: 2415797 - DNA, 19 bp, Homo sapiens
actactaatagaataaagg

SEQ ID NO: 2415798 - DNA, 12 bp, Homo sapiens
actactttataa

SEQ ID NO: 2415799 - DNA, 16 bp, Homo sapiens
actagatgtagtattt

SEQ ID NO: 2415800 - DNA, 17 bp, Homo sapiens
actagatgtagtatttt

SEQ ID NO: 2415801 - DNA, 14 bp, Homo sapiens
actcccacctgaca

SEQ ID NO: 2415802 - DNA, 13 bp, Homo sapiens
actgtgtaattag

SEQ ID NO: 2415803 - DNA, 13 bp, Homo sapiens
acttaatgtatgt

SEQ ID NO: 2415804 - DNA, 18 bp, Homo sapiens
agaagccaactatgatta

SEQ ID NO: 2415805 - DNA, 15 bp, Homo sapiens
agaagtcatcttgct

SEQ ID NO: 2415806 - DNA, 14 bp, Homo sapiens
agaataaaggcagt

SEQ ID NO: 2415807 - DNA, 15 bp, Homo sapiens
agaataaaggcagtt

SEQ ID NO: 2415808 - DNA, 13 bp, Homo sapiens
agacactttggaa

SEQ ID NO: 2415809 - DNA, 12 bp, Homo sapiens
agactagatgta

SEQ ID NO: 2415810 - DNA, 19 bp, Homo sapiens
agactagatgtagtatttt

SEQ ID NO: 2415811 - DNA, 13 bp, Homo sapiens
agagaaacagttg

SEQ ID NO: 2415812 - DNA, 11 bp, Homo sapiens
agagttacagt

SEQ ID NO: 2415813 - DNA, 20 bp, Homo sapiens
agattacaaatcagaagtca

SEQ ID NO: 2415814 - DNA, 18 bp, Homo sapiens
agcatctggctctaattc

SEQ ID NO: 2415815 - DNA, 17 bp, Homo sapiens
agccaactatgattatt

SEQ ID NO: 2415816 - DNA, 20 bp, Homo sapiens
agccaactatgattattaac

SEQ ID NO: 2415817 - DNA, 12 bp, Homo sapiens
agccaccagttc

SEQ ID NO: 2415818 - DNA, 19 bp, Homo sapiens
agctctggggtgggcagtt

SEQ ID NO: 2415819 - DNA, 22 bp, Homo sapiens
agctgtggcagagttacagttc

SEQ ID NO: 2415820 - DNA, 14 bp, Homo sapiens
aggagccaccagtt

SEQ ID NO: 2415821 - DNA, 14 bp, Homo sapiens
aggcagttttctaa

SEQ ID NO: 2415822 - DNA, 17 bp, Homo sapiens
agggtccttttgacact

SEQ ID NO: 2415823 - DNA, 14 bp, Homo sapiens
aggttccctcccag

SEQ ID NO: 2415824 - DNA, 20 bp, Homo sapiens
agtattttttgtataattgg

SEQ ID NO: 2415825 - DNA, 22 bp, Homo sapiens
agtcagatggaaaattcatttt

SEQ ID NO: 2415826 - DNA, 21 bp, Homo sapiens
agtctctcttctctccagctg

SEQ ID NO: 2415827 - DNA, 23 bp, Homo sapiens
agtctctcttctctccagctgac

SEQ ID NO: 2415828 - DNA, 14 bp, Homo sapiens
agtgccacttaatg

SEQ ID NO: 2415829 - DNA, 17 bp, Homo sapiens
agtgccacttaatgtat

SEQ ID NO: 2415830 - DNA, 18 bp, Homo sapiens
agtgccacttaatgtatg

SEQ ID NO: 2415831 - DNA, 14 bp, Homo sapiens
agtgctcttttctc

SEQ ID NO: 2415832 - DNA, 20 bp, Homo sapiens
agtgctgtttattaatctta

SEQ ID NO: 2415833 - DNA, 21 bp, Homo sapiens
agtgctgtttattaatcttag

SEQ ID NO: 2415834 - DNA, 22 bp, Homo sapiens
agtgctgtttattaatcttagt

SEQ ID NO: 2415835 - DNA, 17 bp, Homo sapiens
agttaatttttccaact

SEQ ID NO: 2415836 - DNA, 23 bp, Homo sapiens
agttaatttttccaactactaat

SEQ ID NO: 2415837 - DNA, 13 bp, Homo sapiens
agttacagttctg

SEQ ID NO: 2415838 - DNA, 22 bp, Homo sapiens
agttaccttatagttactgtgt

SEQ ID NO: 2415839 - DNA, 15 bp, Homo sapiens
agttactgtgtaatt

SEQ ID NO: 2415840 - DNA, 18 bp, Homo sapiens
agttactgtgtaattagt

SEQ ID NO: 2415841 - DNA, 19 bp, Homo sapiens
agttctgtggtttcatgtt

SEQ ID NO: 2415842 - DNA, 22 bp, Homo sapiens
agttctgtggtttcatgttagt

SEQ ID NO: 2415843 - DNA, 20 bp, Homo sapiens
agttggtaacttttgtgaat

SEQ ID NO: 2415844 - DNA, 22 bp, Homo sapiens
agttttttgaaaatgggctcaa

SEQ ID NO: 2415845 - DNA, 17 bp, Homo sapiens
ataaaggcagttttcta

SEQ ID NO: 2415846 - DNA, 18 bp, Homo sapiens
ataaaggcagttttctaa

SEQ ID NO: 2415847 - DNA, 13 bp, Homo sapiens
ataaatatatcta

SEQ ID NO: 2415848 - DNA, 21 bp, Homo sapiens
ataaatatatctaccccagac

SEQ ID NO: 2415849 - DNA, 22 bp, Homo sapiens
ataacctgtctcacctggactt

SEQ ID NO: 2415850 - DNA, 16 bp, Homo sapiens
ataattggatttccta

SEQ ID NO: 2415851 - DNA, 16 bp, Homo sapiens
ataatttacctaagat

SEQ ID NO: 2415852 - DNA, 23 bp, Homo sapiens
ataatttacctaagattacaaat

SEQ ID NO: 2415853 - DNA, 12 bp, Homo sapiens
atagaataaagg

SEQ ID NO: 2415854 - DNA, 18 bp, Homo sapiens
atagaataaaggcagttt

SEQ ID NO: 2415855 - DNA, 22 bp, Homo sapiens
atagaataaaggcagttttcta

SEQ ID NO: 2415856 - DNA, 19 bp, Homo sapiens
atagctctggggtgggcag

SEQ ID NO: 2415857 - DNA, 20 bp, Homo sapiens
atagttactgtgtaattagt

SEQ ID NO: 2415858 - DNA, 23 bp, Homo sapiens
atatctaccccagactagatgta

SEQ ID NO: 2415859 - DNA, 21 bp, Homo sapiens
atcatttctattaaatgagca

SEQ ID NO: 2415860 - DNA, 18 bp, Homo sapiens
atcctcaaagaaagtgta

SEQ ID NO: 2415861 - DNA, 21 bp, Homo sapiens
atcctcaaagaaagtgtattg

SEQ ID NO: 2415862 - DNA, 22 bp, Homo sapiens
atgattactggcctttttcatt

SEQ ID NO: 2415863 - DNA, 12 bp, Homo sapiens
atgtagtatttt

SEQ ID NO: 2415864 - DNA, 21 bp, Homo sapiens
atgtagtattttttgtataat

SEQ ID NO: 2415865 - DNA, 23 bp, Homo sapiens
atgtagtattttttgtataattg

SEQ ID NO: 2415866 - DNA, 21 bp, Homo sapiens
atgtcctgcctattatctgtc

SEQ ID NO: 2415867 - DNA, 22 bp, Homo sapiens
atgtcctgcctattatctgtca

SEQ ID NO: 2415868 - DNA, 23 bp, Homo sapiens
atgttagttaccttatagttact

SEQ ID NO: 2415869 - DNA, 16 bp, Homo sapiens
attaatcttagtgtat

SEQ ID NO: 2415870 - DNA, 17 bp, Homo sapiens
attaatcttagtgtatg

SEQ ID NO: 2415871 - DNA, 20 bp, Homo sapiens
attaatcttagtgtatgatt

SEQ ID NO: 2415872 - DNA, 19 bp, Homo sapiens
attacaaatcagaagtcat

SEQ ID NO: 2415873 - DNA, 17 bp, Homo sapiens
attactggcctttttca

SEQ ID NO: 2415874 - DNA, 21 bp, Homo sapiens
attactggcctttttcattta

SEQ ID NO: 2415875 - DNA, 22 bp, Homo sapiens
attactggcctttttcatttat

SEQ ID NO: 2415876 - DNA, 18 bp, Homo sapiens
attagacactttggaaga

SEQ ID NO: 2415877 - DNA, 14 bp, Homo sapiens
attaggctgtaact

SEQ ID NO: 2415878 - DNA, 18 bp, Homo sapiens
attagtgccacttaatgt

SEQ ID NO: 2415879 - DNA, 18 bp, Homo sapiens
attcaaggaatttcttaa

SEQ ID NO: 2415880 - DNA, 19 bp, Homo sapiens
attcaaggaatttcttaac

SEQ ID NO: 2415881 - DNA, 16 bp, Homo sapiens
attcccgttttgtcac

SEQ ID NO: 2415882 - DNA, 15 bp, Homo sapiens
attggatttcctaat

SEQ ID NO: 2415883 - DNA, 17 bp, Homo sapiens
attggtttaaagaaagt

SEQ ID NO: 2415884 - DNA, 18 bp, Homo sapiens
attggtttaaagaaagtg

SEQ ID NO: 2415885 - DNA, 15 bp, Homo sapiens
atttacctaagatta

SEQ ID NO: 2415886 - DNA, 24 bp, Homo sapiens
aaaaataaatatatctaccccaga

SEQ ID NO: 2415887 - DNA, 14 bp, Homo sapiens
aaaataaatatatc

SEQ ID NO: 2415888 - DNA, 13 bp, Homo sapiens
aaaattcattttt

SEQ ID NO: 2415889 - DNA, 22 bp, Homo sapiens
aaacagttggtaacttttgtga

SEQ ID NO: 2415890 - DNA, 19 bp, Homo sapiens
aaactttttttctgtacca

SEQ ID NO: 2415891 - DNA, 22 bp, Homo sapiens
aaactttttttctgtaccagtt

SEQ ID NO: 2415892 - DNA, 16 bp, Homo sapiens
aaagaaagtgtatttg

SEQ ID NO: 2415893 - DNA, 19 bp, Homo sapiens
aaagagaaacagttggtaa

SEQ ID NO: 2415894 - DNA, 22 bp, Homo sapiens
aaagtgtatttggaaataaagt

SEQ ID NO: 2415895 - DNA, 20 bp, Homo sapiens
aacatgtcctgcctattatc

SEQ ID NO: 2415896 - DNA, 15 bp, Homo sapiens
aacccgtctggccca

SEQ ID NO: 2415897 - DNA, 12 bp, Homo sapiens
aacttcttgctt

SEQ ID NO: 2415898 - DNA, 22 bp, Homo sapiens
aactttttttctgtaccagtta

SEQ ID NO: 2415899 - DNA, 12 bp, Homo sapiens
aagaaagtgtat

SEQ ID NO: 2415900 - DNA, 20 bp, Homo sapiens
aagagaaacagttggtaact

SEQ ID NO: 2415901 - DNA, 19 bp, Homo sapiens
aagatggcataacctgtct

SEQ ID NO: 2415902 - DNA, 14 bp, Homo sapiens
aaggaatttcttaa

SEQ ID NO: 2415903 - DNA, 16 bp, Homo sapiens
aaggaatttcttaact

SEQ ID NO: 2415904 - DNA, 17 bp, Homo sapiens
aaggaatttcttaactt

SEQ ID NO: 2415905 - DNA, 19 bp, Homo sapiens
aaggaatttcttaacttct

SEQ ID NO: 2415906 - DNA, 20 bp, Homo sapiens
aaggaatttcttaacttctt

SEQ ID NO: 2415907 - DNA, 16 bp, Homo sapiens
aagtgctgtttattaa

SEQ ID NO: 2415908 - DNA, 17 bp, Homo sapiens
aagtgctgtttattaat

SEQ ID NO: 2415909 - DNA, 22 bp, Homo sapiens
aagtgctgtttattaatcttag

SEQ ID NO: 2415910 - DNA, 21 bp, Homo sapiens
aagtgtatttggaaataaagt

SEQ ID NO: 2415911 - DNA, 19 bp, Homo sapiens
aataaaggcagttttctaa

SEQ ID NO: 2415912 - DNA, 20 bp, Homo sapiens
aatatatctaccccagacta

SEQ ID NO: 2415913 - DNA, 23 bp, Homo sapiens
aatcttagtgtatgattactggc

SEQ ID NO: 2415914 - DNA, 16 bp, Homo sapiens
aatgggctcaaccaga

SEQ ID NO: 2415915 - DNA, 21 bp, Homo sapiens
aatgtatgttaccaaaaataa

SEQ ID NO: 2415916 - DNA, 16 bp, Homo sapiens
aattagacactttgga

SEQ ID NO: 2415917 - DNA, 23 bp, Homo sapiens
aattaggctgtaactactttata

SEQ ID NO: 2415918 - DNA, 17 bp, Homo sapiens
aattcaaggaatttctt

SEQ ID NO: 2415919 - DNA, 18 bp, Homo sapiens
aattcattttttaaattc

SEQ ID NO: 2415920 - DNA, 21 bp, Homo sapiens
aattcccgttttgtcactttt

SEQ ID NO: 2415921 - DNA, 17 bp, Homo sapiens
aattggatttcctaata

SEQ ID NO: 2415922 - DNA, 13 bp, Homo sapiens
aatttacctaaga

SEQ ID NO: 2415923 - DNA, 14 bp, Homo sapiens
aatttacctaagat

SEQ ID NO: 2415924 - DNA, 16 bp, Homo sapiens
aatttacctaagatta

SEQ ID NO: 2415925 - DNA, 17 bp, Homo sapiens
aatttacctaagattac

SEQ ID NO: 2415926 - DNA, 18 bp, Homo sapiens
aatttacctaagattaca

SEQ ID NO: 2415927 - DNA, 20 bp, Homo sapiens
aatttcttaacttcttgctt

SEQ ID NO: 2415928 - DNA, 19 bp, Homo sapiens
aattttgaagtgctgttta

SEQ ID NO: 2415929 - DNA, 20 bp, Homo sapiens
aattttgaagtgctgtttat

SEQ ID NO: 2415930 - DNA, 14 bp, Homo sapiens
acaaatcagaagtc

SEQ ID NO: 2415931 - DNA, 16 bp, Homo sapiens
acaaatcagaagtcat

SEQ ID NO: 2415932 - DNA, 17 bp, Homo sapiens
acacaccaggcgctaat

SEQ ID NO: 2415933 - DNA, 14 bp, Homo sapiens
acactgctctaaca

SEQ ID NO: 2415934 - DNA, 15 bp, Homo sapiens
tagacactttggaag

SEQ ID NO: 2415935 - DNA, 18 bp, Homo sapiens
tagtattttttgtataat

SEQ ID NO: 2415936 - DNA, 19 bp, Homo sapiens
tagtattttttgtataatt

SEQ ID NO: 2415937 - DNA, 15 bp, Homo sapiens
tagtgtatgattact

SEQ ID NO: 2415938 - DNA, 19 bp, Homo sapiens
tagttaccttatagttact

SEQ ID NO: 2415939 - DNA, 17 bp, Homo sapiens
tagttactgtgtaatta

SEQ ID NO: 2415940 - DNA, 18 bp, Homo sapiens
tagttactgtgtaattag

SEQ ID NO: 2415941 - DNA, 19 bp, Homo sapiens
tagttactgtgtaattagt

SEQ ID NO: 2415942 - DNA, 17 bp, Homo sapiens
tataattggatttccta

SEQ ID NO: 2415943 - DNA, 13 bp, Homo sapiens
tatagttactgtg

SEQ ID NO: 2415944 - DNA, 15 bp, Homo sapiens
tatagttactgtgta

SEQ ID NO: 2415945 - DNA, 21 bp, Homo sapiens
tatatctaccccagactagat

SEQ ID NO: 2415946 - DNA, 13 bp, Homo sapiens
tatctataattta

SEQ ID NO: 2415947 - DNA, 15 bp, Homo sapiens
tatctgtcagctgca

SEQ ID NO: 2415948 - DNA, 13 bp, Homo sapiens
tattatctgtcag

SEQ ID NO: 2415949 - DNA, 16 bp, Homo sapiens
tatttggaaataaagt

SEQ ID NO: 2415950 - DNA, 17 bp, Homo sapiens
tattttttgtataattg

SEQ ID NO: 2415951 - DNA, 12 bp, Homo sapiens
tcaaagaaagtg

SEQ ID NO: 2415952 - DNA, 16 bp, Homo sapiens
tcaaggaatttcttaa

SEQ ID NO: 2415953 - DNA, 19 bp, Homo sapiens
tcaaggaatttcttaactt

SEQ ID NO: 2415954 - DNA, 23 bp, Homo sapiens
tcacagaagtgttaacttttcta

SEQ ID NO: 2415955 - DNA, 17 bp, Homo sapiens
tcactttttctgataaa

SEQ ID NO: 2415956 - DNA, 22 bp, Homo sapiens
tcagctgcaaggtactctggtg

SEQ ID NO: 2415957 - DNA, 14 bp, Homo sapiens
tcatcctcaaagaa

SEQ ID NO: 2415958 - DNA, 17 bp, Homo sapiens
tcatcctcaaagaaagt

SEQ ID NO: 2415959 - DNA, 21 bp, Homo sapiens
tcatcctcaaagaaagtgtat

SEQ ID NO: 2415960 - DNA, 22 bp, Homo sapiens
tcatcctcaaagaaagtgtatt

SEQ ID NO: 2415961 - DNA, 11 bp, Homo sapiens
tcatcttgcta

SEQ ID NO: 2415962 - DNA, 18 bp, Homo sapiens
tcatcttgctaccagtat

SEQ ID NO: 2415963 - DNA, 22 bp, Homo sapiens
tcatcttgctaccagtatttag

SEQ ID NO: 2415964 - DNA, 18 bp, Homo sapiens
tcatttatctataattta

SEQ ID NO: 2415965 - DNA, 23 bp, Homo sapiens
tccaactactaatagaataaagg

SEQ ID NO: 2415966 - DNA, 14 bp, Homo sapiens
tccagctgactaaa

SEQ ID NO: 2415967 - DNA, 23 bp, Homo sapiens
tcccacctgacacaccaggcgct

SEQ ID NO: 2415968 - DNA, 16 bp, Homo sapiens
tcctcaaagaaagtgt

SEQ ID NO: 2415969 - DNA, 13 bp, Homo sapiens
tccttttgacact

SEQ ID NO: 2415970 - DNA, 14 bp, Homo sapiens
tccttttgacactg

SEQ ID NO: 2415971 - DNA, 16 bp, Homo sapiens
tccttttgacactgct

SEQ ID NO: 2415972 - DNA, 20 bp, Homo sapiens
tctaacagccctcctctgca

SEQ ID NO: 2415973 - DNA, 22 bp, Homo sapiens
tctaacagccctcctctgcact

SEQ ID NO: 2415974 - DNA, 12 bp, Homo sapiens
tctataatttac

SEQ ID NO: 2415975 - DNA, 13 bp, Homo sapiens
tctcacctggact

SEQ ID NO: 2415976 - DNA, 20 bp, Homo sapiens
tctcagtaccccatggagct

SEQ ID NO: 2415977 - DNA, 17 bp, Homo sapiens
tctcatgggtggcactc

SEQ ID NO: 2415978 - DNA, 12 bp, Homo sapiens
tctcttctctcc

SEQ ID NO: 2415979 - DNA, 21 bp, Homo sapiens
tctgcactcccacctgacaca

SEQ ID NO: 2415980 - DNA, 16 bp, Homo sapiens
tctggcccaccagggt

SEQ ID NO: 2415981 - DNA, 17 bp, Homo sapiens
tctggtgagtcaccact

SEQ ID NO: 2415982 - DNA, 13 bp, Homo sapiens
tctgtaccagtta

SEQ ID NO: 2415983 - DNA, 14 bp, Homo sapiens
tctgtcagctgcaa

SEQ ID NO: 2415984 - DNA, 12 bp, Homo sapiens
tcttaacttctt

SEQ ID NO: 2415985 - DNA, 16 bp, Homo sapiens
tcttaacttcttgctt

SEQ ID NO: 2415986 - DNA, 13 bp, Homo sapiens
tcttgctaccagt

SEQ ID NO: 2415987 - DNA, 18 bp, Homo sapiens
tgaagtgctgtttattaa

SEQ ID NO: 2415988 - DNA, 20 bp, Homo sapiens
tgaattaggctgtaactact

SEQ ID NO: 2415989 - DNA, 16 bp, Homo sapiens
tgacacaccaggcgct

SEQ ID NO: 2415990 - DNA, 21 bp, Homo sapiens
tgacactgctctaacagccct

SEQ ID NO: 2415991 - DNA, 22 bp, Homo sapiens
tgacactgctctaacagccctc

SEQ ID NO: 2415992 - DNA, 12 bp, Homo sapiens
tgactaaacttt

SEQ ID NO: 2415993 - DNA, 18 bp, Homo sapiens
tgactaaactttttttct

SEQ ID NO: 2415994 - DNA, 15 bp, Homo sapiens
tgcaagcacagccct

SEQ ID NO: 2415995 - DNA, 16 bp, Homo sapiens
tgcaaggtactctggt

SEQ ID NO: 2415996 - DNA, 18 bp, Homo sapiens
tgcaaggtactctggtga

SEQ ID NO: 2415997 - DNA, 15 bp, Homo sapiens
tgcactcccacctga

SEQ ID NO: 2415998 - DNA, 17 bp, Homo sapiens
tgcactcccacctgaca

SEQ ID NO: 2415999 - DNA, 19 bp, Homo sapiens
tgcactcccacctgacaca

SEQ ID NO: 2416000 - DNA, 22 bp, Homo sapiens
tgcagctgtggcagagttacag

SEQ ID NO: 2416001 - DNA, 17 bp, Homo sapiens
tgccacttaatgtatgt

SEQ ID NO: 2416002 - DNA, 23 bp, Homo sapiens
tgccacttaatgtatgttaccaa

SEQ ID NO: 2416003 - DNA, 21 bp, Homo sapiens
tgcctattatctgtcagctgc

SEQ ID NO: 2416004 - DNA, 15 bp, Homo sapiens
tgctaccagtattta

SEQ ID NO: 2416005 - DNA, 15 bp, Homo sapiens
tgctctaacagccct

SEQ ID NO: 2416006 - DNA, 15 bp, Homo sapiens
tgctcttttctcctc

SEQ ID NO: 2416007 - DNA, 14 bp, Homo sapiens
tgcttctttctaga

SEQ ID NO: 2416008 - DNA, 14 bp, Homo sapiens
tggcatagctctgg

SEQ ID NO: 2416009 - DNA, 16 bp, Homo sapiens
tggcctttttcattta

SEQ ID NO: 2416010 - DNA, 22 bp, Homo sapiens
tggcctttttcatttatctata

SEQ ID NO: 2416011 - DNA, 16 bp, Homo sapiens
tggtaacttttgtgaa

SEQ ID NO: 2416012 - DNA, 15 bp, Homo sapiens
tggtttaaagaaagt

SEQ ID NO: 2416013 - DNA, 17 bp, Homo sapiens
tggtttaaagaaagtgt

SEQ ID NO: 2416014 - DNA, 17 bp, Homo sapiens
tgtaactactttataac

SEQ ID NO: 2416015 - DNA, 23 bp, Homo sapiens
tgtaattagtgccacttaatgta

SEQ ID NO: 2416016 - DNA, 12 bp, Homo sapiens
tgtatgattact

SEQ ID NO: 2416017 - DNA, 13 bp, Homo sapiens
tgtatgattactg

SEQ ID NO: 2416018 - DNA, 21 bp, Homo sapiens
tgtatttggaaataaagtcag

SEQ ID NO: 2416019 - DNA, 16 bp, Homo sapiens
tgtcatcctcaaagaa

SEQ ID NO: 2416020 - DNA, 21 bp, Homo sapiens
tgtcatcctcaaagaaagtgt

SEQ ID NO: 2416021 - DNA, 14 bp, Homo sapiens
tgtggcagagttac

SEQ ID NO: 2416022 - DNA, 19 bp, Homo sapiens
tgtggcagagttacagttc

SEQ ID NO: 2416023 - DNA, 21 bp, Homo sapiens
tgtggcagagttacagttctg

SEQ ID NO: 2416024 - DNA, 20 bp, Homo sapiens
tgttagttaccttatagtta

SEQ ID NO: 2416025 - DNA, 17 bp, Homo sapiens
tgttggcatagctctgg

SEQ ID NO: 2416026 - DNA, 15 bp, Homo sapiens
tgtttattaatctta

SEQ ID NO: 2416027 - DNA, 19 bp, Homo sapiens
ttaaattcccgttttgtca

SEQ ID NO: 2416028 - DNA, 22 bp, Homo sapiens
ttaaattcccgttttgtcactt

SEQ ID NO: 2416029 - DNA, 14 bp, Homo sapiens
ttaacttcttgctt

SEQ ID NO: 2416030 - DNA, 22 bp, Homo sapiens
ttaagcatctggctctaattca

SEQ ID NO: 2416031 - DNA, 20 bp, Homo sapiens
ttaattttgaagtgctgttt

SEQ ID NO: 2416032 - DNA, 16 bp, Homo sapiens
ttacaaatcagaagtc

SEQ ID NO: 2416033 - DNA, 12 bp, Homo sapiens
ttacagttctgt

SEQ ID NO: 2416034 - DNA, 18 bp, Homo sapiens
ttaccttatagttactgt

SEQ ID NO: 2416035 - DNA, 13 bp, Homo sapiens
ttactggcctttt

SEQ ID NO: 2416036 - DNA, 14 bp, Homo sapiens
ttaggctgtaacta

SEQ ID NO: 2416037 - DNA, 13 bp, Homo sapiens
ttatagttactgt

SEQ ID NO: 2416038 - DNA, 23 bp, Homo sapiens
ctttttcatttatctataattta

SEQ ID NO: 2416039 - DNA, 18 bp, Homo sapiens
gaaacagttggtaacttt

SEQ ID NO: 2416040 - DNA, 23 bp, Homo sapiens
gaaacagttggtaacttttgtga

SEQ ID NO: 2416041 - DNA, 18 bp, Homo sapiens
gaaagagaaacagttggt

SEQ ID NO: 2416042 - DNA, 16 bp, Homo sapiens
gaattaggctgtaact

SEQ ID NO: 2416043 - DNA, 17 bp, Homo sapiens
gaattaggctgtaacta

SEQ ID NO: 2416044 - DNA, 19 bp, Homo sapiens
gaattaggctgtaactact

SEQ ID NO: 2416045 - DNA, 23 bp, Homo sapiens
gaattaggctgtaactactttat

SEQ ID NO: 2416046 - DNA, 13 bp, Homo sapiens
gaatttcttaact

SEQ ID NO: 2416047 - DNA, 19 bp, Homo sapiens
gaatttcttaacttcttgc

SEQ ID NO: 2416048 - DNA, 18 bp, Homo sapiens
gactaaactttttttctg

SEQ ID NO: 2416049 - DNA, 17 bp, Homo sapiens
gagaaacagttggtaac

SEQ ID NO: 2416050 - DNA, 22 bp, Homo sapiens
gagaaacagttggtaacttttg

SEQ ID NO: 2416051 - DNA, 12 bp, Homo sapiens
gagccaccagtt

SEQ ID NO: 2416052 - DNA, 14 bp, Homo sapiens
gagccaccagttct

SEQ ID NO: 2416053 - DNA, 15 bp, Homo sapiens
gagttacagttctgt

SEQ ID NO: 2416054 - DNA, 17 bp, Homo sapiens
gagttacagttctgtgg

SEQ ID NO: 2416055 - DNA, 16 bp, Homo sapiens
gataaaagatggccat

SEQ ID NO: 2416056 - DNA, 17 bp, Homo sapiens
gatggaaaattcatttt

SEQ ID NO: 2416057 - DNA, 20 bp, Homo sapiens
gattacaaatcagaagtcat

SEQ ID NO: 2416058 - DNA, 21 bp, Homo sapiens
gattacaaatcagaagtcatc

SEQ ID NO: 2416059 - DNA, 22 bp, Homo sapiens
gattactggcctttttcattta

SEQ ID NO: 2416060 - DNA, 17 bp, Homo sapiens
gcaaggtactctggtga

SEQ ID NO: 2416061 - DNA, 17 bp, Homo sapiens
gcagagttacagttctg

SEQ ID NO: 2416062 - DNA, 12 bp, Homo sapiens
gcagttttttga

SEQ ID NO: 2416063 - DNA, 18 bp, Homo sapiens
gcagttttttgaaaatgg

SEQ ID NO: 2416064 - DNA, 14 bp, Homo sapiens
gcataacctgtctc

SEQ ID NO: 2416065 - DNA, 14 bp, Homo sapiens
gcatagctctgggg

SEQ ID NO: 2416066 - DNA, 15 bp, Homo sapiens
gcatagctctggggt

SEQ ID NO: 2416067 - DNA, 19 bp, Homo sapiens
gcctttttcatttatctat

SEQ ID NO: 2416068 - DNA, 21 bp, Homo sapiens
gctaccagtatttagaagcca

SEQ ID NO: 2416069 - DNA, 16 bp, Homo sapiens
gctctaattcacagtg

SEQ ID NO: 2416070 - DNA, 12 bp, Homo sapiens
gctgcaaggtac

SEQ ID NO: 2416071 - DNA, 20 bp, Homo sapiens
gctgcaaggtactctggtga

SEQ ID NO: 2416072 - DNA, 21 bp, Homo sapiens
gctgtaactactttataacta

SEQ ID NO: 2416073 - DNA, 15 bp, Homo sapiens
gcttctttctagaaa

SEQ ID NO: 2416074 - DNA, 15 bp, Homo sapiens
ggaaaattcattttt

SEQ ID NO: 2416075 - DNA, 18 bp, Homo sapiens
ggaatttcttaacttctt

SEQ ID NO: 2416076 - DNA, 14 bp, Homo sapiens
ggagccaccagttc

SEQ ID NO: 2416077 - DNA, 13 bp, Homo sapiens
ggcagagttacag

SEQ ID NO: 2416078 - DNA, 18 bp, Homo sapiens
ggcagagttacagttctg

SEQ ID NO: 2416079 - DNA, 13 bp, Homo sapiens
ggcatagctctgg

SEQ ID NO: 2416080 - DNA, 14 bp, Homo sapiens
ggcccaccagggtc

SEQ ID NO: 2416081 - DNA, 15 bp, Homo sapiens
gggtgggcagttttt

SEQ ID NO: 2416082 - DNA, 14 bp, Homo sapiens
gtaacttttgtgaa

SEQ ID NO: 2416083 - DNA, 20 bp, Homo sapiens
gtaattagtgccacttaatg

SEQ ID NO: 2416084 - DNA, 16 bp, Homo sapiens
gtaccagttaattttt

SEQ ID NO: 2416085 - DNA, 20 bp, Homo sapiens
gtaccagttaatttttccaa

SEQ ID NO: 2416086 - DNA, 22 bp, Homo sapiens
gtaccagttaatttttccaact

SEQ ID NO: 2416087 - DNA, 18 bp, Homo sapiens
gtataattggatttccta

SEQ ID NO: 2416088 - DNA, 19 bp, Homo sapiens
gtataattggatttcctaa

SEQ ID NO: 2416089 - DNA, 12 bp, Homo sapiens
gtcatcttgcta

SEQ ID NO: 2416090 - DNA, 15 bp, Homo sapiens
gtcatcttgctacca

SEQ ID NO: 2416091 - DNA, 22 bp, Homo sapiens
gtcatcttgctaccagtattta

SEQ ID NO: 2416092 - DNA, 15 bp, Homo sapiens
gtctggcccaccagg

SEQ ID NO: 2416093 - DNA, 22 bp, Homo sapiens
gtgaattaggctgtaactactt

SEQ ID NO: 2416094 - DNA, 20 bp, Homo sapiens
gtgctcttttctcctcactg

SEQ ID NO: 2416095 - DNA, 15 bp, Homo sapiens
gtgctgtttattaat

SEQ ID NO: 2416096 - DNA, 19 bp, Homo sapiens
gtgctgtttattaatctta

SEQ ID NO: 2416097 - DNA, 14 bp, Homo sapiens
gtggtttcatgtta

SEQ ID NO: 2416098 - DNA, 19 bp, Homo sapiens
gtgtatttggaaataaagt

SEQ ID NO: 2416099 - DNA, 14 bp, Homo sapiens
gttaatttttccaa

SEQ ID NO: 2416100 - DNA, 14 bp, Homo sapiens
gttacagttctgtg

SEQ ID NO: 2416101 - DNA, 22 bp, Homo sapiens
gttaccttatagttactgtgta

SEQ ID NO: 2416102 - DNA, 13 bp, Homo sapiens
gttactgtgtaat

SEQ ID NO: 2416103 - DNA, 22 bp, Homo sapiens
gttagttaccttatagttactg

SEQ ID NO: 2416104 - DNA, 23 bp, Homo sapiens
gttagttaccttatagttactgt

SEQ ID NO: 2416105 - DNA, 16 bp, Homo sapiens
gttcatgcagctgtgg

SEQ ID NO: 2416106 - DNA, 13 bp, Homo sapiens
gttccctcccaga

SEQ ID NO: 2416107 - DNA, 19 bp, Homo sapiens
gttctcatgggtggcactc

SEQ ID NO: 2416108 - DNA, 15 bp, Homo sapiens
gttggcatagctctg

SEQ ID NO: 2416109 - DNA, 18 bp, Homo sapiens
gttggcatagctctgggg

SEQ ID NO: 2416110 - DNA, 19 bp, Homo sapiens
gttggcatagctctggggt

SEQ ID NO: 2416111 - DNA, 16 bp, Homo sapiens
gtttaaagaaagtgta

SEQ ID NO: 2416112 - DNA, 17 bp, Homo sapiens
gtttaaagaaagtgtat

SEQ ID NO: 2416113 - DNA, 18 bp, Homo sapiens
gtttattaatcttagtgt

SEQ ID NO: 2416114 - DNA, 16 bp, Homo sapiens
taaactttttttctgt

SEQ ID NO: 2416115 - DNA, 11 bp, Homo sapiens
taaagaaagtg

SEQ ID NO: 2416116 - DNA, 14 bp, Homo sapiens
taaaggcagttttc

SEQ ID NO: 2416117 - DNA, 18 bp, Homo sapiens
taaatatatctaccccag

SEQ ID NO: 2416118 - DNA, 18 bp, Homo sapiens
taaattcccgttttgtca

SEQ ID NO: 2416119 - DNA, 19 bp, Homo sapiens
taaattcccgttttgtcac

SEQ ID NO: 2416120 - DNA, 16 bp, Homo sapiens
taactaacatgtcctg

SEQ ID NO: 2416121 - DNA, 16 bp, Homo sapiens
taactactttataact

SEQ ID NO: 2416122 - DNA, 17 bp, Homo sapiens
taactactttataacta

SEQ ID NO: 2416123 - DNA, 12 bp, Homo sapiens
taacttcttgct

SEQ ID NO: 2416124 - DNA, 16 bp, Homo sapiens
taatagaataaaggca

SEQ ID NO: 2416125 - DNA, 21 bp, Homo sapiens
taattagtgccacttaatgta

SEQ ID NO: 2416126 - DNA, 18 bp, Homo sapiens
taattcaaggaatttctt

SEQ ID NO: 2416127 - DNA, 15 bp, Homo sapiens
taattggatttccta

SEQ ID NO: 2416128 - DNA, 16 bp, Homo sapiens
taattggatttcctaa

SEQ ID NO: 2416129 - DNA, 18 bp, Homo sapiens
taattttgaagtgctgtt

SEQ ID NO: 2416130 - DNA, 13 bp, Homo sapiens
tacacagtcagct

SEQ ID NO: 2416131 - DNA, 21 bp, Homo sapiens
tacagttctgtggtttcatgt

SEQ ID NO: 2416132 - DNA, 15 bp, Homo sapiens
taccaaaaataaata

SEQ ID NO: 2416133 - DNA, 12 bp, Homo sapiens
taccagtattta

SEQ ID NO: 2416134 - DNA, 18 bp, Homo sapiens
taccagtatttagaagcc

SEQ ID NO: 2416135 - DNA, 19 bp, Homo sapiens
taccagtatttagaagcca

SEQ ID NO: 2416136 - DNA, 20 bp, Homo sapiens
taccagtatttagaagccaa

SEQ ID NO: 2416137 - DNA, 19 bp, Homo sapiens
taccagttaatttttccaa

SEQ ID NO: 2416138 - DNA, 20 bp, Homo sapiens
taccccatggagctgggcta

SEQ ID NO: 2416139 - DNA, 17 bp, Homo sapiens
tacctaagattacaaat

SEQ ID NO: 2416140 - DNA, 14 bp, Homo sapiens
tactgtgtaattag

SEQ ID NO: 2416141 - DNA, 22 bp, Homo sapiens
tagaataaaggcagttttctaa

SEQ ID NO: 2416142 - DNA, 14 bp, Homo sapiens
cagaagtcatcttg

SEQ ID NO: 2416143 - DNA, 14 bp, Homo sapiens
cagactagatgtag

SEQ ID NO: 2416144 - DNA, 15 bp, Homo sapiens
cagactagatgtagt

SEQ ID NO: 2416145 - DNA, 20 bp, Homo sapiens
cagaggagccaccagttctc

SEQ ID NO: 2416146 - DNA, 18 bp, Homo sapiens
cagccctcctctgcactc

SEQ ID NO: 2416147 - DNA, 13 bp, Homo sapiens
cagctgactaaac

SEQ ID NO: 2416148 - DNA, 19 bp, Homo sapiens
cagctgtggcagagttaca

SEQ ID NO: 2416149 - DNA, 22 bp, Homo sapiens
cagggctttactccgtaacaga

SEQ ID NO: 2416150 - DNA, 23 bp, Homo sapiens
cagtaccccatggagctgggcta

SEQ ID NO: 2416151 - DNA, 17 bp, Homo sapiens
cagtatttagaagccaa

SEQ ID NO: 2416152 - DNA, 14 bp, Homo sapiens
cagtctctcttctc

SEQ ID NO: 2416153 - DNA, 14 bp, Homo sapiens
cagtgctcttttct

SEQ ID NO: 2416154 - DNA, 12 bp, Homo sapiens
cagttaattttt

SEQ ID NO: 2416155 - DNA, 16 bp, Homo sapiens
cagttaatttttccaa

SEQ ID NO: 2416156 - DNA, 16 bp, Homo sapiens
cagttggtaacttttg

SEQ ID NO: 2416157 - DNA, 12 bp, Homo sapiens
cataacctgtct

SEQ ID NO: 2416158 - DNA, 12 bp, Homo sapiens
catagctctggg

SEQ ID NO: 2416159 - DNA, 22 bp, Homo sapiens
catcctcaaagaaagtgtattg

SEQ ID NO: 2416160 - DNA, 14 bp, Homo sapiens
catcttgctaccag

SEQ ID NO: 2416161 - DNA, 23 bp, Homo sapiens
catcttgctaccagtatttagaa

SEQ ID NO: 2416162 - DNA, 22 bp, Homo sapiens
catttatctataatttacctaa

SEQ ID NO: 2416163 - DNA, 16 bp, Homo sapiens
ccaaaaataaatatat

SEQ ID NO: 2416164 - DNA, 14 bp, Homo sapiens
ccaactatgattat

SEQ ID NO: 2416165 - DNA, 12 bp, Homo sapiens
ccaccagttctc

SEQ ID NO: 2416166 - DNA, 20 bp, Homo sapiens
ccacctgacacaccaggcgc

SEQ ID NO: 2416167 - DNA, 15 bp, Homo sapiens
ccacttaatgtatgt

SEQ ID NO: 2416168 - DNA, 16 bp, Homo sapiens
ccagaggagccaccag

SEQ ID NO: 2416169 - DNA, 19 bp, Homo sapiens
ccagaggagccaccagttc

SEQ ID NO: 2416170 - DNA, 21 bp, Homo sapiens
ccagaggagccaccagttctc

SEQ ID NO: 2416171 - DNA, 18 bp, Homo sapiens
ccagtatttagaagccaa

SEQ ID NO: 2416172 - DNA, 21 bp, Homo sapiens
ccatttgtgtacacagtcagc

SEQ ID NO: 2416173 - DNA, 19 bp, Homo sapiens
cccaagttcatgcagctgt

SEQ ID NO: 2416174 - DNA, 18 bp, Homo sapiens
ccccagactagatgtagt

SEQ ID NO: 2416175 - DNA, 19 bp, Homo sapiens
ccccatggagctgggctaa

SEQ ID NO: 2416176 - DNA, 17 bp, Homo sapiens
cccgtctggcccaccag

SEQ ID NO: 2416177 - DNA, 14 bp, Homo sapiens
ccgttttgtcactt

SEQ ID NO: 2416178 - DNA, 17 bp, Homo sapiens
cctattatctgtcagct

SEQ ID NO: 2416179 - DNA, 16 bp, Homo sapiens
cctcaaagaaagtgta

SEQ ID NO: 2416180 - DNA, 23 bp, Homo sapiens
cctcccagaggagccaccagttc

SEQ ID NO: 2416181 - DNA, 14 bp, Homo sapiens
ccttatagttactg

SEQ ID NO: 2416182 - DNA, 21 bp, Homo sapiens
ccttatagttactgtgtaatt

SEQ ID NO: 2416183 - DNA, 22 bp, Homo sapiens
ccttgctgcaagcacagccctt

SEQ ID NO: 2416184 - DNA, 13 bp, Homo sapiens
cctttttcattta

SEQ ID NO: 2416185 - DNA, 11 bp, Homo sapiens
cgttttgtcac

SEQ ID NO: 2416186 - DNA, 21 bp, Homo sapiens
ctaaactttttttctgtacca

SEQ ID NO: 2416187 - DNA, 17 bp, Homo sapiens
ctaacatgtcctgccta

SEQ ID NO: 2416188 - DNA, 19 bp, Homo sapiens
ctaagattacaaatcagaa

SEQ ID NO: 2416189 - DNA, 21 bp, Homo sapiens
ctaatagaataaaggcagttt

SEQ ID NO: 2416190 - DNA, 15 bp, Homo sapiens
ctaattcacagtgct

SEQ ID NO: 2416191 - DNA, 13 bp, Homo sapiens
ctaccagtattta

SEQ ID NO: 2416192 - DNA, 14 bp, Homo sapiens
ctactttataacta

SEQ ID NO: 2416193 - DNA, 18 bp, Homo sapiens
ctactttataactaacat

SEQ ID NO: 2416194 - DNA, 19 bp, Homo sapiens
ctactttataactaacatg

SEQ ID NO: 2416195 - DNA, 20 bp, Homo sapiens
ctagatgtagtattttttgt

SEQ ID NO: 2416196 - DNA, 22 bp, Homo sapiens
ctataatttacctaagattaca

SEQ ID NO: 2416197 - DNA, 14 bp, Homo sapiens
ctatgattattaac

SEQ ID NO: 2416198 - DNA, 13 bp, Homo sapiens
ctcaaagaaagtg

SEQ ID NO: 2416199 - DNA, 19 bp, Homo sapiens
ctcagtctctcttctctcc

SEQ ID NO: 2416200 - DNA, 20 bp, Homo sapiens
ctccagctgactaaactttt

SEQ ID NO: 2416201 - DNA, 15 bp, Homo sapiens
ctcccacctgacaca

SEQ ID NO: 2416202 - DNA, 20 bp, Homo sapiens
ctcccacctgacacaccagg

SEQ ID NO: 2416203 - DNA, 21 bp, Homo sapiens
ctcccagaggagccaccagtt

SEQ ID NO: 2416204 - DNA, 23 bp, Homo sapiens
ctcccagaggagccaccagttct

SEQ ID NO: 2416205 - DNA, 19 bp, Homo sapiens
ctcctcactgtatccaggt

SEQ ID NO: 2416206 - DNA, 12 bp, Homo sapiens
ctcctctgcact

SEQ ID NO: 2416207 - DNA, 17 bp, Homo sapiens
ctctaattcacagtgct

SEQ ID NO: 2416208 - DNA, 14 bp, Homo sapiens
ctctccagctgact

SEQ ID NO: 2416209 - DNA, 16 bp, Homo sapiens
ctctccagctgactaa

SEQ ID NO: 2416210 - DNA, 13 bp, Homo sapiens
ctcttctctccag

SEQ ID NO: 2416211 - DNA, 19 bp, Homo sapiens
ctgacacaccaggcgctaa

SEQ ID NO: 2416212 - DNA, 23 bp, Homo sapiens
ctgacacaccaggcgctaattca

SEQ ID NO: 2416213 - DNA, 15 bp, Homo sapiens
ctgactaaacttttt

SEQ ID NO: 2416214 - DNA, 18 bp, Homo sapiens
ctgcactcccacctgaca

SEQ ID NO: 2416215 - DNA, 23 bp, Homo sapiens
ctgcctattatctgtcagctgca

SEQ ID NO: 2416216 - DNA, 12 bp, Homo sapiens
ctgctctaacag

SEQ ID NO: 2416217 - DNA, 22 bp, Homo sapiens
ctggacttaagcatctggctct

SEQ ID NO: 2416218 - DNA, 14 bp, Homo sapiens
ctggcccaccaggg

SEQ ID NO: 2416219 - DNA, 20 bp, Homo sapiens
ctggctctaattcacagtgc

SEQ ID NO: 2416220 - DNA, 22 bp, Homo sapiens
ctggctctaattcacagtgctc

SEQ ID NO: 2416221 - DNA, 24 bp, Homo sapiens
ctggtgagtcaccacttcagggct

SEQ ID NO: 2416222 - DNA, 17 bp, Homo sapiens
ctgtaactactttataa

SEQ ID NO: 2416223 - DNA, 19 bp, Homo sapiens
ctgtaactactttataact

SEQ ID NO: 2416224 - DNA, 16 bp, Homo sapiens
ctgtaccagttaattt

SEQ ID NO: 2416225 - DNA, 17 bp, Homo sapiens
ctgtaccagttaatttt

SEQ ID NO: 2416226 - DNA, 18 bp, Homo sapiens
ctgtaccagttaattttt

SEQ ID NO: 2416227 - DNA, 22 bp, Homo sapiens
ctgtcatcctcaaagaaagtgt

SEQ ID NO: 2416228 - DNA, 14 bp, Homo sapiens
ctgtctcacctgga

SEQ ID NO: 2416229 - DNA, 22 bp, Homo sapiens
ctgtggcagagttacagttctg

SEQ ID NO: 2416230 - DNA, 16 bp, Homo sapiens
ctgtggtttcatgtta

SEQ ID NO: 2416231 - DNA, 18 bp, Homo sapiens
ctgtgtaattagtgccac

SEQ ID NO: 2416232 - DNA, 15 bp, Homo sapiens
cttaagcatctggct

SEQ ID NO: 2416233 - DNA, 11 bp, Homo sapiens
cttagtgtatg

SEQ ID NO: 2416234 - DNA, 15 bp, Homo sapiens
cttatagttactgtg

SEQ ID NO: 2416235 - DNA, 18 bp, Homo sapiens
cttatgcggttaattttg

SEQ ID NO: 2416236 - DNA, 17 bp, Homo sapiens
cttctctccagctgact

SEQ ID NO: 2416237 - DNA, 20 bp, Homo sapiens
cttcttgcttctttctagaa

SEQ ID NO: 2416238 - DNA, 21 bp, Homo sapiens
cttcttgcttctttctagaaa

SEQ ID NO: 2416239 - DNA, 17 bp, Homo sapiens
cttgctaccagtattta

SEQ ID NO: 2416240 - DNA, 20 bp, Homo sapiens
cttgctgcaagcacagccct

SEQ ID NO: 2416241 - DNA, 14 bp, Homo sapiens
cttgcttctttcta

SEQ ID NO: 2416242 - DNA, 22 bp, Homo sapiens
ctttctagaaagagaaacagtt

SEQ ID NO: 2416243 - DNA, 12 bp, Homo sapiens
cttttgacactg

SEQ ID NO: 2416244 - DNA, 13 bp, Homo sapiens
cttttgtgaatta

SEQ ID NO: 2416245 - DNA, 20 bp, Homo sapiens
acactgctctaacagccctc

SEQ ID NO: 2416246 - DNA, 22 bp, Homo sapiens
acagttctgtggtttcatgtta

SEQ ID NO: 2416247 - DNA, 15 bp, Homo sapiens
acagttggtaacttt

SEQ ID NO: 2416248 - DNA, 16 bp, Homo sapiens
acagttggtaactttt

SEQ ID NO: 2416249 - DNA, 14 bp, Homo sapiens
accagtatttagaa

SEQ ID NO: 2416250 - DNA, 13 bp, Homo sapiens
accagttaatttt

SEQ ID NO: 2416251 - DNA, 19 bp, Homo sapiens
accccatggagctgggcta

SEQ ID NO: 2416252 - DNA, 21 bp, Homo sapiens
acctgacacaccaggcgctaa

SEQ ID NO: 2416253 - DNA, 17 bp, Homo sapiens
actaacatgtcctgcct

SEQ ID NO: 2416254 - DNA, 16 bp, Homo sapiens
actaatagaataaagg

SEQ ID NO: 2416255 - DNA, 17 bp, Homo sapiens
actaatagaataaaggc

SEQ ID NO: 2416256 - DNA, 15 bp, Homo sapiens
actatgattattaac

SEQ ID NO: 2416257 - DNA, 17 bp, Homo sapiens
actcagtctctcttctc

SEQ ID NO: 2416258 - DNA, 19 bp, Homo sapiens
actcagtctctcttctctc

SEQ ID NO: 2416259 - DNA, 23 bp, Homo sapiens
actcagtctctcttctctccagc

SEQ ID NO: 2416260 - DNA, 19 bp, Homo sapiens
actccgtaacagattttgt

SEQ ID NO: 2416261 - DNA, 20 bp, Homo sapiens
actctggtgagtcaccactt

SEQ ID NO: 2416262 - DNA, 20 bp, Homo sapiens
acttaagcatctggctctaa

SEQ ID NO: 2416263 - DNA, 21 bp, Homo sapiens
acttaagcatctggctctaat

SEQ ID NO: 2416264 - DNA, 20 bp, Homo sapiens
acttcttgcttctttctaga

SEQ ID NO: 2416265 - DNA, 20 bp, Homo sapiens
actttttttctgtaccagtt

SEQ ID NO: 2416266 - DNA, 21 bp, Homo sapiens
actttttttctgtaccagtta

SEQ ID NO: 2416267 - DNA, 19 bp, Homo sapiens
agaaacagttggtaacttt

SEQ ID NO: 2416268 - DNA, 17 bp, Homo sapiens
agaaagagaaacagttg

SEQ ID NO: 2416269 - DNA, 11 bp, Homo sapiens
agaaagtgtat

SEQ ID NO: 2416270 - DNA, 23 bp, Homo sapiens
agaagccaactatgattattaac

SEQ ID NO: 2416271 - DNA, 16 bp, Homo sapiens
agaagtcatcttgcta

SEQ ID NO: 2416272 - DNA, 22 bp, Homo sapiens
agaagtcatcttgctaccagta

SEQ ID NO: 2416273 - DNA, 16 bp, Homo sapiens
agactagatgtagtat

SEQ ID NO: 2416274 - DNA, 23 bp, Homo sapiens
agactagatgtagtattttttgt

SEQ ID NO: 2416275 - DNA, 15 bp, Homo sapiens
agagttacagttctg

SEQ ID NO: 2416276 - DNA, 18 bp, Homo sapiens
agatggaaaattcatttt

SEQ ID NO: 2416277 - DNA, 16 bp, Homo sapiens
agcatctggctctaat

SEQ ID NO: 2416278 - DNA, 23 bp, Homo sapiens
agcccaagttcatgcagctgtgg

SEQ ID NO: 2416279 - DNA, 21 bp, Homo sapiens
agcccttatgcggttaatttt

SEQ ID NO: 2416280 - DNA, 22 bp, Homo sapiens
agcccttatgcggttaattttg

SEQ ID NO: 2416281 - DNA, 23 bp, Homo sapiens
agctgactaaactttttttctgt

SEQ ID NO: 2416282 - DNA, 17 bp, Homo sapiens
agctgggctaagtaaat

SEQ ID NO: 2416283 - DNA, 13 bp, Homo sapiens
aggaatttcttaa

SEQ ID NO: 2416284 - DNA, 19 bp, Homo sapiens
aggaatttcttaacttctt

SEQ ID NO: 2416285 - DNA, 15 bp, Homo sapiens
aggagccaccagttc

SEQ ID NO: 2416286 - DNA, 12 bp, Homo sapiens
aggcaattagac

SEQ ID NO: 2416287 - DNA, 21 bp, Homo sapiens
aggcaattagacactttggaa

SEQ ID NO: 2416288 - DNA, 12 bp, Homo sapiens
aggcagttttct

SEQ ID NO: 2416289 - DNA, 19 bp, Homo sapiens
agtatttagaagccaacta

SEQ ID NO: 2416290 - DNA, 19 bp, Homo sapiens
agtattttttgtataattg

SEQ ID NO: 2416291 - DNA, 23 bp, Homo sapiens
agtcatcttgctaccagtattta

SEQ ID NO: 2416292 - DNA, 14 bp, Homo sapiens
agtctctcttctct

SEQ ID NO: 2416293 - DNA, 15 bp, Homo sapiens
agtctctcttctctc

SEQ ID NO: 2416294 - DNA, 18 bp, Homo sapiens
agtctctcttctctccag

SEQ ID NO: 2416295 - DNA, 20 bp, Homo sapiens
agtgccacttaatgtatgtt

SEQ ID NO: 2416296 - DNA, 14 bp, Homo sapiens
agtgtatgattact

SEQ ID NO: 2416297 - DNA, 19 bp, Homo sapiens
agtgtatgattactggcct

SEQ ID NO: 2416298 - DNA, 14 bp, Homo sapiens
agtgtatttggaaa

SEQ ID NO: 2416299 - DNA, 14 bp, Homo sapiens
agttacagttctgt

SEQ ID NO: 2416300 - DNA, 16 bp, Homo sapiens
agttacagttctgtgg

SEQ ID NO: 2416301 - DNA, 16 bp, Homo sapiens
agttaccttatagtta

SEQ ID NO: 2416302 - DNA, 14 bp, Homo sapiens
agttactgtgtaat

SEQ ID NO: 2416303 - DNA, 19 bp, Homo sapiens
agttactgtgtaattagtg

SEQ ID NO: 2416304 - DNA, 22 bp, Homo sapiens
agttcatgcagctgtggcagag

SEQ ID NO: 2416305 - DNA, 16 bp, Homo sapiens
agttctgtggtttcat

SEQ ID NO: 2416306 - DNA, 13 bp, Homo sapiens
agttggtaacttt

SEQ ID NO: 2416307 - DNA, 19 bp, Homo sapiens
atagaataaaggcagtttt

SEQ ID NO: 2416308 - DNA, 22 bp, Homo sapiens
atagctctggggtgggcagttt

SEQ ID NO: 2416309 - DNA, 13 bp, Homo sapiens
atagttactgtgt

SEQ ID NO: 2416310 - DNA, 17 bp, Homo sapiens
atagttactgtgtaatt

SEQ ID NO: 2416311 - DNA, 18 bp, Homo sapiens
atagttactgtgtaatta

SEQ ID NO: 2416312 - DNA, 18 bp, Homo sapiens
atcagaagtcatcttgct

SEQ ID NO: 2416313 - DNA, 15 bp, Homo sapiens
atcctcaaagaaagt

SEQ ID NO: 2416314 - DNA, 16 bp, Homo sapiens
atcctcaaagaaagtg

SEQ ID NO: 2416315 - DNA, 20 bp, Homo sapiens
atcctcaaagaaagtgtatt

SEQ ID NO: 2416316 - DNA, 21 bp, Homo sapiens
atctaccccagactagatgta

SEQ ID NO: 2416317 - DNA, 11 bp, Homo sapiens
atctataattt

SEQ ID NO: 2416318 - DNA, 16 bp, Homo sapiens
atctataatttaccta

SEQ ID NO: 2416319 - DNA, 15 bp, Homo sapiens
atcttagtgtatgat

SEQ ID NO: 2416320 - DNA, 19 bp, Homo sapiens
atcttagtgtatgattact

SEQ ID NO: 2416321 - DNA, 14 bp, Homo sapiens
atgattactggcct

SEQ ID NO: 2416322 - DNA, 15 bp, Homo sapiens
atgattactggcctt

SEQ ID NO: 2416323 - DNA, 17 bp, Homo sapiens
atggcataacctgtctc

SEQ ID NO: 2416324 - DNA, 22 bp, Homo sapiens
atgttagttaccttatagttac

SEQ ID NO: 2416325 - DNA, 22 bp, Homo sapiens
attacaaatcagaagtcatctt

SEQ ID NO: 2416326 - DNA, 17 bp, Homo sapiens
attaggctgtaactact

SEQ ID NO: 2416327 - DNA, 23 bp, Homo sapiens
attaggctgtaactactttataa

SEQ ID NO: 2416328 - DNA, 22 bp, Homo sapiens
attcaaggaatttcttaacttc

SEQ ID NO: 2416329 - DNA, 17 bp, Homo sapiens
attcattttttaaattc

SEQ ID NO: 2416330 - DNA, 21 bp, Homo sapiens
attcccgttttgtcacttttt

SEQ ID NO: 2416331 - DNA, 14 bp, Homo sapiens
attggatttcctaa

SEQ ID NO: 2416332 - DNA, 23 bp, Homo sapiens
attggatttcctaatactgtcat

SEQ ID NO: 2416333 - DNA, 17 bp, Homo sapiens
atttacctaagattaca

SEQ ID NO: 2416334 - DNA, 21 bp, Homo sapiens
atttagaagccaactatgatt

SEQ ID NO: 2416335 - DNA, 11 bp, Homo sapiens
atttctattaa

SEQ ID NO: 2416336 - DNA, 19 bp, Homo sapiens
atttcttaacttcttgctt

SEQ ID NO: 2416337 - DNA, 22 bp, Homo sapiens
atttggaaataaagtcagatgg

SEQ ID NO: 2416338 - DNA, 21 bp, Homo sapiens
attttgttggcatagctctgg

SEQ ID NO: 2416339 - DNA, 14 bp, Homo sapiens
caagcacagccctt

SEQ ID NO: 2416340 - DNA, 16 bp, Homo sapiens
cacagtgctcttttct

SEQ ID NO: 2416341 - DNA, 17 bp, Homo sapiens
caccaggcgctaattca

SEQ ID NO: 2416342 - DNA, 16 bp, Homo sapiens
cacctgacacaccagg

SEQ ID NO: 2416343 - DNA, 18 bp, Homo sapiens
cactcagtctctcttctc

SEQ ID NO: 2416344 - DNA, 22 bp, Homo sapiens
cactcccacctgacacaccagg

SEQ ID NO: 2416345 - DNA, 15 bp, Homo sapiens
cactgctctaacagc

SEQ ID NO: 2416346 - DNA, 14 bp, Homo sapiens
cactgtatccaggt

SEQ ID NO: 2416347 - DNA, 14 bp, Homo sapiens
cacttaatgtatgt

SEQ ID NO: 2416348 - DNA, 22 bp, Homo sapiens
actgtcatcctcaaagaaagtg

SEQ ID NO: 2416349 - DNA, 17 bp, Homo sapiens
acttaagcatctggctc

SEQ ID NO: 2416350 - DNA, 15 bp, Homo sapiens
acttaatgtatgtta

SEQ ID NO: 2416351 - DNA, 11 bp, Homo sapiens
acttcttgctt

SEQ ID NO: 2416352 - DNA, 19 bp, Homo sapiens
acttcttgcttctttctag

SEQ ID NO: 2416353 - DNA, 22 bp, Homo sapiens
acttttgtgaattaggctgtaa

SEQ ID NO: 2416354 - DNA, 12 bp, Homo sapiens
actttttctgat

SEQ ID NO: 2416355 - DNA, 23 bp, Homo sapiens
actttttttctgtaccagttaat

SEQ ID NO: 2416356 - DNA, 17 bp, Homo sapiens
agaaacagttggtaact

SEQ ID NO: 2416357 - DNA, 18 bp, Homo sapiens
agaaacagttggtaactt

SEQ ID NO: 2416358 - DNA, 22 bp, Homo sapiens
agaaacagttggtaacttttgt

SEQ ID NO: 2416359 - DNA, 16 bp, Homo sapiens
agaaagtgtatttgga

SEQ ID NO: 2416360 - DNA, 17 bp, Homo sapiens
agaaagtgtatttggaa

SEQ ID NO: 2416361 - DNA, 13 bp, Homo sapiens
agaataaaggcag

SEQ ID NO: 2416362 - DNA, 18 bp, Homo sapiens
agaataaaggcagttttc

SEQ ID NO: 2416363 - DNA, 20 bp, Homo sapiens
agaataaaggcagttttcta

SEQ ID NO: 2416364 - DNA, 21 bp, Homo sapiens
agaataaaggcagttttctaa

SEQ ID NO: 2416365 - DNA, 20 bp, Homo sapiens
agacatccaaactaaaagga

SEQ ID NO: 2416366 - DNA, 14 bp, Homo sapiens
agactagatgtagt

SEQ ID NO: 2416367 - DNA, 17 bp, Homo sapiens
agaggagccaccagttc

SEQ ID NO: 2416368 - DNA, 16 bp, Homo sapiens
agagttacagttctgt

SEQ ID NO: 2416369 - DNA, 22 bp, Homo sapiens
agatggaaaattcattttttaa

SEQ ID NO: 2416370 - DNA, 14 bp, Homo sapiens
agatgtagtatttt

SEQ ID NO: 2416371 - DNA, 12 bp, Homo sapiens
agcacagccctt

SEQ ID NO: 2416372 - DNA, 13 bp, Homo sapiens
agcatctggctct

SEQ ID NO: 2416373 - DNA, 17 bp, Homo sapiens
agccctcctctgcactc

SEQ ID NO: 2416374 - DNA, 21 bp, Homo sapiens
agctctggggtgggcagtttt

SEQ ID NO: 2416375 - DNA, 22 bp, Homo sapiens
agctctggggtgggcagttttt

SEQ ID NO: 2416376 - DNA, 23 bp, Homo sapiens
agctgcaaggtactctggtgagt

SEQ ID NO: 2416377 - DNA, 23 bp, Homo sapiens
aggaatttcttaacttcttgctt

SEQ ID NO: 2416378 - DNA, 22 bp, Homo sapiens
agggtccttttgacactgctct

SEQ ID NO: 2416379 - DNA, 22 bp, Homo sapiens
tagtgccacttaatgtatgtta

SEQ ID NO: 2416380 - DNA, 14 bp, Homo sapiens
tagttaccttatag

SEQ ID NO: 2416381 - DNA, 17 bp, Homo sapiens
tagttaccttatagtta

SEQ ID NO: 2416382 - DNA, 21 bp, Homo sapiens
tagttaccttatagttactgt

SEQ ID NO: 2416383 - DNA, 22 bp, Homo sapiens
tagttaccttatagttactgtg

SEQ ID NO: 2416384 - DNA, 23 bp, Homo sapiens
tagttaccttatagttactgtgt

SEQ ID NO: 2416385 - DNA, 14 bp, Homo sapiens
tataactaacatgt

SEQ ID NO: 2416386 - DNA, 18 bp, Homo sapiens
tataattggatttcctaa

SEQ ID NO: 2416387 - DNA, 18 bp, Homo sapiens
tataatttacctaagatt

SEQ ID NO: 2416388 - DNA, 22 bp, Homo sapiens
tatagttactgtgtaattagtg

SEQ ID NO: 2416389 - DNA, 19 bp, Homo sapiens
tatccaggttccctcccag

SEQ ID NO: 2416390 - DNA, 22 bp, Homo sapiens
tatctaccccagactagatgta

SEQ ID NO: 2416391 - DNA, 22 bp, Homo sapiens
tatgattactggcctttttcat

SEQ ID NO: 2416392 - DNA, 13 bp, Homo sapiens
tatgcggttaatt

SEQ ID NO: 2416393 - DNA, 17 bp, Homo sapiens
tattaatcttagtgtat

SEQ ID NO: 2416394 - DNA, 14 bp, Homo sapiens
tattatctgtcagc

SEQ ID NO: 2416395 - DNA, 20 bp, Homo sapiens
tattggtttaaagaaagtgt

SEQ ID NO: 2416396 - DNA, 19 bp, Homo sapiens
tatttggaaataaagtcag

SEQ ID NO: 2416397 - DNA, 14 bp, Homo sapiens
tattttttgtataa

SEQ ID NO: 2416398 - DNA, 13 bp, Homo sapiens
tcaatcatttcta

SEQ ID NO: 2416399 - DNA, 16 bp, Homo sapiens
tcaatcatttctatta

SEQ ID NO: 2416400 - DNA, 18 bp, Homo sapiens
tcacagtgctcttttctc

SEQ ID NO: 2416401 - DNA, 20 bp, Homo sapiens
tcacagtgctcttttctcct

SEQ ID NO: 2416402 - DNA, 14 bp, Homo sapiens
tcactttttctgat

SEQ ID NO: 2416403 - DNA, 21 bp, Homo sapiens
tcagctgcaaggtactctggt

SEQ ID NO: 2416404 - DNA, 23 bp, Homo sapiens
tcatcctcaaagaaagtgtattg

SEQ ID NO: 2416405 - DNA, 17 bp, Homo sapiens
tcatcttgctaccagta

SEQ ID NO: 2416406 - DNA, 15 bp, Homo sapiens
tcatgttagttacct

SEQ ID NO: 2416407 - DNA, 19 bp, Homo sapiens
tcatgttagttaccttata

SEQ ID NO: 2416408 - DNA, 21 bp, Homo sapiens
tcatttatctataatttacct

SEQ ID NO: 2416409 - DNA, 23 bp, Homo sapiens
ctggctctaattcacagtgctct

SEQ ID NO: 2416410 - DNA, 18 bp, Homo sapiens
ctggggtgggcagttttt

SEQ ID NO: 2416411 - DNA, 21 bp, Homo sapiens
ctgtcatcctcaaagaaagtg

SEQ ID NO: 2416412 - DNA, 23 bp, Homo sapiens
ctgtcatcctcaaagaaagtgta

SEQ ID NO: 2416413 - DNA, 17 bp, Homo sapiens
ctgtctcacctggactt

SEQ ID NO: 2416414 - DNA, 19 bp, Homo sapiens
ctgtggcagagttacagtt

SEQ ID NO: 2416415 - DNA, 15 bp, Homo sapiens
ctgtggtttcatgtt

SEQ ID NO: 2416416 - DNA, 16 bp, Homo sapiens
ctgtttattaatctta

SEQ ID NO: 2416417 - DNA, 15 bp, Homo sapiens
cttaacttcttgctt

SEQ ID NO: 2416418 - DNA, 22 bp, Homo sapiens
cttaacttcttgcttctttcta

SEQ ID NO: 2416419 - DNA, 23 bp, Homo sapiens
cttaagcatctggctctaattca

SEQ ID NO: 2416420 - DNA, 14 bp, Homo sapiens
cttaatgtatgtta

SEQ ID NO: 2416421 - DNA, 15 bp, Homo sapiens
cttagtgtatgatta

SEQ ID NO: 2416422 - DNA, 19 bp, Homo sapiens
cttatagttactgtgtaat

SEQ ID NO: 2416423 - DNA, 17 bp, Homo sapiens
cttatgcggttaatttt

SEQ ID NO: 2416424 - DNA, 15 bp, Homo sapiens
cttctctccagctga

SEQ ID NO: 2416425 - DNA, 18 bp, Homo sapiens
cttctctccagctgacta

SEQ ID NO: 2416426 - DNA, 15 bp, Homo sapiens
cttgcttctttctag

SEQ ID NO: 2416427 - DNA, 16 bp, Homo sapiens
cttttctaacagaaag

SEQ ID NO: 2416428 - DNA, 17 bp, Homo sapiens
cttttgacactgctcta

SEQ ID NO: 2416429 - DNA, 13 bp, Homo sapiens
gaaaattcatttt

SEQ ID NO: 2416430 - DNA, 20 bp, Homo sapiens
gaaacagttggtaacttttg

SEQ ID NO: 2416431 - DNA, 21 bp, Homo sapiens
gaaacagttggtaacttttgt

SEQ ID NO: 2416432 - DNA, 14 bp, Homo sapiens
gaaataaagtcaga

SEQ ID NO: 2416433 - DNA, 17 bp, Homo sapiens
gaataaaggcagttttc

SEQ ID NO: 2416434 - DNA, 20 bp, Homo sapiens
gaataaaggcagttttctaa

SEQ ID NO: 2416435 - DNA, 18 bp, Homo sapiens
gaattaggctgtaactac

SEQ ID NO: 2416436 - DNA, 16 bp, Homo sapiens
gaatttcttaacttct

SEQ ID NO: 2416437 - DNA, 17 bp, Homo sapiens
gaatttcttaacttctt

SEQ ID NO: 2416438 - DNA, 21 bp, Homo sapiens
gaatttcttaacttcttgctt

SEQ ID NO: 2416439 - DNA, 19 bp, Homo sapiens
gactaaactttttttctgt

SEQ ID NO: 2416440 - DNA, 18 bp, Homo sapiens
gactagatgtagtatttt

SEQ ID NO: 2416441 - DNA, 20 bp, Homo sapiens
gacttaagcatctggctcta

SEQ ID NO: 2416442 - DNA, 19 bp, Homo sapiens
gagaaacagttggtaactt

SEQ ID NO: 2416443 - DNA, 13 bp, Homo sapiens
gagccaccagttc

SEQ ID NO: 2416444 - DNA, 21 bp, Homo sapiens
gaggcaattagacactttgga

SEQ ID NO: 2416445 - DNA, 13 bp, Homo sapiens
gagttacagttct

SEQ ID NO: 2416446 - DNA, 13 bp, Homo sapiens
gataaaagatggc

SEQ ID NO: 2416447 - DNA, 23 bp, Homo sapiens
gattacaaatcagaagtcatctt

SEQ ID NO: 2416448 - DNA, 15 bp, Homo sapiens
gcaagcacagccctt

SEQ ID NO: 2416449 - DNA, 18 bp, Homo sapiens
gcactcccacctgacaca

SEQ ID NO: 2416450 - DNA, 21 bp, Homo sapiens
gcagagttacagttctgtggt

SEQ ID NO: 2416451 - DNA, 19 bp, Homo sapiens
gcataacctgtctcacctg

SEQ ID NO: 2416452 - DNA, 11 bp, Homo sapiens
gccaccagttc

SEQ ID NO: 2416453 - DNA, 19 bp, Homo sapiens
gccaccagttctcatgggt

SEQ ID NO: 2416454 - DNA, 13 bp, Homo sapiens
gccacttaatgta

SEQ ID NO: 2416455 - DNA, 16 bp, Homo sapiens
gccacttaatgtatgt

SEQ ID NO: 2416456 - DNA, 21 bp, Homo sapiens
gcctattatctgtcagctgca

SEQ ID NO: 2416457 - DNA, 17 bp, Homo sapiens
gctaattcaaggaattt

SEQ ID NO: 2416458 - DNA, 13 bp, Homo sapiens
gctaccagtattt

SEQ ID NO: 2416459 - DNA, 15 bp, Homo sapiens
gctaccagtatttag

SEQ ID NO: 2416460 - DNA, 18 bp, Homo sapiens
gctaccagtatttagaag

SEQ ID NO: 2416461 - DNA, 22 bp, Homo sapiens
gctaccagtatttagaagccaa

SEQ ID NO: 2416462 - DNA, 18 bp, Homo sapiens
gctctaattcacagtgct

SEQ ID NO: 2416463 - DNA, 19 bp, Homo sapiens
gctctaattcacagtgctc

SEQ ID NO: 2416464 - DNA, 21 bp, Homo sapiens
gctctggggtgggcagttttt

SEQ ID NO: 2416465 - DNA, 15 bp, Homo sapiens
ggagccaccagttct

SEQ ID NO: 2416466 - DNA, 15 bp, Homo sapiens
ggcccaccagggtcc

SEQ ID NO: 2416467 - DNA, 15 bp, Homo sapiens
ggcctttttcattta

SEQ ID NO: 2416468 - DNA, 17 bp, Homo sapiens
ggctctaattcacagtg

SEQ ID NO: 2416469 - DNA, 16 bp, Homo sapiens
ggtccttttgacactg

SEQ ID NO: 2416470 - DNA, 15 bp, Homo sapiens
ggttccttttattag

SEQ ID NO: 2416471 - DNA, 18 bp, Homo sapiens
ggtttaaagaaagtgtat

SEQ ID NO: 2416472 - DNA, 16 bp, Homo sapiens
ggtttcatgttagtta

SEQ ID NO: 2416473 - DNA, 10 bp, Homo sapiens
gtaccagtta

SEQ ID NO: 2416474 - DNA, 23 bp, Homo sapiens
gtaccagttaatttttccaacta

SEQ ID NO: 2416475 - DNA, 20 bp, Homo sapiens
gtatttggaaataaagtcag

SEQ ID NO: 2416476 - DNA, 22 bp, Homo sapiens
gtcatcctcaaagaaagtgtat

SEQ ID NO: 2416477 - DNA, 16 bp, Homo sapiens
gtccttttgacactgc

SEQ ID NO: 2416478 - DNA, 14 bp, Homo sapiens
gtctctcttctctc

SEQ ID NO: 2416479 - DNA, 19 bp, Homo sapiens
gtctctcttctctccagct

SEQ ID NO: 2416480 - DNA, 21 bp, Homo sapiens
gtgaattaggctgtaactact

SEQ ID NO: 2416481 - DNA, 22 bp, Homo sapiens
gtggcactcagtctctcttctc

SEQ ID NO: 2416482 - DNA, 22 bp, Homo sapiens
gttaattttgaagtgctgttta

SEQ ID NO: 2416483 - DNA, 13 bp, Homo sapiens
gttacagttctgt

SEQ ID NO: 2416484 - DNA, 15 bp, Homo sapiens
gttacagttctgtgg

SEQ ID NO: 2416485 - DNA, 15 bp, Homo sapiens
gttaccttatagtta

SEQ ID NO: 2416486 - DNA, 18 bp, Homo sapiens
gttaccttatagttactg

SEQ ID NO: 2416487 - DNA, 17 bp, Homo sapiens
gttagttaccttatagt

SEQ ID NO: 2416488 - DNA, 21 bp, Homo sapiens
gttctgtggtttcatgttagt

SEQ ID NO: 2416489 - DNA, 13 bp, Homo sapiens
gtttaaagaaagt

SEQ ID NO: 2416490 - DNA, 14 bp, Homo sapiens
gtttaaagaaagtg

SEQ ID NO: 2416491 - DNA, 18 bp, Homo sapiens
gtttaaagaaagtgtatt

SEQ ID NO: 2416492 - DNA, 21 bp, Homo sapiens
gtttaaagaaagtgtatttgg

SEQ ID NO: 2416493 - DNA, 14 bp, Homo sapiens
gtttattaatctta

SEQ ID NO: 2416494 - DNA, 15 bp, Homo sapiens
taaagaaagtgtatt

SEQ ID NO: 2416495 - DNA, 16 bp, Homo sapiens
taaagaaagtgtattt

SEQ ID NO: 2416496 - DNA, 20 bp, Homo sapiens
taaagaaagtgtatttggaa

SEQ ID NO: 2416497 - DNA, 20 bp, Homo sapiens
taaatatatctaccccagac

SEQ ID NO: 2416498 - DNA, 18 bp, Homo sapiens
taacagccctcctctgca

SEQ ID NO: 2416499 - DNA, 22 bp, Homo sapiens
taacatgtcctgcctattatct

SEQ ID NO: 2416500 - DNA, 18 bp, Homo sapiens
taacctgtctcacctgga

SEQ ID NO: 2416501 - DNA, 14 bp, Homo sapiens
taactactttataa

SEQ ID NO: 2416502 - DNA, 23 bp, Homo sapiens
taactactttataactaacatgt

SEQ ID NO: 2416503 - DNA, 19 bp, Homo sapiens
taagattacaaatcagaag

SEQ ID NO: 2416504 - DNA, 14 bp, Homo sapiens
taatagaataaagg

SEQ ID NO: 2416505 - DNA, 13 bp, Homo sapiens
taatcttagtgta

SEQ ID NO: 2416506 - DNA, 22 bp, Homo sapiens
taattagtgccacttaatgtat

SEQ ID NO: 2416507 - DNA, 22 bp, Homo sapiens
taattcaaggaatttcttaact

SEQ ID NO: 2416508 - DNA, 21 bp, Homo sapiens
taattcacagtgctcttttct

SEQ ID NO: 2416509 - DNA, 17 bp, Homo sapiens
taattggatttcctaat

SEQ ID NO: 2416510 - DNA, 23 bp, Homo sapiens
taattggatttcctaatactgtc

SEQ ID NO: 2416511 - DNA, 17 bp, Homo sapiens
ctgtggtttcatgttag

SEQ ID NO: 2416512 - DNA, 18 bp, Homo sapiens
ctgtggtttcatgttagt

SEQ ID NO: 2416513 - DNA, 18 bp, Homo sapiens
ctgtttattaatcttagt

SEQ ID NO: 2416514 - DNA, 14 bp, Homo sapiens
cttaacttcttgct

SEQ ID NO: 2416515 - DNA, 16 bp, Homo sapiens
cttatagttactgtgt

SEQ ID NO: 2416516 - DNA, 18 bp, Homo sapiens
cttatagttactgtgtaa

SEQ ID NO: 2416517 - DNA, 21 bp, Homo sapiens
cttatagttactgtgtaatta

SEQ ID NO: 2416518 - DNA, 16 bp, Homo sapiens
cttatgcggttaattt

SEQ ID NO: 2416519 - DNA, 16 bp, Homo sapiens
cttctctccagctgac

SEQ ID NO: 2416520 - DNA, 19 bp, Homo sapiens
cttctctccagctgactaa

SEQ ID NO: 2416521 - DNA, 20 bp, Homo sapiens
cttgctaccagtatttagaa

SEQ ID NO: 2416522 - DNA, 18 bp, Homo sapiens
cttgcttctttctagaaa

SEQ ID NO: 2416523 - DNA, 19 bp, Homo sapiens
cttgcttctttctagaaag

SEQ ID NO: 2416524 - DNA, 18 bp, Homo sapiens
ctttataactaacatgtc

SEQ ID NO: 2416525 - DNA, 20 bp, Homo sapiens
cttttctaacagaaagcatg

SEQ ID NO: 2416526 - DNA, 18 bp, Homo sapiens
cttttgacactgctctaa

SEQ ID NO: 2416527 - DNA, 13 bp, Homo sapiens
ctttttcatttat

SEQ ID NO: 2416528 - DNA, 15 bp, Homo sapiens
ctttttcatttatct

SEQ ID NO: 2416529 - DNA, 19 bp, Homo sapiens
ctttttttctgtaccagtt

SEQ ID NO: 2416530 - DNA, 19 bp, Homo sapiens
gaaacagttggtaactttt

SEQ ID NO: 2416531 - DNA, 15 bp, Homo sapiens
gaaagtgtatttgga

SEQ ID NO: 2416532 - DNA, 23 bp, Homo sapiens
gaaagtgtatttggaaataaagt

SEQ ID NO: 2416533 - DNA, 15 bp, Homo sapiens
gaagtcatcttgcta

SEQ ID NO: 2416534 - DNA, 18 bp, Homo sapiens
gaagtgctgtttattaat

SEQ ID NO: 2416535 - DNA, 15 bp, Homo sapiens
gaataaaggcagttt

SEQ ID NO: 2416536 - DNA, 16 bp, Homo sapiens
gaataaaggcagtttt

SEQ ID NO: 2416537 - DNA, 15 bp, Homo sapiens
gaattaggctgtaac

SEQ ID NO: 2416538 - DNA, 18 bp, Homo sapiens
gaatttcttaacttcttg

SEQ ID NO: 2416539 - DNA, 15 bp, Homo sapiens
gacacaccaggcgct

SEQ ID NO: 2416540 - DNA, 14 bp, Homo sapiens
gacactgctctaac

SEQ ID NO: 2416541 - DNA, 20 bp, Homo sapiens
gacactgctctaacagccct

SEQ ID NO: 2416542 - DNA, 21 bp, Homo sapiens
gacactgctctaacagccctc

SEQ ID NO: 2416543 - DNA, 20 bp, Homo sapiens
gactaaactttttttctgta

SEQ ID NO: 2416544 - DNA, 22 bp, Homo sapiens
gactaaactttttttctgtacc

SEQ ID NO: 2416545 - DNA, 17 bp, Homo sapiens
gactagatgtagtattt

SEQ ID NO: 2416546 - DNA, 22 bp, Homo sapiens
gacttaagcatctggctctaat

SEQ ID NO: 2416547 - DNA, 14 bp, Homo sapiens
gagttacagttctg

SEQ ID NO: 2416548 - DNA, 16 bp, Homo sapiens
gattacaaatcagaag

SEQ ID NO: 2416549 - DNA, 17 bp, Homo sapiens
gattacaaatcagaagt

SEQ ID NO: 2416550 - DNA, 13 bp, Homo sapiens
gatttcctaatac

SEQ ID NO: 2416551 - DNA, 11 bp, Homo sapiens
gcacagccctt

SEQ ID NO: 2416552 - DNA, 17 bp, Homo sapiens
gcactcccacctgacac

SEQ ID NO: 2416553 - DNA, 22 bp, Homo sapiens
gcactcccacctgacacaccag

SEQ ID NO: 2416554 - DNA, 18 bp, Homo sapiens
gcagagttacagttctgt

SEQ ID NO: 2416555 - DNA, 18 bp, Homo sapiens
gccaactatgattattaa

SEQ ID NO: 2416556 - DNA, 14 bp, Homo sapiens
gcctttttcattta

SEQ ID NO: 2416557 - DNA, 18 bp, Homo sapiens
gcctttttcatttatcta

SEQ ID NO: 2416558 - DNA, 22 bp, Homo sapiens
gcgctaattcaaggaatttctt

SEQ ID NO: 2416559 - DNA, 19 bp, Homo sapiens
gctaccagtatttagaagc

SEQ ID NO: 2416560 - DNA, 15 bp, Homo sapiens
gctctaacagccctc

SEQ ID NO: 2416561 - DNA, 20 bp, Homo sapiens
gctgactaaactttttttct

SEQ ID NO: 2416562 - DNA, 12 bp, Homo sapiens
gcttctttctag

SEQ ID NO: 2416563 - DNA, 21 bp, Homo sapiens
gcttctttctagaaagagaaa

SEQ ID NO: 2416564 - DNA, 19 bp, Homo sapiens
ggcagagttacagttctgt

SEQ ID NO: 2416565 - DNA, 19 bp, Homo sapiens
gggtccttttgacactgct

SEQ ID NO: 2416566 - DNA, 24 bp, Homo sapiens
ggtaacttttgtgaattaggctgt

SEQ ID NO: 2416567 - DNA, 12 bp, Homo sapiens
gtaactacttta

SEQ ID NO: 2416568 - DNA, 11 bp, Homo sapiens
gtaccagttaa

SEQ ID NO: 2416569 - DNA, 20 bp, Homo sapiens
gtagtattttttgtataatt

SEQ ID NO: 2416570 - DNA, 20 bp, Homo sapiens
gtataattggatttcctaat

SEQ ID NO: 2416571 - DNA, 19 bp, Homo sapiens
gtcatcctcaaagaaagtg

SEQ ID NO: 2416572 - DNA, 14 bp, Homo sapiens
gtcatcttgctacc

SEQ ID NO: 2416573 - DNA, 15 bp, Homo sapiens
gtccttttgacactg

SEQ ID NO: 2416574 - DNA, 17 bp, Homo sapiens
gtccttttgacactgct

SEQ ID NO: 2416575 - DNA, 20 bp, Homo sapiens
gtccttttgacactgctcta

SEQ ID NO: 2416576 - DNA, 21 bp, Homo sapiens
gtccttttgacactgctctaa

SEQ ID NO: 2416577 - DNA, 19 bp, Homo sapiens
gtctcacctggacttaagc

SEQ ID NO: 2416578 - DNA, 15 bp, Homo sapiens
gtctctcttctctcc

SEQ ID NO: 2416579 - DNA, 20 bp, Homo sapiens
gtctctcttctctccagctg

SEQ ID NO: 2416580 - DNA, 15 bp, Homo sapiens
gtgccacttaatgta

SEQ ID NO: 2416581 - DNA, 18 bp, Homo sapiens
gtgccacttaatgtatgt

SEQ ID NO: 2416582 - DNA, 17 bp, Homo sapiens
gttaattttgaagtgct

SEQ ID NO: 2416583 - DNA, 16 bp, Homo sapiens
gttctgtggtttcatg

SEQ ID NO: 2416584 - DNA, 15 bp, Homo sapiens
gtttaaagaaagtgt

SEQ ID NO: 2416585 - DNA, 22 bp, Homo sapiens
gtttattaatcttagtgtatga

SEQ ID NO: 2416586 - DNA, 21 bp, Homo sapiens
gtttcatgttagttaccttat

SEQ ID NO: 2416587 - DNA, 20 bp, Homo sapiens
taaactttttttctgtacca

SEQ ID NO: 2416588 - DNA, 13 bp, Homo sapiens
taaagaaagtgta

SEQ ID NO: 2416589 - DNA, 24 bp, Homo sapiens
taaagaaagtgtatttggaaataa

SEQ ID NO: 2416590 - DNA, 17 bp, Homo sapiens
taaaggcagttttctaa

SEQ ID NO: 2416591 - DNA, 17 bp, Homo sapiens
taaagtcagatggaaaa

SEQ ID NO: 2416592 - DNA, 11 bp, Homo sapiens
taacagccctc

SEQ ID NO: 2416593 - DNA, 20 bp, Homo sapiens
taacagccctcctctgcact

SEQ ID NO: 2416594 - DNA, 20 bp, Homo sapiens
taacttcttgcttctttcta

SEQ ID NO: 2416595 - DNA, 12 bp, Homo sapiens
taacttttgtga

SEQ ID NO: 2416596 - DNA, 16 bp, Homo sapiens
taacttttgtgaatta

SEQ ID NO: 2416597 - DNA, 18 bp, Homo sapiens
taagcatctggctctaat

SEQ ID NO: 2416598 - DNA, 15 bp, Homo sapiens
taatcttagtgtatg

SEQ ID NO: 2416599 - DNA, 16 bp, Homo sapiens
taatgtatgttaccaa

SEQ ID NO: 2416600 - DNA, 19 bp, Homo sapiens
taattagtgccacttaatg

SEQ ID NO: 2416601 - DNA, 22 bp, Homo sapiens
taattcacagtgctcttttctc

SEQ ID NO: 2416602 - DNA, 13 bp, Homo sapiens
taatttttccaac

SEQ ID NO: 2416603 - DNA, 20 bp, Homo sapiens
tacaaatcagaagtcatctt

SEQ ID NO: 2416604 - DNA, 21 bp, Homo sapiens
taccccagactagatgtagta

SEQ ID NO: 2416605 - DNA, 22 bp, Homo sapiens
tacctaagattacaaatcagaa

SEQ ID NO: 2416606 - DNA, 17 bp, Homo sapiens
taccttatagttactgt

SEQ ID NO: 2416607 - DNA, 18 bp, Homo sapiens
taccttatagttactgtg

SEQ ID NO: 2416608 - DNA, 23 bp, Homo sapiens
tactgtcatcctcaaagaaagtg

SEQ ID NO: 2416609 - DNA, 19 bp, Homo sapiens
tactttataactaacatgt

SEQ ID NO: 2416610 - DNA, 20 bp, Homo sapiens
tactttataactaacatgtc

SEQ ID NO: 2416611 - DNA, 23 bp, Homo sapiens
tactttataactaacatgtcctg

SEQ ID NO: 2416612 - DNA, 16 bp, Homo sapiens
tagaaagagaaacagt

SEQ ID NO: 2416613 - DNA, 14 bp, Homo sapiens
aaagagtctagatt

SEQ ID NO: 2416614 - DNA, 15 bp, Homo sapiens
aaagagtctagattc

SEQ ID NO: 2416615 - DNA, 12 bp, Homo sapiens
aaagataaacac

SEQ ID NO: 2416616 - DNA, 17 bp, Homo sapiens
aaagataaacacaagat

SEQ ID NO: 2416617 - DNA, 20 bp, Homo sapiens
aaagatctgtcctcagcctt

SEQ ID NO: 2416618 - DNA, 13 bp, Homo sapiens
aaagatctgtttt

SEQ ID NO: 2416619 - DNA, 17 bp, Homo sapiens
aaagatgaaagagcagt

SEQ ID NO: 2416620 - DNA, 17 bp, Homo sapiens
aaagatgcactttgctt

SEQ ID NO: 2416621 - DNA, 19 bp, Homo sapiens
aaagatgcactttgcttta

SEQ ID NO: 2416622 - DNA, 23 bp, Homo sapiens
aaagatgcactttgctttaatat

SEQ ID NO: 2416623 - DNA, 18 bp, Homo sapiens
aaagattctatagttcta

SEQ ID NO: 2416624 - DNA, 22 bp, Homo sapiens
aaagattctgaccttaaatgca

SEQ ID NO: 2416625 - DNA, 13 bp, Homo sapiens
aaagattttttaa

SEQ ID NO: 2416626 - DNA, 20 bp, Homo sapiens
aaagattttttaataattta

SEQ ID NO: 2416627 - DNA, 21 bp, Homo sapiens
aaagattttttaataatttag

SEQ ID NO: 2416628 - DNA, 11 bp, Homo sapiens
aaagcaaagca

SEQ ID NO: 2416629 - DNA, 14 bp, Homo sapiens
aaagcaaatcattt

SEQ ID NO: 2416630 - DNA, 14 bp, Homo sapiens
aaagcaagaatcag

SEQ ID NO: 2416631 - DNA, 16 bp, Homo sapiens
aaagcagtatttttct

SEQ ID NO: 2416632 - DNA, 15 bp, Homo sapiens
aaagcatcttgcatt

SEQ ID NO: 2416633 - DNA, 16 bp, Homo sapiens
aaaataaagaaaagat

SEQ ID NO: 2416634 - DNA, 17 bp, Homo sapiens
aaaataaatatatctac

SEQ ID NO: 2416635 - DNA, 13 bp, Homo sapiens
aaaataagcaggt

SEQ ID NO: 2416636 - DNA, 14 bp, Homo sapiens
aaaataattttgta

SEQ ID NO: 2416637 - DNA, 14 bp, Homo sapiens
aaaatacaagactg

SEQ ID NO: 2416638 - DNA, 15 bp, Homo sapiens
aaaatacaagactgc

SEQ ID NO: 2416639 - DNA, 17 bp, Homo sapiens
aaaatacaagactgcca

SEQ ID NO: 2416640 - DNA, 16 bp, Homo sapiens
aaaatacggtgggggt

SEQ ID NO: 2416641 - DNA, 19 bp, Homo sapiens
aaaatagacaaatagaaaa

SEQ ID NO: 2416642 - DNA, 16 bp, Homo sapiens
aaaatagcgttcttgt

SEQ ID NO: 2416643 - DNA, 20 bp, Homo sapiens
aaaatagcgttcttgtaatt

SEQ ID NO: 2416644 - DNA, 20 bp, Homo sapiens
aaaatagctaaatacctcaa

SEQ ID NO: 2416645 - DNA, 13 bp, Homo sapiens
aaaatagtttgga

SEQ ID NO: 2416646 - DNA, 16 bp, Homo sapiens
aaaatagtttggatat

SEQ ID NO: 2416647 - DNA, 13 bp, Homo sapiens
aaaatataaaata

SEQ ID NO: 2416648 - DNA, 10 bp, Homo sapiens
aaaatataac

SEQ ID NO: 2416649 - DNA, 13 bp, Homo sapiens
aaaatatctacat

SEQ ID NO: 2416650 - DNA, 12 bp, Homo sapiens
aaaatattttga

SEQ ID NO: 2416651 - DNA, 21 bp, Homo sapiens
aaaatctcccattttggaatt

SEQ ID NO: 2416652 - DNA, 16 bp, Homo sapiens
aaaatctctccacttt

SEQ ID NO: 2416653 - DNA, 22 bp, Homo sapiens
aaaatctctccactttcagctg

SEQ ID NO: 2416654 - DNA, 20 bp, Homo sapiens
aaaatctgtcacgtagaact

SEQ ID NO: 2416655 - DNA, 21 bp, Homo sapiens
acacaagattggtgttttttt

SEQ ID NO: 2416656 - DNA, 19 bp, Homo sapiens
acacaaggatagatgctgg

SEQ ID NO: 2416657 - DNA, 23 bp, Homo sapiens
acacaaggatagatgctggccca

SEQ ID NO: 2416658 - DNA, 14 bp, Homo sapiens
acacaccaggcgct

SEQ ID NO: 2416659 - DNA, 17 bp, Homo sapiens
acacaccaggcgctaat

SEQ ID NO: 2416660 - DNA, 23 bp, Homo sapiens
acacacggtgcctttatttccac

SEQ ID NO: 2416661 - DNA, 21 bp, Homo sapiens
acacacgtgcgtgcgagcaca

SEQ ID NO: 2416662 - DNA, 18 bp, Homo sapiens
acacagaaaatgttgaga

SEQ ID NO: 2416663 - DNA, 19 bp, Homo sapiens
acacagaaaatgttgagaa

SEQ ID NO: 2416664 - DNA, 20 bp, Homo sapiens
acacagaaaatgttgagaat

SEQ ID NO: 2416665 - DNA, 13 bp, Homo sapiens
acacagaaacctt

SEQ ID NO: 2416666 - DNA, 20 bp, Homo sapiens
acacagcattgtatatgtga

SEQ ID NO: 2416667 - DNA, 17 bp, Homo sapiens
acacagctactctcccc

SEQ ID NO: 2416668 - DNA, 23 bp, Homo sapiens
acacagctactctccccacgagg

SEQ ID NO: 2416669 - DNA, 12 bp, Homo sapiens
acacaggcctgt

SEQ ID NO: 2416670 - DNA, 22 bp, Homo sapiens
acacaggcctgtgtagctgtga

SEQ ID NO: 2416671 - DNA, 12 bp, Homo sapiens
acacagtatttt

SEQ ID NO: 2416672 - DNA, 15 bp, Homo sapiens
acacataccctcttc

SEQ ID NO: 2416673 - DNA, 17 bp, Homo sapiens
acacatacgtgcacagg

SEQ ID NO: 2416674 - DNA, 19 bp, Homo sapiens
acacatacgtgcacagggt

SEQ ID NO: 2416675 - DNA, 15 bp, Homo sapiens
acacatgtatttggt

SEQ ID NO: 2416676 - DNA, 16 bp, Homo sapiens
acacattaggaaaagt

SEQ ID NO: 2416677 - DNA, 21 bp, Homo sapiens
acacattgctgtgaacaggaa

SEQ ID NO: 2416678 - DNA, 20 bp, Homo sapiens
acaccaagcacagcagcctg

SEQ ID NO: 2416679 - DNA, 17 bp, Homo sapiens
acaccactctggcagcc

SEQ ID NO: 2416680 - DNA, 18 bp, Homo sapiens
acaccactctggcagcca

SEQ ID NO: 2416681 - DNA, 22 bp, Homo sapiens
acaccactctggcagccacact

SEQ ID NO: 2416682 - DNA, 18 bp, Homo sapiens
acaccagggccagcctct

SEQ ID NO: 2416683 - DNA, 22 bp, Homo sapiens
acacccttctcccactctccta

SEQ ID NO: 2416684 - DNA, 18 bp, Homo sapiens
acacctattatcccagct

SEQ ID NO: 2416685 - DNA, 19 bp, Homo sapiens
acacctattatcccagctg

SEQ ID NO: 2416686 - DNA, 18 bp, Homo sapiens
acacctccttccctctct

SEQ ID NO: 2416687 - DNA, 16 bp, Homo sapiens
acaccttccagctcct

SEQ ID NO: 2416688 - DNA, 14 bp, Homo sapiens
acacgcacctgcct

SEQ ID NO: 2416689 - DNA, 22 bp, Homo sapiens
acacgcggtttggtttgcagcg

SEQ ID NO: 2416690 - DNA, 20 bp, Homo sapiens
acacggccacatcaaagagg

SEQ ID NO: 2416691 - DNA, 17 bp, Homo sapiens
acacgtgacacaaacac

SEQ ID NO: 2416692 - DNA, 16 bp, Homo sapiens
acactaaccaagctga

SEQ ID NO: 2416693 - DNA, 19 bp, Homo sapiens
acactaatatatttaaaaa

SEQ ID NO: 2416694 - DNA, 20 bp, Homo sapiens
acactaatatatttaaaaat

SEQ ID NO: 2416695 - DNA, 22 bp, Homo sapiens
acactaatatatttaaaaataa

SEQ ID NO: 2416696 - DNA, 13 bp, Homo sapiens
acactaattcata

SEQ ID NO: 2416697 - DNA, 17 bp, Homo sapiens
acactacacactgtgta

SEQ ID NO: 2416698 - DNA, 16 bp, Homo sapiens
acactaccgaatgtgt

SEQ ID NO: 2416699 - DNA, 18 bp, Homo sapiens
acactaccgaatgtgtct

SEQ ID NO: 2416700 - DNA, 19 bp, Homo sapiens
acactaccgaatgtgtctt

SEQ ID NO: 2416701 - DNA, 20 bp, Homo sapiens
acactaccgaatgtgtcttt

SEQ ID NO: 2416702 - DNA, 23 bp, Homo sapiens
acactaccgaatgtgtctttaga

SEQ ID NO: 2416703 - DNA, 19 bp, Homo sapiens
acactcagaagcctggggg

SEQ ID NO: 2416704 - DNA, 21 bp, Homo sapiens
acactcttttgctttattcca

SEQ ID NO: 2416705 - DNA, 23 bp, Homo sapiens
acactgcacaataactcctccca

SEQ ID NO: 2416706 - DNA, 17 bp, Homo sapiens
acactgctctaacagcc

SEQ ID NO: 2416707 - DNA, 18 bp, Homo sapiens
acactggggacttggcct

SEQ ID NO: 2416708 - DNA, 13 bp, Homo sapiens
acactgggtggtg

SEQ ID NO: 2416709 - DNA, 18 bp, Homo sapiens
acactgggtggtggcctg

SEQ ID NO: 2416710 - DNA, 20 bp, Homo sapiens
acactgggtggtggcctggt

SEQ ID NO: 2416711 - DNA, 15 bp, Homo sapiens
acactggtctgctgt

SEQ ID NO: 2416712 - DNA, 20 bp, Homo sapiens
acactgtgcacatctgtgtc

SEQ ID NO: 2416713 - DNA, 23 bp, Homo sapiens
acactgtgtaaatacccatatgt

SEQ ID NO: 2416714 - DNA, 18 bp, Homo sapiens
acactgttcttagctcaa

SEQ ID NO: 2416715 - DNA, 21 bp, Homo sapiens
acactgttcttagctcaatga

SEQ ID NO: 2416716 - DNA, 16 bp, Homo sapiens
acacttcaaactactt

SEQ ID NO: 2416717 - DNA, 20 bp, Homo sapiens
acacttctcaggacacaggc

SEQ ID NO: 2416718 - DNA, 17 bp, Homo sapiens
acacttgtccacatagg

SEQ ID NO: 2416719 - DNA, 16 bp, Homo sapiens
acactttggtaccaga

SEQ ID NO: 2416720 - DNA, 14 bp, Homo sapiens
acagaacttcagaa

SEQ ID NO: 2416721 - DNA, 17 bp, Homo sapiens
acagaacttcagaaaga

SEQ ID NO: 2416722 - DNA, 16 bp, Homo sapiens
acagaagggagggcag

SEQ ID NO: 2416723 - DNA, 17 bp, Homo sapiens
acagaagggagggcaga

SEQ ID NO: 2416724 - DNA, 19 bp, Homo sapiens
acagaagggagggcagagc

SEQ ID NO: 2416725 - DNA, 22 bp, Homo sapiens
acagaagggagggcagagctgg

SEQ ID NO: 2416726 - DNA, 15 bp, Homo sapiens
acagaagtttgcact

SEQ ID NO: 2416727 - DNA, 16 bp, Homo sapiens
acagaattgcttgttt

SEQ ID NO: 2416728 - DNA, 18 bp, Homo sapiens
acagaattttatggtgca

SEQ ID NO: 2416729 - DNA, 21 bp, Homo sapiens
acagacggaagggtaaacaat

SEQ ID NO: 2416730 - DNA, 23 bp, Homo sapiens
acagactatttttagattttctt

SEQ ID NO: 2416731 - DNA, 15 bp, Homo sapiens
acagagaaaccagct

SEQ ID NO: 2416732 - DNA, 17 bp, Homo sapiens
acagagaaaccagcttc

SEQ ID NO: 2416733 - DNA, 20 bp, Homo sapiens
acagagaaaccagcttcctt

SEQ ID NO: 2416734 - DNA, 19 bp, Homo sapiens
acagagaagccagcttgtt

SEQ ID NO: 2416735 - DNA, 12 bp, Homo sapiens
acagagaagcct

SEQ ID NO: 2416736 - DNA, 13 bp, Homo sapiens
acagagaagcctt

SEQ ID NO: 2416737 - DNA, 20 bp, Homo sapiens
acagagaagccttcaagctc

SEQ ID NO: 2416738 - DNA, 17 bp, Homo sapiens
acagagaagtcacaggg

SEQ ID NO: 2416739 - DNA, 12 bp, Homo sapiens
acagagaccaag

SEQ ID NO: 2416740 - DNA, 14 bp, Homo sapiens
acagagagtctgga

SEQ ID NO: 2416741 - DNA, 14 bp, Homo sapiens
acagagcatcagaa

SEQ ID NO: 2416742 - DNA, 16 bp, Homo sapiens
acagagccaggagaag

SEQ ID NO: 2416743 - DNA, 22 bp, Homo sapiens
acagagccaggagaagctcagc

SEQ ID NO: 2416744 - DNA, 17 bp, Homo sapiens
acagaggccccagcctc

SEQ ID NO: 2416745 - DNA, 22 bp, Homo sapiens
acagaggccccagcctccctga

SEQ ID NO: 2416746 - DNA, 15 bp, Homo sapiens
acagaggccctcaag

SEQ ID NO: 2416747 - DNA, 20 bp, Homo sapiens
acagaggccctcaagtcttt

SEQ ID NO: 2416748 - DNA, 16 bp, Homo sapiens
acagagggctgcattc

SEQ ID NO: 2416749 - DNA, 13 bp, Homo sapiens
acagagttgattt

SEQ ID NO: 2416750 - DNA, 12 bp, Homo sapiens
acagatcagtaa

SEQ ID NO: 2416751 - DNA, 22 bp, Homo sapiens
acagatcatcttggaactgcat

SEQ ID NO: 2416752 - DNA, 12 bp, Homo sapiens
acagatctggaa

SEQ ID NO: 2416753 - DNA, 16 bp, Homo sapiens
acagatctggaacctc

SEQ ID NO: 2416754 - DNA, 20 bp, Homo sapiens
acagatctggaacctcagcc

SEQ ID NO: 2416755 - DNA, 14 bp, Homo sapiens
acagatggccagcc

SEQ ID NO: 2416756 - DNA, 15 bp, Homo sapiens
acagatttggaaaga

SEQ ID NO: 2416757 - DNA, 14 bp, Homo sapiens
acagcaaccccagg

SEQ ID NO: 2416758 - DNA, 13 bp, Homo sapiens
aataatgctttga

SEQ ID NO: 2416759 - DNA, 15 bp, Homo sapiens
aataatgctttgaaa

SEQ ID NO: 2416760 - DNA, 21 bp, Homo sapiens
aataatgtgtagttcatgtaa

SEQ ID NO: 2416761 - DNA, 21 bp, Homo sapiens
aataattctgagttttgtgtt

SEQ ID NO: 2416762 - DNA, 12 bp, Homo sapiens
aataattgttgt

SEQ ID NO: 2416763 - DNA, 14 bp, Homo sapiens
aataattgttgttc

SEQ ID NO: 2416764 - DNA, 16 bp, Homo sapiens
aataattgttgttctg

SEQ ID NO: 2416765 - DNA, 17 bp, Homo sapiens
aataattgttgttctgt

SEQ ID NO: 2416766 - DNA, 21 bp, Homo sapiens
aataatttagacttcaagcat

SEQ ID NO: 2416767 - DNA, 13 bp, Homo sapiens
aataatttctaat

SEQ ID NO: 2416768 - DNA, 16 bp, Homo sapiens
aataatttctaatgtt

SEQ ID NO: 2416769 - DNA, 13 bp, Homo sapiens
aataattttgtaa

SEQ ID NO: 2416770 - DNA, 14 bp, Homo sapiens
aataattttgtaat

SEQ ID NO: 2416771 - DNA, 18 bp, Homo sapiens
aatacaaatggattttgg

SEQ ID NO: 2416772 - DNA, 22 bp, Homo sapiens
aatacaagactgccatattaaa

SEQ ID NO: 2416773 - DNA, 13 bp, Homo sapiens
aatacagatatat

SEQ ID NO: 2416774 - DNA, 15 bp, Homo sapiens
aatacagatcatctt

SEQ ID NO: 2416775 - DNA, 16 bp, Homo sapiens
aatacagatcatcttg

SEQ ID NO: 2416776 - DNA, 15 bp, Homo sapiens
aatacaggaaacagt

SEQ ID NO: 2416777 - DNA, 21 bp, Homo sapiens
aatacatgctaagagaagtag

SEQ ID NO: 2416778 - DNA, 23 bp, Homo sapiens
aatacatgctaagagaagtagaa

SEQ ID NO: 2416779 - DNA, 17 bp, Homo sapiens
aatacatttaaaacatt

SEQ ID NO: 2416780 - DNA, 20 bp, Homo sapiens
aatacatttaaaacattaaa

SEQ ID NO: 2416781 - DNA, 19 bp, Homo sapiens
aataccactctgtaattgc

SEQ ID NO: 2416782 - DNA, 20 bp, Homo sapiens
aataccactctgtaattgca

SEQ ID NO: 2416783 - DNA, 21 bp, Homo sapiens
aataccactctgtaattgcaa

SEQ ID NO: 2416784 - DNA, 13 bp, Homo sapiens
aatactaatgaaa

SEQ ID NO: 2416785 - DNA, 18 bp, Homo sapiens
aatactaccttgaaaata

SEQ ID NO: 2416786 - DNA, 15 bp, Homo sapiens
aatactgctgagata

SEQ ID NO: 2416787 - DNA, 16 bp, Homo sapiens
aatactgtattttgta

SEQ ID NO: 2416788 - DNA, 17 bp, Homo sapiens
aatacttcttgtgtgta

SEQ ID NO: 2416789 - DNA, 14 bp, Homo sapiens
aatacttggagggc

SEQ ID NO: 2416790 - DNA, 23 bp, Homo sapiens
aatactttgcagcacagctgaga

SEQ ID NO: 2416791 - DNA, 15 bp, Homo sapiens
aatacttttactctg

SEQ ID NO: 2416792 - DNA, 15 bp, Homo sapiens
aatactttttacaat

SEQ ID NO: 2416793 - DNA, 22 bp, Homo sapiens
aatagaaataaaggatgtgatt

SEQ ID NO: 2416794 - DNA, 15 bp, Homo sapiens
aatagaataaaggca

SEQ ID NO: 2416795 - DNA, 16 bp, Homo sapiens
aatagaataaaggcag

SEQ ID NO: 2416796 - DNA, 19 bp, Homo sapiens
aatagacaaatagaaaatg

SEQ ID NO: 2416797 - DNA, 16 bp, Homo sapiens
aatagacttaaatctc

SEQ ID NO: 2416798 - DNA, 20 bp, Homo sapiens
aatagataagagtagaaact

SEQ ID NO: 2416799 - DNA, 19 bp, Homo sapiens
aatagatgtttgatagatt

SEQ ID NO: 2416800 - DNA, 11 bp, Homo sapiens
aatagattctc

SEQ ID NO: 2416801 - DNA, 21 bp, Homo sapiens
aatagccatatttgtaaaatg

SEQ ID NO: 2416802 - DNA, 16 bp, Homo sapiens
aatagcttatgaaaag

SEQ ID NO: 2416803 - DNA, 16 bp, Homo sapiens
aatagctttaatgata

SEQ ID NO: 2416804 - DNA, 16 bp, Homo sapiens
aataggaattggtttc

SEQ ID NO: 2416805 - DNA, 14 bp, Homo sapiens
aatagtttggatat

SEQ ID NO: 2416806 - DNA, 23 bp, Homo sapiens
aatataaaatatgaagacataaa

SEQ ID NO: 2416807 - DNA, 23 bp, Homo sapiens
aatataaagacgttttataagca

SEQ ID NO: 2416808 - DNA, 15 bp, Homo sapiens
aatataaagttttat

SEQ ID NO: 2416809 - DNA, 19 bp, Homo sapiens
aatataaatgcaaataaca

SEQ ID NO: 2416810 - DNA, 16 bp, Homo sapiens
aatatatattatactt

SEQ ID NO: 2416811 - DNA, 19 bp, Homo sapiens
aatatatattatacttgta

SEQ ID NO: 2416812 - DNA, 13 bp, Homo sapiens
aatatatattatc

SEQ ID NO: 2416813 - DNA, 18 bp, Homo sapiens
aatatatattatcttttc

SEQ ID NO: 2416814 - DNA, 20 bp, Homo sapiens
aatatatctaccccagacta

SEQ ID NO: 2416815 - DNA, 22 bp, Homo sapiens
aatatattattacttgtaaata

SEQ ID NO: 2416816 - DNA, 17 bp, Homo sapiens
aatatccctacatgtat

SEQ ID NO: 2416817 - DNA, 14 bp, Homo sapiens
aatatcctaaacat

SEQ ID NO: 2416818 - DNA, 16 bp, Homo sapiens
aatatcctaaacatca

SEQ ID NO: 2416819 - DNA, 13 bp, Homo sapiens
aatatcctgcttg

SEQ ID NO: 2416820 - DNA, 17 bp, Homo sapiens
aatatctgtaatggtac

SEQ ID NO: 2416821 - DNA, 21 bp, Homo sapiens
aatatggacacttaatactac

SEQ ID NO: 2416822 - DNA, 15 bp, Homo sapiens
aatatggactgctca

SEQ ID NO: 2416823 - DNA, 12 bp, Homo sapiens
aatatgtaccaa

SEQ ID NO: 2416824 - DNA, 19 bp, Homo sapiens
aatatgtaccaagaatctt

SEQ ID NO: 2416825 - DNA, 11 bp, Homo sapiens
aatatgtcagt

SEQ ID NO: 2416826 - DNA, 12 bp, Homo sapiens
aatatgtcctgg

SEQ ID NO: 2416827 - DNA, 16 bp, Homo sapiens
aatattatgagatgct

SEQ ID NO: 2416828 - DNA, 18 bp, Homo sapiens
aatattcatagtttaatt

SEQ ID NO: 2416829 - DNA, 15 bp, Homo sapiens
aatattccctagaaa

SEQ ID NO: 2416830 - DNA, 12 bp, Homo sapiens
aatatttaagac

SEQ ID NO: 2416831 - DNA, 15 bp, Homo sapiens
aatattttaaagaat

SEQ ID NO: 2416832 - DNA, 16 bp, Homo sapiens
aatattttaaagaatt

SEQ ID NO: 2416833 - DNA, 12 bp, Homo sapiens
aatattttcctc

SEQ ID NO: 2416834 - DNA, 12 bp, Homo sapiens
aatcaaaatctc

SEQ ID NO: 2416835 - DNA, 15 bp, Homo sapiens
aatcaaacattttga

SEQ ID NO: 2416836 - DNA, 12 bp, Homo sapiens
aatcaaatgaat

SEQ ID NO: 2416837 - DNA, 18 bp, Homo sapiens
aatcaacttgcttatcaa

SEQ ID NO: 2416838 - DNA, 14 bp, Homo sapiens
aatcaactttactg

SEQ ID NO: 2416839 - DNA, 15 bp, Homo sapiens
aatcaagggtcaggc

SEQ ID NO: 2416840 - DNA, 18 bp, Homo sapiens
aatcaagggtcaggcctt

SEQ ID NO: 2416841 - DNA, 14 bp, Homo sapiens
aatcaatcttgcat

SEQ ID NO: 2416842 - DNA, 18 bp, Homo sapiens
aatcaatcttgcatgtaa

SEQ ID NO: 2416843 - DNA, 20 bp, Homo sapiens
aatcaatcttgcatgtaacg

SEQ ID NO: 2416844 - DNA, 18 bp, Homo sapiens
aatcacatgaattattac

SEQ ID NO: 2416845 - DNA, 15 bp, Homo sapiens
aatcacgctttttga

SEQ ID NO: 2416846 - DNA, 20 bp, Homo sapiens
aatcactctaattaattgta

SEQ ID NO: 2416847 - DNA, 20 bp, Homo sapiens
aatcagaagtcatcttgcta

SEQ ID NO: 2416848 - DNA, 12 bp, Homo sapiens
aatcagactgac

SEQ ID NO: 2416849 - DNA, 16 bp, Homo sapiens
aatcagatagatattc

SEQ ID NO: 2416850 - DNA, 18 bp, Homo sapiens
aatcaggaatattttcca

SEQ ID NO: 2416851 - DNA, 23 bp, Homo sapiens
aatcagttcattagaaatatttt

SEQ ID NO: 2416852 - DNA, 18 bp, Homo sapiens
aatcatataataaatgta

SEQ ID NO: 2416853 - DNA, 21 bp, Homo sapiens
aatcatcaagagaatttgggg

SEQ ID NO: 2416854 - DNA, 20 bp, Homo sapiens
aatcatttctatttctcctc

SEQ ID NO: 2416855 - DNA, 15 bp, Homo sapiens
aatcattttaattat

SEQ ID NO: 2416856 - DNA, 13 bp, Homo sapiens
aatccaaatggcg

SEQ ID NO: 2416857 - DNA, 22 bp, Homo sapiens
aatccaagatattttaaaatct

SEQ ID NO: 2416858 - DNA, 23 bp, Homo sapiens
aatccaagtagataggaagaaag

SEQ ID NO: 2416859 - DNA, 16 bp, Homo sapiens
aatccacatttctaaa

SEQ ID NO: 2416860 - DNA, 11 bp, Homo sapiens
aatcccaaatt

SEQ ID NO: 2416861 - DNA, 18 bp, Homo sapiens
aatcccaaatttgattga

SEQ ID NO: 2416862 - DNA, 18 bp, Homo sapiens
aatccccaacatgcactg

SEQ ID NO: 2416863 - DNA, 14 bp, Homo sapiens
aagattctagatga

SEQ ID NO: 2416864 - DNA, 15 bp, Homo sapiens
aagattctagatgat

SEQ ID NO: 2416865 - DNA, 16 bp, Homo sapiens
aagattctttcccaat

SEQ ID NO: 2416866 - DNA, 19 bp, Homo sapiens
aagattggtgtttttttct

SEQ ID NO: 2416867 - DNA, 20 bp, Homo sapiens
aagattggtgtttttttcta

SEQ ID NO: 2416868 - DNA, 23 bp, Homo sapiens
aagattggtgtttttttctatgg

SEQ ID NO: 2416869 - DNA, 15 bp, Homo sapiens
aagattgttcctgct

SEQ ID NO: 2416870 - DNA, 14 bp, Homo sapiens
aagattttttaata

SEQ ID NO: 2416871 - DNA, 21 bp, Homo sapiens
aagcaaactctaaaattataa

SEQ ID NO: 2416872 - DNA, 15 bp, Homo sapiens
aagcaaagcacagag

SEQ ID NO: 2416873 - DNA, 14 bp, Homo sapiens
aagcaaatcatttg

SEQ ID NO: 2416874 - DNA, 18 bp, Homo sapiens
aagcaaatcgaatgaaat

SEQ ID NO: 2416875 - DNA, 19 bp, Homo sapiens
aagcaaatgtcatgctgcc

SEQ ID NO: 2416876 - DNA, 20 bp, Homo sapiens
aagcaaatgtcatgctgcct

SEQ ID NO: 2416877 - DNA, 20 bp, Homo sapiens
aagcaacattcatagtcttt

SEQ ID NO: 2416878 - DNA, 18 bp, Homo sapiens
aagcaacctcagtaattt

SEQ ID NO: 2416879 - DNA, 20 bp, Homo sapiens
aagcaacctcagtaatttag

SEQ ID NO: 2416880 - DNA, 21 bp, Homo sapiens
aagcaacctcagtaatttaga

SEQ ID NO: 2416881 - DNA, 23 bp, Homo sapiens
aagcaagaatcagagaaggaaca

SEQ ID NO: 2416882 - DNA, 22 bp, Homo sapiens
aagcaagaggccgtggctgctg

SEQ ID NO: 2416883 - DNA, 14 bp, Homo sapiens
aagcaagcaagagg

SEQ ID NO: 2416884 - DNA, 15 bp, Homo sapiens
aagcaagcattcaga

SEQ ID NO: 2416885 - DNA, 19 bp, Homo sapiens
aagcaagcattcagaagaa

SEQ ID NO: 2416886 - DNA, 21 bp, Homo sapiens
aagcaagcattcagaagaaaa

SEQ ID NO: 2416887 - DNA, 13 bp, Homo sapiens
aagcaagcttaat

SEQ ID NO: 2416888 - DNA, 19 bp, Homo sapiens
aagcaatatgcatttaaat

SEQ ID NO: 2416889 - DNA, 11 bp, Homo sapiens
aagcacagcag

SEQ ID NO: 2416890 - DNA, 16 bp, Homo sapiens
aagcacagcagcctgg

SEQ ID NO: 2416891 - DNA, 15 bp, Homo sapiens
aagcacgaaatgtta

SEQ ID NO: 2416892 - DNA, 19 bp, Homo sapiens
aagcagaaagtgcctttca

SEQ ID NO: 2416893 - DNA, 15 bp, Homo sapiens
aagcagaaatccaag

SEQ ID NO: 2416894 - DNA, 15 bp, Homo sapiens
aagcagacagctcca

SEQ ID NO: 2416895 - DNA, 21 bp, Homo sapiens
aagcagaccactgataaaacc

SEQ ID NO: 2416896 - DNA, 12 bp, Homo sapiens
aagcagcagcct

SEQ ID NO: 2416897 - DNA, 21 bp, Homo sapiens
aagcagcagcctcgcccctgg

SEQ ID NO: 2416898 - DNA, 19 bp, Homo sapiens
aagcagcgaccgccccctc

SEQ ID NO: 2416899 - DNA, 20 bp, Homo sapiens
aagcaggtggatctatttca

SEQ ID NO: 2416900 - DNA, 19 bp, Homo sapiens
aagcaggttcccaagctca

SEQ ID NO: 2416901 - DNA, 16 bp, Homo sapiens
aagcaggtttcaagga

SEQ ID NO: 2416902 - DNA, 17 bp, Homo sapiens
aagcaggtttcaaggaa

SEQ ID NO: 2416903 - DNA, 19 bp, Homo sapiens
aagcaggtttcaaggaagt

SEQ ID NO: 2416904 - DNA, 17 bp, Homo sapiens
aagcagtatttttcttg

SEQ ID NO: 2416905 - DNA, 18 bp, Homo sapiens
aagcagtatttttcttga

SEQ ID NO: 2416906 - DNA, 23 bp, Homo sapiens
aagcataaaagatgaaagagcag

SEQ ID NO: 2416907 - DNA, 13 bp, Homo sapiens
aagcataaggccg

SEQ ID NO: 2416908 - DNA, 22 bp, Homo sapiens
aagcatcattatttatgtattg

SEQ ID NO: 2416909 - DNA, 18 bp, Homo sapiens
aagcatctaagttataag

SEQ ID NO: 2416910 - DNA, 23 bp, Homo sapiens
aagcatggcttgaataaggaaat

SEQ ID NO: 2416911 - DNA, 17 bp, Homo sapiens
aagcatgggattattag

SEQ ID NO: 2416912 - DNA, 23 bp, Homo sapiens
aagcatggtcccacatccctggg

SEQ ID NO: 2416913 - DNA, 18 bp, Homo sapiens
aagcattgtaaaataatt

SEQ ID NO: 2416914 - DNA, 22 bp, Homo sapiens
aagcatttaacccccctgtaca

SEQ ID NO: 2416915 - DNA, 12 bp, Homo sapiens
aagcattttgta

SEQ ID NO: 2416916 - DNA, 13 bp, Homo sapiens
aagcattttgtaa

SEQ ID NO: 2416917 - DNA, 23 bp, Homo sapiens
aagccagcaccggaccagcctgg

SEQ ID NO: 2416918 - DNA, 14 bp, Homo sapiens
aagccagcgtcctc

SEQ ID NO: 2416919 - DNA, 11 bp, Homo sapiens
aagccagcttg

SEQ ID NO: 2416920 - DNA, 23 bp, Homo sapiens
aagccagcttgtttacatgctta

SEQ ID NO: 2416921 - DNA, 24 bp, Homo sapiens
aagccaggaatttcccaggaccct

SEQ ID NO: 2416922 - DNA, 15 bp, Homo sapiens
aagccaggtccctct

SEQ ID NO: 2416923 - DNA, 21 bp, Homo sapiens
aagccaggttccacagaggac

SEQ ID NO: 2416924 - DNA, 23 bp, Homo sapiens
aagccaggttccacagaggacac

SEQ ID NO: 2416925 - DNA, 20 bp, Homo sapiens
aagccagtttgggtaaaata

SEQ ID NO: 2416926 - DNA, 23 bp, Homo sapiens
aagccagtttgggtaaaatactt

SEQ ID NO: 2416927 - DNA, 16 bp, Homo sapiens
aagccatcacctcaga

SEQ ID NO: 2416928 - DNA, 16 bp, Homo sapiens
aagcccaccatttggc

SEQ ID NO: 2416929 - DNA, 17 bp, Homo sapiens
aagcccagagggtctgg

SEQ ID NO: 2416930 - DNA, 18 bp, Homo sapiens
aagcccagcccatggaga

SEQ ID NO: 2416931 - DNA, 17 bp, Homo sapiens
aagcccagtgcactgaa

SEQ ID NO: 2416932 - DNA, 16 bp, Homo sapiens
aagcccatcctgacca

SEQ ID NO: 2416933 - DNA, 17 bp, Homo sapiens
aagccccacccaggcca

SEQ ID NO: 2416934 - DNA, 14 bp, Homo sapiens
aagcccccaccgtg

SEQ ID NO: 2416935 - DNA, 20 bp, Homo sapiens
aagcccccaccgtgggcagg

SEQ ID NO: 2416936 - DNA, 12 bp, Homo sapiens
aagcccccagag

SEQ ID NO: 2416937 - DNA, 15 bp, Homo sapiens
aagcccccagagccc

SEQ ID NO: 2416938 - DNA, 19 bp, Homo sapiens
aagcccccagagcccaggc

SEQ ID NO: 2416939 - DNA, 21 bp, Homo sapiens
aagcccccagctaagaacctg

SEQ ID NO: 2416940 - DNA, 22 bp, Homo sapiens
aagcccggctcctggtcaccta

SEQ ID NO: 2416941 - DNA, 15 bp, Homo sapiens
aagcctcaaaacaaa

SEQ ID NO: 2416942 - DNA, 18 bp, Homo sapiens
aagcctcaaaacaaaggc

SEQ ID NO: 2416943 - DNA, 21 bp, Homo sapiens
aagcctcaaggttttaggttc

SEQ ID NO: 2416944 - DNA, 19 bp, Homo sapiens
aagcctcagattccttccc

SEQ ID NO: 2416945 - DNA, 21 bp, Homo sapiens
aagcctcagattccttcccat

SEQ ID NO: 2416946 - DNA, 22 bp, Homo sapiens
aagcctgagtactccacactgc

SEQ ID NO: 2416947 - DNA, 21 bp, Homo sapiens
aagcctggcctacatggttga

SEQ ID NO: 2416948 - DNA, 16 bp, Homo sapiens
aagcctgggggcctgg

SEQ ID NO: 2416949 - DNA, 17 bp, Homo sapiens
aagcctgggggcctggc

SEQ ID NO: 2416950 - DNA, 19 bp, Homo sapiens
aagcctgggggcctggctg

SEQ ID NO: 2416951 - DNA, 21 bp, Homo sapiens
aagcctgggggcctggctggc

SEQ ID NO: 2416952 - DNA, 23 bp, Homo sapiens
aagcctgggggcctggctggctg

SEQ ID NO: 2416953 - DNA, 22 bp, Homo sapiens
aagcctgggtttggtgtatggt

SEQ ID NO: 2416954 - DNA, 20 bp, Homo sapiens
aagcgattctcttgcctcaa

SEQ ID NO: 2416955 - DNA, 14 bp, Homo sapiens
aagcggtgtctctc

SEQ ID NO: 2416956 - DNA, 21 bp, Homo sapiens
aagcggtgtctctcctgcccc

SEQ ID NO: 2416957 - DNA, 22 bp, Homo sapiens
aagcgtgagcttaaaatacaag

SEQ ID NO: 2416958 - DNA, 22 bp, Homo sapiens
aagctaacagggaaggcaggca

SEQ ID NO: 2416959 - DNA, 23 bp, Homo sapiens
aagctaacagggaaggcaggcag

SEQ ID NO: 2416960 - DNA, 14 bp, Homo sapiens
aagctaatttgcat

SEQ ID NO: 2416961 - DNA, 15 bp, Homo sapiens
aagctagacacatga

SEQ ID NO: 2416962 - DNA, 21 bp, Homo sapiens
aagctagacacatgaaggtaa

SEQ ID NO: 2416963 - DNA, 12 bp, Homo sapiens
aagctagtcttt

SEQ ID NO: 2416964 - DNA, 17 bp, Homo sapiens
aagctagtcttttgctt

SEQ ID NO: 2416965 - DNA, 20 bp, Homo sapiens
aagctagtcttttgcttttg

SEQ ID NO: 2416966 - DNA, 21 bp, Homo sapiens
agtagaccttgttacttctga

SEQ ID NO: 2416967 - DNA, 23 bp, Homo sapiens
agtagaccttgttacttctgagg

SEQ ID NO: 2416968 - DNA, 22 bp, Homo sapiens
agtagatgcatttgggtccagg

SEQ ID NO: 2416969 - DNA, 23 bp, Homo sapiens
agtagatgcatttgggtccagga

SEQ ID NO: 2416970 - DNA, 11 bp, Homo sapiens
agtagctgagc

SEQ ID NO: 2416971 - DNA, 13 bp, Homo sapiens
agtagctgagctc

SEQ ID NO: 2416972 - DNA, 17 bp, Homo sapiens
agtaggcatttttacca

SEQ ID NO: 2416973 - DNA, 22 bp, Homo sapiens
agtaggcatttttaccatcact

SEQ ID NO: 2416974 - DNA, 21 bp, Homo sapiens
agtagtccctgcacagtgact

SEQ ID NO: 2416975 - DNA, 17 bp, Homo sapiens
agtataaagaattgtgg

SEQ ID NO: 2416976 - DNA, 14 bp, Homo sapiens
agtattaaaatgta

SEQ ID NO: 2416977 - DNA, 14 bp, Homo sapiens
agtattatatgtac

SEQ ID NO: 2416978 - DNA, 12 bp, Homo sapiens
agtattcttctc

SEQ ID NO: 2416979 - DNA, 18 bp, Homo sapiens
agtattggggtctgaccc

SEQ ID NO: 2416980 - DNA, 15 bp, Homo sapiens
agtatttagaagcca

SEQ ID NO: 2416981 - DNA, 19 bp, Homo sapiens
agtatttagaagccaacta

SEQ ID NO: 2416982 - DNA, 16 bp, Homo sapiens
agtatttcaaattgga

SEQ ID NO: 2416983 - DNA, 21 bp, Homo sapiens
agtatttgggaagtgaagact

SEQ ID NO: 2416984 - DNA, 16 bp, Homo sapiens
agtattttaaaatagc

SEQ ID NO: 2416985 - DNA, 12 bp, Homo sapiens
agtatttttgcc

SEQ ID NO: 2416986 - DNA, 21 bp, Homo sapiens
agtattttttcagtattatat

SEQ ID NO: 2416987 - DNA, 15 bp, Homo sapiens
agtcaacagtaaacc

SEQ ID NO: 2416988 - DNA, 18 bp, Homo sapiens
agtcaacagtaaaccact

SEQ ID NO: 2416989 - DNA, 15 bp, Homo sapiens
agtcaacctgggcaa

SEQ ID NO: 2416990 - DNA, 15 bp, Homo sapiens
agtcaatgacatgaa

SEQ ID NO: 2416991 - DNA, 13 bp, Homo sapiens
agtcacagccacc

SEQ ID NO: 2416992 - DNA, 13 bp, Homo sapiens
agtcacagggcag

SEQ ID NO: 2416993 - DNA, 23 bp, Homo sapiens
agtcactggtctgtttgcatttg

SEQ ID NO: 2416994 - DNA, 12 bp, Homo sapiens
agtcaggaaagg

SEQ ID NO: 2416995 - DNA, 17 bp, Homo sapiens
agtcaggaatggctgca

SEQ ID NO: 2416996 - DNA, 13 bp, Homo sapiens
agtcataattgca

SEQ ID NO: 2416997 - DNA, 17 bp, Homo sapiens
agtcataattgcattga

SEQ ID NO: 2416998 - DNA, 13 bp, Homo sapiens
agtcatccagtct

SEQ ID NO: 2416999 - DNA, 11 bp, Homo sapiens
agtcatcttgc

SEQ ID NO: 2417000 - DNA, 23 bp, Homo sapiens
agtcatcttgctaccagtattta

SEQ ID NO: 2417001 - DNA, 15 bp, Homo sapiens
agtcattggctgtct

SEQ ID NO: 2417002 - DNA, 22 bp, Homo sapiens
agtcatttgctgagcatgtact

SEQ ID NO: 2417003 - DNA, 14 bp, Homo sapiens
agtccacaaaataa

SEQ ID NO: 2417004 - DNA, 14 bp, Homo sapiens
agtccaggtcctgg

SEQ ID NO: 2417005 - DNA, 19 bp, Homo sapiens
agtccaggtcctggtgggg

SEQ ID NO: 2417006 - DNA, 22 bp, Homo sapiens
agtccccacagataactgaaaa

SEQ ID NO: 2417007 - DNA, 20 bp, Homo sapiens
agtcctacaagctaaaatta

SEQ ID NO: 2417008 - DNA, 15 bp, Homo sapiens
agtcctatctgggct

SEQ ID NO: 2417009 - DNA, 20 bp, Homo sapiens
agtcctatctgggcttcctg

SEQ ID NO: 2417010 - DNA, 23 bp, Homo sapiens
agtcctatctgggcttcctggag

SEQ ID NO: 2417011 - DNA, 24 bp, Homo sapiens
agtcctatctgggcttcctggagc

SEQ ID NO: 2417012 - DNA, 17 bp, Homo sapiens
agtcctggatgatacta

SEQ ID NO: 2417013 - DNA, 22 bp, Homo sapiens
agtcctggatgatactaataaa

SEQ ID NO: 2417014 - DNA, 13 bp, Homo sapiens
agtcctgtgaatg

SEQ ID NO: 2417015 - DNA, 20 bp, Homo sapiens
agtcctgtgaatgccactgc

SEQ ID NO: 2417016 - DNA, 16 bp, Homo sapiens
agtcctttttttccat

SEQ ID NO: 2417017 - DNA, 19 bp, Homo sapiens
agtcgatagagctgtatta

SEQ ID NO: 2417018 - DNA, 12 bp, Homo sapiens
agtcggattaga

SEQ ID NO: 2417019 - DNA, 20 bp, Homo sapiens
agtcgtccttactcctgtgg

SEQ ID NO: 2417020 - DNA, 18 bp, Homo sapiens
agtcgtggggtgtgctgg

SEQ ID NO: 2417021 - DNA, 22 bp, Homo sapiens
agtctaaagatggagtttctaa

SEQ ID NO: 2417022 - DNA, 20 bp, Homo sapiens
agtctaaagctggtttaatg

SEQ ID NO: 2417023 - DNA, 13 bp, Homo sapiens
agtctagattctc

SEQ ID NO: 2417024 - DNA, 16 bp, Homo sapiens
agtctagattctctgg

SEQ ID NO: 2417025 - DNA, 19 bp, Homo sapiens
agtctcactttgtcgccca

SEQ ID NO: 2417026 - DNA, 19 bp, Homo sapiens
agtctcagtgaagactatg

SEQ ID NO: 2417027 - DNA, 21 bp, Homo sapiens
agtctcagtttgtgtgtctta

SEQ ID NO: 2417028 - DNA, 20 bp, Homo sapiens
agtctcgtctcttttaccct

SEQ ID NO: 2417029 - DNA, 14 bp, Homo sapiens
agtctctaattcta

SEQ ID NO: 2417030 - DNA, 16 bp, Homo sapiens
agtctctcttctctcc

SEQ ID NO: 2417031 - DNA, 13 bp, Homo sapiens
agtctctgagcag

SEQ ID NO: 2417032 - DNA, 15 bp, Homo sapiens
agtctgaacagctgt

SEQ ID NO: 2417033 - DNA, 18 bp, Homo sapiens
agtctgaacagctgtaat

SEQ ID NO: 2417034 - DNA, 15 bp, Homo sapiens
agtctgaggtcctga

SEQ ID NO: 2417035 - DNA, 15 bp, Homo sapiens
agggtcggtgccttc

SEQ ID NO: 2417036 - DNA, 17 bp, Homo sapiens
agggtctgctctttctc

SEQ ID NO: 2417037 - DNA, 22 bp, Homo sapiens
agggtgagttggcttacctggc

SEQ ID NO: 2417038 - DNA, 12 bp, Homo sapiens
agggtgggaagg

SEQ ID NO: 2417039 - DNA, 15 bp, Homo sapiens
agggtttcaccatgt

SEQ ID NO: 2417040 - DNA, 15 bp, Homo sapiens
agggtttgtgacagg

SEQ ID NO: 2417041 - DNA, 13 bp, Homo sapiens
aggtaaaatgcca

SEQ ID NO: 2417042 - DNA, 20 bp, Homo sapiens
aggtaaataaaaagaaaggc

SEQ ID NO: 2417043 - DNA, 19 bp, Homo sapiens
aggtagctgaaaggggaag

SEQ ID NO: 2417044 - DNA, 14 bp, Homo sapiens
aggtaggccaaggt

SEQ ID NO: 2417045 - DNA, 15 bp, Homo sapiens
aggtatacctcactt

SEQ ID NO: 2417046 - DNA, 21 bp, Homo sapiens
aggtcagcacatctcaacagg

SEQ ID NO: 2417047 - DNA, 15 bp, Homo sapiens
aggtcagccactgtt

SEQ ID NO: 2417048 - DNA, 17 bp, Homo sapiens
aggtcaggccccactcc

SEQ ID NO: 2417049 - DNA, 19 bp, Homo sapiens
aggtccaatgagctttctg

SEQ ID NO: 2417050 - DNA, 20 bp, Homo sapiens
aggtccaatgagctttctga

SEQ ID NO: 2417051 - DNA, 14 bp, Homo sapiens
aggtccacaggtct

SEQ ID NO: 2417052 - DNA, 18 bp, Homo sapiens
aggtccacaggtctagac

SEQ ID NO: 2417053 - DNA, 19 bp, Homo sapiens
aggtccacaggtctagact

SEQ ID NO: 2417054 - DNA, 14 bp, Homo sapiens
aggtccagctctgg

SEQ ID NO: 2417055 - DNA, 23 bp, Homo sapiens
aggtccagctctggaggggaggg

SEQ ID NO: 2417056 - DNA, 19 bp, Homo sapiens
aggtccctgctgccagctt

SEQ ID NO: 2417057 - DNA, 18 bp, Homo sapiens
aggtccggtgttctaaga

SEQ ID NO: 2417058 - DNA, 13 bp, Homo sapiens
aggtcctgagcac

SEQ ID NO: 2417059 - DNA, 17 bp, Homo sapiens
aggtcctgagcactgcc

SEQ ID NO: 2417060 - DNA, 18 bp, Homo sapiens
aggtcctgagcactgcca

SEQ ID NO: 2417061 - DNA, 22 bp, Homo sapiens
aggtcctgagcactgccaggag

SEQ ID NO: 2417062 - DNA, 22 bp, Homo sapiens
aggtcctggtggggcagctcct

SEQ ID NO: 2417063 - DNA, 13 bp, Homo sapiens
aggtctcagcccc

SEQ ID NO: 2417064 - DNA, 14 bp, Homo sapiens
aggtctcatctctt

SEQ ID NO: 2417065 - DNA, 15 bp, Homo sapiens
aggtctcatctcttc

SEQ ID NO: 2417066 - DNA, 17 bp, Homo sapiens
aggtctcatctcttcag

SEQ ID NO: 2417067 - DNA, 19 bp, Homo sapiens
aggtctgggtggggcccag

SEQ ID NO: 2417068 - DNA, 20 bp, Homo sapiens
aggtcttcatcgaatctact

SEQ ID NO: 2417069 - DNA, 21 bp, Homo sapiens
aggtgaaactccagatgccac

SEQ ID NO: 2417070 - DNA, 14 bp, Homo sapiens
aggtgaacattggt

SEQ ID NO: 2417071 - DNA, 19 bp, Homo sapiens
aggtgaccccagggcacag

SEQ ID NO: 2417072 - DNA, 17 bp, Homo sapiens
aggtgaggtcagcacat

SEQ ID NO: 2417073 - DNA, 17 bp, Homo sapiens
aggtgaggtctgttcct

SEQ ID NO: 2417074 - DNA, 18 bp, Homo sapiens
aggtgatccatgtaactg

SEQ ID NO: 2417075 - DNA, 21 bp, Homo sapiens
aggtgatccatgtaactgcct

SEQ ID NO: 2417076 - DNA, 20 bp, Homo sapiens
aggtgcaatttcaaggttct

SEQ ID NO: 2417077 - DNA, 21 bp, Homo sapiens
aggtgcaatttcaaggttcta

SEQ ID NO: 2417078 - DNA, 23 bp, Homo sapiens
aggtgcactgggaggctcccctt

SEQ ID NO: 2417079 - DNA, 13 bp, Homo sapiens
aggtgccactgga

SEQ ID NO: 2417080 - DNA, 12 bp, Homo sapiens
aggtgcccagga

SEQ ID NO: 2417081 - DNA, 13 bp, Homo sapiens
aggtgcccaggag

SEQ ID NO: 2417082 - DNA, 14 bp, Homo sapiens
aggtgcccaggaga

SEQ ID NO: 2417083 - DNA, 15 bp, Homo sapiens
aggtgcccaggagaa

SEQ ID NO: 2417084 - DNA, 23 bp, Homo sapiens
aggtgctaatttgttttggatat

SEQ ID NO: 2417085 - DNA, 20 bp, Homo sapiens
aggtgctacacccttttcca

SEQ ID NO: 2417086 - DNA, 18 bp, Homo sapiens
aggtgctctctttctgtc

SEQ ID NO: 2417087 - DNA, 19 bp, Homo sapiens
aggtgggcactggattagt

SEQ ID NO: 2417088 - DNA, 13 bp, Homo sapiens
aggtggtgtttct

SEQ ID NO: 2417089 - DNA, 14 bp, Homo sapiens
aggtgtcctacaga

SEQ ID NO: 2417090 - DNA, 18 bp, Homo sapiens
aggtgtctcaggctgcct

SEQ ID NO: 2417091 - DNA, 18 bp, Homo sapiens
aggtgttaacattccaag

SEQ ID NO: 2417092 - DNA, 15 bp, Homo sapiens
aggtgttactgtaat

SEQ ID NO: 2417093 - DNA, 21 bp, Homo sapiens
aggtgttgccaaatatgtcct

SEQ ID NO: 2417094 - DNA, 22 bp, Homo sapiens
aggtgttgccaaatatgtcctg

SEQ ID NO: 2417095 - DNA, 13 bp, Homo sapiens
aggttcagccaag

SEQ ID NO: 2417096 - DNA, 13 bp, Homo sapiens
aggttcccactta

SEQ ID NO: 2417097 - DNA, 23 bp, Homo sapiens
aggttccgcttggagcagagggg

SEQ ID NO: 2417098 - DNA, 12 bp, Homo sapiens
aggttctaaagt

SEQ ID NO: 2417099 - DNA, 15 bp, Homo sapiens
aggttctaaagttct

SEQ ID NO: 2417100 - DNA, 19 bp, Homo sapiens
aggttctaaagttctaaga

SEQ ID NO: 2417101 - DNA, 13 bp, Homo sapiens
aggttctccaaca

SEQ ID NO: 2417102 - DNA, 18 bp, Homo sapiens
aggttcttgttggtgcac

SEQ ID NO: 2417103 - DNA, 19 bp, Homo sapiens
aggttggctctgccagtcc

SEQ ID NO: 2417104 - DNA, 20 bp, Homo sapiens
aggtttaaagagtctagatt

SEQ ID NO: 2417105 - DNA, 13 bp, Homo sapiens
aggtttaaatgaa

SEQ ID NO: 2417106 - DNA, 15 bp, Homo sapiens
aggtttaaatgaaca

SEQ ID NO: 2417107 - DNA, 19 bp, Homo sapiens
aggtttaaatgaacaagag

SEQ ID NO: 2417108 - DNA, 20 bp, Homo sapiens
agggagggcagagctggtgc

SEQ ID NO: 2417109 - DNA, 12 bp, Homo sapiens
agggagggctct

SEQ ID NO: 2417110 - DNA, 13 bp, Homo sapiens
agggagggctctg

SEQ ID NO: 2417111 - DNA, 17 bp, Homo sapiens
agggagggctctgaggc

SEQ ID NO: 2417112 - DNA, 15 bp, Homo sapiens
agggagggctgtcat

SEQ ID NO: 2417113 - DNA, 15 bp, Homo sapiens
agggagtctgccagg

SEQ ID NO: 2417114 - DNA, 16 bp, Homo sapiens
agggatggacatcttg

SEQ ID NO: 2417115 - DNA, 17 bp, Homo sapiens
agggattaacctctgca

SEQ ID NO: 2417116 - DNA, 18 bp, Homo sapiens
agggcaaagccaggtccc

SEQ ID NO: 2417117 - DNA, 20 bp, Homo sapiens
agggcaaagccaggtccctc

SEQ ID NO: 2417118 - DNA, 21 bp, Homo sapiens
agggcaaagccaggtccctct

SEQ ID NO: 2417119 - DNA, 18 bp, Homo sapiens
agggcacaggagctacct

SEQ ID NO: 2417120 - DNA, 18 bp, Homo sapiens
agggcactgacggactca

SEQ ID NO: 2417121 - DNA, 13 bp, Homo sapiens
agggcagagctgg

SEQ ID NO: 2417122 - DNA, 16 bp, Homo sapiens
agggcagagctggtgc

SEQ ID NO: 2417123 - DNA, 13 bp, Homo sapiens
agggcagcagcca

SEQ ID NO: 2417124 - DNA, 17 bp, Homo sapiens
agggcagcagccagccc

SEQ ID NO: 2417125 - DNA, 19 bp, Homo sapiens
agggcagcagccagccctg

SEQ ID NO: 2417126 - DNA, 21 bp, Homo sapiens
agggcagcagccagccctgcc

SEQ ID NO: 2417127 - DNA, 14 bp, Homo sapiens
agggcagcagggct

SEQ ID NO: 2417128 - DNA, 15 bp, Homo sapiens
agggcagcagggcta

SEQ ID NO: 2417129 - DNA, 15 bp, Homo sapiens
agggcagccagggag

SEQ ID NO: 2417130 - DNA, 14 bp, Homo sapiens
agggcagcgccagg

SEQ ID NO: 2417131 - DNA, 16 bp, Homo sapiens
agggcagcgccaggct

SEQ ID NO: 2417132 - DNA, 22 bp, Homo sapiens
agggcagtacctgagggtctgt

SEQ ID NO: 2417133 - DNA, 16 bp, Homo sapiens
agggcagttcgcagcc

SEQ ID NO: 2417134 - DNA, 19 bp, Homo sapiens
agggcagttcgcagccacc

SEQ ID NO: 2417135 - DNA, 16 bp, Homo sapiens
agggcataaattattg

SEQ ID NO: 2417136 - DNA, 15 bp, Homo sapiens
agggcatctctgggc

SEQ ID NO: 2417137 - DNA, 18 bp, Homo sapiens
agggcatctctgggctgg

SEQ ID NO: 2417138 - DNA, 22 bp, Homo sapiens
agggcatgccacgtgggctcat

SEQ ID NO: 2417139 - DNA, 21 bp, Homo sapiens
agggccaagcccagcactgct

SEQ ID NO: 2417140 - DNA, 19 bp, Homo sapiens
agggccacatcccactgcc

SEQ ID NO: 2417141 - DNA, 19 bp, Homo sapiens
agggccatgctgaggcctg

SEQ ID NO: 2417142 - DNA, 21 bp, Homo sapiens
agggccatgctgaggcctggg

SEQ ID NO: 2417143 - DNA, 18 bp, Homo sapiens
agggcccagagcccagct

SEQ ID NO: 2417144 - DNA, 15 bp, Homo sapiens
agggccctgtgtctg

SEQ ID NO: 2417145 - DNA, 21 bp, Homo sapiens
agggccggggaactggccaag

SEQ ID NO: 2417146 - DNA, 20 bp, Homo sapiens
agggcctcaaaggcccgctc

SEQ ID NO: 2417147 - DNA, 21 bp, Homo sapiens
agggcctctgtcaattgtacg

SEQ ID NO: 2417148 - DNA, 16 bp, Homo sapiens
agggcggcaggggcct

SEQ ID NO: 2417149 - DNA, 23 bp, Homo sapiens
agggcggcaggggcctggagatc

SEQ ID NO: 2417150 - DNA, 15 bp, Homo sapiens
agggctaccctgagc

SEQ ID NO: 2417151 - DNA, 18 bp, Homo sapiens
agggctaccctgagctga

SEQ ID NO: 2417152 - DNA, 21 bp, Homo sapiens
agggctaccctgagctgaggc

SEQ ID NO: 2417153 - DNA, 24 bp, Homo sapiens
agggctcaatctctgggggctgag

SEQ ID NO: 2417154 - DNA, 11 bp, Homo sapiens
agggctcctgc

SEQ ID NO: 2417155 - DNA, 12 bp, Homo sapiens
agggctcctggg

SEQ ID NO: 2417156 - DNA, 23 bp, Homo sapiens
agggctccttgtgggcctgggct

SEQ ID NO: 2417157 - DNA, 15 bp, Homo sapiens
agggctctcctggct

SEQ ID NO: 2417158 - DNA, 16 bp, Homo sapiens
agggctctcctggctt

SEQ ID NO: 2417159 - DNA, 17 bp, Homo sapiens
agggctctcctggcttc

SEQ ID NO: 2417160 - DNA, 11 bp, Homo sapiens
agggctctgag

SEQ ID NO: 2417161 - DNA, 12 bp, Homo sapiens
agggctctgagg

SEQ ID NO: 2417162 - DNA, 15 bp, Homo sapiens
agggctggaggccca

SEQ ID NO: 2417163 - DNA, 21 bp, Homo sapiens
agggctggaggcccaggctgg

SEQ ID NO: 2417164 - DNA, 19 bp, Homo sapiens
agggctgtaactgccaggc

SEQ ID NO: 2417165 - DNA, 19 bp, Homo sapiens
agggctgtcatctgtgcac

SEQ ID NO: 2417166 - DNA, 18 bp, Homo sapiens
agggctttgttttgcaca

SEQ ID NO: 2417167 - DNA, 16 bp, Homo sapiens
aggggaatcagaactc

SEQ ID NO: 2417168 - DNA, 12 bp, Homo sapiens
aggggaccagga

SEQ ID NO: 2417169 - DNA, 14 bp, Homo sapiens
aggggaccaggagt

SEQ ID NO: 2417170 - DNA, 15 bp, Homo sapiens
aggggaccaggagtg

SEQ ID NO: 2417171 - DNA, 22 bp, Homo sapiens
aggggaccaggagtgggtgggg

SEQ ID NO: 2417172 - DNA, 13 bp, Homo sapiens
aggggacctggaa

SEQ ID NO: 2417173 - DNA, 13 bp, Homo sapiens
aggggagcagagg

SEQ ID NO: 2417174 - DNA, 20 bp, Homo sapiens
aggggagcagaggggcagag

SEQ ID NO: 2417175 - DNA, 24 bp, Homo sapiens
aggggagcccactgtcctgggcct

SEQ ID NO: 2417176 - DNA, 20 bp, Homo sapiens
aggggaggggctcctttcca

SEQ ID NO: 2417177 - DNA, 18 bp, Homo sapiens
aggggatttttatgtctg

SEQ ID NO: 2417178 - DNA, 12 bp, Homo sapiens
aggggcagcccc

SEQ ID NO: 2417179 - DNA, 14 bp, Homo sapiens
aggggccagaggct

SEQ ID NO: 2417180 - DNA, 14 bp, Homo sapiens
aggggcccctctca

SEQ ID NO: 2417181 - DNA, 16 bp, Homo sapiens
aggggcctccatgggc

SEQ ID NO: 2417182 - DNA, 14 bp, Homo sapiens
aggggcctgagcag

SEQ ID NO: 2417183 - DNA, 22 bp, Homo sapiens
aggggcctggagatcctcctgc

SEQ ID NO: 2417184 - DNA, 21 bp, Homo sapiens
aggcatttgcagggtcctctt

SEQ ID NO: 2417185 - DNA, 15 bp, Homo sapiens
aggcatttttaccat

SEQ ID NO: 2417186 - DNA, 14 bp, Homo sapiens
aggccaagaaacgt

SEQ ID NO: 2417187 - DNA, 21 bp, Homo sapiens
aggccaagaaacgtcttctaa

SEQ ID NO: 2417188 - DNA, 17 bp, Homo sapiens
aggccacactcagcaca

SEQ ID NO: 2417189 - DNA, 17 bp, Homo sapiens
aggccacctccccagca

SEQ ID NO: 2417190 - DNA, 19 bp, Homo sapiens
aggccactgtgttccttcc

SEQ ID NO: 2417191 - DNA, 22 bp, Homo sapiens
aggccagaggcccccagcccag

SEQ ID NO: 2417192 - DNA, 14 bp, Homo sapiens
aggccagcaggggc

SEQ ID NO: 2417193 - DNA, 12 bp, Homo sapiens
aggccagcctgg

SEQ ID NO: 2417194 - DNA, 14 bp, Homo sapiens
aggccagcctggcc

SEQ ID NO: 2417195 - DNA, 17 bp, Homo sapiens
aggccagcctggcctcc

SEQ ID NO: 2417196 - DNA, 20 bp, Homo sapiens
aggccagcctggcctcctgc

SEQ ID NO: 2417197 - DNA, 23 bp, Homo sapiens
aggccagctgtggttttcttttg

SEQ ID NO: 2417198 - DNA, 18 bp, Homo sapiens
aggccaggactctgcagc

SEQ ID NO: 2417199 - DNA, 21 bp, Homo sapiens
aggccaggactctgcagcctc

SEQ ID NO: 2417200 - DNA, 21 bp, Homo sapiens
aggccatctgggctcctccag

SEQ ID NO: 2417201 - DNA, 20 bp, Homo sapiens
aggccatggactctgtcctg

SEQ ID NO: 2417202 - DNA, 21 bp, Homo sapiens
aggccatggactctgtcctga

SEQ ID NO: 2417203 - DNA, 22 bp, Homo sapiens
aggccatggactctgtcctgaa

SEQ ID NO: 2417204 - DNA, 18 bp, Homo sapiens
aggcccagccgaccccct

SEQ ID NO: 2417205 - DNA, 16 bp, Homo sapiens
aggcccaggctgggaa

SEQ ID NO: 2417206 - DNA, 17 bp, Homo sapiens
aggcccaggctgggaac

SEQ ID NO: 2417207 - DNA, 15 bp, Homo sapiens
aggccccaaccctgt

SEQ ID NO: 2417208 - DNA, 16 bp, Homo sapiens
aggccccactccttcc

SEQ ID NO: 2417209 - DNA, 17 bp, Homo sapiens
aggccccatgacctcca

SEQ ID NO: 2417210 - DNA, 20 bp, Homo sapiens
agcctcaggggtctgagctc

SEQ ID NO: 2417211 - DNA, 20 bp, Homo sapiens
agcctcagtgaccctggctc

SEQ ID NO: 2417212 - DNA, 14 bp, Homo sapiens
agcctcccaaagtg

SEQ ID NO: 2417213 - DNA, 13 bp, Homo sapiens
agcctcccacccc

SEQ ID NO: 2417214 - DNA, 14 bp, Homo sapiens
agcctcccctgcca

SEQ ID NO: 2417215 - DNA, 16 bp, Homo sapiens
agcctccctgaagcct

SEQ ID NO: 2417216 - DNA, 21 bp, Homo sapiens
agcctcgcaacccgtgccaag

SEQ ID NO: 2417217 - DNA, 20 bp, Homo sapiens
agcctcgcccatccccttga

SEQ ID NO: 2417218 - DNA, 16 bp, Homo sapiens
agcctcgcccctggca

SEQ ID NO: 2417219 - DNA, 19 bp, Homo sapiens
agcctcgcccctggcagag

SEQ ID NO: 2417220 - DNA, 14 bp, Homo sapiens
agcctctcccctgc

SEQ ID NO: 2417221 - DNA, 19 bp, Homo sapiens
agcctctcccctgcctgcc

SEQ ID NO: 2417222 - DNA, 21 bp, Homo sapiens
agcctctcccctgcctgccct

SEQ ID NO: 2417223 - DNA, 22 bp, Homo sapiens
agcctctgcccaggcactgcta

SEQ ID NO: 2417224 - DNA, 22 bp, Homo sapiens
agcctctggcattagaattatt

SEQ ID NO: 2417225 - DNA, 13 bp, Homo sapiens
agcctctgggggg

SEQ ID NO: 2417226 - DNA, 20 bp, Homo sapiens
agcctgagggaaaggccagc

SEQ ID NO: 2417227 - DNA, 21 bp, Homo sapiens
agcctgagggaaaggccagca

SEQ ID NO: 2417228 - DNA, 22 bp, Homo sapiens
agcctgagtactccacactgca

SEQ ID NO: 2417229 - DNA, 16 bp, Homo sapiens
agcctgagtcacctgc

SEQ ID NO: 2417230 - DNA, 19 bp, Homo sapiens
agcctgagtcacctgcaga

SEQ ID NO: 2417231 - DNA, 14 bp, Homo sapiens
agcctgcaggatct

SEQ ID NO: 2417232 - DNA, 23 bp, Homo sapiens
agcctgcaggatctcaccaggca

SEQ ID NO: 2417233 - DNA, 16 bp, Homo sapiens
agcctggacctctgac

SEQ ID NO: 2417234 - DNA, 12 bp, Homo sapiens
agcctggccaga

SEQ ID NO: 2417235 - DNA, 13 bp, Homo sapiens
agcctggcctcct

SEQ ID NO: 2417236 - DNA, 15 bp, Homo sapiens
agcctggcctcctgc

SEQ ID NO: 2417237 - DNA, 20 bp, Homo sapiens
agcctggcctcctgcctcta

SEQ ID NO: 2417238 - DNA, 21 bp, Homo sapiens
agcctgggcctatggagagcc

SEQ ID NO: 2417239 - DNA, 22 bp, Homo sapiens
agcctgggcctatggagagccc

SEQ ID NO: 2417240 - DNA, 24 bp, Homo sapiens
agcctgggcctatggagagccctg

SEQ ID NO: 2417241 - DNA, 22 bp, Homo sapiens
agcctgggcgtacagagcacat

SEQ ID NO: 2417242 - DNA, 15 bp, Homo sapiens
agcctggggctctaa

SEQ ID NO: 2417243 - DNA, 21 bp, Homo sapiens
agcctggggctctaacgcctg

SEQ ID NO: 2417244 - DNA, 14 bp, Homo sapiens
agcctgggggcctg

SEQ ID NO: 2417245 - DNA, 19 bp, Homo sapiens
agcctgggggcctggctgg

SEQ ID NO: 2417246 - DNA, 23 bp, Homo sapiens
agcctgggggcctggctggctga

SEQ ID NO: 2417247 - DNA, 20 bp, Homo sapiens
agcctgtcagatccaggagc

SEQ ID NO: 2417248 - DNA, 17 bp, Homo sapiens
agcctgtcctgcctgtg

SEQ ID NO: 2417249 - DNA, 18 bp, Homo sapiens
agcctgtcctgtcatcat

SEQ ID NO: 2417250 - DNA, 17 bp, Homo sapiens
agcctgtgaacccagga

SEQ ID NO: 2417251 - DNA, 19 bp, Homo sapiens
agcctgtgacataccccct

SEQ ID NO: 2417252 - DNA, 22 bp, Homo sapiens
agcctgtgacataccccctccc

SEQ ID NO: 2417253 - DNA, 14 bp, Homo sapiens
agcctgttcatggc

SEQ ID NO: 2417254 - DNA, 20 bp, Homo sapiens
agccttagctctcccaactc

SEQ ID NO: 2417255 - DNA, 15 bp, Homo sapiens
agccttcaagctctg

SEQ ID NO: 2417256 - DNA, 17 bp, Homo sapiens
agccttcaagctctgag

SEQ ID NO: 2417257 - DNA, 18 bp, Homo sapiens
agccttcaagctctgagg

SEQ ID NO: 2417258 - DNA, 16 bp, Homo sapiens
agccttcccctacccc

SEQ ID NO: 2417259 - DNA, 14 bp, Homo sapiens
agccttgccagaga

SEQ ID NO: 2417260 - DNA, 19 bp, Homo sapiens
agccttgccagagatccaa

SEQ ID NO: 2417261 - DNA, 12 bp, Homo sapiens
agccttgcttgt

SEQ ID NO: 2417262 - DNA, 15 bp, Homo sapiens
agcctttctctcttt

SEQ ID NO: 2417263 - DNA, 15 bp, Homo sapiens
agcctttgcctcccc

SEQ ID NO: 2417264 - DNA, 14 bp, Homo sapiens
agcctttgttcccc

SEQ ID NO: 2417265 - DNA, 21 bp, Homo sapiens
agcctttgttccccactggag

SEQ ID NO: 2417266 - DNA, 24 bp, Homo sapiens
agcctttgttccccactggagcag

SEQ ID NO: 2417267 - DNA, 16 bp, Homo sapiens
agccttttttccccag

SEQ ID NO: 2417268 - DNA, 19 bp, Homo sapiens
agccttttttccccagact

SEQ ID NO: 2417269 - DNA, 16 bp, Homo sapiens
agcgaccgccccctcc

SEQ ID NO: 2417270 - DNA, 20 bp, Homo sapiens
agcgaggagatgctccttgg

SEQ ID NO: 2417271 - DNA, 15 bp, Homo sapiens
agcgagggcgtgtct

SEQ ID NO: 2417272 - DNA, 21 bp, Homo sapiens
agcgagtggagtctgccaccc

SEQ ID NO: 2417273 - DNA, 12 bp, Homo sapiens
agcgccaggctg

SEQ ID NO: 2417274 - DNA, 22 bp, Homo sapiens
agcgcccaaaggacgcactgag

SEQ ID NO: 2417275 - DNA, 14 bp, Homo sapiens
agcgcccagctcct

SEQ ID NO: 2417276 - DNA, 16 bp, Homo sapiens
agcgccctgcagaccc

SEQ ID NO: 2417277 - DNA, 17 bp, Homo sapiens
agcgccctgcagaccct

SEQ ID NO: 2417278 - DNA, 20 bp, Homo sapiens
agcgccctgcagaccctgcc

SEQ ID NO: 2417279 - DNA, 14 bp, Homo sapiens
agcggaggtgtgga

SEQ ID NO: 2417280 - DNA, 14 bp, Homo sapiens
agcggcagatgggg

SEQ ID NO: 2417281 - DNA, 15 bp, Homo sapiens
agcggcatcaggctt

SEQ ID NO: 2417282 - DNA, 18 bp, Homo sapiens
agcggccctgtcatccag

SEQ ID NO: 2417283 - DNA, 21 bp, Homo sapiens
agcgggggagggtaggcagga

SEQ ID NO: 2417284 - DNA, 18 bp, Homo sapiens
agcgggggcctaaaaaaa

SEQ ID NO: 2417285 - DNA, 16 bp, Homo sapiens
agcgggtctgctccca

SEQ ID NO: 2417286 - DNA, 15 bp, Homo sapiens
agcgtcctcctctgt

SEQ ID NO: 2417287 - DNA, 16 bp, Homo sapiens
agcgtcctcctctgtg

SEQ ID NO: 2417288 - DNA, 18 bp, Homo sapiens
agcgtctttcttttttgg

SEQ ID NO: 2417289 - DNA, 15 bp, Homo sapiens
agcgtgagctgagca

SEQ ID NO: 2417290 - DNA, 11 bp, Homo sapiens
agcgttcttgt

SEQ ID NO: 2417291 - DNA, 16 bp, Homo sapiens
agctaacagggaaggc

SEQ ID NO: 2417292 - DNA, 19 bp, Homo sapiens
agctggtgtagctacagag

SEQ ID NO: 2417293 - DNA, 21 bp, Homo sapiens
agctggtgtagctacagagaa

SEQ ID NO: 2417294 - DNA, 20 bp, Homo sapiens
agctggtttaatgttttggc

SEQ ID NO: 2417295 - DNA, 22 bp, Homo sapiens
agctgtaaacttccaatttcta

SEQ ID NO: 2417296 - DNA, 18 bp, Homo sapiens
agctgtcctttttcctct

SEQ ID NO: 2417297 - DNA, 23 bp, Homo sapiens
agctgtcctttttcctctccaca

SEQ ID NO: 2417298 - DNA, 14 bp, Homo sapiens
agctgtgacctgct

SEQ ID NO: 2417299 - DNA, 18 bp, Homo sapiens
agctgtgacctgctgagc

SEQ ID NO: 2417300 - DNA, 19 bp, Homo sapiens
agctgtgacctgctgagct

SEQ ID NO: 2417301 - DNA, 23 bp, Homo sapiens
agctgtgacctgctgagctctga

SEQ ID NO: 2417302 - DNA, 19 bp, Homo sapiens
agctgtgagttctccctgt

SEQ ID NO: 2417303 - DNA, 19 bp, Homo sapiens
agctgtgcttatggtacca

SEQ ID NO: 2417304 - DNA, 21 bp, Homo sapiens
agctgtggcagagttacagtt

SEQ ID NO: 2417305 - DNA, 22 bp, Homo sapiens
agctgtggcagagttacagttc

SEQ ID NO: 2417306 - DNA, 14 bp, Homo sapiens
agctgttttgttga

SEQ ID NO: 2417307 - DNA, 13 bp, Homo sapiens
agcttaaaacttt

SEQ ID NO: 2417308 - DNA, 15 bp, Homo sapiens
agcttaaaatacaag

SEQ ID NO: 2417309 - DNA, 17 bp, Homo sapiens
agcttaaaatacaagac

SEQ ID NO: 2417310 - DNA, 18 bp, Homo sapiens
agcttaaaatacaagact

SEQ ID NO: 2417311 - DNA, 20 bp, Homo sapiens
agcttaaaatacaagactgc

SEQ ID NO: 2417312 - DNA, 18 bp, Homo sapiens
agcttagctttagaaaca

SEQ ID NO: 2417313 - DNA, 19 bp, Homo sapiens
agcttagctttagaaacag

SEQ ID NO: 2417314 - DNA, 15 bp, Homo sapiens
agcttatgaaaagaa

SEQ ID NO: 2417315 - DNA, 19 bp, Homo sapiens
actttaacataagctattt

SEQ ID NO: 2417316 - DNA, 20 bp, Homo sapiens
actttacacaatagaattat

SEQ ID NO: 2417317 - DNA, 11 bp, Homo sapiens
actttactgta

SEQ ID NO: 2417318 - DNA, 15 bp, Homo sapiens
actttagaagcctgc

SEQ ID NO: 2417319 - DNA, 22 bp, Homo sapiens
actttcagctgtcttttggagg

SEQ ID NO: 2417320 - DNA, 20 bp, Homo sapiens
actttcattccttcagattt

SEQ ID NO: 2417321 - DNA, 15 bp, Homo sapiens
actttccattacaag

SEQ ID NO: 2417322 - DNA, 22 bp, Homo sapiens
actttctttctcactaaatctt

SEQ ID NO: 2417323 - DNA, 15 bp, Homo sapiens
actttcttttctgga

SEQ ID NO: 2417324 - DNA, 18 bp, Homo sapiens
actttgaaaggagatgtc

SEQ ID NO: 2417325 - DNA, 14 bp, Homo sapiens
actttgaatgtgtt

SEQ ID NO: 2417326 - DNA, 22 bp, Homo sapiens
actttgacctaaattatttact

SEQ ID NO: 2417327 - DNA, 23 bp, Homo sapiens
actttgcagccggcacagggtct

SEQ ID NO: 2417328 - DNA, 21 bp, Homo sapiens
actttgctaaagacatgaagc

SEQ ID NO: 2417329 - DNA, 15 bp, Homo sapiens
actttgctttaatat

SEQ ID NO: 2417330 - DNA, 16 bp, Homo sapiens
actttgctttaatata

SEQ ID NO: 2417331 - DNA, 22 bp, Homo sapiens
actttgctttaatataaatgca

SEQ ID NO: 2417332 - DNA, 22 bp, Homo sapiens
actttggagtcccctcacctcc

SEQ ID NO: 2417333 - DNA, 23 bp, Homo sapiens
actttggagtcccctcacctcct

SEQ ID NO: 2417334 - DNA, 19 bp, Homo sapiens
actttggcttataattctt

SEQ ID NO: 2417335 - DNA, 21 bp, Homo sapiens
actttggcttataattctttc

SEQ ID NO: 2417336 - DNA, 17 bp, Homo sapiens
actttggtaccagataa

SEQ ID NO: 2417337 - DNA, 22 bp, Homo sapiens
actttggtaccagataactttt

SEQ ID NO: 2417338 - DNA, 14 bp, Homo sapiens
acttttcccactcc

SEQ ID NO: 2417339 - DNA, 15 bp, Homo sapiens
acttttgccctttga

SEQ ID NO: 2417340 - DNA, 11 bp, Homo sapiens
actttttacaa

SEQ ID NO: 2417341 - DNA, 15 bp, Homo sapiens
actttttatatatat

SEQ ID NO: 2417342 - DNA, 22 bp, Homo sapiens
actttttttttttaagagtaaa

SEQ ID NO: 2417343 - DNA, 14 bp, Homo sapiens
agaaaaaaatgtat

SEQ ID NO: 2417344 - DNA, 18 bp, Homo sapiens
agaaaaaaatgtatttta

SEQ ID NO: 2417345 - DNA, 23 bp, Homo sapiens
agaaaaaaatgtattttatgtta

SEQ ID NO: 2417346 - DNA, 14 bp, Homo sapiens
agaaaaaaattgaa

SEQ ID NO: 2417347 - DNA, 13 bp, Homo sapiens
agaaaaacaggca

SEQ ID NO: 2417348 - DNA, 13 bp, Homo sapiens
agaaaaataaaga

SEQ ID NO: 2417349 - DNA, 14 bp, Homo sapiens
agaaaaataaagaa

SEQ ID NO: 2417350 - DNA, 21 bp, Homo sapiens
agaaaacaaaactgcatttca

SEQ ID NO: 2417351 - DNA, 13 bp, Homo sapiens
agaaaacatgttt

SEQ ID NO: 2417352 - DNA, 20 bp, Homo sapiens
agaaaacccttgggccagaa

SEQ ID NO: 2417353 - DNA, 12 bp, Homo sapiens
agaaaagatgca

SEQ ID NO: 2417354 - DNA, 15 bp, Homo sapiens
agaaaagatgcactt

SEQ ID NO: 2417355 - DNA, 22 bp, Homo sapiens
agaaaataaggcacccatctgt

SEQ ID NO: 2417356 - DNA, 16 bp, Homo sapiens
agaaaatgatacagca

SEQ ID NO: 2417357 - DNA, 16 bp, Homo sapiens
agaaaatgttgagaat

SEQ ID NO: 2417358 - DNA, 13 bp, Homo sapiens
agaaacaaagatg

SEQ ID NO: 2417359 - DNA, 17 bp, Homo sapiens
agaaacaaagatgttat

SEQ ID NO: 2417360 - DNA, 14 bp, Homo sapiens
agaaacaacactgt

SEQ ID NO: 2417361 - DNA, 16 bp, Homo sapiens
agaaacaacactgtag

SEQ ID NO: 2417362 - DNA, 19 bp, Homo sapiens
agaaacagttggtaacttt

SEQ ID NO: 2417363 - DNA, 15 bp, Homo sapiens
agaaacctactgccc

SEQ ID NO: 2417364 - DNA, 23 bp, Homo sapiens
agaaacctactgcccaggcactg

SEQ ID NO: 2417365 - DNA, 18 bp, Homo sapiens
agaaacctttttaaaaat

SEQ ID NO: 2417366 - DNA, 16 bp, Homo sapiens
agaaacgtcttctaaa

SEQ ID NO: 2417367 - DNA, 12 bp, Homo sapiens
agaaagacttgg

SEQ ID NO: 2417368 - DNA, 22 bp, Homo sapiens
agaaagacttggttggtagggt

SEQ ID NO: 2417369 - DNA, 17 bp, Homo sapiens
agaaagagaaacagttg

SEQ ID NO: 2417370 - DNA, 20 bp, Homo sapiens
agaaagaggtgaccccaggg

SEQ ID NO: 2417371 - DNA, 17 bp, Homo sapiens
agaaagccccacccagg

SEQ ID NO: 2417372 - DNA, 12 bp, Homo sapiens
agaaagcctgag

SEQ ID NO: 2417373 - DNA, 19 bp, Homo sapiens
agaaagcctgggtgacatt

SEQ ID NO: 2417374 - DNA, 16 bp, Homo sapiens
agaaagctgacttggc

SEQ ID NO: 2417375 - DNA, 22 bp, Homo sapiens
agaaaggaagcattgtaaaata

SEQ ID NO: 2417376 - DNA, 13 bp, Homo sapiens
agaaagggagggc

SEQ ID NO: 2417377 - DNA, 17 bp, Homo sapiens
agaaagggagggctctg

SEQ ID NO: 2417378 - DNA, 21 bp, Homo sapiens
agaaagggagggctctgaggc

SEQ ID NO: 2417379 - DNA, 23 bp, Homo sapiens
agaaagggccctgggcctgcctc

SEQ ID NO: 2417380 - DNA, 16 bp, Homo sapiens
agaaaggggagcccac

SEQ ID NO: 2417381 - DNA, 21 bp, Homo sapiens
agaaagtgcctttcaggatct

SEQ ID NO: 2417382 - DNA, 22 bp, Homo sapiens
agaaagtgcctttcaggatcta

SEQ ID NO: 2417383 - DNA, 23 bp, Homo sapiens
agaaagtggaaaacaaggaagtc

SEQ ID NO: 2417384 - DNA, 17 bp, Homo sapiens
agaaataaaaggaagcc

SEQ ID NO: 2417385 - DNA, 18 bp, Homo sapiens
agaaataaaaggaagcca

SEQ ID NO: 2417386 - DNA, 19 bp, Homo sapiens
agaaataaaaggaagccaa

SEQ ID NO: 2417387 - DNA, 13 bp, Homo sapiens
agaaataagtttt

SEQ ID NO: 2417388 - DNA, 16 bp, Homo sapiens
agaaatagaattataa

SEQ ID NO: 2417389 - DNA, 15 bp, Homo sapiens
agaaatagtcggtga

SEQ ID NO: 2417390 - DNA, 20 bp, Homo sapiens
agaaatatcttcacttgtca

SEQ ID NO: 2417391 - DNA, 21 bp, Homo sapiens
agaaatatgcacaatagcagt

SEQ ID NO: 2417392 - DNA, 14 bp, Homo sapiens
agaaatatggacac

SEQ ID NO: 2417393 - DNA, 15 bp, Homo sapiens
agaaatattttaaaa

SEQ ID NO: 2417394 - DNA, 19 bp, Homo sapiens
agaaatattttaaaatcag

SEQ ID NO: 2417395 - DNA, 22 bp, Homo sapiens
agaaatcattttgcaatccctt

SEQ ID NO: 2417396 - DNA, 22 bp, Homo sapiens
agaaatctatagaactgaatga

SEQ ID NO: 2417397 - DNA, 21 bp, Homo sapiens
agaaatgccaagcacttcttt

SEQ ID NO: 2417398 - DNA, 15 bp, Homo sapiens
agaaatgcttagaaa

SEQ ID NO: 2417399 - DNA, 18 bp, Homo sapiens
agaaattacctgtggata

SEQ ID NO: 2417400 - DNA, 18 bp, Homo sapiens
agaaattcgtgtgttttt

SEQ ID NO: 2417401 - DNA, 23 bp, Homo sapiens
agaaattcgtgtgtttttttatg

SEQ ID NO: 2417402 - DNA, 16 bp, Homo sapiens
agaaattgaatacttt

SEQ ID NO: 2417403 - DNA, 14 bp, Homo sapiens
agaaattgtatatt

SEQ ID NO: 2417404 - DNA, 16 bp, Homo sapiens
agaaattgtatattgt

SEQ ID NO: 2417405 - DNA, 16 bp, Homo sapiens
agaaatttaaactata

SEQ ID NO: 2417406 - DNA, 24 bp, Homo sapiens
agaaatttaaactataagcaagaa

SEQ ID NO: 2417407 - DNA, 17 bp, Homo sapiens
agaaatttaattcagaa

SEQ ID NO: 2417408 - DNA, 15 bp, Homo sapiens
agaacaatgtgctat

SEQ ID NO: 2417409 - DNA, 23 bp, Homo sapiens
agcacatctcaacaggcctcagg

SEQ ID NO: 2417410 - DNA, 17 bp, Homo sapiens
agcaccggaccagcctg

SEQ ID NO: 2417411 - DNA, 18 bp, Homo sapiens
agcaccggaccagcctgg

SEQ ID NO: 2417412 - DNA, 15 bp, Homo sapiens
agcaccgttctgtgc

SEQ ID NO: 2417413 - DNA, 17 bp, Homo sapiens
agcaccgttctgtgcac

SEQ ID NO: 2417414 - DNA, 17 bp, Homo sapiens
agcacctccaaccaaat

SEQ ID NO: 2417415 - DNA, 18 bp, Homo sapiens
agcacctgccctacctgc

SEQ ID NO: 2417416 - DNA, 15 bp, Homo sapiens
agcacctgctgtctg

SEQ ID NO: 2417417 - DNA, 16 bp, Homo sapiens
agcactgccaggaggg

SEQ ID NO: 2417418 - DNA, 19 bp, Homo sapiens
agcactgcctgctcccatc

SEQ ID NO: 2417419 - DNA, 20 bp, Homo sapiens
agcactgcctgctcccatcc

SEQ ID NO: 2417420 - DNA, 21 bp, Homo sapiens
agcactgcctgctcccatcct

SEQ ID NO: 2417421 - DNA, 22 bp, Homo sapiens
agcactgtcccttgcctcaatg

SEQ ID NO: 2417422 - DNA, 13 bp, Homo sapiens
agcagaagcagca

SEQ ID NO: 2417423 - DNA, 23 bp, Homo sapiens
agcagaaggggagatggacgaca

SEQ ID NO: 2417424 - DNA, 14 bp, Homo sapiens
agcagacagagcca

SEQ ID NO: 2417425 - DNA, 16 bp, Homo sapiens
agcagacagagccagg

SEQ ID NO: 2417426 - DNA, 18 bp, Homo sapiens
agcagagctaggtggaaa

SEQ ID NO: 2417427 - DNA, 14 bp, Homo sapiens
agatggcactttga

SEQ ID NO: 2417428 - DNA, 14 bp, Homo sapiens
agatggcagctttt

SEQ ID NO: 2417429 - DNA, 21 bp, Homo sapiens
agatggcagcttttaaaagat

SEQ ID NO: 2417430 - DNA, 21 bp, Homo sapiens
agatggcataacctgtctcac

SEQ ID NO: 2417431 - DNA, 17 bp, Homo sapiens
agatggctcccaggggc

SEQ ID NO: 2417432 - DNA, 22 bp, Homo sapiens
agatgggcttcccaagggctgc

SEQ ID NO: 2417433 - DNA, 19 bp, Homo sapiens
agatggggaccagcagccc

SEQ ID NO: 2417434 - DNA, 23 bp, Homo sapiens
agatgggggaaagcaaagcacag

SEQ ID NO: 2417435 - DNA, 13 bp, Homo sapiens
agatgtaattttg

SEQ ID NO: 2417436 - DNA, 15 bp, Homo sapiens
agatgtaggagggac

SEQ ID NO: 2417437 - DNA, 14 bp, Homo sapiens
agatgtagtatttt

SEQ ID NO: 2417438 - DNA, 23 bp, Homo sapiens
agatgtcatttagttcagcatcc

SEQ ID NO: 2417439 - DNA, 22 bp, Homo sapiens
agatgtcttttcccatttatct

SEQ ID NO: 2417440 - DNA, 20 bp, Homo sapiens
agatgtgatattctaagact

SEQ ID NO: 2417441 - DNA, 18 bp, Homo sapiens
agatgtgtgttgatactg

SEQ ID NO: 2417442 - DNA, 13 bp, Homo sapiens
acagcaccaaatc

SEQ ID NO: 2417443 - DNA, 14 bp, Homo sapiens
acagcagcatctct

SEQ ID NO: 2417444 - DNA, 14 bp, Homo sapiens
acagcatctccaag

SEQ ID NO: 2417445 - DNA, 21 bp, Homo sapiens
acagcatgtacggattttcag

SEQ ID NO: 2417446 - DNA, 22 bp, Homo sapiens
acagcatgtacggattttcagt

SEQ ID NO: 2417447 - DNA, 21 bp, Homo sapiens
acagccaacacgcacctgcct

SEQ ID NO: 2417448 - DNA, 24 bp, Homo sapiens
acagccaacacgcacctgcctcag

SEQ ID NO: 2417449 - DNA, 18 bp, Homo sapiens
acagccaactagcccctg

SEQ ID NO: 2417450 - DNA, 12 bp, Homo sapiens
acagccccaccc

SEQ ID NO: 2417451 - DNA, 13 bp, Homo sapiens
acagccccaccct

SEQ ID NO: 2417452 - DNA, 12 bp, Homo sapiens
acagccctgtca

SEQ ID NO: 2417453 - DNA, 18 bp, Homo sapiens
acagccctgtcagcatga

SEQ ID NO: 2417454 - DNA, 21 bp, Homo sapiens
acagccctgtcagcatgaatt

SEQ ID NO: 2417455 - DNA, 18 bp, Homo sapiens
acagcctcccctgccagg

SEQ ID NO: 2417456 - DNA, 21 bp, Homo sapiens
acagcgcccaaaggacgcact

SEQ ID NO: 2417457 - DNA, 19 bp, Homo sapiens
acagcgcggaggaggaggg

SEQ ID NO: 2417458 - DNA, 15 bp, Homo sapiens
acagcggaggtgtgg

SEQ ID NO: 2417459 - DNA, 12 bp, Homo sapiens
acagctcctccc

SEQ ID NO: 2417460 - DNA, 13 bp, Homo sapiens
acagctggctcta

SEQ ID NO: 2417461 - DNA, 20 bp, Homo sapiens
acagctggctctacttcccc

SEQ ID NO: 2417462 - DNA, 21 bp, Homo sapiens
acagctggggtgcagggatgt

SEQ ID NO: 2417463 - DNA, 21 bp, Homo sapiens
acagctggtgtagctacagag

SEQ ID NO: 2417464 - DNA, 22 bp, Homo sapiens
acagctggtgtagctacagaga

SEQ ID NO: 2417465 - DNA, 23 bp, Homo sapiens
acagctggtgtagctacagagaa

SEQ ID NO: 2417466 - DNA, 20 bp, Homo sapiens
acagctgtattgtctgaact

SEQ ID NO: 2417467 - DNA, 17 bp, Homo sapiens
acagcttgacctgaggc

SEQ ID NO: 2417468 - DNA, 23 bp, Homo sapiens
acagcttgacctgaggctgtggt

SEQ ID NO: 2417469 - DNA, 14 bp, Homo sapiens
acagcttgtctctt

SEQ ID NO: 2417470 - DNA, 21 bp, Homo sapiens
acagcttgtctcttgcctgcc

SEQ ID NO: 2417471 - DNA, 15 bp, Homo sapiens
acagcttttgcaact

SEQ ID NO: 2417472 - DNA, 21 bp, Homo sapiens
acagcttttgcaacttaatac

SEQ ID NO: 2417473 - DNA, 16 bp, Homo sapiens
acaggactaacactca

SEQ ID NO: 2417474 - DNA, 23 bp, Homo sapiens
acaggactaacactcagaagcct

SEQ ID NO: 2417475 - DNA, 20 bp, Homo sapiens
acaggagggcggcctccttc

SEQ ID NO: 2417476 - DNA, 20 bp, Homo sapiens
acaggagggggtcgtggaga

SEQ ID NO: 2417477 - DNA, 23 bp, Homo sapiens
acaggagggggtcgtggagagct

SEQ ID NO: 2417478 - DNA, 22 bp, Homo sapiens
acaggatgtgtttgctttctga

SEQ ID NO: 2417479 - DNA, 15 bp, Homo sapiens
acaggcactgccctg

SEQ ID NO: 2417480 - DNA, 15 bp, Homo sapiens
acaggcagccagtgc

SEQ ID NO: 2417481 - DNA, 19 bp, Homo sapiens
acaggcagccagtgccctg

SEQ ID NO: 2417482 - DNA, 12 bp, Homo sapiens
acaggccccctt

SEQ ID NO: 2417483 - DNA, 21 bp, Homo sapiens
acaggccctccctgttcccca

SEQ ID NO: 2417484 - DNA, 19 bp, Homo sapiens
acaggcgtgagccacctcg

SEQ ID NO: 2417485 - DNA, 16 bp, Homo sapiens
acaggctcaggcaggg

SEQ ID NO: 2417486 - DNA, 18 bp, Homo sapiens
acaggcttctgagcagcg

SEQ ID NO: 2417487 - DNA, 21 bp, Homo sapiens
acagggaaggcaggcagggct

SEQ ID NO: 2417488 - DNA, 20 bp, Homo sapiens
acagggcagtacctgagggt

SEQ ID NO: 2417489 - DNA, 16 bp, Homo sapiens
acagggggtctggctg

SEQ ID NO: 2417490 - DNA, 19 bp, Homo sapiens
acagggggtctggctggtg

SEQ ID NO: 2417491 - DNA, 20 bp, Homo sapiens
acagggggtctggctggtgt

SEQ ID NO: 2417492 - DNA, 18 bp, Homo sapiens
acagggtccccgagtgcc

SEQ ID NO: 2417493 - DNA, 23 bp, Homo sapiens
acagggtctgctctttctctgcc

SEQ ID NO: 2417494 - DNA, 22 bp, Homo sapiens
acaggtagaattatctaattta

SEQ ID NO: 2417495 - DNA, 13 bp, Homo sapiens
acaggtcccaaat

SEQ ID NO: 2417496 - DNA, 15 bp, Homo sapiens
acaggtccctcccct

SEQ ID NO: 2417497 - DNA, 13 bp, Homo sapiens
acaggtctagact

SEQ ID NO: 2417498 - DNA, 18 bp, Homo sapiens
acaggtgctaatttgttt

SEQ ID NO: 2417499 - DNA, 15 bp, Homo sapiens
acaggttataacagt

SEQ ID NO: 2417500 - DNA, 15 bp, Homo sapiens
acagtaaaccactga

SEQ ID NO: 2417501 - DNA, 17 bp, Homo sapiens
acagtaaaccactgaaa

SEQ ID NO: 2417502 - DNA, 18 bp, Homo sapiens
acagtaaaccactgaaaa

SEQ ID NO: 2417503 - DNA, 15 bp, Homo sapiens
acagtacccaaactg

SEQ ID NO: 2417504 - DNA, 14 bp, Homo sapiens
acagtaggagccca

SEQ ID NO: 2417505 - DNA, 22 bp, Homo sapiens
acagtaggagcccagctctgaa

SEQ ID NO: 2417506 - DNA, 23 bp, Homo sapiens
acagtagtcttgatgaccaaagt

SEQ ID NO: 2417507 - DNA, 20 bp, Homo sapiens
acagtatgggggttgtaaat

SEQ ID NO: 2417508 - DNA, 18 bp, Homo sapiens
acagtatttgtaattaaa

SEQ ID NO: 2417509 - DNA, 12 bp, Homo sapiens
acagtctaaagc

SEQ ID NO: 2417510 - DNA, 18 bp, Homo sapiens
acagtgaagacagaagtt

SEQ ID NO: 2417511 - DNA, 19 bp, Homo sapiens
acagtgaagacagaagttt

SEQ ID NO: 2417512 - DNA, 14 bp, Homo sapiens
acagtgacttctga

SEQ ID NO: 2417513 - DNA, 14 bp, Homo sapiens
acagtgcagtgcgc

SEQ ID NO: 2417514 - DNA, 22 bp, Homo sapiens
acagtgtgcaaggcagccgtgg

SEQ ID NO: 2417515 - DNA, 14 bp, Homo sapiens
acagtgtttatcct

SEQ ID NO: 2417516 - DNA, 13 bp, Homo sapiens
acagttacataat

SEQ ID NO: 2417517 - DNA, 19 bp, Homo sapiens
acagttacataattcactc

SEQ ID NO: 2417518 - DNA, 15 bp, Homo sapiens
acagttcatatgtac

SEQ ID NO: 2417519 - DNA, 16 bp, Homo sapiens
acagttctgctctggt

SEQ ID NO: 2417520 - DNA, 19 bp, Homo sapiens
acagttctttgggccagac

SEQ ID NO: 2417521 - DNA, 14 bp, Homo sapiens
acagttggtaactt

SEQ ID NO: 2417522 - DNA, 22 bp, Homo sapiens
acagttgtatttaacagaaatt

SEQ ID NO: 2417523 - DNA, 19 bp, Homo sapiens
acagtttaccagttgcctt

SEQ ID NO: 2417524 - DNA, 22 bp, Homo sapiens
acagtttaccagttgcctttta

SEQ ID NO: 2417525 - DNA, 14 bp, Homo sapiens
acagtttgaaataa

SEQ ID NO: 2417526 - DNA, 17 bp, Homo sapiens
acagttttaactgtgga

SEQ ID NO: 2417527 - DNA, 19 bp, Homo sapiens
acagttttaactgtggata

SEQ ID NO: 2417528 - DNA, 13 bp, Homo sapiens
acataagctattt

SEQ ID NO: 2417529 - DNA, 17 bp, Homo sapiens
acataattatccaggaa

SEQ ID NO: 2417530 - DNA, 21 bp, Homo sapiens
acataatttagtttcatataa

SEQ ID NO: 2417531 - DNA, 15 bp, Homo sapiens
acataccagcttaga

SEQ ID NO: 2417532 - DNA, 15 bp, Homo sapiens
acatacgtgcacagg

SEQ ID NO: 2417533 - DNA, 13 bp, Homo sapiens
acatactcatttt

SEQ ID NO: 2417534 - DNA, 17 bp, Homo sapiens
acatactcatttttcat

SEQ ID NO: 2417535 - DNA, 15 bp, Homo sapiens
acatacttgaagggc

SEQ ID NO: 2417536 - DNA, 17 bp, Homo sapiens
acatacttgaagggcca

SEQ ID NO: 2417537 - DNA, 19 bp, Homo sapiens
acatacttgaagggccaga

SEQ ID NO: 2417538 - DNA, 21 bp, Homo sapiens
acatacttgaagggccagagc

SEQ ID NO: 2417539 - DNA, 16 bp, Homo sapiens
acatagacagaagaaa

SEQ ID NO: 2417540 - DNA, 21 bp, Homo sapiens
acatagagccgggtgtcccca

SEQ ID NO: 2417541 - DNA, 16 bp, Homo sapiens
acatagataaaacatc

SEQ ID NO: 2417542 - DNA, 21 bp, Homo sapiens
acatagcccacttacatttac

SEQ ID NO: 2417543 - DNA, 14 bp, Homo sapiens
accaccctgctcat

SEQ ID NO: 2417544 - DNA, 16 bp, Homo sapiens
accacctttactgtgc

SEQ ID NO: 2417545 - DNA, 22 bp, Homo sapiens
accacctttgtttctcccccat

SEQ ID NO: 2417546 - DNA, 17 bp, Homo sapiens
accaccttttattacat

SEQ ID NO: 2417547 - DNA, 13 bp, Homo sapiens
accacgactggcc

SEQ ID NO: 2417548 - DNA, 19 bp, Homo sapiens
accacgactggccagggcc

SEQ ID NO: 2417549 - DNA, 24 bp, Homo sapiens
accacgactggccagggccacgct

SEQ ID NO: 2417550 - DNA, 16 bp, Homo sapiens
accactagcctcaggg

SEQ ID NO: 2417551 - DNA, 12 bp, Homo sapiens
accactcagaga

SEQ ID NO: 2417552 - DNA, 13 bp, Homo sapiens
accactctggcag

SEQ ID NO: 2417553 - DNA, 14 bp, Homo sapiens
accactctggcagc

SEQ ID NO: 2417554 - DNA, 15 bp, Homo sapiens
accactctggcagcc

SEQ ID NO: 2417555 - DNA, 14 bp, Homo sapiens
accactgaaaaaat

SEQ ID NO: 2417556 - DNA, 17 bp, Homo sapiens
accactgaaaaaatata

SEQ ID NO: 2417557 - DNA, 15 bp, Homo sapiens
accacttcagggctt

SEQ ID NO: 2417558 - DNA, 12 bp, Homo sapiens
accactttttag

SEQ ID NO: 2417559 - DNA, 23 bp, Homo sapiens
accagaaagcagttgagacaaga

SEQ ID NO: 2417560 - DNA, 24 bp, Homo sapiens
accagaaagcagttgagacaagaa

SEQ ID NO: 2417561 - DNA, 20 bp, Homo sapiens
accagaagctcccccagcaa

SEQ ID NO: 2417562 - DNA, 17 bp, Homo sapiens
accagacacccaggact

SEQ ID NO: 2417563 - DNA, 22 bp, Homo sapiens
accagactagatggacctgcct

SEQ ID NO: 2417564 - DNA, 15 bp, Homo sapiens
accagactcttgcct

SEQ ID NO: 2417565 - DNA, 16 bp, Homo sapiens
accagactcttgcctg

SEQ ID NO: 2417566 - DNA, 15 bp, Homo sapiens
accagagagagttgt

SEQ ID NO: 2417567 - DNA, 10 bp, Homo sapiens
accagatgct

SEQ ID NO: 2417568 - DNA, 19 bp, Homo sapiens
accagcagacagagccagg

SEQ ID NO: 2417569 - DNA, 19 bp, Homo sapiens
accagccgtgagcatgttt

SEQ ID NO: 2417570 - DNA, 22 bp, Homo sapiens
accagccgtgagcatgtttgga

SEQ ID NO: 2417571 - DNA, 16 bp, Homo sapiens
accagctcagcactgc

SEQ ID NO: 2417572 - DNA, 13 bp, Homo sapiens
accagctcaggac

SEQ ID NO: 2417573 - DNA, 16 bp, Homo sapiens
accagctcaggacaga

SEQ ID NO: 2417574 - DNA, 23 bp, Homo sapiens
accagctcaggacagatgccaca

SEQ ID NO: 2417575 - DNA, 19 bp, Homo sapiens
accagctccccctccctcc

SEQ ID NO: 2417576 - DNA, 20 bp, Homo sapiens
accagctccccctccctccc

SEQ ID NO: 2417577 - DNA, 15 bp, Homo sapiens
accagcttccttcag

SEQ ID NO: 2417578 - DNA, 22 bp, Homo sapiens
accagcttccttcagagagcag

SEQ ID NO: 2417579 - DNA, 13 bp, Homo sapiens
accaggaacagca

SEQ ID NO: 2417580 - DNA, 16 bp, Homo sapiens
accaggagtgggtggg

SEQ ID NO: 2417581 - DNA, 21 bp, Homo sapiens
accagggttgaccccagagga

SEQ ID NO: 2417582 - DNA, 15 bp, Homo sapiens
accagtcccagagca

SEQ ID NO: 2417583 - DNA, 12 bp, Homo sapiens
accagttaattt

SEQ ID NO: 2417584 - DNA, 13 bp, Homo sapiens
accagttaatttt

SEQ ID NO: 2417585 - DNA, 21 bp, Homo sapiens
accagttctcatgggtggcac

SEQ ID NO: 2417586 - DNA, 15 bp, Homo sapiens
accagttgcagtcac

SEQ ID NO: 2417587 - DNA, 12 bp, Homo sapiens
accagttgcctt

SEQ ID NO: 2417588 - DNA, 20 bp, Homo sapiens
accatctccctggtgcttat

SEQ ID NO: 2417589 - DNA, 20 bp, Homo sapiens
accatgccaggctaattttt

SEQ ID NO: 2417590 - DNA, 22 bp, Homo sapiens
accatgcccggctaatttttgt

SEQ ID NO: 2417591 - DNA, 16 bp, Homo sapiens
accatgctgctgggga

SEQ ID NO: 2417592 - DNA, 22 bp, Homo sapiens
accatggagtggcagcccagcc

SEQ ID NO: 2417593 - DNA, 15 bp, Homo sapiens
accatgtcatttcag

SEQ ID NO: 2417594 - DNA, 14 bp, Homo sapiens
accatgtctttctc

SEQ ID NO: 2417595 - DNA, 17 bp, Homo sapiens
accatgtgttatgtttt

SEQ ID NO: 2417596 - DNA, 13 bp, Homo sapiens
accattaaaccat

SEQ ID NO: 2417597 - DNA, 15 bp, Homo sapiens
accatttcctcagac

SEQ ID NO: 2417598 - DNA, 22 bp, Homo sapiens
acccaagatgggcatcttttgt

SEQ ID NO: 2417599 - DNA, 14 bp, Homo sapiens
acccaatccaaatg

SEQ ID NO: 2417600 - DNA, 17 bp, Homo sapiens
acccaccaaccctcagg

SEQ ID NO: 2417601 - DNA, 19 bp, Homo sapiens
acccaccaaccctcagggc

SEQ ID NO: 2417602 - DNA, 12 bp, Homo sapiens
acccacccctgc

SEQ ID NO: 2417603 - DNA, 19 bp, Homo sapiens
acccaccgggccactcctt

SEQ ID NO: 2417604 - DNA, 22 bp, Homo sapiens
acccaccgggccactccttcct

SEQ ID NO: 2417605 - DNA, 13 bp, Homo sapiens
acccacttctgca

SEQ ID NO: 2417606 - DNA, 17 bp, Homo sapiens
acccagacataaaggaa

SEQ ID NO: 2417607 - DNA, 20 bp, Homo sapiens
acccagacataaaggaaaag

SEQ ID NO: 2417608 - DNA, 22 bp, Homo sapiens
acccagacctgttagcagacag

SEQ ID NO: 2417609 - DNA, 22 bp, Homo sapiens
acccagaggaaggggccagagg

SEQ ID NO: 2417610 - DNA, 14 bp, Homo sapiens
acccagcccacccc

SEQ ID NO: 2417611 - DNA, 16 bp, Homo sapiens
acccagcccacccccg

SEQ ID NO: 2417612 - DNA, 16 bp, Homo sapiens
acccagccctcatccc

SEQ ID NO: 2417613 - DNA, 14 bp, Homo sapiens
acccaggacaagca

SEQ ID NO: 2417614 - DNA, 16 bp, Homo sapiens
acccaggacaagcatg

SEQ ID NO: 2417615 - DNA, 15 bp, Homo sapiens
acccaggggcagccc

SEQ ID NO: 2417616 - DNA, 14 bp, Homo sapiens
acccaggtctgggt

SEQ ID NO: 2417617 - DNA, 22 bp, Homo sapiens
acccaggtctgggtggggccca

SEQ ID NO: 2417618 - DNA, 22 bp, Homo sapiens
acccagtgcccccactgaccag

SEQ ID NO: 2417619 - DNA, 17 bp, Homo sapiens
acccagttgccatctgc

SEQ ID NO: 2417620 - DNA, 17 bp, Homo sapiens
acccagtttccttggga

SEQ ID NO: 2417621 - DNA, 16 bp, Homo sapiens
acccatattgtaaaac

SEQ ID NO: 2417622 - DNA, 20 bp, Homo sapiens
acccatgagttggggtctgg

SEQ ID NO: 2417623 - DNA, 23 bp, Homo sapiens
accccaaacaccttccagctcct

SEQ ID NO: 2417624 - DNA, 15 bp, Homo sapiens
accccaaagctttcc

SEQ ID NO: 2417625 - DNA, 19 bp, Homo sapiens
accccaacctgctctcctc

SEQ ID NO: 2417626 - DNA, 18 bp, Homo sapiens
accccacccacttctgca

SEQ ID NO: 2417627 - DNA, 19 bp, Homo sapiens
accccacccttcccctcct

SEQ ID NO: 2417628 - DNA, 18 bp, Homo sapiens
accccagggcacaggagc

SEQ ID NO: 2417629 - DNA, 16 bp, Homo sapiens
accccagggcagccag

SEQ ID NO: 2417630 - DNA, 17 bp, Homo sapiens
accccagggcagccagg

SEQ ID NO: 2417631 - DNA, 15 bp, Homo sapiens
accccatcccacacc

SEQ ID NO: 2417632 - DNA, 19 bp, Homo sapiens
accccatggagctgggcta

SEQ ID NO: 2417633 - DNA, 14 bp, Homo sapiens
accccattcccgca

SEQ ID NO: 2417634 - DNA, 14 bp, Homo sapiens
acccccacccccag

SEQ ID NO: 2417635 - DNA, 15 bp, Homo sapiens
acccccacccccagc

SEQ ID NO: 2417636 - DNA, 18 bp, Homo sapiens
acccccacccccagctca

SEQ ID NO: 2417637 - DNA, 19 bp, Homo sapiens
acccccacccccagctcaa

SEQ ID NO: 2417638 - DNA, 13 bp, Homo sapiens
acccccagctcaa

SEQ ID NO: 2417639 - DNA, 21 bp, Homo sapiens
acccccagctcaatggactgg

SEQ ID NO: 2417640 - DNA, 17 bp, Homo sapiens
acccccatctctccctc

SEQ ID NO: 2417641 - DNA, 22 bp, Homo sapiens
acccccctgtacacaactcact

SEQ ID NO: 2417642 - DNA, 18 bp, Homo sapiens
acctgccctacctgcccc

SEQ ID NO: 2417643 - DNA, 18 bp, Homo sapiens
acctgctaggccagagcc

SEQ ID NO: 2417644 - DNA, 21 bp, Homo sapiens
acctgctaggccagagcccac

SEQ ID NO: 2417645 - DNA, 22 bp, Homo sapiens
acctgctaggccagagcccact

SEQ ID NO: 2417646 - DNA, 16 bp, Homo sapiens
acctgctcagccctgc

SEQ ID NO: 2417647 - DNA, 16 bp, Homo sapiens
acctgctctcctcttc

SEQ ID NO: 2417648 - DNA, 14 bp, Homo sapiens
acctgctgagctct

SEQ ID NO: 2417649 - DNA, 15 bp, Homo sapiens
acctgctgagctctg

SEQ ID NO: 2417650 - DNA, 19 bp, Homo sapiens
acctgctgagctctgagag

SEQ ID NO: 2417651 - DNA, 15 bp, Homo sapiens
acctggacccctgca

SEQ ID NO: 2417652 - DNA, 16 bp, Homo sapiens
acctggacccctgcat

SEQ ID NO: 2417653 - DNA, 21 bp, Homo sapiens
acctggacccctgcattggaa

SEQ ID NO: 2417654 - DNA, 14 bp, Homo sapiens
acctggcagctctg

SEQ ID NO: 2417655 - DNA, 18 bp, Homo sapiens
acctggcccatcagggta

SEQ ID NO: 2417656 - DNA, 11 bp, Homo sapiens
acctggccttc

SEQ ID NO: 2417657 - DNA, 16 bp, Homo sapiens
acctggctctcacctc

SEQ ID NO: 2417658 - DNA, 22 bp, Homo sapiens
acctgggaggcggatgttgaag

SEQ ID NO: 2417659 - DNA, 13 bp, Homo sapiens
acctgggccctgg

SEQ ID NO: 2417660 - DNA, 14 bp, Homo sapiens
acctgggccctggg

SEQ ID NO: 2417661 - DNA, 18 bp, Homo sapiens
acctgggccctggggcct

SEQ ID NO: 2417662 - DNA, 19 bp, Homo sapiens
acctgggccctggggcctg

SEQ ID NO: 2417663 - DNA, 23 bp, Homo sapiens
acctgggccctggggcctgtact

SEQ ID NO: 2417664 - DNA, 20 bp, Homo sapiens
acctgggttgcagacaggaa

SEQ ID NO: 2417665 - DNA, 15 bp, Homo sapiens
acctgtaagtgtctt

SEQ ID NO: 2417666 - DNA, 23 bp, Homo sapiens
acctgtgcttcgggcccttccca

SEQ ID NO: 2417667 - DNA, 10 bp, Homo sapiens
acctgtggat

SEQ ID NO: 2417668 - DNA, 18 bp, Homo sapiens
acctgtgtttcttgcctc

SEQ ID NO: 2417669 - DNA, 17 bp, Homo sapiens
acctgttagcagacagg

SEQ ID NO: 2417670 - DNA, 22 bp, Homo sapiens
acctgttgagcatcacagaatg

SEQ ID NO: 2417671 - DNA, 12 bp, Homo sapiens
accttatagtta

SEQ ID NO: 2417672 - DNA, 14 bp, Homo sapiens
accttatagttact

SEQ ID NO: 2417673 - DNA, 13 bp, Homo sapiens
accttccagctcc

SEQ ID NO: 2417674 - DNA, 17 bp, Homo sapiens
accttccagctcctgta

SEQ ID NO: 2417675 - DNA, 14 bp, Homo sapiens
accttcgggctgtg

SEQ ID NO: 2417676 - DNA, 14 bp, Homo sapiens
accttctccccagc

SEQ ID NO: 2417677 - DNA, 23 bp, Homo sapiens
accttctctatggggcatcctct

SEQ ID NO: 2417678 - DNA, 22 bp, Homo sapiens
accttgctgcaagcacagccct

SEQ ID NO: 2417679 - DNA, 14 bp, Homo sapiens
accttggcaccaga

SEQ ID NO: 2417680 - DNA, 23 bp, Homo sapiens
accttgtgcccagggttttgccc

SEQ ID NO: 2417681 - DNA, 18 bp, Homo sapiens
acctttgtgccctatcac

SEQ ID NO: 2417682 - DNA, 22 bp, Homo sapiens
acctttttgcatgatatcttca

SEQ ID NO: 2417683 - DNA, 23 bp, Homo sapiens
acctttttgcatgatatcttcaa

SEQ ID NO: 2417684 - DNA, 21 bp, Homo sapiens
acgaaataattgttgttctgt

SEQ ID NO: 2417685 - DNA, 19 bp, Homo sapiens
acgaacctacagttttaac

SEQ ID NO: 2417686 - DNA, 22 bp, Homo sapiens
acgaatacttttgccctttgat

SEQ ID NO: 2417687 - DNA, 13 bp, Homo sapiens
acgacactgcagc

SEQ ID NO: 2417688 - DNA, 19 bp, Homo sapiens
acgagctgtttactaggga

SEQ ID NO: 2417689 - DNA, 20 bp, Homo sapiens
acgaggaatctgtgggtctg

SEQ ID NO: 2417690 - DNA, 20 bp, Homo sapiens
acgagggctggctggcctca

SEQ ID NO: 2417691 - DNA, 20 bp, Homo sapiens
acgaggggtgtcttgggcag

SEQ ID NO: 2417692 - DNA, 17 bp, Homo sapiens
acgcacctgcctcagga

SEQ ID NO: 2417693 - DNA, 20 bp, Homo sapiens
acgcatctcaaaacagaggg

SEQ ID NO: 2417694 - DNA, 23 bp, Homo sapiens
acgcatctcaaaacagagggctg

SEQ ID NO: 2417695 - DNA, 18 bp, Homo sapiens
acgcccgtcctgcctgtg

SEQ ID NO: 2417696 - DNA, 17 bp, Homo sapiens
acgccctttcctcctca

SEQ ID NO: 2417697 - DNA, 15 bp, Homo sapiens
acgcctgagcccagg

SEQ ID NO: 2417698 - DNA, 19 bp, Homo sapiens
acgcctgagcccagggagg

SEQ ID NO: 2417699 - DNA, 13 bp, Homo sapiens
acgcctgaggaac

SEQ ID NO: 2417700 - DNA, 21 bp, Homo sapiens
acgcctgaggaacccttacag

SEQ ID NO: 2417701 - DNA, 13 bp, Homo sapiens
acgcgtcttcctg

SEQ ID NO: 2417702 - DNA, 14 bp, Homo sapiens
acgctattccagct

SEQ ID NO: 2417703 - DNA, 22 bp, Homo sapiens
acgctattccagctgtcccccc

SEQ ID NO: 2417704 - DNA, 11 bp, Homo sapiens
acgctccagct

SEQ ID NO: 2417705 - DNA, 14 bp, Homo sapiens
acgctccagctgcc

SEQ ID NO: 2417706 - DNA, 16 bp, Homo sapiens
acgctccagctgcccc

SEQ ID NO: 2417707 - DNA, 21 bp, Homo sapiens
acgctgctgtcacaaccaaga

SEQ ID NO: 2417708 - DNA, 13 bp, Homo sapiens
acgctttgattca

SEQ ID NO: 2417709 - DNA, 16 bp, Homo sapiens
acggaagggtaaacaa

SEQ ID NO: 2417710 - DNA, 22 bp, Homo sapiens
acggaagggtaaacaatatagt

SEQ ID NO: 2417711 - DNA, 17 bp, Homo sapiens
acggacagagaccaaga

SEQ ID NO: 2417712 - DNA, 15 bp, Homo sapiens
acggagcactgcacc

SEQ ID NO: 2417713 - DNA, 22 bp, Homo sapiens
acggagcactgcacctgcctcc

SEQ ID NO: 2417714 - DNA, 15 bp, Homo sapiens
acggattttcagtta

SEQ ID NO: 2417715 - DNA, 15 bp, Homo sapiens
acggccacacagctg

SEQ ID NO: 2417716 - DNA, 16 bp, Homo sapiens
acggccacacagctgc

SEQ ID NO: 2417717 - DNA, 13 bp, Homo sapiens
acggccaggcaga

SEQ ID NO: 2417718 - DNA, 14 bp, Homo sapiens
acggccaggcagat

SEQ ID NO: 2417719 - DNA, 18 bp, Homo sapiens
acggccagggagaagctc

SEQ ID NO: 2417720 - DNA, 16 bp, Homo sapiens
acggctgcgcactgtg

SEQ ID NO: 2417721 - DNA, 14 bp, Homo sapiens
acggtgcccaagcc

SEQ ID NO: 2417722 - DNA, 17 bp, Homo sapiens
acgtaataaggttttaa

SEQ ID NO: 2417723 - DNA, 21 bp, Homo sapiens
acgtatttaatagcaaagaat

SEQ ID NO: 2417724 - DNA, 17 bp, Homo sapiens
acgtctgggtggccctt

SEQ ID NO: 2417725 - DNA, 12 bp, Homo sapiens
acgtcttctaaa

SEQ ID NO: 2417726 - DNA, 13 bp, Homo sapiens
acgtgacacaaac

SEQ ID NO: 2417727 - DNA, 20 bp, Homo sapiens
acgtgacacaaacacacaca

SEQ ID NO: 2417728 - DNA, 21 bp, Homo sapiens
acgtgacacaaacacacacaa

SEQ ID NO: 2417729 - DNA, 23 bp, Homo sapiens
acgtgctctttgttttgtgtctc

SEQ ID NO: 2417730 - DNA, 16 bp, Homo sapiens
acgtgtttgtgctgtg

SEQ ID NO: 2417731 - DNA, 18 bp, Homo sapiens
acgttggagaagcccgtg

SEQ ID NO: 2417732 - DNA, 19 bp, Homo sapiens
acgttggagaagcccgtgt

SEQ ID NO: 2417733 - DNA, 17 bp, Homo sapiens
acgtttaagccaaaaca

SEQ ID NO: 2417734 - DNA, 20 bp, Homo sapiens
acgttttataagcatcatta

SEQ ID NO: 2417735 - DNA, 12 bp, Homo sapiens
acgttttctaat

SEQ ID NO: 2417736 - DNA, 13 bp, Homo sapiens
acgttttctaatt

SEQ ID NO: 2417737 - DNA, 16 bp, Homo sapiens
actaaaaaaaagatga

SEQ ID NO: 2417738 - DNA, 14 bp, Homo sapiens
actaaaataatttt

SEQ ID NO: 2417739 - DNA, 16 bp, Homo sapiens
actggtcattaatgtg

SEQ ID NO: 2417740 - DNA, 22 bp, Homo sapiens
actggtggggataggccagccg

SEQ ID NO: 2417741 - DNA, 16 bp, Homo sapiens
actgtaagttgggctt

SEQ ID NO: 2417742 - DNA, 18 bp, Homo sapiens
actgtacagctggctcta

SEQ ID NO: 2417743 - DNA, 16 bp, Homo sapiens
actgtacagtgtcttt

SEQ ID NO: 2417744 - DNA, 17 bp, Homo sapiens
actgtacagtgtctttt

SEQ ID NO: 2417745 - DNA, 15 bp, Homo sapiens
actgtagctttggaa

SEQ ID NO: 2417746 - DNA, 16 bp, Homo sapiens
actgtagtaaataatg

SEQ ID NO: 2417747 - DNA, 20 bp, Homo sapiens
actgtagtaaataatgcttt

SEQ ID NO: 2417748 - DNA, 22 bp, Homo sapiens
actgtagtaaataatgctttga

SEQ ID NO: 2417749 - DNA, 13 bp, Homo sapiens
actgtagttctaa

SEQ ID NO: 2417750 - DNA, 15 bp, Homo sapiens
actgtagttctaaga

SEQ ID NO: 2417751 - DNA, 14 bp, Homo sapiens
actgtatattcagg

SEQ ID NO: 2417752 - DNA, 12 bp, Homo sapiens
actgtatttgaa

SEQ ID NO: 2417753 - DNA, 23 bp, Homo sapiens
actgtatttgaaataagaattca

SEQ ID NO: 2417754 - DNA, 21 bp, Homo sapiens
actgtattttgtattgtttca

SEQ ID NO: 2417755 - DNA, 21 bp, Homo sapiens
actgtcatcctcaaagaaagt

SEQ ID NO: 2417756 - DNA, 21 bp, Homo sapiens
actgtctcgatgcaatgaaca

SEQ ID NO: 2417757 - DNA, 13 bp, Homo sapiens
actgtgtaactgc

SEQ ID NO: 2417758 - DNA, 15 bp, Homo sapiens
actgtgtaactgccc

SEQ ID NO: 2417759 - DNA, 18 bp, Homo sapiens
actgtgtgtgccctctgg

SEQ ID NO: 2417760 - DNA, 15 bp, Homo sapiens
actgtgtgtgtgaat

SEQ ID NO: 2417761 - DNA, 16 bp, Homo sapiens
actgtgtgtgtgaatg

SEQ ID NO: 2417762 - DNA, 16 bp, Homo sapiens
actgtgttatgcaaaa

SEQ ID NO: 2417763 - DNA, 15 bp, Homo sapiens
actgttccccctgtg

SEQ ID NO: 2417764 - DNA, 14 bp, Homo sapiens
actgttctaaagct

SEQ ID NO: 2417765 - DNA, 17 bp, Homo sapiens
actgttctaaagctctg

SEQ ID NO: 2417766 - DNA, 16 bp, Homo sapiens
actgttctgtgtcttt

SEQ ID NO: 2417767 - DNA, 20 bp, Homo sapiens
actgttcttagctcaatgag

SEQ ID NO: 2417768 - DNA, 21 bp, Homo sapiens
actgttcttagctcaatgagc

SEQ ID NO: 2417769 - DNA, 11 bp, Homo sapiens
actgttgcacg

SEQ ID NO: 2417770 - DNA, 21 bp, Homo sapiens
actgttggaatggatttttct

SEQ ID NO: 2417771 - DNA, 17 bp, Homo sapiens
actgtttatacactgtg

SEQ ID NO: 2417772 - DNA, 21 bp, Homo sapiens
actgtttgccttctactttta

SEQ ID NO: 2417773 - DNA, 13 bp, Homo sapiens
actgttttttaag

SEQ ID NO: 2417774 - DNA, 19 bp, Homo sapiens
acttaaacttgcatcactt

SEQ ID NO: 2417775 - DNA, 15 bp, Homo sapiens
acttaaatgttatta

SEQ ID NO: 2417776 - DNA, 17 bp, Homo sapiens
acttaacggaccaaagc

SEQ ID NO: 2417777 - DNA, 17 bp, Homo sapiens
acttaagcatctggctc

SEQ ID NO: 2417778 - DNA, 20 bp, Homo sapiens
acttaagcatctggctctaa

SEQ ID NO: 2417779 - DNA, 21 bp, Homo sapiens
acttaagcatctggctctaat

SEQ ID NO: 2417780 - DNA, 17 bp, Homo sapiens
acttaatactaccttga

SEQ ID NO: 2417781 - DNA, 16 bp, Homo sapiens
acttaatgtatgttac

SEQ ID NO: 2417782 - DNA, 15 bp, Homo sapiens
acttacatttacaaa

SEQ ID NO: 2417783 - DNA, 18 bp, Homo sapiens
acttaccaggcaccaaaa

SEQ ID NO: 2417784 - DNA, 13 bp, Homo sapiens
acttactctaaga

SEQ ID NO: 2417785 - DNA, 15 bp, Homo sapiens
acttacttgcttatt

SEQ ID NO: 2417786 - DNA, 21 bp, Homo sapiens
acttagaaaaccagctcagca

SEQ ID NO: 2417787 - DNA, 16 bp, Homo sapiens
acttagattttacatg

SEQ ID NO: 2417788 - DNA, 19 bp, Homo sapiens
acttagattttacatgaag

SEQ ID NO: 2417789 - DNA, 20 bp, Homo sapiens
acttagattttacatgaagt

SEQ ID NO: 2417790 - DNA, 24 bp, Homo sapiens
acttagattttacatgaagtattt

SEQ ID NO: 2417791 - DNA, 16 bp, Homo sapiens
acttagggcaccaggg

SEQ ID NO: 2417792 - DNA, 13 bp, Homo sapiens
acttatagcctct

SEQ ID NO: 2417793 - DNA, 14 bp, Homo sapiens
acttatagcctctg

SEQ ID NO: 2417794 - DNA, 15 bp, Homo sapiens
acttatagcctctgt

SEQ ID NO: 2417795 - DNA, 13 bp, Homo sapiens
acttatttaatgc

SEQ ID NO: 2417796 - DNA, 15 bp, Homo sapiens
acttcaaaagtttgt

SEQ ID NO: 2417797 - DNA, 12 bp, Homo sapiens
acttcagaaaga

SEQ ID NO: 2417798 - DNA, 20 bp, Homo sapiens
acttcaggtatacctcactt

SEQ ID NO: 2417799 - DNA, 21 bp, Homo sapiens
acttcagtttcacagaaaata

SEQ ID NO: 2417800 - DNA, 21 bp, Homo sapiens
acttccaaatcccctaagcag

SEQ ID NO: 2417801 - DNA, 21 bp, Homo sapiens
acttccaggtgttactgtaat

SEQ ID NO: 2417802 - DNA, 20 bp, Homo sapiens
acttccccatggccctgagc

SEQ ID NO: 2417803 - DNA, 20 bp, Homo sapiens
acttcctaaatattatgaga

SEQ ID NO: 2417804 - DNA, 23 bp, Homo sapiens
acttcctgtccagctccaacctg

SEQ ID NO: 2417805 - DNA, 14 bp, Homo sapiens
acttctaattgcca

SEQ ID NO: 2417806 - DNA, 17 bp, Homo sapiens
acttctcaggacacagg

SEQ ID NO: 2417807 - DNA, 22 bp, Homo sapiens
acttctcaggacacaggcctgt

SEQ ID NO: 2417808 - DNA, 15 bp, Homo sapiens
acttctctttgcctc

SEQ ID NO: 2417809 - DNA, 17 bp, Homo sapiens
acttctctttgcctcaa

SEQ ID NO: 2417810 - DNA, 15 bp, Homo sapiens
acttctgacagcctc

SEQ ID NO: 2417811 - DNA, 12 bp, Homo sapiens
acttctgagatc

SEQ ID NO: 2417812 - DNA, 20 bp, Homo sapiens
acttctgagatctgttgatt

SEQ ID NO: 2417813 - DNA, 16 bp, Homo sapiens
acttctgcctggagac

SEQ ID NO: 2417814 - DNA, 12 bp, Homo sapiens
acttcttgaagg

SEQ ID NO: 2417815 - DNA, 13 bp, Homo sapiens
acttcttgaaggt

SEQ ID NO: 2417816 - DNA, 19 bp, Homo sapiens
acttcttgcttctttctag

SEQ ID NO: 2417817 - DNA, 22 bp, Homo sapiens
acttgaacgttttctaattgct

SEQ ID NO: 2417818 - DNA, 14 bp, Homo sapiens
acttgaagggccag

SEQ ID NO: 2417819 - DNA, 22 bp, Homo sapiens
acttgaagggccagagccaggg

SEQ ID NO: 2417820 - DNA, 19 bp, Homo sapiens
acttgatccatttctaatt

SEQ ID NO: 2417821 - DNA, 12 bp, Homo sapiens
acttgcctcttc

SEQ ID NO: 2417822 - DNA, 17 bp, Homo sapiens
acttgcctcttccttga

SEQ ID NO: 2417823 - DNA, 21 bp, Homo sapiens
acttgcctgcctttccatcca

SEQ ID NO: 2417824 - DNA, 20 bp, Homo sapiens
acttgcggttccggcatgga

SEQ ID NO: 2417825 - DNA, 21 bp, Homo sapiens
acttgcttatcaacttcctaa

SEQ ID NO: 2417826 - DNA, 22 bp, Homo sapiens
acttggattctttccatttgca

SEQ ID NO: 2417827 - DNA, 13 bp, Homo sapiens
acttggcagcctt

SEQ ID NO: 2417828 - DNA, 15 bp, Homo sapiens
acttggcagccttgt

SEQ ID NO: 2417829 - DNA, 16 bp, Homo sapiens
acttggcctcatgctg

SEQ ID NO: 2417830 - DNA, 19 bp, Homo sapiens
acttggctcacactcgaca

SEQ ID NO: 2417831 - DNA, 19 bp, Homo sapiens
acttggctcgaatctctgt

SEQ ID NO: 2417832 - DNA, 21 bp, Homo sapiens
acttggctcgaatctctgtgc

SEQ ID NO: 2417833 - DNA, 23 bp, Homo sapiens
acttggctggtgtggtacagaga

SEQ ID NO: 2417834 - DNA, 21 bp, Homo sapiens
acttgggcacccccagcctgg

SEQ ID NO: 2417835 - DNA, 22 bp, Homo sapiens
acttgggcacccccagcctggg

SEQ ID NO: 2417836 - DNA, 16 bp, Homo sapiens
acttggtaattgtact

SEQ ID NO: 2417837 - DNA, 20 bp, Homo sapiens
acttggttggtagggtggga

SEQ ID NO: 2417838 - DNA, 12 bp, Homo sapiens
acttgtaaatat

SEQ ID NO: 2417839 - DNA, 15 bp, Homo sapiens
acttgtaaatataaa

SEQ ID NO: 2417840 - DNA, 18 bp, Homo sapiens
acttgtaaatataaagac

SEQ ID NO: 2417841 - DNA, 18 bp, Homo sapiens
acttgtaatttttttaat

SEQ ID NO: 2417842 - DNA, 20 bp, Homo sapiens
acttgtatattttaagaaat

SEQ ID NO: 2417843 - DNA, 13 bp, Homo sapiens
atttttctcttca

SEQ ID NO: 2417844 - DNA, 13 bp, Homo sapiens
atttttctttaca

SEQ ID NO: 2417845 - DNA, 16 bp, Homo sapiens
atttttctttacaaaa

SEQ ID NO: 2417846 - DNA, 12 bp, Homo sapiens
atttttgtaatt

SEQ ID NO: 2417847 - DNA, 18 bp, Homo sapiens
attttttaaaaaagctta

SEQ ID NO: 2417848 - DNA, 19 bp, Homo sapiens
attttttaaaaaagcttaa

SEQ ID NO: 2417849 - DNA, 13 bp, Homo sapiens
attttttaaattc

SEQ ID NO: 2417850 - DNA, 14 bp, Homo sapiens
attttttaataatt

SEQ ID NO: 2417851 - DNA, 15 bp, Homo sapiens
attttttaattatta

SEQ ID NO: 2417852 - DNA, 13 bp, Homo sapiens
attttttaggaaa

SEQ ID NO: 2417853 - DNA, 14 bp, Homo sapiens
attttttaggaaat

SEQ ID NO: 2417854 - DNA, 22 bp, Homo sapiens
attttttcagtattatatgtac

SEQ ID NO: 2417855 - DNA, 20 bp, Homo sapiens
attttttccttcaaagttta

SEQ ID NO: 2417856 - DNA, 16 bp, Homo sapiens
attttttgtataattg

SEQ ID NO: 2417857 - DNA, 12 bp, Homo sapiens
attttttgttga

SEQ ID NO: 2417858 - DNA, 14 bp, Homo sapiens
attttttgttgaca

SEQ ID NO: 2417859 - DNA, 18 bp, Homo sapiens
atttttttaagaaaaaag

SEQ ID NO: 2417860 - DNA, 16 bp, Homo sapiens
atttttttccttgcaa

SEQ ID NO: 2417861 - DNA, 18 bp, Homo sapiens
attttttttaacattcct

SEQ ID NO: 2417862 - DNA, 20 bp, Homo sapiens
attttttttattagtattgt

SEQ ID NO: 2417863 - DNA, 19 bp, Homo sapiens
atttttttttaagctctga

SEQ ID NO: 2417864 - DNA, 23 bp, Homo sapiens
atttttttttttttttttttaag

SEQ ID NO: 2417865 - DNA, 14 bp, Homo sapiens
caaaaaaaaataca

SEQ ID NO: 2417866 - DNA, 14 bp, Homo sapiens
caaaaatagctaaa

SEQ ID NO: 2417867 - DNA, 12 bp, Homo sapiens
caaaacaaaggc

SEQ ID NO: 2417868 - DNA, 18 bp, Homo sapiens
caaaacaatgtttaaacc

SEQ ID NO: 2417869 - DNA, 22 bp, Homo sapiens
caaaaccaggtccaatgagctt

SEQ ID NO: 2417870 - DNA, 13 bp, Homo sapiens
caaaacccagacc

SEQ ID NO: 2417871 - DNA, 14 bp, Homo sapiens
caaaaccgccagct

SEQ ID NO: 2417872 - DNA, 22 bp, Homo sapiens
caaaactgcctcaggaggcagg

SEQ ID NO: 2417873 - DNA, 12 bp, Homo sapiens
caaaactgctcc

SEQ ID NO: 2417874 - DNA, 12 bp, Homo sapiens
caaaagaagtaa

SEQ ID NO: 2417875 - DNA, 16 bp, Homo sapiens
caaaagggaagagttt

SEQ ID NO: 2417876 - DNA, 18 bp, Homo sapiens
caaaagtttgtttgctta

SEQ ID NO: 2417877 - DNA, 15 bp, Homo sapiens
caaaatcaggtaact

SEQ ID NO: 2417878 - DNA, 19 bp, Homo sapiens
caaaatctcccattttgga

SEQ ID NO: 2417879 - DNA, 23 bp, Homo sapiens
caaaatgtaggcttagtttgtgt

SEQ ID NO: 2417880 - DNA, 19 bp, Homo sapiens
caaaatgttatcttctcaa

SEQ ID NO: 2417881 - DNA, 22 bp, Homo sapiens
caaaatgttatcttctcaagtt

SEQ ID NO: 2417882 - DNA, 21 bp, Homo sapiens
caaaattatagaagtttagat

SEQ ID NO: 2417883 - DNA, 17 bp, Homo sapiens
caaacaatgacaaagca

SEQ ID NO: 2417884 - DNA, 16 bp, Homo sapiens
caaacacacacaaaag

SEQ ID NO: 2417885 - DNA, 18 bp, Homo sapiens
caaacaccaacataaaaa

SEQ ID NO: 2417886 - DNA, 20 bp, Homo sapiens
caaacagccaactagcccct

SEQ ID NO: 2417887 - DNA, 21 bp, Homo sapiens
caaacatatatatactattaa

SEQ ID NO: 2417888 - DNA, 23 bp, Homo sapiens
caaacattttctggccagtgttt

SEQ ID NO: 2417889 - DNA, 17 bp, Homo sapiens
caaaccacgcctcttga

SEQ ID NO: 2417890 - DNA, 20 bp, Homo sapiens
caaaccctagccttgcttgt

SEQ ID NO: 2417891 - DNA, 13 bp, Homo sapiens
caaacctcaccaa

SEQ ID NO: 2417892 - DNA, 13 bp, Homo sapiens
caaactagggcca

SEQ ID NO: 2417893 - DNA, 20 bp, Homo sapiens
atgtaaatattttaaagaat

SEQ ID NO: 2417894 - DNA, 14 bp, Homo sapiens
atgtaaatttgtac

SEQ ID NO: 2417895 - DNA, 23 bp, Homo sapiens
atgtaaggctgtgtaagatttgt

SEQ ID NO: 2417896 - DNA, 12 bp, Homo sapiens
atgtaatacttc

SEQ ID NO: 2417897 - DNA, 15 bp, Homo sapiens
atgtaatcaatgttt

SEQ ID NO: 2417898 - DNA, 16 bp, Homo sapiens
atgtaatggcagttat

SEQ ID NO: 2417899 - DNA, 15 bp, Homo sapiens
atgtaattttgtgta

SEQ ID NO: 2417900 - DNA, 22 bp, Homo sapiens
atgtaattttgtgtaagaaata

SEQ ID NO: 2417901 - DNA, 15 bp, Homo sapiens
atgtacatgagaagg

SEQ ID NO: 2417902 - DNA, 16 bp, Homo sapiens
atgtacatttctcagg

SEQ ID NO: 2417903 - DNA, 21 bp, Homo sapiens
atgtacccaccgggccactcc

SEQ ID NO: 2417904 - DNA, 17 bp, Homo sapiens
atgtaccctctgaaata

SEQ ID NO: 2417905 - DNA, 18 bp, Homo sapiens
atgtactgagccttgtaa

SEQ ID NO: 2417906 - DNA, 14 bp, Homo sapiens
atgtagaaaatttg

SEQ ID NO: 2417907 - DNA, 21 bp, Homo sapiens
atgtagcaaaatacatgacat

SEQ ID NO: 2417908 - DNA, 17 bp, Homo sapiens
atgtagtaacactaata

SEQ ID NO: 2417909 - DNA, 20 bp, Homo sapiens
atgtagtaacactaatatat

SEQ ID NO: 2417910 - DNA, 22 bp, Homo sapiens
atgtagtaacactaatatattt

SEQ ID NO: 2417911 - DNA, 17 bp, Homo sapiens
atgtagttctgctccag

SEQ ID NO: 2417912 - DNA, 20 bp, Homo sapiens
atgtagtttttatatgttgt

SEQ ID NO: 2417913 - DNA, 23 bp, Homo sapiens
atgtataactaggagctttgact

SEQ ID NO: 2417914 - DNA, 17 bp, Homo sapiens
atgtatcaaatacattt

SEQ ID NO: 2417915 - DNA, 12 bp, Homo sapiens
atgtatgttacc

SEQ ID NO: 2417916 - DNA, 14 bp, Homo sapiens
atgtatgttaccaa

SEQ ID NO: 2417917 - DNA, 16 bp, Homo sapiens
atgtattgcacattgt

SEQ ID NO: 2417918 - DNA, 18 bp, Homo sapiens
atgtattgtgcaatgtgt

SEQ ID NO: 2417919 - DNA, 22 bp, Homo sapiens
atgtattgtgcaatgtgtataa

SEQ ID NO: 2417920 - DNA, 24 bp, Homo sapiens
atgtattgtgcaatgtgtataaac

SEQ ID NO: 2417921 - DNA, 14 bp, Homo sapiens
atgtattttatgtt

SEQ ID NO: 2417922 - DNA, 18 bp, Homo sapiens
atgtattttatgttatat

SEQ ID NO: 2417923 - DNA, 23 bp, Homo sapiens
atgtcaaatatttagatgtaatt

SEQ ID NO: 2417924 - DNA, 20 bp, Homo sapiens
atgtcagggtacctggggcc

SEQ ID NO: 2417925 - DNA, 15 bp, Homo sapiens
atgtcatgctgcctt

SEQ ID NO: 2417926 - DNA, 16 bp, Homo sapiens
atgtcatgctgcctta

SEQ ID NO: 2417927 - DNA, 17 bp, Homo sapiens
atgtcatttcagaagtt

SEQ ID NO: 2417928 - DNA, 12 bp, Homo sapiens
atgtccaaagag

SEQ ID NO: 2417929 - DNA, 16 bp, Homo sapiens
atgtccaaagaggctg

SEQ ID NO: 2417930 - DNA, 12 bp, Homo sapiens
atgtccaggaaa

SEQ ID NO: 2417931 - DNA, 14 bp, Homo sapiens
atgtctcctaagca

SEQ ID NO: 2417932 - DNA, 14 bp, Homo sapiens
atgtctggagacca

SEQ ID NO: 2417933 - DNA, 13 bp, Homo sapiens
atgtctggttctc

SEQ ID NO: 2417934 - DNA, 14 bp, Homo sapiens
atgtctggttctca

SEQ ID NO: 2417935 - DNA, 16 bp, Homo sapiens
atgtctggttctcaat

SEQ ID NO: 2417936 - DNA, 22 bp, Homo sapiens
atgtgaaccattaaccagatct

SEQ ID NO: 2417937 - DNA, 22 bp, Homo sapiens
atgtgaagccaattcagacagg

SEQ ID NO: 2417938 - DNA, 14 bp, Homo sapiens
atgtgaagccttcc

SEQ ID NO: 2417939 - DNA, 19 bp, Homo sapiens
cacatttggaatacttttt

SEQ ID NO: 2417940 - DNA, 16 bp, Homo sapiens
caccaaagttctaata

SEQ ID NO: 2417941 - DNA, 22 bp, Homo sapiens
caccaaagttctaataatttct

SEQ ID NO: 2417942 - DNA, 21 bp, Homo sapiens
caccaaatcaaaatctctcca

SEQ ID NO: 2417943 - DNA, 22 bp, Homo sapiens
caccaactcctagttctagaaa

SEQ ID NO: 2417944 - DNA, 13 bp, Homo sapiens
caccaagcacagc

SEQ ID NO: 2417945 - DNA, 17 bp, Homo sapiens
caccaagcacagcagcc

SEQ ID NO: 2417946 - DNA, 16 bp, Homo sapiens
caccaagtgcgggtcc

SEQ ID NO: 2417947 - DNA, 23 bp, Homo sapiens
caccaatgtacccaccgggccac

SEQ ID NO: 2417948 - DNA, 17 bp, Homo sapiens
caccacagccagcacct

SEQ ID NO: 2417949 - DNA, 15 bp, Homo sapiens
caccactagcctcag

SEQ ID NO: 2417950 - DNA, 18 bp, Homo sapiens
caccactagcctcagggg

SEQ ID NO: 2417951 - DNA, 12 bp, Homo sapiens
caccactctggc

SEQ ID NO: 2417952 - DNA, 18 bp, Homo sapiens
caccagacacccaggact

SEQ ID NO: 2417953 - DNA, 19 bp, Homo sapiens
caccagacacccaggactt

SEQ ID NO: 2417954 - DNA, 13 bp, Homo sapiens
caccagatgctga

SEQ ID NO: 2417955 - DNA, 15 bp, Homo sapiens
caccaggcagcctct

SEQ ID NO: 2417956 - DNA, 18 bp, Homo sapiens
caccaggcagcctctggg

SEQ ID NO: 2417957 - DNA, 14 bp, Homo sapiens
caccaggccacctc

SEQ ID NO: 2417958 - DNA, 19 bp, Homo sapiens
caccaggccacctccccag

SEQ ID NO: 2417959 - DNA, 17 bp, Homo sapiens
caccaggcgctaattca

SEQ ID NO: 2417960 - DNA, 17 bp, Homo sapiens
caccagggccagcctct

SEQ ID NO: 2417961 - DNA, 22 bp, Homo sapiens
caccagggttgaccccagagga

SEQ ID NO: 2417962 - DNA, 12 bp, Homo sapiens
caccatggccag

SEQ ID NO: 2417963 - DNA, 16 bp, Homo sapiens
caccattataatgaat

SEQ ID NO: 2417964 - DNA, 18 bp, Homo sapiens
caccattataatgaattt

SEQ ID NO: 2417965 - DNA, 20 bp, Homo sapiens
caccattccaagtctccacc

SEQ ID NO: 2417966 - DNA, 13 bp, Homo sapiens
caccattctgact

SEQ ID NO: 2417967 - DNA, 16 bp, Homo sapiens
caccattgaaggctta

SEQ ID NO: 2417968 - DNA, 22 bp, Homo sapiens
caccatttggcatccctgggcc

SEQ ID NO: 2417969 - DNA, 18 bp, Homo sapiens
cacccaccaaccctcagg

SEQ ID NO: 2417970 - DNA, 14 bp, Homo sapiens
cacccacttctgca

SEQ ID NO: 2417971 - DNA, 20 bp, Homo sapiens
cacccagacataaaggaaaa

SEQ ID NO: 2417972 - DNA, 21 bp, Homo sapiens
cacccagacataaaggaaaag

SEQ ID NO: 2417973 - DNA, 19 bp, Homo sapiens
cacccagccccagccaggg

SEQ ID NO: 2417974 - DNA, 12 bp, Homo sapiens
cacccaggccag

SEQ ID NO: 2417975 - DNA, 13 bp, Homo sapiens
cacccaggggcag

SEQ ID NO: 2417976 - DNA, 16 bp, Homo sapiens
cacccaggggcagccc

SEQ ID NO: 2417977 - DNA, 23 bp, Homo sapiens
cacccagtgccctctcccctcag

SEQ ID NO: 2417978 - DNA, 11 bp, Homo sapiens
cacccatctgt

SEQ ID NO: 2417979 - DNA, 15 bp, Homo sapiens
cacccatttttcctt

SEQ ID NO: 2417980 - DNA, 16 bp, Homo sapiens
caccccaacctgctct

SEQ ID NO: 2417981 - DNA, 19 bp, Homo sapiens
caccccaatcctcccagaa

SEQ ID NO: 2417982 - DNA, 14 bp, Homo sapiens
caccccacccttcc

SEQ ID NO: 2417983 - DNA, 13 bp, Homo sapiens
caccccagggcag

SEQ ID NO: 2417984 - DNA, 22 bp, Homo sapiens
caccccagggcagccagggaga

SEQ ID NO: 2417985 - DNA, 21 bp, Homo sapiens
caccccatcccacaccctgga

SEQ ID NO: 2417986 - DNA, 15 bp, Homo sapiens
caccccattcccgca

SEQ ID NO: 2417987 - DNA, 17 bp, Homo sapiens
cacccccacccccagct

SEQ ID NO: 2417988 - DNA, 13 bp, Homo sapiens
cacccccagcctg

SEQ ID NO: 2417989 - DNA, 14 bp, Homo sapiens
cacccccagcctgg

SEQ ID NO: 2417990 - DNA, 15 bp, Homo sapiens
cacccccagcctggg

SEQ ID NO: 2417991 - DNA, 18 bp, Homo sapiens
cacccccagcctgggcct

SEQ ID NO: 2417992 - DNA, 12 bp, Homo sapiens
cacccccagctc

SEQ ID NO: 2417993 - DNA, 13 bp, Homo sapiens
cacccccatctct

SEQ ID NO: 2417994 - DNA, 17 bp, Homo sapiens
caccctcattctactga

SEQ ID NO: 2417995 - DNA, 21 bp, Homo sapiens
caccctcggggatgtgtcctg

SEQ ID NO: 2417996 - DNA, 11 bp, Homo sapiens
caccctcttcc

SEQ ID NO: 2417997 - DNA, 16 bp, Homo sapiens
caccctcttcctactg

SEQ ID NO: 2417998 - DNA, 17 bp, Homo sapiens
caccctcttcctactgg

SEQ ID NO: 2417999 - DNA, 15 bp, Homo sapiens
caccctgaggagtct

SEQ ID NO: 2418000 - DNA, 18 bp, Homo sapiens
caccctgaggagtctgag

SEQ ID NO: 2418001 - DNA, 12 bp, Homo sapiens
caccctgcctta

SEQ ID NO: 2418002 - DNA, 19 bp, Homo sapiens
caccctgccttatcttgca

SEQ ID NO: 2418003 - DNA, 12 bp, Homo sapiens
caccctgggccc

SEQ ID NO: 2418004 - DNA, 21 bp, Homo sapiens
caccctgggccctgggctgga

SEQ ID NO: 2418005 - DNA, 15 bp, Homo sapiens
caccctggtgggcca

SEQ ID NO: 2418006 - DNA, 16 bp, Homo sapiens
caccctggtgggccaa

SEQ ID NO: 2418007 - DNA, 16 bp, Homo sapiens
caccctgttcctgctg

SEQ ID NO: 2418008 - DNA, 17 bp, Homo sapiens
caccctgttcctgctgc

SEQ ID NO: 2418009 - DNA, 17 bp, Homo sapiens
cacccttctcccactct

SEQ ID NO: 2418010 - DNA, 15 bp, Homo sapiens
cacccttttccagct

SEQ ID NO: 2418011 - DNA, 15 bp, Homo sapiens
caccgaagcccagag

SEQ ID NO: 2418012 - DNA, 21 bp, Homo sapiens
caccgggccactccttcctgc

SEQ ID NO: 2418013 - DNA, 17 bp, Homo sapiens
caccgtgggctccctga

SEQ ID NO: 2418014 - DNA, 15 bp, Homo sapiens
caccgttctgtgcac

SEQ ID NO: 2418015 - DNA, 14 bp, Homo sapiens
caccgttgtctcat

SEQ ID NO: 2418016 - DNA, 17 bp, Homo sapiens
caccgtttcttcctgcc

SEQ ID NO: 2418017 - DNA, 13 bp, Homo sapiens
cacctaaagaaaa

SEQ ID NO: 2418018 - DNA, 17 bp, Homo sapiens
cacctaaagaaaaacaa

SEQ ID NO: 2418019 - DNA, 14 bp, Homo sapiens
cacctagcagcacc

SEQ ID NO: 2418020 - DNA, 13 bp, Homo sapiens
cacctagctgaat

SEQ ID NO: 2418021 - DNA, 18 bp, Homo sapiens
cacctagctgaatgtttt

SEQ ID NO: 2418022 - DNA, 12 bp, Homo sapiens
cacctcagatgg

SEQ ID NO: 2418023 - DNA, 13 bp, Homo sapiens
cacctcagatggc

SEQ ID NO: 2418024 - DNA, 18 bp, Homo sapiens
cacctcagatggcagctt

SEQ ID NO: 2418025 - DNA, 20 bp, Homo sapiens
cacctcagatggcagctttt

SEQ ID NO: 2418026 - DNA, 21 bp, Homo sapiens
cacctcagatggcagctttta

SEQ ID NO: 2418027 - DNA, 16 bp, Homo sapiens
cacctcagcctcccaa

SEQ ID NO: 2418028 - DNA, 13 bp, Homo sapiens
cacctcccttggg

SEQ ID NO: 2418029 - DNA, 14 bp, Homo sapiens
cacctcctcagcct

SEQ ID NO: 2418030 - DNA, 14 bp, Homo sapiens
cacctcctcatgta

SEQ ID NO: 2418031 - DNA, 20 bp, Homo sapiens
cacctcctgggttcaagcga

SEQ ID NO: 2418032 - DNA, 20 bp, Homo sapiens
cacctctaacagcaccaaat

SEQ ID NO: 2418033 - DNA, 22 bp, Homo sapiens
cacctctaggtccccatactcc

SEQ ID NO: 2418034 - DNA, 19 bp, Homo sapiens
cacctgaactgaacaccat

SEQ ID NO: 2418035 - DNA, 14 bp, Homo sapiens
cacctgaggaactg

SEQ ID NO: 2418036 - DNA, 15 bp, Homo sapiens
cacctgcactaacag

SEQ ID NO: 2418037 - DNA, 15 bp, Homo sapiens
cacctgccccaactc

SEQ ID NO: 2418038 - DNA, 14 bp, Homo sapiens
cacctgccctacct

SEQ ID NO: 2418039 - DNA, 11 bp, Homo sapiens
cacctggaccc

SEQ ID NO: 2418040 - DNA, 12 bp, Homo sapiens
cacctggacccc

SEQ ID NO: 2418041 - DNA, 16 bp, Homo sapiens
cacctggacccctgca

SEQ ID NO: 2418042 - DNA, 19 bp, Homo sapiens
cacctggacccctgcattg

SEQ ID NO: 2418043 - DNA, 13 bp, Homo sapiens
cacctggccctgc

SEQ ID NO: 2418044 - DNA, 20 bp, Homo sapiens
cacctggccctgcttcctgc

SEQ ID NO: 2418045 - DNA, 22 bp, Homo sapiens
cacctggccctgcttcctgctt

SEQ ID NO: 2418046 - DNA, 18 bp, Homo sapiens
cacctggctctcacctct

SEQ ID NO: 2418047 - DNA, 14 bp, Homo sapiens
cacctgggccctgg

SEQ ID NO: 2418048 - DNA, 22 bp, Homo sapiens
cacctgggccctggggcctgta

SEQ ID NO: 2418049 - DNA, 15 bp, Homo sapiens
cacctggtggccatg

SEQ ID NO: 2418050 - DNA, 21 bp, Homo sapiens
cacctggtggccatgctcctc

SEQ ID NO: 2418051 - DNA, 15 bp, Homo sapiens
cacctgtagcagcca

SEQ ID NO: 2418052 - DNA, 17 bp, Homo sapiens
cacctgtctcagcctcc

SEQ ID NO: 2418053 - DNA, 19 bp, Homo sapiens
cacctgtctcagcctccca

SEQ ID NO: 2418054 - DNA, 19 bp, Homo sapiens
caccttcaccttcatccat

SEQ ID NO: 2418055 - DNA, 23 bp, Homo sapiens
caccttgctcctccttctgctgc

SEQ ID NO: 2418056 - DNA, 12 bp, Homo sapiens
cacctttactgt

SEQ ID NO: 2418057 - DNA, 15 bp, Homo sapiens
cacctttaggttctt

SEQ ID NO: 2418058 - DNA, 17 bp, Homo sapiens
cacctttgtttctcccc

SEQ ID NO: 2418059 - DNA, 15 bp, Homo sapiens
cacgaaatgttattt

SEQ ID NO: 2418060 - DNA, 16 bp, Homo sapiens
cacgactgtctccatg

SEQ ID NO: 2418061 - DNA, 23 bp, Homo sapiens
cacgaggaatctgtgggtctggg

SEQ ID NO: 2418062 - DNA, 21 bp, Homo sapiens
cacgagggctggctggcctca

SEQ ID NO: 2418063 - DNA, 15 bp, Homo sapiens
cacgcatgcagtgtt

SEQ ID NO: 2418064 - DNA, 16 bp, Homo sapiens
cacgcccgtcctgcct

SEQ ID NO: 2418065 - DNA, 18 bp, Homo sapiens
cacgctccagctgccccg

SEQ ID NO: 2418066 - DNA, 19 bp, Homo sapiens
cacgctctctccaggcagg

SEQ ID NO: 2418067 - DNA, 13 bp, Homo sapiens
cacgcttttgtga

SEQ ID NO: 2418068 - DNA, 18 bp, Homo sapiens
cacggagccactcctctg

SEQ ID NO: 2418069 - DNA, 21 bp, Homo sapiens
cacggagccactcctctgact

SEQ ID NO: 2418070 - DNA, 22 bp, Homo sapiens
cacggagccgcgggacagccaa

SEQ ID NO: 2418071 - DNA, 16 bp, Homo sapiens
cacggccacacagctg

SEQ ID NO: 2418072 - DNA, 13 bp, Homo sapiens
cacggccacatca

SEQ ID NO: 2418073 - DNA, 19 bp, Homo sapiens
cacggccacatcaaagagg

SEQ ID NO: 2418074 - DNA, 16 bp, Homo sapiens
cacggctgcgcactgt

SEQ ID NO: 2418075 - DNA, 14 bp, Homo sapiens
cacgggcctgtcca

SEQ ID NO: 2418076 - DNA, 20 bp, Homo sapiens
cacgggtgtcacggccaggc

SEQ ID NO: 2418077 - DNA, 16 bp, Homo sapiens
cacgtacccaggtctg

SEQ ID NO: 2418078 - DNA, 17 bp, Homo sapiens
cacgtggcctcttgagc

SEQ ID NO: 2418079 - DNA, 23 bp, Homo sapiens
cacgtggcctcttgagcagtggc

SEQ ID NO: 2418080 - DNA, 15 bp, Homo sapiens
cacgtgtgctgggat

SEQ ID NO: 2418081 - DNA, 17 bp, Homo sapiens
cacgtgtgtttttctat

SEQ ID NO: 2418082 - DNA, 20 bp, Homo sapiens
cacgtgtgtttttctattaa

SEQ ID NO: 2418083 - DNA, 23 bp, Homo sapiens
cacgtgtgtttttctattaaaag

SEQ ID NO: 2418084 - DNA, 16 bp, Homo sapiens
cactaatatatttaaa

SEQ ID NO: 2418085 - DNA, 16 bp, Homo sapiens
cagcaaaccggggcct

SEQ ID NO: 2418086 - DNA, 20 bp, Homo sapiens
cagcaacggcacagctaatt

SEQ ID NO: 2418087 - DNA, 20 bp, Homo sapiens
cagcaactatcagactaagc

SEQ ID NO: 2418088 - DNA, 23 bp, Homo sapiens
cagcaactatcagactaagccag

SEQ ID NO: 2418089 - DNA, 17 bp, Homo sapiens
cagcaacttgtcctagc

SEQ ID NO: 2418090 - DNA, 23 bp, Homo sapiens
cagcaacttgtcctagcacagat

SEQ ID NO: 2418091 - DNA, 22 bp, Homo sapiens
cagcaaggcccgagcagctgag

SEQ ID NO: 2418092 - DNA, 13 bp, Homo sapiens
cagcaatttctaa

SEQ ID NO: 2418093 - DNA, 23 bp, Homo sapiens
cagcaatttctaatttttaagaa

SEQ ID NO: 2418094 - DNA, 13 bp, Homo sapiens
cagcacagcttga

SEQ ID NO: 2418095 - DNA, 16 bp, Homo sapiens
cagcacaggagggcgg

SEQ ID NO: 2418096 - DNA, 16 bp, Homo sapiens
cagcacatctcaacag

SEQ ID NO: 2418097 - DNA, 15 bp, Homo sapiens
cagcaccaaatcaaa

SEQ ID NO: 2418098 - DNA, 18 bp, Homo sapiens
cagcaccggaccagcctg

SEQ ID NO: 2418099 - DNA, 20 bp, Homo sapiens
cagcaccggaccagcctggc

SEQ ID NO: 2418100 - DNA, 22 bp, Homo sapiens
cagcaccggaccagcctggccc

SEQ ID NO: 2418101 - DNA, 16 bp, Homo sapiens
cagcaccgttctgtgc

SEQ ID NO: 2418102 - DNA, 12 bp, Homo sapiens
cagcacctcctc

SEQ ID NO: 2418103 - DNA, 17 bp, Homo sapiens
cagcacctcctcagcct

SEQ ID NO: 2418104 - DNA, 15 bp, Homo sapiens
cagcactagccaaac

SEQ ID NO: 2418105 - DNA, 15 bp, Homo sapiens
cagcactgcctgctc

SEQ ID NO: 2418106 - DNA, 23 bp, Homo sapiens
cagcactgcctgctcccatcctg

SEQ ID NO: 2418107 - DNA, 12 bp, Homo sapiens
cagcacttccat

SEQ ID NO: 2418108 - DNA, 14 bp, Homo sapiens
cagcacttggccct

SEQ ID NO: 2418109 - DNA, 22 bp, Homo sapiens
cagcagcatctctaccttctcc

SEQ ID NO: 2418110 - DNA, 11 bp, Homo sapiens
cagcagccagc

SEQ ID NO: 2418111 - DNA, 16 bp, Homo sapiens
cagcagccagccctgc

SEQ ID NO: 2418112 - DNA, 18 bp, Homo sapiens
cagcagccagccctgcct

SEQ ID NO: 2418113 - DNA, 12 bp, Homo sapiens
cagcagccccca

SEQ ID NO: 2418114 - DNA, 18 bp, Homo sapiens
cagcagcctcgcccctgg

SEQ ID NO: 2418115 - DNA, 20 bp, Homo sapiens
cagcagcctggggctggcct

SEQ ID NO: 2418116 - DNA, 21 bp, Homo sapiens
cagcagctttagaatcccagc

SEQ ID NO: 2418117 - DNA, 15 bp, Homo sapiens
cagcaggagggggga

SEQ ID NO: 2418118 - DNA, 15 bp, Homo sapiens
cacttggcagccttg

SEQ ID NO: 2418119 - DNA, 16 bp, Homo sapiens
cacttggcagccttgt

SEQ ID NO: 2418120 - DNA, 19 bp, Homo sapiens
cacttggtaattgtactaa

SEQ ID NO: 2418121 - DNA, 20 bp, Homo sapiens
cacttgtaattttgtatctt

SEQ ID NO: 2418122 - DNA, 12 bp, Homo sapiens
cacttgtacaat

SEQ ID NO: 2418123 - DNA, 22 bp, Homo sapiens
cacttgtcaggagtgtgtgtga

SEQ ID NO: 2418124 - DNA, 23 bp, Homo sapiens
cacttgtccagctgagcgccagg

SEQ ID NO: 2418125 - DNA, 15 bp, Homo sapiens
cactttcagctgtct

SEQ ID NO: 2418126 - DNA, 20 bp, Homo sapiens
cactttctatcctctgtaaa

SEQ ID NO: 2418127 - DNA, 11 bp, Homo sapiens
cactttcttat

SEQ ID NO: 2418128 - DNA, 18 bp, Homo sapiens
cactttggcttataattc

SEQ ID NO: 2418129 - DNA, 20 bp, Homo sapiens
cactttgtttcgtggggagg

SEQ ID NO: 2418130 - DNA, 17 bp, Homo sapiens
cacttttgacaaaggca

SEQ ID NO: 2418131 - DNA, 17 bp, Homo sapiens
cactttttctctttcca

SEQ ID NO: 2418132 - DNA, 15 bp, Homo sapiens
cagaaaaaccttggg

SEQ ID NO: 2418133 - DNA, 22 bp, Homo sapiens
cagaaaaatatgtaccaagaat

SEQ ID NO: 2418134 - DNA, 14 bp, Homo sapiens
cagaaaacaaaact

SEQ ID NO: 2418135 - DNA, 17 bp, Homo sapiens
cagaaaacccttgggcc

SEQ ID NO: 2418136 - DNA, 23 bp, Homo sapiens
cagaaaataaggcacccatctgt

SEQ ID NO: 2418137 - DNA, 19 bp, Homo sapiens
cagaaaatatccctcctgt

SEQ ID NO: 2418138 - DNA, 14 bp, Homo sapiens
cagaaaatgttgag

SEQ ID NO: 2418139 - DNA, 13 bp, Homo sapiens
cagaaaattctgt

SEQ ID NO: 2418140 - DNA, 15 bp, Homo sapiens
cagaaaattctgtgc

SEQ ID NO: 2418141 - DNA, 22 bp, Homo sapiens
cagaaagcagttgagacaagaa

SEQ ID NO: 2418142 - DNA, 20 bp, Homo sapiens
cagaaagccccacccaggcc

SEQ ID NO: 2418143 - DNA, 21 bp, Homo sapiens
cagaaagccccacccaggcca

SEQ ID NO: 2418144 - DNA, 23 bp, Homo sapiens
cagaaagccccacccaggccagg

SEQ ID NO: 2418145 - DNA, 19 bp, Homo sapiens
cagaaagcctgggtgacat

SEQ ID NO: 2418146 - DNA, 20 bp, Homo sapiens
cagaaagggagggctctgag

SEQ ID NO: 2418147 - DNA, 21 bp, Homo sapiens
cagaaagggagggctctgagg

SEQ ID NO: 2418148 - DNA, 14 bp, Homo sapiens
cagaaagtgcctga

SEQ ID NO: 2418149 - DNA, 15 bp, Homo sapiens
cagaaagtgcctgac

SEQ ID NO: 2418150 - DNA, 15 bp, Homo sapiens
cagaaagtgcctttc

SEQ ID NO: 2418151 - DNA, 22 bp, Homo sapiens
cagaaagtgcctttcaggatct

SEQ ID NO: 2418152 - DNA, 15 bp, Homo sapiens
cagaaccaattattt

SEQ ID NO: 2418153 - DNA, 14 bp, Homo sapiens
cagaaccacagggc

SEQ ID NO: 2418154 - DNA, 18 bp, Homo sapiens
cagaaccggagagccagc

SEQ ID NO: 2418155 - DNA, 18 bp, Homo sapiens
cagaagcctgatgctgac

SEQ ID NO: 2418156 - DNA, 21 bp, Homo sapiens
cagaagcctgggggcctggct

SEQ ID NO: 2418157 - DNA, 16 bp, Homo sapiens
cagaagctcccccagc

SEQ ID NO: 2418158 - DNA, 22 bp, Homo sapiens
cagaagggagggcagagctggt

SEQ ID NO: 2418159 - DNA, 15 bp, Homo sapiens
cagaagtaccagact

SEQ ID NO: 2418160 - DNA, 16 bp, Homo sapiens
cagaagtaccagacta

SEQ ID NO: 2418161 - DNA, 22 bp, Homo sapiens
cagaagtcatcttgctaccagt

SEQ ID NO: 2418162 - DNA, 14 bp, Homo sapiens
cagaagtgcatctg

SEQ ID NO: 2418163 - DNA, 18 bp, Homo sapiens
cagaagttagtttgtata

SEQ ID NO: 2418164 - DNA, 16 bp, Homo sapiens
cagaagtttgcactat

SEQ ID NO: 2418165 - DNA, 17 bp, Homo sapiens
cagaataagttattgca

SEQ ID NO: 2418166 - DNA, 20 bp, Homo sapiens
cagaataagttattgcagtt

SEQ ID NO: 2418167 - DNA, 21 bp, Homo sapiens
cagaataagttattgcagttt

SEQ ID NO: 2418168 - DNA, 13 bp, Homo sapiens
cagaatatgtcag

SEQ ID NO: 2418169 - DNA, 11 bp, Homo sapiens
cagaatgctgt

SEQ ID NO: 2418170 - DNA, 17 bp, Homo sapiens
cagaatgctgtacatct

SEQ ID NO: 2418171 - DNA, 21 bp, Homo sapiens
cagaatgtcattttggtactt

SEQ ID NO: 2418172 - DNA, 16 bp, Homo sapiens
cagaatgttgattaca

SEQ ID NO: 2418173 - DNA, 15 bp, Homo sapiens
cagaattaaactttt

SEQ ID NO: 2418174 - DNA, 16 bp, Homo sapiens
cagaattaaactttta

SEQ ID NO: 2418175 - DNA, 23 bp, Homo sapiens
cagaattaaacttttaattcatt

SEQ ID NO: 2418176 - DNA, 18 bp, Homo sapiens
cagaatttagtgtatcca

SEQ ID NO: 2418177 - DNA, 15 bp, Homo sapiens
cagacacaggccctc

SEQ ID NO: 2418178 - DNA, 13 bp, Homo sapiens
cagacacccagga

SEQ ID NO: 2418179 - DNA, 14 bp, Homo sapiens
cagacaccttggac

SEQ ID NO: 2418180 - DNA, 20 bp, Homo sapiens
cagacaggccccgtgaggca

SEQ ID NO: 2418181 - DNA, 18 bp, Homo sapiens
cagacaggctcttagcag

SEQ ID NO: 2418182 - DNA, 16 bp, Homo sapiens
cagacaggtccctccc

SEQ ID NO: 2418183 - DNA, 19 bp, Homo sapiens
cagacagtgttttctggga

SEQ ID NO: 2418184 - DNA, 20 bp, Homo sapiens
cagacataaaggaaaagaca

SEQ ID NO: 2418185 - DNA, 18 bp, Homo sapiens
caaatggcgtctggaagt

SEQ ID NO: 2418186 - DNA, 22 bp, Homo sapiens
caaatggcgtctggaagtccaa

SEQ ID NO: 2418187 - DNA, 15 bp, Homo sapiens
caaatggggccagat

SEQ ID NO: 2418188 - DNA, 20 bp, Homo sapiens
caaatggtaggcatttccta

SEQ ID NO: 2418189 - DNA, 16 bp, Homo sapiens
caaatgtcatgctgcc

SEQ ID NO: 2418190 - DNA, 19 bp, Homo sapiens
caaatgtcatgctgcctta

SEQ ID NO: 2418191 - DNA, 14 bp, Homo sapiens
caaatgtgctttga

SEQ ID NO: 2418192 - DNA, 16 bp, Homo sapiens
caaatgttaaaatgtg

SEQ ID NO: 2418193 - DNA, 12 bp, Homo sapiens
caaatgttctaa

SEQ ID NO: 2418194 - DNA, 14 bp, Homo sapiens
caaattagttatat

SEQ ID NO: 2418195 - DNA, 20 bp, Homo sapiens
caaattcagtttcataaaag

SEQ ID NO: 2418196 - DNA, 19 bp, Homo sapiens
caaatttaaaactgttgga

SEQ ID NO: 2418197 - DNA, 14 bp, Homo sapiens
caaatttgattgat

SEQ ID NO: 2418198 - DNA, 22 bp, Homo sapiens
caacaaaagaagcccggctcct

SEQ ID NO: 2418199 - DNA, 13 bp, Homo sapiens
caacaatttcaat

SEQ ID NO: 2418200 - DNA, 20 bp, Homo sapiens
caacaatttctactttgaag

SEQ ID NO: 2418201 - DNA, 24 bp, Homo sapiens
caacacagcttgtctcttgcctgc

SEQ ID NO: 2418202 - DNA, 16 bp, Homo sapiens
caacacccatttttcc

SEQ ID NO: 2418203 - DNA, 17 bp, Homo sapiens
caacacgcacctgcctc

SEQ ID NO: 2418204 - DNA, 14 bp, Homo sapiens
caacagatcagtaa

SEQ ID NO: 2418205 - DNA, 13 bp, Homo sapiens
caacagatctgga

SEQ ID NO: 2418206 - DNA, 12 bp, Homo sapiens
caacagcgccca

SEQ ID NO: 2418207 - DNA, 15 bp, Homo sapiens
caacagcgttcctag

SEQ ID NO: 2418208 - DNA, 19 bp, Homo sapiens
caacagctggaccctgacc

SEQ ID NO: 2418209 - DNA, 15 bp, Homo sapiens
caacaggcctcaggg

SEQ ID NO: 2418210 - DNA, 16 bp, Homo sapiens
caacaggcctcagggc

SEQ ID NO: 2418211 - DNA, 19 bp, Homo sapiens
caacaggcctcagggctcc

SEQ ID NO: 2418212 - DNA, 20 bp, Homo sapiens
caacaggcctcagggctcct

SEQ ID NO: 2418213 - DNA, 20 bp, Homo sapiens
caacagttttcctatgcttt

SEQ ID NO: 2418214 - DNA, 21 bp, Homo sapiens
caacatagtattcatgactat

SEQ ID NO: 2418215 - DNA, 14 bp, Homo sapiens
caacatcacagccc

SEQ ID NO: 2418216 - DNA, 20 bp, Homo sapiens
caacatcacagcccagcccg

SEQ ID NO: 2418217 - DNA, 15 bp, Homo sapiens
caacatgttatttgt

SEQ ID NO: 2418218 - DNA, 22 bp, Homo sapiens
caacatttctatagccaaaaat

SEQ ID NO: 2418219 - DNA, 14 bp, Homo sapiens
caaccaatggaatg

SEQ ID NO: 2418220 - DNA, 23 bp, Homo sapiens
caaccactggtctgtagggattt

SEQ ID NO: 2418221 - DNA, 14 bp, Homo sapiens
caaccatgtcattt

SEQ ID NO: 2418222 - DNA, 16 bp, Homo sapiens
caaccatgtcatttca

SEQ ID NO: 2418223 - DNA, 22 bp, Homo sapiens
caaccatgtcatttcagaagtt

SEQ ID NO: 2418224 - DNA, 17 bp, Homo sapiens
caaccatttcctcagac

SEQ ID NO: 2418225 - DNA, 18 bp, Homo sapiens
caacccaacctcatcctc

SEQ ID NO: 2418226 - DNA, 21 bp, Homo sapiens
caacccgtctggcccaccagg

SEQ ID NO: 2418227 - DNA, 13 bp, Homo sapiens
caaccctcagggc

SEQ ID NO: 2418228 - DNA, 22 bp, Homo sapiens
caaccctcagggcaaagccagg

SEQ ID NO: 2418229 - DNA, 21 bp, Homo sapiens
caaccgtggcccttcctggac

SEQ ID NO: 2418230 - DNA, 22 bp, Homo sapiens
caaccgtggcccttcctggaca

SEQ ID NO: 2418231 - DNA, 19 bp, Homo sapiens
caagtatttgggaagtgaa

SEQ ID NO: 2418232 - DNA, 22 bp, Homo sapiens
caagtatttgggaagtgaagac

SEQ ID NO: 2418233 - DNA, 11 bp, Homo sapiens
caagtattttt

SEQ ID NO: 2418234 - DNA, 13 bp, Homo sapiens
caagtccaggtcc

SEQ ID NO: 2418235 - DNA, 24 bp, Homo sapiens
caagtccaggtcctggtggggcag

SEQ ID NO: 2418236 - DNA, 22 bp, Homo sapiens
caagtctctgctggcccagcca

SEQ ID NO: 2418237 - DNA, 23 bp, Homo sapiens
caagtctctgctggcccagccaa

SEQ ID NO: 2418238 - DNA, 17 bp, Homo sapiens
caagtctttctctttcc

SEQ ID NO: 2418239 - DNA, 21 bp, Homo sapiens
caagtctttctctttccctgg

SEQ ID NO: 2418240 - DNA, 23 bp, Homo sapiens
caagtctttctctttccctggtc

SEQ ID NO: 2418241 - DNA, 15 bp, Homo sapiens
caagtgaggcagccg

SEQ ID NO: 2418242 - DNA, 17 bp, Homo sapiens
caagttcatgcagctgt

SEQ ID NO: 2418243 - DNA, 20 bp, Homo sapiens
caagttcctctaacttggct

SEQ ID NO: 2418244 - DNA, 17 bp, Homo sapiens
caagttctaagattcta

SEQ ID NO: 2418245 - DNA, 18 bp, Homo sapiens
caagttctaagattctaa

SEQ ID NO: 2418246 - DNA, 19 bp, Homo sapiens
caagttgtgccaaattatt

SEQ ID NO: 2418247 - DNA, 22 bp, Homo sapiens
caagtttatcagtaaataactg

SEQ ID NO: 2418248 - DNA, 17 bp, Homo sapiens
caataactcctcccagg

SEQ ID NO: 2418249 - DNA, 15 bp, Homo sapiens
caatacaaatggatt

SEQ ID NO: 2418250 - DNA, 13 bp, Homo sapiens
caatacagatata

SEQ ID NO: 2418251 - DNA, 19 bp, Homo sapiens
caatagcagacagtgtttt

SEQ ID NO: 2418252 - DNA, 13 bp, Homo sapiens
caatatctgaagc

SEQ ID NO: 2418253 - DNA, 17 bp, Homo sapiens
caatcaactttactgta

SEQ ID NO: 2418254 - DNA, 15 bp, Homo sapiens
caatcagctccttcc

SEQ ID NO: 2418255 - DNA, 16 bp, Homo sapiens
caatcagctccttcct

SEQ ID NO: 2418256 - DNA, 22 bp, Homo sapiens
caatcccttaatatcctaaaca

SEQ ID NO: 2418257 - DNA, 12 bp, Homo sapiens
caatcctatgca

SEQ ID NO: 2418258 - DNA, 18 bp, Homo sapiens
caatcttgcatgtaacgc

SEQ ID NO: 2418259 - DNA, 15 bp, Homo sapiens
caatgaaaaaatgta

SEQ ID NO: 2418260 - DNA, 16 bp, Homo sapiens
caatgaaaactctttg

SEQ ID NO: 2418261 - DNA, 19 bp, Homo sapiens
caatgaaaactctttgctg

SEQ ID NO: 2418262 - DNA, 23 bp, Homo sapiens
caatgaattttataatctgcagc

SEQ ID NO: 2418263 - DNA, 14 bp, Homo sapiens
caatgacaaagcag

SEQ ID NO: 2418264 - DNA, 13 bp, Homo sapiens
caatgagcatgtt

SEQ ID NO: 2418265 - DNA, 18 bp, Homo sapiens
caatgagcatgtttagac

SEQ ID NO: 2418266 - DNA, 21 bp, Homo sapiens
caatgatgaatgagaatctac

SEQ ID NO: 2418267 - DNA, 13 bp, Homo sapiens
caatgccatcatc

SEQ ID NO: 2418268 - DNA, 17 bp, Homo sapiens
caatgctcaggtgctgg

SEQ ID NO: 2418269 - DNA, 21 bp, Homo sapiens
caatgggagctgaggccacac

SEQ ID NO: 2418270 - DNA, 14 bp, Homo sapiens
caatgtaaatattt

SEQ ID NO: 2418271 - DNA, 23 bp, Homo sapiens
caatgtaattatttatgtatggt

SEQ ID NO: 2418272 - DNA, 20 bp, Homo sapiens
caatgtagataagtgttctg

SEQ ID NO: 2418273 - DNA, 23 bp, Homo sapiens
caatgtgtataaacaagaaaaat

SEQ ID NO: 2418274 - DNA, 12 bp, Homo sapiens
caatgtgtgtat

SEQ ID NO: 2418275 - DNA, 16 bp, Homo sapiens
caatgtgtgtatatgg

SEQ ID NO: 2418276 - DNA, 18 bp, Homo sapiens
caatgtgtgtatatggac

SEQ ID NO: 2418277 - DNA, 21 bp, Homo sapiens
caatgttaaacttataaccca

SEQ ID NO: 2418278 - DNA, 22 bp, Homo sapiens
caatgtttcaagaggagccccc

SEQ ID NO: 2418279 - DNA, 17 bp, Homo sapiens
caatgtttcttctaggt

SEQ ID NO: 2418280 - DNA, 18 bp, Homo sapiens
caattagtttccttttta

SEQ ID NO: 2418281 - DNA, 17 bp, Homo sapiens
caattcccctctgctgc

SEQ ID NO: 2418282 - DNA, 17 bp, Homo sapiens
caattgctgctacttat

SEQ ID NO: 2418283 - DNA, 21 bp, Homo sapiens
caattgtgagccaccacgtcc

SEQ ID NO: 2418284 - DNA, 15 bp, Homo sapiens
caattgtgtagcctt

SEQ ID NO: 2418285 - DNA, 18 bp, Homo sapiens
caattgtgtagccttttt

SEQ ID NO: 2418286 - DNA, 15 bp, Homo sapiens
caatttcaaggttct

SEQ ID NO: 2418287 - DNA, 16 bp, Homo sapiens
caatttcaaggttcta

SEQ ID NO: 2418288 - DNA, 17 bp, Homo sapiens
caatttctaatttttaa

SEQ ID NO: 2418289 - DNA, 14 bp, Homo sapiens
attggatttcctaa

SEQ ID NO: 2418290 - DNA, 23 bp, Homo sapiens
attggatttcctaatactgtcat

SEQ ID NO: 2418291 - DNA, 21 bp, Homo sapiens
attggcatggaaatttaaagc

SEQ ID NO: 2418292 - DNA, 21 bp, Homo sapiens
attggcctgtagagttgctga

SEQ ID NO: 2418293 - DNA, 23 bp, Homo sapiens
attggcctgtagagttgctgaga

SEQ ID NO: 2418294 - DNA, 22 bp, Homo sapiens
attggggaagagagcctgcagg

SEQ ID NO: 2418295 - DNA, 23 bp, Homo sapiens
attggggaagagagcctgcagga

SEQ ID NO: 2418296 - DNA, 17 bp, Homo sapiens
attgggggaggaaaagt

SEQ ID NO: 2418297 - DNA, 13 bp, Homo sapiens
attggggtagttg

SEQ ID NO: 2418298 - DNA, 18 bp, Homo sapiens
attggtttaaagaaagtg

SEQ ID NO: 2418299 - DNA, 23 bp, Homo sapiens
attgtaaacaaactgtgtaactg

SEQ ID NO: 2418300 - DNA, 12 bp, Homo sapiens
attgtaaagtaa

SEQ ID NO: 2418301 - DNA, 17 bp, Homo sapiens
attgtagaattgtatat

SEQ ID NO: 2418302 - DNA, 15 bp, Homo sapiens
attgtatattgtaat

SEQ ID NO: 2418303 - DNA, 16 bp, Homo sapiens
attgtccttttgcaaa

SEQ ID NO: 2418304 - DNA, 17 bp, Homo sapiens
attgtccttttgcaaag

SEQ ID NO: 2418305 - DNA, 18 bp, Homo sapiens
attgtccttttgcaaaga

SEQ ID NO: 2418306 - DNA, 16 bp, Homo sapiens
attgtgagccaccacg

SEQ ID NO: 2418307 - DNA, 18 bp, Homo sapiens
attgtgcaatgtaaatat

SEQ ID NO: 2418308 - DNA, 17 bp, Homo sapiens
attgtgcaatgtgtata

SEQ ID NO: 2418309 - DNA, 16 bp, Homo sapiens
attgtgtagccttttt

SEQ ID NO: 2418310 - DNA, 20 bp, Homo sapiens
attgtgttacctgtagattc

SEQ ID NO: 2418311 - DNA, 15 bp, Homo sapiens
attgttacagaagct

SEQ ID NO: 2418312 - DNA, 21 bp, Homo sapiens
attgttacattatgtggaaaa

SEQ ID NO: 2418313 - DNA, 17 bp, Homo sapiens
attgttctcagaatccc

SEQ ID NO: 2418314 - DNA, 18 bp, Homo sapiens
attgttgaaaaagtttgt

SEQ ID NO: 2418315 - DNA, 16 bp, Homo sapiens
attgttgagctattgc

SEQ ID NO: 2418316 - DNA, 13 bp, Homo sapiens
attgttgtccttt

SEQ ID NO: 2418317 - DNA, 18 bp, Homo sapiens
attgttgtccttttcata

SEQ ID NO: 2418318 - DNA, 13 bp, Homo sapiens
attgttgttctgt

SEQ ID NO: 2418319 - DNA, 14 bp, Homo sapiens
attgttgttctgtt

SEQ ID NO: 2418320 - DNA, 17 bp, Homo sapiens
atttaaaaaactaaaaa

SEQ ID NO: 2418321 - DNA, 22 bp, Homo sapiens
atttaaaaaactaaaaactaga

SEQ ID NO: 2418322 - DNA, 20 bp, Homo sapiens
atttaaaacattaaaatata

SEQ ID NO: 2418323 - DNA, 13 bp, Homo sapiens
atttaaaatagca

SEQ ID NO: 2418324 - DNA, 20 bp, Homo sapiens
atttaaaatagcaaaagaag

SEQ ID NO: 2418325 - DNA, 18 bp, Homo sapiens
atttaaaccgctaaaaga

SEQ ID NO: 2418326 - DNA, 19 bp, Homo sapiens
atttaaaccgctaaaagaa

SEQ ID NO: 2418327 - DNA, 24 bp, Homo sapiens
atttaaaccgctaaaagaaacttt

SEQ ID NO: 2418328 - DNA, 12 bp, Homo sapiens
atttaaactata

SEQ ID NO: 2418329 - DNA, 19 bp, Homo sapiens
atttaaagcaggttcttgt

SEQ ID NO: 2418330 - DNA, 14 bp, Homo sapiens
atttaacagaaatt

SEQ ID NO: 2418331 - DNA, 16 bp, Homo sapiens
atttaacccccctgta

SEQ ID NO: 2418332 - DNA, 13 bp, Homo sapiens
atttaactctctt

SEQ ID NO: 2418333 - DNA, 13 bp, Homo sapiens
atttaactgacta

SEQ ID NO: 2418334 - DNA, 21 bp, Homo sapiens
atttaacttttagtaaagtca

SEQ ID NO: 2418335 - DNA, 15 bp, Homo sapiens
atttaagacactgaa

SEQ ID NO: 2418336 - DNA, 16 bp, Homo sapiens
atttaagacactgaaa

SEQ ID NO: 2418337 - DNA, 23 bp, Homo sapiens
atttaagggggaaaaagtgtcaa

SEQ ID NO: 2418338 - DNA, 17 bp, Homo sapiens
atttaatagcaaagaat

SEQ ID NO: 2418339 - DNA, 18 bp, Homo sapiens
atttaatagcaaagaatt

SEQ ID NO: 2418340 - DNA, 20 bp, Homo sapiens
atttaatagcaaagaattga

SEQ ID NO: 2418341 - DNA, 14 bp, Homo sapiens
atttaatgttttca

SEQ ID NO: 2418342 - DNA, 20 bp, Homo sapiens
atttacaaaaatataaaata

SEQ ID NO: 2418343 - DNA, 16 bp, Homo sapiens
atttacatcatttctt

SEQ ID NO: 2418344 - DNA, 17 bp, Homo sapiens
atttacctaagattaca

SEQ ID NO: 2418345 - DNA, 14 bp, Homo sapiens
atttacctcagcct

SEQ ID NO: 2418346 - DNA, 15 bp, Homo sapiens
atttacctcagcctg

SEQ ID NO: 2418347 - DNA, 18 bp, Homo sapiens
atttagaaaactttaaag

SEQ ID NO: 2418348 - DNA, 22 bp, Homo sapiens
atttagaagccaactatgatta

SEQ ID NO: 2418349 - DNA, 13 bp, Homo sapiens
atttagcattgta

SEQ ID NO: 2418350 - DNA, 22 bp, Homo sapiens
atttagcctgtcctgtcatcat

SEQ ID NO: 2418351 - DNA, 14 bp, Homo sapiens
atttaggagaagcc

SEQ ID NO: 2418352 - DNA, 16 bp, Homo sapiens
atttagtcatgtgacc

SEQ ID NO: 2418353 - DNA, 21 bp, Homo sapiens
atttagtgatcaaattgtgca

SEQ ID NO: 2418354 - DNA, 22 bp, Homo sapiens
atttagtttgattattcagtgt

SEQ ID NO: 2418355 - DNA, 16 bp, Homo sapiens
atttataaaaaggtgt

SEQ ID NO: 2418356 - DNA, 15 bp, Homo sapiens
atttatatcacatgt

SEQ ID NO: 2418357 - DNA, 17 bp, Homo sapiens
atttatctaaatatgga

SEQ ID NO: 2418358 - DNA, 18 bp, Homo sapiens
atttatgtattgtgcaat

SEQ ID NO: 2418359 - DNA, 19 bp, Homo sapiens
atttatgtattgtgcaatg

SEQ ID NO: 2418360 - DNA, 12 bp, Homo sapiens
atttattaaaga

SEQ ID NO: 2418361 - DNA, 13 bp, Homo sapiens
atttattaaagaa

SEQ ID NO: 2418362 - DNA, 15 bp, Homo sapiens
atttattaaagaaaa

SEQ ID NO: 2418363 - DNA, 17 bp, Homo sapiens
atttattaaagaaaaaa

SEQ ID NO: 2418364 - DNA, 18 bp, Homo sapiens
atttattaaagaaaaaaa

SEQ ID NO: 2418365 - DNA, 20 bp, Homo sapiens
atttattaaagaaaaaaatg

SEQ ID NO: 2418366 - DNA, 12 bp, Homo sapiens
atttattaatat

SEQ ID NO: 2418367 - DNA, 17 bp, Homo sapiens
atttattgactttgaca

SEQ ID NO: 2418368 - DNA, 16 bp, Homo sapiens
atttattgtattctgg

SEQ ID NO: 2418369 - DNA, 16 bp, Homo sapiens
atttatttaaaatagc

SEQ ID NO: 2418370 - DNA, 12 bp, Homo sapiens
atttatttcctc

SEQ ID NO: 2418371 - DNA, 17 bp, Homo sapiens
atttatttcctccctct

SEQ ID NO: 2418372 - DNA, 13 bp, Homo sapiens
atttatttgaatg

SEQ ID NO: 2418373 - DNA, 14 bp, Homo sapiens
atttattttgacat

SEQ ID NO: 2418374 - DNA, 17 bp, Homo sapiens
atttattttttcttttc

SEQ ID NO: 2418375 - DNA, 14 bp, Homo sapiens
atttcaaaatgctt

SEQ ID NO: 2418376 - DNA, 15 bp, Homo sapiens
atttcaaaatgcttt

SEQ ID NO: 2418377 - DNA, 13 bp, Homo sapiens
atttcaaggttct

SEQ ID NO: 2418378 - DNA, 14 bp, Homo sapiens
atttcaaggttcta

SEQ ID NO: 2418379 - DNA, 15 bp, Homo sapiens
atttcaaggttctaa

SEQ ID NO: 2418380 - DNA, 17 bp, Homo sapiens
atttcaaggttctaacc

SEQ ID NO: 2418381 - DNA, 19 bp, Homo sapiens
atttcacaacagcctgaca

SEQ ID NO: 2418382 - DNA, 12 bp, Homo sapiens
atttcactggag

SEQ ID NO: 2418383 - DNA, 19 bp, Homo sapiens
atttcactggagcacaata

SEQ ID NO: 2418384 - DNA, 13 bp, Homo sapiens
atttcactgtctt

SEQ ID NO: 2418385 - DNA, 23 bp, Homo sapiens
atttcactgtctttaattctgta

SEQ ID NO: 2418386 - DNA, 12 bp, Homo sapiens
atttcagaagtt

SEQ ID NO: 2418387 - DNA, 21 bp, Homo sapiens
atttcagaagttagtttgtat

SEQ ID NO: 2418388 - DNA, 12 bp, Homo sapiens
atttcagactcc

SEQ ID NO: 2418389 - DNA, 23 bp, Homo sapiens
atttcagagtgactacacacagt

SEQ ID NO: 2418390 - DNA, 19 bp, Homo sapiens
atttcaggcattggatatt

SEQ ID NO: 2418391 - DNA, 13 bp, Homo sapiens
atttccactgtgc

SEQ ID NO: 2418392 - DNA, 19 bp, Homo sapiens
atttcccaacacaaagatt

SEQ ID NO: 2418393 - DNA, 13 bp, Homo sapiens
atttcccaggacc

SEQ ID NO: 2418394 - DNA, 20 bp, Homo sapiens
attcatccaagttaaatgta

SEQ ID NO: 2418395 - DNA, 16 bp, Homo sapiens
attcattagtcatgtt

SEQ ID NO: 2418396 - DNA, 16 bp, Homo sapiens
attccaacagtttaat

SEQ ID NO: 2418397 - DNA, 19 bp, Homo sapiens
attccaacagtttaatgaa

SEQ ID NO: 2418398 - DNA, 23 bp, Homo sapiens
attccaactcgtatagcatgcat

SEQ ID NO: 2418399 - DNA, 14 bp, Homo sapiens
attccagaatgctg

SEQ ID NO: 2418400 - DNA, 19 bp, Homo sapiens
attccagaatgctgtacat

SEQ ID NO: 2418401 - DNA, 20 bp, Homo sapiens
attccagaatgctgtacatc

SEQ ID NO: 2418402 - DNA, 23 bp, Homo sapiens
attccagaatgctgtacatctat

SEQ ID NO: 2418403 - DNA, 14 bp, Homo sapiens
attccagcccctct

SEQ ID NO: 2418404 - DNA, 20 bp, Homo sapiens
attccatgactgcttgccct

SEQ ID NO: 2418405 - DNA, 15 bp, Homo sapiens
attccatgtgcccag

SEQ ID NO: 2418406 - DNA, 16 bp, Homo sapiens
attccattggtccaag

SEQ ID NO: 2418407 - DNA, 18 bp, Homo sapiens
attccccatctcaggcca

SEQ ID NO: 2418408 - DNA, 15 bp, Homo sapiens
attcccgcagtggga

SEQ ID NO: 2418409 - DNA, 20 bp, Homo sapiens
attccctagaaacttccaaa

SEQ ID NO: 2418410 - DNA, 11 bp, Homo sapiens
attccctcact

SEQ ID NO: 2418411 - DNA, 15 bp, Homo sapiens
attccggatcctaag

SEQ ID NO: 2418412 - DNA, 12 bp, Homo sapiens
attccgtcacca

SEQ ID NO: 2418413 - DNA, 19 bp, Homo sapiens
attccttagactcttttcc

SEQ ID NO: 2418414 - DNA, 12 bp, Homo sapiens
attccttcccat

SEQ ID NO: 2418415 - DNA, 16 bp, Homo sapiens
attcgacctataagaa

SEQ ID NO: 2418416 - DNA, 21 bp, Homo sapiens
attcggtatccccccatcttg

SEQ ID NO: 2418417 - DNA, 21 bp, Homo sapiens
attcggtgtgcaccagggttg

SEQ ID NO: 2418418 - DNA, 22 bp, Homo sapiens
attcgtagatattggacaaaga

SEQ ID NO: 2418419 - DNA, 13 bp, Homo sapiens
attcgttctgtgg

SEQ ID NO: 2418420 - DNA, 14 bp, Homo sapiens
attctaaaatgatt

SEQ ID NO: 2418421 - DNA, 15 bp, Homo sapiens
attctaaaatgcctt

SEQ ID NO: 2418422 - DNA, 17 bp, Homo sapiens
attctaaagattctata

SEQ ID NO: 2418423 - DNA, 18 bp, Homo sapiens
attctaaagattctatag

SEQ ID NO: 2418424 - DNA, 19 bp, Homo sapiens
attctaaagattctatagt

SEQ ID NO: 2418425 - DNA, 15 bp, Homo sapiens
attctaaatgaatgt

SEQ ID NO: 2418426 - DNA, 22 bp, Homo sapiens
attctaagacttactctaagat

SEQ ID NO: 2418427 - DNA, 15 bp, Homo sapiens
attctaagtgaaatt

SEQ ID NO: 2418428 - DNA, 18 bp, Homo sapiens
attctataagttttatgt

SEQ ID NO: 2418429 - DNA, 13 bp, Homo sapiens
attctatagttct

SEQ ID NO: 2418430 - DNA, 20 bp, Homo sapiens
attctatttatatgtacatg

SEQ ID NO: 2418431 - DNA, 17 bp, Homo sapiens
attctcaaaggagcgag

SEQ ID NO: 2418432 - DNA, 18 bp, Homo sapiens
attctcattaaaagaata

SEQ ID NO: 2418433 - DNA, 21 bp, Homo sapiens
attctcattggaaatttagca

SEQ ID NO: 2418434 - DNA, 23 bp, Homo sapiens
attctcattggaaatttagcatt

SEQ ID NO: 2418435 - DNA, 14 bp, Homo sapiens
attctccacagcaa

SEQ ID NO: 2418436 - DNA, 11 bp, Homo sapiens
attctctgagc

SEQ ID NO: 2418437 - DNA, 18 bp, Homo sapiens
attctctgagctgtgcag

SEQ ID NO: 2418438 - DNA, 17 bp, Homo sapiens
attctctggctgtaagg

SEQ ID NO: 2418439 - DNA, 21 bp, Homo sapiens
attctctggctgtaaggctct

SEQ ID NO: 2418440 - DNA, 22 bp, Homo sapiens
attctctggctgtaaggctcta

SEQ ID NO: 2418441 - DNA, 12 bp, Homo sapiens
attctctgtctc

SEQ ID NO: 2418442 - DNA, 16 bp, Homo sapiens
attctctgtctcatcc

SEQ ID NO: 2418443 - DNA, 17 bp, Homo sapiens
attctctgtctcatcca

SEQ ID NO: 2418444 - DNA, 18 bp, Homo sapiens
attctctgtgtctaagat

SEQ ID NO: 2418445 - DNA, 22 bp, Homo sapiens
attctgaactaaagtgctgcac

SEQ ID NO: 2418446 - DNA, 15 bp, Homo sapiens
attctgaatgcttct

SEQ ID NO: 2418447 - DNA, 19 bp, Homo sapiens
attctgaatgcttctaagt

SEQ ID NO: 2418448 - DNA, 22 bp, Homo sapiens
attctgaatgcttctaagtaaa

SEQ ID NO: 2418449 - DNA, 21 bp, Homo sapiens
attctgcagtaaatcttttac

SEQ ID NO: 2418450 - DNA, 15 bp, Homo sapiens
attctgcctctctag

SEQ ID NO: 2418451 - DNA, 16 bp, Homo sapiens
attctgcctctctagg

SEQ ID NO: 2418452 - DNA, 13 bp, Homo sapiens
attctgctggcct

SEQ ID NO: 2418453 - DNA, 22 bp, Homo sapiens
attctggacaggatgtgtttgc

SEQ ID NO: 2418454 - DNA, 14 bp, Homo sapiens
attcttctagagtt

SEQ ID NO: 2418455 - DNA, 16 bp, Homo sapiens
attcttctctgttgtc

SEQ ID NO: 2418456 - DNA, 12 bp, Homo sapiens
attcttgatgta

SEQ ID NO: 2418457 - DNA, 19 bp, Homo sapiens
attctttcaatacagatat

SEQ ID NO: 2418458 - DNA, 15 bp, Homo sapiens
attctttccatttgc

SEQ ID NO: 2418459 - DNA, 17 bp, Homo sapiens
attctttccatttgcat

SEQ ID NO: 2418460 - DNA, 19 bp, Homo sapiens
attgaaaaaatagagcctg

SEQ ID NO: 2418461 - DNA, 14 bp, Homo sapiens
attgaaatgtaagg

SEQ ID NO: 2418462 - DNA, 18 bp, Homo sapiens
attgaacacaaactgtaa

SEQ ID NO: 2418463 - DNA, 18 bp, Homo sapiens
attgaacctttgtgccct

SEQ ID NO: 2418464 - DNA, 15 bp, Homo sapiens
attgaaggcttaaac

SEQ ID NO: 2418465 - DNA, 16 bp, Homo sapiens
attgaagtaaactttt

SEQ ID NO: 2418466 - DNA, 22 bp, Homo sapiens
attgaagtaaactttttgttct

SEQ ID NO: 2418467 - DNA, 18 bp, Homo sapiens
attgaatactttgaatgt

SEQ ID NO: 2418468 - DNA, 22 bp, Homo sapiens
attgaattcttggttgaggaaa

SEQ ID NO: 2418469 - DNA, 17 bp, Homo sapiens
attgacaacacccattt

SEQ ID NO: 2418470 - DNA, 17 bp, Homo sapiens
attgacacagaaaatgt

SEQ ID NO: 2418471 - DNA, 14 bp, Homo sapiens
attgacttgtatat

SEQ ID NO: 2418472 - DNA, 11 bp, Homo sapiens
attgagagaat

SEQ ID NO: 2418473 - DNA, 19 bp, Homo sapiens
attgagtaatggtgtagaa

SEQ ID NO: 2418474 - DNA, 13 bp, Homo sapiens
attgattgtattg

SEQ ID NO: 2418475 - DNA, 16 bp, Homo sapiens
attgattgtattgttg

SEQ ID NO: 2418476 - DNA, 19 bp, Homo sapiens
attgcaaatcttgaaatta

SEQ ID NO: 2418477 - DNA, 14 bp, Homo sapiens
attgcaatatctga

SEQ ID NO: 2418478 - DNA, 15 bp, Homo sapiens
attgcacgtggcctc

SEQ ID NO: 2418479 - DNA, 16 bp, Homo sapiens
attgcacgtggcctct

SEQ ID NO: 2418480 - DNA, 17 bp, Homo sapiens
attgcacgtggcctctt

SEQ ID NO: 2418481 - DNA, 19 bp, Homo sapiens
attgcacgtggcctcttga

SEQ ID NO: 2418482 - DNA, 17 bp, Homo sapiens
attgcagaaaattctgt

SEQ ID NO: 2418483 - DNA, 14 bp, Homo sapiens
attgcaggatggtg

SEQ ID NO: 2418484 - DNA, 18 bp, Homo sapiens
attgcagtttatcattca

SEQ ID NO: 2418485 - DNA, 22 bp, Homo sapiens
attgcatctcccagataatgtg

SEQ ID NO: 2418486 - DNA, 11 bp, Homo sapiens
attgcattgac

SEQ ID NO: 2418487 - DNA, 20 bp, Homo sapiens
attgccaaaaagtgaaataa

SEQ ID NO: 2418488 - DNA, 13 bp, Homo sapiens
attgcgagagatg

SEQ ID NO: 2418489 - DNA, 16 bp, Homo sapiens
attgcgagagatgtgt

SEQ ID NO: 2418490 - DNA, 21 bp, Homo sapiens
attgcgagagatgtgtgttga

SEQ ID NO: 2418491 - DNA, 19 bp, Homo sapiens
attgctagagctcctccct

SEQ ID NO: 2418492 - DNA, 23 bp, Homo sapiens
attgctagagctcctccctctca

SEQ ID NO: 2418493 - DNA, 16 bp, Homo sapiens
attgctcacccagtgc

SEQ ID NO: 2418494 - DNA, 15 bp, Homo sapiens
attggaactggaggc

SEQ ID NO: 2418495 - DNA, 18 bp, Homo sapiens
attggaatgttctcagat

SEQ ID NO: 2418496 - DNA, 14 bp, Homo sapiens
attggacccttcca

SEQ ID NO: 2418497 - DNA, 15 bp, Homo sapiens
attggacccttccat

SEQ ID NO: 2418498 - DNA, 22 bp, Homo sapiens
attggatattttttactttaga

SEQ ID NO: 2418499 - DNA, 12 bp, Homo sapiens
attaaagaatat

SEQ ID NO: 2418500 - DNA, 15 bp, Homo sapiens
attaaagactccagt

SEQ ID NO: 2418501 - DNA, 14 bp, Homo sapiens
attaaattcacaaa

SEQ ID NO: 2418502 - DNA, 16 bp, Homo sapiens
attaaattcacaaact

SEQ ID NO: 2418503 - DNA, 19 bp, Homo sapiens
attaaattttttgttgaca

SEQ ID NO: 2418504 - DNA, 11 bp, Homo sapiens
attaacctaga

SEQ ID NO: 2418505 - DNA, 13 bp, Homo sapiens
attaacctctgca

SEQ ID NO: 2418506 - DNA, 22 bp, Homo sapiens
attaactgggtaatgaaacaaa

SEQ ID NO: 2418507 - DNA, 23 bp, Homo sapiens
attaagaaaggaagcattgtaaa

SEQ ID NO: 2418508 - DNA, 19 bp, Homo sapiens
attaagaaggcaaaaatgt

SEQ ID NO: 2418509 - DNA, 17 bp, Homo sapiens
attaagccacttaaaat

SEQ ID NO: 2418510 - DNA, 18 bp, Homo sapiens
attaatatccctacatgt

SEQ ID NO: 2418511 - DNA, 20 bp, Homo sapiens
attaatatccctacatgtat

SEQ ID NO: 2418512 - DNA, 16 bp, Homo sapiens
attaatcttagtgtat

SEQ ID NO: 2418513 - DNA, 20 bp, Homo sapiens
attaatcttagtgtatgatt

SEQ ID NO: 2418514 - DNA, 19 bp, Homo sapiens
attaatgaaaataagaatt

SEQ ID NO: 2418515 - DNA, 14 bp, Homo sapiens
attaatgcactttc

SEQ ID NO: 2418516 - DNA, 13 bp, Homo sapiens
attaattgtaatc

SEQ ID NO: 2418517 - DNA, 20 bp, Homo sapiens
attaattgtaatctgaataa

SEQ ID NO: 2418518 - DNA, 18 bp, Homo sapiens
attacaaatcagaagtca

SEQ ID NO: 2418519 - DNA, 19 bp, Homo sapiens
attacaaatcagaagtcat

SEQ ID NO: 2418520 - DNA, 23 bp, Homo sapiens
attacaaatcagaagtcatcttg

SEQ ID NO: 2418521 - DNA, 13 bp, Homo sapiens
attacagaaattt

SEQ ID NO: 2418522 - DNA, 22 bp, Homo sapiens
attacaggcacctgccaccatg

SEQ ID NO: 2418523 - DNA, 17 bp, Homo sapiens
attacaggcgtgagcca

SEQ ID NO: 2418524 - DNA, 15 bp, Homo sapiens
attacaggcttgagc

SEQ ID NO: 2418525 - DNA, 14 bp, Homo sapiens
attaccatgtaatg

SEQ ID NO: 2418526 - DNA, 14 bp, Homo sapiens
attacctgtggata

SEQ ID NO: 2418527 - DNA, 22 bp, Homo sapiens
attactggcctttttcatttat

SEQ ID NO: 2418528 - DNA, 15 bp, Homo sapiens
attacttgtaaatat

SEQ ID NO: 2418529 - DNA, 20 bp, Homo sapiens
attacttgtaaatataaaga

SEQ ID NO: 2418530 - DNA, 12 bp, Homo sapiens
attagaaatatt

SEQ ID NO: 2418531 - DNA, 15 bp, Homo sapiens
attagaaatatttta

SEQ ID NO: 2418532 - DNA, 17 bp, Homo sapiens
attagaaatattttaaa

SEQ ID NO: 2418533 - DNA, 19 bp, Homo sapiens
attagaatcaaacattttg

SEQ ID NO: 2418534 - DNA, 20 bp, Homo sapiens
attagaatcaaacattttga

SEQ ID NO: 2418535 - DNA, 13 bp, Homo sapiens
attagaattattt

SEQ ID NO: 2418536 - DNA, 14 bp, Homo sapiens
attagaattattta

SEQ ID NO: 2418537 - DNA, 18 bp, Homo sapiens
attagacactttggaaga

SEQ ID NO: 2418538 - DNA, 13 bp, Homo sapiens
attagacagaaca

SEQ ID NO: 2418539 - DNA, 15 bp, Homo sapiens
attagacagaacacc

SEQ ID NO: 2418540 - DNA, 13 bp, Homo sapiens
attagagcctgta

SEQ ID NO: 2418541 - DNA, 16 bp, Homo sapiens
attagagtgtctttcc

SEQ ID NO: 2418542 - DNA, 22 bp, Homo sapiens
attaggctgtaactactttata

SEQ ID NO: 2418543 - DNA, 13 bp, Homo sapiens
attagtaacatgt

SEQ ID NO: 2418544 - DNA, 13 bp, Homo sapiens
attagtattgttg

SEQ ID NO: 2418545 - DNA, 18 bp, Homo sapiens
attagtgccacttaatgt

SEQ ID NO: 2418546 - DNA, 14 bp, Homo sapiens
attataatcttata

SEQ ID NO: 2418547 - DNA, 16 bp, Homo sapiens
attataccaaaatgtt

SEQ ID NO: 2418548 - DNA, 17 bp, Homo sapiens
attatacttgtaattat

SEQ ID NO: 2418549 - DNA, 18 bp, Homo sapiens
attatacttgtaattatg

SEQ ID NO: 2418550 - DNA, 20 bp, Homo sapiens
attatacttgtaattatgga

SEQ ID NO: 2418551 - DNA, 23 bp, Homo sapiens
attatagtgatgtaatcttgaat

SEQ ID NO: 2418552 - DNA, 19 bp, Homo sapiens
attatagtttctgaggctt

SEQ ID NO: 2418553 - DNA, 17 bp, Homo sapiens
attatataactgtattt

SEQ ID NO: 2418554 - DNA, 19 bp, Homo sapiens
attatataactgtatttga

SEQ ID NO: 2418555 - DNA, 17 bp, Homo sapiens
attatatggaaatatat

SEQ ID NO: 2418556 - DNA, 23 bp, Homo sapiens
attatatttctattttattatga

SEQ ID NO: 2418557 - DNA, 20 bp, Homo sapiens
attatcgttttcttaaagtg

SEQ ID NO: 2418558 - DNA, 14 bp, Homo sapiens
attatctgggctta

SEQ ID NO: 2418559 - DNA, 15 bp, Homo sapiens
attatcttttcaaag

SEQ ID NO: 2418560 - DNA, 19 bp, Homo sapiens
attatgaagaaggtgaata

SEQ ID NO: 2418561 - DNA, 20 bp, Homo sapiens
attatgaatgtgaagccttc

SEQ ID NO: 2418562 - DNA, 18 bp, Homo sapiens
attatgcaatttttatat

SEQ ID NO: 2418563 - DNA, 17 bp, Homo sapiens
attatgggtcacaggaa

SEQ ID NO: 2418564 - DNA, 14 bp, Homo sapiens
attatgtagctctt

SEQ ID NO: 2418565 - DNA, 16 bp, Homo sapiens
attatgtggttttaga

SEQ ID NO: 2418566 - DNA, 17 bp, Homo sapiens
attatgtggttttagat

SEQ ID NO: 2418567 - DNA, 16 bp, Homo sapiens
attattaatttatgca

SEQ ID NO: 2418568 - DNA, 15 bp, Homo sapiens
attattacagtgttt

SEQ ID NO: 2418569 - DNA, 13 bp, Homo sapiens
attattacttgta

SEQ ID NO: 2418570 - DNA, 17 bp, Homo sapiens
attattacttgtaaata

SEQ ID NO: 2418571 - DNA, 15 bp, Homo sapiens
attattacttttgct

SEQ ID NO: 2418572 - DNA, 17 bp, Homo sapiens
attattagaatcaaaca

SEQ ID NO: 2418573 - DNA, 22 bp, Homo sapiens
attattagttttgatttaatgt

SEQ ID NO: 2418574 - DNA, 11 bp, Homo sapiens
attatttaaac

SEQ ID NO: 2418575 - DNA, 12 bp, Homo sapiens
attatttatgta

SEQ ID NO: 2418576 - DNA, 11 bp, Homo sapiens
attatttgcat

SEQ ID NO: 2418577 - DNA, 22 bp, Homo sapiens
attatttgtgttttaatttaaa

SEQ ID NO: 2418578 - DNA, 12 bp, Homo sapiens
attattttgatg

SEQ ID NO: 2418579 - DNA, 13 bp, Homo sapiens
attcaaaagttcc

SEQ ID NO: 2418580 - DNA, 21 bp, Homo sapiens
attcaaaagttccaagagtct

SEQ ID NO: 2418581 - DNA, 20 bp, Homo sapiens
attcaaaatagggtatattt

SEQ ID NO: 2418582 - DNA, 14 bp, Homo sapiens
attcaaagtgttat

SEQ ID NO: 2418583 - DNA, 16 bp, Homo sapiens
attcaacaatttcaat

SEQ ID NO: 2418584 - DNA, 22 bp, Homo sapiens
attcaacaatttcaataaaaga

SEQ ID NO: 2418585 - DNA, 16 bp, Homo sapiens
attcaaggaatttctt

SEQ ID NO: 2418586 - DNA, 20 bp, Homo sapiens
attcaagtgtaaaatatttt

SEQ ID NO: 2418587 - DNA, 16 bp, Homo sapiens
attcaattcaaagctg

SEQ ID NO: 2418588 - DNA, 13 bp, Homo sapiens
attcacaaacttt

SEQ ID NO: 2418589 - DNA, 23 bp, Homo sapiens
attcacagttctttgggccagac

SEQ ID NO: 2418590 - DNA, 20 bp, Homo sapiens
attcacatctaacctcatct

SEQ ID NO: 2418591 - DNA, 20 bp, Homo sapiens
attcagaaaatgttctgttt

SEQ ID NO: 2418592 - DNA, 23 bp, Homo sapiens
attcagaaccccaactactgtgt

SEQ ID NO: 2418593 - DNA, 15 bp, Homo sapiens
attcagacatctgag

SEQ ID NO: 2418594 - DNA, 18 bp, Homo sapiens
attcaggacttgaaagaa

SEQ ID NO: 2418595 - DNA, 20 bp, Homo sapiens
attcagggaaggaggagcct

SEQ ID NO: 2418596 - DNA, 16 bp, Homo sapiens
attcaggtaatacaaa

SEQ ID NO: 2418597 - DNA, 17 bp, Homo sapiens
attcaggtaatacaaac

SEQ ID NO: 2418598 - DNA, 15 bp, Homo sapiens
attcaggtttttcct

SEQ ID NO: 2418599 - DNA, 14 bp, Homo sapiens
attcagtgtcactg

SEQ ID NO: 2418600 - DNA, 13 bp, Homo sapiens
attcagtttcata

SEQ ID NO: 2418601 - DNA, 15 bp, Homo sapiens
attcagttttcattt

SEQ ID NO: 2418602 - DNA, 19 bp, Homo sapiens
attcatagtaacttcttat

SEQ ID NO: 2418603 - DNA, 19 bp, Homo sapiens
attcatccaagttaaatgt

SEQ ID NO: 2418604 - DNA, 14 bp, Homo sapiens
atgttgaatacttt

SEQ ID NO: 2418605 - DNA, 15 bp, Homo sapiens
atgttgaatactttt

SEQ ID NO: 2418606 - DNA, 22 bp, Homo sapiens
atgttgagaatcccaaatttga

SEQ ID NO: 2418607 - DNA, 22 bp, Homo sapiens
atgttgccatcctaccgtcttt

SEQ ID NO: 2418608 - DNA, 19 bp, Homo sapiens
atgttggacacctttaggt

SEQ ID NO: 2418609 - DNA, 23 bp, Homo sapiens
atgttggacacctttaggttctt

SEQ ID NO: 2418610 - DNA, 19 bp, Homo sapiens
atgttggccaggctggtct

SEQ ID NO: 2418611 - DNA, 21 bp, Homo sapiens
atgttggccaggctggtctaa

SEQ ID NO: 2418612 - DNA, 19 bp, Homo sapiens
atgttgggaaacttggctc

SEQ ID NO: 2418613 - DNA, 20 bp, Homo sapiens
atgttgggaaacttggctcg

SEQ ID NO: 2418614 - DNA, 12 bp, Homo sapiens
atgttgggactg

SEQ ID NO: 2418615 - DNA, 19 bp, Homo sapiens
atgttgtaatatttcttca

SEQ ID NO: 2418616 - DNA, 14 bp, Homo sapiens
atgttgtctaagaa

SEQ ID NO: 2418617 - DNA, 13 bp, Homo sapiens
atgttgttattta

SEQ ID NO: 2418618 - DNA, 14 bp, Homo sapiens
atgttgttatttaa

SEQ ID NO: 2418619 - DNA, 14 bp, Homo sapiens
atgttgttgaaagg

SEQ ID NO: 2418620 - DNA, 18 bp, Homo sapiens
atgtttacactctttgta

SEQ ID NO: 2418621 - DNA, 18 bp, Homo sapiens
atgtttagactttaacat

SEQ ID NO: 2418622 - DNA, 20 bp, Homo sapiens
atgtttagtgaatgactttt

SEQ ID NO: 2418623 - DNA, 15 bp, Homo sapiens
atgtttccagcattc

SEQ ID NO: 2418624 - DNA, 16 bp, Homo sapiens
atgtttccagcattcc

SEQ ID NO: 2418625 - DNA, 21 bp, Homo sapiens
atgtttccagcattcccaggt

SEQ ID NO: 2418626 - DNA, 14 bp, Homo sapiens
atgtttcctctagt

SEQ ID NO: 2418627 - DNA, 12 bp, Homo sapiens
atgtttctggat

SEQ ID NO: 2418628 - DNA, 22 bp, Homo sapiens
atgttttcgaaaatcaaatggt

SEQ ID NO: 2418629 - DNA, 15 bp, Homo sapiens
atgtttttaataaaa

SEQ ID NO: 2418630 - DNA, 19 bp, Homo sapiens
atgtttttaataaaagaaa

SEQ ID NO: 2418631 - DNA, 12 bp, Homo sapiens
atgtttttaatg

SEQ ID NO: 2418632 - DNA, 19 bp, Homo sapiens
atgttttttgccacagctt

SEQ ID NO: 2418633 - DNA, 21 bp, Homo sapiens
atgttttttgccacagctttt

SEQ ID NO: 2418634 - DNA, 14 bp, Homo sapiens
attaaaaaaaaaga

SEQ ID NO: 2418635 - DNA, 20 bp, Homo sapiens
attaaaaaaaaagatctgtt

SEQ ID NO: 2418636 - DNA, 14 bp, Homo sapiens
attaaaaaagataa

SEQ ID NO: 2418637 - DNA, 12 bp, Homo sapiens
attaaaagactc

SEQ ID NO: 2418638 - DNA, 13 bp, Homo sapiens
attaaaagactca

SEQ ID NO: 2418639 - DNA, 14 bp, Homo sapiens
attaaaagactcat

SEQ ID NO: 2418640 - DNA, 15 bp, Homo sapiens
attaaaagactcatc

SEQ ID NO: 2418641 - DNA, 15 bp, Homo sapiens
attaaaagcaaatca

SEQ ID NO: 2418642 - DNA, 16 bp, Homo sapiens
attaaaatcctcaatc

SEQ ID NO: 2418643 - DNA, 14 bp, Homo sapiens
attaaaatgcttcc

SEQ ID NO: 2418644 - DNA, 22 bp, Homo sapiens
attaaaccatctccctggtgct

SEQ ID NO: 2418645 - DNA, 14 bp, Homo sapiens
attaaacgattttt

SEQ ID NO: 2418646 - DNA, 21 bp, Homo sapiens
attaaacgatttttaaaatgt

SEQ ID NO: 2418647 - DNA, 16 bp, Homo sapiens
attaaagaaaaaaatg

SEQ ID NO: 2418648 - DNA, 19 bp, Homo sapiens
attaaagaaaaaaatgtat

SEQ ID NO: 2418649 - DNA, 15 bp, Homo sapiens
attaaagaagacctg

SEQ ID NO: 2418650 - DNA, 16 bp, Homo sapiens
attaaagaagacctga

SEQ ID NO: 2418651 - DNA, 21 bp, Homo sapiens
attaaagaagacctgagaatg

SEQ ID NO: 2418652 - DNA, 16 bp, Homo sapiens
atctcaccccatccca

SEQ ID NO: 2418653 - DNA, 12 bp, Homo sapiens
atctcagaaagt

SEQ ID NO: 2418654 - DNA, 20 bp, Homo sapiens
atctcagatcagtgtaccat

SEQ ID NO: 2418655 - DNA, 18 bp, Homo sapiens
atctcagtatgaattatt

SEQ ID NO: 2418656 - DNA, 19 bp, Homo sapiens
atctcagttgattttctgg

SEQ ID NO: 2418657 - DNA, 15 bp, Homo sapiens
atctcattggaccct

SEQ ID NO: 2418658 - DNA, 23 bp, Homo sapiens
atctccaagcagcttagagttgg

SEQ ID NO: 2418659 - DNA, 17 bp, Homo sapiens
atctcccattttggaat

SEQ ID NO: 2418660 - DNA, 14 bp, Homo sapiens
atctccctggtgct

SEQ ID NO: 2418661 - DNA, 21 bp, Homo sapiens
atctccctggtgcttatgctc

SEQ ID NO: 2418662 - DNA, 23 bp, Homo sapiens
atctccctggtgcttatgctctt

SEQ ID NO: 2418663 - DNA, 12 bp, Homo sapiens
atctcctgaaaa

SEQ ID NO: 2418664 - DNA, 17 bp, Homo sapiens
atctcctgccttcctcc

SEQ ID NO: 2418665 - DNA, 17 bp, Homo sapiens
atctctaccttctcccc

SEQ ID NO: 2418666 - DNA, 19 bp, Homo sapiens
atctctaccttctccccag

SEQ ID NO: 2418667 - DNA, 20 bp, Homo sapiens
atctctaccttctccccagc

SEQ ID NO: 2418668 - DNA, 18 bp, Homo sapiens
atctctccactttcagct

SEQ ID NO: 2418669 - DNA, 19 bp, Homo sapiens
atctctccactttcagctg

SEQ ID NO: 2418670 - DNA, 14 bp, Homo sapiens
atctctctgcccaa

SEQ ID NO: 2418671 - DNA, 13 bp, Homo sapiens
atctctgtgcctt

SEQ ID NO: 2418672 - DNA, 19 bp, Homo sapiens
atctcttattttacaataa

SEQ ID NO: 2418673 - DNA, 14 bp, Homo sapiens
atctgacccagtgc

SEQ ID NO: 2418674 - DNA, 18 bp, Homo sapiens
atctgacccagtgccccc

SEQ ID NO: 2418675 - DNA, 21 bp, Homo sapiens
atctgatttgtaacccactga

SEQ ID NO: 2418676 - DNA, 14 bp, Homo sapiens
atctgctggagttt

SEQ ID NO: 2418677 - DNA, 21 bp, Homo sapiens
atctgcttaggagtttaggga

SEQ ID NO: 2418678 - DNA, 19 bp, Homo sapiens
atctggaacccagactcag

SEQ ID NO: 2418679 - DNA, 11 bp, Homo sapiens
atctggaacct

SEQ ID NO: 2418680 - DNA, 20 bp, Homo sapiens
atctggaacctcagcctggc

SEQ ID NO: 2418681 - DNA, 15 bp, Homo sapiens
atctgggccttggcc

SEQ ID NO: 2418682 - DNA, 10 bp, Homo sapiens
atctgggctt

SEQ ID NO: 2418683 - DNA, 16 bp, Homo sapiens
atctgggcttcctgga

SEQ ID NO: 2418684 - DNA, 16 bp, Homo sapiens
atctggggagcaggca

SEQ ID NO: 2418685 - DNA, 19 bp, Homo sapiens
atctggggagcaggcagcc

SEQ ID NO: 2418686 - DNA, 21 bp, Homo sapiens
atctggggagcaggcagccag

SEQ ID NO: 2418687 - DNA, 18 bp, Homo sapiens
atctgtataccctctgtt

SEQ ID NO: 2418688 - DNA, 18 bp, Homo sapiens
atctgtccccctttagat

SEQ ID NO: 2418689 - DNA, 15 bp, Homo sapiens
atctgtcctcagcct

SEQ ID NO: 2418690 - DNA, 19 bp, Homo sapiens
atctgtctgccaacctaaa

SEQ ID NO: 2418691 - DNA, 14 bp, Homo sapiens
atctgtctggtggc

SEQ ID NO: 2418692 - DNA, 12 bp, Homo sapiens
atctgtgtcttg

SEQ ID NO: 2418693 - DNA, 15 bp, Homo sapiens
atctgtgtcttgttt

SEQ ID NO: 2418694 - DNA, 19 bp, Homo sapiens
atcttaaaccttaagatac

SEQ ID NO: 2418695 - DNA, 13 bp, Homo sapiens
atcttagattctc

SEQ ID NO: 2418696 - DNA, 22 bp, Homo sapiens
atcttagattctctgtgtctaa

SEQ ID NO: 2418697 - DNA, 20 bp, Homo sapiens
atgactttctttttgtagct

SEQ ID NO: 2418698 - DNA, 11 bp, Homo sapiens
atgagaaactt

SEQ ID NO: 2418699 - DNA, 14 bp, Homo sapiens
atgagaaagccttc

SEQ ID NO: 2418700 - DNA, 13 bp, Homo sapiens
atgagaacaaaca

SEQ ID NO: 2418701 - DNA, 21 bp, Homo sapiens
atgagaatttgagtgctctga

SEQ ID NO: 2418702 - DNA, 15 bp, Homo sapiens
atgagatgctggctt

SEQ ID NO: 2418703 - DNA, 19 bp, Homo sapiens
atgagatgctggcttgggc

SEQ ID NO: 2418704 - DNA, 10 bp, Homo sapiens
atgagctccc

SEQ ID NO: 2418705 - DNA, 17 bp, Homo sapiens
atgagctttctgaacag

SEQ ID NO: 2418706 - DNA, 18 bp, Homo sapiens
atgagctttctgaacagc

SEQ ID NO: 2418707 - DNA, 19 bp, Homo sapiens
atgagctttctgaacagct

SEQ ID NO: 2418708 - DNA, 20 bp, Homo sapiens
atgagctttctgaacagctg

SEQ ID NO: 2418709 - DNA, 21 bp, Homo sapiens
atgagctttctgaacagctgg

SEQ ID NO: 2418710 - DNA, 21 bp, Homo sapiens
atgaggccatggactctgtcc

SEQ ID NO: 2418711 - DNA, 14 bp, Homo sapiens
atgaggccctccac

SEQ ID NO: 2418712 - DNA, 14 bp, Homo sapiens
atgagggcagcagc

SEQ ID NO: 2418713 - DNA, 16 bp, Homo sapiens
atgagggcagcagcca

SEQ ID NO: 2418714 - DNA, 20 bp, Homo sapiens
atgagggcagcagccagccc

SEQ ID NO: 2418715 - DNA, 23 bp, Homo sapiens
atgagggcagcagccagccctgc

SEQ ID NO: 2418716 - DNA, 20 bp, Homo sapiens
atgaggggttcctcccctcc

SEQ ID NO: 2418717 - DNA, 22 bp, Homo sapiens
atgaggggttcctcccctccag

SEQ ID NO: 2418718 - DNA, 17 bp, Homo sapiens
atgagtaacatttgctg

SEQ ID NO: 2418719 - DNA, 21 bp, Homo sapiens
atgagtggaaattaagacttt

SEQ ID NO: 2418720 - DNA, 17 bp, Homo sapiens
atgataaagagacagtg

SEQ ID NO: 2418721 - DNA, 15 bp, Homo sapiens
atgataatagattct

SEQ ID NO: 2418722 - DNA, 19 bp, Homo sapiens
atgatactaataaactaat

SEQ ID NO: 2418723 - DNA, 20 bp, Homo sapiens
atgatcctgtattcagacag

SEQ ID NO: 2418724 - DNA, 15 bp, Homo sapiens
atgatctgtctgtgg

SEQ ID NO: 2418725 - DNA, 12 bp, Homo sapiens
atgatgaatgag

SEQ ID NO: 2418726 - DNA, 21 bp, Homo sapiens
atgatgttaaaaaaataagaa

SEQ ID NO: 2418727 - DNA, 20 bp, Homo sapiens
atgattaaataagattctaa

SEQ ID NO: 2418728 - DNA, 14 bp, Homo sapiens
atgattactggcct

SEQ ID NO: 2418729 - DNA, 15 bp, Homo sapiens
atgattactggcctt

SEQ ID NO: 2418730 - DNA, 23 bp, Homo sapiens
atgattagaaattacctgtggat

SEQ ID NO: 2418731 - DNA, 16 bp, Homo sapiens
atgattcagtgttaaa

SEQ ID NO: 2418732 - DNA, 13 bp, Homo sapiens
atgatttacattt

SEQ ID NO: 2418733 - DNA, 15 bp, Homo sapiens
atgatttccttgaat

SEQ ID NO: 2418734 - DNA, 16 bp, Homo sapiens
atgatttccttgaatg

SEQ ID NO: 2418735 - DNA, 17 bp, Homo sapiens
atgatttccttgaatgt

SEQ ID NO: 2418736 - DNA, 20 bp, Homo sapiens
atgatttccttgaatgtggc

SEQ ID NO: 2418737 - DNA, 21 bp, Homo sapiens
atgatttccttgaatgtggct

SEQ ID NO: 2418738 - DNA, 14 bp, Homo sapiens
atgatttcttctta

SEQ ID NO: 2418739 - DNA, 14 bp, Homo sapiens
atgcaaaccatagc

SEQ ID NO: 2418740 - DNA, 15 bp, Homo sapiens
atgcaaccatttgaa

SEQ ID NO: 2418741 - DNA, 13 bp, Homo sapiens
atgcaatttttat

SEQ ID NO: 2418742 - DNA, 14 bp, Homo sapiens
atgcacagtatttg

SEQ ID NO: 2418743 - DNA, 20 bp, Homo sapiens
atgctcctcttccccagacg

SEQ ID NO: 2418744 - DNA, 16 bp, Homo sapiens
atgctcttaattgcca

SEQ ID NO: 2418745 - DNA, 23 bp, Homo sapiens
atgctcttaattgccacctctaa

SEQ ID NO: 2418746 - DNA, 23 bp, Homo sapiens
atgctgaaaatgtccttgtgatg

SEQ ID NO: 2418747 - DNA, 19 bp, Homo sapiens
atgctgacattcacctgcc

SEQ ID NO: 2418748 - DNA, 22 bp, Homo sapiens
atgctgacattcacctgcccca

SEQ ID NO: 2418749 - DNA, 14 bp, Homo sapiens
atgctgaggcctgg

SEQ ID NO: 2418750 - DNA, 17 bp, Homo sapiens
atgctgaggcctgggcc

SEQ ID NO: 2418751 - DNA, 18 bp, Homo sapiens
atgctgaggcctgggccg

SEQ ID NO: 2418752 - DNA, 17 bp, Homo sapiens
atgctgctggggaagac

SEQ ID NO: 2418753 - DNA, 13 bp, Homo sapiens
atgctggagggag

SEQ ID NO: 2418754 - DNA, 23 bp, Homo sapiens
atgctggcatttgcacctacctc

SEQ ID NO: 2418755 - DNA, 15 bp, Homo sapiens
atgctggcccagggc

SEQ ID NO: 2418756 - DNA, 16 bp, Homo sapiens
atgctggcccagggcc

SEQ ID NO: 2418757 - DNA, 21 bp, Homo sapiens
atgctggctatagatgtcttt

SEQ ID NO: 2418758 - DNA, 15 bp, Homo sapiens
atgctgggactcagc

SEQ ID NO: 2418759 - DNA, 16 bp, Homo sapiens
atgctgtacatctatt

SEQ ID NO: 2418760 - DNA, 21 bp, Homo sapiens
atgctgtgagtctttggttct

SEQ ID NO: 2418761 - DNA, 16 bp, Homo sapiens
atgcttaaaataagca

SEQ ID NO: 2418762 - DNA, 23 bp, Homo sapiens
atgcttattccatgactgcttgc

SEQ ID NO: 2418763 - DNA, 18 bp, Homo sapiens
atgcttgggaagactcct

SEQ ID NO: 2418764 - DNA, 21 bp, Homo sapiens
atgctttgaaattgaaccttt

SEQ ID NO: 2418765 - DNA, 22 bp, Homo sapiens
atgctttttattattattattt

SEQ ID NO: 2418766 - DNA, 19 bp, Homo sapiens
atgctttttatttctgcat

SEQ ID NO: 2418767 - DNA, 16 bp, Homo sapiens
atggaattgatttgca

SEQ ID NO: 2418768 - DNA, 17 bp, Homo sapiens
atggaattttgcaaaga

SEQ ID NO: 2418769 - DNA, 19 bp, Homo sapiens
atggacaggctggctccag

SEQ ID NO: 2418770 - DNA, 18 bp, Homo sapiens
atggacagggcatgccac

SEQ ID NO: 2418771 - DNA, 20 bp, Homo sapiens
atggaccggagagtgggggt

SEQ ID NO: 2418772 - DNA, 18 bp, Homo sapiens
atggacctgcctgcatag

SEQ ID NO: 2418773 - DNA, 14 bp, Homo sapiens
atggactctgtcct

SEQ ID NO: 2418774 - DNA, 16 bp, Homo sapiens
atggactctgtcctga

SEQ ID NO: 2418775 - DNA, 16 bp, Homo sapiens
atggagaaagctgact

SEQ ID NO: 2418776 - DNA, 23 bp, Homo sapiens
atggagaaagctgacttggctgg

SEQ ID NO: 2418777 - DNA, 13 bp, Homo sapiens
atggagagccctg

SEQ ID NO: 2418778 - DNA, 16 bp, Homo sapiens
atggagagccctggga

SEQ ID NO: 2418779 - DNA, 19 bp, Homo sapiens
atggagattcagttttcat

SEQ ID NO: 2418780 - DNA, 20 bp, Homo sapiens
atggagattcagttttcatt

SEQ ID NO: 2418781 - DNA, 20 bp, Homo sapiens
atggagattgacctggatgg

SEQ ID NO: 2418782 - DNA, 12 bp, Homo sapiens
atggaggttcta

SEQ ID NO: 2418783 - DNA, 13 bp, Homo sapiens
atggagtgctgtt

SEQ ID NO: 2418784 - DNA, 20 bp, Homo sapiens
atggagtgctgttttgttat

SEQ ID NO: 2418785 - DNA, 21 bp, Homo sapiens
atggagtgctgttttgttata

SEQ ID NO: 2418786 - DNA, 16 bp, Homo sapiens
atggagtttctaaggt

SEQ ID NO: 2418787 - DNA, 23 bp, Homo sapiens
atggatgccaatattaaatctgc

SEQ ID NO: 2418788 - DNA, 15 bp, Homo sapiens
tcctctgactcaggg

SEQ ID NO: 2418789 - DNA, 22 bp, Homo sapiens
tcctctggcttggccacagcca

SEQ ID NO: 2418790 - DNA, 22 bp, Homo sapiens
tcctctgtcagtcacagccacc

SEQ ID NO: 2418791 - DNA, 15 bp, Homo sapiens
tcctctgtctcgagc

SEQ ID NO: 2418792 - DNA, 19 bp, Homo sapiens
tcctctgtgaccaatgtct

SEQ ID NO: 2418793 - DNA, 23 bp, Homo sapiens
tcctctgttcaaagctgcctgtc

SEQ ID NO: 2418794 - DNA, 12 bp, Homo sapiens
tcctcttcccca

SEQ ID NO: 2418795 - DNA, 14 bp, Homo sapiens
tcctcttccctctc

SEQ ID NO: 2418796 - DNA, 22 bp, Homo sapiens
tcctcttctactcacttttccc

SEQ ID NO: 2418797 - DNA, 13 bp, Homo sapiens
tcctcttctgggc

SEQ ID NO: 2418798 - DNA, 14 bp, Homo sapiens
tcctctttcagctc

SEQ ID NO: 2418799 - DNA, 15 bp, Homo sapiens
tcctctttcagctcc

SEQ ID NO: 2418800 - DNA, 17 bp, Homo sapiens
tcctctttcagctcctg

SEQ ID NO: 2418801 - DNA, 14 bp, Homo sapiens
tcctgaagaaccag

SEQ ID NO: 2418802 - DNA, 16 bp, Homo sapiens
tcctgaagaaccagtc

SEQ ID NO: 2418803 - DNA, 19 bp, Homo sapiens
tcctgacacccttctccca

SEQ ID NO: 2418804 - DNA, 17 bp, Homo sapiens
tcctgacactgctggag

SEQ ID NO: 2418805 - DNA, 14 bp, Homo sapiens
tcctgaccagttgc

SEQ ID NO: 2418806 - DNA, 15 bp, Homo sapiens
tcctgacctcaggca

SEQ ID NO: 2418807 - DNA, 19 bp, Homo sapiens
tcctgagaaaaaaggttcc

SEQ ID NO: 2418808 - DNA, 14 bp, Homo sapiens
tcctgagcactgcc

SEQ ID NO: 2418809 - DNA, 19 bp, Homo sapiens
tcctgagcactgccaggag

SEQ ID NO: 2418810 - DNA, 22 bp, Homo sapiens
tcctgagcactgccaggaggga

SEQ ID NO: 2418811 - DNA, 14 bp, Homo sapiens
tcctgagccccagg

SEQ ID NO: 2418812 - DNA, 16 bp, Homo sapiens
tcctgaggctttggat

SEQ ID NO: 2418813 - DNA, 17 bp, Homo sapiens
tcctgaggctttggatt

SEQ ID NO: 2418814 - DNA, 14 bp, Homo sapiens
tcctgatcagagcc

SEQ ID NO: 2418815 - DNA, 17 bp, Homo sapiens
tcctgcagaccacgccc

SEQ ID NO: 2418816 - DNA, 13 bp, Homo sapiens
tcctgccagcccc

SEQ ID NO: 2418817 - DNA, 15 bp, Homo sapiens
tcctgccccaggcct

SEQ ID NO: 2418818 - DNA, 23 bp, Homo sapiens
tcctgcccccaaggaggcagcct

SEQ ID NO: 2418819 - DNA, 19 bp, Homo sapiens
tcctgcctattatctgtca

SEQ ID NO: 2418820 - DNA, 14 bp, Homo sapiens
tcctgcctcagcct

SEQ ID NO: 2418821 - DNA, 17 bp, Homo sapiens
tcctgcctctactggga

SEQ ID NO: 2418822 - DNA, 13 bp, Homo sapiens
tcctgcctgtggc

SEQ ID NO: 2418823 - DNA, 14 bp, Homo sapiens
tcctgcctgtggcc

SEQ ID NO: 2418824 - DNA, 19 bp, Homo sapiens
tcctgccttcctcctgggc

SEQ ID NO: 2418825 - DNA, 14 bp, Homo sapiens
tcctgcgggtgggg

SEQ ID NO: 2418826 - DNA, 14 bp, Homo sapiens
tcctgctgctccct

SEQ ID NO: 2418827 - DNA, 17 bp, Homo sapiens
tcctgctgctccctcag

SEQ ID NO: 2418828 - DNA, 19 bp, Homo sapiens
tcctgctgctccctcagac

SEQ ID NO: 2418829 - DNA, 14 bp, Homo sapiens
tcctgctgctgtct

SEQ ID NO: 2418830 - DNA, 15 bp, Homo sapiens
tcctgctgctgtctg

SEQ ID NO: 2418831 - DNA, 22 bp, Homo sapiens
tcctgcttgatgggattctgga

SEQ ID NO: 2418832 - DNA, 17 bp, Homo sapiens
tcctgcttgccaaggca

SEQ ID NO: 2418833 - DNA, 19 bp, Homo sapiens
tcctgcttgccaaggcaga

SEQ ID NO: 2418834 - DNA, 17 bp, Homo sapiens
tcctggacactcagacc

SEQ ID NO: 2418835 - DNA, 13 bp, Homo sapiens
tcctggacagctg

SEQ ID NO: 2418836 - DNA, 16 bp, Homo sapiens
tcctggacagctgtgc

SEQ ID NO: 2418837 - DNA, 22 bp, Homo sapiens
tcctggacatgaagattctttc

SEQ ID NO: 2418838 - DNA, 14 bp, Homo sapiens
tcctggagcagaag

SEQ ID NO: 2418839 - DNA, 14 bp, Homo sapiens
tcctggaggcccag

SEQ ID NO: 2418840 - DNA, 18 bp, Homo sapiens
tcctggaggcccagttca

SEQ ID NO: 2418841 - DNA, 22 bp, Homo sapiens
tcctggatgatactaataaact

SEQ ID NO: 2418842 - DNA, 14 bp, Homo sapiens
tcctggccgcctgg

SEQ ID NO: 2418843 - DNA, 17 bp, Homo sapiens
tcctgggccctctctgc

SEQ ID NO: 2418844 - DNA, 21 bp, Homo sapiens
tcctgggccctctctgctctg

SEQ ID NO: 2418845 - DNA, 12 bp, Homo sapiens
tcctgggcctgc

SEQ ID NO: 2418846 - DNA, 23 bp, Homo sapiens
tcctggggtataaaactttcctc

SEQ ID NO: 2418847 - DNA, 16 bp, Homo sapiens
tcctggtggggcagct

SEQ ID NO: 2418848 - DNA, 18 bp, Homo sapiens
tcctggtggtattttcaa

SEQ ID NO: 2418849 - DNA, 19 bp, Homo sapiens
tcctggtggtattttcaat

SEQ ID NO: 2418850 - DNA, 15 bp, Homo sapiens
tcctggttcccgttt

SEQ ID NO: 2418851 - DNA, 20 bp, Homo sapiens
tcctgtattcagacagatga

SEQ ID NO: 2418852 - DNA, 21 bp, Homo sapiens
tcctgtatttgttcccaagag

SEQ ID NO: 2418853 - DNA, 22 bp, Homo sapiens
tcctgtcatcatcatggccagc

SEQ ID NO: 2418854 - DNA, 15 bp, Homo sapiens
tcctgtcctctttca

SEQ ID NO: 2418855 - DNA, 18 bp, Homo sapiens
tcctgtcctctttcagct

SEQ ID NO: 2418856 - DNA, 19 bp, Homo sapiens
tcctgtcctttaccaaaga

SEQ ID NO: 2418857 - DNA, 12 bp, Homo sapiens
tcctgtggcccc

SEQ ID NO: 2418858 - DNA, 12 bp, Homo sapiens
tcctgtggctcc

SEQ ID NO: 2418859 - DNA, 14 bp, Homo sapiens
tcctgtgggagcct

SEQ ID NO: 2418860 - DNA, 15 bp, Homo sapiens
tcctgtgtggagagg

SEQ ID NO: 2418861 - DNA, 16 bp, Homo sapiens
tcctgtgtggagaggg

SEQ ID NO: 2418862 - DNA, 18 bp, Homo sapiens
tcctgtgtggagagggaa

SEQ ID NO: 2418863 - DNA, 22 bp, Homo sapiens
tcctgtgtgtccaaaactgcct

SEQ ID NO: 2418864 - DNA, 19 bp, Homo sapiens
tcctgtgtgttaagctctg

SEQ ID NO: 2418865 - DNA, 22 bp, Homo sapiens
tcctgtgtgttaagctctgcta

SEQ ID NO: 2418866 - DNA, 13 bp, Homo sapiens
tcctgttgggaga

SEQ ID NO: 2418867 - DNA, 17 bp, Homo sapiens
tcctgttgtcaagaata

SEQ ID NO: 2418868 - DNA, 18 bp, Homo sapiens
tcctgtttcctagctgtg

SEQ ID NO: 2418869 - DNA, 13 bp, Homo sapiens
tcctgtttgtcta

SEQ ID NO: 2418870 - DNA, 18 bp, Homo sapiens
tccttaaaatgtaagatt

SEQ ID NO: 2418871 - DNA, 18 bp, Homo sapiens
tccttactttttatatat

SEQ ID NO: 2418872 - DNA, 20 bp, Homo sapiens
tccttactttttatatatat

SEQ ID NO: 2418873 - DNA, 17 bp, Homo sapiens
tccttagatctggcatg

SEQ ID NO: 2418874 - DNA, 15 bp, Homo sapiens
tccttagcctggacc

SEQ ID NO: 2418875 - DNA, 14 bp, Homo sapiens
tatctgggcttcct

SEQ ID NO: 2418876 - DNA, 20 bp, Homo sapiens
tatctgggcttcctggagca

SEQ ID NO: 2418877 - DNA, 13 bp, Homo sapiens
tatctgtaatggt

SEQ ID NO: 2418878 - DNA, 15 bp, Homo sapiens
tatctgtcagctgca

SEQ ID NO: 2418879 - DNA, 19 bp, Homo sapiens
tatctgtgaaatgctggca

SEQ ID NO: 2418880 - DNA, 17 bp, Homo sapiens
tatcttggacaaatcac

SEQ ID NO: 2418881 - DNA, 23 bp, Homo sapiens
tatcttttcatacattttctaag

SEQ ID NO: 2418882 - DNA, 21 bp, Homo sapiens
tatgaagaaggtgaatagcca

SEQ ID NO: 2418883 - DNA, 15 bp, Homo sapiens
tatgaatactttgca

SEQ ID NO: 2418884 - DNA, 18 bp, Homo sapiens
tatgaatgtgaagccttc

SEQ ID NO: 2418885 - DNA, 15 bp, Homo sapiens
tatgataatagattc

SEQ ID NO: 2418886 - DNA, 14 bp, Homo sapiens
tatgatgttaaaaa

SEQ ID NO: 2418887 - DNA, 12 bp, Homo sapiens
tatgattattaa

SEQ ID NO: 2418888 - DNA, 14 bp, Homo sapiens
tatgcaaaagcaag

SEQ ID NO: 2418889 - DNA, 15 bp, Homo sapiens
tatgcacatgaactt

SEQ ID NO: 2418890 - DNA, 19 bp, Homo sapiens
tatgcacatgaacttagat

SEQ ID NO: 2418891 - DNA, 20 bp, Homo sapiens
tatgcacttataattttcct

SEQ ID NO: 2418892 - DNA, 21 bp, Homo sapiens
tatgcatggtgccccaggacc

SEQ ID NO: 2418893 - DNA, 16 bp, Homo sapiens
tatgcatggtttcagc

SEQ ID NO: 2418894 - DNA, 19 bp, Homo sapiens
tatgcatggtttcagcact

SEQ ID NO: 2418895 - DNA, 22 bp, Homo sapiens
tatgcatgttgtctaagaaatt

SEQ ID NO: 2418896 - DNA, 22 bp, Homo sapiens
tatgcatttaaatacagtcttc

SEQ ID NO: 2418897 - DNA, 16 bp, Homo sapiens
tatgctcttaattgcc

SEQ ID NO: 2418898 - DNA, 18 bp, Homo sapiens
tatgctcttaattgccac

SEQ ID NO: 2418899 - DNA, 15 bp, Homo sapiens
tatgctgatttattt

SEQ ID NO: 2418900 - DNA, 19 bp, Homo sapiens
tatgcttaaaataagcagg

SEQ ID NO: 2418901 - DNA, 20 bp, Homo sapiens
tatgcttgtaactaaaataa

SEQ ID NO: 2418902 - DNA, 18 bp, Homo sapiens
tatggaattgatttgcat

SEQ ID NO: 2418903 - DNA, 21 bp, Homo sapiens
tatggactatctgtctggtgg

SEQ ID NO: 2418904 - DNA, 15 bp, Homo sapiens
tatggatgtccccag

SEQ ID NO: 2418905 - DNA, 16 bp, Homo sapiens
tatggatgtccccagc

SEQ ID NO: 2418906 - DNA, 19 bp, Homo sapiens
tatggcgtaagtacagaga

SEQ ID NO: 2418907 - DNA, 20 bp, Homo sapiens
tatggcgtaagtacagagaa

SEQ ID NO: 2418908 - DNA, 22 bp, Homo sapiens
tatggcgtaagtacagagaagc

SEQ ID NO: 2418909 - DNA, 23 bp, Homo sapiens
tatggcgtaagtacagagaagcc

SEQ ID NO: 2418910 - DNA, 19 bp, Homo sapiens
tatgggtagggtaaatcag

SEQ ID NO: 2418911 - DNA, 14 bp, Homo sapiens
tatgggtcacagga

SEQ ID NO: 2418912 - DNA, 11 bp, Homo sapiens
tatggtaaaaa

SEQ ID NO: 2418913 - DNA, 15 bp, Homo sapiens
tatgtaaaacattta

SEQ ID NO: 2418914 - DNA, 23 bp, Homo sapiens
tatgtatgggtagggtaaatcag

SEQ ID NO: 2418915 - DNA, 17 bp, Homo sapiens
tatgtattgtgcaatgt

SEQ ID NO: 2418916 - DNA, 13 bp, Homo sapiens
tatgtccaggtgt

SEQ ID NO: 2418917 - DNA, 21 bp, Homo sapiens
tatgtctggttctcaattcca

SEQ ID NO: 2418918 - DNA, 15 bp, Homo sapiens
tatgttatatataaa

SEQ ID NO: 2418919 - DNA, 21 bp, Homo sapiens
tatgttcaactaggatcagaa

SEQ ID NO: 2418920 - DNA, 22 bp, Homo sapiens
tatgttgtaatatttcttcaaa

SEQ ID NO: 2418921 - DNA, 15 bp, Homo sapiens
tatgtttttgttcaa

SEQ ID NO: 2418922 - DNA, 16 bp, Homo sapiens
tatgtttttgttcaaa

SEQ ID NO: 2418923 - DNA, 14 bp, Homo sapiens
tattaaaagactca

SEQ ID NO: 2418924 - DNA, 18 bp, Homo sapiens
tattaaaagactcatccg

SEQ ID NO: 2418925 - DNA, 20 bp, Homo sapiens
tattaaagaaaaaaatgtat

SEQ ID NO: 2418926 - DNA, 22 bp, Homo sapiens
tattaaagaaaaaaatgtattt

SEQ ID NO: 2418927 - DNA, 24 bp, Homo sapiens
tattaaagtgctaaggttctaagg

SEQ ID NO: 2418928 - DNA, 20 bp, Homo sapiens
tattaaattttttaaaaagc

SEQ ID NO: 2418929 - DNA, 18 bp, Homo sapiens
tattaatatatattatct

SEQ ID NO: 2418930 - DNA, 22 bp, Homo sapiens
tattaatatatattatcttttc

SEQ ID NO: 2418931 - DNA, 17 bp, Homo sapiens
tattaatcttagtgtat

SEQ ID NO: 2418932 - DNA, 13 bp, Homo sapiens
tattaatgaaaat

SEQ ID NO: 2418933 - DNA, 14 bp, Homo sapiens
tattaatgcacttt

SEQ ID NO: 2418934 - DNA, 20 bp, Homo sapiens
tattaatgcactttctatcc

SEQ ID NO: 2418935 - DNA, 14 bp, Homo sapiens
tattaattttagtt

SEQ ID NO: 2418936 - DNA, 15 bp, Homo sapiens
tattaccccttttcg

SEQ ID NO: 2418937 - DNA, 22 bp, Homo sapiens
tattacgtatgtctggttctca

SEQ ID NO: 2418938 - DNA, 22 bp, Homo sapiens
tattagaatcaaacattttgaa

SEQ ID NO: 2418939 - DNA, 15 bp, Homo sapiens
tattagagtgtcttt

SEQ ID NO: 2418940 - DNA, 17 bp, Homo sapiens
tattaggtgcaatttca

SEQ ID NO: 2418941 - DNA, 19 bp, Homo sapiens
tcacatagcccacttacat

SEQ ID NO: 2418942 - DNA, 15 bp, Homo sapiens
tcacatgaattatta

SEQ ID NO: 2418943 - DNA, 16 bp, Homo sapiens
tcacatgaattattac

SEQ ID NO: 2418944 - DNA, 22 bp, Homo sapiens
tcacatgaattattacagtgtt

SEQ ID NO: 2418945 - DNA, 21 bp, Homo sapiens
tcacatgatgcacttcaaatt

SEQ ID NO: 2418946 - DNA, 21 bp, Homo sapiens
tcacatgtcagtaccttcaaa

SEQ ID NO: 2418947 - DNA, 22 bp, Homo sapiens
tcacattagaagacaattgaca

SEQ ID NO: 2418948 - DNA, 23 bp, Homo sapiens
tcaccaatgtacccaccgggcca

SEQ ID NO: 2418949 - DNA, 20 bp, Homo sapiens
tcaccacgactggccagggc

SEQ ID NO: 2418950 - DNA, 18 bp, Homo sapiens
tcaccagatctgatttgt

SEQ ID NO: 2418951 - DNA, 22 bp, Homo sapiens
tcaccaggcagcctctgggggg

SEQ ID NO: 2418952 - DNA, 13 bp, Homo sapiens
tcaccattcccag

SEQ ID NO: 2418953 - DNA, 22 bp, Homo sapiens
tcaccatttgattatgtagcaa

SEQ ID NO: 2418954 - DNA, 20 bp, Homo sapiens
tcaccatttggatcctgtgt

SEQ ID NO: 2418955 - DNA, 19 bp, Homo sapiens
tcacccagacataaaggaa

SEQ ID NO: 2418956 - DNA, 22 bp, Homo sapiens
tcacccagacataaaggaaaag

SEQ ID NO: 2418957 - DNA, 12 bp, Homo sapiens
tcaccccatccc

SEQ ID NO: 2418958 - DNA, 13 bp, Homo sapiens
tcaccccatccca

SEQ ID NO: 2418959 - DNA, 22 bp, Homo sapiens
tcacccccttctccatccacat

SEQ ID NO: 2418960 - DNA, 13 bp, Homo sapiens
tcaccctgcctta

SEQ ID NO: 2418961 - DNA, 18 bp, Homo sapiens
tcaccctggaggcacctg

SEQ ID NO: 2418962 - DNA, 16 bp, Homo sapiens
tcaccgagtgggggca

SEQ ID NO: 2418963 - DNA, 18 bp, Homo sapiens
tcaccgtgggctccctga

SEQ ID NO: 2418964 - DNA, 23 bp, Homo sapiens
tcacctagctgaatgtttttcta

SEQ ID NO: 2418965 - DNA, 15 bp, Homo sapiens
tcacctaggaagcct

SEQ ID NO: 2418966 - DNA, 17 bp, Homo sapiens
tcacctaggaagcctca

SEQ ID NO: 2418967 - DNA, 23 bp, Homo sapiens
tcacctaggaagcctcagattcc

SEQ ID NO: 2418968 - DNA, 20 bp, Homo sapiens
tcacctatttccattcaaca

SEQ ID NO: 2418969 - DNA, 19 bp, Homo sapiens
tcacctcagatggcagctt

SEQ ID NO: 2418970 - DNA, 22 bp, Homo sapiens
tcacctcagatggcagctttta

SEQ ID NO: 2418971 - DNA, 22 bp, Homo sapiens
tcacctcctctaaggttgggca

SEQ ID NO: 2418972 - DNA, 13 bp, Homo sapiens
tcacctggccctg

SEQ ID NO: 2418973 - DNA, 20 bp, Homo sapiens
tcacctgtgcttcgggccct

SEQ ID NO: 2418974 - DNA, 23 bp, Homo sapiens
tcaccttggcaccagacacccag

SEQ ID NO: 2418975 - DNA, 14 bp, Homo sapiens
tcacgcatgcagtg

SEQ ID NO: 2418976 - DNA, 20 bp, Homo sapiens
tcacggccacacagctgccg

SEQ ID NO: 2418977 - DNA, 14 bp, Homo sapiens
tcacggctgcgcac

SEQ ID NO: 2418978 - DNA, 19 bp, Homo sapiens
tcacggctgcgcactgtgt

SEQ ID NO: 2418979 - DNA, 17 bp, Homo sapiens
tcactaaatcttttata

SEQ ID NO: 2418980 - DNA, 19 bp, Homo sapiens
tcactaggcccccacttgc

SEQ ID NO: 2418981 - DNA, 21 bp, Homo sapiens
tcactaggcccccacttgcct

SEQ ID NO: 2418982 - DNA, 14 bp, Homo sapiens
tcactccttttaaa

SEQ ID NO: 2418983 - DNA, 15 bp, Homo sapiens
tcactccttttaaag

SEQ ID NO: 2418984 - DNA, 16 bp, Homo sapiens
tcactccttttaaaga

SEQ ID NO: 2418985 - DNA, 17 bp, Homo sapiens
tcactccttttaaagaa

SEQ ID NO: 2418986 - DNA, 21 bp, Homo sapiens
tcactctaattaattgtaatc

SEQ ID NO: 2418987 - DNA, 20 bp, Homo sapiens
tcactctagtcaatgacatg

SEQ ID NO: 2418988 - DNA, 21 bp, Homo sapiens
tcactctagtcaatgacatga

SEQ ID NO: 2418989 - DNA, 18 bp, Homo sapiens
tcagccctcacacaccct

SEQ ID NO: 2418990 - DNA, 14 bp, Homo sapiens
tcagccctgcacca

SEQ ID NO: 2418991 - DNA, 16 bp, Homo sapiens
tcagcctcccaaagtg

SEQ ID NO: 2418992 - DNA, 20 bp, Homo sapiens
tcagcctccggagtagctgg

SEQ ID NO: 2418993 - DNA, 18 bp, Homo sapiens
tcagcctggccagacaca

SEQ ID NO: 2418994 - DNA, 13 bp, Homo sapiens
tcagcctgggcgc

SEQ ID NO: 2418995 - DNA, 16 bp, Homo sapiens
tcagcctgggcgctgg

SEQ ID NO: 2418996 - DNA, 14 bp, Homo sapiens
tcagccttgccaga

SEQ ID NO: 2418997 - DNA, 13 bp, Homo sapiens
tcagcgtggcctt

SEQ ID NO: 2418998 - DNA, 19 bp, Homo sapiens
tcagctccaggtggctctg

SEQ ID NO: 2418999 - DNA, 18 bp, Homo sapiens
tcagctcccacaagcctc

SEQ ID NO: 2419000 - DNA, 20 bp, Homo sapiens
tcagctcccacaagcctctg

SEQ ID NO: 2419001 - DNA, 14 bp, Homo sapiens
tcagctccttcctg

SEQ ID NO: 2419002 - DNA, 20 bp, Homo sapiens
tcagctgcaaggtactctgg

SEQ ID NO: 2419003 - DNA, 22 bp, Homo sapiens
tcagctgcaaggtactctggtg

SEQ ID NO: 2419004 - DNA, 15 bp, Homo sapiens
tcaggaaaggaatca

SEQ ID NO: 2419005 - DNA, 17 bp, Homo sapiens
tcaggaatattttccaa

SEQ ID NO: 2419006 - DNA, 17 bp, Homo sapiens
tcaggacacaggcctgt

SEQ ID NO: 2419007 - DNA, 16 bp, Homo sapiens
tcaggacccagaggaa

SEQ ID NO: 2419008 - DNA, 13 bp, Homo sapiens
tcaggactgggag

SEQ ID NO: 2419009 - DNA, 17 bp, Homo sapiens
tcaggaggaatactgaa

SEQ ID NO: 2419010 - DNA, 21 bp, Homo sapiens
tcaggattgcgagagatgtgt

SEQ ID NO: 2419011 - DNA, 19 bp, Homo sapiens
tcaggcactgggcatgagg

SEQ ID NO: 2419012 - DNA, 22 bp, Homo sapiens
tcaggcccccgccttggcctgt

SEQ ID NO: 2419013 - DNA, 20 bp, Homo sapiens
tcaggcgatccacctgtctc

SEQ ID NO: 2419014 - DNA, 16 bp, Homo sapiens
tcaggctaggccagca

SEQ ID NO: 2419015 - DNA, 18 bp, Homo sapiens
tcagggaaagtgggacag

SEQ ID NO: 2419016 - DNA, 17 bp, Homo sapiens
tcagggaaggaggagcc

SEQ ID NO: 2419017 - DNA, 19 bp, Homo sapiens
tcagggaaggaggagcctg

SEQ ID NO: 2419018 - DNA, 23 bp, Homo sapiens
tcagggaaggaggagcctgtcct

SEQ ID NO: 2419019 - DNA, 22 bp, Homo sapiens
tcagggaggccctgtgcccctt

SEQ ID NO: 2419020 - DNA, 15 bp, Homo sapiens
tcagggcaaagccag

SEQ ID NO: 2419021 - DNA, 20 bp, Homo sapiens
tcagggcaaagccaggtccc

SEQ ID NO: 2419022 - DNA, 13 bp, Homo sapiens
tcagggccaggcc

SEQ ID NO: 2419023 - DNA, 18 bp, Homo sapiens
tcagggccatgctgaggc

SEQ ID NO: 2419024 - DNA, 21 bp, Homo sapiens
tcagggccatgctgaggcctg

SEQ ID NO: 2419025 - DNA, 17 bp, Homo sapiens
tcaggtatacctcactt

SEQ ID NO: 2419026 - DNA, 18 bp, Homo sapiens
tcaggtcacataaaactt

SEQ ID NO: 2419027 - DNA, 23 bp, Homo sapiens
tcaggtgctggggcctggttccc

SEQ ID NO: 2419028 - DNA, 18 bp, Homo sapiens
tcagtaaataactggaaa

SEQ ID NO: 2419029 - DNA, 12 bp, Homo sapiens
tcagtaagaggt

SEQ ID NO: 2419030 - DNA, 19 bp, Homo sapiens
tcagtaatttagaaatcat

SEQ ID NO: 2419031 - DNA, 20 bp, Homo sapiens
tcagtaatttagaaatcatt

SEQ ID NO: 2419032 - DNA, 16 bp, Homo sapiens
tcagtaccctctcagc

SEQ ID NO: 2419033 - DNA, 17 bp, Homo sapiens
tcagtagattgcagaaa

SEQ ID NO: 2419034 - DNA, 23 bp, Homo sapiens
tcagtaggtgcccagaataagtt

SEQ ID NO: 2419035 - DNA, 15 bp, Homo sapiens
tcagtatttaactaa

SEQ ID NO: 2419036 - DNA, 12 bp, Homo sapiens
tcagtccaggat

SEQ ID NO: 2419037 - DNA, 18 bp, Homo sapiens
tcagtccccacagataac

SEQ ID NO: 2419038 - DNA, 18 bp, Homo sapiens
tcagtctcagaatgtcat

SEQ ID NO: 2419039 - DNA, 13 bp, Homo sapiens
tcagtctctgagc

SEQ ID NO: 2419040 - DNA, 14 bp, Homo sapiens
tcagtgctgtgctg

SEQ ID NO: 2419041 - DNA, 22 bp, Homo sapiens
tcagtgtagaacctaattcaat

SEQ ID NO: 2419042 - DNA, 13 bp, Homo sapiens
ggtgaccccaggg

SEQ ID NO: 2419043 - DNA, 20 bp, Homo sapiens
ggtgaccccagggcacagga

SEQ ID NO: 2419044 - DNA, 22 bp, Homo sapiens
ggtgacccggcaccccctgcag

SEQ ID NO: 2419045 - DNA, 20 bp, Homo sapiens
ggtgatccatgtaactgcct

SEQ ID NO: 2419046 - DNA, 16 bp, Homo sapiens
ggtgatgagggcagca

SEQ ID NO: 2419047 - DNA, 19 bp, Homo sapiens
ggtgatgagggcagcagcc

SEQ ID NO: 2419048 - DNA, 18 bp, Homo sapiens
ggtgatttaagggcccag

SEQ ID NO: 2419049 - DNA, 22 bp, Homo sapiens
ggtgcacagcacaaattagtta

SEQ ID NO: 2419050 - DNA, 16 bp, Homo sapiens
ggtgcagggatgtggg

SEQ ID NO: 2419051 - DNA, 10 bp, Homo sapiens
ggtgccacct

SEQ ID NO: 2419052 - DNA, 14 bp, Homo sapiens
ggtgcccaagccag

SEQ ID NO: 2419053 - DNA, 21 bp, Homo sapiens
ggtgcccaagccagaggctgg

SEQ ID NO: 2419054 - DNA, 23 bp, Homo sapiens
ggtgcccaagccagaggctgggt

SEQ ID NO: 2419055 - DNA, 23 bp, Homo sapiens
ggtgcccacagtgtcaggcactg

SEQ ID NO: 2419056 - DNA, 12 bp, Homo sapiens
ggtgcccaggag

SEQ ID NO: 2419057 - DNA, 13 bp, Homo sapiens
ggtgcccaggaga

SEQ ID NO: 2419058 - DNA, 16 bp, Homo sapiens
ggtgccccaggaccag

SEQ ID NO: 2419059 - DNA, 23 bp, Homo sapiens
ggtgctacacccttttccagctg

SEQ ID NO: 2419060 - DNA, 18 bp, Homo sapiens
ggtgctactggggaaact

SEQ ID NO: 2419061 - DNA, 14 bp, Homo sapiens
ggtgctcagggggc

SEQ ID NO: 2419062 - DNA, 15 bp, Homo sapiens
ggtgctgacggccag

SEQ ID NO: 2419063 - DNA, 16 bp, Homo sapiens
ggtgctgacggccagg

SEQ ID NO: 2419064 - DNA, 21 bp, Homo sapiens
ggtgctgacttcatctcccac

SEQ ID NO: 2419065 - DNA, 13 bp, Homo sapiens
ggtgctggtcccg

SEQ ID NO: 2419066 - DNA, 14 bp, Homo sapiens
ggtgcttctcctct

SEQ ID NO: 2419067 - DNA, 18 bp, Homo sapiens
ggtggcacaggccccctt

SEQ ID NO: 2419068 - DNA, 12 bp, Homo sapiens
ggtggccaggcc

SEQ ID NO: 2419069 - DNA, 19 bp, Homo sapiens
ggtggccctctcccctgcc

SEQ ID NO: 2419070 - DNA, 20 bp, Homo sapiens
ggtggccctctcccctgccc

SEQ ID NO: 2419071 - DNA, 18 bp, Homo sapiens
ggtggctactctgtgcca

SEQ ID NO: 2419072 - DNA, 23 bp, Homo sapiens
ggtggctactctgtgccagagcc

SEQ ID NO: 2419073 - DNA, 14 bp, Homo sapiens
ggtggtggcctggt

SEQ ID NO: 2419074 - DNA, 22 bp, Homo sapiens
ggtgtagaacactaattcataa

SEQ ID NO: 2419075 - DNA, 17 bp, Homo sapiens
ggtgtagctacagagaa

SEQ ID NO: 2419076 - DNA, 19 bp, Homo sapiens
ggtgtcacggccaggcaga

SEQ ID NO: 2419077 - DNA, 18 bp, Homo sapiens
ggtgtcctacagaaaaac

SEQ ID NO: 2419078 - DNA, 21 bp, Homo sapiens
ggtgtcctacagaaaaacctt

SEQ ID NO: 2419079 - DNA, 20 bp, Homo sapiens
gttctagacatggaggttct

SEQ ID NO: 2419080 - DNA, 14 bp, Homo sapiens
gttctaggtttcaa

SEQ ID NO: 2419081 - DNA, 19 bp, Homo sapiens
gttctaggtttcaaagatg

SEQ ID NO: 2419082 - DNA, 17 bp, Homo sapiens
gttctcaggtgttgcca

SEQ ID NO: 2419083 - DNA, 22 bp, Homo sapiens
gttctcatgataccacctttac

SEQ ID NO: 2419084 - DNA, 21 bp, Homo sapiens
gttctccaacatcacagccca

SEQ ID NO: 2419085 - DNA, 20 bp, Homo sapiens
gttctccctgtacagtgtta

SEQ ID NO: 2419086 - DNA, 17 bp, Homo sapiens
gttctcctgctgctccc

SEQ ID NO: 2419087 - DNA, 21 bp, Homo sapiens
gttctcctgctgctccctcag

SEQ ID NO: 2419088 - DNA, 13 bp, Homo sapiens
gttctccttttcc

SEQ ID NO: 2419089 - DNA, 18 bp, Homo sapiens
gttctccttttcctctct

SEQ ID NO: 2419090 - DNA, 17 bp, Homo sapiens
gttctgcctgccagctg

SEQ ID NO: 2419091 - DNA, 19 bp, Homo sapiens
gttctgcctgccagctgca

SEQ ID NO: 2419092 - DNA, 15 bp, Homo sapiens
gttctgctcatcatt

SEQ ID NO: 2419093 - DNA, 14 bp, Homo sapiens
gttctgctctggtt

SEQ ID NO: 2419094 - DNA, 11 bp, Homo sapiens
gttctgtccct

SEQ ID NO: 2419095 - DNA, 11 bp, Homo sapiens
gttctgtgcac

SEQ ID NO: 2419096 - DNA, 16 bp, Homo sapiens
gttctgtggtttcatg

SEQ ID NO: 2419097 - DNA, 19 bp, Homo sapiens
gttctgtggtttcatgtta

SEQ ID NO: 2419098 - DNA, 13 bp, Homo sapiens
gttctgtgtcttt

SEQ ID NO: 2419099 - DNA, 23 bp, Homo sapiens
gttctgtgtctttcacagctcct

SEQ ID NO: 2419100 - DNA, 21 bp, Homo sapiens
gttctgttaactgaataccac

SEQ ID NO: 2419101 - DNA, 18 bp, Homo sapiens
gttctgtttcaaggcact

SEQ ID NO: 2419102 - DNA, 13 bp, Homo sapiens
gttctgtttgctg

SEQ ID NO: 2419103 - DNA, 16 bp, Homo sapiens
gttctgttttgtttcg

SEQ ID NO: 2419104 - DNA, 17 bp, Homo sapiens
gttcttagctcaatgag

SEQ ID NO: 2419105 - DNA, 14 bp, Homo sapiens
gttcttcctcagcc

SEQ ID NO: 2419106 - DNA, 18 bp, Homo sapiens
gttcttcctcagccagcc

SEQ ID NO: 2419107 - DNA, 20 bp, Homo sapiens
gttcttcctcagccagcctc

SEQ ID NO: 2419108 - DNA, 12 bp, Homo sapiens
gttcttgtattt

SEQ ID NO: 2419109 - DNA, 23 bp, Homo sapiens
gttctttaaaatgtaaagccatg

SEQ ID NO: 2419110 - DNA, 13 bp, Homo sapiens
gttctttgttcat

SEQ ID NO: 2419111 - DNA, 20 bp, Homo sapiens
gttctttgttcatagcccag

SEQ ID NO: 2419112 - DNA, 21 bp, Homo sapiens
gttctttgttcatagcccagt

SEQ ID NO: 2419113 - DNA, 21 bp, Homo sapiens
gttgaaaaagtttgtttttgc

SEQ ID NO: 2419114 - DNA, 23 bp, Homo sapiens
gttgaagcaaatcgaatgaaatt

SEQ ID NO: 2419115 - DNA, 18 bp, Homo sapiens
gttgacagttcatatgta

SEQ ID NO: 2419116 - DNA, 13 bp, Homo sapiens
gttgacattctga

SEQ ID NO: 2419117 - DNA, 14 bp, Homo sapiens
gttgacattctgaa

SEQ ID NO: 2419118 - DNA, 15 bp, Homo sapiens
gttgacattctgaat

SEQ ID NO: 2419119 - DNA, 19 bp, Homo sapiens
gttgacattctgaatgctt

SEQ ID NO: 2419120 - DNA, 15 bp, Homo sapiens
gttgaccccagagga

SEQ ID NO: 2419121 - DNA, 15 bp, Homo sapiens
gttgagacaagaaaa

SEQ ID NO: 2419122 - DNA, 12 bp, Homo sapiens
gttgagacagag

SEQ ID NO: 2419123 - DNA, 14 bp, Homo sapiens
gttgagccttttcc

SEQ ID NO: 2419124 - DNA, 14 bp, Homo sapiens
gttgatactgttgc

SEQ ID NO: 2419125 - DNA, 21 bp, Homo sapiens
gttgatactgttgcacgtgtg

SEQ ID NO: 2419126 - DNA, 23 bp, Homo sapiens
gttgatttttttttttttttcct

SEQ ID NO: 2419127 - DNA, 14 bp, Homo sapiens
gttgcacactttgg

SEQ ID NO: 2419128 - DNA, 19 bp, Homo sapiens
gttgcacgtgtgtttttct

SEQ ID NO: 2419129 - DNA, 22 bp, Homo sapiens
gttgcacgtgtgtttttctatt

SEQ ID NO: 2419130 - DNA, 17 bp, Homo sapiens
gttgcagtcactctagt

SEQ ID NO: 2419131 - DNA, 20 bp, Homo sapiens
gttgcatgtagtaacactaa

SEQ ID NO: 2419132 - DNA, 18 bp, Homo sapiens
gttgccaagctccaagcc

SEQ ID NO: 2419133 - DNA, 19 bp, Homo sapiens
gttgccaagctccaagccc

SEQ ID NO: 2419134 - DNA, 15 bp, Homo sapiens
gttgcccccatttct

SEQ ID NO: 2419135 - DNA, 19 bp, Homo sapiens
gttgctccgcctggcctgg

SEQ ID NO: 2419136 - DNA, 18 bp, Homo sapiens
gttgctgcttctcccagg

SEQ ID NO: 2419137 - DNA, 22 bp, Homo sapiens
gttgctgcttctcccaggcaag

SEQ ID NO: 2419138 - DNA, 15 bp, Homo sapiens
gttggaatggatttt

SEQ ID NO: 2419139 - DNA, 17 bp, Homo sapiens
gttggacaagcttctga

SEQ ID NO: 2419140 - DNA, 18 bp, Homo sapiens
gttggagctcattctgtc

SEQ ID NO: 2419141 - DNA, 14 bp, Homo sapiens
gttggcaggctggc

SEQ ID NO: 2419142 - DNA, 15 bp, Homo sapiens
gttggcatagctctg

SEQ ID NO: 2419143 - DNA, 13 bp, Homo sapiens
gttggcctgcact

SEQ ID NO: 2419144 - DNA, 21 bp, Homo sapiens
gttggcgtaggctacagagaa

SEQ ID NO: 2419145 - DNA, 15 bp, Homo sapiens
gttggctctgccagt

SEQ ID NO: 2419146 - DNA, 22 bp, Homo sapiens
gttggctctgccagtcctgtcc

SEQ ID NO: 2419147 - DNA, 16 bp, Homo sapiens
gttggcttacctggcc

SEQ ID NO: 2419148 - DNA, 20 bp, Homo sapiens
gttgggagagggcgcaggcc

SEQ ID NO: 2419149 - DNA, 23 bp, Homo sapiens
gttggggaaacagcatctccaag

SEQ ID NO: 2419150 - DNA, 21 bp, Homo sapiens
gttggggacacatgtatttgg

SEQ ID NO: 2419151 - DNA, 14 bp, Homo sapiens
gttggttggttttc

SEQ ID NO: 2419152 - DNA, 15 bp, Homo sapiens
gttggttttcttctt

SEQ ID NO: 2419153 - DNA, 17 bp, Homo sapiens
gttgtaatatttcttca

SEQ ID NO: 2419154 - DNA, 12 bp, Homo sapiens
gttgtattcatt

SEQ ID NO: 2419155 - DNA, 22 bp, Homo sapiens
gttgtcaagaatagcattgtaa

SEQ ID NO: 2419156 - DNA, 15 bp, Homo sapiens
gttgtctaagaaatt

SEQ ID NO: 2419157 - DNA, 11 bp, Homo sapiens
gttgtctctga

SEQ ID NO: 2419158 - DNA, 20 bp, Homo sapiens
gttgtgagtttaccttgtat

SEQ ID NO: 2419159 - DNA, 21 bp, Homo sapiens
gttgtggcctttgcgctcctg

SEQ ID NO: 2419160 - DNA, 18 bp, Homo sapiens
gttgttctgttaactgaa

SEQ ID NO: 2419161 - DNA, 23 bp, Homo sapiens
gtttaaaagacacacttgtccac

SEQ ID NO: 2419162 - DNA, 15 bp, Homo sapiens
gtttaaagaaagtgt

SEQ ID NO: 2419163 - DNA, 21 bp, Homo sapiens
gtttaaagaaagtgtatttgg

SEQ ID NO: 2419164 - DNA, 17 bp, Homo sapiens
gtttaaagagtctagat

SEQ ID NO: 2419165 - DNA, 19 bp, Homo sapiens
gtttaaagagtctagattc

SEQ ID NO: 2419166 - DNA, 11 bp, Homo sapiens
gtttaaatgaa

SEQ ID NO: 2419167 - DNA, 23 bp, Homo sapiens
gtttaaatgaacaagagaagcat

SEQ ID NO: 2419168 - DNA, 13 bp, Homo sapiens
gtttaatgttttg

SEQ ID NO: 2419169 - DNA, 20 bp, Homo sapiens
gtttacaaaaatttctgtaa

SEQ ID NO: 2419170 - DNA, 16 bp, Homo sapiens
gtttacactctttgta

SEQ ID NO: 2419171 - DNA, 11 bp, Homo sapiens
gtttacagaat

SEQ ID NO: 2419172 - DNA, 15 bp, Homo sapiens
gtttaccagaaagca

SEQ ID NO: 2419173 - DNA, 12 bp, Homo sapiens
gtttagctctga

SEQ ID NO: 2419174 - DNA, 13 bp, Homo sapiens
gtttagctctgag

SEQ ID NO: 2419175 - DNA, 14 bp, Homo sapiens
gtttaggctatttg

SEQ ID NO: 2419176 - DNA, 23 bp, Homo sapiens
gtttaggctatttgtaaatctgc

SEQ ID NO: 2419177 - DNA, 16 bp, Homo sapiens
gtttagggaacaattt

SEQ ID NO: 2419178 - DNA, 22 bp, Homo sapiens
gtttatgttccattaaacgatt

SEQ ID NO: 2419179 - DNA, 18 bp, Homo sapiens
gtttattaagcatcagaa

SEQ ID NO: 2419180 - DNA, 23 bp, Homo sapiens
gtttattacgtatgtctggttct

SEQ ID NO: 2419181 - DNA, 20 bp, Homo sapiens
gtttattcttctagagttca

SEQ ID NO: 2419182 - DNA, 22 bp, Homo sapiens
gtttatttaacttttagtaaag

SEQ ID NO: 2419183 - DNA, 20 bp, Homo sapiens
gtttcaaagatgctgtgagt

SEQ ID NO: 2419184 - DNA, 20 bp, Homo sapiens
tacatacagaattactgtaa

SEQ ID NO: 2419185 - DNA, 19 bp, Homo sapiens
tacatagtgctgctgtgtg

SEQ ID NO: 2419186 - DNA, 22 bp, Homo sapiens
tacatagtgctgctgtgtgctt

SEQ ID NO: 2419187 - DNA, 20 bp, Homo sapiens
tacatctattttggattgta

SEQ ID NO: 2419188 - DNA, 14 bp, Homo sapiens
tacatcttctgcct

SEQ ID NO: 2419189 - DNA, 17 bp, Homo sapiens
tacatcttctgccttag

SEQ ID NO: 2419190 - DNA, 15 bp, Homo sapiens
tacatgaagtatttt

SEQ ID NO: 2419191 - DNA, 22 bp, Homo sapiens
tacatgaagtattttttcagta

SEQ ID NO: 2419192 - DNA, 16 bp, Homo sapiens
tacatgacatttattt

SEQ ID NO: 2419193 - DNA, 21 bp, Homo sapiens
tacatgacatttatttttcat

SEQ ID NO: 2419194 - DNA, 13 bp, Homo sapiens
tacatgaggactc

SEQ ID NO: 2419195 - DNA, 14 bp, Homo sapiens
tacatgaggactct

SEQ ID NO: 2419196 - DNA, 17 bp, Homo sapiens
tacatgctaagagaagt

SEQ ID NO: 2419197 - DNA, 18 bp, Homo sapiens
tacatgctaagagaagta

SEQ ID NO: 2419198 - DNA, 20 bp, Homo sapiens
tacatgcttattccatgact

SEQ ID NO: 2419199 - DNA, 14 bp, Homo sapiens
tacatggtgctggg

SEQ ID NO: 2419200 - DNA, 23 bp, Homo sapiens
tacatggtgctgggagaggcagc

SEQ ID NO: 2419201 - DNA, 15 bp, Homo sapiens
tacatggtgtttgtg

SEQ ID NO: 2419202 - DNA, 15 bp, Homo sapiens
tacatttaaaacatt

SEQ ID NO: 2419203 - DNA, 19 bp, Homo sapiens
tacatttaaaacattaaaa

SEQ ID NO: 2419204 - DNA, 11 bp, Homo sapiens
tacatttaata

SEQ ID NO: 2419205 - DNA, 18 bp, Homo sapiens
tacatttacaaactgaag

SEQ ID NO: 2419206 - DNA, 14 bp, Homo sapiens
tacatttctcaggc

SEQ ID NO: 2419207 - DNA, 15 bp, Homo sapiens
tacattttctaagaa

SEQ ID NO: 2419208 - DNA, 15 bp, Homo sapiens
taccaatgaaaaaat

SEQ ID NO: 2419209 - DNA, 13 bp, Homo sapiens
taccactctgtaa

SEQ ID NO: 2419210 - DNA, 14 bp, Homo sapiens
taccactctgtaat

SEQ ID NO: 2419211 - DNA, 15 bp, Homo sapiens
taccagataactttt

SEQ ID NO: 2419212 - DNA, 23 bp, Homo sapiens
taccagataacttttttttttct

SEQ ID NO: 2419213 - DNA, 12 bp, Homo sapiens
taccagatgcag

SEQ ID NO: 2419214 - DNA, 13 bp, Homo sapiens
taccagcgaggag

SEQ ID NO: 2419215 - DNA, 20 bp, Homo sapiens
taccagcgaggaggctccag

SEQ ID NO: 2419216 - DNA, 21 bp, Homo sapiens
taccaggcaccaaaagaagta

SEQ ID NO: 2419217 - DNA, 16 bp, Homo sapiens
taccagttgcctttta

SEQ ID NO: 2419218 - DNA, 20 bp, Homo sapiens
taccatcactgagttttcca

SEQ ID NO: 2419219 - DNA, 14 bp, Homo sapiens
taccattaaaccat

SEQ ID NO: 2419220 - DNA, 15 bp, Homo sapiens
taccattaaaccatc

SEQ ID NO: 2419221 - DNA, 17 bp, Homo sapiens
taccatttacatgtttt

SEQ ID NO: 2419222 - DNA, 24 bp, Homo sapiens
tacccagtttctaaactggagact

SEQ ID NO: 2419223 - DNA, 16 bp, Homo sapiens
tacccccagctgtgct

SEQ ID NO: 2419224 - DNA, 15 bp, Homo sapiens
taccctcctggctct

SEQ ID NO: 2419225 - DNA, 14 bp, Homo sapiens
taccctctgaaata

SEQ ID NO: 2419226 - DNA, 18 bp, Homo sapiens
taccctggccgccccctg

SEQ ID NO: 2419227 - DNA, 22 bp, Homo sapiens
tacccttttctgaccaaagaga

SEQ ID NO: 2419228 - DNA, 18 bp, Homo sapiens
tacctagatttaatataa

SEQ ID NO: 2419229 - DNA, 22 bp, Homo sapiens
tacctagcgggatggggctccc

SEQ ID NO: 2419230 - DNA, 13 bp, Homo sapiens
tacctcagcctgg

SEQ ID NO: 2419231 - DNA, 15 bp, Homo sapiens
tacctcagcctgggc

SEQ ID NO: 2419232 - DNA, 11 bp, Homo sapiens
tacctgagggt

SEQ ID NO: 2419233 - DNA, 15 bp, Homo sapiens
tacctgagggtctgt

SEQ ID NO: 2419234 - DNA, 20 bp, Homo sapiens
tacctgtgtttcttgcctca

SEQ ID NO: 2419235 - DNA, 21 bp, Homo sapiens
tacctgtgtttcttgcctcat

SEQ ID NO: 2419236 - DNA, 13 bp, Homo sapiens
tacctgttgagca

SEQ ID NO: 2419237 - DNA, 17 bp, Homo sapiens
taccttatagttactgt

SEQ ID NO: 2419238 - DNA, 18 bp, Homo sapiens
taccttatagttactgtg

SEQ ID NO: 2419239 - DNA, 13 bp, Homo sapiens
taccttctcccca

SEQ ID NO: 2419240 - DNA, 22 bp, Homo sapiens
taccttgaaaataagaatagaa

SEQ ID NO: 2419241 - DNA, 20 bp, Homo sapiens
taccttgtatactgtaggca

SEQ ID NO: 2419242 - DNA, 12 bp, Homo sapiens
tacctttcatac

SEQ ID NO: 2419243 - DNA, 19 bp, Homo sapiens
tacgagagcagaggtctcc

SEQ ID NO: 2419244 - DNA, 22 bp, Homo sapiens
tacgcagcgtgctttaaaaaat

SEQ ID NO: 2419245 - DNA, 14 bp, Homo sapiens
tacgctgtccagaa

SEQ ID NO: 2419246 - DNA, 20 bp, Homo sapiens
tacgtgcacagggtccccga

SEQ ID NO: 2419247 - DNA, 14 bp, Homo sapiens
tactaataaactaa

SEQ ID NO: 2419248 - DNA, 16 bp, Homo sapiens
tactaccttgaaaata

SEQ ID NO: 2419249 - DNA, 20 bp, Homo sapiens
tactaccttgaaaataagaa

SEQ ID NO: 2419250 - DNA, 12 bp, Homo sapiens
tactatttaaag

SEQ ID NO: 2419251 - DNA, 12 bp, Homo sapiens
tactatttcaca

SEQ ID NO: 2419252 - DNA, 17 bp, Homo sapiens
tactcaaatgagtaaca

SEQ ID NO: 2419253 - DNA, 13 bp, Homo sapiens
tactccacactgc

SEQ ID NO: 2419254 - DNA, 18 bp, Homo sapiens
tactcctgtgggagcctc

SEQ ID NO: 2419255 - DNA, 22 bp, Homo sapiens
tactctaagatcttagattctc

SEQ ID NO: 2419256 - DNA, 20 bp, Homo sapiens
tactctgtgccagagcctgg

SEQ ID NO: 2419257 - DNA, 23 bp, Homo sapiens
tactctgtgccagagcctggggc

SEQ ID NO: 2419258 - DNA, 14 bp, Homo sapiens
tactctttctgtat

SEQ ID NO: 2419259 - DNA, 15 bp, Homo sapiens
tactctttctgtata

SEQ ID NO: 2419260 - DNA, 20 bp, Homo sapiens
tactgaacatctgagtcctg

SEQ ID NO: 2419261 - DNA, 20 bp, Homo sapiens
tactgactttgcttgctttg

SEQ ID NO: 2419262 - DNA, 22 bp, Homo sapiens
tactgactttgcttgctttgaa

SEQ ID NO: 2419263 - DNA, 15 bp, Homo sapiens
tactgagccttgtaa

SEQ ID NO: 2419264 - DNA, 18 bp, Homo sapiens
tactgagccttgtaattc

SEQ ID NO: 2419265 - DNA, 16 bp, Homo sapiens
tactgcaaaaagaaaa

SEQ ID NO: 2419266 - DNA, 21 bp, Homo sapiens
tactgcaaatcaggcttttgt

SEQ ID NO: 2419267 - DNA, 20 bp, Homo sapiens
tactgcagcctttgcctccc

SEQ ID NO: 2419268 - DNA, 22 bp, Homo sapiens
tactgccgtcagtgctgtgctg

SEQ ID NO: 2419269 - DNA, 11 bp, Homo sapiens
tactgcctgct

SEQ ID NO: 2419270 - DNA, 22 bp, Homo sapiens
tactgcgactttctgcctggag

SEQ ID NO: 2419271 - DNA, 13 bp, Homo sapiens
tactgctctgaga

SEQ ID NO: 2419272 - DNA, 18 bp, Homo sapiens
tactggaaattaggggat

SEQ ID NO: 2419273 - DNA, 16 bp, Homo sapiens
tactggggaaactggc

SEQ ID NO: 2419274 - DNA, 24 bp, Homo sapiens
tactggggaaactggccatggcct

SEQ ID NO: 2419275 - DNA, 19 bp, Homo sapiens
tactggtctctctatgcct

SEQ ID NO: 2419276 - DNA, 13 bp, Homo sapiens
tactgtaattcct

SEQ ID NO: 2419277 - DNA, 16 bp, Homo sapiens
tactgtaattcctcaa

SEQ ID NO: 2419278 - DNA, 13 bp, Homo sapiens
tactgtgtaatta

SEQ ID NO: 2419279 - DNA, 17 bp, Homo sapiens
tactgtgttatgcaaaa

SEQ ID NO: 2419280 - DNA, 18 bp, Homo sapiens
tactgttctaaagctctg

SEQ ID NO: 2419281 - DNA, 17 bp, Homo sapiens
tacttatataattgcca

SEQ ID NO: 2419282 - DNA, 18 bp, Homo sapiens
tacttatttgtatatggt

SEQ ID NO: 2419283 - DNA, 22 bp, Homo sapiens
tacttcaaaagtttgtttgctt

SEQ ID NO: 2419284 - DNA, 16 bp, Homo sapiens
tacttcctcctcccca

SEQ ID NO: 2419285 - DNA, 24 bp, Homo sapiens
tagcagtggcaggcagaggcccag

SEQ ID NO: 2419286 - DNA, 18 bp, Homo sapiens
tagcatgcttgttgcaat

SEQ ID NO: 2419287 - DNA, 17 bp, Homo sapiens
tagcatgtcactaaagc

SEQ ID NO: 2419288 - DNA, 14 bp, Homo sapiens
tagccaaacctcac

SEQ ID NO: 2419289 - DNA, 17 bp, Homo sapiens
tagccaaacctcaccaa

SEQ ID NO: 2419290 - DNA, 15 bp, Homo sapiens
tagccacaccaggat

SEQ ID NO: 2419291 - DNA, 21 bp, Homo sapiens
tagccacatttggaatacttt

SEQ ID NO: 2419292 - DNA, 20 bp, Homo sapiens
tagccactaaccttgcctgg

SEQ ID NO: 2419293 - DNA, 23 bp, Homo sapiens
tagccagccggggcgagtggcac

SEQ ID NO: 2419294 - DNA, 17 bp, Homo sapiens
tagccatatttgtaaaa

SEQ ID NO: 2419295 - DNA, 19 bp, Homo sapiens
tagccatatttgtaaaatg

SEQ ID NO: 2419296 - DNA, 20 bp, Homo sapiens
tagccatatttgtaaaatga

SEQ ID NO: 2419297 - DNA, 22 bp, Homo sapiens
tagccccctggtaatagctgta

SEQ ID NO: 2419298 - DNA, 22 bp, Homo sapiens
tagcctcaggggtctgagctcc

SEQ ID NO: 2419299 - DNA, 11 bp, Homo sapiens
tagcctggacc

SEQ ID NO: 2419300 - DNA, 23 bp, Homo sapiens
tagcctggacctctgacagcagc

SEQ ID NO: 2419301 - DNA, 14 bp, Homo sapiens
tagcctggcttggg

SEQ ID NO: 2419302 - DNA, 13 bp, Homo sapiens
tagccttgcttgt

SEQ ID NO: 2419303 - DNA, 17 bp, Homo sapiens
tagcctttttgtataaa

SEQ ID NO: 2419304 - DNA, 23 bp, Homo sapiens
tagccttttttccccagacttgt

SEQ ID NO: 2419305 - DNA, 21 bp, Homo sapiens
tagcgctatctccctgcctcc

SEQ ID NO: 2419306 - DNA, 18 bp, Homo sapiens
tagcgggatggggctccc

SEQ ID NO: 2419307 - DNA, 17 bp, Homo sapiens
tagcgttcttgtaattt

SEQ ID NO: 2419308 - DNA, 20 bp, Homo sapiens
tagctaaacggattccaaag

SEQ ID NO: 2419309 - DNA, 20 bp, Homo sapiens
tagctaataaaaagcttttg

SEQ ID NO: 2419310 - DNA, 12 bp, Homo sapiens
tagctcaatgag

SEQ ID NO: 2419311 - DNA, 16 bp, Homo sapiens
tcatgcccctggctgg

SEQ ID NO: 2419312 - DNA, 13 bp, Homo sapiens
tcatgcctctgag

SEQ ID NO: 2419313 - DNA, 21 bp, Homo sapiens
tcatgcgatgacacttgtaca

SEQ ID NO: 2419314 - DNA, 20 bp, Homo sapiens
tcatgctggagggaggctgg

SEQ ID NO: 2419315 - DNA, 23 bp, Homo sapiens
tcatggatgggggaactcagatc

SEQ ID NO: 2419316 - DNA, 16 bp, Homo sapiens
tcatggccagctggag

SEQ ID NO: 2419317 - DNA, 13 bp, Homo sapiens
tcatgtaaactgt

SEQ ID NO: 2419318 - DNA, 17 bp, Homo sapiens
tcatgtaaactgtgcac

SEQ ID NO: 2419319 - DNA, 13 bp, Homo sapiens
tcatgtaaataat

SEQ ID NO: 2419320 - DNA, 18 bp, Homo sapiens
tcatgtaaataatacatt

SEQ ID NO: 2419321 - DNA, 17 bp, Homo sapiens
tcatgtacaagatgaag

SEQ ID NO: 2419322 - DNA, 10 bp, Homo sapiens
tcatgtgtat

SEQ ID NO: 2419323 - DNA, 23 bp, Homo sapiens
tcatgtgtgtccacgactgtctc

SEQ ID NO: 2419324 - DNA, 12 bp, Homo sapiens
tcatgtgtgtta

SEQ ID NO: 2419325 - DNA, 12 bp, Homo sapiens
tcattaaataaa

SEQ ID NO: 2419326 - DNA, 19 bp, Homo sapiens
tcattaaataaatttgact

SEQ ID NO: 2419327 - DNA, 12 bp, Homo sapiens
tcattactataa

SEQ ID NO: 2419328 - DNA, 15 bp, Homo sapiens
tcattagaaatattt

SEQ ID NO: 2419329 - DNA, 19 bp, Homo sapiens
tcattattacttttgctgt

SEQ ID NO: 2419330 - DNA, 14 bp, Homo sapiens
tcattatttatgta

SEQ ID NO: 2419331 - DNA, 14 bp, Homo sapiens
tcattcatttttgt

SEQ ID NO: 2419332 - DNA, 17 bp, Homo sapiens
tcattccatgtgcccag

SEQ ID NO: 2419333 - DNA, 18 bp, Homo sapiens
tcattccatgtgcccagt

SEQ ID NO: 2419334 - DNA, 20 bp, Homo sapiens
tcattccatgtgcccagtta

SEQ ID NO: 2419335 - DNA, 16 bp, Homo sapiens
tcattctctgtctcat

SEQ ID NO: 2419336 - DNA, 18 bp, Homo sapiens
tcattctgaaggagcccc

SEQ ID NO: 2419337 - DNA, 16 bp, Homo sapiens
tcattctgcaagtata

SEQ ID NO: 2419338 - DNA, 13 bp, Homo sapiens
tcattgcttacaa

SEQ ID NO: 2419339 - DNA, 16 bp, Homo sapiens
tcattgtaaacaaact

SEQ ID NO: 2419340 - DNA, 18 bp, Homo sapiens
tcattgtctgtgtagagt

SEQ ID NO: 2419341 - DNA, 23 bp, Homo sapiens
tcatttagcatgttgttgaaagg

SEQ ID NO: 2419342 - DNA, 16 bp, Homo sapiens
tcatttatctataatt

SEQ ID NO: 2419343 - DNA, 15 bp, Homo sapiens
tcatttgctttggaa

SEQ ID NO: 2419344 - DNA, 18 bp, Homo sapiens
tcatttggttcattaatt

SEQ ID NO: 2419345 - DNA, 14 bp, Homo sapiens
tcattttggtactt

SEQ ID NO: 2419346 - DNA, 19 bp, Homo sapiens
tcatttttcaatagcacat

SEQ ID NO: 2419347 - DNA, 18 bp, Homo sapiens
tccaaaagaagcccccag

SEQ ID NO: 2419348 - DNA, 21 bp, Homo sapiens
tccaaaagaagcccccagcta

SEQ ID NO: 2419349 - DNA, 18 bp, Homo sapiens
tccaaaatcttgatcagt

SEQ ID NO: 2419350 - DNA, 19 bp, Homo sapiens
tccaaactcttccctctct

SEQ ID NO: 2419351 - DNA, 14 bp, Homo sapiens
tccaaagcagacag

SEQ ID NO: 2419352 - DNA, 17 bp, Homo sapiens
tccaaatactaatgaaa

SEQ ID NO: 2419353 - DNA, 14 bp, Homo sapiens
tccaaattcagttt

SEQ ID NO: 2419354 - DNA, 19 bp, Homo sapiens
tccaaattcagtttcataa

SEQ ID NO: 2419355 - DNA, 21 bp, Homo sapiens
tccaacaccaagcacagcagc

SEQ ID NO: 2419356 - DNA, 15 bp, Homo sapiens
tccaacagtttaatg

SEQ ID NO: 2419357 - DNA, 23 bp, Homo sapiens
tccaacagtttaatgaagatcta

SEQ ID NO: 2419358 - DNA, 21 bp, Homo sapiens
tccaacctgcaaagatctgtc

SEQ ID NO: 2419359 - DNA, 18 bp, Homo sapiens
tccaactcgaatctgtgt

SEQ ID NO: 2419360 - DNA, 15 bp, Homo sapiens
tccaacttggctgca

SEQ ID NO: 2419361 - DNA, 14 bp, Homo sapiens
tccaagactctaga

SEQ ID NO: 2419362 - DNA, 15 bp, Homo sapiens
tccaagactctagag

SEQ ID NO: 2419363 - DNA, 23 bp, Homo sapiens
tccaagactctagagtccaaggt

SEQ ID NO: 2419364 - DNA, 17 bp, Homo sapiens
tccaagagtctaaagat

SEQ ID NO: 2419365 - DNA, 13 bp, Homo sapiens
tccaagattctag

SEQ ID NO: 2419366 - DNA, 15 bp, Homo sapiens
tccaagattctagat

SEQ ID NO: 2419367 - DNA, 18 bp, Homo sapiens
tccaagattctagatgat

SEQ ID NO: 2419368 - DNA, 22 bp, Homo sapiens
tctaaggtccggtgttctaaga

SEQ ID NO: 2419369 - DNA, 19 bp, Homo sapiens
tctaagtaaatacaatttt

SEQ ID NO: 2419370 - DNA, 13 bp, Homo sapiens
tctaagtctttcc

SEQ ID NO: 2419371 - DNA, 13 bp, Homo sapiens
tctaagtgatata

SEQ ID NO: 2419372 - DNA, 17 bp, Homo sapiens
tctaagttataagactc

SEQ ID NO: 2419373 - DNA, 20 bp, Homo sapiens
tctaagttataagactctca

SEQ ID NO: 2419374 - DNA, 17 bp, Homo sapiens
tctaagtttctaagatt

SEQ ID NO: 2419375 - DNA, 23 bp, Homo sapiens
tctaagtttctaagattctaaag

SEQ ID NO: 2419376 - DNA, 15 bp, Homo sapiens
tctaataatttctaa

SEQ ID NO: 2419377 - DNA, 17 bp, Homo sapiens
tctaataatttctaatg

SEQ ID NO: 2419378 - DNA, 20 bp, Homo sapiens
tctcattggacccttccatg

SEQ ID NO: 2419379 - DNA, 18 bp, Homo sapiens
tctcatttagcctgtcct

SEQ ID NO: 2419380 - DNA, 20 bp, Homo sapiens
tctccaacatcacagcccag

SEQ ID NO: 2419381 - DNA, 19 bp, Homo sapiens
tctccactttcagctgtct

SEQ ID NO: 2419382 - DNA, 21 bp, Homo sapiens
tctccagctgggctctgcaat

SEQ ID NO: 2419383 - DNA, 22 bp, Homo sapiens
tctccaggggctgcttcctcct

SEQ ID NO: 2419384 - DNA, 18 bp, Homo sapiens
tctccagtggattcccag

SEQ ID NO: 2419385 - DNA, 18 bp, Homo sapiens
tctccattctgctccttc

SEQ ID NO: 2419386 - DNA, 21 bp, Homo sapiens
tctccattctgctccttcccc

SEQ ID NO: 2419387 - DNA, 19 bp, Homo sapiens
tctcccaactcttgcacag

SEQ ID NO: 2419388 - DNA, 22 bp, Homo sapiens
tctcccaactcttgcacagtca

SEQ ID NO: 2419389 - DNA, 12 bp, Homo sapiens
tctcccaccctc

SEQ ID NO: 2419390 - DNA, 14 bp, Homo sapiens
tctcccaccctctt

SEQ ID NO: 2419391 - DNA, 14 bp, Homo sapiens
tctcccactctcct

SEQ ID NO: 2419392 - DNA, 20 bp, Homo sapiens
tctcccaggcaaggctgtgg

SEQ ID NO: 2419393 - DNA, 13 bp, Homo sapiens
tctcccaggcccc

SEQ ID NO: 2419394 - DNA, 14 bp, Homo sapiens
tctcccaggcccca

SEQ ID NO: 2419395 - DNA, 20 bp, Homo sapiens
tctcccaggccccatgacct

SEQ ID NO: 2419396 - DNA, 19 bp, Homo sapiens
tctccccacgagggctggc

SEQ ID NO: 2419397 - DNA, 15 bp, Homo sapiens
tctccccagctccca

SEQ ID NO: 2419398 - DNA, 15 bp, Homo sapiens
tctccccccgcctgc

SEQ ID NO: 2419399 - DNA, 21 bp, Homo sapiens
tctccccctatttattgactt

SEQ ID NO: 2419400 - DNA, 16 bp, Homo sapiens
tctcccctgcactgta

SEQ ID NO: 2419401 - DNA, 21 bp, Homo sapiens
tctcccctgcactgtaaaatg

SEQ ID NO: 2419402 - DNA, 19 bp, Homo sapiens
tctcccctgccccctgcag

SEQ ID NO: 2419403 - DNA, 21 bp, Homo sapiens
tctccctcctccaggaagcct

SEQ ID NO: 2419404 - DNA, 14 bp, Homo sapiens
tctccctgcatggc

SEQ ID NO: 2419405 - DNA, 14 bp, Homo sapiens
tctccctgtacagt

SEQ ID NO: 2419406 - DNA, 15 bp, Homo sapiens
tctcccttgggctct

SEQ ID NO: 2419407 - DNA, 17 bp, Homo sapiens
tctcccttgggctctga

SEQ ID NO: 2419408 - DNA, 15 bp, Homo sapiens
tctcccttttccatg

SEQ ID NO: 2419409 - DNA, 17 bp, Homo sapiens
tctccgttagctcctgt

SEQ ID NO: 2419410 - DNA, 19 bp, Homo sapiens
tctccgttagctcctgtgg

SEQ ID NO: 2419411 - DNA, 14 bp, Homo sapiens
tctcctagcccctg

SEQ ID NO: 2419412 - DNA, 15 bp, Homo sapiens
tctcctaggcattct

SEQ ID NO: 2419413 - DNA, 20 bp, Homo sapiens
tctcctccatgggagaaaat

SEQ ID NO: 2419414 - DNA, 18 bp, Homo sapiens
tctcctgccttcctcctg

SEQ ID NO: 2419415 - DNA, 16 bp, Homo sapiens
tctcctgccttgaaaa

SEQ ID NO: 2419416 - DNA, 22 bp, Homo sapiens
tctcctggcttcccatccccag

SEQ ID NO: 2419417 - DNA, 21 bp, Homo sapiens
tctccttcatgacagcctcca

SEQ ID NO: 2419418 - DNA, 22 bp, Homo sapiens
tctcctttaattgtaaagtaaa

SEQ ID NO: 2419419 - DNA, 16 bp, Homo sapiens
tctcgagcgccctgca

SEQ ID NO: 2419420 - DNA, 22 bp, Homo sapiens
tctcgagcgccctgcagaccct

SEQ ID NO: 2419421 - DNA, 13 bp, Homo sapiens
tctcgatctcctg

SEQ ID NO: 2419422 - DNA, 14 bp, Homo sapiens
tctcgatgcaatga

SEQ ID NO: 2419423 - DNA, 16 bp, Homo sapiens
tctcgcataggacctt

SEQ ID NO: 2419424 - DNA, 19 bp, Homo sapiens
tctcgtcctcgtttgtgtt

SEQ ID NO: 2419425 - DNA, 21 bp, Homo sapiens
tctcgtcctcgtttgtgttct

SEQ ID NO: 2419426 - DNA, 14 bp, Homo sapiens
tctcgtctctttta

SEQ ID NO: 2419427 - DNA, 18 bp, Homo sapiens
tctctacagtctcgtctc

SEQ ID NO: 2419428 - DNA, 14 bp, Homo sapiens
tctctaccttctcc

SEQ ID NO: 2419429 - DNA, 23 bp, Homo sapiens
tctctaccttctccccagctccc

SEQ ID NO: 2419430 - DNA, 22 bp, Homo sapiens
tctctaggaccatggttaagag

SEQ ID NO: 2419431 - DNA, 17 bp, Homo sapiens
tctctagttccacgcct

SEQ ID NO: 2419432 - DNA, 18 bp, Homo sapiens
tctctatcctctcttcct

SEQ ID NO: 2419433 - DNA, 13 bp, Homo sapiens
tctctcaacacca

SEQ ID NO: 2419434 - DNA, 16 bp, Homo sapiens
tctctcattgtctgtg

SEQ ID NO: 2419435 - DNA, 16 bp, Homo sapiens
tctctccactttcagc

SEQ ID NO: 2419436 - DNA, 23 bp, Homo sapiens
tctctcggctccccatgtgtcct

SEQ ID NO: 2419437 - DNA, 12 bp, Homo sapiens
tctctctgccca

SEQ ID NO: 2419438 - DNA, 14 bp, Homo sapiens
tctctctgcccaac

SEQ ID NO: 2419439 - DNA, 17 bp, Homo sapiens
tctctctttatacagct

SEQ ID NO: 2419440 - DNA, 20 bp, Homo sapiens
tctctctttgcatggatttc

SEQ ID NO: 2419441 - DNA, 16 bp, Homo sapiens
tctctgacttctgcct

SEQ ID NO: 2419442 - DNA, 17 bp, Homo sapiens
tctctgacttctgcctg

SEQ ID NO: 2419443 - DNA, 18 bp, Homo sapiens
tctctgacttctgcctgg

SEQ ID NO: 2419444 - DNA, 15 bp, Homo sapiens
tctctgatgcagctt

SEQ ID NO: 2419445 - DNA, 16 bp, Homo sapiens
tctctgatgcagctta

SEQ ID NO: 2419446 - DNA, 22 bp, Homo sapiens
tctctgcccttgatcagcccca

SEQ ID NO: 2419447 - DNA, 18 bp, Homo sapiens
tctctgctctgcgtgtca

SEQ ID NO: 2419448 - DNA, 21 bp, Homo sapiens
tctctgctctgcgtgtcacct

SEQ ID NO: 2419449 - DNA, 23 bp, Homo sapiens
tctctgctctgcgtgtcacctgt

SEQ ID NO: 2419450 - DNA, 23 bp, Homo sapiens
tctctggctgtaaggctctagat

SEQ ID NO: 2419451 - DNA, 12 bp, Homo sapiens
tctctgggctgg

SEQ ID NO: 2419452 - DNA, 18 bp, Homo sapiens
tctctgggggctgaggag

SEQ ID NO: 2419453 - DNA, 17 bp, Homo sapiens
tctctggtaatattgac

SEQ ID NO: 2419454 - DNA, 12 bp, Homo sapiens
tctctgtctcat

SEQ ID NO: 2419455 - DNA, 15 bp, Homo sapiens
tctctgtctcatcca

SEQ ID NO: 2419456 - DNA, 23 bp, Homo sapiens
tctctgtctcatccatcatcatg

SEQ ID NO: 2419457 - DNA, 12 bp, Homo sapiens
tctctgtgcctt

SEQ ID NO: 2419458 - DNA, 15 bp, Homo sapiens
tctctgtgtctaaga

SEQ ID NO: 2419459 - DNA, 16 bp, Homo sapiens
tctctgtgtctaagat

SEQ ID NO: 2419460 - DNA, 22 bp, Homo sapiens
tctcttattgcctcacttcagg

SEQ ID NO: 2419461 - DNA, 16 bp, Homo sapiens
tctcttctctccagct

SEQ ID NO: 2419462 - DNA, 13 bp, Homo sapiens
tctcttgcctgcc

SEQ ID NO: 2419463 - DNA, 16 bp, Homo sapiens
tctctttatacagctg

SEQ ID NO: 2419464 - DNA, 17 bp, Homo sapiens
tctctttatacagctgt

SEQ ID NO: 2419465 - DNA, 16 bp, Homo sapiens
tctctttccctggtcc

SEQ ID NO: 2419466 - DNA, 17 bp, Homo sapiens
tctctttccctggtccc

SEQ ID NO: 2419467 - DNA, 12 bp, Homo sapiens
tctctttctgtc

SEQ ID NO: 2419468 - DNA, 15 bp, Homo sapiens
tctcttttgctttct

SEQ ID NO: 2419469 - DNA, 19 bp, Homo sapiens
tctgaaaagtgaagacaga

SEQ ID NO: 2419470 - DNA, 14 bp, Homo sapiens
tctgaaaatataac

SEQ ID NO: 2419471 - DNA, 15 bp, Homo sapiens
tctgaaatttttctt

SEQ ID NO: 2419472 - DNA, 15 bp, Homo sapiens
tctgaacacgaagct

SEQ ID NO: 2419473 - DNA, 14 bp, Homo sapiens
tctgaacagctggt

SEQ ID NO: 2419474 - DNA, 21 bp, Homo sapiens
tctgaacagctggtgtagcta

SEQ ID NO: 2419475 - DNA, 19 bp, Homo sapiens
tctgaacttgcattgtgat

SEQ ID NO: 2419476 - DNA, 16 bp, Homo sapiens
tctgaagccctcccag

SEQ ID NO: 2419477 - DNA, 13 bp, Homo sapiens
tgaggggaccagg

SEQ ID NO: 2419478 - DNA, 22 bp, Homo sapiens
tgaggggaccaggagtgggtgg

SEQ ID NO: 2419479 - DNA, 15 bp, Homo sapiens
tgaggggttcctccc

SEQ ID NO: 2419480 - DNA, 17 bp, Homo sapiens
tgaggggttcctcccct

SEQ ID NO: 2419481 - DNA, 15 bp, Homo sapiens
tgagggtctgtaggt

SEQ ID NO: 2419482 - DNA, 22 bp, Homo sapiens
tgaggtcagcacatctcaacag

SEQ ID NO: 2419483 - DNA, 13 bp, Homo sapiens
tgaggtcctgagc

SEQ ID NO: 2419484 - DNA, 15 bp, Homo sapiens
tgaggtcctgagcac

SEQ ID NO: 2419485 - DNA, 16 bp, Homo sapiens
tgaggtcctgagcact

SEQ ID NO: 2419486 - DNA, 21 bp, Homo sapiens
tgaggtcctgagcactgccag

SEQ ID NO: 2419487 - DNA, 13 bp, Homo sapiens
tgaggtctcagcc

SEQ ID NO: 2419488 - DNA, 16 bp, Homo sapiens
tgaggtctcagcccct

SEQ ID NO: 2419489 - DNA, 17 bp, Homo sapiens
tgaggtctcagcccctt

SEQ ID NO: 2419490 - DNA, 19 bp, Homo sapiens
tgaggtgcactgggaggct

SEQ ID NO: 2419491 - DNA, 17 bp, Homo sapiens
tgaggtgcccaggagaa

SEQ ID NO: 2419492 - DNA, 14 bp, Homo sapiens
tgaggtgcctgtcc

SEQ ID NO: 2419493 - DNA, 14 bp, Homo sapiens
tgaggttactggaa

SEQ ID NO: 2419494 - DNA, 22 bp, Homo sapiens
tgaggttttatttcatttttca

SEQ ID NO: 2419495 - DNA, 16 bp, Homo sapiens
tgagtaacatttgctg

SEQ ID NO: 2419496 - DNA, 18 bp, Homo sapiens
tgagtaacatttgctgtt

SEQ ID NO: 2419497 - DNA, 15 bp, Homo sapiens
tgatttaatttgaaa

SEQ ID NO: 2419498 - DNA, 20 bp, Homo sapiens
tgatttaggagaagccagga

SEQ ID NO: 2419499 - DNA, 15 bp, Homo sapiens
tgatttcagttctag

SEQ ID NO: 2419500 - DNA, 21 bp, Homo sapiens
tgatttcagttctaggaaaat

SEQ ID NO: 2419501 - DNA, 13 bp, Homo sapiens
tgatttccttgaa

SEQ ID NO: 2419502 - DNA, 16 bp, Homo sapiens
tgatttccttgaatgt

SEQ ID NO: 2419503 - DNA, 12 bp, Homo sapiens
tgatttgcattg

SEQ ID NO: 2419504 - DNA, 22 bp, Homo sapiens
tgattttaggagctaaggctct

SEQ ID NO: 2419505 - DNA, 14 bp, Homo sapiens
tgatttttctttac

SEQ ID NO: 2419506 - DNA, 20 bp, Homo sapiens
tgatttttttttttttttcc

SEQ ID NO: 2419507 - DNA, 19 bp, Homo sapiens
tgcaaaaactacaaccaat

SEQ ID NO: 2419508 - DNA, 20 bp, Homo sapiens
tgcaaactctttggtcgttt

SEQ ID NO: 2419509 - DNA, 23 bp, Homo sapiens
tgcaaagatctgtcctcagcctt

SEQ ID NO: 2419510 - DNA, 13 bp, Homo sapiens
tgcaaataaatat

SEQ ID NO: 2419511 - DNA, 17 bp, Homo sapiens
tgcaaataacaaatgcc

SEQ ID NO: 2419512 - DNA, 23 bp, Homo sapiens
tgcaaatactgtatattcaggac

SEQ ID NO: 2419513 - DNA, 20 bp, Homo sapiens
tgcaaatcaggcttttgttt

SEQ ID NO: 2419514 - DNA, 22 bp, Homo sapiens
tgcaacactggtctgctgttcc

SEQ ID NO: 2419515 - DNA, 16 bp, Homo sapiens
tgcaacagacttgaat

SEQ ID NO: 2419516 - DNA, 12 bp, Homo sapiens
tgcaaccaggaa

SEQ ID NO: 2419517 - DNA, 19 bp, Homo sapiens
tgcaacctccacctcctgg

SEQ ID NO: 2419518 - DNA, 14 bp, Homo sapiens
tgcaacctcgctgg

SEQ ID NO: 2419519 - DNA, 20 bp, Homo sapiens
tgcaacctcgctggactctc

SEQ ID NO: 2419520 - DNA, 17 bp, Homo sapiens
tgcaactcaaggacttt

SEQ ID NO: 2419521 - DNA, 23 bp, Homo sapiens
tgccttattagagtgtctttcca

SEQ ID NO: 2419522 - DNA, 17 bp, Homo sapiens
tgccttattcagggaag

SEQ ID NO: 2419523 - DNA, 15 bp, Homo sapiens
tgccttccagaaaac

SEQ ID NO: 2419524 - DNA, 13 bp, Homo sapiens
tgccttcgcttct

SEQ ID NO: 2419525 - DNA, 22 bp, Homo sapiens
tgccttcgcttcttgcctctgt

SEQ ID NO: 2419526 - DNA, 16 bp, Homo sapiens
tgccttctacttttaa

SEQ ID NO: 2419527 - DNA, 17 bp, Homo sapiens
tgccttggcctcccaag

SEQ ID NO: 2419528 - DNA, 23 bp, Homo sapiens
tgccttggtttttactgctctga

SEQ ID NO: 2419529 - DNA, 17 bp, Homo sapiens
tgcctttcaggatctat

SEQ ID NO: 2419530 - DNA, 21 bp, Homo sapiens
tgcctttccatccatggccag

SEQ ID NO: 2419531 - DNA, 15 bp, Homo sapiens
tgcgactttctgcct

SEQ ID NO: 2419532 - DNA, 12 bp, Homo sapiens
tgcgagagatgt

SEQ ID NO: 2419533 - DNA, 17 bp, Homo sapiens
tgcgccaccgcccagag

SEQ ID NO: 2419534 - DNA, 23 bp, Homo sapiens
tgcgccccctccgccctgccact

SEQ ID NO: 2419535 - DNA, 14 bp, Homo sapiens
tgcgctcagggcca

SEQ ID NO: 2419536 - DNA, 20 bp, Homo sapiens
tgcgctcctggcccagcctt

SEQ ID NO: 2419537 - DNA, 13 bp, Homo sapiens
tgcggatggccgg

SEQ ID NO: 2419538 - DNA, 12 bp, Homo sapiens
tgcggctgtgtg

SEQ ID NO: 2419539 - DNA, 15 bp, Homo sapiens
tgcggggtgggggca

SEQ ID NO: 2419540 - DNA, 18 bp, Homo sapiens
tgcgggtgaacaaagcag

SEQ ID NO: 2419541 - DNA, 23 bp, Homo sapiens
tgcgggtgaacaaagcagccacg

SEQ ID NO: 2419542 - DNA, 23 bp, Homo sapiens
tgcgggtggggcttggggctcac

SEQ ID NO: 2419543 - DNA, 16 bp, Homo sapiens
tgcggtagccagcaca

SEQ ID NO: 2419544 - DNA, 18 bp, Homo sapiens
tgcggtagccagcacaca

SEQ ID NO: 2419545 - DNA, 16 bp, Homo sapiens
tgcggttaattttgaa

SEQ ID NO: 2419546 - DNA, 23 bp, Homo sapiens
tgcggttcaggaaaattgaatgc

SEQ ID NO: 2419547 - DNA, 14 bp, Homo sapiens
tgcgtgacaataaa

SEQ ID NO: 2419548 - DNA, 17 bp, Homo sapiens
tgcgtgacaataaaaca

SEQ ID NO: 2419549 - DNA, 20 bp, Homo sapiens
tgcgtggaatgcccttcact

SEQ ID NO: 2419550 - DNA, 19 bp, Homo sapiens
tgcgtggtggtccctgggt

SEQ ID NO: 2419551 - DNA, 21 bp, Homo sapiens
tgctaaataaaatttgttgca

SEQ ID NO: 2419552 - DNA, 19 bp, Homo sapiens
tgctaacggtgctcagggg

SEQ ID NO: 2419553 - DNA, 16 bp, Homo sapiens
tgctaagagaagtaga

SEQ ID NO: 2419554 - DNA, 22 bp, Homo sapiens
tgctacacctattatcccagct

SEQ ID NO: 2419555 - DNA, 18 bp, Homo sapiens
tgctacagggtccaacat

SEQ ID NO: 2419556 - DNA, 22 bp, Homo sapiens
tgctgcatggcagggggctgct

SEQ ID NO: 2419557 - DNA, 19 bp, Homo sapiens
tgctgccagcttcaggtga

SEQ ID NO: 2419558 - DNA, 18 bp, Homo sapiens
tgctgccttattcaggga

SEQ ID NO: 2419559 - DNA, 19 bp, Homo sapiens
tgctgccttattcagggaa

SEQ ID NO: 2419560 - DNA, 19 bp, Homo sapiens
tgctgctaatattttcctc

SEQ ID NO: 2419561 - DNA, 15 bp, Homo sapiens
tgctgctacttatat

SEQ ID NO: 2419562 - DNA, 15 bp, Homo sapiens
tgctgctccctcaga

SEQ ID NO: 2419563 - DNA, 18 bp, Homo sapiens
tgctgctcttggctggac

SEQ ID NO: 2419564 - DNA, 21 bp, Homo sapiens
tgctgctcttggctggaccca

SEQ ID NO: 2419565 - DNA, 15 bp, Homo sapiens
tgctgctgagaacct

SEQ ID NO: 2419566 - DNA, 22 bp, Homo sapiens
tgctgctgagaacctggccttc

SEQ ID NO: 2419567 - DNA, 14 bp, Homo sapiens
tgctgctgggctca

SEQ ID NO: 2419568 - DNA, 16 bp, Homo sapiens
tgctggaattctaaca

SEQ ID NO: 2419569 - DNA, 20 bp, Homo sapiens
tgctggagaggccccagccg

SEQ ID NO: 2419570 - DNA, 13 bp, Homo sapiens
tgctggcccaggg

SEQ ID NO: 2419571 - DNA, 20 bp, Homo sapiens
tgctggcccagggcccagag

SEQ ID NO: 2419572 - DNA, 22 bp, Homo sapiens
tgctggcccagggcccagagcc

SEQ ID NO: 2419573 - DNA, 13 bp, Homo sapiens
tgctggcctctgc

SEQ ID NO: 2419574 - DNA, 16 bp, Homo sapiens
tgctggcctctgcgag

SEQ ID NO: 2419575 - DNA, 22 bp, Homo sapiens
tgctgggactcagccttcagac

SEQ ID NO: 2419576 - DNA, 16 bp, Homo sapiens
tgctgggagctccact

SEQ ID NO: 2419577 - DNA, 17 bp, Homo sapiens
tgctgggagctccactc

SEQ ID NO: 2419578 - DNA, 18 bp, Homo sapiens
tgctgggagctccactct

SEQ ID NO: 2419579 - DNA, 23 bp, Homo sapiens
tgctgggagctccactctgcttc

SEQ ID NO: 2419580 - DNA, 14 bp, Homo sapiens
tgctgggctcagtg

SEQ ID NO: 2419581 - DNA, 15 bp, Homo sapiens
tgctgggctcagtga

SEQ ID NO: 2419582 - DNA, 17 bp, Homo sapiens
tgctggggcctgggaca

SEQ ID NO: 2419583 - DNA, 21 bp, Homo sapiens
tgctgtacatctattttggat

SEQ ID NO: 2419584 - DNA, 19 bp, Homo sapiens
tgctgtctgggtggctcac

SEQ ID NO: 2419585 - DNA, 13 bp, Homo sapiens
tgctgtgaggctg

SEQ ID NO: 2419586 - DNA, 14 bp, Homo sapiens
tgctgtgaggctgt

SEQ ID NO: 2419587 - DNA, 16 bp, Homo sapiens
tgctgtgaggctgtcc

SEQ ID NO: 2419588 - DNA, 18 bp, Homo sapiens
tgctgtgaggctgtcctg

SEQ ID NO: 2419589 - DNA, 23 bp, Homo sapiens
tgctgtgagtctttggttctaag

SEQ ID NO: 2419590 - DNA, 20 bp, Homo sapiens
tgctgtgatacgatgcttca

SEQ ID NO: 2419591 - DNA, 16 bp, Homo sapiens
tgctgtgcgcccaggg

SEQ ID NO: 2419592 - DNA, 18 bp, Homo sapiens
tgctgtgctgtgctatgg

SEQ ID NO: 2419593 - DNA, 15 bp, Homo sapiens
tgctgtggccaggag

SEQ ID NO: 2419594 - DNA, 16 bp, Homo sapiens
tgctgtggccaggagg

SEQ ID NO: 2419595 - DNA, 15 bp, Homo sapiens
tgctgtggtgtgtcc

SEQ ID NO: 2419596 - DNA, 17 bp, Homo sapiens
tgctgtggtgtgtcccc

SEQ ID NO: 2419597 - DNA, 12 bp, Homo sapiens
tgctgtgtaaaa

SEQ ID NO: 2419598 - DNA, 22 bp, Homo sapiens
tgctgttctcttgggaactgaa

SEQ ID NO: 2419599 - DNA, 17 bp, Homo sapiens
tgctgtttattaatctt

SEQ ID NO: 2419600 - DNA, 17 bp, Homo sapiens
tgctgtttgacacctct

SEQ ID NO: 2419601 - DNA, 12 bp, Homo sapiens
tgctgttttgtt

SEQ ID NO: 2419602 - DNA, 18 bp, Homo sapiens
tgctgttttgttatataa

SEQ ID NO: 2419603 - DNA, 14 bp, Homo sapiens
tgcttaaaataagc

SEQ ID NO: 2419604 - DNA, 15 bp, Homo sapiens
tgcttaaaataagca

SEQ ID NO: 2419605 - DNA, 17 bp, Homo sapiens
tgcttaaaataagcagg

SEQ ID NO: 2419606 - DNA, 19 bp, Homo sapiens
tgcttaaaataagcaggtg

SEQ ID NO: 2419607 - DNA, 22 bp, Homo sapiens
tgcttacctctcagccttagct

SEQ ID NO: 2419608 - DNA, 14 bp, Homo sapiens
tgcttatggtacca

SEQ ID NO: 2419609 - DNA, 21 bp, Homo sapiens
tgcttattccatgactgcttg

SEQ ID NO: 2419610 - DNA, 14 bp, Homo sapiens
tgcttcaactgtct

SEQ ID NO: 2419611 - DNA, 23 bp, Homo sapiens
tgcttcaagagaaaatgcggtta

SEQ ID NO: 2419612 - DNA, 15 bp, Homo sapiens
tgcttcatgtgtccc

SEQ ID NO: 2419613 - DNA, 21 bp, Homo sapiens
tgcttcatgtgtcccagaaga

SEQ ID NO: 2419614 - DNA, 15 bp, Homo sapiens
tgcttccctaatcta

SEQ ID NO: 2419615 - DNA, 15 bp, Homo sapiens
tgcttcgggcccttc

SEQ ID NO: 2419616 - DNA, 20 bp, Homo sapiens
tgcttctaagtaaatacaat

SEQ ID NO: 2419617 - DNA, 22 bp, Homo sapiens
tgcttctaagtaaatacaattt

SEQ ID NO: 2419618 - DNA, 20 bp, Homo sapiens
tgcttctctgacttctgcct

SEQ ID NO: 2419619 - DNA, 15 bp, Homo sapiens
tgcttggagctgagc

SEQ ID NO: 2419620 - DNA, 17 bp, Homo sapiens
tgcttggagctgagcaa

SEQ ID NO: 2419621 - DNA, 20 bp, Homo sapiens
tgcttggggggtgatgaggg

SEQ ID NO: 2419622 - DNA, 19 bp, Homo sapiens
tgcttgttccctctccctg

SEQ ID NO: 2419623 - DNA, 13 bp, Homo sapiens
tgctttaatataa

SEQ ID NO: 2419624 - DNA, 20 bp, Homo sapiens
tgctttaatataaatgcaaa

SEQ ID NO: 2419625 - DNA, 21 bp, Homo sapiens
tgctttaatataaatgcaaat

SEQ ID NO: 2419626 - DNA, 15 bp, Homo sapiens
tgctttattccagaa

SEQ ID NO: 2419627 - DNA, 21 bp, Homo sapiens
tgctttccattcgtgaaaaca

SEQ ID NO: 2419628 - DNA, 18 bp, Homo sapiens
tgctttcgaactgctagt

SEQ ID NO: 2419629 - DNA, 22 bp, Homo sapiens
tgctttctcctttaattgtaaa

SEQ ID NO: 2419630 - DNA, 14 bp, Homo sapiens
tgctttctgatcaa

SEQ ID NO: 2419631 - DNA, 15 bp, Homo sapiens
tgctttctgttccaa

SEQ ID NO: 2419632 - DNA, 17 bp, Homo sapiens
tgctttctgttccaaat

SEQ ID NO: 2419633 - DNA, 16 bp, Homo sapiens
tgctttctgtttctta

SEQ ID NO: 2419634 - DNA, 16 bp, Homo sapiens
tgctttgaaacagaaa

SEQ ID NO: 2419635 - DNA, 21 bp, Homo sapiens
tgctttggacctaaatggcct

SEQ ID NO: 2419636 - DNA, 23 bp, Homo sapiens
tgctttggacctaaatggcctca

SEQ ID NO: 2419637 - DNA, 17 bp, Homo sapiens
tgctttgggcttgggcc

SEQ ID NO: 2419638 - DNA, 16 bp, Homo sapiens
tgcttttcatgcaaac

SEQ ID NO: 2419639 - DNA, 18 bp, Homo sapiens
tgcttttccctttgtgag

SEQ ID NO: 2419640 - DNA, 12 bp, Homo sapiens
tgcttttgccca

SEQ ID NO: 2419641 - DNA, 14 bp, Homo sapiens
tgcttttgcccatt

SEQ ID NO: 2419642 - DNA, 16 bp, Homo sapiens
tgctttttgtgttttt

SEQ ID NO: 2419643 - DNA, 17 bp, Homo sapiens
tgcttttttgttttggc

SEQ ID NO: 2419644 - DNA, 16 bp, Homo sapiens
tggaaaacagaacact

SEQ ID NO: 2419645 - DNA, 18 bp, Homo sapiens
tggaaaacagaacactta

SEQ ID NO: 2419646 - DNA, 20 bp, Homo sapiens
tggaaaacagaacacttatg

SEQ ID NO: 2419647 - DNA, 15 bp, Homo sapiens
tggaaaattcatttt

SEQ ID NO: 2419648 - DNA, 14 bp, Homo sapiens
tggaaacttttctt

SEQ ID NO: 2419649 - DNA, 23 bp, Homo sapiens
tggaaagataactaggaaatcca

SEQ ID NO: 2419650 - DNA, 14 bp, Homo sapiens
tggaaataaagtca

SEQ ID NO: 2419651 - DNA, 16 bp, Homo sapiens
tggaaataaagtcaga

SEQ ID NO: 2419652 - DNA, 13 bp, Homo sapiens
tggaaatatatat

SEQ ID NO: 2419653 - DNA, 17 bp, Homo sapiens
tggaaatatatattata

SEQ ID NO: 2419654 - DNA, 21 bp, Homo sapiens
tggaaatttaaagcaggttct

SEQ ID NO: 2419655 - DNA, 18 bp, Homo sapiens
tggaaatttagcattgta

SEQ ID NO: 2419656 - DNA, 14 bp, Homo sapiens
tggaacaccaggct

SEQ ID NO: 2419657 - DNA, 15 bp, Homo sapiens
tggaacaccaggctg

SEQ ID NO: 2419658 - DNA, 15 bp, Homo sapiens
tggaacacggccaca

SEQ ID NO: 2419659 - DNA, 21 bp, Homo sapiens
tggaacactagacaagccaga

SEQ ID NO: 2419660 - DNA, 17 bp, Homo sapiens
tggaacattggaatgtt

SEQ ID NO: 2419661 - DNA, 12 bp, Homo sapiens
tggaaccagact

SEQ ID NO: 2419662 - DNA, 19 bp, Homo sapiens
tggaaccagactcttgcct

SEQ ID NO: 2419663 - DNA, 14 bp, Homo sapiens
tggaacccagactc

SEQ ID NO: 2419664 - DNA, 17 bp, Homo sapiens
tggaacccagactcaga

SEQ ID NO: 2419665 - DNA, 15 bp, Homo sapiens
tggaacctcagcctg

SEQ ID NO: 2419666 - DNA, 17 bp, Homo sapiens
tggaacctcagcctggc

SEQ ID NO: 2419667 - DNA, 13 bp, Homo sapiens
tggaactgaaggg

SEQ ID NO: 2419668 - DNA, 16 bp, Homo sapiens
tggaactgaagggggc

SEQ ID NO: 2419669 - DNA, 20 bp, Homo sapiens
tggaactgaagggggcggcc

SEQ ID NO: 2419670 - DNA, 21 bp, Homo sapiens
tggaactgaagggggcggcct

SEQ ID NO: 2419671 - DNA, 17 bp, Homo sapiens
tggaactgctgccactg

SEQ ID NO: 2419672 - DNA, 16 bp, Homo sapiens
tggaactggaggcagg

SEQ ID NO: 2419673 - DNA, 18 bp, Homo sapiens
tggaacttgcctgccttt

SEQ ID NO: 2419674 - DNA, 22 bp, Homo sapiens
tggaacttgcctgcctttccat

SEQ ID NO: 2419675 - DNA, 20 bp, Homo sapiens
tggaagagcagcacctcctc

SEQ ID NO: 2419676 - DNA, 16 bp, Homo sapiens
tggaagctaatttgca

SEQ ID NO: 2419677 - DNA, 23 bp, Homo sapiens
tggaagctagacacatgaaggta

SEQ ID NO: 2419678 - DNA, 13 bp, Homo sapiens
tggaaggagcaga

SEQ ID NO: 2419679 - DNA, 14 bp, Homo sapiens
tggaaggagcagaa

SEQ ID NO: 2419680 - DNA, 19 bp, Homo sapiens
tggaagtgaaaactttgta

SEQ ID NO: 2419681 - DNA, 19 bp, Homo sapiens
tggaagtttagctctgaga

SEQ ID NO: 2419682 - DNA, 20 bp, Homo sapiens
tggaagtttagctctgagaa

SEQ ID NO: 2419683 - DNA, 12 bp, Homo sapiens
tggaatactttt

SEQ ID NO: 2419684 - DNA, 23 bp, Homo sapiens
tggaatcaggaatattttccaaa

SEQ ID NO: 2419685 - DNA, 13 bp, Homo sapiens
tggaatcctttca

SEQ ID NO: 2419686 - DNA, 14 bp, Homo sapiens
tggaatgtaatcaa

SEQ ID NO: 2419687 - DNA, 18 bp, Homo sapiens
tggaattgatttgcattg

SEQ ID NO: 2419688 - DNA, 22 bp, Homo sapiens
tggaattgatttgcattgaaca

SEQ ID NO: 2419689 - DNA, 16 bp, Homo sapiens
tggaatttgcctgctg

SEQ ID NO: 2419690 - DNA, 15 bp, Homo sapiens
tggaattttgcaaag

SEQ ID NO: 2419691 - DNA, 20 bp, Homo sapiens
tggacacacacagactattt

SEQ ID NO: 2419692 - DNA, 15 bp, Homo sapiens
tggacagctgtgcct

SEQ ID NO: 2419693 - DNA, 16 bp, Homo sapiens
tggacagctgtgcctc

SEQ ID NO: 2419694 - DNA, 20 bp, Homo sapiens
tggaccatggagtggcagcc

SEQ ID NO: 2419695 - DNA, 17 bp, Homo sapiens
tggacccagccaggccc

SEQ ID NO: 2419696 - DNA, 18 bp, Homo sapiens
tggacccagccaggccca

SEQ ID NO: 2419697 - DNA, 13 bp, Homo sapiens
tggacccctgcat

SEQ ID NO: 2419698 - DNA, 13 bp, Homo sapiens
tggaccctgacca

SEQ ID NO: 2419699 - DNA, 20 bp, Homo sapiens
tggaccctgaccagctcccc

SEQ ID NO: 2419700 - DNA, 23 bp, Homo sapiens
tggaccctgaccagctccccctc

SEQ ID NO: 2419701 - DNA, 15 bp, Homo sapiens
tggaccggagagtgg

SEQ ID NO: 2419702 - DNA, 14 bp, Homo sapiens
tggacctctgacag

SEQ ID NO: 2419703 - DNA, 18 bp, Homo sapiens
tggacctctgacagcagc

SEQ ID NO: 2419704 - DNA, 15 bp, Homo sapiens
tggactctgtcctga

SEQ ID NO: 2419705 - DNA, 17 bp, Homo sapiens
tggactctgtcctgaag

SEQ ID NO: 2419706 - DNA, 23 bp, Homo sapiens
tggactctgtcctgaaggcctga

SEQ ID NO: 2419707 - DNA, 14 bp, Homo sapiens
tggactggaagggg

SEQ ID NO: 2419708 - DNA, 19 bp, Homo sapiens
tggacttaagcatctggct

SEQ ID NO: 2419709 - DNA, 14 bp, Homo sapiens
tggactttcctgca

SEQ ID NO: 2419710 - DNA, 19 bp, Homo sapiens
tggactttcctgcaactca

SEQ ID NO: 2419711 - DNA, 16 bp, Homo sapiens
tggagaagtctcagct

SEQ ID NO: 2419712 - DNA, 17 bp, Homo sapiens
tggagaccaccagggca

SEQ ID NO: 2419713 - DNA, 20 bp, Homo sapiens
tggagactgtctggcccccc

SEQ ID NO: 2419714 - DNA, 21 bp, Homo sapiens
tggagactgtctggcccccct

SEQ ID NO: 2419715 - DNA, 21 bp, Homo sapiens
tggagacttagggcaccaggg

SEQ ID NO: 2419716 - DNA, 15 bp, Homo sapiens
tggagagccctggga

SEQ ID NO: 2419717 - DNA, 16 bp, Homo sapiens
tggagagtttcctgaa

SEQ ID NO: 2419718 - DNA, 17 bp, Homo sapiens
tggagagtttcctgaaa

SEQ ID NO: 2419719 - DNA, 14 bp, Homo sapiens
tggagcagaagcag

SEQ ID NO: 2419720 - DNA, 15 bp, Homo sapiens
tggagcagaagcagc

SEQ ID NO: 2419721 - DNA, 17 bp, Homo sapiens
tggagcagaccaccccg

SEQ ID NO: 2419722 - DNA, 13 bp, Homo sapiens
tggagcagagggg

SEQ ID NO: 2419723 - DNA, 21 bp, Homo sapiens
tggagcatttctcatcagtag

SEQ ID NO: 2419724 - DNA, 17 bp, Homo sapiens
tggagccgaggcctacc

SEQ ID NO: 2419725 - DNA, 12 bp, Homo sapiens
tggagctgagca

SEQ ID NO: 2419726 - DNA, 21 bp, Homo sapiens
tggagcttcatggcagaaggc

SEQ ID NO: 2419727 - DNA, 14 bp, Homo sapiens
tggaggagcccagg

SEQ ID NO: 2419728 - DNA, 22 bp, Homo sapiens
tggaggagcccaggccaggact

SEQ ID NO: 2419729 - DNA, 21 bp, Homo sapiens
tggaggaggagggaggcgctg

SEQ ID NO: 2419730 - DNA, 18 bp, Homo sapiens
tggaggcaggggcttcct

SEQ ID NO: 2419731 - DNA, 19 bp, Homo sapiens
tggaggcaggggcttcctg

SEQ ID NO: 2419732 - DNA, 20 bp, Homo sapiens
tggaggcaggggcttcctgg

SEQ ID NO: 2419733 - DNA, 14 bp, Homo sapiens
tggaggcccaggct

SEQ ID NO: 2419734 - DNA, 18 bp, Homo sapiens
tggaggcccaggctggga

SEQ ID NO: 2419735 - DNA, 22 bp, Homo sapiens
tggagggacaagtggactcagg

SEQ ID NO: 2419736 - DNA, 21 bp, Homo sapiens
tggaggggtaggggctgggaa

SEQ ID NO: 2419737 - DNA, 22 bp, Homo sapiens
tggaggggtaggggctgggaac

SEQ ID NO: 2419738 - DNA, 14 bp, Homo sapiens
tggaggggtgtggc

SEQ ID NO: 2419739 - DNA, 16 bp, Homo sapiens
tggaggttaaggcata

SEQ ID NO: 2419740 - DNA, 15 bp, Homo sapiens
tggagtacttagcta

SEQ ID NO: 2419741 - DNA, 14 bp, Homo sapiens
tggagtcccctcac

SEQ ID NO: 2419742 - DNA, 20 bp, Homo sapiens
tggagtcccctcacctcctc

SEQ ID NO: 2419743 - DNA, 21 bp, Homo sapiens
tggagtcccctcacctcctct

SEQ ID NO: 2419744 - DNA, 18 bp, Homo sapiens
tggagtctgccacccagg

SEQ ID NO: 2419745 - DNA, 18 bp, Homo sapiens
tggagtggcagcccagcc

SEQ ID NO: 2419746 - DNA, 22 bp, Homo sapiens
tggagtgttccccttccactga

SEQ ID NO: 2419747 - DNA, 13 bp, Homo sapiens
tggagtttctaag

SEQ ID NO: 2419748 - DNA, 20 bp, Homo sapiens
tggagttttgtttcctctgt

SEQ ID NO: 2419749 - DNA, 11 bp, Homo sapiens
tggatatttgt

SEQ ID NO: 2419750 - DNA, 17 bp, Homo sapiens
tggatcactcaccattc

SEQ ID NO: 2419751 - DNA, 18 bp, Homo sapiens
tggatcagcgtggccttg

SEQ ID NO: 2419752 - DNA, 22 bp, Homo sapiens
tggatctccctgagatgggctt

SEQ ID NO: 2419753 - DNA, 15 bp, Homo sapiens
tggatggccccagca

SEQ ID NO: 2419754 - DNA, 13 bp, Homo sapiens
tggatggggcagg

SEQ ID NO: 2419755 - DNA, 21 bp, Homo sapiens
tggatgggggaactcagatcc

SEQ ID NO: 2419756 - DNA, 14 bp, Homo sapiens
tggatgtccccagc

SEQ ID NO: 2419757 - DNA, 16 bp, Homo sapiens
tggatgtccccagcag

SEQ ID NO: 2419758 - DNA, 22 bp, Homo sapiens
tggattccccatctcaggccag

SEQ ID NO: 2419759 - DNA, 13 bp, Homo sapiens
tggattctaaaat

SEQ ID NO: 2419760 - DNA, 15 bp, Homo sapiens
tggattctaaaatgc

SEQ ID NO: 2419761 - DNA, 16 bp, Homo sapiens
tggatttaaaagcctg

SEQ ID NO: 2419762 - DNA, 15 bp, Homo sapiens
tggatttctttgaaa

SEQ ID NO: 2419763 - DNA, 18 bp, Homo sapiens
tggatttctttgaaaaaa

SEQ ID NO: 2419764 - DNA, 15 bp, Homo sapiens
tggatttttctttaa

SEQ ID NO: 2419765 - DNA, 20 bp, Homo sapiens
tggcaaaactctacttaatc

SEQ ID NO: 2419766 - DNA, 17 bp, Homo sapiens
tggcaaaggaaggtgga

SEQ ID NO: 2419767 - DNA, 17 bp, Homo sapiens
tggcaacagatctggaa

SEQ ID NO: 2419768 - DNA, 22 bp, Homo sapiens
tggcaacagatctggaacctca

SEQ ID NO: 2419769 - DNA, 21 bp, Homo sapiens
tggcaatgccacagccctgtc

SEQ ID NO: 2419770 - DNA, 23 bp, Homo sapiens
tggcaatgccacagccctgtcag

SEQ ID NO: 2419771 - DNA, 14 bp, Homo sapiens
tggcaattttgtgg

SEQ ID NO: 2419772 - DNA, 21 bp, Homo sapiens
tggcacaggagtgtcctcttc

SEQ ID NO: 2419773 - DNA, 20 bp, Homo sapiens
tggcaccagacacccaggac

SEQ ID NO: 2419774 - DNA, 16 bp, Homo sapiens
tggcactttgaagggg

SEQ ID NO: 2419775 - DNA, 13 bp, Homo sapiens
tggcagagatgcc

SEQ ID NO: 2419776 - DNA, 11 bp, Homo sapiens
tggcagccaca

SEQ ID NO: 2419777 - DNA, 21 bp, Homo sapiens
tggcagccacacttctcagga

SEQ ID NO: 2419778 - DNA, 19 bp, Homo sapiens
tggcagcctcccatccagg

SEQ ID NO: 2419779 - DNA, 20 bp, Homo sapiens
tggcagcctcccatccaggg

SEQ ID NO: 2419780 - DNA, 11 bp, Homo sapiens
tggcagccttg

SEQ ID NO: 2419781 - DNA, 22 bp, Homo sapiens
tggcagctctggacagccccac

SEQ ID NO: 2419782 - DNA, 12 bp, Homo sapiens
tggcaggcagag

SEQ ID NO: 2419783 - DNA, 14 bp, Homo sapiens
tggcaggctggcca

SEQ ID NO: 2419784 - DNA, 17 bp, Homo sapiens
tggcagggggctgctgc

SEQ ID NO: 2419785 - DNA, 16 bp, Homo sapiens
tggcatagctctgggg

SEQ ID NO: 2419786 - DNA, 15 bp, Homo sapiens
tggcatccctgggcc

SEQ ID NO: 2419787 - DNA, 13 bp, Homo sapiens
tggcatgagaaat

SEQ ID NO: 2419788 - DNA, 18 bp, Homo sapiens
tggcatgagaaatacaaa

SEQ ID NO: 2419789 - DNA, 21 bp, Homo sapiens
tggcatgagaaatacaaaaat

SEQ ID NO: 2419790 - DNA, 20 bp, Homo sapiens
tggcatggaaatttaaagca

SEQ ID NO: 2419791 - DNA, 23 bp, Homo sapiens
tggcatggaaatttaaagcaggt

SEQ ID NO: 2419792 - DNA, 19 bp, Homo sapiens
tggccaagctgaggtgccc

SEQ ID NO: 2419793 - DNA, 22 bp, Homo sapiens
tggccaagctgaggtgcccagg

SEQ ID NO: 2419794 - DNA, 16 bp, Homo sapiens
tggccaaggaaaggca

SEQ ID NO: 2419795 - DNA, 14 bp, Homo sapiens
tggccaagttcctc

SEQ ID NO: 2419796 - DNA, 22 bp, Homo sapiens
tggccaatgcacctaaagaaaa

SEQ ID NO: 2419797 - DNA, 14 bp, Homo sapiens
tggccacagccagg

SEQ ID NO: 2419798 - DNA, 18 bp, Homo sapiens
tggccacagccaggggag

SEQ ID NO: 2419799 - DNA, 18 bp, Homo sapiens
tggccactccgagaggtg

SEQ ID NO: 2419800 - DNA, 23 bp, Homo sapiens
tggccactccgagaggtgggcca

SEQ ID NO: 2419801 - DNA, 12 bp, Homo sapiens
tggccagacaca

SEQ ID NO: 2419802 - DNA, 18 bp, Homo sapiens
tggccagacacaggccct

SEQ ID NO: 2419803 - DNA, 15 bp, Homo sapiens
tggccagcagcacct

SEQ ID NO: 2419804 - DNA, 16 bp, Homo sapiens
tggccagcagcacctg

SEQ ID NO: 2419805 - DNA, 18 bp, Homo sapiens
tggccagcagcacctgcc

SEQ ID NO: 2419806 - DNA, 16 bp, Homo sapiens
tggccagccccttaga

SEQ ID NO: 2419807 - DNA, 21 bp, Homo sapiens
tggccagccccttagacagag

SEQ ID NO: 2419808 - DNA, 13 bp, Homo sapiens
tggccaggaagct

SEQ ID NO: 2419809 - DNA, 12 bp, Homo sapiens
tggccaggaggt

SEQ ID NO: 2419810 - DNA, 16 bp, Homo sapiens
tggccaggaggtgcca

SEQ ID NO: 2419811 - DNA, 22 bp, Homo sapiens
tggccaggccgggaaaaagccc

SEQ ID NO: 2419812 - DNA, 14 bp, Homo sapiens
tggccagtccaggc

SEQ ID NO: 2419813 - DNA, 16 bp, Homo sapiens
tggccagtccaggctg

SEQ ID NO: 2419814 - DNA, 21 bp, Homo sapiens
tggccagtccaggctgccgtg

SEQ ID NO: 2419815 - DNA, 18 bp, Homo sapiens
tggccagtgtttaaaact

SEQ ID NO: 2419816 - DNA, 20 bp, Homo sapiens
tggccatatttacctcagcc

SEQ ID NO: 2419817 - DNA, 15 bp, Homo sapiens
tggccatgaccctgc

SEQ ID NO: 2419818 - DNA, 20 bp, Homo sapiens
tggccatgaccctgcctctc

SEQ ID NO: 2419819 - DNA, 21 bp, Homo sapiens
tggccatgaccctgcctctcc

SEQ ID NO: 2419820 - DNA, 17 bp, Homo sapiens
tggccatgctcctcttc

SEQ ID NO: 2419821 - DNA, 22 bp, Homo sapiens
tggccatgctcctcttccccag

SEQ ID NO: 2419822 - DNA, 16 bp, Homo sapiens
tggccatggagaaagc

SEQ ID NO: 2419823 - DNA, 14 bp, Homo sapiens
tggccatggcctgc

SEQ ID NO: 2419824 - DNA, 19 bp, Homo sapiens
tggcccaccccacccactt

SEQ ID NO: 2419825 - DNA, 23 bp, Homo sapiens
tggcccaccccacccacttctgc

SEQ ID NO: 2419826 - DNA, 12 bp, Homo sapiens
tggcccagcctt

SEQ ID NO: 2419827 - DNA, 16 bp, Homo sapiens
tggcccagggcccaga

SEQ ID NO: 2419828 - DNA, 20 bp, Homo sapiens
tggcccagggcccagagccc

SEQ ID NO: 2419829 - DNA, 12 bp, Homo sapiens
tggcccatcagg

SEQ ID NO: 2419830 - DNA, 22 bp, Homo sapiens
tggccccaccctgggccctggg

SEQ ID NO: 2419831 - DNA, 13 bp, Homo sapiens
tggccccagcaca

SEQ ID NO: 2419832 - DNA, 17 bp, Homo sapiens
tggccccagcacagctt

SEQ ID NO: 2419833 - DNA, 21 bp, Homo sapiens
tggcccctcaaatcgtccagc

SEQ ID NO: 2419834 - DNA, 12 bp, Homo sapiens
tggcccctctga

SEQ ID NO: 2419835 - DNA, 14 bp, Homo sapiens
tggcccctctgacc

SEQ ID NO: 2419836 - DNA, 17 bp, Homo sapiens
tggccctctcccctgcc

SEQ ID NO: 2419837 - DNA, 19 bp, Homo sapiens
tggccctctcccctgcccc

SEQ ID NO: 2419838 - DNA, 17 bp, Homo sapiens
tggccctgcttcctgct

SEQ ID NO: 2419839 - DNA, 23 bp, Homo sapiens
tggccctgggagaatcgctcctg

SEQ ID NO: 2419840 - DNA, 20 bp, Homo sapiens
tggcccttcctggacagctg

SEQ ID NO: 2419841 - DNA, 15 bp, Homo sapiens
tggccgagtccaagc

SEQ ID NO: 2419842 - DNA, 19 bp, Homo sapiens
tggccgagtccaagctggg

SEQ ID NO: 2419843 - DNA, 21 bp, Homo sapiens
tggccgctgtgccaggcgagg

SEQ ID NO: 2419844 - DNA, 17 bp, Homo sapiens
tggccgtgaatgggtgc

SEQ ID NO: 2419845 - DNA, 18 bp, Homo sapiens
tggcctcatgtggctgga

SEQ ID NO: 2419846 - DNA, 15 bp, Homo sapiens
tggcctcccccactt

SEQ ID NO: 2419847 - DNA, 20 bp, Homo sapiens
tggcctcccctgccaccagg

SEQ ID NO: 2419848 - DNA, 23 bp, Homo sapiens
tggcctcccctgccaccaggcca

SEQ ID NO: 2419849 - DNA, 15 bp, Homo sapiens
tggcctcctgcctct

SEQ ID NO: 2419850 - DNA, 23 bp, Homo sapiens
tggcctctctatcctctcttcct

SEQ ID NO: 2419851 - DNA, 14 bp, Homo sapiens
tggcctctgctttc

SEQ ID NO: 2419852 - DNA, 17 bp, Homo sapiens
tggcctcttgagcagtg

SEQ ID NO: 2419853 - DNA, 22 bp, Homo sapiens
tggcctcttgagcagtggctgg

SEQ ID NO: 2419854 - DNA, 20 bp, Homo sapiens
tggcctctttcctcagcctt

SEQ ID NO: 2419855 - DNA, 19 bp, Homo sapiens
tggcctgcaaactgggaac

SEQ ID NO: 2419856 - DNA, 20 bp, Homo sapiens
tggcctgctaaggtcttgga

SEQ ID NO: 2419857 - DNA, 20 bp, Homo sapiens
tggcctggccagtgccctga

SEQ ID NO: 2419858 - DNA, 18 bp, Homo sapiens
tggcctgtagagttgctg

SEQ ID NO: 2419859 - DNA, 16 bp, Homo sapiens
tggcctgtgtcactca

SEQ ID NO: 2419860 - DNA, 14 bp, Homo sapiens
tggcctttgcgctc

SEQ ID NO: 2419861 - DNA, 20 bp, Homo sapiens
tggcctttttcatttatcta

SEQ ID NO: 2419862 - DNA, 13 bp, Homo sapiens
tggcgatgccagc

SEQ ID NO: 2419863 - DNA, 15 bp, Homo sapiens
tggcgccgtctccag

SEQ ID NO: 2419864 - DNA, 21 bp, Homo sapiens
tggcggctggggtcccagcag

SEQ ID NO: 2419865 - DNA, 17 bp, Homo sapiens
tggcggggaggaggaaa

SEQ ID NO: 2419866 - DNA, 20 bp, Homo sapiens
tggcgtaagtacagagaagc

SEQ ID NO: 2419867 - DNA, 23 bp, Homo sapiens
tggcgtaagtacagagaagccat

SEQ ID NO: 2419868 - DNA, 18 bp, Homo sapiens
tggcgtaggctacagaga

SEQ ID NO: 2419869 - DNA, 19 bp, Homo sapiens
tggcgtaggctacagagaa

SEQ ID NO: 2419870 - DNA, 21 bp, Homo sapiens
tggcgtaggctacagagaagc

SEQ ID NO: 2419871 - DNA, 22 bp, Homo sapiens
tggcgtaggctacagagaagcc

SEQ ID NO: 2419872 - DNA, 14 bp, Homo sapiens
tggctaaagctcga

SEQ ID NO: 2419873 - DNA, 17 bp, Homo sapiens
tggctatgtttttaatg

SEQ ID NO: 2419874 - DNA, 17 bp, Homo sapiens
tggctcacactcgacat

SEQ ID NO: 2419875 - DNA, 21 bp, Homo sapiens
tggctcacactcgacatgaaa

SEQ ID NO: 2419876 - DNA, 22 bp, Homo sapiens
tggctcagatcggccacagggc

SEQ ID NO: 2419877 - DNA, 12 bp, Homo sapiens
tggctcagccag

SEQ ID NO: 2419878 - DNA, 19 bp, Homo sapiens
tggctcccaggggctccct

SEQ ID NO: 2419879 - DNA, 17 bp, Homo sapiens
tggctccttcccatcgc

SEQ ID NO: 2419880 - DNA, 19 bp, Homo sapiens
tggctccttcccatcgctg

SEQ ID NO: 2419881 - DNA, 19 bp, Homo sapiens
tggctctaattcacagtgc

SEQ ID NO: 2419882 - DNA, 15 bp, Homo sapiens
tggctctcacctcta

SEQ ID NO: 2419883 - DNA, 23 bp, Homo sapiens
tggctcttgatacccccctctgt

SEQ ID NO: 2419884 - DNA, 16 bp, Homo sapiens
tggctgaaattctcct

SEQ ID NO: 2419885 - DNA, 19 bp, Homo sapiens
tggctgaaattctcctgga

SEQ ID NO: 2419886 - DNA, 21 bp, Homo sapiens
tggctgaaattctcctggagg

SEQ ID NO: 2419887 - DNA, 22 bp, Homo sapiens
tggctgaaattctcctggaggt

SEQ ID NO: 2419888 - DNA, 21 bp, Homo sapiens
tggctgaatagcttctccaaa

SEQ ID NO: 2419889 - DNA, 18 bp, Homo sapiens
tggctgacatgaagctgt

SEQ ID NO: 2419890 - DNA, 15 bp, Homo sapiens
tggctgagggcagtt

SEQ ID NO: 2419891 - DNA, 23 bp, Homo sapiens
tggctgagggcagttcgcagcca

SEQ ID NO: 2419892 - DNA, 14 bp, Homo sapiens
tggctgataatttt

SEQ ID NO: 2419893 - DNA, 15 bp, Homo sapiens
tggctgcagcctcag

SEQ ID NO: 2419894 - DNA, 23 bp, Homo sapiens
tggctgcagcctcaggactggga

SEQ ID NO: 2419895 - DNA, 14 bp, Homo sapiens
tggctgcaggaatc

SEQ ID NO: 2419896 - DNA, 16 bp, Homo sapiens
tggctgctgtgggaaa

SEQ ID NO: 2419897 - DNA, 19 bp, Homo sapiens
tggctggaagatcctgcgg

SEQ ID NO: 2419898 - DNA, 13 bp, Homo sapiens
tggctggacccag

SEQ ID NO: 2419899 - DNA, 14 bp, Homo sapiens
tggctggacccagc

SEQ ID NO: 2419900 - DNA, 15 bp, Homo sapiens
tggctggacccagcc

SEQ ID NO: 2419901 - DNA, 16 bp, Homo sapiens
tggctggacccagcca

SEQ ID NO: 2419902 - DNA, 21 bp, Homo sapiens
tggctggacccagccaggccc

SEQ ID NO: 2419903 - DNA, 22 bp, Homo sapiens
tggctggacccagccaggccca

SEQ ID NO: 2419904 - DNA, 19 bp, Homo sapiens
tggctggcctcacccaccc

SEQ ID NO: 2419905 - DNA, 13 bp, Homo sapiens
tggctggctgagg

SEQ ID NO: 2419906 - DNA, 15 bp, Homo sapiens
tggctggctgagggc

SEQ ID NO: 2419907 - DNA, 18 bp, Homo sapiens
tggctggctgagggcagt

SEQ ID NO: 2419908 - DNA, 23 bp, Homo sapiens
tggctggcttgtttgatttcaac

SEQ ID NO: 2419909 - DNA, 23 bp, Homo sapiens
tggctgggacgtggctcagccag

SEQ ID NO: 2419910 - DNA, 14 bp, Homo sapiens
tggctggtcaactt

SEQ ID NO: 2419911 - DNA, 17 bp, Homo sapiens
tggctggtgtggtacag

SEQ ID NO: 2419912 - DNA, 23 bp, Homo sapiens
tggctggtgtggtacagagaagc

SEQ ID NO: 2419913 - DNA, 20 bp, Homo sapiens
tggctggtgttaacagaagg

SEQ ID NO: 2419914 - DNA, 20 bp, Homo sapiens
tggctgtaaggctctagatc

SEQ ID NO: 2419915 - DNA, 14 bp, Homo sapiens
tggctgtggcaggc

SEQ ID NO: 2419916 - DNA, 17 bp, Homo sapiens
tggcttctggccaggaa

SEQ ID NO: 2419917 - DNA, 16 bp, Homo sapiens
tggcttgggcagcatc

SEQ ID NO: 2419918 - DNA, 17 bp, Homo sapiens
tggcttgtttgatttca

SEQ ID NO: 2419919 - DNA, 20 bp, Homo sapiens
tggcttgtttgatttcaaca

SEQ ID NO: 2419920 - DNA, 14 bp, Homo sapiens
tggctttcagggag

SEQ ID NO: 2419921 - DNA, 18 bp, Homo sapiens
tgggaaacttggctcgaa

SEQ ID NO: 2419922 - DNA, 20 bp, Homo sapiens
tgggaaagcccctgcccctc

SEQ ID NO: 2419923 - DNA, 22 bp, Homo sapiens
tgggaagactcctagctgtcct

SEQ ID NO: 2419924 - DNA, 17 bp, Homo sapiens
tgggaaggcttgggatt

SEQ ID NO: 2419925 - DNA, 18 bp, Homo sapiens
tgggaagtccggccccag

SEQ ID NO: 2419926 - DNA, 15 bp, Homo sapiens
tgggacaactgctcc

SEQ ID NO: 2419927 - DNA, 23 bp, Homo sapiens
tgggacctcagttttatcatttt

SEQ ID NO: 2419928 - DNA, 14 bp, Homo sapiens
tgggacggtgccca

SEQ ID NO: 2419929 - DNA, 15 bp, Homo sapiens
tgggacgtggctcag

SEQ ID NO: 2419930 - DNA, 16 bp, Homo sapiens
tgggacgtggctcagc

SEQ ID NO: 2419931 - DNA, 17 bp, Homo sapiens
tgggactagcctggctt

SEQ ID NO: 2419932 - DNA, 19 bp, Homo sapiens
tgggactagcctggcttgg

SEQ ID NO: 2419933 - DNA, 13 bp, Homo sapiens
tgggactcagcct

SEQ ID NO: 2419934 - DNA, 23 bp, Homo sapiens
tgggactcagccttcagacagag

SEQ ID NO: 2419935 - DNA, 16 bp, Homo sapiens
tgggagacatgtgaca

SEQ ID NO: 2419936 - DNA, 22 bp, Homo sapiens
tgggagaccggcctgccaggag

SEQ ID NO: 2419937 - DNA, 18 bp, Homo sapiens
tgggagacctgtaatcat

SEQ ID NO: 2419938 - DNA, 15 bp, Homo sapiens
tgggagagacttgtt

SEQ ID NO: 2419939 - DNA, 21 bp, Homo sapiens
tgggagagacttgttttggat

SEQ ID NO: 2419940 - DNA, 18 bp, Homo sapiens
tgggagaggcagcccagg

SEQ ID NO: 2419941 - DNA, 22 bp, Homo sapiens
tgggagaggcagcccaggaagt

SEQ ID NO: 2419942 - DNA, 20 bp, Homo sapiens
tgggagcaaactgcatgccc

SEQ ID NO: 2419943 - DNA, 18 bp, Homo sapiens
tgggagcccccagcctgt

SEQ ID NO: 2419944 - DNA, 19 bp, Homo sapiens
tgggagcccccagcctgtc

SEQ ID NO: 2419945 - DNA, 20 bp, Homo sapiens
tgggagcccccagcctgtca

SEQ ID NO: 2419946 - DNA, 23 bp, Homo sapiens
tgggagccgggtctgcctcttct

SEQ ID NO: 2419947 - DNA, 16 bp, Homo sapiens
tgggagctccactctg

SEQ ID NO: 2419948 - DNA, 13 bp, Homo sapiens
tgggaggaaggac

SEQ ID NO: 2419949 - DNA, 18 bp, Homo sapiens
tgggagggcagcagggct

SEQ ID NO: 2419950 - DNA, 22 bp, Homo sapiens
tgggagttgatcgcctttccca

SEQ ID NO: 2419951 - DNA, 14 bp, Homo sapiens
tgggagttgtagtt

SEQ ID NO: 2419952 - DNA, 19 bp, Homo sapiens
tgggatcaggggtaggaat

SEQ ID NO: 2419953 - DNA, 14 bp, Homo sapiens
tgggatctactttc

SEQ ID NO: 2419954 - DNA, 21 bp, Homo sapiens
tgggatctactttccctctgg

SEQ ID NO: 2419955 - DNA, 16 bp, Homo sapiens
tgggatggtggagggc

SEQ ID NO: 2419956 - DNA, 21 bp, Homo sapiens
tgggatgttcagcactgtccc

SEQ ID NO: 2419957 - DNA, 20 bp, Homo sapiens
tgggattatgggtcacagga

SEQ ID NO: 2419958 - DNA, 19 bp, Homo sapiens
tgggattgagtctgtgcca

SEQ ID NO: 2419959 - DNA, 15 bp, Homo sapiens
tgggcaaagcctagt

SEQ ID NO: 2419960 - DNA, 16 bp, Homo sapiens
tgggcacccccagcct

SEQ ID NO: 2419961 - DNA, 19 bp, Homo sapiens
tgggcacccccagcctggg

SEQ ID NO: 2419962 - DNA, 22 bp, Homo sapiens
tgggcacccccagcctgggcct

SEQ ID NO: 2419963 - DNA, 23 bp, Homo sapiens
tgggcacccccagcctgggccta

SEQ ID NO: 2419964 - DNA, 16 bp, Homo sapiens
tgggcactggattagt

SEQ ID NO: 2419965 - DNA, 14 bp, Homo sapiens
tgggcagagcccaa

SEQ ID NO: 2419966 - DNA, 12 bp, Homo sapiens
tgggcagagctg

SEQ ID NO: 2419967 - DNA, 15 bp, Homo sapiens
tgggcatcttttgta

SEQ ID NO: 2419968 - DNA, 20 bp, Homo sapiens
tgggcatggtgttctcctgc

SEQ ID NO: 2419969 - DNA, 20 bp, Homo sapiens
tgggccagaagtaccagact

SEQ ID NO: 2419970 - DNA, 21 bp, Homo sapiens
tgggccagaagtaccagacta

SEQ ID NO: 2419971 - DNA, 18 bp, Homo sapiens
tgggccagcttttcaaac

SEQ ID NO: 2419972 - DNA, 16 bp, Homo sapiens
tgggccagtctgtgga

SEQ ID NO: 2419973 - DNA, 19 bp, Homo sapiens
tgggccatgtccaaagagg

SEQ ID NO: 2419974 - DNA, 23 bp, Homo sapiens
tgggccatgtccaaagaggctgc

SEQ ID NO: 2419975 - DNA, 16 bp, Homo sapiens
tgggcccacacctcct

SEQ ID NO: 2419976 - DNA, 15 bp, Homo sapiens
tgggcccaggcctca

SEQ ID NO: 2419977 - DNA, 21 bp, Homo sapiens
tgggccccaggggaacactgg

SEQ ID NO: 2419978 - DNA, 13 bp, Homo sapiens
tgggccctctctg

SEQ ID NO: 2419979 - DNA, 18 bp, Homo sapiens
tgggccctctctgctctg

SEQ ID NO: 2419980 - DNA, 19 bp, Homo sapiens
tgggccctggggcctgtac

SEQ ID NO: 2419981 - DNA, 21 bp, Homo sapiens
tgggccggcttcatgccagct

SEQ ID NO: 2419982 - DNA, 20 bp, Homo sapiens
tgggcctatggagagccctg

SEQ ID NO: 2419983 - DNA, 22 bp, Homo sapiens
tgggcctatggagagccctggg

SEQ ID NO: 2419984 - DNA, 13 bp, Homo sapiens
tgggcctgcagaa

SEQ ID NO: 2419985 - DNA, 18 bp, Homo sapiens
tgggcctgctgctgagaa

SEQ ID NO: 2419986 - DNA, 23 bp, Homo sapiens
tgggcctgctgctgagaacctgg

SEQ ID NO: 2419987 - DNA, 16 bp, Homo sapiens
tgggcctgggctcctg

SEQ ID NO: 2419988 - DNA, 18 bp, Homo sapiens
tgggcctgggctcctgga

SEQ ID NO: 2419989 - DNA, 22 bp, Homo sapiens
tgggcctggtctcaccctggag

SEQ ID NO: 2419990 - DNA, 12 bp, Homo sapiens
tgggccttggcc

SEQ ID NO: 2419991 - DNA, 14 bp, Homo sapiens
tgggcgctggtcct

SEQ ID NO: 2419992 - DNA, 22 bp, Homo sapiens
tgggcgctggtcctttcttccg

SEQ ID NO: 2419993 - DNA, 11 bp, Homo sapiens
tgggctccctg

SEQ ID NO: 2419994 - DNA, 15 bp, Homo sapiens
tgggctccctgactg

SEQ ID NO: 2419995 - DNA, 19 bp, Homo sapiens
tgggctccctgactgggag

SEQ ID NO: 2419996 - DNA, 21 bp, Homo sapiens
tgggctccggaggactcacca

SEQ ID NO: 2419997 - DNA, 18 bp, Homo sapiens
tgggctccgtgtgggaga

SEQ ID NO: 2419998 - DNA, 18 bp, Homo sapiens
tgggctcctggacccccc

SEQ ID NO: 2419999 - DNA, 14 bp, Homo sapiens
tgggctctgatgaa

SEQ ID NO: 2420000 - DNA, 20 bp, Homo sapiens
tgggctctgcaattcccctc

SEQ ID NO: 2420001 - DNA, 11 bp, Homo sapiens
tgggctgaggg

SEQ ID NO: 2420002 - DNA, 16 bp, Homo sapiens
tgggctgagggagcct

SEQ ID NO: 2420003 - DNA, 18 bp, Homo sapiens
tgggctggaatcaggaat

SEQ ID NO: 2420004 - DNA, 16 bp, Homo sapiens
tgggctggatgagctc

SEQ ID NO: 2420005 - DNA, 18 bp, Homo sapiens
tgggctggtatctcagaa

SEQ ID NO: 2420006 - DNA, 23 bp, Homo sapiens
tgggctggtatctcagaaagtgc

SEQ ID NO: 2420007 - DNA, 13 bp, Homo sapiens
tgggcttcctgga

SEQ ID NO: 2420008 - DNA, 14 bp, Homo sapiens
tgggcttcctggag

SEQ ID NO: 2420009 - DNA, 16 bp, Homo sapiens
tgggcttcctggagca

SEQ ID NO: 2420010 - DNA, 14 bp, Homo sapiens
tgggcttgattctg

SEQ ID NO: 2420011 - DNA, 22 bp, Homo sapiens
tgggcttgggcctaggctgcat

SEQ ID NO: 2420012 - DNA, 18 bp, Homo sapiens
tgggcttgtggggcctgg

SEQ ID NO: 2420013 - DNA, 18 bp, Homo sapiens
ggcagggctctcctggct

SEQ ID NO: 2420014 - DNA, 20 bp, Homo sapiens
ggcagggctctcctggcttc

SEQ ID NO: 2420015 - DNA, 15 bp, Homo sapiens
ggcaggggcttcctg

SEQ ID NO: 2420016 - DNA, 22 bp, Homo sapiens
ggcagtatcctgtttgaggaaa

SEQ ID NO: 2420017 - DNA, 19 bp, Homo sapiens
ggcagtcgatagagctgta

SEQ ID NO: 2420018 - DNA, 21 bp, Homo sapiens
ggcagtgagggagggctgtca

SEQ ID NO: 2420019 - DNA, 14 bp, Homo sapiens
ggcagttatatttt

SEQ ID NO: 2420020 - DNA, 15 bp, Homo sapiens
ggcagttcgcagcca

SEQ ID NO: 2420021 - DNA, 16 bp, Homo sapiens
ggcagttcgcagccac

SEQ ID NO: 2420022 - DNA, 20 bp, Homo sapiens
ggcagttcgcagccaccctg

SEQ ID NO: 2420023 - DNA, 22 bp, Homo sapiens
ggcagttcgcagccaccctgag

SEQ ID NO: 2420024 - DNA, 14 bp, Homo sapiens
ggcatcctccagcc

SEQ ID NO: 2420025 - DNA, 17 bp, Homo sapiens
ggcatcctctttttcca

SEQ ID NO: 2420026 - DNA, 21 bp, Homo sapiens
ggcatcgcaccattctgactc

SEQ ID NO: 2420027 - DNA, 16 bp, Homo sapiens
ggcatctctgggctgg

SEQ ID NO: 2420028 - DNA, 20 bp, Homo sapiens
ggcatgaggggttcctcccc

SEQ ID NO: 2420029 - DNA, 12 bp, Homo sapiens
ggcatggaaatt

SEQ ID NO: 2420030 - DNA, 20 bp, Homo sapiens
ggcattagaattatttaaac

SEQ ID NO: 2420031 - DNA, 18 bp, Homo sapiens
ggcattctggacctctgg

SEQ ID NO: 2420032 - DNA, 11 bp, Homo sapiens
ggcatttccta

SEQ ID NO: 2420033 - DNA, 16 bp, Homo sapiens
ggcatttcctgggtgg

SEQ ID NO: 2420034 - DNA, 18 bp, Homo sapiens
ggcatttcctgggtggct

SEQ ID NO: 2420035 - DNA, 20 bp, Homo sapiens
ggccaaaggggacctggaag

SEQ ID NO: 2420036 - DNA, 15 bp, Homo sapiens
ggccaagctgaggtg

SEQ ID NO: 2420037 - DNA, 22 bp, Homo sapiens
ggccaagctgaggtgcccagga

SEQ ID NO: 2420038 - DNA, 16 bp, Homo sapiens
ggccaaggacctgaga

SEQ ID NO: 2420039 - DNA, 22 bp, Homo sapiens
ggccaatgcacctaaagaaaaa

SEQ ID NO: 2420040 - DNA, 20 bp, Homo sapiens
ggccacacttcaaactactt

SEQ ID NO: 2420041 - DNA, 12 bp, Homo sapiens
ggccacagccag

SEQ ID NO: 2420042 - DNA, 13 bp, Homo sapiens
ggccacagccagg

SEQ ID NO: 2420043 - DNA, 13 bp, Homo sapiens
ggccacagggcgg

SEQ ID NO: 2420044 - DNA, 19 bp, Homo sapiens
ggccacatcaaagaggctg

SEQ ID NO: 2420045 - DNA, 13 bp, Homo sapiens
ggccacctcccca

SEQ ID NO: 2420046 - DNA, 17 bp, Homo sapiens
ggccacctggctctcac

SEQ ID NO: 2420047 - DNA, 22 bp, Homo sapiens
ggccacctggctctcacctcta

SEQ ID NO: 2420048 - DNA, 16 bp, Homo sapiens
ggccactgtgttcctt

SEQ ID NO: 2420049 - DNA, 12 bp, Homo sapiens
ggccagaagtac

SEQ ID NO: 2420050 - DNA, 17 bp, Homo sapiens
ggccagacacaggccct

SEQ ID NO: 2420051 - DNA, 12 bp, Homo sapiens
ggccagagccca

SEQ ID NO: 2420052 - DNA, 15 bp, Homo sapiens
ggccagagcccactc

SEQ ID NO: 2420053 - DNA, 11 bp, Homo sapiens
ggccagaggct

SEQ ID NO: 2420054 - DNA, 12 bp, Homo sapiens
ggccagatccag

SEQ ID NO: 2420055 - DNA, 16 bp, Homo sapiens
ggccagatccagcctg

SEQ ID NO: 2420056 - DNA, 12 bp, Homo sapiens
ggccagcagcac

SEQ ID NO: 2420057 - DNA, 21 bp, Homo sapiens
ggccagccccttagacagagg

SEQ ID NO: 2420058 - DNA, 23 bp, Homo sapiens
ggccagccccttagacagaggcc

SEQ ID NO: 2420059 - DNA, 12 bp, Homo sapiens
ggccagcctggc

SEQ ID NO: 2420060 - DNA, 14 bp, Homo sapiens
ggccagcctggcct

SEQ ID NO: 2420061 - DNA, 15 bp, Homo sapiens
ggccagcctggcctc

SEQ ID NO: 2420062 - DNA, 21 bp, Homo sapiens
ggccagcctggcctcctgcct

SEQ ID NO: 2420063 - DNA, 22 bp, Homo sapiens
ggccagcctggcctcctgcctc

SEQ ID NO: 2420064 - DNA, 15 bp, Homo sapiens
ggccagctggaggca

SEQ ID NO: 2420065 - DNA, 18 bp, Homo sapiens
ggccagctggaggcaggg

SEQ ID NO: 2420066 - DNA, 18 bp, Homo sapiens
ggccaggactctgcagcc

SEQ ID NO: 2420067 - DNA, 20 bp, Homo sapiens
ggccaggactctgcagcctc

SEQ ID NO: 2420068 - DNA, 18 bp, Homo sapiens
ggccaggcagatgacctc

SEQ ID NO: 2420069 - DNA, 19 bp, Homo sapiens
ggccaggcatgtggcaggg

SEQ ID NO: 2420070 - DNA, 19 bp, Homo sapiens
ggccaggctggtctaaaac

SEQ ID NO: 2420071 - DNA, 17 bp, Homo sapiens
ggccagggagaagctcc

SEQ ID NO: 2420072 - DNA, 20 bp, Homo sapiens
ggccagggccacgctccagc

SEQ ID NO: 2420073 - DNA, 15 bp, Homo sapiens
ggccagtctgtggat

SEQ ID NO: 2420074 - DNA, 21 bp, Homo sapiens
ggccagtgccctgatcccaga

SEQ ID NO: 2420075 - DNA, 14 bp, Homo sapiens
ggccagtgtttaaa

SEQ ID NO: 2420076 - DNA, 18 bp, Homo sapiens
ggccatatttacctcagc

SEQ ID NO: 2420077 - DNA, 15 bp, Homo sapiens
ggccatgctcctctt

SEQ ID NO: 2420078 - DNA, 14 bp, Homo sapiens
ggccatgctgaggc

SEQ ID NO: 2420079 - DNA, 22 bp, Homo sapiens
ggagttgtcaagtctctgctgg

SEQ ID NO: 2420080 - DNA, 13 bp, Homo sapiens
ggatagatgctgg

SEQ ID NO: 2420081 - DNA, 14 bp, Homo sapiens
ggatagatgctggc

SEQ ID NO: 2420082 - DNA, 16 bp, Homo sapiens
ggatcagaacaggagc

SEQ ID NO: 2420083 - DNA, 18 bp, Homo sapiens
ggatcaggggtaggaatg

SEQ ID NO: 2420084 - DNA, 18 bp, Homo sapiens
ggatccctcatctgtccc

SEQ ID NO: 2420085 - DNA, 19 bp, Homo sapiens
ggatccgactgctttggac

SEQ ID NO: 2420086 - DNA, 21 bp, Homo sapiens
ggatctccctgagatgggctt

SEQ ID NO: 2420087 - DNA, 23 bp, Homo sapiens
ggatgagaatttgagtgctctga

SEQ ID NO: 2420088 - DNA, 14 bp, Homo sapiens
ggatgagctcccac

SEQ ID NO: 2420089 - DNA, 20 bp, Homo sapiens
ggatgagggaaaagaaaaag

SEQ ID NO: 2420090 - DNA, 16 bp, Homo sapiens
ggatgctaacatctaa

SEQ ID NO: 2420091 - DNA, 13 bp, Homo sapiens
ggatggccccagc

SEQ ID NO: 2420092 - DNA, 15 bp, Homo sapiens
ggatgggggaactca

SEQ ID NO: 2420093 - DNA, 21 bp, Homo sapiens
ggatggggtatggattctaaa

SEQ ID NO: 2420094 - DNA, 21 bp, Homo sapiens
ggatggtcttacagcaggcag

SEQ ID NO: 2420095 - DNA, 12 bp, Homo sapiens
ggatggtgtctc

SEQ ID NO: 2420096 - DNA, 16 bp, Homo sapiens
ggatgtccccagcaga

SEQ ID NO: 2420097 - DNA, 16 bp, Homo sapiens
ggatgtgtcctgacac

SEQ ID NO: 2420098 - DNA, 16 bp, Homo sapiens
ggattaacctctgcac

SEQ ID NO: 2420099 - DNA, 17 bp, Homo sapiens
ggattaacctctgcact

SEQ ID NO: 2420100 - DNA, 20 bp, Homo sapiens
ggattcaggaaaaggcctgg

SEQ ID NO: 2420101 - DNA, 19 bp, Homo sapiens
ggattgaaaatgtccagga

SEQ ID NO: 2420102 - DNA, 17 bp, Homo sapiens
ggattgcacgtggcctc

SEQ ID NO: 2420103 - DNA, 16 bp, Homo sapiens
ggatttaaaagcctgc

SEQ ID NO: 2420104 - DNA, 19 bp, Homo sapiens
ggatttatttaaaatagca

SEQ ID NO: 2420105 - DNA, 20 bp, Homo sapiens
ggatttcatgatttcatttc

SEQ ID NO: 2420106 - DNA, 23 bp, Homo sapiens
ggatttttgttttgtttttacaa

SEQ ID NO: 2420107 - DNA, 13 bp, Homo sapiens
ggcaaacccatca

SEQ ID NO: 2420108 - DNA, 22 bp, Homo sapiens
ggcaaagcacgaaatgttattt

SEQ ID NO: 2420109 - DNA, 16 bp, Homo sapiens
ggcaaaggaaggtgga

SEQ ID NO: 2420110 - DNA, 14 bp, Homo sapiens
ggcaacagatctgg

SEQ ID NO: 2420111 - DNA, 15 bp, Homo sapiens
ggcaacagatctgga

SEQ ID NO: 2420112 - DNA, 22 bp, Homo sapiens
ggcaatgttaatttagtggaaa

SEQ ID NO: 2420113 - DNA, 13 bp, Homo sapiens
ggcacaagactga

SEQ ID NO: 2420114 - DNA, 16 bp, Homo sapiens
ggcacaggagctacct

SEQ ID NO: 2420115 - DNA, 19 bp, Homo sapiens
ggcacaggagctacctgtg

SEQ ID NO: 2420116 - DNA, 20 bp, Homo sapiens
ggcacaggagtgtcctcttc

SEQ ID NO: 2420117 - DNA, 17 bp, Homo sapiens
ggcacagggtctgctct

SEQ ID NO: 2420118 - DNA, 17 bp, Homo sapiens
ggcaccagacacccagg

SEQ ID NO: 2420119 - DNA, 19 bp, Homo sapiens
ggcaccagacacccaggac

SEQ ID NO: 2420120 - DNA, 18 bp, Homo sapiens
ggcacccccagcctgggc

SEQ ID NO: 2420121 - DNA, 19 bp, Homo sapiens
ggcacccccagcctgggcc

SEQ ID NO: 2420122 - DNA, 13 bp, Homo sapiens
ggcaccccctgca

SEQ ID NO: 2420123 - DNA, 16 bp, Homo sapiens
ggcaccgaagcccaga

SEQ ID NO: 2420124 - DNA, 23 bp, Homo sapiens
ggcaccgaagcccagagggtctg

SEQ ID NO: 2420125 - DNA, 16 bp, Homo sapiens
ggcacctaatccaggc

SEQ ID NO: 2420126 - DNA, 19 bp, Homo sapiens
ggcacctaatccaggcaga

SEQ ID NO: 2420127 - DNA, 16 bp, Homo sapiens
ggcacctcacaggccc

SEQ ID NO: 2420128 - DNA, 19 bp, Homo sapiens
ggcacctcacaggccccag

SEQ ID NO: 2420129 - DNA, 24 bp, Homo sapiens
ggcactgccctggtggccctctcc

SEQ ID NO: 2420130 - DNA, 14 bp, Homo sapiens
ggcactgctaggct

SEQ ID NO: 2420131 - DNA, 15 bp, Homo sapiens
ggcactgggcatgag

SEQ ID NO: 2420132 - DNA, 14 bp, Homo sapiens
ggcacttaaagctt

SEQ ID NO: 2420133 - DNA, 18 bp, Homo sapiens
ggcacttggcagccttgt

SEQ ID NO: 2420134 - DNA, 17 bp, Homo sapiens
ggcagaagtgtttttta

SEQ ID NO: 2420135 - DNA, 20 bp, Homo sapiens
ggcagactctttatgcttgc

SEQ ID NO: 2420136 - DNA, 22 bp, Homo sapiens
ggcagactctttatgcttgcaa

SEQ ID NO: 2420137 - DNA, 18 bp, Homo sapiens
ggcagagatgcctccctg

SEQ ID NO: 2420138 - DNA, 16 bp, Homo sapiens
ggcagagcccaaggga

SEQ ID NO: 2420139 - DNA, 15 bp, Homo sapiens
ggcagagctggtgcg

SEQ ID NO: 2420140 - DNA, 19 bp, Homo sapiens
ggcagaggcccaggctgcc

SEQ ID NO: 2420141 - DNA, 21 bp, Homo sapiens
ggcagaggcccaggctgccgt

SEQ ID NO: 2420142 - DNA, 12 bp, Homo sapiens
ggcagagggctg

SEQ ID NO: 2420143 - DNA, 13 bp, Homo sapiens
ggcagagggctgg

SEQ ID NO: 2420144 - DNA, 13 bp, Homo sapiens
ggcagagttacag

SEQ ID NO: 2420145 - DNA, 14 bp, Homo sapiens
ggcagatccaggac

SEQ ID NO: 2420146 - DNA, 16 bp, Homo sapiens
ggcagatgtaggaggg

SEQ ID NO: 2420147 - DNA, 19 bp, Homo sapiens
gggtctgctctttctctgc

SEQ ID NO: 2420148 - DNA, 21 bp, Homo sapiens
gggtctgctctttctctgcca

SEQ ID NO: 2420149 - DNA, 22 bp, Homo sapiens
gggtctggcagcctcccatcca

SEQ ID NO: 2420150 - DNA, 13 bp, Homo sapiens
gggtctggctggt

SEQ ID NO: 2420151 - DNA, 21 bp, Homo sapiens
gggtctgggggcacaagactg

SEQ ID NO: 2420152 - DNA, 20 bp, Homo sapiens
gggtctgtaggttgcacact

SEQ ID NO: 2420153 - DNA, 21 bp, Homo sapiens
gggtctgtaggttgcacactt

SEQ ID NO: 2420154 - DNA, 23 bp, Homo sapiens
gggtgagttggcttacctggccc

SEQ ID NO: 2420155 - DNA, 21 bp, Homo sapiens
gggtgatgagggcagcagcca

SEQ ID NO: 2420156 - DNA, 14 bp, Homo sapiens
gggtgcacaggagg

SEQ ID NO: 2420157 - DNA, 13 bp, Homo sapiens
gggtggccaggcc

SEQ ID NO: 2420158 - DNA, 21 bp, Homo sapiens
gggtggccgctgagtggcagg

SEQ ID NO: 2420159 - DNA, 12 bp, Homo sapiens
gggtggggccca

SEQ ID NO: 2420160 - DNA, 14 bp, Homo sapiens
gggtgggggcagca

SEQ ID NO: 2420161 - DNA, 13 bp, Homo sapiens
gggtggtgtcaga

SEQ ID NO: 2420162 - DNA, 15 bp, Homo sapiens
gggtgtcttgggcag

SEQ ID NO: 2420163 - DNA, 21 bp, Homo sapiens
gggtgtcttgggcagagctgg

SEQ ID NO: 2420164 - DNA, 13 bp, Homo sapiens
gggtgtgctggga

SEQ ID NO: 2420165 - DNA, 14 bp, Homo sapiens
gggttcatttgtgt

SEQ ID NO: 2420166 - DNA, 18 bp, Homo sapiens
gggttcctcccctccagc

SEQ ID NO: 2420167 - DNA, 19 bp, Homo sapiens
gggttcctcccctccagct

SEQ ID NO: 2420168 - DNA, 20 bp, Homo sapiens
gggtttcaccatgttggcca

SEQ ID NO: 2420169 - DNA, 15 bp, Homo sapiens
gggttttaactttgt

SEQ ID NO: 2420170 - DNA, 22 bp, Homo sapiens
ggtaaaaaaaaattactgttta

SEQ ID NO: 2420171 - DNA, 14 bp, Homo sapiens
ggtaaaaaatttat

SEQ ID NO: 2420172 - DNA, 16 bp, Homo sapiens
ggtaaaaaatttataa

SEQ ID NO: 2420173 - DNA, 16 bp, Homo sapiens
ggtaaagactggcttt

SEQ ID NO: 2420174 - DNA, 20 bp, Homo sapiens
ggtaaagttaagttgagata

SEQ ID NO: 2420175 - DNA, 12 bp, Homo sapiens
ggtacagagaag

SEQ ID NO: 2420176 - DNA, 14 bp, Homo sapiens
ggtacagagaagcc

SEQ ID NO: 2420177 - DNA, 16 bp, Homo sapiens
ggtacagagaagccag

SEQ ID NO: 2420178 - DNA, 16 bp, Homo sapiens
ggtacagcgcggagga

SEQ ID NO: 2420179 - DNA, 17 bp, Homo sapiens
ggtacagtatgggggtt

SEQ ID NO: 2420180 - DNA, 16 bp, Homo sapiens
ggtacatggtgctggg

SEQ ID NO: 2420181 - DNA, 18 bp, Homo sapiens
ggtacatggtgtttgtgg

SEQ ID NO: 2420182 - DNA, 17 bp, Homo sapiens
ggtaccagataactttt

SEQ ID NO: 2420183 - DNA, 17 bp, Homo sapiens
ggtaccttgtgcccagg

SEQ ID NO: 2420184 - DNA, 18 bp, Homo sapiens
ggtactgactttgcttgc

SEQ ID NO: 2420185 - DNA, 15 bp, Homo sapiens
ggtactgtacagctg

SEQ ID NO: 2420186 - DNA, 15 bp, Homo sapiens
ggtacttcttgaagg

SEQ ID NO: 2420187 - DNA, 15 bp, Homo sapiens
ggtagaagggaaagc

SEQ ID NO: 2420188 - DNA, 16 bp, Homo sapiens
gtgagttggcttacct

SEQ ID NO: 2420189 - DNA, 20 bp, Homo sapiens
gtgagttggcttacctggcc

SEQ ID NO: 2420190 - DNA, 23 bp, Homo sapiens
gtgatatataagtgtacatatgt

SEQ ID NO: 2420191 - DNA, 17 bp, Homo sapiens
gtgatcatgtgtggaag

SEQ ID NO: 2420192 - DNA, 18 bp, Homo sapiens
gtgatgagggcagcagcc

SEQ ID NO: 2420193 - DNA, 22 bp, Homo sapiens
gtgatgtcatacagagaagtca

SEQ ID NO: 2420194 - DNA, 15 bp, Homo sapiens
gtgatgtgaagccaa

SEQ ID NO: 2420195 - DNA, 16 bp, Homo sapiens
gtgatgttctaaggct

SEQ ID NO: 2420196 - DNA, 21 bp, Homo sapiens
gtgattcagaaaatgttctgt

SEQ ID NO: 2420197 - DNA, 23 bp, Homo sapiens
gtgcaacctcttggcctgatcag

SEQ ID NO: 2420198 - DNA, 12 bp, Homo sapiens
gtgcaaggcagc

SEQ ID NO: 2420199 - DNA, 14 bp, Homo sapiens
gtgcaaggcagccg

SEQ ID NO: 2420200 - DNA, 15 bp, Homo sapiens
gtgcaaggcagccgt

SEQ ID NO: 2420201 - DNA, 23 bp, Homo sapiens
gtgcaataaatctgacccagtgc

SEQ ID NO: 2420202 - DNA, 17 bp, Homo sapiens
gtgcaatgtaaatattt

SEQ ID NO: 2420203 - DNA, 20 bp, Homo sapiens
gtgcaatgtaaatattttaa

SEQ ID NO: 2420204 - DNA, 17 bp, Homo sapiens
gtgcaatgtgtataaac

SEQ ID NO: 2420205 - DNA, 20 bp, Homo sapiens
gtgcaatgtgtgtatatgga

SEQ ID NO: 2420206 - DNA, 19 bp, Homo sapiens
gtgcacagcacaaattagt

SEQ ID NO: 2420207 - DNA, 12 bp, Homo sapiens
gtgcacaggagg

SEQ ID NO: 2420208 - DNA, 14 bp, Homo sapiens
gtgcacaggagggg

SEQ ID NO: 2420209 - DNA, 23 bp, Homo sapiens
gtgcacgtaaagtacttgtagtt

SEQ ID NO: 2420210 - DNA, 13 bp, Homo sapiens
gtgcactgggagg

SEQ ID NO: 2420211 - DNA, 20 bp, Homo sapiens
gtgcactgggaggctcccct

SEQ ID NO: 2420212 - DNA, 14 bp, Homo sapiens
gtgcagggatgtgg

SEQ ID NO: 2420213 - DNA, 15 bp, Homo sapiens
gtgcaggtggggaga

SEQ ID NO: 2420214 - DNA, 14 bp, Homo sapiens
gtgcagtcctgggt

SEQ ID NO: 2420215 - DNA, 15 bp, Homo sapiens
gtgcagtcctgggtc

SEQ ID NO: 2420216 - DNA, 20 bp, Homo sapiens
gtgcatcaggctttcttttt

SEQ ID NO: 2420217 - DNA, 19 bp, Homo sapiens
gtgcatttggagggagtga

SEQ ID NO: 2420218 - DNA, 21 bp, Homo sapiens
gtgccaagtccaggtcctggt

SEQ ID NO: 2420219 - DNA, 16 bp, Homo sapiens
gtgccagagaacccag

SEQ ID NO: 2420220 - DNA, 16 bp, Homo sapiens
gtgccaggtgaggtca

SEQ ID NO: 2420221 - DNA, 13 bp, Homo sapiens
gtgcccacaggcc

SEQ ID NO: 2420222 - DNA, 22 bp, Homo sapiens
gtgcccacagtgtcaggcactg

SEQ ID NO: 2420223 - DNA, 13 bp, Homo sapiens
gtgcccagggttt

SEQ ID NO: 2420224 - DNA, 16 bp, Homo sapiens
gtgcccagggttttgc

SEQ ID NO: 2420225 - DNA, 15 bp, Homo sapiens
gtgccccaggaccag

SEQ ID NO: 2420226 - DNA, 21 bp, Homo sapiens
gtgccccaggaccagctcagg

SEQ ID NO: 2420227 - DNA, 22 bp, Homo sapiens
gtgcccccaaccatttcctcag

SEQ ID NO: 2420228 - DNA, 19 bp, Homo sapiens
gtgcccccactgaccagaa

SEQ ID NO: 2420229 - DNA, 13 bp, Homo sapiens
gtgccctctccca

SEQ ID NO: 2420230 - DNA, 19 bp, Homo sapiens
gtgccctctcccaccctct

SEQ ID NO: 2420231 - DNA, 15 bp, Homo sapiens
gtgccctgagccagg

SEQ ID NO: 2420232 - DNA, 13 bp, Homo sapiens
gtgccctgatccc

SEQ ID NO: 2420233 - DNA, 20 bp, Homo sapiens
gtgcctaggcctgggcagtg

SEQ ID NO: 2420234 - DNA, 18 bp, Homo sapiens
gtgcctattgctagagct

SEQ ID NO: 2420235 - DNA, 22 bp, Homo sapiens
gtgcctcctccctccctctccg

SEQ ID NO: 2420236 - DNA, 19 bp, Homo sapiens
gtgcctcgctccccactct

SEQ ID NO: 2420237 - DNA, 20 bp, Homo sapiens
gtgcctcgctccccactctg

SEQ ID NO: 2420238 - DNA, 21 bp, Homo sapiens
gtgccttcaacacagcttgtc

SEQ ID NO: 2420239 - DNA, 14 bp, Homo sapiens
gtgccttctctctc

SEQ ID NO: 2420240 - DNA, 20 bp, Homo sapiens
gtgcctttatttccactgtg

SEQ ID NO: 2420241 - DNA, 16 bp, Homo sapiens
gtgcctttcaggatct

SEQ ID NO: 2420242 - DNA, 15 bp, Homo sapiens
gtgcgcccagggctg

SEQ ID NO: 2420243 - DNA, 16 bp, Homo sapiens
gtgcgtgcgagcacac

SEQ ID NO: 2420244 - DNA, 16 bp, Homo sapiens
gtgctaaggttctaag

SEQ ID NO: 2420245 - DNA, 19 bp, Homo sapiens
gtgctactggggaaactgg

SEQ ID NO: 2420246 - DNA, 16 bp, Homo sapiens
gtgctatttgtcatct

SEQ ID NO: 2420247 - DNA, 13 bp, Homo sapiens
gtgctcaaggcca

SEQ ID NO: 2420248 - DNA, 21 bp, Homo sapiens
gtgctcagggggcgcctgtgg

SEQ ID NO: 2420249 - DNA, 16 bp, Homo sapiens
gtgctcgccccagcag

SEQ ID NO: 2420250 - DNA, 16 bp, Homo sapiens
gtgctctctttctgtc

SEQ ID NO: 2420251 - DNA, 14 bp, Homo sapiens
gtgctcttttctcc

SEQ ID NO: 2420252 - DNA, 19 bp, Homo sapiens
gtgctgaatgttgggactg

SEQ ID NO: 2420253 - DNA, 15 bp, Homo sapiens
gtgctgacggccagg

SEQ ID NO: 2420254 - DNA, 23 bp, Homo sapiens
gtgctgacggccagggagaagct

SEQ ID NO: 2420255 - DNA, 14 bp, Homo sapiens
gtgctgagattaca

SEQ ID NO: 2420256 - DNA, 18 bp, Homo sapiens
gtgctgccgcgcagtgtg

SEQ ID NO: 2420257 - DNA, 12 bp, Homo sapiens
gtgctgcctcta

SEQ ID NO: 2420258 - DNA, 15 bp, Homo sapiens
gtgctggccagcgag

SEQ ID NO: 2420259 - DNA, 19 bp, Homo sapiens
gtgctggggcctggttccc

SEQ ID NO: 2420260 - DNA, 21 bp, Homo sapiens
gtgcttatcccatagccagga

SEQ ID NO: 2420261 - DNA, 17 bp, Homo sapiens
gtgctttgagagagaaa

SEQ ID NO: 2420262 - DNA, 21 bp, Homo sapiens
gtggaaaacttatgctgattt

SEQ ID NO: 2420263 - DNA, 16 bp, Homo sapiens
gtggaccatggagtgg

SEQ ID NO: 2420264 - DNA, 14 bp, Homo sapiens
gtggactcagggca

SEQ ID NO: 2420265 - DNA, 18 bp, Homo sapiens
gtggactgagtgggaagc

SEQ ID NO: 2420266 - DNA, 20 bp, Homo sapiens
gtggactgagtgggaagccc

SEQ ID NO: 2420267 - DNA, 13 bp, Homo sapiens
gtggaggctgctc

SEQ ID NO: 2420268 - DNA, 14 bp, Homo sapiens
gtggaggctgctcg

SEQ ID NO: 2420269 - DNA, 22 bp, Homo sapiens
gtggaggggtaggggctgggaa

SEQ ID NO: 2420270 - DNA, 14 bp, Homo sapiens
gtggatattgttac

SEQ ID NO: 2420271 - DNA, 19 bp, Homo sapiens
gtggatccaaactgatcca

SEQ ID NO: 2420272 - DNA, 13 bp, Homo sapiens
gtggatggcccca

SEQ ID NO: 2420273 - DNA, 16 bp, Homo sapiens
gtggatggccccagca

SEQ ID NO: 2420274 - DNA, 19 bp, Homo sapiens
gtggcagcaacggcacagc

SEQ ID NO: 2420275 - DNA, 14 bp, Homo sapiens
gtggcagcccagcc

SEQ ID NO: 2420276 - DNA, 22 bp, Homo sapiens
gtggcaggcagaggcccaggct

SEQ ID NO: 2420277 - DNA, 16 bp, Homo sapiens
gtggcaggggacagga

SEQ ID NO: 2420278 - DNA, 17 bp, Homo sapiens
gtggccaagaagcagtg

SEQ ID NO: 2420279 - DNA, 22 bp, Homo sapiens
gtggccaagaagcagtggcctt

SEQ ID NO: 2420280 - DNA, 23 bp, Homo sapiens
gtggccaggccgggaaaaagccc

SEQ ID NO: 2420281 - DNA, 20 bp, Homo sapiens
gtggccatgaccctgcctct

SEQ ID NO: 2420282 - DNA, 18 bp, Homo sapiens
gtggccatgctcctcttc

SEQ ID NO: 2420283 - DNA, 19 bp, Homo sapiens
gtggccatgctcctcttcc

SEQ ID NO: 2420284 - DNA, 20 bp, Homo sapiens
gtggccccaccctgggccct

SEQ ID NO: 2420285 - DNA, 13 bp, Homo sapiens
gtggcccttcctg

SEQ ID NO: 2420286 - DNA, 23 bp, Homo sapiens
gtggccctttcggatccagggag

SEQ ID NO: 2420287 - DNA, 14 bp, Homo sapiens
gtggcctggtccct

SEQ ID NO: 2420288 - DNA, 15 bp, Homo sapiens
gtggcctggtccctg

SEQ ID NO: 2420289 - DNA, 20 bp, Homo sapiens
gtggcctttgcgctcctggc

SEQ ID NO: 2420290 - DNA, 17 bp, Homo sapiens
gtggctactctgtgcca

SEQ ID NO: 2420291 - DNA, 13 bp, Homo sapiens
gtggctgcagcct

SEQ ID NO: 2420292 - DNA, 15 bp, Homo sapiens
gtggctgcagcctca

SEQ ID NO: 2420293 - DNA, 17 bp, Homo sapiens
gtggctgcagcctcagg

SEQ ID NO: 2420294 - DNA, 22 bp, Homo sapiens
gtggcttgagaaatatggacac

SEQ ID NO: 2420295 - DNA, 16 bp, Homo sapiens
gtgggaaatggtactg

SEQ ID NO: 2420296 - DNA, 21 bp, Homo sapiens
gtgggaagcccatcctgacca

SEQ ID NO: 2420297 - DNA, 23 bp, Homo sapiens
gtgggagcaaactgcatgcccag

SEQ ID NO: 2420298 - DNA, 11 bp, Homo sapiens
gtgggagcctc

SEQ ID NO: 2420299 - DNA, 13 bp, Homo sapiens
gtgggagcctcgc

SEQ ID NO: 2420300 - DNA, 14 bp, Homo sapiens
gtgggagcctcgca

SEQ ID NO: 2420301 - DNA, 22 bp, Homo sapiens
gtgggattatgggtcacaggaa

SEQ ID NO: 2420302 - DNA, 13 bp, Homo sapiens
gtgggcctgggct

SEQ ID NO: 2420303 - DNA, 21 bp, Homo sapiens
gtgggcctgggctcctggacc

SEQ ID NO: 2420304 - DNA, 13 bp, Homo sapiens
gtgggctccctga

SEQ ID NO: 2420305 - DNA, 16 bp, Homo sapiens
gtgggctggccgctgt

SEQ ID NO: 2420306 - DNA, 22 bp, Homo sapiens
gtgggctggccgctgtgccagg

SEQ ID NO: 2420307 - DNA, 14 bp, Homo sapiens
gtgggcttgattct

SEQ ID NO: 2420308 - DNA, 12 bp, Homo sapiens
gtggggagtggg

SEQ ID NO: 2420309 - DNA, 13 bp, Homo sapiens
gtggggcagaggc

SEQ ID NO: 2420310 - DNA, 14 bp, Homo sapiens
gtggggccaggtca

SEQ ID NO: 2420311 - DNA, 17 bp, Homo sapiens
gtggggccgccgcctct

SEQ ID NO: 2420312 - DNA, 22 bp, Homo sapiens
gtgggggtagggggctggagga

SEQ ID NO: 2420313 - DNA, 15 bp, Homo sapiens
gtggggtggctgcag

SEQ ID NO: 2420314 - DNA, 13 bp, Homo sapiens
gtggggtgtgctg

SEQ ID NO: 2420315 - DNA, 16 bp, Homo sapiens
gtggggtgtgctggga

SEQ ID NO: 2420316 - DNA, 14 bp, Homo sapiens
gtgggttccacaga

SEQ ID NO: 2420317 - DNA, 18 bp, Homo sapiens
gtgggttttttagttgaa

SEQ ID NO: 2420318 - DNA, 12 bp, Homo sapiens
gtggtacagaga

SEQ ID NO: 2420319 - DNA, 14 bp, Homo sapiens
gtggtacagagaag

SEQ ID NO: 2420320 - DNA, 16 bp, Homo sapiens
gtggtacagagaagcc

SEQ ID NO: 2420321 - DNA, 17 bp, Homo sapiens
gtggtacagagaagcca

SEQ ID NO: 2420322 - DNA, 22 bp, Homo sapiens
gtggtacagagaagccagcttg

SEQ ID NO: 2420323 - DNA, 14 bp, Homo sapiens
gtggtaccctctgg

SEQ ID NO: 2420324 - DNA, 23 bp, Homo sapiens
gtggtattttcaatagccactaa

SEQ ID NO: 2420325 - DNA, 15 bp, Homo sapiens
gtggtcacagcggag

SEQ ID NO: 2420326 - DNA, 18 bp, Homo sapiens
gtggtcacagcggaggtg

SEQ ID NO: 2420327 - DNA, 17 bp, Homo sapiens
gtggtctgttggcaggc

SEQ ID NO: 2420328 - DNA, 21 bp, Homo sapiens
gtggtctgttggcaggctggc

SEQ ID NO: 2420329 - DNA, 16 bp, Homo sapiens
gtggtggcacaggccc

SEQ ID NO: 2420330 - DNA, 15 bp, Homo sapiens
gtggtgtcagaccct

SEQ ID NO: 2420331 - DNA, 23 bp, Homo sapiens
gtggttttagattttctggttct

SEQ ID NO: 2420332 - DNA, 18 bp, Homo sapiens
gtgtaaaatattttgaat

SEQ ID NO: 2420333 - DNA, 14 bp, Homo sapiens
gtgtaaatatgtac

SEQ ID NO: 2420334 - DNA, 15 bp, Homo sapiens
gtgtaaatatgtaca

SEQ ID NO: 2420335 - DNA, 19 bp, Homo sapiens
gtgtaacaattgtgtagcc

SEQ ID NO: 2420336 - DNA, 23 bp, Homo sapiens
gtgtaacaattgtgtagcctttt

SEQ ID NO: 2420337 - DNA, 19 bp, Homo sapiens
gtgtaagggccagaaatat

SEQ ID NO: 2420338 - DNA, 12 bp, Homo sapiens
gtgtacatatgt

SEQ ID NO: 2420339 - DNA, 21 bp, Homo sapiens
gtgtaccacccatccctgtgg

SEQ ID NO: 2420340 - DNA, 15 bp, Homo sapiens
gtgtagaacactaat

SEQ ID NO: 2420341 - DNA, 19 bp, Homo sapiens
gtgtagaacactaattcat

SEQ ID NO: 2420342 - DNA, 13 bp, Homo sapiens
gtgtagccttttt

SEQ ID NO: 2420343 - DNA, 20 bp, Homo sapiens
gtgtagcctttttgtataaa

SEQ ID NO: 2420344 - DNA, 16 bp, Homo sapiens
gtgtagctgtgacctg

SEQ ID NO: 2420345 - DNA, 19 bp, Homo sapiens
gtgtagctgtgacctgctg

SEQ ID NO: 2420346 - DNA, 14 bp, Homo sapiens
gtgtataaacaaga

SEQ ID NO: 2420347 - DNA, 17 bp, Homo sapiens
gtgtataaacaagaaaa

SEQ ID NO: 2420348 - DNA, 17 bp, Homo sapiens
gtgtatttacgctttga

SEQ ID NO: 2420349 - DNA, 18 bp, Homo sapiens
gtgtcacggccaggcaga

SEQ ID NO: 2420350 - DNA, 15 bp, Homo sapiens
gtgtcactcaaggcg

SEQ ID NO: 2420351 - DNA, 17 bp, Homo sapiens
gtgtccaaaaccgccag

SEQ ID NO: 2420352 - DNA, 18 bp, Homo sapiens
gtgtcccagaagatgact

SEQ ID NO: 2420353 - DNA, 18 bp, Homo sapiens
gtgtccccctctgtccag

SEQ ID NO: 2420354 - DNA, 12 bp, Homo sapiens
gtgtcctacaga

SEQ ID NO: 2420355 - DNA, 20 bp, Homo sapiens
gtgtcctcctggggttcttt

SEQ ID NO: 2420356 - DNA, 18 bp, Homo sapiens
gtgtcctcttccctctct

SEQ ID NO: 2420357 - DNA, 13 bp, Homo sapiens
gtgtcctgacact

SEQ ID NO: 2420358 - DNA, 22 bp, Homo sapiens
gtgtcctgagctcagcgtggag

SEQ ID NO: 2420359 - DNA, 17 bp, Homo sapiens
gtgtctaagattctaga

SEQ ID NO: 2420360 - DNA, 12 bp, Homo sapiens
gtgtctcaggct

SEQ ID NO: 2420361 - DNA, 14 bp, Homo sapiens
gtgtctcaggctgc

SEQ ID NO: 2420362 - DNA, 19 bp, Homo sapiens
gtgtctcaggctgcctgag

SEQ ID NO: 2420363 - DNA, 14 bp, Homo sapiens
gtgtcttaattatt

SEQ ID NO: 2420364 - DNA, 17 bp, Homo sapiens
gtgtctttagatagccc

SEQ ID NO: 2420365 - DNA, 16 bp, Homo sapiens
gtgtctttttttgtat

SEQ ID NO: 2420366 - DNA, 20 bp, Homo sapiens
gtgtgaaactttcattcctt

SEQ ID NO: 2420367 - DNA, 21 bp, Homo sapiens
gtgtgaatcggcgacggagca

SEQ ID NO: 2420368 - DNA, 13 bp, Homo sapiens
gtgtgaatgaaca

SEQ ID NO: 2420369 - DNA, 15 bp, Homo sapiens
gtgtgaatgaacact

SEQ ID NO: 2420370 - DNA, 12 bp, Homo sapiens
gtgtgaggccag

SEQ ID NO: 2420371 - DNA, 15 bp, Homo sapiens
gtgtgaggccagggc

SEQ ID NO: 2420372 - DNA, 14 bp, Homo sapiens
gtgtgatcgtctga

SEQ ID NO: 2420373 - DNA, 16 bp, Homo sapiens
gtgtgcaccagggttg

SEQ ID NO: 2420374 - DNA, 16 bp, Homo sapiens
gtgtgcccccttcaag

SEQ ID NO: 2420375 - DNA, 16 bp, Homo sapiens
gtgtgccctctgggct

SEQ ID NO: 2420376 - DNA, 21 bp, Homo sapiens
gtgtgctctccattctgctcc

SEQ ID NO: 2420377 - DNA, 23 bp, Homo sapiens
gtgtgctctccattctgctcctt

SEQ ID NO: 2420378 - DNA, 11 bp, Homo sapiens
gtgtgctggga

SEQ ID NO: 2420379 - DNA, 13 bp, Homo sapiens
gtgtggacaggac

SEQ ID NO: 2420380 - DNA, 20 bp, Homo sapiens
gtgtggagagggaatgtgaa

SEQ ID NO: 2420381 - DNA, 21 bp, Homo sapiens
gtgtggagagggaatgtgaaa

SEQ ID NO: 2420382 - DNA, 11 bp, Homo sapiens
gtgtgggagac

SEQ ID NO: 2420383 - DNA, 18 bp, Homo sapiens
gtgtgtccccctctgtcc

SEQ ID NO: 2420384 - DNA, 14 bp, Homo sapiens
gtgtgtgccctctg

SEQ ID NO: 2420385 - DNA, 17 bp, Homo sapiens
gtgtgttaagctctgct

SEQ ID NO: 2420386 - DNA, 22 bp, Homo sapiens
gtgtgttgatactgttgcacgt

SEQ ID NO: 2420387 - DNA, 23 bp, Homo sapiens
gtgtgttgatactgttgcacgtg

SEQ ID NO: 2420388 - DNA, 16 bp, Homo sapiens
gtgtgtttttctatta

SEQ ID NO: 2420389 - DNA, 21 bp, Homo sapiens
gtgtgtttttctattaaaaga

SEQ ID NO: 2420390 - DNA, 12 bp, Homo sapiens
gtgttaattttt

SEQ ID NO: 2420391 - DNA, 15 bp, Homo sapiens
gtgttaatttttgat

SEQ ID NO: 2420392 - DNA, 15 bp, Homo sapiens
gtgttactgtaattc

SEQ ID NO: 2420393 - DNA, 19 bp, Homo sapiens
gtgttactgtaattcctca

SEQ ID NO: 2420394 - DNA, 21 bp, Homo sapiens
gtgttagccttttttccccag

SEQ ID NO: 2420395 - DNA, 22 bp, Homo sapiens
gtgttagggaagggcctgccac

SEQ ID NO: 2420396 - DNA, 23 bp, Homo sapiens
gtgttagggaagggcctgccaca

SEQ ID NO: 2420397 - DNA, 19 bp, Homo sapiens
gtgttccccttccactgag

SEQ ID NO: 2420398 - DNA, 13 bp, Homo sapiens
gtctcagcctccc

SEQ ID NO: 2420399 - DNA, 13 bp, Homo sapiens
gtctcaggctgcc

SEQ ID NO: 2420400 - DNA, 16 bp, Homo sapiens
gtctcaggctgcctga

SEQ ID NO: 2420401 - DNA, 16 bp, Homo sapiens
gtctcagtgaagacta

SEQ ID NO: 2420402 - DNA, 14 bp, Homo sapiens
gtctcagtttcttg

SEQ ID NO: 2420403 - DNA, 21 bp, Homo sapiens
gtctcagtttgtgtgtcttaa

SEQ ID NO: 2420404 - DNA, 15 bp, Homo sapiens
gtctcatctggggag

SEQ ID NO: 2420405 - DNA, 16 bp, Homo sapiens
gtctccaggggctgct

SEQ ID NO: 2420406 - DNA, 21 bp, Homo sapiens
gtctccaggggctgcttcctc

SEQ ID NO: 2420407 - DNA, 23 bp, Homo sapiens
gtctccaggggctgcttcctcct

SEQ ID NO: 2420408 - DNA, 14 bp, Homo sapiens
gtctccatggccct

SEQ ID NO: 2420409 - DNA, 16 bp, Homo sapiens
gtctcctaagcacctg

SEQ ID NO: 2420410 - DNA, 17 bp, Homo sapiens
gtctcgagcgccctgca

SEQ ID NO: 2420411 - DNA, 19 bp, Homo sapiens
gtctcgagcgccctgcaga

SEQ ID NO: 2420412 - DNA, 15 bp, Homo sapiens
gtctcggccttcaca

SEQ ID NO: 2420413 - DNA, 14 bp, Homo sapiens
gtctcgtctctttt

SEQ ID NO: 2420414 - DNA, 18 bp, Homo sapiens
gtctctagagcagggatt

SEQ ID NO: 2420415 - DNA, 18 bp, Homo sapiens
gtctctcagggccaggcc

SEQ ID NO: 2420416 - DNA, 22 bp, Homo sapiens
gtctctcgtagtgttaagttat

SEQ ID NO: 2420417 - DNA, 15 bp, Homo sapiens
gtctctcttctctcc

SEQ ID NO: 2420418 - DNA, 20 bp, Homo sapiens
gtctctcttctctccagctg

SEQ ID NO: 2420419 - DNA, 23 bp, Homo sapiens
gtctctcttctctccagctgact

SEQ ID NO: 2420420 - DNA, 19 bp, Homo sapiens
gtctctgatgcagcttata

SEQ ID NO: 2420421 - DNA, 13 bp, Homo sapiens
gtctctgctggcc

SEQ ID NO: 2420422 - DNA, 17 bp, Homo sapiens
gtctctgctggcccagc

SEQ ID NO: 2420423 - DNA, 20 bp, Homo sapiens
gtctctgctggcccagccaa

SEQ ID NO: 2420424 - DNA, 22 bp, Homo sapiens
gtctctgttttacaagttggag

SEQ ID NO: 2420425 - DNA, 23 bp, Homo sapiens
gtctcttatggatgtccccagca

SEQ ID NO: 2420426 - DNA, 18 bp, Homo sapiens
gtctcttgcctgccactg

SEQ ID NO: 2420427 - DNA, 21 bp, Homo sapiens
gtctcttttaccctggcccct

SEQ ID NO: 2420428 - DNA, 19 bp, Homo sapiens
gtctgactttcttttttga

SEQ ID NO: 2420429 - DNA, 15 bp, Homo sapiens
gtctgaggtcctgag

SEQ ID NO: 2420430 - DNA, 18 bp, Homo sapiens
gtctgaggtcctgagcac

SEQ ID NO: 2420431 - DNA, 19 bp, Homo sapiens
gtctgaggtcctgagcact

SEQ ID NO: 2420432 - DNA, 21 bp, Homo sapiens
gtctgaggtcctgagcactgc

SEQ ID NO: 2420433 - DNA, 17 bp, Homo sapiens
gtctgccacccaggatc

SEQ ID NO: 2420434 - DNA, 10 bp, Homo sapiens
gtctgccagg

SEQ ID NO: 2420435 - DNA, 21 bp, Homo sapiens
gtctgccagggcccctctccc

SEQ ID NO: 2420436 - DNA, 22 bp, Homo sapiens
gtctgctctttctctgccagtg

SEQ ID NO: 2420437 - DNA, 16 bp, Homo sapiens
gtctgctgttccagtg

SEQ ID NO: 2420438 - DNA, 21 bp, Homo sapiens
gtctggagaccaccagggcat

SEQ ID NO: 2420439 - DNA, 18 bp, Homo sapiens
gtctggcaatgccacagc

SEQ ID NO: 2420440 - DNA, 19 bp, Homo sapiens
gtctggcagtttatattta

SEQ ID NO: 2420441 - DNA, 15 bp, Homo sapiens
gtctggcccaccagg

SEQ ID NO: 2420442 - DNA, 14 bp, Homo sapiens
gtctgggtgctact

SEQ ID NO: 2420443 - DNA, 17 bp, Homo sapiens
gtctgggtggctcactc

SEQ ID NO: 2420444 - DNA, 23 bp, Homo sapiens
gtctgggtggggcccaggcccgg

SEQ ID NO: 2420445 - DNA, 13 bp, Homo sapiens
gtctggtggcccc

SEQ ID NO: 2420446 - DNA, 20 bp, Homo sapiens
gtctggtggccccgtttctg

SEQ ID NO: 2420447 - DNA, 19 bp, Homo sapiens
gtctgtgccccttccgcca

SEQ ID NO: 2420448 - DNA, 20 bp, Homo sapiens
gtctgtgccccttccgccac

SEQ ID NO: 2420449 - DNA, 19 bp, Homo sapiens
gtctgttgattaaagatga

SEQ ID NO: 2420450 - DNA, 18 bp, Homo sapiens
gtctgttggcaggctggc

SEQ ID NO: 2420451 - DNA, 13 bp, Homo sapiens
gtctgtttactgc

SEQ ID NO: 2420452 - DNA, 16 bp, Homo sapiens
gtcttattcccttcct

SEQ ID NO: 2420453 - DNA, 12 bp, Homo sapiens
gtcttcctgagt

SEQ ID NO: 2420454 - DNA, 17 bp, Homo sapiens
gtcttcttacttggaac

SEQ ID NO: 2420455 - DNA, 14 bp, Homo sapiens
gtcttgagctctat

SEQ ID NO: 2420456 - DNA, 18 bp, Homo sapiens
gtcttgatgaccaaagtc

SEQ ID NO: 2420457 - DNA, 17 bp, Homo sapiens
gtcttggaacttgcctg

SEQ ID NO: 2420458 - DNA, 22 bp, Homo sapiens
gtcttggaacttgcctgccttt

SEQ ID NO: 2420459 - DNA, 16 bp, Homo sapiens
gtctttagatagccct

SEQ ID NO: 2420460 - DNA, 21 bp, Homo sapiens
gtctttagatagccctgtcct

SEQ ID NO: 2420461 - DNA, 22 bp, Homo sapiens
gtctttagatagccctgtcctg

SEQ ID NO: 2420462 - DNA, 16 bp, Homo sapiens
gtctttcacagctcct

SEQ ID NO: 2420463 - DNA, 20 bp, Homo sapiens
gtctttccattggatctcat

SEQ ID NO: 2420464 - DNA, 14 bp, Homo sapiens
gtctttctctctca

SEQ ID NO: 2420465 - DNA, 22 bp, Homo sapiens
gtcttttgcttttgcccatttt

SEQ ID NO: 2420466 - DNA, 19 bp, Homo sapiens
gtgaaaacacatttgcttt

SEQ ID NO: 2420467 - DNA, 22 bp, Homo sapiens
gtgaaatttacatcatttcttt

SEQ ID NO: 2420468 - DNA, 18 bp, Homo sapiens
gtgaacaaagcagccacg

SEQ ID NO: 2420469 - DNA, 13 bp, Homo sapiens
gtgaacccaggac

SEQ ID NO: 2420470 - DNA, 14 bp, Homo sapiens
gtgaagaatacttc

SEQ ID NO: 2420471 - DNA, 21 bp, Homo sapiens
gtgaagaatgcacaagaatgg

SEQ ID NO: 2420472 - DNA, 15 bp, Homo sapiens
gtgaagttgctgctt

SEQ ID NO: 2420473 - DNA, 16 bp, Homo sapiens
gtgaataaatgtcttg

SEQ ID NO: 2420474 - DNA, 21 bp, Homo sapiens
gtgaatactgctacagcaatt

SEQ ID NO: 2420475 - DNA, 13 bp, Homo sapiens
gtgaatcaagggt

SEQ ID NO: 2420476 - DNA, 21 bp, Homo sapiens
gtgaatcaagggtcaggcctt

SEQ ID NO: 2420477 - DNA, 14 bp, Homo sapiens
gtgacaataaaaca

SEQ ID NO: 2420478 - DNA, 15 bp, Homo sapiens
gtgacagacaggctc

SEQ ID NO: 2420479 - DNA, 19 bp, Homo sapiens
gtgacatcggaaaaataat

SEQ ID NO: 2420480 - DNA, 14 bp, Homo sapiens
gtgacccacatgcc

SEQ ID NO: 2420481 - DNA, 13 bp, Homo sapiens
gtgaccccagggc

SEQ ID NO: 2420482 - DNA, 23 bp, Homo sapiens
gtgacccggcaccccctgcagct

SEQ ID NO: 2420483 - DNA, 21 bp, Homo sapiens
gtgaccggacttttctgcaaa

SEQ ID NO: 2420484 - DNA, 13 bp, Homo sapiens
gtgacctgctagg

SEQ ID NO: 2420485 - DNA, 19 bp, Homo sapiens
gtgacctgctgagctctga

SEQ ID NO: 2420486 - DNA, 21 bp, Homo sapiens
gtgacctgctgagctctgaga

SEQ ID NO: 2420487 - DNA, 11 bp, Homo sapiens
gtgacttctga

SEQ ID NO: 2420488 - DNA, 23 bp, Homo sapiens
gtgacttgtgtcccatgatccct

SEQ ID NO: 2420489 - DNA, 22 bp, Homo sapiens
gtgagaacctgggttgcagaca

SEQ ID NO: 2420490 - DNA, 21 bp, Homo sapiens
gtgagaagtgaatgctgggac

SEQ ID NO: 2420491 - DNA, 22 bp, Homo sapiens
gtgagaagtgaatgctgggact

SEQ ID NO: 2420492 - DNA, 13 bp, Homo sapiens
gtgagcatgtttg

SEQ ID NO: 2420493 - DNA, 19 bp, Homo sapiens
gtgagcatgtttggaaggg

SEQ ID NO: 2420494 - DNA, 15 bp, Homo sapiens
gtgagcccagctggg

SEQ ID NO: 2420495 - DNA, 12 bp, Homo sapiens
gtgaggcagccg

SEQ ID NO: 2420496 - DNA, 19 bp, Homo sapiens
gtgaggcagccgaggtccc

SEQ ID NO: 2420497 - DNA, 16 bp, Homo sapiens
gtgaggctgtcctgta

SEQ ID NO: 2420498 - DNA, 22 bp, Homo sapiens
gtgagtctctctgggccttagg

SEQ ID NO: 2420499 - DNA, 19 bp, Homo sapiens
gtgagtctttggttctaag

SEQ ID NO: 2420500 - DNA, 11 bp, Homo sapiens
gtgagtggagt

SEQ ID NO: 2420501 - DNA, 13 bp, Homo sapiens
gtgagttctccct

SEQ ID NO: 2420502 - DNA, 23 bp, Homo sapiens
gtgttccccttccactgagggca

SEQ ID NO: 2420503 - DNA, 22 bp, Homo sapiens
gtgttctattgctgagaagcaa

SEQ ID NO: 2420504 - DNA, 22 bp, Homo sapiens
gtgttctcctgctgctccctca

SEQ ID NO: 2420505 - DNA, 15 bp, Homo sapiens
gtgttctgttttgtt

SEQ ID NO: 2420506 - DNA, 20 bp, Homo sapiens
gtgttgccaaatatgtcctg

SEQ ID NO: 2420507 - DNA, 14 bp, Homo sapiens
gtgttgccaagctc

SEQ ID NO: 2420508 - DNA, 12 bp, Homo sapiens
gtgttgtctcta

SEQ ID NO: 2420509 - DNA, 13 bp, Homo sapiens
gtgtttcacagtt

SEQ ID NO: 2420510 - DNA, 14 bp, Homo sapiens
gtgtttccatctca

SEQ ID NO: 2420511 - DNA, 13 bp, Homo sapiens
gtgtttgctttct

SEQ ID NO: 2420512 - DNA, 16 bp, Homo sapiens
gtgttttaattgtaaa

SEQ ID NO: 2420513 - DNA, 15 bp, Homo sapiens
gtgttttaatttaaa

SEQ ID NO: 2420514 - DNA, 16 bp, Homo sapiens
gtgttttgttcaccat

SEQ ID NO: 2420515 - DNA, 18 bp, Homo sapiens
gtgtttttctattaaaag

SEQ ID NO: 2420516 - DNA, 19 bp, Homo sapiens
gtgtttttctattaaaaga

SEQ ID NO: 2420517 - DNA, 23 bp, Homo sapiens
gtgtttttctattaaaagactca

SEQ ID NO: 2420518 - DNA, 12 bp, Homo sapiens
gttaaatgtaga

SEQ ID NO: 2420519 - DNA, 23 bp, Homo sapiens
gttaacattccaagactctagag

SEQ ID NO: 2420520 - DNA, 24 bp, Homo sapiens
gttaacattccaagactctagagt

SEQ ID NO: 2420521 - DNA, 14 bp, Homo sapiens
gttaactgaatacc

SEQ ID NO: 2420522 - DNA, 14 bp, Homo sapiens
gttaagaaaataaa

SEQ ID NO: 2420523 - DNA, 15 bp, Homo sapiens
gttaagaaaataaat

SEQ ID NO: 2420524 - DNA, 15 bp, Homo sapiens
gttaagaaatttcac

SEQ ID NO: 2420525 - DNA, 13 bp, Homo sapiens
gttaagacctggc

SEQ ID NO: 2420526 - DNA, 14 bp, Homo sapiens
gttaagacctggca

SEQ ID NO: 2420527 - DNA, 15 bp, Homo sapiens
gttaatatttaagac

SEQ ID NO: 2420528 - DNA, 13 bp, Homo sapiens
gttaatcttgctt

SEQ ID NO: 2420529 - DNA, 16 bp, Homo sapiens
gttaatcttgctttct

SEQ ID NO: 2420530 - DNA, 18 bp, Homo sapiens
gttacactttttggaagt

SEQ ID NO: 2420531 - DNA, 14 bp, Homo sapiens
gttacagttctgtg

SEQ ID NO: 2420532 - DNA, 20 bp, Homo sapiens
gttaccttatagttactgtg

SEQ ID NO: 2420533 - DNA, 15 bp, Homo sapiens
gttagagaataaatt

SEQ ID NO: 2420534 - DNA, 18 bp, Homo sapiens
gttagagcaggactgatg

SEQ ID NO: 2420535 - DNA, 13 bp, Homo sapiens
gttagattaagaa

SEQ ID NO: 2420536 - DNA, 12 bp, Homo sapiens
gttagctcctgt

SEQ ID NO: 2420537 - DNA, 15 bp, Homo sapiens
gttagctcctgtggc

SEQ ID NO: 2420538 - DNA, 16 bp, Homo sapiens
gttagctcctgtggcc

SEQ ID NO: 2420539 - DNA, 20 bp, Homo sapiens
gttagggactgaccagcagc

SEQ ID NO: 2420540 - DNA, 14 bp, Homo sapiens
gttagtatcttttg

SEQ ID NO: 2420541 - DNA, 18 bp, Homo sapiens
gttagtatcttttgatat

SEQ ID NO: 2420542 - DNA, 12 bp, Homo sapiens
gttagtcatttg

SEQ ID NO: 2420543 - DNA, 17 bp, Homo sapiens
gttagttaccttatagt

SEQ ID NO: 2420544 - DNA, 22 bp, Homo sapiens
gttagttaccttatagttactg

SEQ ID NO: 2420545 - DNA, 14 bp, Homo sapiens
gttataaagataca

SEQ ID NO: 2420546 - DNA, 14 bp, Homo sapiens
gttataagactctc

SEQ ID NO: 2420547 - DNA, 14 bp, Homo sapiens
gttatatataaata

SEQ ID NO: 2420548 - DNA, 19 bp, Homo sapiens
gttatatataaatatatta

SEQ ID NO: 2420549 - DNA, 14 bp, Homo sapiens
gttatattttgcag

SEQ ID NO: 2420550 - DNA, 17 bp, Homo sapiens
gttatcagtgcttcccg

SEQ ID NO: 2420551 - DNA, 13 bp, Homo sapiens
gttatctctgtgt

SEQ ID NO: 2420552 - DNA, 13 bp, Homo sapiens
gttattgcagttt

SEQ ID NO: 2420553 - DNA, 14 bp, Homo sapiens
gttattgcagttta

SEQ ID NO: 2420554 - DNA, 13 bp, Homo sapiens
gttatttaaagaa

SEQ ID NO: 2420555 - DNA, 13 bp, Homo sapiens
gttattttgcaac

SEQ ID NO: 2420556 - DNA, 16 bp, Homo sapiens
gttattttttaattat

SEQ ID NO: 2420557 - DNA, 21 bp, Homo sapiens
gttattttttaattattattt

SEQ ID NO: 2420558 - DNA, 13 bp, Homo sapiens
gttcaaagccagc

SEQ ID NO: 2420559 - DNA, 14 bp, Homo sapiens
gttcaaagctgcct

SEQ ID NO: 2420560 - DNA, 21 bp, Homo sapiens
gttcaatataagcttttcttt

SEQ ID NO: 2420561 - DNA, 12 bp, Homo sapiens
gttcaatatttt

SEQ ID NO: 2420562 - DNA, 20 bp, Homo sapiens
gttcagaattaaacttttaa

SEQ ID NO: 2420563 - DNA, 19 bp, Homo sapiens
gttcagagtccttaaaatg

SEQ ID NO: 2420564 - DNA, 16 bp, Homo sapiens
gttcagcactgtccct

SEQ ID NO: 2420565 - DNA, 18 bp, Homo sapiens
gttcagcactgtcccttg

SEQ ID NO: 2420566 - DNA, 22 bp, Homo sapiens
gttcagcgctgtcaggattgcg

SEQ ID NO: 2420567 - DNA, 22 bp, Homo sapiens
gttcatatgtaccatgtacatg

SEQ ID NO: 2420568 - DNA, 16 bp, Homo sapiens
gttcatgtaaataata

SEQ ID NO: 2420569 - DNA, 12 bp, Homo sapiens
gttccactgaga

SEQ ID NO: 2420570 - DNA, 18 bp, Homo sapiens
gttccacttatagcctct

SEQ ID NO: 2420571 - DNA, 14 bp, Homo sapiens
gttccagaaagtaa

SEQ ID NO: 2420572 - DNA, 17 bp, Homo sapiens
gttccagaagtgtgact

SEQ ID NO: 2420573 - DNA, 20 bp, Homo sapiens
gttccagggtccctctgtgt

SEQ ID NO: 2420574 - DNA, 21 bp, Homo sapiens
gttccagggtccctctgtgta

SEQ ID NO: 2420575 - DNA, 21 bp, Homo sapiens
gttcccaagagcatcatgcct

SEQ ID NO: 2420576 - DNA, 23 bp, Homo sapiens
gttcccaagagcatcatgcctct

SEQ ID NO: 2420577 - DNA, 17 bp, Homo sapiens
gttcccacattaaagaa

SEQ ID NO: 2420578 - DNA, 13 bp, Homo sapiens
gttccccactgga

SEQ ID NO: 2420579 - DNA, 14 bp, Homo sapiens
gttccccactggag

SEQ ID NO: 2420580 - DNA, 17 bp, Homo sapiens
gttccccactggagcag

SEQ ID NO: 2420581 - DNA, 20 bp, Homo sapiens
gttccccactgtatctaggc

SEQ ID NO: 2420582 - DNA, 22 bp, Homo sapiens
gttccccttccactgagggcag

SEQ ID NO: 2420583 - DNA, 17 bp, Homo sapiens
gttccttcccaatccag

SEQ ID NO: 2420584 - DNA, 20 bp, Homo sapiens
gttcgcagccaccctgagga

SEQ ID NO: 2420585 - DNA, 14 bp, Homo sapiens
gttcgcatggtcac

SEQ ID NO: 2420586 - DNA, 14 bp, Homo sapiens
gttctaaagttcta

SEQ ID NO: 2420587 - DNA, 18 bp, Homo sapiens
gttctaaagttctaagat

SEQ ID NO: 2420588 - DNA, 13 bp, Homo sapiens
gttctaacctcct

SEQ ID NO: 2420589 - DNA, 16 bp, Homo sapiens
gttctaacctttacat

SEQ ID NO: 2420590 - DNA, 15 bp, Homo sapiens
gttctaagactcaaa

SEQ ID NO: 2420591 - DNA, 13 bp, Homo sapiens
gttctaagatgtg

SEQ ID NO: 2420592 - DNA, 21 bp, Homo sapiens
gttctaagatgtgatattcta

SEQ ID NO: 2420593 - DNA, 22 bp, Homo sapiens
gttctaagatgtgatattctaa

SEQ ID NO: 2420594 - DNA, 13 bp, Homo sapiens
gttctaagattct

SEQ ID NO: 2420595 - DNA, 14 bp, Homo sapiens
gttctaagattctg

SEQ ID NO: 2420596 - DNA, 15 bp, Homo sapiens
gttctaagattctga

SEQ ID NO: 2420597 - DNA, 22 bp, Homo sapiens
gttctaaggcctaggattctaa

SEQ ID NO: 2420598 - DNA, 12 bp, Homo sapiens
gttctaaggctc

SEQ ID NO: 2420599 - DNA, 16 bp, Homo sapiens
gttctaaggctctgag

SEQ ID NO: 2420600 - DNA, 16 bp, Homo sapiens
gttctaagtctttcca

SEQ ID NO: 2420601 - DNA, 15 bp, Homo sapiens
gttctaagtttctaa

SEQ ID NO: 2420602 - DNA, 17 bp, Homo sapiens
gttctaagtttctaaga

SEQ ID NO: 2420603 - DNA, 17 bp, Homo sapiens
gttctaataatttctaa

SEQ ID NO: 2420604 - DNA, 20 bp, Homo sapiens
gttctacctcaggcagctca

SEQ ID NO: 2420605 - DNA, 21 bp, Homo sapiens
gttctacctcaggcagctcaa

SEQ ID NO: 2420606 - DNA, 14 bp, Homo sapiens
gttctagaaaaaca

SEQ ID NO: 2420607 - DNA, 18 bp, Homo sapiens
gttctagaaaaacaggca

SEQ ID NO: 2420608 - DNA, 14 bp, Homo sapiens
gctgctacttatat

SEQ ID NO: 2420609 - DNA, 20 bp, Homo sapiens
gctgctagagtgactcacta

SEQ ID NO: 2420610 - DNA, 13 bp, Homo sapiens
gctgctccctcag

SEQ ID NO: 2420611 - DNA, 14 bp, Homo sapiens
gctgctccctcaga

SEQ ID NO: 2420612 - DNA, 21 bp, Homo sapiens
gctgctcggggtgcacaggag

SEQ ID NO: 2420613 - DNA, 15 bp, Homo sapiens
gctgctcttggctgg

SEQ ID NO: 2420614 - DNA, 23 bp, Homo sapiens
gctgctcttggctggacccagcc

SEQ ID NO: 2420615 - DNA, 16 bp, Homo sapiens
gctgctgagaacctgg

SEQ ID NO: 2420616 - DNA, 21 bp, Homo sapiens
gctgctgagaacctggccttc

SEQ ID NO: 2420617 - DNA, 18 bp, Homo sapiens
gctgctgcccatgtttca

SEQ ID NO: 2420618 - DNA, 16 bp, Homo sapiens
gctgctgggctcagtg

SEQ ID NO: 2420619 - DNA, 20 bp, Homo sapiens
gctgctggggaagacagtgg

SEQ ID NO: 2420620 - DNA, 21 bp, Homo sapiens
gctgctggggaagacagtggc

SEQ ID NO: 2420621 - DNA, 15 bp, Homo sapiens
gctgctgtccctccc

SEQ ID NO: 2420622 - DNA, 14 bp, Homo sapiens
gcttcatgccagct

SEQ ID NO: 2420623 - DNA, 15 bp, Homo sapiens
gcttcatgtgtccca

SEQ ID NO: 2420624 - DNA, 18 bp, Homo sapiens
gcttcccatccccagcga

SEQ ID NO: 2420625 - DNA, 15 bp, Homo sapiens
gcttccctgaagctc

SEQ ID NO: 2420626 - DNA, 18 bp, Homo sapiens
gcttccctgactcattct

SEQ ID NO: 2420627 - DNA, 14 bp, Homo sapiens
gcttcctgcttgcc

SEQ ID NO: 2420628 - DNA, 14 bp, Homo sapiens
gcttcctggtgctg

SEQ ID NO: 2420629 - DNA, 18 bp, Homo sapiens
gcttcgggcccttcccac

SEQ ID NO: 2420630 - DNA, 16 bp, Homo sapiens
gcttctaagtaaatac

SEQ ID NO: 2420631 - DNA, 18 bp, Homo sapiens
gcttctaagtaaatacaa

SEQ ID NO: 2420632 - DNA, 11 bp, Homo sapiens
gcttctcccag

SEQ ID NO: 2420633 - DNA, 20 bp, Homo sapiens
gcttctcccaggcaaggctg

SEQ ID NO: 2420634 - DNA, 13 bp, Homo sapiens
gcttctcctctcc

SEQ ID NO: 2420635 - DNA, 14 bp, Homo sapiens
gcttctctgacttc

SEQ ID NO: 2420636 - DNA, 17 bp, Homo sapiens
gcttctctgacttctgc

SEQ ID NO: 2420637 - DNA, 22 bp, Homo sapiens
gcttctctgacttctgcctgga

SEQ ID NO: 2420638 - DNA, 22 bp, Homo sapiens
gcttctgagcagcgagcctgct

SEQ ID NO: 2420639 - DNA, 17 bp, Homo sapiens
gcttctgccccctgcag

SEQ ID NO: 2420640 - DNA, 15 bp, Homo sapiens
gcttctgctggggcc

SEQ ID NO: 2420641 - DNA, 18 bp, Homo sapiens
gcttctgctggggcctgg

SEQ ID NO: 2420642 - DNA, 20 bp, Homo sapiens
gcttctgctggggcctggga

SEQ ID NO: 2420643 - DNA, 22 bp, Homo sapiens
gcttctgctggggcctgggaca

SEQ ID NO: 2420644 - DNA, 15 bp, Homo sapiens
gcttctgtcctgccc

SEQ ID NO: 2420645 - DNA, 16 bp, Homo sapiens
gcttctgtcctgcccc

SEQ ID NO: 2420646 - DNA, 18 bp, Homo sapiens
gcttcttgcctctgtgct

SEQ ID NO: 2420647 - DNA, 21 bp, Homo sapiens
gcttcttgcctctgtgctgtg

SEQ ID NO: 2420648 - DNA, 19 bp, Homo sapiens
gcttgaaacccgtggcgct

SEQ ID NO: 2420649 - DNA, 20 bp, Homo sapiens
gcttgagaaatatggacact

SEQ ID NO: 2420650 - DNA, 19 bp, Homo sapiens
gcttgatgggattctggac

SEQ ID NO: 2420651 - DNA, 15 bp, Homo sapiens
gcttgccaaggcaga

SEQ ID NO: 2420652 - DNA, 21 bp, Homo sapiens
gcttgccctaagcagaaagtg

SEQ ID NO: 2420653 - DNA, 14 bp, Homo sapiens
gcttgctattctgt

SEQ ID NO: 2420654 - DNA, 18 bp, Homo sapiens
gcttgctattctgtccct

SEQ ID NO: 2420655 - DNA, 20 bp, Homo sapiens
gcttgctattctgtccctag

SEQ ID NO: 2420656 - DNA, 17 bp, Homo sapiens
gcttggccacagccagg

SEQ ID NO: 2420657 - DNA, 14 bp, Homo sapiens
gcttgggcctaggc

SEQ ID NO: 2420658 - DNA, 18 bp, Homo sapiens
gcttgggcctaggctgca

SEQ ID NO: 2420659 - DNA, 16 bp, Homo sapiens
gcttggggctcacaca

SEQ ID NO: 2420660 - DNA, 14 bp, Homo sapiens
gcttggggggtgat

SEQ ID NO: 2420661 - DNA, 16 bp, Homo sapiens
gcttggttccttccca

SEQ ID NO: 2420662 - DNA, 22 bp, Homo sapiens
gcttgtaactaaaataattttg

SEQ ID NO: 2420663 - DNA, 13 bp, Homo sapiens
gcttgtagccagc

SEQ ID NO: 2420664 - DNA, 17 bp, Homo sapiens
gcttgtagccagccggg

SEQ ID NO: 2420665 - DNA, 20 bp, Homo sapiens
gcttgtctcttgcctgccac

SEQ ID NO: 2420666 - DNA, 22 bp, Homo sapiens
gcttgtctcttgcctgccactg

SEQ ID NO: 2420667 - DNA, 23 bp, Homo sapiens
gcttgtctcttgcctgccactgt

SEQ ID NO: 2420668 - DNA, 18 bp, Homo sapiens
gcttgtggggcctgggag

SEQ ID NO: 2420669 - DNA, 19 bp, Homo sapiens
gcttgtggggcctgggagg

SEQ ID NO: 2420670 - DNA, 16 bp, Homo sapiens
gcttgttgtgctttta

SEQ ID NO: 2420671 - DNA, 16 bp, Homo sapiens
gcttgtttacatgctt

SEQ ID NO: 2420672 - DNA, 17 bp, Homo sapiens
gcttgtttgatttcaac

SEQ ID NO: 2420673 - DNA, 20 bp, Homo sapiens
gcttgtttgatttcaacatg

SEQ ID NO: 2420674 - DNA, 17 bp, Homo sapiens
gctttaatataaatgca

SEQ ID NO: 2420675 - DNA, 16 bp, Homo sapiens
gctttagaatcccagc

SEQ ID NO: 2420676 - DNA, 21 bp, Homo sapiens
gctttatgataatagattctc

SEQ ID NO: 2420677 - DNA, 19 bp, Homo sapiens
gctttctgaacagctggtg

SEQ ID NO: 2420678 - DNA, 16 bp, Homo sapiens
gctttctgttccaaat

SEQ ID NO: 2420679 - DNA, 15 bp, Homo sapiens
gctttgactcaggag

SEQ ID NO: 2420680 - DNA, 16 bp, Homo sapiens
gctttgactcaggagc

SEQ ID NO: 2420681 - DNA, 22 bp, Homo sapiens
gctttgagagagaaaggactcc

SEQ ID NO: 2420682 - DNA, 12 bp, Homo sapiens
gctttgattcat

SEQ ID NO: 2420683 - DNA, 20 bp, Homo sapiens
gctttgattcatagtaactt

SEQ ID NO: 2420684 - DNA, 21 bp, Homo sapiens
gctttggaagtttagctctga

SEQ ID NO: 2420685 - DNA, 14 bp, Homo sapiens
gcttttaaaagatt

SEQ ID NO: 2420686 - DNA, 19 bp, Homo sapiens
gcttttaacagagtctgaa

SEQ ID NO: 2420687 - DNA, 21 bp, Homo sapiens
gcttttagtattttagtgaac

SEQ ID NO: 2420688 - DNA, 15 bp, Homo sapiens
gcttttattaatgca

SEQ ID NO: 2420689 - DNA, 22 bp, Homo sapiens
gcttttattaatgcactttcta

SEQ ID NO: 2420690 - DNA, 13 bp, Homo sapiens
gcttttcaaacaa

SEQ ID NO: 2420691 - DNA, 18 bp, Homo sapiens
gcttttcatgcaaactct

SEQ ID NO: 2420692 - DNA, 20 bp, Homo sapiens
gcttttgcccattttgaatc

SEQ ID NO: 2420693 - DNA, 21 bp, Homo sapiens
gcttttggcggggaggaggaa

SEQ ID NO: 2420694 - DNA, 23 bp, Homo sapiens
gcttttgtttcctttttcagata

SEQ ID NO: 2420695 - DNA, 15 bp, Homo sapiens
gctttttatttctgc

SEQ ID NO: 2420696 - DNA, 17 bp, Homo sapiens
gctttttatttctgcat

SEQ ID NO: 2420697 - DNA, 21 bp, Homo sapiens
gctttttatttctgcatatgt

SEQ ID NO: 2420698 - DNA, 17 bp, Homo sapiens
gcttttttgttttggct

SEQ ID NO: 2420699 - DNA, 21 bp, Homo sapiens
gctttttttgtgtgtatttgc

SEQ ID NO: 2420700 - DNA, 19 bp, Homo sapiens
ggaaaaagtgggtttttta

SEQ ID NO: 2420701 - DNA, 10 bp, Homo sapiens
ggaaaagctt

SEQ ID NO: 2420702 - DNA, 13 bp, Homo sapiens
ggaaaaggcctgg

SEQ ID NO: 2420703 - DNA, 17 bp, Homo sapiens
ggaaaaggcctggggtg

SEQ ID NO: 2420704 - DNA, 16 bp, Homo sapiens
ggaaaataatactgct

SEQ ID NO: 2420705 - DNA, 19 bp, Homo sapiens
ggaaaataggcaggaagcc

SEQ ID NO: 2420706 - DNA, 15 bp, Homo sapiens
ggaaacgagactttc

SEQ ID NO: 2420707 - DNA, 17 bp, Homo sapiens
ggaaactcctgtgacca

SEQ ID NO: 2420708 - DNA, 20 bp, Homo sapiens
ggaaagcaaagcacagagag

SEQ ID NO: 2420709 - DNA, 21 bp, Homo sapiens
ggaaagcaaagcacagagagt

SEQ ID NO: 2420710 - DNA, 12 bp, Homo sapiens
ggaaaggccagc

SEQ ID NO: 2420711 - DNA, 16 bp, Homo sapiens
ggaaaggccagcactc

SEQ ID NO: 2420712 - DNA, 19 bp, Homo sapiens
ggaaagtgctgtcttaaac

SEQ ID NO: 2420713 - DNA, 18 bp, Homo sapiens
ggaaatacagttctgctc

SEQ ID NO: 2420714 - DNA, 19 bp, Homo sapiens
ggaaatacagttctgctct

SEQ ID NO: 2420715 - DNA, 18 bp, Homo sapiens
ggaaatctcaccccatcc

SEQ ID NO: 2420716 - DNA, 15 bp, Homo sapiens
ggaacaattgaagta

SEQ ID NO: 2420717 - DNA, 21 bp, Homo sapiens
ggaacaattgaagtaaacttt

SEQ ID NO: 2420718 - DNA, 21 bp, Homo sapiens
ggaacactagacaagccagaa

SEQ ID NO: 2420719 - DNA, 11 bp, Homo sapiens
ggaaccagact

SEQ ID NO: 2420720 - DNA, 14 bp, Homo sapiens
ggaacccctttccc

SEQ ID NO: 2420721 - DNA, 16 bp, Homo sapiens
ggaacccctttcccac

SEQ ID NO: 2420722 - DNA, 13 bp, Homo sapiens
ggaacctcagcct

SEQ ID NO: 2420723 - DNA, 15 bp, Homo sapiens
ggaacctcagcctgg

SEQ ID NO: 2420724 - DNA, 15 bp, Homo sapiens
ggaactcagatccag

SEQ ID NO: 2420725 - DNA, 16 bp, Homo sapiens
ggaactcagatccagg

SEQ ID NO: 2420726 - DNA, 17 bp, Homo sapiens
ggaactcatctggttga

SEQ ID NO: 2420727 - DNA, 12 bp, Homo sapiens
ggaactgaaggg

SEQ ID NO: 2420728 - DNA, 12 bp, Homo sapiens
ggaactgctgcc

SEQ ID NO: 2420729 - DNA, 14 bp, Homo sapiens
ggaactgctgccac

SEQ ID NO: 2420730 - DNA, 15 bp, Homo sapiens
ggaactgctgccact

SEQ ID NO: 2420731 - DNA, 17 bp, Homo sapiens
ggaacttgcctgccttt

SEQ ID NO: 2420732 - DNA, 15 bp, Homo sapiens
ggaagaaagaagaca

SEQ ID NO: 2420733 - DNA, 15 bp, Homo sapiens
ggaagacagtggccc

SEQ ID NO: 2420734 - DNA, 17 bp, Homo sapiens
ggaagacccattccttc

SEQ ID NO: 2420735 - DNA, 16 bp, Homo sapiens
ggaagagcaggactcc

SEQ ID NO: 2420736 - DNA, 19 bp, Homo sapiens
ggaagagccttccacccag

SEQ ID NO: 2420737 - DNA, 22 bp, Homo sapiens
ggaagatggggaccagcagccc

SEQ ID NO: 2420738 - DNA, 18 bp, Homo sapiens
ggaagcagaaatccaagc

SEQ ID NO: 2420739 - DNA, 13 bp, Homo sapiens
ggaagcagcagcc

SEQ ID NO: 2420740 - DNA, 18 bp, Homo sapiens
ggaagcagcagcctcgcc

SEQ ID NO: 2420741 - DNA, 14 bp, Homo sapiens
ggaagccaaagagt

SEQ ID NO: 2420742 - DNA, 20 bp, Homo sapiens
ggaagcccatcctgaccagc

SEQ ID NO: 2420743 - DNA, 13 bp, Homo sapiens
ggaagcccccacc

SEQ ID NO: 2420744 - DNA, 21 bp, Homo sapiens
ggaagcccccaccgtgggcag

SEQ ID NO: 2420745 - DNA, 22 bp, Homo sapiens
ggaagcccccaccgtgggcagg

SEQ ID NO: 2420746 - DNA, 18 bp, Homo sapiens
ggaagctagacacatgaa

SEQ ID NO: 2420747 - DNA, 19 bp, Homo sapiens
ggaagctagtcttttgctt

SEQ ID NO: 2420748 - DNA, 14 bp, Homo sapiens
ggaaggagctgcct

SEQ ID NO: 2420749 - DNA, 17 bp, Homo sapiens
ggaaggaggagcctgtc

SEQ ID NO: 2420750 - DNA, 16 bp, Homo sapiens
ggaaggattctgctgg

SEQ ID NO: 2420751 - DNA, 19 bp, Homo sapiens
ggaaggattctgctggcct

SEQ ID NO: 2420752 - DNA, 11 bp, Homo sapiens
ggaaggcaggc

SEQ ID NO: 2420753 - DNA, 12 bp, Homo sapiens
ggaaggcaggca

SEQ ID NO: 2420754 - DNA, 14 bp, Homo sapiens
ggaaggcaggcagg

SEQ ID NO: 2420755 - DNA, 15 bp, Homo sapiens
ggaaggcaggcaggg

SEQ ID NO: 2420756 - DNA, 17 bp, Homo sapiens
ggaaggcaggcagggct

SEQ ID NO: 2420757 - DNA, 21 bp, Homo sapiens
ggaaggcaggcagggctctcc

SEQ ID NO: 2420758 - DNA, 19 bp, Homo sapiens
ggaaggctacttcggggct

SEQ ID NO: 2420759 - DNA, 20 bp, Homo sapiens
ggaaggctacttcggggctg

SEQ ID NO: 2420760 - DNA, 23 bp, Homo sapiens
ggaaggctacttcggggctggga

SEQ ID NO: 2420761 - DNA, 21 bp, Homo sapiens
ggaagggagccaagggatgga

SEQ ID NO: 2420762 - DNA, 14 bp, Homo sapiens
ggaagggtaaacaa

SEQ ID NO: 2420763 - DNA, 15 bp, Homo sapiens
ggaagggtaaacaat

SEQ ID NO: 2420764 - DNA, 17 bp, Homo sapiens
ggaatactttttgttat

SEQ ID NO: 2420765 - DNA, 17 bp, Homo sapiens
ggaatagcatgtcacta

SEQ ID NO: 2420766 - DNA, 24 bp, Homo sapiens
ggaatcatttctatttctcctcca

SEQ ID NO: 2420767 - DNA, 14 bp, Homo sapiens
ggaatggcagcagg

SEQ ID NO: 2420768 - DNA, 19 bp, Homo sapiens
ggaattgatttgcattgaa

SEQ ID NO: 2420769 - DNA, 14 bp, Homo sapiens
ggaatttcccagga

SEQ ID NO: 2420770 - DNA, 15 bp, Homo sapiens
ggaatttcccaggac

SEQ ID NO: 2420771 - DNA, 18 bp, Homo sapiens
ggaatttcttaacttctt

SEQ ID NO: 2420772 - DNA, 16 bp, Homo sapiens
ggaatttgcctgctgg

SEQ ID NO: 2420773 - DNA, 14 bp, Homo sapiens
ggacaaagaacctt

SEQ ID NO: 2420774 - DNA, 21 bp, Homo sapiens
ggacaactgctcccacctcct

SEQ ID NO: 2420775 - DNA, 22 bp, Homo sapiens
ggacaactgctcccacctcctg

SEQ ID NO: 2420776 - DNA, 23 bp, Homo sapiens
ggacaactgctcccacctcctga

SEQ ID NO: 2420777 - DNA, 12 bp, Homo sapiens
ggacacaggcct

SEQ ID NO: 2420778 - DNA, 22 bp, Homo sapiens
ggacacgctcagtggggcagag

SEQ ID NO: 2420779 - DNA, 23 bp, Homo sapiens
ggacacgctcagtggggcagagg

SEQ ID NO: 2420780 - DNA, 21 bp, Homo sapiens
ggacacgggcctgtccacagg

SEQ ID NO: 2420781 - DNA, 16 bp, Homo sapiens
ggacacttaatactac

SEQ ID NO: 2420782 - DNA, 14 bp, Homo sapiens
ggacagaggcccca

SEQ ID NO: 2420783 - DNA, 15 bp, Homo sapiens
ggacagaggccccag

SEQ ID NO: 2420784 - DNA, 14 bp, Homo sapiens
ggacagccccaccc

SEQ ID NO: 2420785 - DNA, 16 bp, Homo sapiens
ggacagccgcctggag

SEQ ID NO: 2420786 - DNA, 12 bp, Homo sapiens
ggacagctgtgc

SEQ ID NO: 2420787 - DNA, 17 bp, Homo sapiens
ggacagctgtgcctcgc

SEQ ID NO: 2420788 - DNA, 19 bp, Homo sapiens
ggacaggactaacactcag

SEQ ID NO: 2420789 - DNA, 17 bp, Homo sapiens
ggacaggatgtgtttgc

SEQ ID NO: 2420790 - DNA, 18 bp, Homo sapiens
ggacaggatgtgtttgct

SEQ ID NO: 2420791 - DNA, 20 bp, Homo sapiens
ggacaggatgtgtttgcttt

SEQ ID NO: 2420792 - DNA, 16 bp, Homo sapiens
ggacatgcggtagcca

SEQ ID NO: 2420793 - DNA, 14 bp, Homo sapiens
ggacatttctctaa

SEQ ID NO: 2420794 - DNA, 12 bp, Homo sapiens
ggaccaaagcaa

SEQ ID NO: 2420795 - DNA, 22 bp, Homo sapiens
ggaccaaagggagtctgccagg

SEQ ID NO: 2420796 - DNA, 18 bp, Homo sapiens
ggaccagaagctccccca

SEQ ID NO: 2420797 - DNA, 15 bp, Homo sapiens
ggaccagcctggccc

SEQ ID NO: 2420798 - DNA, 16 bp, Homo sapiens
ggaccagcctggccca

SEQ ID NO: 2420799 - DNA, 16 bp, Homo sapiens
ggaccagctcaggaca

SEQ ID NO: 2420800 - DNA, 22 bp, Homo sapiens
ggactgggagcccccagcctgt

SEQ ID NO: 2420801 - DNA, 18 bp, Homo sapiens
ggactgtaagttgggctt

SEQ ID NO: 2420802 - DNA, 19 bp, Homo sapiens
ggacttagaaaaccagctc

SEQ ID NO: 2420803 - DNA, 23 bp, Homo sapiens
ggacttagaaaaccagctcagca

SEQ ID NO: 2420804 - DNA, 14 bp, Homo sapiens
ggacttctggggta

SEQ ID NO: 2420805 - DNA, 15 bp, Homo sapiens
ggacttgaacccagg

SEQ ID NO: 2420806 - DNA, 15 bp, Homo sapiens
ggacttggcctctct

SEQ ID NO: 2420807 - DNA, 17 bp, Homo sapiens
ggacttggcctctctct

SEQ ID NO: 2420808 - DNA, 17 bp, Homo sapiens
ggactttgcagccggca

SEQ ID NO: 2420809 - DNA, 20 bp, Homo sapiens
ggagaagaaagaggtgaccc

SEQ ID NO: 2420810 - DNA, 23 bp, Homo sapiens
ggagaagaaagaggtgaccccag

SEQ ID NO: 2420811 - DNA, 17 bp, Homo sapiens
ggagacactggcccctc

SEQ ID NO: 2420812 - DNA, 14 bp, Homo sapiens
ggagacagcatcag

SEQ ID NO: 2420813 - DNA, 22 bp, Homo sapiens
ggagacataaccactgcttcca

SEQ ID NO: 2420814 - DNA, 19 bp, Homo sapiens
ggagaccggcctgccagga

SEQ ID NO: 2420815 - DNA, 21 bp, Homo sapiens
ggagaccggcctgccaggagg

SEQ ID NO: 2420816 - DNA, 15 bp, Homo sapiens
ggagactgcccagct

SEQ ID NO: 2420817 - DNA, 19 bp, Homo sapiens
ggagactgtctggcccccc

SEQ ID NO: 2420818 - DNA, 22 bp, Homo sapiens
ggagacttagggcaccaggggt

SEQ ID NO: 2420819 - DNA, 12 bp, Homo sapiens
ggagagacttgt

SEQ ID NO: 2420820 - DNA, 21 bp, Homo sapiens
ggagagccagctaaggggtgg

SEQ ID NO: 2420821 - DNA, 15 bp, Homo sapiens
ggagagcccaggagc

SEQ ID NO: 2420822 - DNA, 22 bp, Homo sapiens
ggagagcccaggagctcccctc

SEQ ID NO: 2420823 - DNA, 14 bp, Homo sapiens
ggagagccctggga

SEQ ID NO: 2420824 - DNA, 14 bp, Homo sapiens
ggagagctaggagc

SEQ ID NO: 2420825 - DNA, 17 bp, Homo sapiens
ggagaggccccagccgc

SEQ ID NO: 2420826 - DNA, 14 bp, Homo sapiens
ggagagggaatgtg

SEQ ID NO: 2420827 - DNA, 19 bp, Homo sapiens
ggagagggaatgtgaaatt

SEQ ID NO: 2420828 - DNA, 20 bp, Homo sapiens
ggagcaaactgcatgcccag

SEQ ID NO: 2420829 - DNA, 22 bp, Homo sapiens
ggagcaaactgcatgcccagag

SEQ ID NO: 2420830 - DNA, 14 bp, Homo sapiens
ggagcaaagcctgt

SEQ ID NO: 2420831 - DNA, 18 bp, Homo sapiens
ggagcacaaagaccctgg

SEQ ID NO: 2420832 - DNA, 21 bp, Homo sapiens
ggagcacaaagaccctggctt

SEQ ID NO: 2420833 - DNA, 12 bp, Homo sapiens
ggagcagagggg

SEQ ID NO: 2420834 - DNA, 16 bp, Homo sapiens
ggagcaggcagccagc

SEQ ID NO: 2420835 - DNA, 23 bp, Homo sapiens
ggagccatgcgccccctccgccc

SEQ ID NO: 2420836 - DNA, 17 bp, Homo sapiens
ggagcccacgacactgc

SEQ ID NO: 2420837 - DNA, 20 bp, Homo sapiens
ggagcccacgctcaccccct

SEQ ID NO: 2420838 - DNA, 12 bp, Homo sapiens
ggagcccactgt

SEQ ID NO: 2420839 - DNA, 17 bp, Homo sapiens
ggagccccagctaccct

SEQ ID NO: 2420840 - DNA, 18 bp, Homo sapiens
ggagccccagctaccctt

SEQ ID NO: 2420841 - DNA, 16 bp, Homo sapiens
ggagccccattcctgg

SEQ ID NO: 2420842 - DNA, 17 bp, Homo sapiens
ggagccccattcctggg

SEQ ID NO: 2420843 - DNA, 13 bp, Homo sapiens
ggagcccccagcc

SEQ ID NO: 2420844 - DNA, 18 bp, Homo sapiens
ggagccccttctgctcag

SEQ ID NO: 2420845 - DNA, 17 bp, Homo sapiens
ggagccgggtctgcctc

SEQ ID NO: 2420846 - DNA, 16 bp, Homo sapiens
ggagcctgtcctgcct

SEQ ID NO: 2420847 - DNA, 14 bp, Homo sapiens
ggagcctgtgaacc

SEQ ID NO: 2420848 - DNA, 17 bp, Homo sapiens
ggagcctgtgaacccag

SEQ ID NO: 2420849 - DNA, 22 bp, Homo sapiens
ggagcctgtgaacccaggacaa

SEQ ID NO: 2420850 - DNA, 14 bp, Homo sapiens
ggagcgggtctgct

SEQ ID NO: 2420851 - DNA, 15 bp, Homo sapiens
ggagctaaggctcta

SEQ ID NO: 2420852 - DNA, 12 bp, Homo sapiens
ggagctattttc

SEQ ID NO: 2420853 - DNA, 20 bp, Homo sapiens
ggagctccactctgcttctc

SEQ ID NO: 2420854 - DNA, 16 bp, Homo sapiens
ggagctccagcctgac

SEQ ID NO: 2420855 - DNA, 18 bp, Homo sapiens
ggagctccagcctgacat

SEQ ID NO: 2420856 - DNA, 19 bp, Homo sapiens
ggagctccagtgtcctgag

SEQ ID NO: 2420857 - DNA, 13 bp, Homo sapiens
ggagctcccctcc

SEQ ID NO: 2420858 - DNA, 17 bp, Homo sapiens
ggagctcccctccccaa

SEQ ID NO: 2420859 - DNA, 13 bp, Homo sapiens
ggagctgcctgga

SEQ ID NO: 2420860 - DNA, 17 bp, Homo sapiens
ggagctgcctggacccg

SEQ ID NO: 2420861 - DNA, 20 bp, Homo sapiens
ggagctgtgagttctccctg

SEQ ID NO: 2420862 - DNA, 12 bp, Homo sapiens
ggaggaatactg

SEQ ID NO: 2420863 - DNA, 20 bp, Homo sapiens
ggaggagcccaggccaggac

SEQ ID NO: 2420864 - DNA, 15 bp, Homo sapiens
ggaggagcctgtcct

SEQ ID NO: 2420865 - DNA, 15 bp, Homo sapiens
ggaggaggagggagg

SEQ ID NO: 2420866 - DNA, 13 bp, Homo sapiens
ggaggaggagggt

SEQ ID NO: 2420867 - DNA, 19 bp, Homo sapiens
ggaggagggtcggtgcctt

SEQ ID NO: 2420868 - DNA, 17 bp, Homo sapiens
ggaggcaggggcttcct

SEQ ID NO: 2420869 - DNA, 16 bp, Homo sapiens
ggaggcccaggctggg

SEQ ID NO: 2420870 - DNA, 22 bp, Homo sapiens
ggaggccccaaccctgtcctcc

SEQ ID NO: 2420871 - DNA, 14 bp, Homo sapiens
gcgaccgccccctc

SEQ ID NO: 2420872 - DNA, 18 bp, Homo sapiens
gcgactccgttggccact

SEQ ID NO: 2420873 - DNA, 12 bp, Homo sapiens
gcgagagatgtg

SEQ ID NO: 2420874 - DNA, 15 bp, Homo sapiens
gcgagagatgtgtgt

SEQ ID NO: 2420875 - DNA, 18 bp, Homo sapiens
gcgagcatgtcgtggaca

SEQ ID NO: 2420876 - DNA, 19 bp, Homo sapiens
gcgaggagatgctccttgg

SEQ ID NO: 2420877 - DNA, 13 bp, Homo sapiens
gcgatagagtctc

SEQ ID NO: 2420878 - DNA, 17 bp, Homo sapiens
gcgatccacctgtctca

SEQ ID NO: 2420879 - DNA, 21 bp, Homo sapiens
gcgatccacctgtctcagcct

SEQ ID NO: 2420880 - DNA, 17 bp, Homo sapiens
gcgatctcggctcactg

SEQ ID NO: 2420881 - DNA, 21 bp, Homo sapiens
gcgatgtggaactgctgccac

SEQ ID NO: 2420882 - DNA, 23 bp, Homo sapiens
gcgatgtggaactgctgccactg

SEQ ID NO: 2420883 - DNA, 14 bp, Homo sapiens
gcgattccctctcc

SEQ ID NO: 2420884 - DNA, 15 bp, Homo sapiens
gcgccaggctgacca

SEQ ID NO: 2420885 - DNA, 13 bp, Homo sapiens
gcgcccagggctg

SEQ ID NO: 2420886 - DNA, 21 bp, Homo sapiens
gcgccccctccgccctgccac

SEQ ID NO: 2420887 - DNA, 22 bp, Homo sapiens
gcgccccctccgccctgccact

SEQ ID NO: 2420888 - DNA, 18 bp, Homo sapiens
gcgccctgcagaccctgc

SEQ ID NO: 2420889 - DNA, 22 bp, Homo sapiens
gcgccgtctccaggggctgctt

SEQ ID NO: 2420890 - DNA, 22 bp, Homo sapiens
gcgctaattcaaggaatttctt

SEQ ID NO: 2420891 - DNA, 15 bp, Homo sapiens
gcgctatctccctgc

SEQ ID NO: 2420892 - DNA, 13 bp, Homo sapiens
gcgctcagggcca

SEQ ID NO: 2420893 - DNA, 16 bp, Homo sapiens
gcgctcagggccatgc

SEQ ID NO: 2420894 - DNA, 18 bp, Homo sapiens
gcgctcctggcccagcct

SEQ ID NO: 2420895 - DNA, 13 bp, Homo sapiens
gcgctgctggtgt

SEQ ID NO: 2420896 - DNA, 23 bp, Homo sapiens
gcgctgtcaggattgcgagagat

SEQ ID NO: 2420897 - DNA, 13 bp, Homo sapiens
gcggaggaggagg

SEQ ID NO: 2420898 - DNA, 17 bp, Homo sapiens
gcggaggaggagggagg

SEQ ID NO: 2420899 - DNA, 17 bp, Homo sapiens
gcggaggggacagagcg

SEQ ID NO: 2420900 - DNA, 21 bp, Homo sapiens
gcggaggtgtggagccgaggc

SEQ ID NO: 2420901 - DNA, 13 bp, Homo sapiens
gcggatggccgga

SEQ ID NO: 2420902 - DNA, 16 bp, Homo sapiens
gcggcaggggcctgga

SEQ ID NO: 2420903 - DNA, 14 bp, Homo sapiens
gcggccctgtcatc

SEQ ID NO: 2420904 - DNA, 14 bp, Homo sapiens
gcggcctccttctg

SEQ ID NO: 2420905 - DNA, 14 bp, Homo sapiens
gcggctcctcaggg

SEQ ID NO: 2420906 - DNA, 13 bp, Homo sapiens
gcgggacagccaa

SEQ ID NO: 2420907 - DNA, 16 bp, Homo sapiens
gcgggcagagggctgg

SEQ ID NO: 2420908 - DNA, 17 bp, Homo sapiens
gcgggcagagggctgga

SEQ ID NO: 2420909 - DNA, 21 bp, Homo sapiens
gcggggcttgccttctggtgt

SEQ ID NO: 2420910 - DNA, 21 bp, Homo sapiens
gcggtagccagcacacagggc

SEQ ID NO: 2420911 - DNA, 14 bp, Homo sapiens
gcggtgggcctggt

SEQ ID NO: 2420912 - DNA, 19 bp, Homo sapiens
gcggttataaaaaatggtt

SEQ ID NO: 2420913 - DNA, 12 bp, Homo sapiens
gcggttcaggaa

SEQ ID NO: 2420914 - DNA, 20 bp, Homo sapiens
gcggtttactcactgctgca

SEQ ID NO: 2420915 - DNA, 16 bp, Homo sapiens
gcgtaagtacagagaa

SEQ ID NO: 2420916 - DNA, 17 bp, Homo sapiens
gcgtaagtacagagaag

SEQ ID NO: 2420917 - DNA, 19 bp, Homo sapiens
gcgtaagtacagagaagcc

SEQ ID NO: 2420918 - DNA, 21 bp, Homo sapiens
gcgtaagtacagagaagccat

SEQ ID NO: 2420919 - DNA, 23 bp, Homo sapiens
gcgtaagtacagagaagccatca

SEQ ID NO: 2420920 - DNA, 14 bp, Homo sapiens
gcgtaggctacaga

SEQ ID NO: 2420921 - DNA, 17 bp, Homo sapiens
gcgtaggctacagagaa

SEQ ID NO: 2420922 - DNA, 12 bp, Homo sapiens
gcgtcttcctga

SEQ ID NO: 2420923 - DNA, 13 bp, Homo sapiens
gcgtgacaataaa

SEQ ID NO: 2420924 - DNA, 11 bp, Homo sapiens
gcgtgcagatg

SEQ ID NO: 2420925 - DNA, 23 bp, Homo sapiens
gcgtgcgagcacacacacacata

SEQ ID NO: 2420926 - DNA, 17 bp, Homo sapiens
gcgtggtggtccctggg

SEQ ID NO: 2420927 - DNA, 18 bp, Homo sapiens
gcgtggtggtccctgggt

SEQ ID NO: 2420928 - DNA, 17 bp, Homo sapiens
gcgtgtcacctgtgctt

SEQ ID NO: 2420929 - DNA, 13 bp, Homo sapiens
gcgttcctttctt

SEQ ID NO: 2420930 - DNA, 16 bp, Homo sapiens
gctaaaagaaactttc

SEQ ID NO: 2420931 - DNA, 15 bp, Homo sapiens
gctaaagacatgaag

SEQ ID NO: 2420932 - DNA, 17 bp, Homo sapiens
gctaaagcaatatgcat

SEQ ID NO: 2420933 - DNA, 19 bp, Homo sapiens
gctaaagcaatatgcattt

SEQ ID NO: 2420934 - DNA, 17 bp, Homo sapiens
gctaagaacctggaact

SEQ ID NO: 2420935 - DNA, 23 bp, Homo sapiens
gctaagaacctggaacttgggga

SEQ ID NO: 2420936 - DNA, 14 bp, Homo sapiens
gctaaggttctaag

SEQ ID NO: 2420937 - DNA, 20 bp, Homo sapiens
gctacaccactctggcagcc

SEQ ID NO: 2420938 - DNA, 23 bp, Homo sapiens
gctacacctattatcccagctgc

SEQ ID NO: 2420939 - DNA, 13 bp, Homo sapiens
gctacagagaaac

SEQ ID NO: 2420940 - DNA, 20 bp, Homo sapiens
gctacagagaaaccagcttc

SEQ ID NO: 2420941 - DNA, 21 bp, Homo sapiens
gctacagagaaaccagcttcc

SEQ ID NO: 2420942 - DNA, 13 bp, Homo sapiens
gctacagagaagc

SEQ ID NO: 2420943 - DNA, 17 bp, Homo sapiens
gctacagcaatttctaa

SEQ ID NO: 2420944 - DNA, 16 bp, Homo sapiens
gctaccaccagctgtg

SEQ ID NO: 2420945 - DNA, 20 bp, Homo sapiens
gctaccaccagctgtgtcca

SEQ ID NO: 2420946 - DNA, 19 bp, Homo sapiens
gctaccagtatttagaagc

SEQ ID NO: 2420947 - DNA, 12 bp, Homo sapiens
gctaccctgagc

SEQ ID NO: 2420948 - DNA, 19 bp, Homo sapiens
gctaccctgagctgaggca

SEQ ID NO: 2420949 - DNA, 18 bp, Homo sapiens
gctaccctttttctccag

SEQ ID NO: 2420950 - DNA, 21 bp, Homo sapiens
gctaccctttttctccagctg

SEQ ID NO: 2420951 - DNA, 20 bp, Homo sapiens
gctacctgctcagccctgca

SEQ ID NO: 2420952 - DNA, 18 bp, Homo sapiens
gctacctgtgtggacagg

SEQ ID NO: 2420953 - DNA, 22 bp, Homo sapiens
gctactctccccacgagggctg

SEQ ID NO: 2420954 - DNA, 15 bp, Homo sapiens
gctactctgtgccag

SEQ ID NO: 2420955 - DNA, 20 bp, Homo sapiens
gctactctgtgccagagcct

SEQ ID NO: 2420956 - DNA, 22 bp, Homo sapiens
gctactctgtgccagagcctgg

SEQ ID NO: 2420957 - DNA, 18 bp, Homo sapiens
gctactgccgtcagtgct

SEQ ID NO: 2420958 - DNA, 22 bp, Homo sapiens
gctactgccgtcagtgctgtgc

SEQ ID NO: 2420959 - DNA, 16 bp, Homo sapiens
gctactggggaaactg

SEQ ID NO: 2420960 - DNA, 23 bp, Homo sapiens
gctactggggaaactggccatgg

SEQ ID NO: 2420961 - DNA, 21 bp, Homo sapiens
gctactgtgtgtgtgaatgaa

SEQ ID NO: 2420962 - DNA, 19 bp, Homo sapiens
gctacttcctcctccccac

SEQ ID NO: 2420963 - DNA, 14 bp, Homo sapiens
gctagaaccctctg

SEQ ID NO: 2420964 - DNA, 14 bp, Homo sapiens
gctagcagtggcag

SEQ ID NO: 2420965 - DNA, 18 bp, Homo sapiens
gctagcagtggcaggcag

SEQ ID NO: 2420966 - DNA, 18 bp, Homo sapiens
gctaggagcaaagcctgt

SEQ ID NO: 2420967 - DNA, 16 bp, Homo sapiens
gctaggccagagccca

SEQ ID NO: 2420968 - DNA, 17 bp, Homo sapiens
gctaggccagcaggggc

SEQ ID NO: 2420969 - DNA, 18 bp, Homo sapiens
gctaggccagcaggggct

SEQ ID NO: 2420970 - DNA, 21 bp, Homo sapiens
gctagtgacttgtgtcccatg

SEQ ID NO: 2420971 - DNA, 22 bp, Homo sapiens
gctagttatacttatttgtata

SEQ ID NO: 2420972 - DNA, 16 bp, Homo sapiens
gctatgtttttaatgt

SEQ ID NO: 2420973 - DNA, 19 bp, Homo sapiens
gctattccagctgtccccc

SEQ ID NO: 2420974 - DNA, 12 bp, Homo sapiens
gctctcacctct

SEQ ID NO: 2420975 - DNA, 17 bp, Homo sapiens
gctctcacctggccctg

SEQ ID NO: 2420976 - DNA, 21 bp, Homo sapiens
gctctccattctgctccttcc

SEQ ID NO: 2420977 - DNA, 13 bp, Homo sapiens
gctctcctcttct

SEQ ID NO: 2420978 - DNA, 15 bp, Homo sapiens
gctctcctggcttcc

SEQ ID NO: 2420979 - DNA, 19 bp, Homo sapiens
gctctctcattgtctgtgt

SEQ ID NO: 2420980 - DNA, 18 bp, Homo sapiens
gaggtgcactgggaggct

SEQ ID NO: 2420981 - DNA, 13 bp, Homo sapiens
gaggtgccactgg

SEQ ID NO: 2420982 - DNA, 15 bp, Homo sapiens
gaggtgcccaggaga

SEQ ID NO: 2420983 - DNA, 13 bp, Homo sapiens
gaggtgcctgtcc

SEQ ID NO: 2420984 - DNA, 15 bp, Homo sapiens
gaggtgcctgtccca

SEQ ID NO: 2420985 - DNA, 16 bp, Homo sapiens
gaggtgtccaactggc

SEQ ID NO: 2420986 - DNA, 17 bp, Homo sapiens
gaggtgtctcaggctgc

SEQ ID NO: 2420987 - DNA, 16 bp, Homo sapiens
gaggtttgcagtccca

SEQ ID NO: 2420988 - DNA, 21 bp, Homo sapiens
gagtaacaatacaaatggatt

SEQ ID NO: 2420989 - DNA, 13 bp, Homo sapiens
gagtaacatttgc

SEQ ID NO: 2420990 - DNA, 19 bp, Homo sapiens
gagtaatggtgtagaacac

SEQ ID NO: 2420991 - DNA, 19 bp, Homo sapiens
gagtagaaactgcagggaa

SEQ ID NO: 2420992 - DNA, 14 bp, Homo sapiens
gagtagaattgcat

SEQ ID NO: 2420993 - DNA, 15 bp, Homo sapiens
gagtagctgagctca

SEQ ID NO: 2420994 - DNA, 23 bp, Homo sapiens
gagtattaaaatgtatgcatgtt

SEQ ID NO: 2420995 - DNA, 14 bp, Homo sapiens
gagtcaaaaagaac

SEQ ID NO: 2420996 - DNA, 14 bp, Homo sapiens
gagtcaaaacactt

SEQ ID NO: 2420997 - DNA, 19 bp, Homo sapiens
gagtcaaaactacaaatca

SEQ ID NO: 2420998 - DNA, 13 bp, Homo sapiens
gagtcaatacata

SEQ ID NO: 2420999 - DNA, 15 bp, Homo sapiens
gagtcagagccatgt

SEQ ID NO: 2421000 - DNA, 23 bp, Homo sapiens
gagtcaggacttgaacccaggtc

SEQ ID NO: 2421001 - DNA, 14 bp, Homo sapiens
gagtcatttttaca

SEQ ID NO: 2421002 - DNA, 21 bp, Homo sapiens
gagtcccaggttggctctgcc

SEQ ID NO: 2421003 - DNA, 23 bp, Homo sapiens
gagtcccaggttggctctgccag

SEQ ID NO: 2421004 - DNA, 17 bp, Homo sapiens
gagtcgtggggtgtgct

SEQ ID NO: 2421005 - DNA, 11 bp, Homo sapiens
gagtctaaaga

SEQ ID NO: 2421006 - DNA, 21 bp, Homo sapiens
gagtctaaagatggagtttct

SEQ ID NO: 2421007 - DNA, 11 bp, Homo sapiens
gagtctagatg

SEQ ID NO: 2421008 - DNA, 23 bp, Homo sapiens
gagtctagattcaaaggttctag

SEQ ID NO: 2421009 - DNA, 13 bp, Homo sapiens
gagtctgaggtcc

SEQ ID NO: 2421010 - DNA, 18 bp, Homo sapiens
gcaccaccaagccaaggg

SEQ ID NO: 2421011 - DNA, 19 bp, Homo sapiens
gcaccagacacccaggact

SEQ ID NO: 2421012 - DNA, 20 bp, Homo sapiens
gcaccagacacccaggactt

SEQ ID NO: 2421013 - DNA, 13 bp, Homo sapiens
gcaccaggaagcc

SEQ ID NO: 2421014 - DNA, 18 bp, Homo sapiens
gcaccaggggtttctcgc

SEQ ID NO: 2421015 - DNA, 23 bp, Homo sapiens
gcaccagggttgaccccagagga

SEQ ID NO: 2421016 - DNA, 18 bp, Homo sapiens
gcaccatgctgctgggga

SEQ ID NO: 2421017 - DNA, 16 bp, Homo sapiens
gcacccccagcctggg

SEQ ID NO: 2421018 - DNA, 15 bp, Homo sapiens
gcaccgaagcccaga

SEQ ID NO: 2421019 - DNA, 17 bp, Homo sapiens
gcaccggaccagcctgg

SEQ ID NO: 2421020 - DNA, 15 bp, Homo sapiens
gcaccgttctgtgca

SEQ ID NO: 2421021 - DNA, 15 bp, Homo sapiens
gcacctaatccaggc

SEQ ID NO: 2421022 - DNA, 17 bp, Homo sapiens
gcacctcccttgggcac

SEQ ID NO: 2421023 - DNA, 21 bp, Homo sapiens
gcacctgccctacctgcccca

SEQ ID NO: 2421024 - DNA, 13 bp, Homo sapiens
gcacctgcctcag

SEQ ID NO: 2421025 - DNA, 14 bp, Homo sapiens
gcacctgcctcagg

SEQ ID NO: 2421026 - DNA, 16 bp, Homo sapiens
gcacctgcctcaggac

SEQ ID NO: 2421027 - DNA, 13 bp, Homo sapiens
gcacctgcctcca

SEQ ID NO: 2421028 - DNA, 23 bp, Homo sapiens
gcacctgctgtctgggtggctca

SEQ ID NO: 2421029 - DNA, 16 bp, Homo sapiens
gcacctgggccctggg

SEQ ID NO: 2421030 - DNA, 22 bp, Homo sapiens
gcacctgggccctggggcctgt

SEQ ID NO: 2421031 - DNA, 14 bp, Homo sapiens
gcacggctctgtcc

SEQ ID NO: 2421032 - DNA, 14 bp, Homo sapiens
gcacgggtgtcacg

SEQ ID NO: 2421033 - DNA, 18 bp, Homo sapiens
gcacgtaaagtacttgta

SEQ ID NO: 2421034 - DNA, 13 bp, Homo sapiens
gcacgtggcctct

SEQ ID NO: 2421035 - DNA, 19 bp, Homo sapiens
gcacgtgtgtttttctatt

SEQ ID NO: 2421036 - DNA, 17 bp, Homo sapiens
gcactactgacatgtgg

SEQ ID NO: 2421037 - DNA, 18 bp, Homo sapiens
gcactcccacctgacaca

SEQ ID NO: 2421038 - DNA, 17 bp, Homo sapiens
gcactcgctagcagtgg

SEQ ID NO: 2421039 - DNA, 11 bp, Homo sapiens
gcactctagat

SEQ ID NO: 2421040 - DNA, 15 bp, Homo sapiens
gcactctagattcca

SEQ ID NO: 2421041 - DNA, 17 bp, Homo sapiens
gcactgaagtgcttagt

SEQ ID NO: 2421042 - DNA, 22 bp, Homo sapiens
gcactgatgctgcccctcatct

SEQ ID NO: 2421043 - DNA, 20 bp, Homo sapiens
gcactgatgttgtgttttta

SEQ ID NO: 2421044 - DNA, 19 bp, Homo sapiens
gcactgcacctgcctccag

SEQ ID NO: 2421045 - DNA, 13 bp, Homo sapiens
gcactgccaggag

SEQ ID NO: 2421046 - DNA, 14 bp, Homo sapiens
gcactgccaggagg

SEQ ID NO: 2421047 - DNA, 16 bp, Homo sapiens
gcactgccaggaggga

SEQ ID NO: 2421048 - DNA, 17 bp, Homo sapiens
gcactgccaggagggac

SEQ ID NO: 2421049 - DNA, 23 bp, Homo sapiens
gcactgccaggagggacaaagga

SEQ ID NO: 2421050 - DNA, 13 bp, Homo sapiens
gcactgccctggt

SEQ ID NO: 2421051 - DNA, 12 bp, Homo sapiens
gcactgtaaaat

SEQ ID NO: 2421052 - DNA, 14 bp, Homo sapiens
gcactgtaaaatgt

SEQ ID NO: 2421053 - DNA, 16 bp, Homo sapiens
gcactgtaaaatgtgg

SEQ ID NO: 2421054 - DNA, 16 bp, Homo sapiens
gcactgtagttctaag

SEQ ID NO: 2421055 - DNA, 19 bp, Homo sapiens
gcactgtagttctaagact

SEQ ID NO: 2421056 - DNA, 18 bp, Homo sapiens
gcactgtcccttgcctca

SEQ ID NO: 2421057 - DNA, 23 bp, Homo sapiens
gcactgtcccttgcctcaatgcc

SEQ ID NO: 2421058 - DNA, 22 bp, Homo sapiens
gcacttactggtaggaccaagc

SEQ ID NO: 2421059 - DNA, 22 bp, Homo sapiens
gcacttcctctcgcggccctca

SEQ ID NO: 2421060 - DNA, 13 bp, Homo sapiens
gcacttggcagcc

SEQ ID NO: 2421061 - DNA, 16 bp, Homo sapiens
gcacttggcagccttg

SEQ ID NO: 2421062 - DNA, 17 bp, Homo sapiens
gcacttggggcaccttg

SEQ ID NO: 2421063 - DNA, 17 bp, Homo sapiens
gcactttggcttataat

SEQ ID NO: 2421064 - DNA, 21 bp, Homo sapiens
gcagaaaacccttgggccaga

SEQ ID NO: 2421065 - DNA, 22 bp, Homo sapiens
gcagaaaacccttgggccagaa

SEQ ID NO: 2421066 - DNA, 14 bp, Homo sapiens
gcagaaagtgcctt

SEQ ID NO: 2421067 - DNA, 23 bp, Homo sapiens
gcagaaagtgcctttcaggatct

SEQ ID NO: 2421068 - DNA, 13 bp, Homo sapiens
gcagaagcagcaa

SEQ ID NO: 2421069 - DNA, 16 bp, Homo sapiens
gcagaagtgtttttta

SEQ ID NO: 2421070 - DNA, 15 bp, Homo sapiens
gcagacaccttggac

SEQ ID NO: 2421071 - DNA, 12 bp, Homo sapiens
gcagacagagcc

SEQ ID NO: 2421072 - DNA, 13 bp, Homo sapiens
gcagacagagcca

SEQ ID NO: 2421073 - DNA, 14 bp, Homo sapiens
gcagacagagccag

SEQ ID NO: 2421074 - DNA, 21 bp, Homo sapiens
gcagacagagccaggagaagc

SEQ ID NO: 2421075 - DNA, 20 bp, Homo sapiens
gcagacaggccccgtgaggc

SEQ ID NO: 2421076 - DNA, 17 bp, Homo sapiens
gcagaccaccccgcctg

SEQ ID NO: 2421077 - DNA, 21 bp, Homo sapiens
gcagaccaccccgcctgccct

SEQ ID NO: 2421078 - DNA, 17 bp, Homo sapiens
gcagaccttttttagga

SEQ ID NO: 2421079 - DNA, 15 bp, Homo sapiens
gcagacttcccagct

SEQ ID NO: 2421080 - DNA, 15 bp, Homo sapiens
gcagagatgcctccc

SEQ ID NO: 2421081 - DNA, 17 bp, Homo sapiens
gcagagatgcctccctg

SEQ ID NO: 2421082 - DNA, 15 bp, Homo sapiens
gcagagctggctctg

SEQ ID NO: 2421083 - DNA, 17 bp, Homo sapiens
gcagagctggctctgag

SEQ ID NO: 2421084 - DNA, 21 bp, Homo sapiens
gcagaggcagtacctgggcaa

SEQ ID NO: 2421085 - DNA, 12 bp, Homo sapiens
gcagaggccaga

SEQ ID NO: 2421086 - DNA, 13 bp, Homo sapiens
gcagaggcctgca

SEQ ID NO: 2421087 - DNA, 19 bp, Homo sapiens
gcagaggcctgcagggcct

SEQ ID NO: 2421088 - DNA, 22 bp, Homo sapiens
gcagaggcctgggctgggaaaa

SEQ ID NO: 2421089 - DNA, 17 bp, Homo sapiens
gcagagggctggaggcc

SEQ ID NO: 2421090 - DNA, 23 bp, Homo sapiens
gcagagggctggaggcccaggct

SEQ ID NO: 2421091 - DNA, 14 bp, Homo sapiens
gcagaggggcagag

SEQ ID NO: 2421092 - DNA, 19 bp, Homo sapiens
gcccccctggcctccccca

SEQ ID NO: 2421093 - DNA, 14 bp, Homo sapiens
gccccctccctgga

SEQ ID NO: 2421094 - DNA, 17 bp, Homo sapiens
gccccctgaccactcag

SEQ ID NO: 2421095 - DNA, 11 bp, Homo sapiens
gccccctgcag

SEQ ID NO: 2421096 - DNA, 15 bp, Homo sapiens
gccccctgcaggaag

SEQ ID NO: 2421097 - DNA, 18 bp, Homo sapiens
gccccctgcaggaaggag

SEQ ID NO: 2421098 - DNA, 21 bp, Homo sapiens
gccccctgcaggaaggagctg

SEQ ID NO: 2421099 - DNA, 23 bp, Homo sapiens
gccccctgcaggaaggagctgcc

SEQ ID NO: 2421100 - DNA, 18 bp, Homo sapiens
gccccctgccccccagcc

SEQ ID NO: 2421101 - DNA, 14 bp, Homo sapiens
gccccctgtctctc

SEQ ID NO: 2421102 - DNA, 17 bp, Homo sapiens
gccccctgtctctcagg

SEQ ID NO: 2421103 - DNA, 16 bp, Homo sapiens
gcccctccctcccaga

SEQ ID NO: 2421104 - DNA, 15 bp, Homo sapiens
gcccctctcaccaaa

SEQ ID NO: 2421105 - DNA, 13 bp, Homo sapiens
gcccctctcagcc

SEQ ID NO: 2421106 - DNA, 16 bp, Homo sapiens
gcccctctcagccctc

SEQ ID NO: 2421107 - DNA, 20 bp, Homo sapiens
gcccctctcccttgggctct

SEQ ID NO: 2421108 - DNA, 23 bp, Homo sapiens
gcccctcttggagaagtctcagc

SEQ ID NO: 2421109 - DNA, 13 bp, Homo sapiens
gcccctggcccca

SEQ ID NO: 2421110 - DNA, 15 bp, Homo sapiens
gcccctggggtggcc

SEQ ID NO: 2421111 - DNA, 16 bp, Homo sapiens
gccccttagacagagg

SEQ ID NO: 2421112 - DNA, 17 bp, Homo sapiens
gccccttagacagaggc

SEQ ID NO: 2421113 - DNA, 14 bp, Homo sapiens
gccccttccgccac

SEQ ID NO: 2421114 - DNA, 15 bp, Homo sapiens
gccccttccgccact

SEQ ID NO: 2421115 - DNA, 21 bp, Homo sapiens
gccccttccgccactggggct

SEQ ID NO: 2421116 - DNA, 15 bp, Homo sapiens
gccccttctgctcag

SEQ ID NO: 2421117 - DNA, 18 bp, Homo sapiens
gccccttctgctcagctc

SEQ ID NO: 2421118 - DNA, 19 bp, Homo sapiens
gccccttctgctcagctct

SEQ ID NO: 2421119 - DNA, 15 bp, Homo sapiens
gccccttggacacgc

SEQ ID NO: 2421120 - DNA, 12 bp, Homo sapiens
gcccgagcagct

SEQ ID NO: 2421121 - DNA, 13 bp, Homo sapiens
gcccgagcagctg

SEQ ID NO: 2421122 - DNA, 20 bp, Homo sapiens
gcccgaggaggtgtctcagg

SEQ ID NO: 2421123 - DNA, 14 bp, Homo sapiens
gcccgtcctgcctg

SEQ ID NO: 2421124 - DNA, 15 bp, Homo sapiens
gcccgtcctgcctgt

SEQ ID NO: 2421125 - DNA, 18 bp, Homo sapiens
gccctacctgccccactt

SEQ ID NO: 2421126 - DNA, 12 bp, Homo sapiens
gccctactggga

SEQ ID NO: 2421127 - DNA, 16 bp, Homo sapiens
gccctcatggcccctc

SEQ ID NO: 2421128 - DNA, 13 bp, Homo sapiens
gccctccacacct

SEQ ID NO: 2421129 - DNA, 15 bp, Homo sapiens
gccctccacacctgc

SEQ ID NO: 2421130 - DNA, 18 bp, Homo sapiens
gccctccacacctgcggc

SEQ ID NO: 2421131 - DNA, 12 bp, Homo sapiens
gccctcctgtgc

SEQ ID NO: 2421132 - DNA, 17 bp, Homo sapiens
gccctcctgtgctcagc

SEQ ID NO: 2421133 - DNA, 18 bp, Homo sapiens
gccctcctgtgctcagcc

SEQ ID NO: 2421134 - DNA, 19 bp, Homo sapiens
gccctctcccaccctcttc

SEQ ID NO: 2421135 - DNA, 16 bp, Homo sapiens
gccctctcccctgccc

SEQ ID NO: 2421136 - DNA, 20 bp, Homo sapiens
gccctctcccctgccccctg

SEQ ID NO: 2421137 - DNA, 22 bp, Homo sapiens
gccctctcccctgccccctgca

SEQ ID NO: 2421138 - DNA, 23 bp, Homo sapiens
gccctctcccctgccccctgcag

SEQ ID NO: 2421139 - DNA, 17 bp, Homo sapiens
gccctctgcatcctctg

SEQ ID NO: 2421140 - DNA, 18 bp, Homo sapiens
gccctctgcatcctctgg

SEQ ID NO: 2421141 - DNA, 22 bp, Homo sapiens
gccctctgcatcctctggagcc

SEQ ID NO: 2421142 - DNA, 11 bp, Homo sapiens
gccctctgggc

SEQ ID NO: 2421143 - DNA, 14 bp, Homo sapiens
gccctctgggctct

SEQ ID NO: 2421144 - DNA, 16 bp, Homo sapiens
gccctctgggctctga

SEQ ID NO: 2421145 - DNA, 18 bp, Homo sapiens
gccctctgggctctgagt

SEQ ID NO: 2421146 - DNA, 12 bp, Homo sapiens
gccctgagccag

SEQ ID NO: 2421147 - DNA, 19 bp, Homo sapiens
gccctgagccagggtctcc

SEQ ID NO: 2421148 - DNA, 18 bp, Homo sapiens
gccctgcaaaaggactct

SEQ ID NO: 2421149 - DNA, 21 bp, Homo sapiens
gccctgcaaaaggactctcag

SEQ ID NO: 2421150 - DNA, 13 bp, Homo sapiens
gccctgcagaccc

SEQ ID NO: 2421151 - DNA, 18 bp, Homo sapiens
gccctgcagaccctgccc

SEQ ID NO: 2421152 - DNA, 19 bp, Homo sapiens
gccctgcagaccctgccct

SEQ ID NO: 2421153 - DNA, 20 bp, Homo sapiens
gccctgcagaccctgccctt

SEQ ID NO: 2421154 - DNA, 11 bp, Homo sapiens
gccctgccact

SEQ ID NO: 2421155 - DNA, 12 bp, Homo sapiens
gccctgcctgga

SEQ ID NO: 2421156 - DNA, 16 bp, Homo sapiens
gccctgcctggaggac

SEQ ID NO: 2421157 - DNA, 18 bp, Homo sapiens
gccctgcctggaggacct

SEQ ID NO: 2421158 - DNA, 23 bp, Homo sapiens
gccctgcctggaggacctgagcc

SEQ ID NO: 2421159 - DNA, 20 bp, Homo sapiens
gccctggatcagcgtggcct

SEQ ID NO: 2421160 - DNA, 21 bp, Homo sapiens
gccctggatcagcgtggcctt

SEQ ID NO: 2421161 - DNA, 23 bp, Homo sapiens
gccctgggagaatcgctcctgca

SEQ ID NO: 2421162 - DNA, 13 bp, Homo sapiens
gccctgggcctgc

SEQ ID NO: 2421163 - DNA, 12 bp, Homo sapiens
gccctgggctgg

SEQ ID NO: 2421164 - DNA, 13 bp, Homo sapiens
gccctggggcctg

SEQ ID NO: 2421165 - DNA, 15 bp, Homo sapiens
gccctggggcctgta

SEQ ID NO: 2421166 - DNA, 19 bp, Homo sapiens
gccctggggcctgtactgc

SEQ ID NO: 2421167 - DNA, 13 bp, Homo sapiens
gccctggtggccc

SEQ ID NO: 2421168 - DNA, 22 bp, Homo sapiens
gccctgtgccccttgacaactg

SEQ ID NO: 2421169 - DNA, 18 bp, Homo sapiens
gcccttcctggacagctg

SEQ ID NO: 2421170 - DNA, 19 bp, Homo sapiens
gcccttcctggacagctgt

SEQ ID NO: 2421171 - DNA, 20 bp, Homo sapiens
gcccttcctggacagctgtg

SEQ ID NO: 2421172 - DNA, 16 bp, Homo sapiens
gcccttctttctaccc

SEQ ID NO: 2421173 - DNA, 21 bp, Homo sapiens
gcccttgggggtcctcctcca

SEQ ID NO: 2421174 - DNA, 18 bp, Homo sapiens
gcccttgtttggggcagg

SEQ ID NO: 2421175 - DNA, 16 bp, Homo sapiens
gccctttcctcctcag

SEQ ID NO: 2421176 - DNA, 18 bp, Homo sapiens
gccctttgagtgcagtcc

SEQ ID NO: 2421177 - DNA, 14 bp, Homo sapiens
gccgagcaaccgtg

SEQ ID NO: 2421178 - DNA, 19 bp, Homo sapiens
gccgagcaaccgtggccct

SEQ ID NO: 2421179 - DNA, 15 bp, Homo sapiens
gccgagtccaagctg

SEQ ID NO: 2421180 - DNA, 23 bp, Homo sapiens
gccgccccctgccccccagcctc

SEQ ID NO: 2421181 - DNA, 17 bp, Homo sapiens
gccgctgagcgaggaga

SEQ ID NO: 2421182 - DNA, 13 bp, Homo sapiens
gccggcacagggt

SEQ ID NO: 2421183 - DNA, 14 bp, Homo sapiens
gccggccccaggct

SEQ ID NO: 2421184 - DNA, 12 bp, Homo sapiens
gccggctggtga

SEQ ID NO: 2421185 - DNA, 17 bp, Homo sapiens
gccggctgtgcagtcct

SEQ ID NO: 2421186 - DNA, 18 bp, Homo sapiens
gccgggaccaccctgagc

SEQ ID NO: 2421187 - DNA, 22 bp, Homo sapiens
gccgggaccaccctgagccggc

SEQ ID NO: 2421188 - DNA, 23 bp, Homo sapiens
gccggggaactggccaagctgag

SEQ ID NO: 2421189 - DNA, 17 bp, Homo sapiens
gccggggcgagtggcac

SEQ ID NO: 2421190 - DNA, 21 bp, Homo sapiens
gccgggtctgcctcttctggg

SEQ ID NO: 2421191 - DNA, 11 bp, Homo sapiens
gcctgccagga

SEQ ID NO: 2421192 - DNA, 12 bp, Homo sapiens
gcctgccaggag

SEQ ID NO: 2421193 - DNA, 13 bp, Homo sapiens
gcctgccaggagg

SEQ ID NO: 2421194 - DNA, 18 bp, Homo sapiens
gcctgcccccaccccatt

SEQ ID NO: 2421195 - DNA, 19 bp, Homo sapiens
gcctgcccccaccccattc

SEQ ID NO: 2421196 - DNA, 12 bp, Homo sapiens
gcctgccgagca

SEQ ID NO: 2421197 - DNA, 21 bp, Homo sapiens
gcctgcgccaccgcccagaga

SEQ ID NO: 2421198 - DNA, 15 bp, Homo sapiens
gcctgctccagacct

SEQ ID NO: 2421199 - DNA, 16 bp, Homo sapiens
gcctgctccagacctg

SEQ ID NO: 2421200 - DNA, 12 bp, Homo sapiens
gcctgctgctga

SEQ ID NO: 2421201 - DNA, 14 bp, Homo sapiens
gcctgctgctgaga

SEQ ID NO: 2421202 - DNA, 19 bp, Homo sapiens
gcctgctgctgagaacctg

SEQ ID NO: 2421203 - DNA, 21 bp, Homo sapiens
gcctgctgctgagaacctggc

SEQ ID NO: 2421204 - DNA, 22 bp, Homo sapiens
gcctgctgctgagaacctggcc

SEQ ID NO: 2421205 - DNA, 23 bp, Homo sapiens
gcctggacccgttcatgggggag

SEQ ID NO: 2421206 - DNA, 18 bp, Homo sapiens
gcctggacctctgacagc

SEQ ID NO: 2421207 - DNA, 23 bp, Homo sapiens
gcctggacctctgacagcagcat

SEQ ID NO: 2421208 - DNA, 16 bp, Homo sapiens
gcctggactttcctgc

SEQ ID NO: 2421209 - DNA, 13 bp, Homo sapiens
gcctggaggacct

SEQ ID NO: 2421210 - DNA, 15 bp, Homo sapiens
gcctggaggacctga

SEQ ID NO: 2421211 - DNA, 22 bp, Homo sapiens
gcctggaggacctgagcctgcc

SEQ ID NO: 2421212 - DNA, 17 bp, Homo sapiens
gcctggccagtgccctg

SEQ ID NO: 2421213 - DNA, 19 bp, Homo sapiens
gcctggcctcctgcctcta

SEQ ID NO: 2421214 - DNA, 22 bp, Homo sapiens
gcctggcctcctgcctctactg

SEQ ID NO: 2421215 - DNA, 13 bp, Homo sapiens
gcctggcctggcc

SEQ ID NO: 2421216 - DNA, 21 bp, Homo sapiens
gcctggctgctgatcgccttc

SEQ ID NO: 2421217 - DNA, 16 bp, Homo sapiens
gcctggctggctgagg

SEQ ID NO: 2421218 - DNA, 19 bp, Homo sapiens
gcctgggacaactgctccc

SEQ ID NO: 2421219 - DNA, 13 bp, Homo sapiens
gcctgggcagtgg

SEQ ID NO: 2421220 - DNA, 16 bp, Homo sapiens
gcctgggccgctgcca

SEQ ID NO: 2421221 - DNA, 17 bp, Homo sapiens
gcctgggccgctgccac

SEQ ID NO: 2421222 - DNA, 18 bp, Homo sapiens
gcctgggcctatggagag

SEQ ID NO: 2421223 - DNA, 19 bp, Homo sapiens
gcctgggcctatggagagc

SEQ ID NO: 2421224 - DNA, 22 bp, Homo sapiens
gcctgggcctatggagagccct

SEQ ID NO: 2421225 - DNA, 10 bp, Homo sapiens
gcctgggctc

SEQ ID NO: 2421226 - DNA, 20 bp, Homo sapiens
gcctggggctctaacgcctg

SEQ ID NO: 2421227 - DNA, 22 bp, Homo sapiens
gcctggggctctaacgcctgag

SEQ ID NO: 2421228 - DNA, 23 bp, Homo sapiens
gcctggggctctaacgcctgagc

SEQ ID NO: 2421229 - DNA, 14 bp, Homo sapiens
gcctggggctggcc

SEQ ID NO: 2421230 - DNA, 14 bp, Homo sapiens
gcctgggggcctgg

SEQ ID NO: 2421231 - DNA, 15 bp, Homo sapiens
gcctgggggcctggc

SEQ ID NO: 2421232 - DNA, 16 bp, Homo sapiens
gcctgggggtgccagg

SEQ ID NO: 2421233 - DNA, 21 bp, Homo sapiens
gcctgggggtgccaggaccag

SEQ ID NO: 2421234 - DNA, 18 bp, Homo sapiens
gcctggggtgacccggca

SEQ ID NO: 2421235 - DNA, 22 bp, Homo sapiens
gcctggggtgacccggcacccc

SEQ ID NO: 2421236 - DNA, 22 bp, Homo sapiens
gcctggtctcaccctggaggca

SEQ ID NO: 2421237 - DNA, 13 bp, Homo sapiens
gcctgtactgcct

SEQ ID NO: 2421238 - DNA, 13 bp, Homo sapiens
gcctgtagagttg

SEQ ID NO: 2421239 - DNA, 15 bp, Homo sapiens
gcctgtagagttgct

SEQ ID NO: 2421240 - DNA, 16 bp, Homo sapiens
gcctgtagagttgctg

SEQ ID NO: 2421241 - DNA, 21 bp, Homo sapiens
gcctgtcagatccaggagctc

SEQ ID NO: 2421242 - DNA, 22 bp, Homo sapiens
gcctgtcagatccaggagctcc

SEQ ID NO: 2421243 - DNA, 13 bp, Homo sapiens
gcctgtcctgcct

SEQ ID NO: 2421244 - DNA, 19 bp, Homo sapiens
gcctgtcctgcctgtggcc

SEQ ID NO: 2421245 - DNA, 12 bp, Homo sapiens
gcctgtctcaag

SEQ ID NO: 2421246 - DNA, 16 bp, Homo sapiens
gcctgtgaacccagga

SEQ ID NO: 2421247 - DNA, 17 bp, Homo sapiens
gcctgtgaacccaggac

SEQ ID NO: 2421248 - DNA, 19 bp, Homo sapiens
gcctgtgaacccaggacaa

SEQ ID NO: 2421249 - DNA, 21 bp, Homo sapiens
gcctgtgaacccaggacaagc

SEQ ID NO: 2421250 - DNA, 23 bp, Homo sapiens
gcctgtgacataccccctccccc

SEQ ID NO: 2421251 - DNA, 15 bp, Homo sapiens
gcctgtgcaatgcat

SEQ ID NO: 2421252 - DNA, 10 bp, Homo sapiens
gcctgtgcca

SEQ ID NO: 2421253 - DNA, 21 bp, Homo sapiens
gcctgtggcgccgtctccagg

SEQ ID NO: 2421254 - DNA, 12 bp, Homo sapiens
gcctgtggttct

SEQ ID NO: 2421255 - DNA, 15 bp, Homo sapiens
gcctgtgtagctgtg

SEQ ID NO: 2421256 - DNA, 14 bp, Homo sapiens
gcctgtgtccatgc

SEQ ID NO: 2421257 - DNA, 23 bp, Homo sapiens
gcctgtgtccatgcgctcagggc

SEQ ID NO: 2421258 - DNA, 16 bp, Homo sapiens
gcctgttcatggcaga

SEQ ID NO: 2421259 - DNA, 19 bp, Homo sapiens
gcctgtttcccaggcccac

SEQ ID NO: 2421260 - DNA, 14 bp, Homo sapiens
gcctgtttggcctc

SEQ ID NO: 2421261 - DNA, 16 bp, Homo sapiens
gccttattcagggaag

SEQ ID NO: 2421262 - DNA, 22 bp, Homo sapiens
gccttcaagctctgagggaaag

SEQ ID NO: 2421263 - DNA, 14 bp, Homo sapiens
gccttccacccagg

SEQ ID NO: 2421264 - DNA, 22 bp, Homo sapiens
gccttcctcctgggccctctct

SEQ ID NO: 2421265 - DNA, 20 bp, Homo sapiens
gccttcgcttcttgcctctg

SEQ ID NO: 2421266 - DNA, 19 bp, Homo sapiens
gccttctggtgttggacaa

SEQ ID NO: 2421267 - DNA, 23 bp, Homo sapiens
gccttcttttgggggtcaacagt

SEQ ID NO: 2421268 - DNA, 12 bp, Homo sapiens
gccttgccagag

SEQ ID NO: 2421269 - DNA, 16 bp, Homo sapiens
gccttgcggctcctca

SEQ ID NO: 2421270 - DNA, 17 bp, Homo sapiens
gccttgcggctcctcag

SEQ ID NO: 2421271 - DNA, 12 bp, Homo sapiens
gccttggcctgg

SEQ ID NO: 2421272 - DNA, 17 bp, Homo sapiens
gccttggtttttactgc

SEQ ID NO: 2421273 - DNA, 22 bp, Homo sapiens
gccttggtttttactgctctga

SEQ ID NO: 2421274 - DNA, 20 bp, Homo sapiens
gccttgtaattctaaatgaa

SEQ ID NO: 2421275 - DNA, 23 bp, Homo sapiens
gccttgtgatgtcatacagagaa

SEQ ID NO: 2421276 - DNA, 16 bp, Homo sapiens
gccttgttctgtcacc

SEQ ID NO: 2421277 - DNA, 14 bp, Homo sapiens
gcctttaacagaaa

SEQ ID NO: 2421278 - DNA, 19 bp, Homo sapiens
gcctttatttccactgtgc

SEQ ID NO: 2421279 - DNA, 14 bp, Homo sapiens
gcctttcaggatct

SEQ ID NO: 2421280 - DNA, 18 bp, Homo sapiens
gcctttcaggatctattt

SEQ ID NO: 2421281 - DNA, 15 bp, Homo sapiens
gcctttccatccatg

SEQ ID NO: 2421282 - DNA, 21 bp, Homo sapiens
gcctttccatccatggccagc

SEQ ID NO: 2421283 - DNA, 15 bp, Homo sapiens
gcctttgccaggtga

SEQ ID NO: 2421284 - DNA, 18 bp, Homo sapiens
gcctttgcgctcctggcc

SEQ ID NO: 2421285 - DNA, 18 bp, Homo sapiens
gcctttgttccccactgg

SEQ ID NO: 2421286 - DNA, 19 bp, Homo sapiens
gcctttgttccccactgga

SEQ ID NO: 2421287 - DNA, 21 bp, Homo sapiens
gcctttgttccccactggagc

SEQ ID NO: 2421288 - DNA, 14 bp, Homo sapiens
gcctttttcattta

SEQ ID NO: 2421289 - DNA, 15 bp, Homo sapiens
gcctttttcatttat

SEQ ID NO: 2421290 - DNA, 18 bp, Homo sapiens
gcctttttcatttatcta

SEQ ID NO: 2421291 - DNA, 14 bp, Homo sapiens
gccttttttcccca

SEQ ID NO: 2421292 - DNA, 15 bp, Homo sapiens
gccttttttccccag

SEQ ID NO: 2421293 - DNA, 23 bp, Homo sapiens
gccttttttctgtataaatgtct

SEQ ID NO: 2421294 - DNA, 20 bp, Homo sapiens
gactcagccttcagacagag

SEQ ID NO: 2421295 - DNA, 13 bp, Homo sapiens
gactcattctgaa

SEQ ID NO: 2421296 - DNA, 19 bp, Homo sapiens
gactccaggcccaaggctc

SEQ ID NO: 2421297 - DNA, 13 bp, Homo sapiens
gactcccattcct

SEQ ID NO: 2421298 - DNA, 16 bp, Homo sapiens
gactccgttggccact

SEQ ID NO: 2421299 - DNA, 17 bp, Homo sapiens
gactcctcctttttcca

SEQ ID NO: 2421300 - DNA, 16 bp, Homo sapiens
gactcgggggtgggga

SEQ ID NO: 2421301 - DNA, 15 bp, Homo sapiens
gactctaagaaagaa

SEQ ID NO: 2421302 - DNA, 18 bp, Homo sapiens
gactctgcagcctcagag

SEQ ID NO: 2421303 - DNA, 16 bp, Homo sapiens
gactctgtgctggcca

SEQ ID NO: 2421304 - DNA, 11 bp, Homo sapiens
gactcttgcct

SEQ ID NO: 2421305 - DNA, 21 bp, Homo sapiens
gactcttgcctgtttcccagg

SEQ ID NO: 2421306 - DNA, 17 bp, Homo sapiens
gactcttttccttccct

SEQ ID NO: 2421307 - DNA, 16 bp, Homo sapiens
gactgagtgggaagcc

SEQ ID NO: 2421308 - DNA, 17 bp, Homo sapiens
gactgagtgggaagccc

SEQ ID NO: 2421309 - DNA, 15 bp, Homo sapiens
gactgatgtctccta

SEQ ID NO: 2421310 - DNA, 22 bp, Homo sapiens
gactgatgtctcctaagcacct

SEQ ID NO: 2421311 - DNA, 20 bp, Homo sapiens
gactgccaagactgctgtgg

SEQ ID NO: 2421312 - DNA, 12 bp, Homo sapiens
gactgctaaata

SEQ ID NO: 2421313 - DNA, 17 bp, Homo sapiens
gactgctaaataaaatt

SEQ ID NO: 2421314 - DNA, 15 bp, Homo sapiens
gactgctggtttgta

SEQ ID NO: 2421315 - DNA, 17 bp, Homo sapiens
gactgctgtggccagga

SEQ ID NO: 2421316 - DNA, 18 bp, Homo sapiens
gactgctgtggccaggag

SEQ ID NO: 2421317 - DNA, 19 bp, Homo sapiens
gactgctgtggccaggagg

SEQ ID NO: 2421318 - DNA, 21 bp, Homo sapiens
gactggaagctaatttgcatt

SEQ ID NO: 2421319 - DNA, 17 bp, Homo sapiens
gactggatgtaccacca

SEQ ID NO: 2421320 - DNA, 23 bp, Homo sapiens
gactggcatactatgtggatgtg

SEQ ID NO: 2421321 - DNA, 10 bp, Homo sapiens
gactggcttt

SEQ ID NO: 2421322 - DNA, 23 bp, Homo sapiens
gactggcttttattaatgcactt

SEQ ID NO: 2421323 - DNA, 20 bp, Homo sapiens
gactgggaccaggcaccagg

SEQ ID NO: 2421324 - DNA, 18 bp, Homo sapiens
gactgggagcccccagcc

SEQ ID NO: 2421325 - DNA, 14 bp, Homo sapiens
gactgggctgaggg

SEQ ID NO: 2421326 - DNA, 13 bp, Homo sapiens
gactgtagggagg

SEQ ID NO: 2421327 - DNA, 22 bp, Homo sapiens
gactgtagggagggcggcaggg

SEQ ID NO: 2421328 - DNA, 19 bp, Homo sapiens
gactgtctggcccccctgg

SEQ ID NO: 2421329 - DNA, 15 bp, Homo sapiens
gactgtgtgtgccct

SEQ ID NO: 2421330 - DNA, 17 bp, Homo sapiens
gactgtgtgtgccctct

SEQ ID NO: 2421331 - DNA, 18 bp, Homo sapiens
gactgtgtgtgccctctg

SEQ ID NO: 2421332 - DNA, 19 bp, Homo sapiens
gactgttttctctcggctc

SEQ ID NO: 2421333 - DNA, 20 bp, Homo sapiens
gacttaagcatctggctcta

SEQ ID NO: 2421334 - DNA, 21 bp, Homo sapiens
gacttaagcccagtgcactga

SEQ ID NO: 2421335 - DNA, 16 bp, Homo sapiens
gacttagggcaccagg

SEQ ID NO: 2421336 - DNA, 12 bp, Homo sapiens
gacttcatccca

SEQ ID NO: 2421337 - DNA, 24 bp, Homo sapiens
gacttcatctcccacctagcagca

SEQ ID NO: 2421338 - DNA, 12 bp, Homo sapiens
gacttcccagct

SEQ ID NO: 2421339 - DNA, 19 bp, Homo sapiens
gacttcctgtccagctcca

SEQ ID NO: 2421340 - DNA, 14 bp, Homo sapiens
gacttctctttgcc

SEQ ID NO: 2421341 - DNA, 14 bp, Homo sapiens
gacttggcctctct

SEQ ID NO: 2421342 - DNA, 18 bp, Homo sapiens
gacttgggcacccccagc

SEQ ID NO: 2421343 - DNA, 18 bp, Homo sapiens
gagctctgagaggccctg

SEQ ID NO: 2421344 - DNA, 22 bp, Homo sapiens
gagctctgagaggccctggatc

SEQ ID NO: 2421345 - DNA, 14 bp, Homo sapiens
gagctgaccagccg

SEQ ID NO: 2421346 - DNA, 16 bp, Homo sapiens
gagctgcctggacccg

SEQ ID NO: 2421347 - DNA, 13 bp, Homo sapiens
gagctggctctga

SEQ ID NO: 2421348 - DNA, 12 bp, Homo sapiens
gagctgggcctg

SEQ ID NO: 2421349 - DNA, 16 bp, Homo sapiens
gagctgggcctggtct

SEQ ID NO: 2421350 - DNA, 13 bp, Homo sapiens
gagctggggacct

SEQ ID NO: 2421351 - DNA, 19 bp, Homo sapiens
gagctggggacctggtacc

SEQ ID NO: 2421352 - DNA, 20 bp, Homo sapiens
gagctggtgcggctggccat

SEQ ID NO: 2421353 - DNA, 20 bp, Homo sapiens
gagctgtgagttctccctgt

SEQ ID NO: 2421354 - DNA, 17 bp, Homo sapiens
gagcttaaaatacaaga

SEQ ID NO: 2421355 - DNA, 17 bp, Homo sapiens
gagctttctgaacagct

SEQ ID NO: 2421356 - DNA, 20 bp, Homo sapiens
gagctttctgaacagctggt

SEQ ID NO: 2421357 - DNA, 22 bp, Homo sapiens
gagctttctgaacagctggtgt

SEQ ID NO: 2421358 - DNA, 23 bp, Homo sapiens
gagctttgtctacttcaaaagtt

SEQ ID NO: 2421359 - DNA, 13 bp, Homo sapiens
gaggaagaatggt

SEQ ID NO: 2421360 - DNA, 18 bp, Homo sapiens
gaggacaagagaaaaaag

SEQ ID NO: 2421361 - DNA, 17 bp, Homo sapiens
gaggacagatgcctcct

SEQ ID NO: 2421362 - DNA, 13 bp, Homo sapiens
gaggacctgagcc

SEQ ID NO: 2421363 - DNA, 15 bp, Homo sapiens
gaggacctgagcctg

SEQ ID NO: 2421364 - DNA, 16 bp, Homo sapiens
gaggacctgagcctgc

SEQ ID NO: 2421365 - DNA, 17 bp, Homo sapiens
gaggagatgctccttgg

SEQ ID NO: 2421366 - DNA, 20 bp, Homo sapiens
gaggagcagcaggagggggg

SEQ ID NO: 2421367 - DNA, 16 bp, Homo sapiens
gaggagccaccagttc

SEQ ID NO: 2421368 - DNA, 23 bp, Homo sapiens
gaggagcccacgacactgcagcc

SEQ ID NO: 2421369 - DNA, 13 bp, Homo sapiens
gaggagcccaggc

SEQ ID NO: 2421370 - DNA, 20 bp, Homo sapiens
gaggagcccccaccctgttc

SEQ ID NO: 2421371 - DNA, 23 bp, Homo sapiens
gaggagcccccaccctgttcctg

SEQ ID NO: 2421372 - DNA, 12 bp, Homo sapiens
gaggagcctgtc

SEQ ID NO: 2421373 - DNA, 14 bp, Homo sapiens
gaggagcctgtcct

SEQ ID NO: 2421374 - DNA, 12 bp, Homo sapiens
gatccagggaca

SEQ ID NO: 2421375 - DNA, 13 bp, Homo sapiens
gatccagggacag

SEQ ID NO: 2421376 - DNA, 20 bp, Homo sapiens
gatccagggaggctggtcct

SEQ ID NO: 2421377 - DNA, 17 bp, Homo sapiens
gatccagtataagacta

SEQ ID NO: 2421378 - DNA, 14 bp, Homo sapiens
gatccatgtaactg

SEQ ID NO: 2421379 - DNA, 14 bp, Homo sapiens
gatccatttctaat

SEQ ID NO: 2421380 - DNA, 17 bp, Homo sapiens
gatcccagagagcccga

SEQ ID NO: 2421381 - DNA, 21 bp, Homo sapiens
gatccctgtgttgtctctaga

SEQ ID NO: 2421382 - DNA, 24 bp, Homo sapiens
gatccctgtgttgtctctagagca

SEQ ID NO: 2421383 - DNA, 14 bp, Homo sapiens
gatccgactgcttt

SEQ ID NO: 2421384 - DNA, 15 bp, Homo sapiens
gatcctagatcctaa

SEQ ID NO: 2421385 - DNA, 16 bp, Homo sapiens
gatcctcctgcagacc

SEQ ID NO: 2421386 - DNA, 18 bp, Homo sapiens
gatcctgcgggtggggct

SEQ ID NO: 2421387 - DNA, 16 bp, Homo sapiens
gatcctggaggcccag

SEQ ID NO: 2421388 - DNA, 17 bp, Homo sapiens
gatcctggaggcccagt

SEQ ID NO: 2421389 - DNA, 20 bp, Homo sapiens
gatcctgtattcagacagat

SEQ ID NO: 2421390 - DNA, 14 bp, Homo sapiens
gatcgccttcccca

SEQ ID NO: 2421391 - DNA, 14 bp, Homo sapiens
gatctaaataaaat

SEQ ID NO: 2421392 - DNA, 18 bp, Homo sapiens
gatctaaataaaatgcta

SEQ ID NO: 2421393 - DNA, 23 bp, Homo sapiens
gatctcaccaggcagcctctggg

SEQ ID NO: 2421394 - DNA, 14 bp, Homo sapiens
gatctctgaagcca

SEQ ID NO: 2421395 - DNA, 19 bp, Homo sapiens
gatctctgaagccacaaat

SEQ ID NO: 2421396 - DNA, 17 bp, Homo sapiens
gatctgagtcagagcca

SEQ ID NO: 2421397 - DNA, 12 bp, Homo sapiens
gatctggaaccc

SEQ ID NO: 2421398 - DNA, 16 bp, Homo sapiens
gatctggaacctcagc

SEQ ID NO: 2421399 - DNA, 19 bp, Homo sapiens
gatctggaacctcagcctg

SEQ ID NO: 2421400 - DNA, 14 bp, Homo sapiens
gatcttttttgtca

SEQ ID NO: 2421401 - DNA, 15 bp, Homo sapiens
gattgcacgtggcct

SEQ ID NO: 2421402 - DNA, 17 bp, Homo sapiens
gattgcacgtggcctct

SEQ ID NO: 2421403 - DNA, 15 bp, Homo sapiens
gattgcgagagatgt

SEQ ID NO: 2421404 - DNA, 21 bp, Homo sapiens
gattgcgagagatgtgtgttg

SEQ ID NO: 2421405 - DNA, 21 bp, Homo sapiens
gattgctgccccatcagtgct

SEQ ID NO: 2421406 - DNA, 16 bp, Homo sapiens
gattggcctgtagagt

SEQ ID NO: 2421407 - DNA, 21 bp, Homo sapiens
gattgggtttttggacttctg

SEQ ID NO: 2421408 - DNA, 23 bp, Homo sapiens
gattgtaatatgtaaatggtatg

SEQ ID NO: 2421409 - DNA, 15 bp, Homo sapiens
gattgtattgttgaa

SEQ ID NO: 2421410 - DNA, 20 bp, Homo sapiens
gattgtattgttgaaaaagt

SEQ ID NO: 2421411 - DNA, 23 bp, Homo sapiens
gatttaatataaagttttatata

SEQ ID NO: 2421412 - DNA, 19 bp, Homo sapiens
gatttaatctgccaagggc

SEQ ID NO: 2421413 - DNA, 20 bp, Homo sapiens
gatttaggagaagccaggaa

SEQ ID NO: 2421414 - DNA, 19 bp, Homo sapiens
gatttatcacacaaagcag

SEQ ID NO: 2421415 - DNA, 12 bp, Homo sapiens
gatttattaaag

SEQ ID NO: 2421416 - DNA, 15 bp, Homo sapiens
gatttattaaagaaa

SEQ ID NO: 2421417 - DNA, 15 bp, Homo sapiens
gatttcatagttcag

SEQ ID NO: 2421418 - DNA, 13 bp, Homo sapiens
gatttccttgaat

SEQ ID NO: 2421419 - DNA, 18 bp, Homo sapiens
gatttgaagaacatgtga

SEQ ID NO: 2421420 - DNA, 13 bp, Homo sapiens
gatttgacattgc

SEQ ID NO: 2421421 - DNA, 21 bp, Homo sapiens
gatttgcattgaacacaaact

SEQ ID NO: 2421422 - DNA, 19 bp, Homo sapiens
gatttgtaacccactgaga

SEQ ID NO: 2421423 - DNA, 13 bp, Homo sapiens
gattttacatgaa

SEQ ID NO: 2421424 - DNA, 19 bp, Homo sapiens
gattttaggagctaaggct

SEQ ID NO: 2421425 - DNA, 20 bp, Homo sapiens
gattttctgctactttgctg

SEQ ID NO: 2421426 - DNA, 15 bp, Homo sapiens
gattttctggttcta

SEQ ID NO: 2421427 - DNA, 16 bp, Homo sapiens
gattttctggttctaa

SEQ ID NO: 2421428 - DNA, 17 bp, Homo sapiens
gattttcttttgccttt

SEQ ID NO: 2421429 - DNA, 16 bp, Homo sapiens
gatttttaaaatgtac

SEQ ID NO: 2421430 - DNA, 12 bp, Homo sapiens
gatttttcttta

SEQ ID NO: 2421431 - DNA, 13 bp, Homo sapiens
gatttttctttaa

SEQ ID NO: 2421432 - DNA, 19 bp, Homo sapiens
gattttttaataatttaga

SEQ ID NO: 2421433 - DNA, 11 bp, Homo sapiens
gattttttcca

SEQ ID NO: 2421434 - DNA, 13 bp, Homo sapiens
gattttttccaaa

SEQ ID NO: 2421435 - DNA, 14 bp, Homo sapiens
gattttttccaaaa

SEQ ID NO: 2421436 - DNA, 18 bp, Homo sapiens
gattttttccttcaaagt

SEQ ID NO: 2421437 - DNA, 16 bp, Homo sapiens
gattttttttttttct

SEQ ID NO: 2421438 - DNA, 20 bp, Homo sapiens
gatttttttttttttttcct

SEQ ID NO: 2421439 - DNA, 14 bp, Homo sapiens
gcaaaaaagaaaac

SEQ ID NO: 2421440 - DNA, 15 bp, Homo sapiens
gcaaaaaagaaaacc

SEQ ID NO: 2421441 - DNA, 18 bp, Homo sapiens
gcaaaaaagaaaaccttt

SEQ ID NO: 2421442 - DNA, 17 bp, Homo sapiens
gcaaaaaatgtttttgg

SEQ ID NO: 2421443 - DNA, 23 bp, Homo sapiens
gcaaaaatagtttggatatgtaa

SEQ ID NO: 2421444 - DNA, 17 bp, Homo sapiens
gcaaaactctacttaat

SEQ ID NO: 2421445 - DNA, 22 bp, Homo sapiens
gcaaaactctacttaatccaat

SEQ ID NO: 2421446 - DNA, 23 bp, Homo sapiens
gcaaaactctacttaatccaatg

SEQ ID NO: 2421447 - DNA, 13 bp, Homo sapiens
gcaaaattgcaaa

SEQ ID NO: 2421448 - DNA, 12 bp, Homo sapiens
gcaaacacttaa

SEQ ID NO: 2421449 - DNA, 13 bp, Homo sapiens
gcaaactgcatgc

SEQ ID NO: 2421450 - DNA, 14 bp, Homo sapiens
gcaaagaattgact

SEQ ID NO: 2421451 - DNA, 16 bp, Homo sapiens
gcaaagatttaatctg

SEQ ID NO: 2421452 - DNA, 16 bp, Homo sapiens
gcaaagccaggtccct

SEQ ID NO: 2421453 - DNA, 13 bp, Homo sapiens
gcaaagcccccag

SEQ ID NO: 2421454 - DNA, 12 bp, Homo sapiens
gcaaagcctgtt

SEQ ID NO: 2421455 - DNA, 15 bp, Homo sapiens
gcaaaggaaggtgga

SEQ ID NO: 2421456 - DNA, 15 bp, Homo sapiens
gcaaagtggttccct

SEQ ID NO: 2421457 - DNA, 17 bp, Homo sapiens
gcaaatcaggcttttgt

SEQ ID NO: 2421458 - DNA, 20 bp, Homo sapiens
gcaaatgtcatgctgcctta

SEQ ID NO: 2421459 - DNA, 12 bp, Homo sapiens
gcaacagatctg

SEQ ID NO: 2421460 - DNA, 22 bp, Homo sapiens
gcaacagggtatggactatctg

SEQ ID NO: 2421461 - DNA, 14 bp, Homo sapiens
gcaacatgatgagg

SEQ ID NO: 2421462 - DNA, 13 bp, Homo sapiens
gcaacatggcttt

SEQ ID NO: 2421463 - DNA, 18 bp, Homo sapiens
gcaaccgtggcccttcct

SEQ ID NO: 2421464 - DNA, 19 bp, Homo sapiens
gcaacctacctgttgagca

SEQ ID NO: 2421465 - DNA, 19 bp, Homo sapiens
gcaacctcagtaatttaga

SEQ ID NO: 2421466 - DNA, 16 bp, Homo sapiens
gcaacctcttggcctg

SEQ ID NO: 2421467 - DNA, 17 bp, Homo sapiens
gcaacgctattccagct

SEQ ID NO: 2421468 - DNA, 19 bp, Homo sapiens
gcaactatcagactaagcc

SEQ ID NO: 2421469 - DNA, 22 bp, Homo sapiens
gcaactcaaggactttgcagcc

SEQ ID NO: 2421470 - DNA, 18 bp, Homo sapiens
gcaagaggccgtggctgc

SEQ ID NO: 2421471 - DNA, 20 bp, Homo sapiens
gcaagaggccgtggctgctg

SEQ ID NO: 2421472 - DNA, 23 bp, Homo sapiens
gcaagcttaatggctgataattt

SEQ ID NO: 2421473 - DNA, 15 bp, Homo sapiens
gcaaggcagccgtgg

SEQ ID NO: 2421474 - DNA, 18 bp, Homo sapiens
gcaaggcccgagcagctg

SEQ ID NO: 2421475 - DNA, 21 bp, Homo sapiens
gcaaggcccgagcagctgagc

SEQ ID NO: 2421476 - DNA, 16 bp, Homo sapiens
gcaataaatctgaccc

SEQ ID NO: 2421477 - DNA, 13 bp, Homo sapiens
gcaatacatacca

SEQ ID NO: 2421478 - DNA, 20 bp, Homo sapiens
gcaatgggagctgaggccac

SEQ ID NO: 2421479 - DNA, 15 bp, Homo sapiens
gcaatgtaaatattt

SEQ ID NO: 2421480 - DNA, 18 bp, Homo sapiens
gcaatgtaaatattttaa

SEQ ID NO: 2421481 - DNA, 13 bp, Homo sapiens
gaatgtgaagcct

SEQ ID NO: 2421482 - DNA, 20 bp, Homo sapiens
gaatgtgaagccttcccctt

SEQ ID NO: 2421483 - DNA, 19 bp, Homo sapiens
gaatgtgataaggaaatca

SEQ ID NO: 2421484 - DNA, 15 bp, Homo sapiens
gaatgtgtctttaga

SEQ ID NO: 2421485 - DNA, 20 bp, Homo sapiens
gaatgtgtttcacagtttga

SEQ ID NO: 2421486 - DNA, 21 bp, Homo sapiens
gaatgtgtttcacagtttgaa

SEQ ID NO: 2421487 - DNA, 22 bp, Homo sapiens
gaatgtgtttcacagtttgaaa

SEQ ID NO: 2421488 - DNA, 20 bp, Homo sapiens
gaatgttgattacagtgcag

SEQ ID NO: 2421489 - DNA, 14 bp, Homo sapiens
gaatgttgggactg

SEQ ID NO: 2421490 - DNA, 23 bp, Homo sapiens
gaatgttgggactgctaaataaa

SEQ ID NO: 2421491 - DNA, 21 bp, Homo sapiens
gaatgtttacactctttgtaa

SEQ ID NO: 2421492 - DNA, 17 bp, Homo sapiens
gaattaggctgtaacta

SEQ ID NO: 2421493 - DNA, 14 bp, Homo sapiens
gaattatctaattt

SEQ ID NO: 2421494 - DNA, 12 bp, Homo sapiens
gaattccctcac

SEQ ID NO: 2421495 - DNA, 12 bp, Homo sapiens
gaattgatttgc

SEQ ID NO: 2421496 - DNA, 15 bp, Homo sapiens
gaattgatttgcatt

SEQ ID NO: 2421497 - DNA, 18 bp, Homo sapiens
gaattgatttgcattgaa

SEQ ID NO: 2421498 - DNA, 12 bp, Homo sapiens
gaattgcattga

SEQ ID NO: 2421499 - DNA, 24 bp, Homo sapiens
gaattgcttgtttgcttcaactgt

SEQ ID NO: 2421500 - DNA, 16 bp, Homo sapiens
gaattgtaactgttct

SEQ ID NO: 2421501 - DNA, 14 bp, Homo sapiens
gaatttcccaggac

SEQ ID NO: 2421502 - DNA, 15 bp, Homo sapiens
gaatttcccaggacc

SEQ ID NO: 2421503 - DNA, 16 bp, Homo sapiens
gaatttcttaacttct

SEQ ID NO: 2421504 - DNA, 17 bp, Homo sapiens
gaatttcttaacttctt

SEQ ID NO: 2421505 - DNA, 17 bp, Homo sapiens
gaatttgagtgctctga

SEQ ID NO: 2421506 - DNA, 15 bp, Homo sapiens
gaattttagcttttg

SEQ ID NO: 2421507 - DNA, 16 bp, Homo sapiens
gaattttagcttttgt

SEQ ID NO: 2421508 - DNA, 17 bp, Homo sapiens
gaatttttaaacaagta

SEQ ID NO: 2421509 - DNA, 20 bp, Homo sapiens
gaattttttttaacattcct

SEQ ID NO: 2421510 - DNA, 15 bp, Homo sapiens
gacaaactttgcatc

SEQ ID NO: 2421511 - DNA, 20 bp, Homo sapiens
gacaaatcacatattttaaa

SEQ ID NO: 2421512 - DNA, 19 bp, Homo sapiens
gacaaccactggtctgtag

SEQ ID NO: 2421513 - DNA, 21 bp, Homo sapiens
gacaactgctcccacctcctg

SEQ ID NO: 2421514 - DNA, 17 bp, Homo sapiens
gacaactggcaggcagg

SEQ ID NO: 2421515 - DNA, 13 bp, Homo sapiens
gacaagcttctga

SEQ ID NO: 2421516 - DNA, 15 bp, Homo sapiens
gacaagtggactcag

SEQ ID NO: 2421517 - DNA, 15 bp, Homo sapiens
gacacaaacacacac

SEQ ID NO: 2421518 - DNA, 19 bp, Homo sapiens
gacacactaaccaagctga

SEQ ID NO: 2421519 - DNA, 11 bp, Homo sapiens
gacacagaaaa

SEQ ID NO: 2421520 - DNA, 16 bp, Homo sapiens
gacacagaaaatgttg

SEQ ID NO: 2421521 - DNA, 15 bp, Homo sapiens
gacacaggcctgtgt

SEQ ID NO: 2421522 - DNA, 16 bp, Homo sapiens
gacacaggcctgtgta

SEQ ID NO: 2421523 - DNA, 19 bp, Homo sapiens
gacacatgaaggtaaataa

SEQ ID NO: 2421524 - DNA, 23 bp, Homo sapiens
gacacattttttaggaaatgttt

SEQ ID NO: 2421525 - DNA, 13 bp, Homo sapiens
gacacccaggact

SEQ ID NO: 2421526 - DNA, 19 bp, Homo sapiens
gacacccttctcccactct

SEQ ID NO: 2421527 - DNA, 15 bp, Homo sapiens
gacacctaactcttc

SEQ ID NO: 2421528 - DNA, 16 bp, Homo sapiens
gacacctaactcttct

SEQ ID NO: 2421529 - DNA, 14 bp, Homo sapiens
gacacctttaggtt

SEQ ID NO: 2421530 - DNA, 19 bp, Homo sapiens
gacacgggcctgtccacag

SEQ ID NO: 2421531 - DNA, 13 bp, Homo sapiens
gacactcagacct

SEQ ID NO: 2421532 - DNA, 15 bp, Homo sapiens
gacactcagacctga

SEQ ID NO: 2421533 - DNA, 20 bp, Homo sapiens
gacactgctctaacagccct

SEQ ID NO: 2421534 - DNA, 21 bp, Homo sapiens
gacactgctctaacagccctc

SEQ ID NO: 2421535 - DNA, 14 bp, Homo sapiens
gaccactgttatca

SEQ ID NO: 2421536 - DNA, 18 bp, Homo sapiens
gaccagcagacagagcca

SEQ ID NO: 2421537 - DNA, 19 bp, Homo sapiens
gaccagcagacagagccag

SEQ ID NO: 2421538 - DNA, 14 bp, Homo sapiens
gaccagcctggccc

SEQ ID NO: 2421539 - DNA, 16 bp, Homo sapiens
gaccagcctggcccac

SEQ ID NO: 2421540 - DNA, 14 bp, Homo sapiens
gaccagctcaggac

SEQ ID NO: 2421541 - DNA, 19 bp, Homo sapiens
gaccagctgctccgaggac

SEQ ID NO: 2421542 - DNA, 23 bp, Homo sapiens
gaccagctgctccgaggacccag

SEQ ID NO: 2421543 - DNA, 10 bp, Homo sapiens
gaccaggagt

SEQ ID NO: 2421544 - DNA, 23 bp, Homo sapiens
gaccaggcatcctccacaatagc

SEQ ID NO: 2421545 - DNA, 11 bp, Homo sapiens
gaccagggctc

SEQ ID NO: 2421546 - DNA, 18 bp, Homo sapiens
gaccagggctccagcccc

SEQ ID NO: 2421547 - DNA, 16 bp, Homo sapiens
gaccagtcccagagca

SEQ ID NO: 2421548 - DNA, 14 bp, Homo sapiens
gaccagttgcagtc

SEQ ID NO: 2421549 - DNA, 22 bp, Homo sapiens
gaccagttgcagtcactctagt

SEQ ID NO: 2421550 - DNA, 21 bp, Homo sapiens
gaccatgctcatctgctggtc

SEQ ID NO: 2421551 - DNA, 22 bp, Homo sapiens
gaccatggttaagagtccaaga

SEQ ID NO: 2421552 - DNA, 14 bp, Homo sapiens
gacccacatgccat

SEQ ID NO: 2421553 - DNA, 17 bp, Homo sapiens
gacccagccaggcccag

SEQ ID NO: 2421554 - DNA, 19 bp, Homo sapiens
gacccagccaggcccagcc

SEQ ID NO: 2421555 - DNA, 22 bp, Homo sapiens
gacccagccaggcccagccgac

SEQ ID NO: 2421556 - DNA, 15 bp, Homo sapiens
gacccagtgccccca

SEQ ID NO: 2421557 - DNA, 16 bp, Homo sapiens
gacccattccttccca

SEQ ID NO: 2421558 - DNA, 16 bp, Homo sapiens
gaccccagggcacagg

SEQ ID NO: 2421559 - DNA, 19 bp, Homo sapiens
gaccccagggcacaggagc

SEQ ID NO: 2421560 - DNA, 17 bp, Homo sapiens
gacccccagctccggcc

SEQ ID NO: 2421561 - DNA, 20 bp, Homo sapiens
gacccccctttcacaggcag

SEQ ID NO: 2421562 - DNA, 22 bp, Homo sapiens
gacccccctttcacaggcagcc

SEQ ID NO: 2421563 - DNA, 16 bp, Homo sapiens
gacccctgttcatgcc

SEQ ID NO: 2421564 - DNA, 17 bp, Homo sapiens
gacccggcaccccctgc

SEQ ID NO: 2421565 - DNA, 20 bp, Homo sapiens
gacccggcaccccctgcagc

SEQ ID NO: 2421566 - DNA, 16 bp, Homo sapiens
gaccctaaatcttgac

SEQ ID NO: 2421567 - DNA, 16 bp, Homo sapiens
gaccctgaaggggcca

SEQ ID NO: 2421568 - DNA, 23 bp, Homo sapiens
gaccctgaccagctccccctccc

SEQ ID NO: 2421569 - DNA, 20 bp, Homo sapiens
gaccctgagctgaccagccg

SEQ ID NO: 2421570 - DNA, 12 bp, Homo sapiens
gaccctgcctct

SEQ ID NO: 2421571 - DNA, 13 bp, Homo sapiens
gaccctgcctctc

SEQ ID NO: 2421572 - DNA, 23 bp, Homo sapiens
gaccctggctccttgtgccagag

SEQ ID NO: 2421573 - DNA, 17 bp, Homo sapiens
gacccttgacacctgct

SEQ ID NO: 2421574 - DNA, 18 bp, Homo sapiens
gacccttttgggtttctg

SEQ ID NO: 2421575 - DNA, 15 bp, Homo sapiens
gaccgccccctcctc

SEQ ID NO: 2421576 - DNA, 16 bp, Homo sapiens
gaccgccccctcctct

SEQ ID NO: 2421577 - DNA, 23 bp, Homo sapiens
gaccgctacaccactctggcagc

SEQ ID NO: 2421578 - DNA, 17 bp, Homo sapiens
gaccggagagtgggggt

SEQ ID NO: 2421579 - DNA, 13 bp, Homo sapiens
gacctacaggggg

SEQ ID NO: 2421580 - DNA, 20 bp, Homo sapiens
gacctacagggggtctggct

SEQ ID NO: 2421581 - DNA, 22 bp, Homo sapiens
gacctacagggggtctggctgg

SEQ ID NO: 2421582 - DNA, 17 bp, Homo sapiens
gacctactgttctaaag

SEQ ID NO: 2421583 - DNA, 20 bp, Homo sapiens
gacctatacctgtgtttctt

SEQ ID NO: 2421584 - DNA, 17 bp, Homo sapiens
gacctcaagtgatctgc

SEQ ID NO: 2421585 - DNA, 21 bp, Homo sapiens
gacctcagttttatcattttc

SEQ ID NO: 2421586 - DNA, 19 bp, Homo sapiens
cttgcctgccactgtgtga

SEQ ID NO: 2421587 - DNA, 21 bp, Homo sapiens
cttgcctgccactgtgtgaat

SEQ ID NO: 2421588 - DNA, 14 bp, Homo sapiens
cttgcctgtgccag

SEQ ID NO: 2421589 - DNA, 18 bp, Homo sapiens
cttgccttattagagtgt

SEQ ID NO: 2421590 - DNA, 15 bp, Homo sapiens
cttgccttctggtgt

SEQ ID NO: 2421591 - DNA, 15 bp, Homo sapiens
cttgcggctcctcag

SEQ ID NO: 2421592 - DNA, 15 bp, Homo sapiens
cttgctcctccttct

SEQ ID NO: 2421593 - DNA, 11 bp, Homo sapiens
cttgctgcttt

SEQ ID NO: 2421594 - DNA, 15 bp, Homo sapiens
cttgctgtgaattaa

SEQ ID NO: 2421595 - DNA, 18 bp, Homo sapiens
cttgcttctttctagaaa

SEQ ID NO: 2421596 - DNA, 19 bp, Homo sapiens
cttgcttctttctagaaag

SEQ ID NO: 2421597 - DNA, 13 bp, Homo sapiens
cttgcttttcatg

SEQ ID NO: 2421598 - DNA, 19 bp, Homo sapiens
cttgcttttcatgcaaact

SEQ ID NO: 2421599 - DNA, 11 bp, Homo sapiens
cttggaactgc

SEQ ID NO: 2421600 - DNA, 22 bp, Homo sapiens
cttggaacttgcctgcctttcc

SEQ ID NO: 2421601 - DNA, 14 bp, Homo sapiens
cttggacaaatcac

SEQ ID NO: 2421602 - DNA, 15 bp, Homo sapiens
cttggacacgctcag

SEQ ID NO: 2421603 - DNA, 15 bp, Homo sapiens
cttggacatcctcct

SEQ ID NO: 2421604 - DNA, 17 bp, Homo sapiens
cttggacatcctcctcc

SEQ ID NO: 2421605 - DNA, 18 bp, Homo sapiens
cttggagtattggggtct

SEQ ID NO: 2421606 - DNA, 16 bp, Homo sapiens
cttggatacttggatt

SEQ ID NO: 2421607 - DNA, 18 bp, Homo sapiens
cttggattctttccattt

SEQ ID NO: 2421608 - DNA, 19 bp, Homo sapiens
cttggcaccagacacccag

SEQ ID NO: 2421609 - DNA, 21 bp, Homo sapiens
cttggcaccagacacccagga

SEQ ID NO: 2421610 - DNA, 16 bp, Homo sapiens
cttggcagccttgtga

SEQ ID NO: 2421611 - DNA, 14 bp, Homo sapiens
cttggcctctctct

SEQ ID NO: 2421612 - DNA, 16 bp, Homo sapiens
cttggcctctctctag

SEQ ID NO: 2421613 - DNA, 17 bp, Homo sapiens
cttggcctgatcagacc

SEQ ID NO: 2421614 - DNA, 13 bp, Homo sapiens
cttggcctggagc

SEQ ID NO: 2421615 - DNA, 14 bp, Homo sapiens
cttggcgatgccag

SEQ ID NO: 2421616 - DNA, 18 bp, Homo sapiens
cttggcgatgccagccaa

SEQ ID NO: 2421617 - DNA, 23 bp, Homo sapiens
cttggctcacactcgacatgaaa

SEQ ID NO: 2421618 - DNA, 19 bp, Homo sapiens
cttggctcgaatctctgtg

SEQ ID NO: 2421619 - DNA, 20 bp, Homo sapiens
cttggctcgaatctctgtgc

SEQ ID NO: 2421620 - DNA, 12 bp, Homo sapiens
cttggctggtgt

SEQ ID NO: 2421621 - DNA, 13 bp, Homo sapiens
cttggctggtgtg

SEQ ID NO: 2421622 - DNA, 20 bp, Homo sapiens
cttggctggtgtggtacaga

SEQ ID NO: 2421623 - DNA, 23 bp, Homo sapiens
cttggctggtgtggtacagagaa

SEQ ID NO: 2421624 - DNA, 18 bp, Homo sapiens
cttgggaagactcctagc

SEQ ID NO: 2421625 - DNA, 20 bp, Homo sapiens
cttgggaagactcctagctg

SEQ ID NO: 2421626 - DNA, 20 bp, Homo sapiens
cttgggactaaatgccctgc

SEQ ID NO: 2421627 - DNA, 13 bp, Homo sapiens
cttgggcaccccc

SEQ ID NO: 2421628 - DNA, 19 bp, Homo sapiens
cttgggcacccccagcctg

SEQ ID NO: 2421629 - DNA, 19 bp, Homo sapiens
cttgggcagagctggctct

SEQ ID NO: 2421630 - DNA, 20 bp, Homo sapiens
cttgggcagagctggctctg

SEQ ID NO: 2421631 - DNA, 14 bp, Homo sapiens
cttgggccctttga

SEQ ID NO: 2421632 - DNA, 16 bp, Homo sapiens
cttgggccctttgagt

SEQ ID NO: 2421633 - DNA, 17 bp, Homo sapiens
cttgggcctaggctgca

SEQ ID NO: 2421634 - DNA, 21 bp, Homo sapiens
cttgggctccctgtaacctct

SEQ ID NO: 2421635 - DNA, 21 bp, Homo sapiens
cttgggctccgtgtgggagac

SEQ ID NO: 2421636 - DNA, 20 bp, Homo sapiens
cttggggggtgatgagggca

SEQ ID NO: 2421637 - DNA, 16 bp, Homo sapiens
cttggttgaggaaaca

SEQ ID NO: 2421638 - DNA, 23 bp, Homo sapiens
cttggtttttactgctctgagaa

SEQ ID NO: 2421639 - DNA, 23 bp, Homo sapiens
cttgtaaattattaatttatgca

SEQ ID NO: 2421640 - DNA, 10 bp, Homo sapiens
cttgtaatta

SEQ ID NO: 2421641 - DNA, 11 bp, Homo sapiens
cttgtaattat

SEQ ID NO: 2421642 - DNA, 14 bp, Homo sapiens
cttgtaattatgga

SEQ ID NO: 2421643 - DNA, 13 bp, Homo sapiens
cttgtagccagcc

SEQ ID NO: 2421644 - DNA, 21 bp, Homo sapiens
cttgtagccagccggggcgag

SEQ ID NO: 2421645 - DNA, 17 bp, Homo sapiens
cttgtatattttaagaa

SEQ ID NO: 2421646 - DNA, 12 bp, Homo sapiens
cttgtcatgtgt

SEQ ID NO: 2421647 - DNA, 13 bp, Homo sapiens
cttgtcatgtgta

SEQ ID NO: 2421648 - DNA, 14 bp, Homo sapiens
cttgtcatgtgtat

SEQ ID NO: 2421649 - DNA, 21 bp, Homo sapiens
gaaaataaggcacccatctgt

SEQ ID NO: 2421650 - DNA, 13 bp, Homo sapiens
gaaaatgaaagct

SEQ ID NO: 2421651 - DNA, 15 bp, Homo sapiens
gaaaatgatacagca

SEQ ID NO: 2421652 - DNA, 15 bp, Homo sapiens
gaaaatgcggttata

SEQ ID NO: 2421653 - DNA, 22 bp, Homo sapiens
gaaaatggtccaattagtttcc

SEQ ID NO: 2421654 - DNA, 18 bp, Homo sapiens
gaaaatggtccaggagaa

SEQ ID NO: 2421655 - DNA, 14 bp, Homo sapiens
gaaaatgtcttgtg

SEQ ID NO: 2421656 - DNA, 15 bp, Homo sapiens
gaaaatgttgagaat

SEQ ID NO: 2421657 - DNA, 14 bp, Homo sapiens
gaaaattcattttt

SEQ ID NO: 2421658 - DNA, 22 bp, Homo sapiens
gaaaattctgtgccttgttttt

SEQ ID NO: 2421659 - DNA, 13 bp, Homo sapiens
gaaacaaaataca

SEQ ID NO: 2421660 - DNA, 14 bp, Homo sapiens
gaaacaacactgta

SEQ ID NO: 2421661 - DNA, 14 bp, Homo sapiens
gaaacacagaaacc

SEQ ID NO: 2421662 - DNA, 22 bp, Homo sapiens
gaaacagaaaaatatgtaccaa

SEQ ID NO: 2421663 - DNA, 21 bp, Homo sapiens
gaaacagttggtaacttttgt

SEQ ID NO: 2421664 - DNA, 13 bp, Homo sapiens
gaaacatttatat

SEQ ID NO: 2421665 - DNA, 18 bp, Homo sapiens
gaaactggccatggcctg

SEQ ID NO: 2421666 - DNA, 19 bp, Homo sapiens
gaaactggccatggcctgc

SEQ ID NO: 2421667 - DNA, 11 bp, Homo sapiens
gaaacttttct

SEQ ID NO: 2421668 - DNA, 17 bp, Homo sapiens
gaaagaggcaccaggaa

SEQ ID NO: 2421669 - DNA, 21 bp, Homo sapiens
gaaagaggcaccaggaagccg

SEQ ID NO: 2421670 - DNA, 19 bp, Homo sapiens
gaaagaggtgaccccaggg

SEQ ID NO: 2421671 - DNA, 23 bp, Homo sapiens
gaaagaggtgaccccagggcaca

SEQ ID NO: 2421672 - DNA, 20 bp, Homo sapiens
gaaagcaagaatcagagaag

SEQ ID NO: 2421673 - DNA, 23 bp, Homo sapiens
gaaagcccctgcccctcctctcc

SEQ ID NO: 2421674 - DNA, 12 bp, Homo sapiens
gaaagctctaga

SEQ ID NO: 2421675 - DNA, 12 bp, Homo sapiens
gaaaggagatgt

SEQ ID NO: 2421676 - DNA, 15 bp, Homo sapiens
gaaaggccagcactc

SEQ ID NO: 2421677 - DNA, 13 bp, Homo sapiens
gaaagggagggct

SEQ ID NO: 2421678 - DNA, 14 bp, Homo sapiens
gaaagggagggctc

SEQ ID NO: 2421679 - DNA, 19 bp, Homo sapiens
gaaagggagggctctgagg

SEQ ID NO: 2421680 - DNA, 13 bp, Homo sapiens
gaaaggggagccc

SEQ ID NO: 2421681 - DNA, 17 bp, Homo sapiens
gaaaggtggtgtttctg

SEQ ID NO: 2421682 - DNA, 13 bp, Homo sapiens
gaaaggttttttt

SEQ ID NO: 2421683 - DNA, 17 bp, Homo sapiens
gaaagtacactctgctg

SEQ ID NO: 2421684 - DNA, 19 bp, Homo sapiens
gaaagtacactctgctgtt

SEQ ID NO: 2421685 - DNA, 16 bp, Homo sapiens
gaaagtgcctttcagg

SEQ ID NO: 2421686 - DNA, 18 bp, Homo sapiens
gaaagtgggcaaaagctt

SEQ ID NO: 2421687 - DNA, 11 bp, Homo sapiens
gaaagtgtatt

SEQ ID NO: 2421688 - DNA, 21 bp, Homo sapiens
gaaataaaactgtttttgaac

SEQ ID NO: 2421689 - DNA, 16 bp, Homo sapiens
gaaataaaaggaagcc

SEQ ID NO: 2421690 - DNA, 19 bp, Homo sapiens
gaaataaaaggaagccaaa

SEQ ID NO: 2421691 - DNA, 20 bp, Homo sapiens
gaaataaaggatgtgattgt

SEQ ID NO: 2421692 - DNA, 20 bp, Homo sapiens
gaaataagctatttgatgta

SEQ ID NO: 2421693 - DNA, 23 bp, Homo sapiens
gaaataagctatttgatgtaata

SEQ ID NO: 2421694 - DNA, 20 bp, Homo sapiens
gaaataagtgccctctccca

SEQ ID NO: 2421695 - DNA, 19 bp, Homo sapiens
gaaataatgtacatctggc

SEQ ID NO: 2421696 - DNA, 12 bp, Homo sapiens
gaaataatgtgt

SEQ ID NO: 2421697 - DNA, 13 bp, Homo sapiens
gaaataatgtgta

SEQ ID NO: 2421698 - DNA, 19 bp, Homo sapiens
gaagtctcatctggggagc

SEQ ID NO: 2421699 - DNA, 23 bp, Homo sapiens
gaagtgcatctggagagaacagg

SEQ ID NO: 2421700 - DNA, 18 bp, Homo sapiens
gaagtgctgtttattaat

SEQ ID NO: 2421701 - DNA, 21 bp, Homo sapiens
gaagtgcttagtgtacttgga

SEQ ID NO: 2421702 - DNA, 19 bp, Homo sapiens
gaagttagctttaacttaa

SEQ ID NO: 2421703 - DNA, 17 bp, Homo sapiens
gaagttagtttgtatat

SEQ ID NO: 2421704 - DNA, 13 bp, Homo sapiens
gaagttttacatt

SEQ ID NO: 2421705 - DNA, 17 bp, Homo sapiens
gaataaaggcagttttc

SEQ ID NO: 2421706 - DNA, 19 bp, Homo sapiens
gaataaaggcagttttcta

SEQ ID NO: 2421707 - DNA, 20 bp, Homo sapiens
gaataaaggcagttttctaa

SEQ ID NO: 2421708 - DNA, 16 bp, Homo sapiens
gaataaatgtcacttt

SEQ ID NO: 2421709 - DNA, 23 bp, Homo sapiens
gaataaatgtcactttttgaggc

SEQ ID NO: 2421710 - DNA, 17 bp, Homo sapiens
gaataaattgtacagcc

SEQ ID NO: 2421711 - DNA, 17 bp, Homo sapiens
gaataaggtacaagaag

SEQ ID NO: 2421712 - DNA, 23 bp, Homo sapiens
gaataaggtacaagaagcatttt

SEQ ID NO: 2421713 - DNA, 12 bp, Homo sapiens
gaataagttatt

SEQ ID NO: 2421714 - DNA, 13 bp, Homo sapiens
gaataagttattg

SEQ ID NO: 2421715 - DNA, 14 bp, Homo sapiens
gaataagttattgc

SEQ ID NO: 2421716 - DNA, 16 bp, Homo sapiens
gaataccactctgtaa

SEQ ID NO: 2421717 - DNA, 12 bp, Homo sapiens
gaataccctttt

SEQ ID NO: 2421718 - DNA, 20 bp, Homo sapiens
gaatactttttacaattaaa

SEQ ID NO: 2421719 - DNA, 23 bp, Homo sapiens
gaatagaaataaaggatgtgatt

SEQ ID NO: 2421720 - DNA, 17 bp, Homo sapiens
gaatagaagctaaggtt

SEQ ID NO: 2421721 - DNA, 16 bp, Homo sapiens
gaatagatatgaaagc

SEQ ID NO: 2421722 - DNA, 18 bp, Homo sapiens
gaatagccacatttggaa

SEQ ID NO: 2421723 - DNA, 19 bp, Homo sapiens
gaatataattgttttatct

SEQ ID NO: 2421724 - DNA, 20 bp, Homo sapiens
gaatataattgttttatctg

SEQ ID NO: 2421725 - DNA, 17 bp, Homo sapiens
gaatatctgtaatggta

SEQ ID NO: 2421726 - DNA, 17 bp, Homo sapiens
gaatatgaaacatagat

SEQ ID NO: 2421727 - DNA, 14 bp, Homo sapiens
gaatcaaacatttt

SEQ ID NO: 2421728 - DNA, 13 bp, Homo sapiens
gaatcagaactca

SEQ ID NO: 2421729 - DNA, 23 bp, Homo sapiens
gaatcagagaccttccagaaata

SEQ ID NO: 2421730 - DNA, 21 bp, Homo sapiens
gaatcaggaatattttccaaa

SEQ ID NO: 2421731 - DNA, 23 bp, Homo sapiens
gaatcaggaatattttccaaaga

SEQ ID NO: 2421732 - DNA, 17 bp, Homo sapiens
gaatcagtttaaaagca

SEQ ID NO: 2421733 - DNA, 22 bp, Homo sapiens
gaatcatttctatttctcctcc

SEQ ID NO: 2421734 - DNA, 19 bp, Homo sapiens
gaatcccagccccctgacc

SEQ ID NO: 2421735 - DNA, 19 bp, Homo sapiens
gaatccccaacatgcactg

SEQ ID NO: 2421736 - DNA, 19 bp, Homo sapiens
gaatcccttaacagttgta

SEQ ID NO: 2421737 - DNA, 15 bp, Homo sapiens
gaatctactaattcc

SEQ ID NO: 2421738 - DNA, 15 bp, Homo sapiens
gaatctgcaattcaa

SEQ ID NO: 2421739 - DNA, 21 bp, Homo sapiens
gaatctgcaattcaaaagttc

SEQ ID NO: 2421740 - DNA, 22 bp, Homo sapiens
gaatctgcaattcaaaagttcc

SEQ ID NO: 2421741 - DNA, 15 bp, Homo sapiens
gaatgattcagtgtt

SEQ ID NO: 2421742 - DNA, 16 bp, Homo sapiens
gaatgatttttcttta

SEQ ID NO: 2421743 - DNA, 20 bp, Homo sapiens
gaatgcacaagaatggatca

SEQ ID NO: 2421744 - DNA, 21 bp, Homo sapiens
gaatgcacaagaatggatcac

SEQ ID NO: 2421745 - DNA, 18 bp, Homo sapiens
gaatgctgggactcagcc

SEQ ID NO: 2421746 - DNA, 11 bp, Homo sapiens
gaatgtaatca

SEQ ID NO: 2421747 - DNA, 23 bp, Homo sapiens
cttaagacctactgttctaaagc

SEQ ID NO: 2421748 - DNA, 19 bp, Homo sapiens
cttaagcccagtgcactga

SEQ ID NO: 2421749 - DNA, 13 bp, Homo sapiens
cttaatactaagg

SEQ ID NO: 2421750 - DNA, 22 bp, Homo sapiens
cttaatggctgataattttaaa

SEQ ID NO: 2421751 - DNA, 18 bp, Homo sapiens
cttaattattatttgtgt

SEQ ID NO: 2421752 - DNA, 15 bp, Homo sapiens
cttaatttgcacagt

SEQ ID NO: 2421753 - DNA, 14 bp, Homo sapiens
cttacaaatgaaaa

SEQ ID NO: 2421754 - DNA, 23 bp, Homo sapiens
cttacagtaggagcccagctctg

SEQ ID NO: 2421755 - DNA, 19 bp, Homo sapiens
cttaccaggcaccaaaaga

SEQ ID NO: 2421756 - DNA, 16 bp, Homo sapiens
cttactcctgtgggag

SEQ ID NO: 2421757 - DNA, 14 bp, Homo sapiens
cttacttctcacta

SEQ ID NO: 2421758 - DNA, 20 bp, Homo sapiens
cttagaaaaccagctcagca

SEQ ID NO: 2421759 - DNA, 24 bp, Homo sapiens
cttagaaaaccagctcagcactgc

SEQ ID NO: 2421760 - DNA, 21 bp, Homo sapiens
cttagacagaggccctcaagt

SEQ ID NO: 2421761 - DNA, 17 bp, Homo sapiens
cttagagttggccatat

SEQ ID NO: 2421762 - DNA, 15 bp, Homo sapiens
cttagatctggcatg

SEQ ID NO: 2421763 - DNA, 20 bp, Homo sapiens
cttagatgttccagtaatct

SEQ ID NO: 2421764 - DNA, 14 bp, Homo sapiens
cttagatgttctaa

SEQ ID NO: 2421765 - DNA, 24 bp, Homo sapiens
cttagattctctgtgtctaagatt

SEQ ID NO: 2421766 - DNA, 15 bp, Homo sapiens
cttagattttacatg

SEQ ID NO: 2421767 - DNA, 20 bp, Homo sapiens
cttagattttacatgaagta

SEQ ID NO: 2421768 - DNA, 16 bp, Homo sapiens
cttagcagcttccaga

SEQ ID NO: 2421769 - DNA, 17 bp, Homo sapiens
cttagcagcttccagat

SEQ ID NO: 2421770 - DNA, 18 bp, Homo sapiens
cttagcagcttccagatt

SEQ ID NO: 2421771 - DNA, 12 bp, Homo sapiens
cttagcagtccc

SEQ ID NO: 2421772 - DNA, 19 bp, Homo sapiens
cttagcctggacctctgac

SEQ ID NO: 2421773 - DNA, 18 bp, Homo sapiens
cttagctcaatgagcatg

SEQ ID NO: 2421774 - DNA, 16 bp, Homo sapiens
cttaggaagagccttc

SEQ ID NO: 2421775 - DNA, 23 bp, Homo sapiens
cttaggaagagccttccacccag

SEQ ID NO: 2421776 - DNA, 16 bp, Homo sapiens
cttatacgaaataatt

SEQ ID NO: 2421777 - DNA, 17 bp, Homo sapiens
cttatacgaaataattg

SEQ ID NO: 2421778 - DNA, 18 bp, Homo sapiens
cttatacgaaataattgt

SEQ ID NO: 2421779 - DNA, 16 bp, Homo sapiens
cttatagttactgtgt

SEQ ID NO: 2421780 - DNA, 12 bp, Homo sapiens
cttatcctccct

SEQ ID NO: 2421781 - DNA, 14 bp, Homo sapiens
cttatcctccctgt

SEQ ID NO: 2421782 - DNA, 13 bp, Homo sapiens
cttatgaaaagaa

SEQ ID NO: 2421783 - DNA, 18 bp, Homo sapiens
cttatgaaaagaattgtt

SEQ ID NO: 2421784 - DNA, 23 bp, Homo sapiens
cttatgatagcaaatggcctcat

SEQ ID NO: 2421785 - DNA, 19 bp, Homo sapiens
cttatggaattgatttgca

SEQ ID NO: 2421786 - DNA, 18 bp, Homo sapiens
cttatggatgtccccagc

SEQ ID NO: 2421787 - DNA, 13 bp, Homo sapiens
cttatggtaccag

SEQ ID NO: 2421788 - DNA, 14 bp, Homo sapiens
cttattccatgact

SEQ ID NO: 2421789 - DNA, 17 bp, Homo sapiens
cttattccatgactgct

SEQ ID NO: 2421790 - DNA, 14 bp, Homo sapiens
cttattgcctcact

SEQ ID NO: 2421791 - DNA, 16 bp, Homo sapiens
cttatttgtatatggt

SEQ ID NO: 2421792 - DNA, 20 bp, Homo sapiens
cttcaaaatgttatcttctc

SEQ ID NO: 2421793 - DNA, 14 bp, Homo sapiens
cttcaaactacttt

SEQ ID NO: 2421794 - DNA, 15 bp, Homo sapiens
cttcaaagtttaata

SEQ ID NO: 2421795 - DNA, 20 bp, Homo sapiens
cttcaacaattctaaaatga

SEQ ID NO: 2421796 - DNA, 15 bp, Homo sapiens
cttcaacacagcttg

SEQ ID NO: 2421797 - DNA, 18 bp, Homo sapiens
cttcaagaaaacaggcac

SEQ ID NO: 2421798 - DNA, 20 bp, Homo sapiens
cttcaagctctgagggaaag

SEQ ID NO: 2421799 - DNA, 17 bp, Homo sapiens
cttcaccatttggcaat

SEQ ID NO: 2421800 - DNA, 14 bp, Homo sapiens
cttcagagagcagt

SEQ ID NO: 2421801 - DNA, 18 bp, Homo sapiens
cttcagagagcagtgctt

SEQ ID NO: 2421802 - DNA, 14 bp, Homo sapiens
cttcagctgccagt

SEQ ID NO: 2421803 - DNA, 17 bp, Homo sapiens
cttcaggtccaggctgt

SEQ ID NO: 2421804 - DNA, 18 bp, Homo sapiens
cttcaggtccaggctgtg

SEQ ID NO: 2421805 - DNA, 23 bp, Homo sapiens
cttcagtaccctctcagctccag

SEQ ID NO: 2421806 - DNA, 17 bp, Homo sapiens
cttcagttgtctctgat

SEQ ID NO: 2421807 - DNA, 20 bp, Homo sapiens
cttcagttgtctctgatgca

SEQ ID NO: 2421808 - DNA, 15 bp, Homo sapiens
cttcagtttcacaga

SEQ ID NO: 2421809 - DNA, 17 bp, Homo sapiens
cttcagtttcacagaaa

SEQ ID NO: 2421810 - DNA, 16 bp, Homo sapiens
cttcatacttgaacgt

SEQ ID NO: 2421811 - DNA, 19 bp, Homo sapiens
cttcatcccactccaactc

SEQ ID NO: 2421812 - DNA, 20 bp, Homo sapiens
ctttagaatcccagccccct

SEQ ID NO: 2421813 - DNA, 20 bp, Homo sapiens
ctttagatagccctgtcctg

SEQ ID NO: 2421814 - DNA, 16 bp, Homo sapiens
ctttagatctctgaag

SEQ ID NO: 2421815 - DNA, 13 bp, Homo sapiens
ctttataaatgta

SEQ ID NO: 2421816 - DNA, 15 bp, Homo sapiens
ctttataagaaagcc

SEQ ID NO: 2421817 - DNA, 23 bp, Homo sapiens
ctttatacagctgtattgtctga

SEQ ID NO: 2421818 - DNA, 19 bp, Homo sapiens
ctttatgataatagattct

SEQ ID NO: 2421819 - DNA, 21 bp, Homo sapiens
ctttatgtctgtggatttttt

SEQ ID NO: 2421820 - DNA, 23 bp, Homo sapiens
ctttattccagaatgctgtacat

SEQ ID NO: 2421821 - DNA, 11 bp, Homo sapiens
ctttattttga

SEQ ID NO: 2421822 - DNA, 13 bp, Homo sapiens
ctttattttgaga

SEQ ID NO: 2421823 - DNA, 14 bp, Homo sapiens
ctttcacaggcagc

SEQ ID NO: 2421824 - DNA, 15 bp, Homo sapiens
ctttcacaggcagcc

SEQ ID NO: 2421825 - DNA, 12 bp, Homo sapiens
ctttcagctcct

SEQ ID NO: 2421826 - DNA, 17 bp, Homo sapiens
ctttcagctcctgacca

SEQ ID NO: 2421827 - DNA, 15 bp, Homo sapiens
ctttcaggatctatt

SEQ ID NO: 2421828 - DNA, 16 bp, Homo sapiens
ctttcaggatctattt

SEQ ID NO: 2421829 - DNA, 23 bp, Homo sapiens
ctttcatatagttagctaataaa

SEQ ID NO: 2421830 - DNA, 18 bp, Homo sapiens
ctttcatcacactgggtg

SEQ ID NO: 2421831 - DNA, 19 bp, Homo sapiens
ctttcatcacactgggtgg

SEQ ID NO: 2421832 - DNA, 18 bp, Homo sapiens
ctttcatttgctttggaa

SEQ ID NO: 2421833 - DNA, 18 bp, Homo sapiens
ctttcattttctctcagg

SEQ ID NO: 2421834 - DNA, 19 bp, Homo sapiens
ctttcattttctctcaggt

SEQ ID NO: 2421835 - DNA, 21 bp, Homo sapiens
ctttcattttctctcaggtga

SEQ ID NO: 2421836 - DNA, 21 bp, Homo sapiens
ctttccacggagccactcctc

SEQ ID NO: 2421837 - DNA, 22 bp, Homo sapiens
ctttccacggagccactcctct

SEQ ID NO: 2421838 - DNA, 15 bp, Homo sapiens
ctttccatccatggc

SEQ ID NO: 2421839 - DNA, 16 bp, Homo sapiens
ctttcccatggggagg

SEQ ID NO: 2421840 - DNA, 16 bp, Homo sapiens
ctttccctaccctcta

SEQ ID NO: 2421841 - DNA, 21 bp, Homo sapiens
ctttcccttgtagctcctccc

SEQ ID NO: 2421842 - DNA, 23 bp, Homo sapiens
ctttcccttgtagctcctcccct

SEQ ID NO: 2421843 - DNA, 12 bp, Homo sapiens
ctttcctgcccc

SEQ ID NO: 2421844 - DNA, 13 bp, Homo sapiens
ctttcctgcccca

SEQ ID NO: 2421845 - DNA, 23 bp, Homo sapiens
ctttcctgtatttgttcccaaga

SEQ ID NO: 2421846 - DNA, 18 bp, Homo sapiens
ctttctcctttaattgta

SEQ ID NO: 2421847 - DNA, 15 bp, Homo sapiens
ctttctctgaggaca

SEQ ID NO: 2421848 - DNA, 13 bp, Homo sapiens
ctttctctgccag

SEQ ID NO: 2421849 - DNA, 14 bp, Homo sapiens
ctttctctgccagt

SEQ ID NO: 2421850 - DNA, 18 bp, Homo sapiens
ctttctctttccctggtc

SEQ ID NO: 2421851 - DNA, 21 bp, Homo sapiens
ctttctctttccctggtccct

SEQ ID NO: 2421852 - DNA, 15 bp, Homo sapiens
ctttctgatcaaggc

SEQ ID NO: 2421853 - DNA, 14 bp, Homo sapiens
ctttctgcctggag

SEQ ID NO: 2421854 - DNA, 15 bp, Homo sapiens
ctttctgcctggagt

SEQ ID NO: 2421855 - DNA, 23 bp, Homo sapiens
ctttctggattattctgggggct

SEQ ID NO: 2421856 - DNA, 12 bp, Homo sapiens
ctttctgttcca

SEQ ID NO: 2421857 - DNA, 14 bp, Homo sapiens
ctttctgttccaaa

SEQ ID NO: 2421858 - DNA, 15 bp, Homo sapiens
ctttctgttccaaat

SEQ ID NO: 2421859 - DNA, 20 bp, Homo sapiens
ctttctgttccaaattcagt

SEQ ID NO: 2421860 - DNA, 23 bp, Homo sapiens
ctttctgttccaaattcagtttc

SEQ ID NO: 2421861 - DNA, 18 bp, Homo sapiens
ctttcttttttggccatc

SEQ ID NO: 2421862 - DNA, 13 bp, Homo sapiens
ctttgaaacagaa

SEQ ID NO: 2421863 - DNA, 23 bp, Homo sapiens
ctttgaaattgaacctttgtgcc

SEQ ID NO: 2421864 - DNA, 13 bp, Homo sapiens
ctttgaagtagct

SEQ ID NO: 2421865 - DNA, 17 bp, Homo sapiens
ctttgaagtagctcttt

SEQ ID NO: 2421866 - DNA, 21 bp, Homo sapiens
ctttgaagttagctttaactt

SEQ ID NO: 2421867 - DNA, 12 bp, Homo sapiens
ctttgaataaat

SEQ ID NO: 2421868 - DNA, 18 bp, Homo sapiens
ctttgaataaatgtcact

SEQ ID NO: 2421869 - DNA, 23 bp, Homo sapiens
ctttgaatgtgtttcacagtttg

SEQ ID NO: 2421870 - DNA, 16 bp, Homo sapiens
ctttgacaattactca

SEQ ID NO: 2421871 - DNA, 23 bp, Homo sapiens
ctttgactcaggagcctgtgaca

SEQ ID NO: 2421872 - DNA, 15 bp, Homo sapiens
ctttgagagagaaag

SEQ ID NO: 2421873 - DNA, 22 bp, Homo sapiens
ctttgagctactgccgtcagtg

SEQ ID NO: 2421874 - DNA, 21 bp, Homo sapiens
ctttgagcttaatctttgaaa

SEQ ID NO: 2421875 - DNA, 19 bp, Homo sapiens
ctttgattcatagtaactt

SEQ ID NO: 2421876 - DNA, 21 bp, Homo sapiens
ctttgattcatagtaacttct

SEQ ID NO: 2421877 - DNA, 15 bp, Homo sapiens
ctttgcatggatttc

SEQ ID NO: 2421878 - DNA, 18 bp, Homo sapiens
ctttgcccagttggagac

SEQ ID NO: 2421879 - DNA, 11 bp, Homo sapiens
ctttgcctcaa

SEQ ID NO: 2421880 - DNA, 18 bp, Homo sapiens
ctttgctaaagacatgaa

SEQ ID NO: 2421881 - DNA, 15 bp, Homo sapiens
ctttgctgcatggca

SEQ ID NO: 2421882 - DNA, 21 bp, Homo sapiens
ctttgctgtgaggctgtcctg

SEQ ID NO: 2421883 - DNA, 17 bp, Homo sapiens
ctttgctttaatataaa

SEQ ID NO: 2421884 - DNA, 22 bp, Homo sapiens
ctttggaaagtacactctgctg

SEQ ID NO: 2421885 - DNA, 23 bp, Homo sapiens
ctttggaaagtacactctgctgt

SEQ ID NO: 2421886 - DNA, 21 bp, Homo sapiens
ctttggaaccagactcttgcc

SEQ ID NO: 2421887 - DNA, 23 bp, Homo sapiens
ctttggaaccagactcttgcctg

SEQ ID NO: 2421888 - DNA, 18 bp, Homo sapiens
ctttggaagtttagctct

SEQ ID NO: 2421889 - DNA, 21 bp, Homo sapiens
ctttggacctaaatggcctca

SEQ ID NO: 2421890 - DNA, 16 bp, Homo sapiens
ctttggagtcccctca

SEQ ID NO: 2421891 - DNA, 15 bp, Homo sapiens
ctttggatttgacat

SEQ ID NO: 2421892 - DNA, 16 bp, Homo sapiens
ctttgggcttcagctg

SEQ ID NO: 2421893 - DNA, 19 bp, Homo sapiens
ctttggtgagaacctgggt

SEQ ID NO: 2421894 - DNA, 13 bp, Homo sapiens
ctttggttctaag

SEQ ID NO: 2421895 - DNA, 13 bp, Homo sapiens
ctttgtgagtcaa

SEQ ID NO: 2421896 - DNA, 19 bp, Homo sapiens
ctttgtgagtcaatacata

SEQ ID NO: 2421897 - DNA, 13 bp, Homo sapiens
ctttgtgccctat

SEQ ID NO: 2421898 - DNA, 18 bp, Homo sapiens
ctttgtgccctatcaccc

SEQ ID NO: 2421899 - DNA, 15 bp, Homo sapiens
ctttgttttattttc

SEQ ID NO: 2421900 - DNA, 19 bp, Homo sapiens
ctttgttttgcacactttg

SEQ ID NO: 2421901 - DNA, 23 bp, Homo sapiens
ctttgttttgcacactttgccat

SEQ ID NO: 2421902 - DNA, 14 bp, Homo sapiens
ctttgttttgtgtc

SEQ ID NO: 2421903 - DNA, 22 bp, Homo sapiens
cttttaaagaaaaaaattgaaa

SEQ ID NO: 2421904 - DNA, 19 bp, Homo sapiens
cttttaccctggcccctct

SEQ ID NO: 2421905 - DNA, 23 bp, Homo sapiens
cttttaccctggcccctctccct

SEQ ID NO: 2421906 - DNA, 19 bp, Homo sapiens
cttttatactctttctgta

SEQ ID NO: 2421907 - DNA, 21 bp, Homo sapiens
cttttataggatttatttaaa

SEQ ID NO: 2421908 - DNA, 14 bp, Homo sapiens
cttttattaatgca

SEQ ID NO: 2421909 - DNA, 16 bp, Homo sapiens
cttttattaatgcact

SEQ ID NO: 2421910 - DNA, 19 bp, Homo sapiens
cttttattaatgcactttc

SEQ ID NO: 2421911 - DNA, 17 bp, Homo sapiens
cttttattgacacagaa

SEQ ID NO: 2421912 - DNA, 21 bp, Homo sapiens
cttttcacatccatttcccct

SEQ ID NO: 2421913 - DNA, 14 bp, Homo sapiens
cttttcatgcaaac

SEQ ID NO: 2421914 - DNA, 15 bp, Homo sapiens
cttttcatgcaaact

SEQ ID NO: 2421915 - DNA, 23 bp, Homo sapiens
cttttcccccattaatcagttca

SEQ ID NO: 2421916 - DNA, 17 bp, Homo sapiens
ctgtgcacaccccactc

SEQ ID NO: 2421917 - DNA, 19 bp, Homo sapiens
ctgtgcacatctgtgtctt

SEQ ID NO: 2421918 - DNA, 16 bp, Homo sapiens
ctgtgcagccgctgag

SEQ ID NO: 2421919 - DNA, 16 bp, Homo sapiens
ctgtgcaggttcccac

SEQ ID NO: 2421920 - DNA, 21 bp, Homo sapiens
ctgtgccagagcctggggctc

SEQ ID NO: 2421921 - DNA, 22 bp, Homo sapiens
ctgtgccagagcctggggctct

SEQ ID NO: 2421922 - DNA, 19 bp, Homo sapiens
ctgtgccaggtgaggtcag

SEQ ID NO: 2421923 - DNA, 20 bp, Homo sapiens
ctgtgccaggtgaggtcagc

SEQ ID NO: 2421924 - DNA, 12 bp, Homo sapiens
ctgtgcccccag

SEQ ID NO: 2421925 - DNA, 14 bp, Homo sapiens
ctgtgcccccaggg

SEQ ID NO: 2421926 - DNA, 17 bp, Homo sapiens
ctgtgccccttccgcca

SEQ ID NO: 2421927 - DNA, 18 bp, Homo sapiens
ctgtgccccttccgccac

SEQ ID NO: 2421928 - DNA, 21 bp, Homo sapiens
ctgtgccccttccgccactgg

SEQ ID NO: 2421929 - DNA, 22 bp, Homo sapiens
ctgtgccccttccgccactggg

SEQ ID NO: 2421930 - DNA, 15 bp, Homo sapiens
ctgtgcctcagagac

SEQ ID NO: 2421931 - DNA, 23 bp, Homo sapiens
ctgtgcctcgctccccactctgc

SEQ ID NO: 2421932 - DNA, 24 bp, Homo sapiens
ctgtgcctcgctccccactctgct

SEQ ID NO: 2421933 - DNA, 23 bp, Homo sapiens
ctgtgccttgttttttgtttgtt

SEQ ID NO: 2421934 - DNA, 14 bp, Homo sapiens
ctgtgcgcccaggg

SEQ ID NO: 2421935 - DNA, 17 bp, Homo sapiens
ctgtgcgcccagggctg

SEQ ID NO: 2421936 - DNA, 12 bp, Homo sapiens
ctgtgctggcca

SEQ ID NO: 2421937 - DNA, 23 bp, Homo sapiens
ctgtggattttttccttcaaagt

SEQ ID NO: 2421938 - DNA, 22 bp, Homo sapiens
ctgtggcagagttacagttctg

SEQ ID NO: 2421939 - DNA, 15 bp, Homo sapiens
ctgtggccaggaggt

SEQ ID NO: 2421940 - DNA, 18 bp, Homo sapiens
ctgtggccccaccctggg

SEQ ID NO: 2421941 - DNA, 20 bp, Homo sapiens
ctgtggccccaccctgggcc

SEQ ID NO: 2421942 - DNA, 24 bp, Homo sapiens
ctgtggcgccgtctccaggggctg

SEQ ID NO: 2421943 - DNA, 24 bp, Homo sapiens
ctgtgggaaatggtactgtacagc

SEQ ID NO: 2421944 - DNA, 16 bp, Homo sapiens
ctgtgggagcctcgca

SEQ ID NO: 2421945 - DNA, 14 bp, Homo sapiens
ctgtgggatgggat

SEQ ID NO: 2421946 - DNA, 21 bp, Homo sapiens
ctgtggggggtaatccctgct

SEQ ID NO: 2421947 - DNA, 19 bp, Homo sapiens
ctgtgggggtgtgccccct

SEQ ID NO: 2421948 - DNA, 18 bp, Homo sapiens
ctgtggtctacccgtgtc

SEQ ID NO: 2421949 - DNA, 22 bp, Homo sapiens
ctgtggtgtgtccccctctgtc

SEQ ID NO: 2421950 - DNA, 20 bp, Homo sapiens
ctgtggttctgagatggctc

SEQ ID NO: 2421951 - DNA, 11 bp, Homo sapiens
ctgtgtaactg

SEQ ID NO: 2421952 - DNA, 13 bp, Homo sapiens
ctgtgtaactgcc

SEQ ID NO: 2421953 - DNA, 18 bp, Homo sapiens
ctgtgtaagatttgtttt

SEQ ID NO: 2421954 - DNA, 15 bp, Homo sapiens
ctgtgtagctgtgac

SEQ ID NO: 2421955 - DNA, 18 bp, Homo sapiens
ctgtgtagctgtgacctg

SEQ ID NO: 2421956 - DNA, 14 bp, Homo sapiens
ctgtgtcacccagg

SEQ ID NO: 2421957 - DNA, 21 bp, Homo sapiens
ctgtgtccaaaaccgccagct

SEQ ID NO: 2421958 - DNA, 13 bp, Homo sapiens
ctgtgtccatgcg

SEQ ID NO: 2421959 - DNA, 21 bp, Homo sapiens
ctgtgtccatgcgctcagggc

SEQ ID NO: 2421960 - DNA, 20 bp, Homo sapiens
ctgtgtctttcacagctcct

SEQ ID NO: 2421961 - DNA, 22 bp, Homo sapiens
ctgtgtgtccaaaactgcctca

SEQ ID NO: 2421962 - DNA, 16 bp, Homo sapiens
ctgtgtgtgccctctg

SEQ ID NO: 2421963 - DNA, 17 bp, Homo sapiens
ctgtgtgtgtgaatgaa

SEQ ID NO: 2421964 - DNA, 17 bp, Homo sapiens
ctgtgtgttaagctctg

SEQ ID NO: 2421965 - DNA, 20 bp, Homo sapiens
ctgtgtgttaagctctgcta

SEQ ID NO: 2421966 - DNA, 14 bp, Homo sapiens
ctgtgttgccaagc

SEQ ID NO: 2421967 - DNA, 15 bp, Homo sapiens
ctgtgtttccatctc

SEQ ID NO: 2421968 - DNA, 23 bp, Homo sapiens
ctgtgtttccatctcaaagaagg

SEQ ID NO: 2421969 - DNA, 13 bp, Homo sapiens
ctgtgtttcttgc

SEQ ID NO: 2421970 - DNA, 16 bp, Homo sapiens
ctgtgtttggctttca

SEQ ID NO: 2421971 - DNA, 16 bp, Homo sapiens
ctgtgttttgaaagaa

SEQ ID NO: 2421972 - DNA, 19 bp, Homo sapiens
ctgttaaatacaggaaaca

SEQ ID NO: 2421973 - DNA, 23 bp, Homo sapiens
ctgttaaatacaggaaacagttg

SEQ ID NO: 2421974 - DNA, 13 bp, Homo sapiens
ctgttaactgaat

SEQ ID NO: 2421975 - DNA, 15 bp, Homo sapiens
ctgttaactgaatac

SEQ ID NO: 2421976 - DNA, 22 bp, Homo sapiens
ctgttaactgaataccactctg

SEQ ID NO: 2421977 - DNA, 14 bp, Homo sapiens
ctgttagtcatttg

SEQ ID NO: 2421978 - DNA, 15 bp, Homo sapiens
ctgttagtcatttgc

SEQ ID NO: 2421979 - DNA, 18 bp, Homo sapiens
ctgttagtcatttgctga

SEQ ID NO: 2421980 - DNA, 17 bp, Homo sapiens
ctgtacacaactcactc

SEQ ID NO: 2421981 - DNA, 11 bp, Homo sapiens
ctgtacagtgt

SEQ ID NO: 2421982 - DNA, 16 bp, Homo sapiens
ctgtacagtgtctttt

SEQ ID NO: 2421983 - DNA, 21 bp, Homo sapiens
ctgtacagtgtctttttttgt

SEQ ID NO: 2421984 - DNA, 15 bp, Homo sapiens
ctgtacattgtggga

SEQ ID NO: 2421985 - DNA, 12 bp, Homo sapiens
ctgtaccagtta

SEQ ID NO: 2421986 - DNA, 18 bp, Homo sapiens
ctgtaccagttaattttt

SEQ ID NO: 2421987 - DNA, 22 bp, Homo sapiens
ctgtaccttttgaggagcccca

SEQ ID NO: 2421988 - DNA, 12 bp, Homo sapiens
ctgtactgcctg

SEQ ID NO: 2421989 - DNA, 15 bp, Homo sapiens
ctgtactgcctgctt

SEQ ID NO: 2421990 - DNA, 17 bp, Homo sapiens
ctgtactgcctgcttgg

SEQ ID NO: 2421991 - DNA, 18 bp, Homo sapiens
ctgtactgcctgcttggg

SEQ ID NO: 2421992 - DNA, 13 bp, Homo sapiens
ctgtagagttgct

SEQ ID NO: 2421993 - DNA, 17 bp, Homo sapiens
ctgtagagttgctgaga

SEQ ID NO: 2421994 - DNA, 21 bp, Homo sapiens
ctgtagggagggcggcagggg

SEQ ID NO: 2421995 - DNA, 16 bp, Homo sapiens
ctgtaggttgcacact

SEQ ID NO: 2421996 - DNA, 22 bp, Homo sapiens
ctgtaggttgcacactttggta

SEQ ID NO: 2421997 - DNA, 18 bp, Homo sapiens
ctgtagtaaataatgctt

SEQ ID NO: 2421998 - DNA, 22 bp, Homo sapiens
ctgtagtaggcatttttaccat

SEQ ID NO: 2421999 - DNA, 16 bp, Homo sapiens
ctgtagtgctacaggg

SEQ ID NO: 2422000 - DNA, 20 bp, Homo sapiens
ctgtagtgctacagggtcca

SEQ ID NO: 2422001 - DNA, 13 bp, Homo sapiens
ctgtagttctaag

SEQ ID NO: 2422002 - DNA, 22 bp, Homo sapiens
ctgtatattacagatatttgtc

SEQ ID NO: 2422003 - DNA, 23 bp, Homo sapiens
ctgtatcaggacccagaggaagg

SEQ ID NO: 2422004 - DNA, 16 bp, Homo sapiens
ctgtattcagacagat

SEQ ID NO: 2422005 - DNA, 13 bp, Homo sapiens
ctgtattgtctga

SEQ ID NO: 2422006 - DNA, 17 bp, Homo sapiens
ctgtattgtctgaactt

SEQ ID NO: 2422007 - DNA, 20 bp, Homo sapiens
ctgtattttgtattgtttca

SEQ ID NO: 2422008 - DNA, 15 bp, Homo sapiens
ctgtcacaaccaaga

SEQ ID NO: 2422009 - DNA, 13 bp, Homo sapiens
ctgtcagatccag

SEQ ID NO: 2422010 - DNA, 22 bp, Homo sapiens
ctgtcagatccaggagctccag

SEQ ID NO: 2422011 - DNA, 14 bp, Homo sapiens
ctgtcagcatgaat

SEQ ID NO: 2422012 - DNA, 22 bp, Homo sapiens
ctgtcagcatgaatttgtaatg

SEQ ID NO: 2422013 - DNA, 14 bp, Homo sapiens
ctgtcaggattgcg

SEQ ID NO: 2422014 - DNA, 19 bp, Homo sapiens
ctgtcaggattgcgagaga

SEQ ID NO: 2422015 - DNA, 21 bp, Homo sapiens
ctgtcaggattgcgagagatg

SEQ ID NO: 2422016 - DNA, 23 bp, Homo sapiens
ctgtcaggattgcgagagatgtg

SEQ ID NO: 2422017 - DNA, 13 bp, Homo sapiens
ctgtcagtcacag

SEQ ID NO: 2422018 - DNA, 14 bp, Homo sapiens
ctgtcagtcacagc

SEQ ID NO: 2422019 - DNA, 15 bp, Homo sapiens
ctgtcagtcacagcc

SEQ ID NO: 2422020 - DNA, 19 bp, Homo sapiens
ctgtcagttctaacctcct

SEQ ID NO: 2422021 - DNA, 20 bp, Homo sapiens
ctgtcatcatcatggccagc

SEQ ID NO: 2422022 - DNA, 21 bp, Homo sapiens
ctgtcatcatcatggccagct

SEQ ID NO: 2422023 - DNA, 21 bp, Homo sapiens
ctgtcatcctcaaagaaagtg

SEQ ID NO: 2422024 - DNA, 23 bp, Homo sapiens
ctgtcatcctcaaagaaagtgta

SEQ ID NO: 2422025 - DNA, 15 bp, Homo sapiens
ctgtcatctgtgcac

SEQ ID NO: 2422026 - DNA, 22 bp, Homo sapiens
ctgtcatggtgtccagacagag

SEQ ID NO: 2422027 - DNA, 22 bp, Homo sapiens
ctgtccacaggcttctgagcag

SEQ ID NO: 2422028 - DNA, 12 bp, Homo sapiens
ctgtccagaaag

SEQ ID NO: 2422029 - DNA, 19 bp, Homo sapiens
ctgtccaggcactgagata

SEQ ID NO: 2422030 - DNA, 15 bp, Homo sapiens
ctgtccccagcctgg

SEQ ID NO: 2422031 - DNA, 15 bp, Homo sapiens
ctgtccccccactcc

SEQ ID NO: 2422032 - DNA, 15 bp, Homo sapiens
ctgtcccctgctaca

SEQ ID NO: 2422033 - DNA, 11 bp, Homo sapiens
ctgtccctagg

SEQ ID NO: 2422034 - DNA, 12 bp, Homo sapiens
ctgtccctccgg

SEQ ID NO: 2422035 - DNA, 21 bp, Homo sapiens
ctgtccctccgggacctggtg

SEQ ID NO: 2422036 - DNA, 18 bp, Homo sapiens
ctgtcccttgcccccctg

SEQ ID NO: 2422037 - DNA, 13 bp, Homo sapiens
ctgtcccttgcct

SEQ ID NO: 2422038 - DNA, 15 bp, Homo sapiens
ctgtcccttgcctca

SEQ ID NO: 2422039 - DNA, 14 bp, Homo sapiens
ctgtcctcagcctt

SEQ ID NO: 2422040 - DNA, 19 bp, Homo sapiens
ctgtcctctttcagctcct

SEQ ID NO: 2422041 - DNA, 16 bp, Homo sapiens
ctgtcctgaaggcctg

SEQ ID NO: 2422042 - DNA, 19 bp, Homo sapiens
ctgtcctgaaggcctgagg

SEQ ID NO: 2422043 - DNA, 20 bp, Homo sapiens
ctgtcctgtcatcatcatgg

SEQ ID NO: 2422044 - DNA, 17 bp, Homo sapiens
ctgtccttgaaggacta

SEQ ID NO: 2422045 - DNA, 13 bp, Homo sapiens
ctgtcctttctag

SEQ ID NO: 2422046 - DNA, 23 bp, Homo sapiens
ctgtcctttctagagcactgcca

SEQ ID NO: 2422047 - DNA, 16 bp, Homo sapiens
ctgtcgctctcagttc

SEQ ID NO: 2422048 - DNA, 15 bp, Homo sapiens
ctgtcgttaaaaaca

SEQ ID NO: 2422049 - DNA, 18 bp, Homo sapiens
ctgtctacttgctcaggt

SEQ ID NO: 2422050 - DNA, 18 bp, Homo sapiens
ctgtctcaagctcttcct

SEQ ID NO: 2422051 - DNA, 20 bp, Homo sapiens
ctgtctcaagctcttcctta

SEQ ID NO: 2422052 - DNA, 14 bp, Homo sapiens
ctgtctcagcctcc

SEQ ID NO: 2422053 - DNA, 15 bp, Homo sapiens
ctgtctcagcctccc

SEQ ID NO: 2422054 - DNA, 17 bp, Homo sapiens
ctgtctcagcctcccag

SEQ ID NO: 2422055 - DNA, 20 bp, Homo sapiens
ctgtctcatccatcatcatg

SEQ ID NO: 2422056 - DNA, 21 bp, Homo sapiens
ctgtctcatccatcatcatgt

SEQ ID NO: 2422057 - DNA, 19 bp, Homo sapiens
ctgtctcgagcgccctgca

SEQ ID NO: 2422058 - DNA, 17 bp, Homo sapiens
ctgtctgccaacctaaa

SEQ ID NO: 2422059 - DNA, 19 bp, Homo sapiens
ctgtctgccccgccctcat

SEQ ID NO: 2422060 - DNA, 16 bp, Homo sapiens
ctgtctggcaatgcca

SEQ ID NO: 2422061 - DNA, 17 bp, Homo sapiens
ctgtctggcaatgccac

SEQ ID NO: 2422062 - DNA, 16 bp, Homo sapiens
ctgtctggcccccctg

SEQ ID NO: 2422063 - DNA, 21 bp, Homo sapiens
ctgtctgggtgctactgggga

SEQ ID NO: 2422064 - DNA, 13 bp, Homo sapiens
ctgtctggtggcc

SEQ ID NO: 2422065 - DNA, 14 bp, Homo sapiens
ctgtcttaattttc

SEQ ID NO: 2422066 - DNA, 16 bp, Homo sapiens
ctgtcttatcctccac

SEQ ID NO: 2422067 - DNA, 13 bp, Homo sapiens
ctgtcttctggac

SEQ ID NO: 2422068 - DNA, 15 bp, Homo sapiens
ctgtcttctggactg

SEQ ID NO: 2422069 - DNA, 16 bp, Homo sapiens
ctgtgaaatgctggca

SEQ ID NO: 2422070 - DNA, 15 bp, Homo sapiens
ctgtgaacccaggac

SEQ ID NO: 2422071 - DNA, 20 bp, Homo sapiens
ctgtgaatgccactgccttc

SEQ ID NO: 2422072 - DNA, 13 bp, Homo sapiens
ctgtgaattaagc

SEQ ID NO: 2422073 - DNA, 15 bp, Homo sapiens
ctgtgacccccagct

SEQ ID NO: 2422074 - DNA, 16 bp, Homo sapiens
ctgtgacccccagctc

SEQ ID NO: 2422075 - DNA, 17 bp, Homo sapiens
ctgtgacccccagctcc

SEQ ID NO: 2422076 - DNA, 14 bp, Homo sapiens
ctgtgacctgctga

SEQ ID NO: 2422077 - DNA, 20 bp, Homo sapiens
ctgtgacctgctgagctctg

SEQ ID NO: 2422078 - DNA, 22 bp, Homo sapiens
ctgtgacctgctgagctctgag

SEQ ID NO: 2422079 - DNA, 14 bp, Homo sapiens
ctgtgagcccagct

SEQ ID NO: 2422080 - DNA, 17 bp, Homo sapiens
ctgtgagcccagctggg

SEQ ID NO: 2422081 - DNA, 15 bp, Homo sapiens
ctgtgagttctccct

SEQ ID NO: 2422082 - DNA, 17 bp, Homo sapiens
ctgtgagttctccctgt

SEQ ID NO: 2422083 - DNA, 18 bp, Homo sapiens
ctgtgagttctccctgta

SEQ ID NO: 2422084 - DNA, 13 bp, Homo sapiens
ctgtgattcagaa

SEQ ID NO: 2422085 - DNA, 11 bp, Homo sapiens
ctgggcctggt

SEQ ID NO: 2422086 - DNA, 19 bp, Homo sapiens
ctgggcctggtctcaccct

SEQ ID NO: 2422087 - DNA, 14 bp, Homo sapiens
ctgggccttaggaa

SEQ ID NO: 2422088 - DNA, 19 bp, Homo sapiens
ctgggccttggcctggagc

SEQ ID NO: 2422089 - DNA, 14 bp, Homo sapiens
ctgggctcctccag

SEQ ID NO: 2422090 - DNA, 13 bp, Homo sapiens
ctgggctgaggga

SEQ ID NO: 2422091 - DNA, 18 bp, Homo sapiens
ctgggctggatgagctcc

SEQ ID NO: 2422092 - DNA, 19 bp, Homo sapiens
ctgggctggatgagctccc

SEQ ID NO: 2422093 - DNA, 20 bp, Homo sapiens
ctgggcttatatctggcctc

SEQ ID NO: 2422094 - DNA, 20 bp, Homo sapiens
ctggggaaaactccaccttc

SEQ ID NO: 2422095 - DNA, 17 bp, Homo sapiens
ctggggaaactggccat

SEQ ID NO: 2422096 - DNA, 19 bp, Homo sapiens
ctggggaaactggccatgg

SEQ ID NO: 2422097 - DNA, 22 bp, Homo sapiens
ctggggaaactggccatggcct

SEQ ID NO: 2422098 - DNA, 18 bp, Homo sapiens
ctggggacttggcctctc

SEQ ID NO: 2422099 - DNA, 21 bp, Homo sapiens
ctggggagcaggcagccagca

SEQ ID NO: 2422100 - DNA, 12 bp, Homo sapiens
ctggggcaggct

SEQ ID NO: 2422101 - DNA, 15 bp, Homo sapiens
ctggggcaggctggg

SEQ ID NO: 2422102 - DNA, 16 bp, Homo sapiens
ctggggcaggctgggc

SEQ ID NO: 2422103 - DNA, 17 bp, Homo sapiens
ctggggcaggctgggcc

SEQ ID NO: 2422104 - DNA, 21 bp, Homo sapiens
ctggggcaggctgggccatgt

SEQ ID NO: 2422105 - DNA, 12 bp, Homo sapiens
ctggggcctggg

SEQ ID NO: 2422106 - DNA, 13 bp, Homo sapiens
ctggggcctggga

SEQ ID NO: 2422107 - DNA, 14 bp, Homo sapiens
ctggggcctgtact

SEQ ID NO: 2422108 - DNA, 16 bp, Homo sapiens
ctggggcctgtactgc

SEQ ID NO: 2422109 - DNA, 18 bp, Homo sapiens
ctggggcctgtactgcct

SEQ ID NO: 2422110 - DNA, 19 bp, Homo sapiens
ctggggcctgtactgcctg

SEQ ID NO: 2422111 - DNA, 20 bp, Homo sapiens
ctggggcctgtactgcctgc

SEQ ID NO: 2422112 - DNA, 23 bp, Homo sapiens
ctggggcctgtactgcctgcttg

SEQ ID NO: 2422113 - DNA, 14 bp, Homo sapiens
ctggggctcagagc

SEQ ID NO: 2422114 - DNA, 17 bp, Homo sapiens
ctggggctcagagccgg

SEQ ID NO: 2422115 - DNA, 18 bp, Homo sapiens
ctggggctggcctcccaa

SEQ ID NO: 2422116 - DNA, 20 bp, Homo sapiens
ctgggggcacaagactgacg

SEQ ID NO: 2422117 - DNA, 16 bp, Homo sapiens
ctgggggcctcttctg

SEQ ID NO: 2422118 - DNA, 15 bp, Homo sapiens
ctgggggcctggctg

SEQ ID NO: 2422119 - DNA, 16 bp, Homo sapiens
ctgggggcctggctgg

SEQ ID NO: 2422120 - DNA, 23 bp, Homo sapiens
ctgggggcctggctggctgaggg

SEQ ID NO: 2422121 - DNA, 15 bp, Homo sapiens
ctgggggtgccagga

SEQ ID NO: 2422122 - DNA, 16 bp, Homo sapiens
ctggggtcccagcagc

SEQ ID NO: 2422123 - DNA, 17 bp, Homo sapiens
ctgggtacttcttgaag

SEQ ID NO: 2422124 - DNA, 23 bp, Homo sapiens
ctgggtccaattgtggcacttgg

SEQ ID NO: 2422125 - DNA, 14 bp, Homo sapiens
ctgggtgctactgg

SEQ ID NO: 2422126 - DNA, 17 bp, Homo sapiens
ctgggtggctactctgt

SEQ ID NO: 2422127 - DNA, 14 bp, Homo sapiens
ctgggtggggccca

SEQ ID NO: 2422128 - DNA, 17 bp, Homo sapiens
ctgggttgcctttattt

SEQ ID NO: 2422129 - DNA, 14 bp, Homo sapiens
ctgggttgggatca

SEQ ID NO: 2422130 - DNA, 23 bp, Homo sapiens
ctgggttgggatcaggggtagga

SEQ ID NO: 2422131 - DNA, 14 bp, Homo sapiens
ctggtaatagctgt

SEQ ID NO: 2422132 - DNA, 14 bp, Homo sapiens
ctggtaccctcctg

SEQ ID NO: 2422133 - DNA, 16 bp, Homo sapiens
ctggtaccctcctggc

SEQ ID NO: 2422134 - DNA, 19 bp, Homo sapiens
ctggtactccctctcagga

SEQ ID NO: 2422135 - DNA, 22 bp, Homo sapiens
ctggtagaagggaaagcccata

SEQ ID NO: 2422136 - DNA, 20 bp, Homo sapiens
ctggtaggaatagcatgtca

SEQ ID NO: 2422137 - DNA, 15 bp, Homo sapiens
ctggtatctcagaaa

SEQ ID NO: 2422138 - DNA, 17 bp, Homo sapiens
ctggtattgttctcaca

SEQ ID NO: 2422139 - DNA, 16 bp, Homo sapiens
ctggtcacctaggaag

SEQ ID NO: 2422140 - DNA, 17 bp, Homo sapiens
ctggtcacctaggaagc

SEQ ID NO: 2422141 - DNA, 18 bp, Homo sapiens
ctggtcacctaggaagcc

SEQ ID NO: 2422142 - DNA, 22 bp, Homo sapiens
ctggtcacctaggaagcctcag

SEQ ID NO: 2422143 - DNA, 23 bp, Homo sapiens
ctggtcacctaggaagcctcaga

SEQ ID NO: 2422144 - DNA, 19 bp, Homo sapiens
ctggtcccggggccagcac

SEQ ID NO: 2422145 - DNA, 19 bp, Homo sapiens
ctggtcccttgtatcccct

SEQ ID NO: 2422146 - DNA, 15 bp, Homo sapiens
ctggtccgtgggacg

SEQ ID NO: 2422147 - DNA, 19 bp, Homo sapiens
ctggtccgtgggacggtgc

SEQ ID NO: 2422148 - DNA, 22 bp, Homo sapiens
ctggtcctttttggtcgaggag

SEQ ID NO: 2422149 - DNA, 13 bp, Homo sapiens
ctggtctcaccct

SEQ ID NO: 2422150 - DNA, 17 bp, Homo sapiens
ctggtctcaccctggag

SEQ ID NO: 2422151 - DNA, 17 bp, Homo sapiens
ctggtctctctatgcct

SEQ ID NO: 2422152 - DNA, 19 bp, Homo sapiens
ctggtctgctgttccagtg

SEQ ID NO: 2422153 - DNA, 14 bp, Homo sapiens
ctggtgcctccaga

SEQ ID NO: 2422154 - DNA, 20 bp, Homo sapiens
ctggtgcggctggccatgga

SEQ ID NO: 2422155 - DNA, 14 bp, Homo sapiens
ctggtgctggaggt

SEQ ID NO: 2422156 - DNA, 17 bp, Homo sapiens
ctggtgcttatgctctt

SEQ ID NO: 2422157 - DNA, 18 bp, Homo sapiens
ctggtggccctctcccct

SEQ ID NO: 2422158 - DNA, 22 bp, Homo sapiens
ctggtggccctctcccctgccc

SEQ ID NO: 2422159 - DNA, 20 bp, Homo sapiens
ctggtgggctggccgctgtg

SEQ ID NO: 2422160 - DNA, 14 bp, Homo sapiens
ctggtggggcagct

SEQ ID NO: 2422161 - DNA, 23 bp, Homo sapiens
ctggtggtctgttggcaggctgg

SEQ ID NO: 2422162 - DNA, 22 bp, Homo sapiens
ctggtgtggtacagagaagcca

SEQ ID NO: 2422163 - DNA, 16 bp, Homo sapiens
ctggtgttaacagaag

SEQ ID NO: 2422164 - DNA, 20 bp, Homo sapiens
ctggttcacactgaccaaga

SEQ ID NO: 2422165 - DNA, 14 bp, Homo sapiens
ctggttccagggtc

SEQ ID NO: 2422166 - DNA, 18 bp, Homo sapiens
ctggttccagggtccctc

SEQ ID NO: 2422167 - DNA, 22 bp, Homo sapiens
ctggttccagggtccctctgtg

SEQ ID NO: 2422168 - DNA, 16 bp, Homo sapiens
ctggttctcaattcca

SEQ ID NO: 2422169 - DNA, 20 bp, Homo sapiens
ctggttctcaattccaacag

SEQ ID NO: 2422170 - DNA, 16 bp, Homo sapiens
ctggttgtttctgttc

SEQ ID NO: 2422171 - DNA, 15 bp, Homo sapiens
ctgtaaaacaggtta

SEQ ID NO: 2422172 - DNA, 15 bp, Homo sapiens
ctgtaaaatgtggga

SEQ ID NO: 2422173 - DNA, 14 bp, Homo sapiens
ctgtaaagagttgc

SEQ ID NO: 2422174 - DNA, 21 bp, Homo sapiens
ctgtaaagatgtttatttcag

SEQ ID NO: 2422175 - DNA, 18 bp, Homo sapiens
ctgtaaatctacacacgg

SEQ ID NO: 2422176 - DNA, 19 bp, Homo sapiens
ctgtaacctcttcagaggc

SEQ ID NO: 2422177 - DNA, 23 bp, Homo sapiens
ctgtaacctcttcagaggccctc

SEQ ID NO: 2422178 - DNA, 13 bp, Homo sapiens
ctgtaactgtcac

SEQ ID NO: 2422179 - DNA, 21 bp, Homo sapiens
ctgtaaggatccggaaagaag

SEQ ID NO: 2422180 - DNA, 15 bp, Homo sapiens
ctgtaaggctctaga

SEQ ID NO: 2422181 - DNA, 18 bp, Homo sapiens
ctgtaaggctctagatca

SEQ ID NO: 2422182 - DNA, 20 bp, Homo sapiens
ctgtaaggctctagatcata

SEQ ID NO: 2422183 - DNA, 22 bp, Homo sapiens
ctgtaaggctctagatcataag

SEQ ID NO: 2422184 - DNA, 20 bp, Homo sapiens
ctgtaagtagatgcatttgg

SEQ ID NO: 2422185 - DNA, 24 bp, Homo sapiens
ctgtaagttgggcttgctattctg

SEQ ID NO: 2422186 - DNA, 20 bp, Homo sapiens
ctgtaatataaagtattcaa

SEQ ID NO: 2422187 - DNA, 14 bp, Homo sapiens
ctgtaattgcaaaa

SEQ ID NO: 2422188 - DNA, 16 bp, Homo sapiens
ctgtaattgtgtgtga

SEQ ID NO: 2422189 - DNA, 16 bp, Homo sapiens
ctgaggtcctgagcac

SEQ ID NO: 2422190 - DNA, 18 bp, Homo sapiens
ctgaggtgcactgggagg

SEQ ID NO: 2422191 - DNA, 17 bp, Homo sapiens
ctgaggtgcctgtccca

SEQ ID NO: 2422192 - DNA, 15 bp, Homo sapiens
ctgagtactccacac

SEQ ID NO: 2422193 - DNA, 21 bp, Homo sapiens
ctgagtcagagccatgtcttc

SEQ ID NO: 2422194 - DNA, 16 bp, Homo sapiens
ctgagtggcaggggac

SEQ ID NO: 2422195 - DNA, 18 bp, Homo sapiens
ctgagtggcaggggacag

SEQ ID NO: 2422196 - DNA, 16 bp, Homo sapiens
ctgagttgcttttcag

SEQ ID NO: 2422197 - DNA, 11 bp, Homo sapiens
ctgagtttcct

SEQ ID NO: 2422198 - DNA, 20 bp, Homo sapiens
ctgagtttcctatgggaaca

SEQ ID NO: 2422199 - DNA, 11 bp, Homo sapiens
ctgagttttcc

SEQ ID NO: 2422200 - DNA, 16 bp, Homo sapiens
ctgagttttccatggc

SEQ ID NO: 2422201 - DNA, 18 bp, Homo sapiens
ctgagttttccatggcag

SEQ ID NO: 2422202 - DNA, 17 bp, Homo sapiens
ctgagttttgtgtttgt

SEQ ID NO: 2422203 - DNA, 21 bp, Homo sapiens
ctgagttttgtgtttgttgta

SEQ ID NO: 2422204 - DNA, 19 bp, Homo sapiens
ctgataaaaccatgtagaa

SEQ ID NO: 2422205 - DNA, 23 bp, Homo sapiens
ctgataaaaccatgtagaaaatt

SEQ ID NO: 2422206 - DNA, 18 bp, Homo sapiens
ctgataaaagatggccat

SEQ ID NO: 2422207 - DNA, 23 bp, Homo sapiens
ctgatagggtttgtgacagggcg

SEQ ID NO: 2422208 - DNA, 15 bp, Homo sapiens
ctgatcaaggcctta

SEQ ID NO: 2422209 - DNA, 16 bp, Homo sapiens
ctgatcagaacaaatg

SEQ ID NO: 2422210 - DNA, 18 bp, Homo sapiens
ctgatcccagagagcccg

SEQ ID NO: 2422211 - DNA, 20 bp, Homo sapiens
ctgatcccagagagcccgag

SEQ ID NO: 2422212 - DNA, 12 bp, Homo sapiens
ctgatcctggag

SEQ ID NO: 2422213 - DNA, 15 bp, Homo sapiens
ctgatcctggaggcc

SEQ ID NO: 2422214 - DNA, 13 bp, Homo sapiens
ctgatctcgtttt

SEQ ID NO: 2422215 - DNA, 21 bp, Homo sapiens
ctgatgaactcttaatcaaat

SEQ ID NO: 2422216 - DNA, 17 bp, Homo sapiens
ctgatgcatcagaaagg

SEQ ID NO: 2422217 - DNA, 18 bp, Homo sapiens
ctgatgcatcagaaaggg

SEQ ID NO: 2422218 - DNA, 21 bp, Homo sapiens
ctgatgcatcagaaagggagg

SEQ ID NO: 2422219 - DNA, 23 bp, Homo sapiens
ctgatgcatcagaaagggagggc

SEQ ID NO: 2422220 - DNA, 20 bp, Homo sapiens
ctgatgtcaatttctgtgtt

SEQ ID NO: 2422221 - DNA, 22 bp, Homo sapiens
ctgatgtcaatttctgtgttgc

SEQ ID NO: 2422222 - DNA, 22 bp, Homo sapiens
ctgatttaggagaagccaggaa

SEQ ID NO: 2422223 - DNA, 23 bp, Homo sapiens
ctgattttaggagctaaggctct

SEQ ID NO: 2422224 - DNA, 16 bp, Homo sapiens
ctgcaaactgggaacc

SEQ ID NO: 2422225 - DNA, 17 bp, Homo sapiens
ctgcaacctccacctcc

SEQ ID NO: 2422226 - DNA, 20 bp, Homo sapiens
ctgcaagcacatctgcattt

SEQ ID NO: 2422227 - DNA, 16 bp, Homo sapiens
ctgcaaggtactctgg

SEQ ID NO: 2422228 - DNA, 22 bp, Homo sapiens
ctgcaagtgaggtgtgtcacaa

SEQ ID NO: 2422229 - DNA, 24 bp, Homo sapiens
ctgcaattcaaaagttccaagagt

SEQ ID NO: 2422230 - DNA, 16 bp, Homo sapiens
ctgcaattcccctctg

SEQ ID NO: 2422231 - DNA, 16 bp, Homo sapiens
ctgcacaataactcct

SEQ ID NO: 2422232 - DNA, 22 bp, Homo sapiens
ctgcacaataactcctcccagg

SEQ ID NO: 2422233 - DNA, 23 bp, Homo sapiens
ctgcacaataactcctcccaggg

SEQ ID NO: 2422234 - DNA, 19 bp, Homo sapiens
ctgcacagtgacttctgag

SEQ ID NO: 2422235 - DNA, 20 bp, Homo sapiens
ctgcacagtgacttctgaga

SEQ ID NO: 2422236 - DNA, 18 bp, Homo sapiens
ctgcacatctgtaaatct

SEQ ID NO: 2422237 - DNA, 22 bp, Homo sapiens
ctgcacatgactcgggggtggg

SEQ ID NO: 2422238 - DNA, 15 bp, Homo sapiens
ctgcacgtgcgggtg

SEQ ID NO: 2422239 - DNA, 17 bp, Homo sapiens
ctgcactaacagagtgg

SEQ ID NO: 2422240 - DNA, 14 bp, Homo sapiens
ctgcactgtaaaat

SEQ ID NO: 2422241 - DNA, 15 bp, Homo sapiens
ctgcacttacttgct

SEQ ID NO: 2422242 - DNA, 22 bp, Homo sapiens
ctgcacttgcggttccggcatg

SEQ ID NO: 2422243 - DNA, 16 bp, Homo sapiens
ctgcagaaactactga

SEQ ID NO: 2422244 - DNA, 16 bp, Homo sapiens
ctgcagaaccggagag

SEQ ID NO: 2422245 - DNA, 21 bp, Homo sapiens
ctgcagaaccggagagccagc

SEQ ID NO: 2422246 - DNA, 15 bp, Homo sapiens
ctgcagaccctgccc

SEQ ID NO: 2422247 - DNA, 17 bp, Homo sapiens
ctgcagacttcccagct

SEQ ID NO: 2422248 - DNA, 18 bp, Homo sapiens
ctgcagacttcccagcta

SEQ ID NO: 2422249 - DNA, 16 bp, Homo sapiens
ctgcagcctcaggact

SEQ ID NO: 2422250 - DNA, 19 bp, Homo sapiens
ctgcagcctcaggactggg

SEQ ID NO: 2422251 - DNA, 22 bp, Homo sapiens
ctgcagcctcaggactgggagc

SEQ ID NO: 2422252 - DNA, 13 bp, Homo sapiens
ctgcaggaaggag

SEQ ID NO: 2422253 - DNA, 22 bp, Homo sapiens
ctgcaggaaggagctgcctgga

SEQ ID NO: 2422254 - DNA, 23 bp, Homo sapiens
ctgcaggaaggagctgcctggac

SEQ ID NO: 2422255 - DNA, 14 bp, Homo sapiens
ctgcaggaatcttt

SEQ ID NO: 2422256 - DNA, 16 bp, Homo sapiens
ctgcaggccctggcct

SEQ ID NO: 2422257 - DNA, 17 bp, Homo sapiens
ctgcaggccctggcctc

SEQ ID NO: 2422258 - DNA, 18 bp, Homo sapiens
ctgcaggccctggcctcc

SEQ ID NO: 2422259 - DNA, 22 bp, Homo sapiens
ctgcagggaaaattatttgcat

SEQ ID NO: 2422260 - DNA, 18 bp, Homo sapiens
ctgctcagccctgcacca

SEQ ID NO: 2422261 - DNA, 21 bp, Homo sapiens
ctgctcagccctgcaccatgc

SEQ ID NO: 2422262 - DNA, 13 bp, Homo sapiens
ctgctcagctctg

SEQ ID NO: 2422263 - DNA, 14 bp, Homo sapiens
ctgctcagctctgg

SEQ ID NO: 2422264 - DNA, 16 bp, Homo sapiens
ctgctcatcattctct

SEQ ID NO: 2422265 - DNA, 13 bp, Homo sapiens
ctgctcatccact

SEQ ID NO: 2422266 - DNA, 21 bp, Homo sapiens
ctgctccagacctgatcctgg

SEQ ID NO: 2422267 - DNA, 23 bp, Homo sapiens
ctgctcccaaggggcctgagcag

SEQ ID NO: 2422268 - DNA, 14 bp, Homo sapiens
ctgctcccatcctg

SEQ ID NO: 2422269 - DNA, 14 bp, Homo sapiens
ctgctccttcccca

SEQ ID NO: 2422270 - DNA, 15 bp, Homo sapiens
ctgctccttccccat

SEQ ID NO: 2422271 - DNA, 17 bp, Homo sapiens
ctgctcggggtgcacag

SEQ ID NO: 2422272 - DNA, 22 bp, Homo sapiens
ctgctcgtccccaagtgaccta

SEQ ID NO: 2422273 - DNA, 17 bp, Homo sapiens
ctgctctcctcttctac

SEQ ID NO: 2422274 - DNA, 13 bp, Homo sapiens
ctgctctgagaat

SEQ ID NO: 2422275 - DNA, 22 bp, Homo sapiens
ctgctctgcgtgtcacctgtgc

SEQ ID NO: 2422276 - DNA, 18 bp, Homo sapiens
ctgctctggttgtttctg

SEQ ID NO: 2422277 - DNA, 21 bp, Homo sapiens
ctgctctggttgtttctgttc

SEQ ID NO: 2422278 - DNA, 22 bp, Homo sapiens
ctgctctggttgtttctgttcc

SEQ ID NO: 2422279 - DNA, 15 bp, Homo sapiens
ctgctcttggctgga

SEQ ID NO: 2422280 - DNA, 20 bp, Homo sapiens
ctgctcttggctggacccag

SEQ ID NO: 2422281 - DNA, 23 bp, Homo sapiens
ctgctcttggctggacccagcca

SEQ ID NO: 2422282 - DNA, 17 bp, Homo sapiens
ctgctctttctctgcca

SEQ ID NO: 2422283 - DNA, 12 bp, Homo sapiens
ctgctgagaacc

SEQ ID NO: 2422284 - DNA, 13 bp, Homo sapiens
ctgctgagaacct

SEQ ID NO: 2422285 - DNA, 17 bp, Homo sapiens
ctgctgagaacctggcc

SEQ ID NO: 2422286 - DNA, 14 bp, Homo sapiens
ctgctgagctctga

SEQ ID NO: 2422287 - DNA, 16 bp, Homo sapiens
ctgctgagctctgaga

SEQ ID NO: 2422288 - DNA, 16 bp, Homo sapiens
ctgctgatcgccttcc

SEQ ID NO: 2422289 - DNA, 13 bp, Homo sapiens
ctgctgccactga

SEQ ID NO: 2422290 - DNA, 17 bp, Homo sapiens
ctgctgccactgagggg

SEQ ID NO: 2422291 - DNA, 13 bp, Homo sapiens
ctgctgctccctc

SEQ ID NO: 2422292 - DNA, 17 bp, Homo sapiens
ctgctgctccctcagac

SEQ ID NO: 2422293 - DNA, 21 bp, Homo sapiens
ctgctgctcttggctggaccc

SEQ ID NO: 2422294 - DNA, 15 bp, Homo sapiens
ctgagctgtgcaggt

SEQ ID NO: 2422295 - DNA, 14 bp, Homo sapiens
ctgaggactgattt

SEQ ID NO: 2422296 - DNA, 22 bp, Homo sapiens
ctgaggactgatttcagagtga

SEQ ID NO: 2422297 - DNA, 14 bp, Homo sapiens
ctgaggagcagcag

SEQ ID NO: 2422298 - DNA, 21 bp, Homo sapiens
ctgaggagcagcaggaggggg

SEQ ID NO: 2422299 - DNA, 23 bp, Homo sapiens
ctgaggagcagcaggagggggga

SEQ ID NO: 2422300 - DNA, 12 bp, Homo sapiens
ctgaggagtctg

SEQ ID NO: 2422301 - DNA, 17 bp, Homo sapiens
ctgaggagtctgaggtc

SEQ ID NO: 2422302 - DNA, 15 bp, Homo sapiens
ctgaggcagcagtgt

SEQ ID NO: 2422303 - DNA, 24 bp, Homo sapiens
ctgaggccacactcagcacaaggc

SEQ ID NO: 2422304 - DNA, 17 bp, Homo sapiens
ctgaggccacccagagg

SEQ ID NO: 2422305 - DNA, 17 bp, Homo sapiens
ctgaggccagcctggcc

SEQ ID NO: 2422306 - DNA, 22 bp, Homo sapiens
ctgaggccagcctggcctcctg

SEQ ID NO: 2422307 - DNA, 23 bp, Homo sapiens
ctgaggccagcctggcctcctgc

SEQ ID NO: 2422308 - DNA, 12 bp, Homo sapiens
ctgaggcctgga

SEQ ID NO: 2422309 - DNA, 14 bp, Homo sapiens
ctgaggcctgggcc

SEQ ID NO: 2422310 - DNA, 23 bp, Homo sapiens
ctgaggcctgggccgctgccacg

SEQ ID NO: 2422311 - DNA, 13 bp, Homo sapiens
ctgaggctgtggt

SEQ ID NO: 2422312 - DNA, 17 bp, Homo sapiens
ctgaggctgtggtcaca

SEQ ID NO: 2422313 - DNA, 14 bp, Homo sapiens
ctgaggctttggat

SEQ ID NO: 2422314 - DNA, 17 bp, Homo sapiens
ctgaggctttggatttg

SEQ ID NO: 2422315 - DNA, 17 bp, Homo sapiens
ctgagggaaaggccagc

SEQ ID NO: 2422316 - DNA, 18 bp, Homo sapiens
ctgagggaaaggccagca

SEQ ID NO: 2422317 - DNA, 21 bp, Homo sapiens
ctgagggaaaggccagcactc

SEQ ID NO: 2422318 - DNA, 15 bp, Homo sapiens
ctgagggatctttac

SEQ ID NO: 2422319 - DNA, 19 bp, Homo sapiens
ctgagggcagttcgcagcc

SEQ ID NO: 2422320 - DNA, 16 bp, Homo sapiens
ctgagggtctgtaggt

SEQ ID NO: 2422321 - DNA, 13 bp, Homo sapiens
ctgaggtcctgag

SEQ ID NO: 2422322 - DNA, 14 bp, Homo sapiens
ctgaggtcctgagc

SEQ ID NO: 2422323 - DNA, 15 bp, Homo sapiens
ctgaggtcctgagca

SEQ ID NO: 2422324 - DNA, 14 bp, Homo sapiens
ctctgtcaattgta

SEQ ID NO: 2422325 - DNA, 15 bp, Homo sapiens
ctctgtcaattgtac

SEQ ID NO: 2422326 - DNA, 17 bp, Homo sapiens
ctctgtccccagcctgg

SEQ ID NO: 2422327 - DNA, 22 bp, Homo sapiens
ctctgtcctgaaggcctgaggt

SEQ ID NO: 2422328 - DNA, 20 bp, Homo sapiens
ctctgtcgcccatgctggag

SEQ ID NO: 2422329 - DNA, 19 bp, Homo sapiens
ctctgtctacttgctcagg

SEQ ID NO: 2422330 - DNA, 21 bp, Homo sapiens
ctctgtctcgagcgccctgca

SEQ ID NO: 2422331 - DNA, 14 bp, Homo sapiens
ctctgtcttctgga

SEQ ID NO: 2422332 - DNA, 17 bp, Homo sapiens
ctctgtcttctggactg

SEQ ID NO: 2422333 - DNA, 19 bp, Homo sapiens
ctctgtgaccaatgtcttg

SEQ ID NO: 2422334 - DNA, 16 bp, Homo sapiens
ctctgtgccagagcct

SEQ ID NO: 2422335 - DNA, 17 bp, Homo sapiens
ctctgtgccagagcctg

SEQ ID NO: 2422336 - DNA, 12 bp, Homo sapiens
ctctgtgctggc

SEQ ID NO: 2422337 - DNA, 16 bp, Homo sapiens
ctctgtgctggccagc

SEQ ID NO: 2422338 - DNA, 19 bp, Homo sapiens
ctctgtgtatttgcttttt

SEQ ID NO: 2422339 - DNA, 18 bp, Homo sapiens
ctctgttcaaagctgcct

SEQ ID NO: 2422340 - DNA, 22 bp, Homo sapiens
ctctgttcaaagctgcctgtcc

SEQ ID NO: 2422341 - DNA, 22 bp, Homo sapiens
ctctgttccttccctgtgcctc

SEQ ID NO: 2422342 - DNA, 15 bp, Homo sapiens
ctctgttcttcctca

SEQ ID NO: 2422343 - DNA, 20 bp, Homo sapiens
ctctgttttacaagttggag

SEQ ID NO: 2422344 - DNA, 23 bp, Homo sapiens
ctctgttttacaagttggagtca

SEQ ID NO: 2422345 - DNA, 19 bp, Homo sapiens
ctcttatgctgtacccagt

SEQ ID NO: 2422346 - DNA, 20 bp, Homo sapiens
ctcttatgctgtacccagtt

SEQ ID NO: 2422347 - DNA, 19 bp, Homo sapiens
ctcttatggatgtccccag

SEQ ID NO: 2422348 - DNA, 14 bp, Homo sapiens
ctcttattgcctca

SEQ ID NO: 2422349 - DNA, 22 bp, Homo sapiens
ctcttattgcctcacttcaggt

SEQ ID NO: 2422350 - DNA, 12 bp, Homo sapiens
ctcttcaggttc

SEQ ID NO: 2422351 - DNA, 18 bp, Homo sapiens
ctcttcatttttttttca

SEQ ID NO: 2422352 - DNA, 14 bp, Homo sapiens
ctcttcccccaaga

SEQ ID NO: 2422353 - DNA, 18 bp, Homo sapiens
ctcttccccctctcccag

SEQ ID NO: 2422354 - DNA, 16 bp, Homo sapiens
ctcttcctactggtct

SEQ ID NO: 2422355 - DNA, 13 bp, Homo sapiens
ctcttcctcttcc

SEQ ID NO: 2422356 - DNA, 22 bp, Homo sapiens
ctcttctctccagctgactaaa

SEQ ID NO: 2422357 - DNA, 21 bp, Homo sapiens
ctcttctgggagggcagcagg

SEQ ID NO: 2422358 - DNA, 23 bp, Homo sapiens
ctcttctggggcaggctgggcca

SEQ ID NO: 2422359 - DNA, 23 bp, Homo sapiens
ctcttgagtttgtcgctcatgtg

SEQ ID NO: 2422360 - DNA, 21 bp, Homo sapiens
ctcttgatacccccctctgtc

SEQ ID NO: 2422361 - DNA, 18 bp, Homo sapiens
ctcttgcctcaacctccc

SEQ ID NO: 2422362 - DNA, 14 bp, Homo sapiens
ctcttgcctgccac

SEQ ID NO: 2422363 - DNA, 15 bp, Homo sapiens
ctcttgcctgccact

SEQ ID NO: 2422364 - DNA, 20 bp, Homo sapiens
ctcttgcctgccactgtgtg

SEQ ID NO: 2422365 - DNA, 21 bp, Homo sapiens
ctcttgcctgccactgtgtga

SEQ ID NO: 2422366 - DNA, 22 bp, Homo sapiens
ctcttgcctgccactgtgtgaa

SEQ ID NO: 2422367 - DNA, 22 bp, Homo sapiens
ctcttgcttgtgggactagcct

SEQ ID NO: 2422368 - DNA, 15 bp, Homo sapiens
ctcttggagaagtct

SEQ ID NO: 2422369 - DNA, 18 bp, Homo sapiens
ctcttggagaagtctcag

SEQ ID NO: 2422370 - DNA, 19 bp, Homo sapiens
ctcttggctggacccagcc

SEQ ID NO: 2422371 - DNA, 20 bp, Homo sapiens
ctcttgtataagatcctaga

SEQ ID NO: 2422372 - DNA, 17 bp, Homo sapiens
ctctttatgatctggcc

SEQ ID NO: 2422373 - DNA, 13 bp, Homo sapiens
ctctttccctggt

SEQ ID NO: 2422374 - DNA, 17 bp, Homo sapiens
ctctttctctgccagtg

SEQ ID NO: 2422375 - DNA, 15 bp, Homo sapiens
ctctttctgtatata

SEQ ID NO: 2422376 - DNA, 14 bp, Homo sapiens
ctctttgagaaata

SEQ ID NO: 2422377 - DNA, 12 bp, Homo sapiens
ctctttgtaaga

SEQ ID NO: 2422378 - DNA, 17 bp, Homo sapiens
ctcttttttcgtttgtt

SEQ ID NO: 2422379 - DNA, 13 bp, Homo sapiens
ctgaaaaaatata

SEQ ID NO: 2422380 - DNA, 22 bp, Homo sapiens
ctgaaaaatctaagtgatataa

SEQ ID NO: 2422381 - DNA, 13 bp, Homo sapiens
ctgaaaatataac

SEQ ID NO: 2422382 - DNA, 17 bp, Homo sapiens
ctgaaaattatttaaac

SEQ ID NO: 2422383 - DNA, 14 bp, Homo sapiens
ctgaaagaggctga

SEQ ID NO: 2422384 - DNA, 22 bp, Homo sapiens
ctgaaagaggctgaggcctgga

SEQ ID NO: 2422385 - DNA, 12 bp, Homo sapiens
ctgaaattccaa

SEQ ID NO: 2422386 - DNA, 17 bp, Homo sapiens
ctgaaattccaaagtct

SEQ ID NO: 2422387 - DNA, 14 bp, Homo sapiens
ctgaaattctcctg

SEQ ID NO: 2422388 - DNA, 16 bp, Homo sapiens
ctgaaattctcctgga

SEQ ID NO: 2422389 - DNA, 19 bp, Homo sapiens
ctgaaattctcctggaggt

SEQ ID NO: 2422390 - DNA, 19 bp, Homo sapiens
ctgaaatttttcttcttga

SEQ ID NO: 2422391 - DNA, 20 bp, Homo sapiens
ctgaaatttttcttcttgag

SEQ ID NO: 2422392 - DNA, 19 bp, Homo sapiens
ctgaacaccattgaaggct

SEQ ID NO: 2422393 - DNA, 12 bp, Homo sapiens
ctgaacagctgg

SEQ ID NO: 2422394 - DNA, 15 bp, Homo sapiens
ctgaacatctgagtc

SEQ ID NO: 2422395 - DNA, 19 bp, Homo sapiens
ctgaacatctgagtcctgg

SEQ ID NO: 2422396 - DNA, 15 bp, Homo sapiens
ctgaaccccagggct

SEQ ID NO: 2422397 - DNA, 15 bp, Homo sapiens
ctgaactaaagtgct

SEQ ID NO: 2422398 - DNA, 13 bp, Homo sapiens
ctgaactcacttt

SEQ ID NO: 2422399 - DNA, 15 bp, Homo sapiens
ctgaagaaccagtcc

SEQ ID NO: 2422400 - DNA, 22 bp, Homo sapiens
ctgaagaaccagtccccccacc

SEQ ID NO: 2422401 - DNA, 20 bp, Homo sapiens
ctgaagcagcctctccccag

SEQ ID NO: 2422402 - DNA, 19 bp, Homo sapiens
ctgaagcaggttcccaagc

SEQ ID NO: 2422403 - DNA, 21 bp, Homo sapiens
ctgaagcaggttcccaagctc

SEQ ID NO: 2422404 - DNA, 15 bp, Homo sapiens
ctgaagccctcccag

SEQ ID NO: 2422405 - DNA, 23 bp, Homo sapiens
ctgaagcctttgcattttggaga

SEQ ID NO: 2422406 - DNA, 15 bp, Homo sapiens
ctgaagctcccacag

SEQ ID NO: 2422407 - DNA, 12 bp, Homo sapiens
ctgaaggagccc

SEQ ID NO: 2422408 - DNA, 19 bp, Homo sapiens
ctgaaggggccatgatggc

SEQ ID NO: 2422409 - DNA, 23 bp, Homo sapiens
ctgaaggggccatgatggcaaca

SEQ ID NO: 2422410 - DNA, 15 bp, Homo sapiens
ctgaagggggcggcc

SEQ ID NO: 2422411 - DNA, 17 bp, Homo sapiens
ctgaaggttgtggcctt

SEQ ID NO: 2422412 - DNA, 21 bp, Homo sapiens
ctgaataaattgtacagccgg

SEQ ID NO: 2422413 - DNA, 15 bp, Homo sapiens
ctgaataccactctg

SEQ ID NO: 2422414 - DNA, 18 bp, Homo sapiens
ctgaataccactctgtaa

SEQ ID NO: 2422415 - DNA, 15 bp, Homo sapiens
ctgaatctgctacca

SEQ ID NO: 2422416 - DNA, 22 bp, Homo sapiens
ctgaatctgctaccaaaacagt

SEQ ID NO: 2422417 - DNA, 14 bp, Homo sapiens
ctgaatgcttctaa

SEQ ID NO: 2422418 - DNA, 15 bp, Homo sapiens
ctgaatgcttctaag

SEQ ID NO: 2422419 - DNA, 18 bp, Homo sapiens
ctgaatgcttctaagtaa

SEQ ID NO: 2422420 - DNA, 20 bp, Homo sapiens
ctgaatgcttctaagtaaat

SEQ ID NO: 2422421 - DNA, 17 bp, Homo sapiens
ctgaattatctatttca

SEQ ID NO: 2422422 - DNA, 18 bp, Homo sapiens
ctgaattatctatttcat

SEQ ID NO: 2422423 - DNA, 22 bp, Homo sapiens
ctgaatttttaaacaagtattt

SEQ ID NO: 2422424 - DNA, 18 bp, Homo sapiens
ctgacaaccactggtctg

SEQ ID NO: 2422425 - DNA, 16 bp, Homo sapiens
ctgacacccttctccc

SEQ ID NO: 2422426 - DNA, 17 bp, Homo sapiens
ctgacacccttctccca

SEQ ID NO: 2422427 - DNA, 13 bp, Homo sapiens
ctgacagaggggg

SEQ ID NO: 2422428 - DNA, 21 bp, Homo sapiens
ctcctctgctgacctgctgac

SEQ ID NO: 2422429 - DNA, 13 bp, Homo sapiens
ctcctctgtgacc

SEQ ID NO: 2422430 - DNA, 23 bp, Homo sapiens
ctcctctgtgaccaatgtcttga

SEQ ID NO: 2422431 - DNA, 20 bp, Homo sapiens
ctcctcttccatgctgtgcg

SEQ ID NO: 2422432 - DNA, 14 bp, Homo sapiens
ctcctcttccccag

SEQ ID NO: 2422433 - DNA, 21 bp, Homo sapiens
ctcctgaaaaaaaacctgaga

SEQ ID NO: 2422434 - DNA, 17 bp, Homo sapiens
ctcctgacactgctgga

SEQ ID NO: 2422435 - DNA, 18 bp, Homo sapiens
ctcctgacactgctggag

SEQ ID NO: 2422436 - DNA, 22 bp, Homo sapiens
ctcctgaccagttgcagtcact

SEQ ID NO: 2422437 - DNA, 15 bp, Homo sapiens
ctcctgacctcaagt

SEQ ID NO: 2422438 - DNA, 14 bp, Homo sapiens
ctcctgacctcagg

SEQ ID NO: 2422439 - DNA, 16 bp, Homo sapiens
ctcctgacctcaggca

SEQ ID NO: 2422440 - DNA, 19 bp, Homo sapiens
ctcctgcacttacttgctt

SEQ ID NO: 2422441 - DNA, 22 bp, Homo sapiens
ctcctgcacttacttgcttatt

SEQ ID NO: 2422442 - DNA, 15 bp, Homo sapiens
ctcctgcctctactg

SEQ ID NO: 2422443 - DNA, 19 bp, Homo sapiens
ctcctgccttcctcctggg

SEQ ID NO: 2422444 - DNA, 21 bp, Homo sapiens
ctcctgccttgaaaaagacat

SEQ ID NO: 2422445 - DNA, 19 bp, Homo sapiens
ctcctgctgctccctcaga

SEQ ID NO: 2422446 - DNA, 23 bp, Homo sapiens
ctcctgctgctccctcagactgg

SEQ ID NO: 2422447 - DNA, 21 bp, Homo sapiens
ctcctggacccccctttcaca

SEQ ID NO: 2422448 - DNA, 15 bp, Homo sapiens
ctcctggatctccct

SEQ ID NO: 2422449 - DNA, 21 bp, Homo sapiens
ctcctggatctccctgagatg

SEQ ID NO: 2422450 - DNA, 15 bp, Homo sapiens
ctcctggcccagcct

SEQ ID NO: 2422451 - DNA, 18 bp, Homo sapiens
ctcctggcccagcctttg

SEQ ID NO: 2422452 - DNA, 22 bp, Homo sapiens
ctcctggctcttgatacccccc

SEQ ID NO: 2422453 - DNA, 21 bp, Homo sapiens
ctcctggcttcccatccccag

SEQ ID NO: 2422454 - DNA, 14 bp, Homo sapiens
ctcctgggccctct

SEQ ID NO: 2422455 - DNA, 19 bp, Homo sapiens
ctcctgggccctctctgct

SEQ ID NO: 2422456 - DNA, 19 bp, Homo sapiens
ctcctgggttcaagcgatt

SEQ ID NO: 2422457 - DNA, 13 bp, Homo sapiens
ctcctgtcccctg

SEQ ID NO: 2422458 - DNA, 20 bp, Homo sapiens
ctcctgtgctcagccctgag

SEQ ID NO: 2422459 - DNA, 13 bp, Homo sapiens
ctcctgtggcccc

SEQ ID NO: 2422460 - DNA, 21 bp, Homo sapiens
ctcctgtggccccaccctggg

SEQ ID NO: 2422461 - DNA, 22 bp, Homo sapiens
ctcctgtggccccaccctgggc

SEQ ID NO: 2422462 - DNA, 19 bp, Homo sapiens
ctcctgtgggagcctcgca

SEQ ID NO: 2422463 - DNA, 22 bp, Homo sapiens
ctcctgttgggagagggcgcag

SEQ ID NO: 2422464 - DNA, 19 bp, Homo sapiens
ctcctgttttgcacagcca

SEQ ID NO: 2422465 - DNA, 16 bp, Homo sapiens
ctccttccagctagtg

SEQ ID NO: 2422466 - DNA, 15 bp, Homo sapiens
ctccttcctgtgtgt

SEQ ID NO: 2422467 - DNA, 13 bp, Homo sapiens
ctccttctccctt

SEQ ID NO: 2422468 - DNA, 16 bp, Homo sapiens
ctccttctgagctcct

SEQ ID NO: 2422469 - DNA, 19 bp, Homo sapiens
ctccttctgagctcctgtc

SEQ ID NO: 2422470 - DNA, 20 bp, Homo sapiens
ctccttctgagctcctgtcc

SEQ ID NO: 2422471 - DNA, 23 bp, Homo sapiens
ctccttctgagctcctgtcccct

SEQ ID NO: 2422472 - DNA, 12 bp, Homo sapiens
ctccttgggccc

SEQ ID NO: 2422473 - DNA, 18 bp, Homo sapiens
ctccttgggccctttgag

SEQ ID NO: 2422474 - DNA, 19 bp, Homo sapiens
ctccttgggccctttgagt

SEQ ID NO: 2422475 - DNA, 21 bp, Homo sapiens
ctccttgtgggcctgggctcc

SEQ ID NO: 2422476 - DNA, 23 bp, Homo sapiens
ctccttttaaagaaaaaaattga

SEQ ID NO: 2422477 - DNA, 19 bp, Homo sapiens
ctcgaaacacagaaacctt

SEQ ID NO: 2422478 - DNA, 20 bp, Homo sapiens
ctcgaaacacagaaaccttt

SEQ ID NO: 2422479 - DNA, 13 bp, Homo sapiens
ctcgaatctctgt

SEQ ID NO: 2422480 - DNA, 16 bp, Homo sapiens
ctcgaatctctgtgcc

SEQ ID NO: 2422481 - DNA, 14 bp, Homo sapiens
ctcgaatctgtgtg

SEQ ID NO: 2422482 - DNA, 20 bp, Homo sapiens
ctcgagcgccctgcagaccc

SEQ ID NO: 2422483 - DNA, 21 bp, Homo sapiens
ctcgagcgccctgcagaccct

SEQ ID NO: 2422484 - DNA, 18 bp, Homo sapiens
ctcgagggcagggaccac

SEQ ID NO: 2422485 - DNA, 23 bp, Homo sapiens
ctcgagggcagggaccacaccct

SEQ ID NO: 2422486 - DNA, 19 bp, Homo sapiens
ctcgatgtggtcacagctg

SEQ ID NO: 2422487 - DNA, 16 bp, Homo sapiens
ctcgcaacccgtgcca

SEQ ID NO: 2422488 - DNA, 17 bp, Homo sapiens
ctcgctccccactctgc

SEQ ID NO: 2422489 - DNA, 21 bp, Homo sapiens
ctcgctccccactctgctctg

SEQ ID NO: 2422490 - DNA, 16 bp, Homo sapiens
ctcgctggactctcag

SEQ ID NO: 2422491 - DNA, 19 bp, Homo sapiens
ctcgctggactctcagtct

SEQ ID NO: 2422492 - DNA, 17 bp, Homo sapiens
ctcgctttgttgcccag

SEQ ID NO: 2422493 - DNA, 17 bp, Homo sapiens
ctcggaggaagccccca

SEQ ID NO: 2422494 - DNA, 18 bp, Homo sapiens
ctcggcctcccaaagtgc

SEQ ID NO: 2422495 - DNA, 11 bp, Homo sapiens
ctcggcctgcc

SEQ ID NO: 2422496 - DNA, 19 bp, Homo sapiens
ctcggggatgtgtcctgac

SEQ ID NO: 2422497 - DNA, 16 bp, Homo sapiens
ctcgtaagatttcctt

SEQ ID NO: 2422498 - DNA, 16 bp, Homo sapiens
ctcgtactcaggagcc

SEQ ID NO: 2422499 - DNA, 18 bp, Homo sapiens
ctcgtccccaagtgacct

SEQ ID NO: 2422500 - DNA, 19 bp, Homo sapiens
ctcgtcctcgtttgtgttc

SEQ ID NO: 2422501 - DNA, 23 bp, Homo sapiens
ctcgtctcttttaccctggcccc

SEQ ID NO: 2422502 - DNA, 14 bp, Homo sapiens
ctctaacagcacca

SEQ ID NO: 2422503 - DNA, 15 bp, Homo sapiens
ctctaacagtggaca

SEQ ID NO: 2422504 - DNA, 13 bp, Homo sapiens
ctctaacgcctga

SEQ ID NO: 2422505 - DNA, 16 bp, Homo sapiens
ctaaggttctaaggcc

SEQ ID NO: 2422506 - DNA, 17 bp, Homo sapiens
ctaaggttctaaggcct

SEQ ID NO: 2422507 - DNA, 15 bp, Homo sapiens
ctaagtaaatacaat

SEQ ID NO: 2422508 - DNA, 17 bp, Homo sapiens
ctaagtaaatacaattt

SEQ ID NO: 2422509 - DNA, 17 bp, Homo sapiens
ctaagtaaataggaatt

SEQ ID NO: 2422510 - DNA, 14 bp, Homo sapiens
ctaagtctttccat

SEQ ID NO: 2422511 - DNA, 16 bp, Homo sapiens
ctaagtgatataaatc

SEQ ID NO: 2422512 - DNA, 13 bp, Homo sapiens
ctaagtttctaag

SEQ ID NO: 2422513 - DNA, 14 bp, Homo sapiens
ctaagtttctaaga

SEQ ID NO: 2422514 - DNA, 15 bp, Homo sapiens
ctaagtttctaagat

SEQ ID NO: 2422515 - DNA, 17 bp, Homo sapiens
ctaagtttctaagattc

SEQ ID NO: 2422516 - DNA, 19 bp, Homo sapiens
ctaagtttctaagattcta

SEQ ID NO: 2422517 - DNA, 17 bp, Homo sapiens
ctaataaactaataatt

SEQ ID NO: 2422518 - DNA, 18 bp, Homo sapiens
ctaataaactaataattg

SEQ ID NO: 2422519 - DNA, 17 bp, Homo sapiens
ctaataacatgtgaaaa

SEQ ID NO: 2422520 - DNA, 15 bp, Homo sapiens
ctaataatttctaat

SEQ ID NO: 2422521 - DNA, 16 bp, Homo sapiens
ctaataatttctaatg

SEQ ID NO: 2422522 - DNA, 17 bp, Homo sapiens
ctaataatttctaatgt

SEQ ID NO: 2422523 - DNA, 18 bp, Homo sapiens
ctaataatttctaatgtt

SEQ ID NO: 2422524 - DNA, 23 bp, Homo sapiens
ctaatagaataaaggcagttttc

SEQ ID NO: 2422525 - DNA, 16 bp, Homo sapiens
ctaatatatttaaaaa

SEQ ID NO: 2422526 - DNA, 19 bp, Homo sapiens
ctaatcagggaggtcattt

SEQ ID NO: 2422527 - DNA, 21 bp, Homo sapiens
ctaatcagggaggtcattttg

SEQ ID NO: 2422528 - DNA, 20 bp, Homo sapiens
ctaatccaggcagatccagg

SEQ ID NO: 2422529 - DNA, 23 bp, Homo sapiens
ctaatccaggcagatccaggact

SEQ ID NO: 2422530 - DNA, 15 bp, Homo sapiens
ctaattatgtagctc

SEQ ID NO: 2422531 - DNA, 15 bp, Homo sapiens
ctaattcaattcaaa

SEQ ID NO: 2422532 - DNA, 17 bp, Homo sapiens
ctaattccacacctttt

SEQ ID NO: 2422533 - DNA, 18 bp, Homo sapiens
ctaattgcttatttattg

SEQ ID NO: 2422534 - DNA, 11 bp, Homo sapiens
ctaatttaaca

SEQ ID NO: 2422535 - DNA, 17 bp, Homo sapiens
ctaatttataaaaaggt

SEQ ID NO: 2422536 - DNA, 18 bp, Homo sapiens
ctaatttcaaaatgcttt

SEQ ID NO: 2422537 - DNA, 19 bp, Homo sapiens
ctaatttcaaaatgctttt

SEQ ID NO: 2422538 - DNA, 22 bp, Homo sapiens
ctaatttcaaaatgctttttat

SEQ ID NO: 2422539 - DNA, 12 bp, Homo sapiens
ctaatttgcatt

SEQ ID NO: 2422540 - DNA, 13 bp, Homo sapiens
ctaatttgcatta

SEQ ID NO: 2422541 - DNA, 21 bp, Homo sapiens
ctaatttgcattaaattcaca

SEQ ID NO: 2422542 - DNA, 22 bp, Homo sapiens
ctaatttgcattaaattcacaa

SEQ ID NO: 2422543 - DNA, 17 bp, Homo sapiens
ctaatttttattaattt

SEQ ID NO: 2422544 - DNA, 16 bp, Homo sapiens
ctaattttttgttgtt

SEQ ID NO: 2422545 - DNA, 16 bp, Homo sapiens
ctacaattcattgtgt

SEQ ID NO: 2422546 - DNA, 16 bp, Homo sapiens
ctacaccactctggca

SEQ ID NO: 2422547 - DNA, 19 bp, Homo sapiens
ctacaccactctggcagcc

SEQ ID NO: 2422548 - DNA, 16 bp, Homo sapiens
ctacacccttttccag

SEQ ID NO: 2422549 - DNA, 18 bp, Homo sapiens
ctacacccttttccagct

SEQ ID NO: 2422550 - DNA, 17 bp, Homo sapiens
ctacacctattatccca

SEQ ID NO: 2422551 - DNA, 18 bp, Homo sapiens
ctacacctattatcccag

SEQ ID NO: 2422552 - DNA, 15 bp, Homo sapiens
ctacactcacctgca

SEQ ID NO: 2422553 - DNA, 16 bp, Homo sapiens
ctacagaaaaaccttg

SEQ ID NO: 2422554 - DNA, 10 bp, Homo sapiens
ctacagagaa

SEQ ID NO: 2422555 - DNA, 14 bp, Homo sapiens
ctacagagaaacca

SEQ ID NO: 2422556 - DNA, 11 bp, Homo sapiens
ctacagagaag

SEQ ID NO: 2422557 - DNA, 23 bp, Homo sapiens
ctacagagaagccttcaagctct

SEQ ID NO: 2422558 - DNA, 16 bp, Homo sapiens
ctacagagcttccctg

SEQ ID NO: 2422559 - DNA, 14 bp, Homo sapiens
ctacagcctcagaa

SEQ ID NO: 2422560 - DNA, 22 bp, Homo sapiens
ctacagctggggtgcagggatg

SEQ ID NO: 2422561 - DNA, 20 bp, Homo sapiens
ctacagggggtctggctggt

SEQ ID NO: 2422562 - DNA, 23 bp, Homo sapiens
ctacagggggtctggctggtgtt

SEQ ID NO: 2422563 - DNA, 17 bp, Homo sapiens
ctacagggtccaacata

SEQ ID NO: 2422564 - DNA, 18 bp, Homo sapiens
ctacagtcaggaaaggaa

SEQ ID NO: 2422565 - DNA, 16 bp, Homo sapiens
ctacagtctcgtctct

SEQ ID NO: 2422566 - DNA, 15 bp, Homo sapiens
ctacagttttaactg

SEQ ID NO: 2422567 - DNA, 20 bp, Homo sapiens
ctacagttttaactgtggat

SEQ ID NO: 2422568 - DNA, 14 bp, Homo sapiens
ctacatgagaacaa

SEQ ID NO: 2422569 - DNA, 17 bp, Homo sapiens
ctacatgagaacaaaca

SEQ ID NO: 2422570 - DNA, 23 bp, Homo sapiens
ctacatggttgaaaccccatctc

SEQ ID NO: 2422571 - DNA, 15 bp, Homo sapiens
ctaccaccagctgtg

SEQ ID NO: 2422572 - DNA, 16 bp, Homo sapiens
ctaccaccagctgtgt

SEQ ID NO: 2422573 - DNA, 18 bp, Homo sapiens
ctaccaccagctgtgtcc

SEQ ID NO: 2422574 - DNA, 19 bp, Homo sapiens
ctaccaccagctgtgtcca

SEQ ID NO: 2422575 - DNA, 19 bp, Homo sapiens
ctacccccagctgtgctta

SEQ ID NO: 2422576 - DNA, 15 bp, Homo sapiens
ctaccccgcagacac

SEQ ID NO: 2422577 - DNA, 20 bp, Homo sapiens
ctaccccgcagacaccttgg

SEQ ID NO: 2422578 - DNA, 16 bp, Homo sapiens
ctaccctctagagaaa

SEQ ID NO: 2422579 - DNA, 18 bp, Homo sapiens
ctaccctgagctgaggca

SEQ ID NO: 2422580 - DNA, 16 bp, Homo sapiens
ctaccctttttctcca

SEQ ID NO: 2422581 - DNA, 19 bp, Homo sapiens
ctaccctttttctccagct

SEQ ID NO: 2422582 - DNA, 17 bp, Homo sapiens
ctacctcaggcagctca

SEQ ID NO: 2422583 - DNA, 11 bp, Homo sapiens
ctacctgtgtg

SEQ ID NO: 2422584 - DNA, 17 bp, Homo sapiens
ctacctgtgtggacagg

SEQ ID NO: 2422585 - DNA, 22 bp, Homo sapiens
ctacctgttgagcatcacagaa

SEQ ID NO: 2422586 - DNA, 20 bp, Homo sapiens
ctaccttctccccagctccc

SEQ ID NO: 2422587 - DNA, 16 bp, Homo sapiens
ctacgctgtccagaaa

SEQ ID NO: 2422588 - DNA, 18 bp, Homo sapiens
ctactaatagaataaagg

SEQ ID NO: 2422589 - DNA, 22 bp, Homo sapiens
ctactagagtctgaacagctgt

SEQ ID NO: 2422590 - DNA, 13 bp, Homo sapiens
ctactcacacagg

SEQ ID NO: 2422591 - DNA, 15 bp, Homo sapiens
ctactcacacaggca

SEQ ID NO: 2422592 - DNA, 18 bp, Homo sapiens
ctccaagattctagatga

SEQ ID NO: 2422593 - DNA, 19 bp, Homo sapiens
ctccaagcagcttagagtt

SEQ ID NO: 2422594 - DNA, 20 bp, Homo sapiens
ctccaaggggaatcagaact

SEQ ID NO: 2422595 - DNA, 23 bp, Homo sapiens
ctccaattttttaagtgaaaata

SEQ ID NO: 2422596 - DNA, 14 bp, Homo sapiens
ctccacactgcaca

SEQ ID NO: 2422597 - DNA, 15 bp, Homo sapiens
ctccacactgcacaa

SEQ ID NO: 2422598 - DNA, 16 bp, Homo sapiens
ctccacagcaacccca

SEQ ID NO: 2422599 - DNA, 19 bp, Homo sapiens
ctccacagcaaccccaggc

SEQ ID NO: 2422600 - DNA, 14 bp, Homo sapiens
ctccaccctggccg

SEQ ID NO: 2422601 - DNA, 15 bp, Homo sapiens
ctccaccctggccga

SEQ ID NO: 2422602 - DNA, 14 bp, Homo sapiens
ctccacctcctggg

SEQ ID NO: 2422603 - DNA, 20 bp, Homo sapiens
ctccactctgcttctctgac

SEQ ID NO: 2422604 - DNA, 15 bp, Homo sapiens
ctccactttcagctg

SEQ ID NO: 2422605 - DNA, 18 bp, Homo sapiens
ctccactttcagctgtct

SEQ ID NO: 2422606 - DNA, 12 bp, Homo sapiens
ctccagacctga

SEQ ID NO: 2422607 - DNA, 19 bp, Homo sapiens
ctccagacctgatcctgga

SEQ ID NO: 2422608 - DNA, 23 bp, Homo sapiens
ctccagacctgatcctggaggcc

SEQ ID NO: 2422609 - DNA, 20 bp, Homo sapiens
ctccagagggcactctgctt

SEQ ID NO: 2422610 - DNA, 17 bp, Homo sapiens
ctccagatgcagggcag

SEQ ID NO: 2422611 - DNA, 21 bp, Homo sapiens
ctccagatgcagggcagtcat

SEQ ID NO: 2422612 - DNA, 19 bp, Homo sapiens
ctccagattagagcctgta

SEQ ID NO: 2422613 - DNA, 20 bp, Homo sapiens
ctccagcctgacatcaaaaa

SEQ ID NO: 2422614 - DNA, 22 bp, Homo sapiens
ctccagcggccctgtcatccag

SEQ ID NO: 2422615 - DNA, 14 bp, Homo sapiens
ctccagctgccccg

SEQ ID NO: 2422616 - DNA, 19 bp, Homo sapiens
ctccagctgggctctgcaa

SEQ ID NO: 2422617 - DNA, 17 bp, Homo sapiens
ctccaggcccaaggctc

SEQ ID NO: 2422618 - DNA, 13 bp, Homo sapiens
ctccagtgtcctg

SEQ ID NO: 2422619 - DNA, 14 bp, Homo sapiens
ctccagtgtcctga

SEQ ID NO: 2422620 - DNA, 12 bp, Homo sapiens
ctccatccctgg

SEQ ID NO: 2422621 - DNA, 13 bp, Homo sapiens
ctccatccctggc

SEQ ID NO: 2422622 - DNA, 14 bp, Homo sapiens
ctccatccctggcc

SEQ ID NO: 2422623 - DNA, 15 bp, Homo sapiens
ctccatccctggccc

SEQ ID NO: 2422624 - DNA, 16 bp, Homo sapiens
ctccatccctggcccc

SEQ ID NO: 2422625 - DNA, 23 bp, Homo sapiens
ctccatctggtagaagggaaagc

SEQ ID NO: 2422626 - DNA, 16 bp, Homo sapiens
ctccattctgctcctt

SEQ ID NO: 2422627 - DNA, 17 bp, Homo sapiens
ctccattctgctccttc

SEQ ID NO: 2422628 - DNA, 18 bp, Homo sapiens
ctcccaaacgccctttcc

SEQ ID NO: 2422629 - DNA, 20 bp, Homo sapiens
ctcccaaacgccctttcctc

SEQ ID NO: 2422630 - DNA, 15 bp, Homo sapiens
ctcccaaatgagcca

SEQ ID NO: 2422631 - DNA, 15 bp, Homo sapiens
ctcccacaagcctct

SEQ ID NO: 2422632 - DNA, 17 bp, Homo sapiens
ctcccacaagcctgagg

SEQ ID NO: 2422633 - DNA, 23 bp, Homo sapiens
ctcccacaagcctgagggaaagg

SEQ ID NO: 2422634 - DNA, 20 bp, Homo sapiens
ctcccacccccatctctccc

SEQ ID NO: 2422635 - DNA, 14 bp, Homo sapiens
ctcccaccctcttc

SEQ ID NO: 2422636 - DNA, 13 bp, Homo sapiens
ctcccacctcctg

SEQ ID NO: 2422637 - DNA, 21 bp, Homo sapiens
ctcccacctcctgacaccctt

SEQ ID NO: 2422638 - DNA, 18 bp, Homo sapiens
ctcccagagcacctgctg

SEQ ID NO: 2422639 - DNA, 15 bp, Homo sapiens
ctcccagaggagcca

SEQ ID NO: 2422640 - DNA, 12 bp, Homo sapiens
ctcccaggcccc

SEQ ID NO: 2422641 - DNA, 21 bp, Homo sapiens
ctcccaggggctccctccgcc

SEQ ID NO: 2422642 - DNA, 16 bp, Homo sapiens
ctcccagggttttaac

SEQ ID NO: 2422643 - DNA, 22 bp, Homo sapiens
ctcccatccagggcccccatct

SEQ ID NO: 2422644 - DNA, 16 bp, Homo sapiens
ctcccatcctgtgtgt

SEQ ID NO: 2422645 - DNA, 14 bp, Homo sapiens
ctcccattcctgaa

SEQ ID NO: 2422646 - DNA, 16 bp, Homo sapiens
ctccccactctgctct

SEQ ID NO: 2422647 - DNA, 19 bp, Homo sapiens
ctccccactctgctctgat

SEQ ID NO: 2422648 - DNA, 22 bp, Homo sapiens
ctccccactctgctctgatgca

SEQ ID NO: 2422649 - DNA, 14 bp, Homo sapiens
ctccccagcccaga

SEQ ID NO: 2422650 - DNA, 15 bp, Homo sapiens
ctccccagcccagag

SEQ ID NO: 2422651 - DNA, 16 bp, Homo sapiens
ctccccagcccagaga

SEQ ID NO: 2422652 - DNA, 18 bp, Homo sapiens
ctccccagggaagcagca

SEQ ID NO: 2422653 - DNA, 22 bp, Homo sapiens
ctccccagggaagcagcagcct

SEQ ID NO: 2422654 - DNA, 16 bp, Homo sapiens
ctccccaggtccagct

SEQ ID NO: 2422655 - DNA, 21 bp, Homo sapiens
ctccccaggtccagctctgga

SEQ ID NO: 2422656 - DNA, 14 bp, Homo sapiens
ctccccatgtgtcc

SEQ ID NO: 2422657 - DNA, 18 bp, Homo sapiens
ctccccatgtgtcctggt

SEQ ID NO: 2422658 - DNA, 20 bp, Homo sapiens
ctccccatgtgtcctggttc

SEQ ID NO: 2422659 - DNA, 21 bp, Homo sapiens
ctcccccaacagctggaccct

SEQ ID NO: 2422660 - DNA, 19 bp, Homo sapiens
ctcccccaccgttgtctca

SEQ ID NO: 2422661 - DNA, 22 bp, Homo sapiens
ctcccccaccgttgtctcatgc

SEQ ID NO: 2422662 - DNA, 23 bp, Homo sapiens
ctcccctaaagcctcaaaacaaa

SEQ ID NO: 2422663 - DNA, 15 bp, Homo sapiens
ctcccctcagcctct

SEQ ID NO: 2422664 - DNA, 23 bp, Homo sapiens
ctcccctccatccctggccccct

SEQ ID NO: 2422665 - DNA, 15 bp, Homo sapiens
ctcccctccccaact

SEQ ID NO: 2422666 - DNA, 16 bp, Homo sapiens
ctcccctctccttcct

SEQ ID NO: 2422667 - DNA, 17 bp, Homo sapiens
ctcccctgacctgtgag

SEQ ID NO: 2422668 - DNA, 22 bp, Homo sapiens
ctcccctgacctgtgagcccag

SEQ ID NO: 2422669 - DNA, 14 bp, Homo sapiens
ctcccctgcactgt

SEQ ID NO: 2422670 - DNA, 21 bp, Homo sapiens
ctcccctggagggggaatggc

SEQ ID NO: 2422671 - DNA, 18 bp, Homo sapiens
ctccccttgcctgtgcca

SEQ ID NO: 2422672 - DNA, 12 bp, Homo sapiens
ctcccgagctcc

SEQ ID NO: 2422673 - DNA, 24 bp, Homo sapiens
ctcccgagctcctcttccatgctg

SEQ ID NO: 2422674 - DNA, 20 bp, Homo sapiens
ctcccggaggttgggtgggc

SEQ ID NO: 2422675 - DNA, 14 bp, Homo sapiens
ctccctcccctgcc

SEQ ID NO: 2422676 - DNA, 21 bp, Homo sapiens
ctccctccccttgcctgtgcc

SEQ ID NO: 2422677 - DNA, 18 bp, Homo sapiens
ctccctctcaacacccag

SEQ ID NO: 2422678 - DNA, 19 bp, Homo sapiens
ctccctctcaacacccagt

SEQ ID NO: 2422679 - DNA, 14 bp, Homo sapiens
ctccctgcatggca

SEQ ID NO: 2422680 - DNA, 12 bp, Homo sapiens
ctccctggaatg

SEQ ID NO: 2422681 - DNA, 15 bp, Homo sapiens
ctccctgtaacttga

SEQ ID NO: 2422682 - DNA, 13 bp, Homo sapiens
ctccctgtgcccc

SEQ ID NO: 2422683 - DNA, 15 bp, Homo sapiens
ctccctgtgccccca

SEQ ID NO: 2422684 - DNA, 17 bp, Homo sapiens
ctccctgttccccagag

SEQ ID NO: 2422685 - DNA, 18 bp, Homo sapiens
ctccctgttccccagaga

SEQ ID NO: 2422686 - DNA, 16 bp, Homo sapiens
ctcccttctacagcct

SEQ ID NO: 2422687 - DNA, 14 bp, Homo sapiens
ctcccttcttccct

SEQ ID NO: 2422688 - DNA, 13 bp, Homo sapiens
ctcccttgggctc

SEQ ID NO: 2422689 - DNA, 20 bp, Homo sapiens
ctcccttgggctctgatgaa

SEQ ID NO: 2422690 - DNA, 19 bp, Homo sapiens
ctccctttctatcgttctc

SEQ ID NO: 2422691 - DNA, 14 bp, Homo sapiens
ctccctttttatat

SEQ ID NO: 2422692 - DNA, 15 bp, Homo sapiens
ctccgcccccaggta

SEQ ID NO: 2422693 - DNA, 16 bp, Homo sapiens
ctccgcccccaggtag

SEQ ID NO: 2422694 - DNA, 15 bp, Homo sapiens
ctccgccctgccact

SEQ ID NO: 2422695 - DNA, 15 bp, Homo sapiens
ctccgctctgtagtg

SEQ ID NO: 2422696 - DNA, 12 bp, Homo sapiens
ctccgtgtggga

SEQ ID NO: 2422697 - DNA, 14 bp, Homo sapiens
ctccgtgtgggaga

SEQ ID NO: 2422698 - DNA, 16 bp, Homo sapiens
ctccgttagctcctgt

SEQ ID NO: 2422699 - DNA, 17 bp, Homo sapiens
ctccgttagctcctgtg

SEQ ID NO: 2422700 - DNA, 18 bp, Homo sapiens
ctccgttagctcctgtgg

SEQ ID NO: 2422701 - DNA, 12 bp, Homo sapiens
ctccgttggcca

SEQ ID NO: 2422702 - DNA, 20 bp, Homo sapiens
ctccgttggccactccgaga

SEQ ID NO: 2422703 - DNA, 22 bp, Homo sapiens
ctcctaagcaactaggccttca

SEQ ID NO: 2422704 - DNA, 21 bp, Homo sapiens
ctcctagctgtcctttttcct

SEQ ID NO: 2422705 - DNA, 19 bp, Homo sapiens
ctcctaggcattctggacc

SEQ ID NO: 2422706 - DNA, 23 bp, Homo sapiens
ctcctatgatctgagtcagagcc

SEQ ID NO: 2422707 - DNA, 21 bp, Homo sapiens
ctcctcaacccctcccctcca

SEQ ID NO: 2422708 - DNA, 12 bp, Homo sapiens
ctcctcagcctg

SEQ ID NO: 2422709 - DNA, 13 bp, Homo sapiens
ctcctcagcctga

SEQ ID NO: 2422710 - DNA, 18 bp, Homo sapiens
ctcctcaggcacacagct

SEQ ID NO: 2422711 - DNA, 11 bp, Homo sapiens
ctcctcaggga

SEQ ID NO: 2422712 - DNA, 15 bp, Homo sapiens
ctcctccaggaagcc

SEQ ID NO: 2422713 - DNA, 13 bp, Homo sapiens
ctcctccagggtg

SEQ ID NO: 2422714 - DNA, 22 bp, Homo sapiens
ctcctcccagggttttaacttt

SEQ ID NO: 2422715 - DNA, 21 bp, Homo sapiens
ctcctctccccagcccagaga

SEQ ID NO: 2422716 - DNA, 23 bp, Homo sapiens
ctcctctccccagcccagagaca

SEQ ID NO: 2422717 - DNA, 11 bp, Homo sapiens
ctcctctgctg

SEQ ID NO: 2422718 - DNA, 12 bp, Homo sapiens
ctcctctgctga

SEQ ID NO: 2422719 - DNA, 19 bp, Homo sapiens
ctcctctgctgacctgctg

SEQ ID NO: 2422720 - DNA, 19 bp, Homo sapiens
ctaaggacctgaaattcca

SEQ ID NO: 2422721 - DNA, 23 bp, Homo sapiens
ctaaggagtgtagcaactacagt

SEQ ID NO: 2422722 - DNA, 14 bp, Homo sapiens
ctaaggcctaggat

SEQ ID NO: 2422723 - DNA, 19 bp, Homo sapiens
ctaaggcctaggattctaa

SEQ ID NO: 2422724 - DNA, 20 bp, Homo sapiens
ctaaggcctaggattctaaa

SEQ ID NO: 2422725 - DNA, 13 bp, Homo sapiens
ctaaggctctgag

SEQ ID NO: 2422726 - DNA, 14 bp, Homo sapiens
ctaaggctctgaga

SEQ ID NO: 2422727 - DNA, 15 bp, Homo sapiens
ctaaggctctgagag

SEQ ID NO: 2422728 - DNA, 22 bp, Homo sapiens
ctaaggctctgagagtctagat

SEQ ID NO: 2422729 - DNA, 19 bp, Homo sapiens
ctaagggtcgaaagctcta

SEQ ID NO: 2422730 - DNA, 22 bp, Homo sapiens
ctaagggtcgaaagctctagaa

SEQ ID NO: 2422731 - DNA, 19 bp, Homo sapiens
ctaaggtccggtgttctaa

SEQ ID NO: 2422732 - DNA, 21 bp, Homo sapiens
ctaaggtccggtgttctaaga

SEQ ID NO: 2422733 - DNA, 21 bp, Homo sapiens
ctaaggtcttggaacttgcct

SEQ ID NO: 2422734 - DNA, 12 bp, Homo sapiens
ctaaggttctaa

SEQ ID NO: 2422735 - DNA, 18 bp, Homo sapiens
cgctgtcaggattgcgag

SEQ ID NO: 2422736 - DNA, 20 bp, Homo sapiens
cgctgtcaggattgcgagag

SEQ ID NO: 2422737 - DNA, 17 bp, Homo sapiens
cgctgtcctttctagag

SEQ ID NO: 2422738 - DNA, 22 bp, Homo sapiens
cgcttcttgcctctgtgctgtg

SEQ ID NO: 2422739 - DNA, 20 bp, Homo sapiens
cgcttggcgatgccagccaa

SEQ ID NO: 2422740 - DNA, 22 bp, Homo sapiens
cgcttggcgatgccagccaagc

SEQ ID NO: 2422741 - DNA, 18 bp, Homo sapiens
cggaaagaagagcgagag

SEQ ID NO: 2422742 - DNA, 19 bp, Homo sapiens
cggaccaaagggagtctgc

SEQ ID NO: 2422743 - DNA, 21 bp, Homo sapiens
cggaccaaagggagtctgcca

SEQ ID NO: 2422744 - DNA, 14 bp, Homo sapiens
cggaccagcctggc

SEQ ID NO: 2422745 - DNA, 13 bp, Homo sapiens
cggacgcatctca

SEQ ID NO: 2422746 - DNA, 23 bp, Homo sapiens
cggacttagaaaaccagctcagc

SEQ ID NO: 2422747 - DNA, 14 bp, Homo sapiens
cggacttttctgca

SEQ ID NO: 2422748 - DNA, 16 bp, Homo sapiens
cggacttttctgcaaa

SEQ ID NO: 2422749 - DNA, 23 bp, Homo sapiens
cggagaagtgtgccttctctctc

SEQ ID NO: 2422750 - DNA, 14 bp, Homo sapiens
cggagagtgggggt

SEQ ID NO: 2422751 - DNA, 11 bp, Homo sapiens
cggagccactc

SEQ ID NO: 2422752 - DNA, 13 bp, Homo sapiens
cggagccactcct

SEQ ID NO: 2422753 - DNA, 17 bp, Homo sapiens
cggagccactcctctga

SEQ ID NO: 2422754 - DNA, 16 bp, Homo sapiens
cggaggtgtggagccg

SEQ ID NO: 2422755 - DNA, 18 bp, Homo sapiens
cggagtgagttttttagt

SEQ ID NO: 2422756 - DNA, 14 bp, Homo sapiens
cggagtgcggacca

SEQ ID NO: 2422757 - DNA, 20 bp, Homo sapiens
cggatcctaagcatctaagt

SEQ ID NO: 2422758 - DNA, 12 bp, Homo sapiens
cggcaacatcaa

SEQ ID NO: 2422759 - DNA, 19 bp, Homo sapiens
cggcacagggtctgctctt

SEQ ID NO: 2422760 - DNA, 22 bp, Homo sapiens
cggcacctgggccctggggcct

SEQ ID NO: 2422761 - DNA, 20 bp, Homo sapiens
cggcagcttctgccccctgc

SEQ ID NO: 2422762 - DNA, 22 bp, Homo sapiens
cggcagggcgggcagagggctg

SEQ ID NO: 2422763 - DNA, 23 bp, Homo sapiens
cggcagggcgggcagagggctgg

SEQ ID NO: 2422764 - DNA, 21 bp, Homo sapiens
cggcatggacaatggaccgga

SEQ ID NO: 2422765 - DNA, 17 bp, Homo sapiens
cggccacacagctgccg

SEQ ID NO: 2422766 - DNA, 17 bp, Homo sapiens
cggccagggagaagctc

SEQ ID NO: 2422767 - DNA, 20 bp, Homo sapiens
cggcccatccccaggcacct

SEQ ID NO: 2422768 - DNA, 17 bp, Homo sapiens
cggcccctcccctccaa

SEQ ID NO: 2422769 - DNA, 21 bp, Homo sapiens
cggccctcagtagtccctgca

SEQ ID NO: 2422770 - DNA, 14 bp, Homo sapiens
cggccggccagccc

SEQ ID NO: 2422771 - DNA, 21 bp, Homo sapiens
cggcctccttctgagctcctg

SEQ ID NO: 2422772 - DNA, 22 bp, Homo sapiens
cggcctgccaggaggacccagg

SEQ ID NO: 2422773 - DNA, 20 bp, Homo sapiens
cggcctgcccccaccccatt

SEQ ID NO: 2422774 - DNA, 17 bp, Homo sapiens
cggcgacggagcactgc

SEQ ID NO: 2422775 - DNA, 20 bp, Homo sapiens
cggcgacggagcactgcacc

SEQ ID NO: 2422776 - DNA, 17 bp, Homo sapiens
cggctccccatgtgtcc

SEQ ID NO: 2422777 - DNA, 15 bp, Homo sapiens
cggctctgtccccag

SEQ ID NO: 2422778 - DNA, 17 bp, Homo sapiens
cggctctgtccccagcc

SEQ ID NO: 2422779 - DNA, 11 bp, Homo sapiens
cggctgaccat

SEQ ID NO: 2422780 - DNA, 15 bp, Homo sapiens
cggctgaccatgctc

SEQ ID NO: 2422781 - DNA, 22 bp, Homo sapiens
cggctgaccatgctcatctgct

SEQ ID NO: 2422782 - DNA, 20 bp, Homo sapiens
cggctgcagaggccagaggc

SEQ ID NO: 2422783 - DNA, 13 bp, Homo sapiens
cggctggccatgg

SEQ ID NO: 2422784 - DNA, 21 bp, Homo sapiens
cggctggccatggagaaagct

SEQ ID NO: 2422785 - DNA, 16 bp, Homo sapiens
cggctggggtcccagc

SEQ ID NO: 2422786 - DNA, 18 bp, Homo sapiens
cggctggggtcccagcag

SEQ ID NO: 2422787 - DNA, 23 bp, Homo sapiens
cggctggggtcccagcagctgcc

SEQ ID NO: 2422788 - DNA, 20 bp, Homo sapiens
cggctgtgcagtcctgggtc

SEQ ID NO: 2422789 - DNA, 15 bp, Homo sapiens
cgggaaaaagcccac

SEQ ID NO: 2422790 - DNA, 20 bp, Homo sapiens
cgggaattttcatctaggat

SEQ ID NO: 2422791 - DNA, 23 bp, Homo sapiens
cgggcacgggtgtcacggccagg

SEQ ID NO: 2422792 - DNA, 15 bp, Homo sapiens
cgggcagagggctgg

SEQ ID NO: 2422793 - DNA, 21 bp, Homo sapiens
cgggccactccttcctgcccc

SEQ ID NO: 2422794 - DNA, 22 bp, Homo sapiens
cgggccactccttcctgcccca

SEQ ID NO: 2422795 - DNA, 20 bp, Homo sapiens
cggggaactggccaagctga

SEQ ID NO: 2422796 - DNA, 19 bp, Homo sapiens
cgggggttccgtgtccacc

SEQ ID NO: 2422797 - DNA, 20 bp, Homo sapiens
cgggtgaacaaagcagccac

SEQ ID NO: 2422798 - DNA, 21 bp, Homo sapiens
cgggtgaacaaagcagccacg

SEQ ID NO: 2422799 - DNA, 22 bp, Homo sapiens
cggtatccccccatcttgcttc

SEQ ID NO: 2422800 - DNA, 17 bp, Homo sapiens
cggtcggggcatctggc

SEQ ID NO: 2422801 - DNA, 14 bp, Homo sapiens
cggtctgtgcccct

SEQ ID NO: 2422802 - DNA, 21 bp, Homo sapiens
cggtctgttctgtttcaaggc

SEQ ID NO: 2422803 - DNA, 12 bp, Homo sapiens
cggtgggcctgg

SEQ ID NO: 2422804 - DNA, 10 bp, Homo sapiens
cggtgggggt

SEQ ID NO: 2422805 - DNA, 18 bp, Homo sapiens
cggttataaaaaatggtt

SEQ ID NO: 2422806 - DNA, 20 bp, Homo sapiens
cggttataaaaaatggttca

SEQ ID NO: 2422807 - DNA, 21 bp, Homo sapiens
cggttataaaaaatggttcag

SEQ ID NO: 2422808 - DNA, 16 bp, Homo sapiens
cgtaaagtacttgtag

SEQ ID NO: 2422809 - DNA, 16 bp, Homo sapiens
cgtaagtacagagaag

SEQ ID NO: 2422810 - DNA, 19 bp, Homo sapiens
cgtaagtacagagaagcca

SEQ ID NO: 2422811 - DNA, 12 bp, Homo sapiens
cgtaatttaact

SEQ ID NO: 2422812 - DNA, 14 bp, Homo sapiens
cgtactcaggagcc

SEQ ID NO: 2422813 - DNA, 22 bp, Homo sapiens
cgtagatattggacaaagaacc

SEQ ID NO: 2422814 - DNA, 15 bp, Homo sapiens
cgtaggctacagaga

SEQ ID NO: 2422815 - DNA, 17 bp, Homo sapiens
cgtaggctacagagaag

SEQ ID NO: 2422816 - DNA, 18 bp, Homo sapiens
cgtatgtctggttctcaa

SEQ ID NO: 2422817 - DNA, 21 bp, Homo sapiens
cgtatttaatagcaaagaatt

SEQ ID NO: 2422818 - DNA, 22 bp, Homo sapiens
cgtcaagagtgaattccctcac

SEQ ID NO: 2422819 - DNA, 18 bp, Homo sapiens
cgtcaccacgactggcca

SEQ ID NO: 2422820 - DNA, 21 bp, Homo sapiens
cgtcatgaggagattctgcct

SEQ ID NO: 2422821 - DNA, 23 bp, Homo sapiens
cgtccatcacgttagctgtccca

SEQ ID NO: 2422822 - DNA, 15 bp, Homo sapiens
cgtcctcctctgtga

SEQ ID NO: 2422823 - DNA, 14 bp, Homo sapiens
cgtcctgcctgtgg

SEQ ID NO: 2422824 - DNA, 22 bp, Homo sapiens
cgtccttactcctgtgggagcc

SEQ ID NO: 2422825 - DNA, 24 bp, Homo sapiens
cgtctcccccaacagctggaccct

SEQ ID NO: 2422826 - DNA, 16 bp, Homo sapiens
cgtctcggccttcaca

SEQ ID NO: 2422827 - DNA, 17 bp, Homo sapiens
cgtctggcccaccaggg

SEQ ID NO: 2422828 - DNA, 19 bp, Homo sapiens
cgtgaaaacacatttgctt

SEQ ID NO: 2422829 - DNA, 19 bp, Homo sapiens
cgtgacaataaaacattaa

SEQ ID NO: 2422830 - DNA, 22 bp, Homo sapiens
cgtgacctgctaggccagagcc

SEQ ID NO: 2422831 - DNA, 12 bp, Homo sapiens
cgtgcctgtgtc

SEQ ID NO: 2422832 - DNA, 15 bp, Homo sapiens
cgtggagagctagga

SEQ ID NO: 2422833 - DNA, 19 bp, Homo sapiens
cgtggagagctaggagcaa

SEQ ID NO: 2422834 - DNA, 15 bp, Homo sapiens
cgtggaggctgctcg

SEQ ID NO: 2422835 - DNA, 20 bp, Homo sapiens
cgtggaggggtaggggctgg

SEQ ID NO: 2422836 - DNA, 17 bp, Homo sapiens
cgtggattgcacgtggc

SEQ ID NO: 2422837 - DNA, 17 bp, Homo sapiens
cgtggcccttcctggac

SEQ ID NO: 2422838 - DNA, 23 bp, Homo sapiens
cgtggcctcttgagcagtggctg

SEQ ID NO: 2422839 - DNA, 13 bp, Homo sapiens
cgtggccttgttc

SEQ ID NO: 2422840 - DNA, 20 bp, Homo sapiens
cgtggccttgttctgtcacc

SEQ ID NO: 2422841 - DNA, 15 bp, Homo sapiens
cgtggctcagccagc

SEQ ID NO: 2422842 - DNA, 13 bp, Homo sapiens
cgtgggtgtgtgc

SEQ ID NO: 2422843 - DNA, 13 bp, Homo sapiens
cgtggtggtccct

SEQ ID NO: 2422844 - DNA, 16 bp, Homo sapiens
cgtgtcacctgtgctt

SEQ ID NO: 2422845 - DNA, 14 bp, Homo sapiens
cgtgtccaccccca

SEQ ID NO: 2422846 - DNA, 13 bp, Homo sapiens
cctttgccaggtg

SEQ ID NO: 2422847 - DNA, 23 bp, Homo sapiens
cctttgcgctcctggcccagcct

SEQ ID NO: 2422848 - DNA, 16 bp, Homo sapiens
cctttgctgcatggca

SEQ ID NO: 2422849 - DNA, 13 bp, Homo sapiens
cctttgctgtgag

SEQ ID NO: 2422850 - DNA, 19 bp, Homo sapiens
cctttgggcttcagctgcc

SEQ ID NO: 2422851 - DNA, 22 bp, Homo sapiens
cctttgtgcacatttatttcct

SEQ ID NO: 2422852 - DNA, 13 bp, Homo sapiens
cctttgtgcccta

SEQ ID NO: 2422853 - DNA, 18 bp, Homo sapiens
cctggcctcccccacttt

SEQ ID NO: 2422854 - DNA, 18 bp, Homo sapiens
cctggcctcctgcctcta

SEQ ID NO: 2422855 - DNA, 18 bp, Homo sapiens
cctggccttcagtgtacc

SEQ ID NO: 2422856 - DNA, 13 bp, Homo sapiens
cctggctctcacc

SEQ ID NO: 2422857 - DNA, 15 bp, Homo sapiens
cctggctctcacctc

SEQ ID NO: 2422858 - DNA, 16 bp, Homo sapiens
cctggctctcacctct

SEQ ID NO: 2422859 - DNA, 18 bp, Homo sapiens
cctggctggctgagggca

SEQ ID NO: 2422860 - DNA, 20 bp, Homo sapiens
cctggctgggacgtggctca

SEQ ID NO: 2422861 - DNA, 21 bp, Homo sapiens
cctggctgggacgtggctcag

SEQ ID NO: 2422862 - DNA, 22 bp, Homo sapiens
cctggctgggacgtggctcagc

SEQ ID NO: 2422863 - DNA, 22 bp, Homo sapiens
cctggcttcccatccccagcga

SEQ ID NO: 2422864 - DNA, 22 bp, Homo sapiens
cctggctttcattttctctcag

SEQ ID NO: 2422865 - DNA, 23 bp, Homo sapiens
cctggctttcattttctctcagg

SEQ ID NO: 2422866 - DNA, 22 bp, Homo sapiens
cctgggacaactgctcccacct

SEQ ID NO: 2422867 - DNA, 22 bp, Homo sapiens
cctgggagaatcgctcctgcag

SEQ ID NO: 2422868 - DNA, 12 bp, Homo sapiens
cctgggaggaga

SEQ ID NO: 2422869 - DNA, 15 bp, Homo sapiens
cctgggccctctctg

SEQ ID NO: 2422870 - DNA, 18 bp, Homo sapiens
cctgggccctctctgctc

SEQ ID NO: 2422871 - DNA, 14 bp, Homo sapiens
cctgggccctgggc

SEQ ID NO: 2422872 - DNA, 16 bp, Homo sapiens
cctgggccgctgccac

SEQ ID NO: 2422873 - DNA, 21 bp, Homo sapiens
cctgggcctatggagagccct

SEQ ID NO: 2422874 - DNA, 12 bp, Homo sapiens
cctgggcctgca

SEQ ID NO: 2422875 - DNA, 14 bp, Homo sapiens
cctgggcctgctgc

SEQ ID NO: 2422876 - DNA, 16 bp, Homo sapiens
cctgggcctgctgctg

SEQ ID NO: 2422877 - DNA, 20 bp, Homo sapiens
cctgggcctgctgctgagaa

SEQ ID NO: 2422878 - DNA, 17 bp, Homo sapiens
cctgggccttgggctcc

SEQ ID NO: 2422879 - DNA, 15 bp, Homo sapiens
cctgggcgctggtcc

SEQ ID NO: 2422880 - DNA, 14 bp, Homo sapiens
cctgggctcctgga

SEQ ID NO: 2422881 - DNA, 20 bp, Homo sapiens
cctgggctggaatcaggaat

SEQ ID NO: 2422882 - DNA, 14 bp, Homo sapiens
cctggggcctgtac

SEQ ID NO: 2422883 - DNA, 21 bp, Homo sapiens
cctggggcctgtactgcctgc

SEQ ID NO: 2422884 - DNA, 23 bp, Homo sapiens
cctggggctctaacgcctgagcc

SEQ ID NO: 2422885 - DNA, 16 bp, Homo sapiens
cctgggggtgccagga

SEQ ID NO: 2422886 - DNA, 19 bp, Homo sapiens
cctgggtccaatgctcagg

SEQ ID NO: 2422887 - DNA, 19 bp, Homo sapiens
cctgggtggctactctgtg

SEQ ID NO: 2422888 - DNA, 22 bp, Homo sapiens
cctgggtggctactctgtgcca

SEQ ID NO: 2422889 - DNA, 23 bp, Homo sapiens
cctgggtggctactctgtgccag

SEQ ID NO: 2422890 - DNA, 16 bp, Homo sapiens
cctgggttaagtatta

SEQ ID NO: 2422891 - DNA, 17 bp, Homo sapiens
cctgggttgcagacagg

SEQ ID NO: 2422892 - DNA, 19 bp, Homo sapiens
cctgggtttggtgtatggt

SEQ ID NO: 2422893 - DNA, 20 bp, Homo sapiens
cctgggttttgtattctctg

SEQ ID NO: 2422894 - DNA, 23 bp, Homo sapiens
cctgggttttgtattctctgagc

SEQ ID NO: 2422895 - DNA, 14 bp, Homo sapiens
cctggtaccctcct

SEQ ID NO: 2422896 - DNA, 15 bp, Homo sapiens
cctggtaccctcctg

SEQ ID NO: 2422897 - DNA, 13 bp, Homo sapiens
cctggtactccct

SEQ ID NO: 2422898 - DNA, 15 bp, Homo sapiens
cctggtcccctcctt

SEQ ID NO: 2422899 - DNA, 18 bp, Homo sapiens
cctggtctcaccctggag

SEQ ID NO: 2422900 - DNA, 21 bp, Homo sapiens
cctggtctcaccctggaggca

SEQ ID NO: 2422901 - DNA, 12 bp, Homo sapiens
cctggtgccacc

SEQ ID NO: 2422902 - DNA, 14 bp, Homo sapiens
cctggtggccatgc

SEQ ID NO: 2422903 - DNA, 14 bp, Homo sapiens
cctggtggggcagc

SEQ ID NO: 2422904 - DNA, 19 bp, Homo sapiens
cctggtggtattttcaata

SEQ ID NO: 2422905 - DNA, 21 bp, Homo sapiens
cctggtggtattttcaatagc

SEQ ID NO: 2422906 - DNA, 23 bp, Homo sapiens
cctgtaacatactggcctggact

SEQ ID NO: 2422907 - DNA, 21 bp, Homo sapiens
cctgtaacctcttcagaggcc

SEQ ID NO: 2422908 - DNA, 21 bp, Homo sapiens
cctgtacagtagattttccaa

SEQ ID NO: 2422909 - DNA, 14 bp, Homo sapiens
cctgtacagtgtta

SEQ ID NO: 2422910 - DNA, 16 bp, Homo sapiens
cctgtacattgtggga

SEQ ID NO: 2422911 - DNA, 15 bp, Homo sapiens
cctgtactgcctgct

SEQ ID NO: 2422912 - DNA, 16 bp, Homo sapiens
cctgtactgcctgctt

SEQ ID NO: 2422913 - DNA, 17 bp, Homo sapiens
cctgtactgcctgcttg

SEQ ID NO: 2422914 - DNA, 22 bp, Homo sapiens
cctgtagaactcaacctctaca

SEQ ID NO: 2422915 - DNA, 15 bp, Homo sapiens
cctgtagcacttact

SEQ ID NO: 2422916 - DNA, 23 bp, Homo sapiens
cctgtattcctgacctccgccat

SEQ ID NO: 2422917 - DNA, 23 bp, Homo sapiens
cctgtcagatccaggagctccag

SEQ ID NO: 2422918 - DNA, 19 bp, Homo sapiens
cctgtcatcatcatggcca

SEQ ID NO: 2422919 - DNA, 20 bp, Homo sapiens
cctgtcatccagctcactca

SEQ ID NO: 2422920 - DNA, 19 bp, Homo sapiens
cctgtccagctccaacctg

SEQ ID NO: 2422921 - DNA, 13 bp, Homo sapiens
cctgtcccctgct

SEQ ID NO: 2422922 - DNA, 21 bp, Homo sapiens
cctgtcctccaacaccaagca

SEQ ID NO: 2422923 - DNA, 15 bp, Homo sapiens
cctgtctcacctgga

SEQ ID NO: 2422924 - DNA, 16 bp, Homo sapiens
cctgtctcagcctccc

SEQ ID NO: 2422925 - DNA, 19 bp, Homo sapiens
cctgtcttcagagaaccca

SEQ ID NO: 2422926 - DNA, 15 bp, Homo sapiens
cctgtgaacccagga

SEQ ID NO: 2422927 - DNA, 16 bp, Homo sapiens
cctgtgaacccaggac

SEQ ID NO: 2422928 - DNA, 21 bp, Homo sapiens
cctgtgaatgccactgccttc

SEQ ID NO: 2422929 - DNA, 18 bp, Homo sapiens
cctgtgaccacaacatga

SEQ ID NO: 2422930 - DNA, 22 bp, Homo sapiens
cctgtgcacaccccactcccac

SEQ ID NO: 2422931 - DNA, 23 bp, Homo sapiens
cctgtgcacaccccactcccaca

SEQ ID NO: 2422932 - DNA, 20 bp, Homo sapiens
cctgtgcagccgctgagcga

SEQ ID NO: 2422933 - DNA, 13 bp, Homo sapiens
cctgtgcccccag

SEQ ID NO: 2422934 - DNA, 22 bp, Homo sapiens
cctgtggccccaccctgggccc

SEQ ID NO: 2422935 - DNA, 13 bp, Homo sapiens
cctgtgggagcct

SEQ ID NO: 2422936 - DNA, 14 bp, Homo sapiens
cctgtgggagcctc

SEQ ID NO: 2422937 - DNA, 22 bp, Homo sapiens
cctgtggggggtaatccctgct

SEQ ID NO: 2422938 - DNA, 16 bp, Homo sapiens
cctgtggtcactgact

SEQ ID NO: 2422939 - DNA, 13 bp, Homo sapiens
cctgtgtagctgt

SEQ ID NO: 2422940 - DNA, 20 bp, Homo sapiens
cctgtgtagctgtgacctgc

SEQ ID NO: 2422941 - DNA, 13 bp, Homo sapiens
cctgtgtccatgc

SEQ ID NO: 2422942 - DNA, 17 bp, Homo sapiens
cctgtgtggacaggact

SEQ ID NO: 2422943 - DNA, 22 bp, Homo sapiens
cctgtgtggagagggaatgtga

SEQ ID NO: 2422944 - DNA, 20 bp, Homo sapiens
cctgtgtgtccaaaactgcc

SEQ ID NO: 2422945 - DNA, 22 bp, Homo sapiens
cctgtgttgtctctagagcagg

SEQ ID NO: 2422946 - DNA, 22 bp, Homo sapiens
cctgttcatgccgacgcttgca

SEQ ID NO: 2422947 - DNA, 15 bp, Homo sapiens
cctgttcctgctgct

SEQ ID NO: 2422948 - DNA, 17 bp, Homo sapiens
cctgttctatgccttta

SEQ ID NO: 2422949 - DNA, 17 bp, Homo sapiens
cctgttgagcatcacag

SEQ ID NO: 2422950 - DNA, 15 bp, Homo sapiens
cctgtttcccaggcc

SEQ ID NO: 2422951 - DNA, 14 bp, Homo sapiens
cctgtttctggcac

SEQ ID NO: 2422952 - DNA, 15 bp, Homo sapiens
cctgtttggcctctc

SEQ ID NO: 2422953 - DNA, 16 bp, Homo sapiens
cctgtttggcctctct

SEQ ID NO: 2422954 - DNA, 20 bp, Homo sapiens
cctgtttggcctctctatcc

SEQ ID NO: 2422955 - DNA, 20 bp, Homo sapiens
ccttaaacaaaaattaaaat

SEQ ID NO: 2422956 - DNA, 20 bp, Homo sapiens
cctctcgctcctcaacccct

SEQ ID NO: 2422957 - DNA, 19 bp, Homo sapiens
cctctctatcctctcttcc

SEQ ID NO: 2422958 - DNA, 23 bp, Homo sapiens
cctctctgcagacttcccagcta

SEQ ID NO: 2422959 - DNA, 13 bp, Homo sapiens
cctctctggagaa

SEQ ID NO: 2422960 - DNA, 11 bp, Homo sapiens
cctctcttcct

SEQ ID NO: 2422961 - DNA, 17 bp, Homo sapiens
cctctgaggccagcctg

SEQ ID NO: 2422962 - DNA, 18 bp, Homo sapiens
cctctgaggccagcctgg

SEQ ID NO: 2422963 - DNA, 19 bp, Homo sapiens
cctctgaggccagcctggc

SEQ ID NO: 2422964 - DNA, 20 bp, Homo sapiens
cctctgaggccagcctggcc

SEQ ID NO: 2422965 - DNA, 21 bp, Homo sapiens
cctctgaggccagcctggcct

SEQ ID NO: 2422966 - DNA, 16 bp, Homo sapiens
cctctgcactcccacc

SEQ ID NO: 2422967 - DNA, 17 bp, Homo sapiens
cctctgcatcctctgga

SEQ ID NO: 2422968 - DNA, 19 bp, Homo sapiens
cctctgcatcctctggagc

SEQ ID NO: 2422969 - DNA, 22 bp, Homo sapiens
cctctgccaaaggatgtgatat

SEQ ID NO: 2422970 - DNA, 23 bp, Homo sapiens
cctctggcattagaattatttaa

SEQ ID NO: 2422971 - DNA, 14 bp, Homo sapiens
cctctgggctctga

SEQ ID NO: 2422972 - DNA, 17 bp, Homo sapiens
cctctggtcgctcctgc

SEQ ID NO: 2422973 - DNA, 15 bp, Homo sapiens
cctctgtcagtcaca

SEQ ID NO: 2422974 - DNA, 19 bp, Homo sapiens
cctctgtctcgagcgccct

SEQ ID NO: 2422975 - DNA, 22 bp, Homo sapiens
cctctgtcttgtgaaggcaggg

SEQ ID NO: 2422976 - DNA, 19 bp, Homo sapiens
cctctgtgaccaatgtctt

SEQ ID NO: 2422977 - DNA, 16 bp, Homo sapiens
cctctgtgctgtgtgt

SEQ ID NO: 2422978 - DNA, 18 bp, Homo sapiens
cctctgttcaaagctgcc

SEQ ID NO: 2422979 - DNA, 22 bp, Homo sapiens
cctcttccccagacgcctggct

SEQ ID NO: 2422980 - DNA, 15 bp, Homo sapiens
cctcttcccccaaga

SEQ ID NO: 2422981 - DNA, 16 bp, Homo sapiens
cctcttcccccaagat

SEQ ID NO: 2422982 - DNA, 13 bp, Homo sapiens
cctcttctgggag

SEQ ID NO: 2422983 - DNA, 13 bp, Homo sapiens
cctcttgaccagg

SEQ ID NO: 2422984 - DNA, 15 bp, Homo sapiens
cctcttgaccaggct

SEQ ID NO: 2422985 - DNA, 20 bp, Homo sapiens
cctcttgaccaggctgcctc

SEQ ID NO: 2422986 - DNA, 17 bp, Homo sapiens
cctcttgagcagtggct

SEQ ID NO: 2422987 - DNA, 14 bp, Homo sapiens
cctcttggagaagt

SEQ ID NO: 2422988 - DNA, 22 bp, Homo sapiens
cctcttggagaagtctcagcta

SEQ ID NO: 2422989 - DNA, 13 bp, Homo sapiens
cctcttggcctga

SEQ ID NO: 2422990 - DNA, 13 bp, Homo sapiens
cctctttcagctc

SEQ ID NO: 2422991 - DNA, 16 bp, Homo sapiens
cctctttcagctcctg

SEQ ID NO: 2422992 - DNA, 18 bp, Homo sapiens
cctctttcagctcctgac

SEQ ID NO: 2422993 - DNA, 19 bp, Homo sapiens
cctctttggctcccctgta

SEQ ID NO: 2422994 - DNA, 15 bp, Homo sapiens
cctgaaacaacttgg

SEQ ID NO: 2422995 - DNA, 13 bp, Homo sapiens
cctgaaattccaa

SEQ ID NO: 2422996 - DNA, 18 bp, Homo sapiens
cctgaaattccaaagtct

SEQ ID NO: 2422997 - DNA, 16 bp, Homo sapiens
cctgaaccccagggct

SEQ ID NO: 2422998 - DNA, 13 bp, Homo sapiens
cctgaagaaccag

SEQ ID NO: 2422999 - DNA, 16 bp, Homo sapiens
cctgaagaaccagtcc

SEQ ID NO: 2423000 - DNA, 17 bp, Homo sapiens
cctgaagaaccagtccc

SEQ ID NO: 2423001 - DNA, 12 bp, Homo sapiens
cctgaagtattt

SEQ ID NO: 2423002 - DNA, 21 bp, Homo sapiens
cctgaatacccttttctgacc

SEQ ID NO: 2423003 - DNA, 18 bp, Homo sapiens
cctgacaaccactggtct

SEQ ID NO: 2423004 - DNA, 14 bp, Homo sapiens
cctgacacactaac

SEQ ID NO: 2423005 - DNA, 13 bp, Homo sapiens
cctgaccactcag

SEQ ID NO: 2423006 - DNA, 17 bp, Homo sapiens
cctgaccactcagagac

SEQ ID NO: 2423007 - DNA, 14 bp, Homo sapiens
cctgaccagctccc

SEQ ID NO: 2423008 - DNA, 23 bp, Homo sapiens
cctgaccagttgcagtcactcta

SEQ ID NO: 2423009 - DNA, 14 bp, Homo sapiens
cctgacctggcccc

SEQ ID NO: 2423010 - DNA, 21 bp, Homo sapiens
cctgacctgtgagcccagctg

SEQ ID NO: 2423011 - DNA, 19 bp, Homo sapiens
cctgactagggagccatgt

SEQ ID NO: 2423012 - DNA, 19 bp, Homo sapiens
cctgagatttattaaagaa

SEQ ID NO: 2423013 - DNA, 21 bp, Homo sapiens
cctgagatttattaaagaaaa

SEQ ID NO: 2423014 - DNA, 22 bp, Homo sapiens
cctgagcagtccttggcctgct

SEQ ID NO: 2423015 - DNA, 15 bp, Homo sapiens
cctgagccagggtct

SEQ ID NO: 2423016 - DNA, 15 bp, Homo sapiens
cctgagcccagggag

SEQ ID NO: 2423017 - DNA, 17 bp, Homo sapiens
cctgagccggccccagg

SEQ ID NO: 2423018 - DNA, 20 bp, Homo sapiens
cctgagcctgccgagcaacc

SEQ ID NO: 2423019 - DNA, 20 bp, Homo sapiens
cctgagcgagtggagtctgc

SEQ ID NO: 2423020 - DNA, 13 bp, Homo sapiens
cctgagctcagcg

SEQ ID NO: 2423021 - DNA, 14 bp, Homo sapiens
cctgagctcagcgt

SEQ ID NO: 2423022 - DNA, 18 bp, Homo sapiens
cctgagctgaggcagcag

SEQ ID NO: 2423023 - DNA, 18 bp, Homo sapiens
cctgaggaacccttacag

SEQ ID NO: 2423024 - DNA, 17 bp, Homo sapiens
cctgaggagtctgaggt

SEQ ID NO: 2423025 - DNA, 20 bp, Homo sapiens
cctgaggagtctgaggtcct

SEQ ID NO: 2423026 - DNA, 22 bp, Homo sapiens
cctgaggagtctgaggtcctga

SEQ ID NO: 2423027 - DNA, 15 bp, Homo sapiens
cctgaggctgtggtc

SEQ ID NO: 2423028 - DNA, 20 bp, Homo sapiens
cctgaggctttggatttgac

SEQ ID NO: 2423029 - DNA, 22 bp, Homo sapiens
cctgaggctttggatttgacat

SEQ ID NO: 2423030 - DNA, 22 bp, Homo sapiens
cctgagggaaaggccagcactc

SEQ ID NO: 2423031 - DNA, 19 bp, Homo sapiens
cctgagggtctgtaggttg

SEQ ID NO: 2423032 - DNA, 22 bp, Homo sapiens
cctgagtcgtgacctgctaggc

SEQ ID NO: 2423033 - DNA, 19 bp, Homo sapiens
cctgatcccagagagcccg

SEQ ID NO: 2423034 - DNA, 15 bp, Homo sapiens
cctgatcctggaggc

SEQ ID NO: 2423035 - DNA, 21 bp, Homo sapiens
cctgatgctgacattcacctg

SEQ ID NO: 2423036 - DNA, 19 bp, Homo sapiens
cctgatttaggagaagcca

SEQ ID NO: 2423037 - DNA, 20 bp, Homo sapiens
cctgatttaggagaagccag

SEQ ID NO: 2423038 - DNA, 22 bp, Homo sapiens
cctgcaaactgggaaccccttt

SEQ ID NO: 2423039 - DNA, 17 bp, Homo sapiens
cctgcaagtcagtccag

SEQ ID NO: 2423040 - DNA, 17 bp, Homo sapiens
cctgcacagtgacttct

SEQ ID NO: 2423041 - DNA, 21 bp, Homo sapiens
cctgcacagtgacttctgaga

SEQ ID NO: 2423042 - DNA, 22 bp, Homo sapiens
cctgcacagtgacttctgagat

SEQ ID NO: 2423043 - DNA, 17 bp, Homo sapiens
cctgcactaacagagtg

SEQ ID NO: 2423044 - DNA, 21 bp, Homo sapiens
cctgcactggggagcccgtct

SEQ ID NO: 2423045 - DNA, 16 bp, Homo sapiens
cctgcagaatttgggt

SEQ ID NO: 2423046 - DNA, 15 bp, Homo sapiens
cctgcagaccctgcc

SEQ ID NO: 2423047 - DNA, 16 bp, Homo sapiens
cctgcagaccctgccc

SEQ ID NO: 2423048 - DNA, 18 bp, Homo sapiens
cctgcagcttgtagccag

SEQ ID NO: 2423049 - DNA, 19 bp, Homo sapiens
cctgcagcttgtagccagc

SEQ ID NO: 2423050 - DNA, 13 bp, Homo sapiens
cctgcaggaagga

SEQ ID NO: 2423051 - DNA, 19 bp, Homo sapiens
cctgcaggaaggagctgcc

SEQ ID NO: 2423052 - DNA, 23 bp, Homo sapiens
cctgcatccattctcctgaggat

SEQ ID NO: 2423053 - DNA, 15 bp, Homo sapiens
cctgcatggcatcct

SEQ ID NO: 2423054 - DNA, 12 bp, Homo sapiens
cctgccaccagg

SEQ ID NO: 2423055 - DNA, 13 bp, Homo sapiens
cctgccaccaggc

SEQ ID NO: 2423056 - DNA, 18 bp, Homo sapiens
cctgccacctccccccac

SEQ ID NO: 2423057 - DNA, 21 bp, Homo sapiens
cctgccacctggacccctgca

SEQ ID NO: 2423058 - DNA, 21 bp, Homo sapiens
cctgccactcactaggccccc

SEQ ID NO: 2423059 - DNA, 16 bp, Homo sapiens
cctgccactgtgtgaa

SEQ ID NO: 2423060 - DNA, 21 bp, Homo sapiens
cagccccttagacagaggccc

SEQ ID NO: 2423061 - DNA, 13 bp, Homo sapiens
cagcccctttccc

SEQ ID NO: 2423062 - DNA, 15 bp, Homo sapiens
cagcccgcacacctg

SEQ ID NO: 2423063 - DNA, 17 bp, Homo sapiens
cagccctcacacaccct

SEQ ID NO: 2423064 - DNA, 23 bp, Homo sapiens
cagccctgaggacagatgcctcc

SEQ ID NO: 2423065 - DNA, 15 bp, Homo sapiens
cagccctgcaccatg

SEQ ID NO: 2423066 - DNA, 14 bp, Homo sapiens
cagccctgcctgga

SEQ ID NO: 2423067 - DNA, 16 bp, Homo sapiens
cagccctgcctggagg

SEQ ID NO: 2423068 - DNA, 16 bp, Homo sapiens
cagccctgtcagcatg

SEQ ID NO: 2423069 - DNA, 16 bp, Homo sapiens
cagcccttccaaactc

SEQ ID NO: 2423070 - DNA, 22 bp, Homo sapiens
cagccgaccccctctccctgca

SEQ ID NO: 2423071 - DNA, 14 bp, Homo sapiens
cagccgccggctgt

SEQ ID NO: 2423072 - DNA, 20 bp, Homo sapiens
cagccgctgagcgaggagat

SEQ ID NO: 2423073 - DNA, 17 bp, Homo sapiens
cagccggcacagggtct

SEQ ID NO: 2423074 - DNA, 15 bp, Homo sapiens
cagccggggcgagtg

SEQ ID NO: 2423075 - DNA, 14 bp, Homo sapiens
cagccgtgagcatg

SEQ ID NO: 2423076 - DNA, 17 bp, Homo sapiens
cagccgtgggccccacc

SEQ ID NO: 2423077 - DNA, 21 bp, Homo sapiens
cagcctagggctgagctgggg

SEQ ID NO: 2423078 - DNA, 21 bp, Homo sapiens
cagcctcagagacatcagccc

SEQ ID NO: 2423079 - DNA, 21 bp, Homo sapiens
cagcctcagtgaccctggctc

SEQ ID NO: 2423080 - DNA, 14 bp, Homo sapiens
cagcctcccacccc

SEQ ID NO: 2423081 - DNA, 14 bp, Homo sapiens
cagcctcccatcca

SEQ ID NO: 2423082 - DNA, 18 bp, Homo sapiens
cagcctcccatccagggc

SEQ ID NO: 2423083 - DNA, 19 bp, Homo sapiens
cagcctcccatccagggcc

SEQ ID NO: 2423084 - DNA, 19 bp, Homo sapiens
cagcctcccctgccagggc

SEQ ID NO: 2423085 - DNA, 22 bp, Homo sapiens
cagcctcccctgccagggcagg

SEQ ID NO: 2423086 - DNA, 19 bp, Homo sapiens
cagcctcgcccctggcaga

SEQ ID NO: 2423087 - DNA, 21 bp, Homo sapiens
cagcctcgcccctggcagaga

SEQ ID NO: 2423088 - DNA, 14 bp, Homo sapiens
cagcctctccccag

SEQ ID NO: 2423089 - DNA, 16 bp, Homo sapiens
cagcctctccccaggt

SEQ ID NO: 2423090 - DNA, 19 bp, Homo sapiens
cagcctctccccaggtcca

SEQ ID NO: 2423091 - DNA, 20 bp, Homo sapiens
cagcctctccccaggtccag

SEQ ID NO: 2423092 - DNA, 13 bp, Homo sapiens
cagcctctggcat

SEQ ID NO: 2423093 - DNA, 23 bp, Homo sapiens
cagcctctggggggtggccaggc

SEQ ID NO: 2423094 - DNA, 22 bp, Homo sapiens
cagcctgaaccccagggctgta

SEQ ID NO: 2423095 - DNA, 13 bp, Homo sapiens
cagcctggccaga

SEQ ID NO: 2423096 - DNA, 15 bp, Homo sapiens
cagcctggccagaca

SEQ ID NO: 2423097 - DNA, 20 bp, Homo sapiens
cagcctggccagacacaggc

SEQ ID NO: 2423098 - DNA, 11 bp, Homo sapiens
cagcctggcct

SEQ ID NO: 2423099 - DNA, 13 bp, Homo sapiens
cagcctggcctcc

SEQ ID NO: 2423100 - DNA, 15 bp, Homo sapiens
cagcctggcctcctg

SEQ ID NO: 2423101 - DNA, 16 bp, Homo sapiens
cagcctggcctcctgc

SEQ ID NO: 2423102 - DNA, 21 bp, Homo sapiens
cagcctggcctcctgcctcta

SEQ ID NO: 2423103 - DNA, 20 bp, Homo sapiens
cagcctgggaaagcccctgc

SEQ ID NO: 2423104 - DNA, 21 bp, Homo sapiens
cagcctggggctggcctccca

SEQ ID NO: 2423105 - DNA, 17 bp, Homo sapiens
cagcctgtcagatccag

SEQ ID NO: 2423106 - DNA, 21 bp, Homo sapiens
cagcctgtcagatccaggagc

SEQ ID NO: 2423107 - DNA, 19 bp, Homo sapiens
cagccttagctctcccaac

SEQ ID NO: 2423108 - DNA, 21 bp, Homo sapiens
cagccttagctctcccaactc

SEQ ID NO: 2423109 - DNA, 15 bp, Homo sapiens
cagccttgccagaga

SEQ ID NO: 2423110 - DNA, 16 bp, Homo sapiens
cagccttgccagagat

SEQ ID NO: 2423111 - DNA, 14 bp, Homo sapiens
cagcctttgttccc

SEQ ID NO: 2423112 - DNA, 16 bp, Homo sapiens
cagcctttgttcccca

SEQ ID NO: 2423113 - DNA, 18 bp, Homo sapiens
cagcctttgttccccact

SEQ ID NO: 2423114 - DNA, 16 bp, Homo sapiens
cagcgaccgccccctc

SEQ ID NO: 2423115 - DNA, 18 bp, Homo sapiens
cagcgaccgccccctcct

SEQ ID NO: 2423116 - DNA, 17 bp, Homo sapiens
cagcgactccgttggcc

SEQ ID NO: 2423117 - DNA, 21 bp, Homo sapiens
cagcgactccgttggccactc

SEQ ID NO: 2423118 - DNA, 14 bp, Homo sapiens
cagcgagcctgcta

SEQ ID NO: 2423119 - DNA, 17 bp, Homo sapiens
cagcgaggaggctccag

SEQ ID NO: 2423120 - DNA, 18 bp, Homo sapiens
cagcgaggaggctccaga

SEQ ID NO: 2423121 - DNA, 20 bp, Homo sapiens
cagcgcggaggaggagggag

SEQ ID NO: 2423122 - DNA, 14 bp, Homo sapiens
cagcggccctgtca

SEQ ID NO: 2423123 - DNA, 19 bp, Homo sapiens
cagcggtgggacctaggga

SEQ ID NO: 2423124 - DNA, 16 bp, Homo sapiens
cagcgtcctcctctgt

SEQ ID NO: 2423125 - DNA, 19 bp, Homo sapiens
cagcgtgctttaaaaaata

SEQ ID NO: 2423126 - DNA, 12 bp, Homo sapiens
cagcgtggcctt

SEQ ID NO: 2423127 - DNA, 13 bp, Homo sapiens
cagcgtggccttg

SEQ ID NO: 2423128 - DNA, 15 bp, Homo sapiens
cagcgtggccttgtt

SEQ ID NO: 2423129 - DNA, 19 bp, Homo sapiens
cagctaaagcaatatgcat

SEQ ID NO: 2423130 - DNA, 14 bp, Homo sapiens
cagctaagaacctg

SEQ ID NO: 2423131 - DNA, 18 bp, Homo sapiens
cagctaagaacctggaac

SEQ ID NO: 2423132 - DNA, 19 bp, Homo sapiens
cagctaagaacctggaact

SEQ ID NO: 2423133 - DNA, 23 bp, Homo sapiens
cagctaagaacctggaacttggg

SEQ ID NO: 2423134 - DNA, 14 bp, Homo sapiens
cagctaagctcacg

SEQ ID NO: 2423135 - DNA, 21 bp, Homo sapiens
cagctaaggggtggggctgcg

SEQ ID NO: 2423136 - DNA, 23 bp, Homo sapiens
cagctactctccccacgagggct

SEQ ID NO: 2423137 - DNA, 21 bp, Homo sapiens
cagctaggaagagcaggactc

SEQ ID NO: 2423138 - DNA, 13 bp, Homo sapiens
cagctagtgaccc

SEQ ID NO: 2423139 - DNA, 20 bp, Homo sapiens
cagctatgttatattgaaaa

SEQ ID NO: 2423140 - DNA, 15 bp, Homo sapiens
cagctattttgtgaa

SEQ ID NO: 2423141 - DNA, 12 bp, Homo sapiens
cagctcagcact

SEQ ID NO: 2423142 - DNA, 12 bp, Homo sapiens
cagctcaggaca

SEQ ID NO: 2423143 - DNA, 20 bp, Homo sapiens
cagctccaacctgcaaagat

SEQ ID NO: 2423144 - DNA, 23 bp, Homo sapiens
cagctccaacctgcaaagatctg

SEQ ID NO: 2423145 - DNA, 15 bp, Homo sapiens
cagctccaccctggc

SEQ ID NO: 2423146 - DNA, 12 bp, Homo sapiens
cagctcccacaa

SEQ ID NO: 2423147 - DNA, 17 bp, Homo sapiens
cagctcccacaagcctc

SEQ ID NO: 2423148 - DNA, 21 bp, Homo sapiens
cagctcccacctccccttggg

SEQ ID NO: 2423149 - DNA, 15 bp, Homo sapiens
cagctccccctccct

SEQ ID NO: 2423150 - DNA, 16 bp, Homo sapiens
cagctccccctccctc

SEQ ID NO: 2423151 - DNA, 18 bp, Homo sapiens
cagctccctgtgccccca

SEQ ID NO: 2423152 - DNA, 20 bp, Homo sapiens
cagctccctgtgcccccagg

SEQ ID NO: 2423153 - DNA, 21 bp, Homo sapiens
cagctccggcctgtcctccaa

SEQ ID NO: 2423154 - DNA, 18 bp, Homo sapiens
cagctcctctgtctcgag

SEQ ID NO: 2423155 - DNA, 21 bp, Homo sapiens
cagctctggacagccccaccc

SEQ ID NO: 2423156 - DNA, 11 bp, Homo sapiens
cagctctggag

SEQ ID NO: 2423157 - DNA, 22 bp, Homo sapiens
cagctctgggccattctccaca

SEQ ID NO: 2423158 - DNA, 23 bp, Homo sapiens
cagctctgggccattctccacag

SEQ ID NO: 2423159 - DNA, 13 bp, Homo sapiens
cagctgactaaac

SEQ ID NO: 2423160 - DNA, 18 bp, Homo sapiens
cagctgactaaacttttt

SEQ ID NO: 2423161 - DNA, 13 bp, Homo sapiens
cagctgagcaggg

SEQ ID NO: 2423162 - DNA, 14 bp, Homo sapiens
cagctgagcgccag

SEQ ID NO: 2423163 - DNA, 16 bp, Homo sapiens
cagctgagcgccagga

SEQ ID NO: 2423164 - DNA, 22 bp, Homo sapiens
cagctgcaaggtactctggtga

SEQ ID NO: 2423165 - DNA, 20 bp, Homo sapiens
cctcagtgaccctggctcct

SEQ ID NO: 2423166 - DNA, 21 bp, Homo sapiens
cctcagtgaccctggctcctt

SEQ ID NO: 2423167 - DNA, 16 bp, Homo sapiens
cctcatcaaggacacg

SEQ ID NO: 2423168 - DNA, 22 bp, Homo sapiens
cctcatccaccccatccctccc

SEQ ID NO: 2423169 - DNA, 20 bp, Homo sapiens
cctcatcccgagcacctcca

SEQ ID NO: 2423170 - DNA, 19 bp, Homo sapiens
cctcatctctctgcccaac

SEQ ID NO: 2423171 - DNA, 17 bp, Homo sapiens
cctcatctgtccctccg

SEQ ID NO: 2423172 - DNA, 18 bp, Homo sapiens
cctcatcttcttcaccat

SEQ ID NO: 2423173 - DNA, 15 bp, Homo sapiens
cctcatgaatgtaaa

SEQ ID NO: 2423174 - DNA, 16 bp, Homo sapiens
cctcatgaatgtaaat

SEQ ID NO: 2423175 - DNA, 18 bp, Homo sapiens
cctcatgctggagggagg

SEQ ID NO: 2423176 - DNA, 15 bp, Homo sapiens
cctcatggcccctct

SEQ ID NO: 2423177 - DNA, 18 bp, Homo sapiens
cctcatggcccctctgac

SEQ ID NO: 2423178 - DNA, 16 bp, Homo sapiens
cctcatgtggctggaa

SEQ ID NO: 2423179 - DNA, 13 bp, Homo sapiens
cctcatttaaaag

SEQ ID NO: 2423180 - DNA, 20 bp, Homo sapiens
cctccaaccaaataagactt

SEQ ID NO: 2423181 - DNA, 21 bp, Homo sapiens
cctccaaccaaataagacttc

SEQ ID NO: 2423182 - DNA, 21 bp, Homo sapiens
cctccaagtggtccacaagct

SEQ ID NO: 2423183 - DNA, 13 bp, Homo sapiens
cctccacacctgc

SEQ ID NO: 2423184 - DNA, 14 bp, Homo sapiens
cctccacacctgcg

SEQ ID NO: 2423185 - DNA, 20 bp, Homo sapiens
cctccacatcctccacgttc

SEQ ID NO: 2423186 - DNA, 17 bp, Homo sapiens
cctccacgttctgctca

SEQ ID NO: 2423187 - DNA, 18 bp, Homo sapiens
cctccacgttctgctcat

SEQ ID NO: 2423188 - DNA, 21 bp, Homo sapiens
cctccagctccctgtgccccc

SEQ ID NO: 2423189 - DNA, 11 bp, Homo sapiens
cctccagctgt

SEQ ID NO: 2423190 - DNA, 17 bp, Homo sapiens
cctccagctttcctgta

SEQ ID NO: 2423191 - DNA, 14 bp, Homo sapiens
cctccatccctggc

SEQ ID NO: 2423192 - DNA, 16 bp, Homo sapiens
cctccatccctggccc

SEQ ID NO: 2423193 - DNA, 11 bp, Homo sapiens
cctccatggga

SEQ ID NO: 2423194 - DNA, 12 bp, Homo sapiens
cctccatgggcc

SEQ ID NO: 2423195 - DNA, 18 bp, Homo sapiens
cctccatgggccccaggg

SEQ ID NO: 2423196 - DNA, 18 bp, Homo sapiens
cctcccaaagtgctgaga

SEQ ID NO: 2423197 - DNA, 19 bp, Homo sapiens
cctcccagaaagcaaacct

SEQ ID NO: 2423198 - DNA, 21 bp, Homo sapiens
cctcccagagcacctgctgtc

SEQ ID NO: 2423199 - DNA, 21 bp, Homo sapiens
cctcccagaggagccaccagt

SEQ ID NO: 2423200 - DNA, 12 bp, Homo sapiens
cctcccagggtt

SEQ ID NO: 2423201 - DNA, 21 bp, Homo sapiens
cctcccagggttttaactttg

SEQ ID NO: 2423202 - DNA, 15 bp, Homo sapiens
cctcccatccagggc

SEQ ID NO: 2423203 - DNA, 19 bp, Homo sapiens
cctcccccccatgcactgt

SEQ ID NO: 2423204 - DNA, 12 bp, Homo sapiens
cctccccctgag

SEQ ID NO: 2423205 - DNA, 12 bp, Homo sapiens
cctcccctccag

SEQ ID NO: 2423206 - DNA, 13 bp, Homo sapiens
cctcccctgccac

SEQ ID NO: 2423207 - DNA, 14 bp, Homo sapiens
cctcccctgccatt

SEQ ID NO: 2423208 - DNA, 14 bp, Homo sapiens
cctcccctggaggg

SEQ ID NO: 2423209 - DNA, 18 bp, Homo sapiens
cctccccttaaaggggag

SEQ ID NO: 2423210 - DNA, 13 bp, Homo sapiens
cctccccttgcct

SEQ ID NO: 2423211 - DNA, 24 bp, Homo sapiens
cctccccttgggcccacacctcct

SEQ ID NO: 2423212 - DNA, 15 bp, Homo sapiens
cctccctccccttgc

SEQ ID NO: 2423213 - DNA, 18 bp, Homo sapiens
cctccctgttccccagag

SEQ ID NO: 2423214 - DNA, 14 bp, Homo sapiens
cctccgccctgcca

SEQ ID NO: 2423215 - DNA, 15 bp, Homo sapiens
cctccgccctgccac

SEQ ID NO: 2423216 - DNA, 16 bp, Homo sapiens
cctccgccctgccact

SEQ ID NO: 2423217 - DNA, 18 bp, Homo sapiens
cctccgccctgccactca

SEQ ID NO: 2423218 - DNA, 15 bp, Homo sapiens
cctccgtcccctgcc

SEQ ID NO: 2423219 - DNA, 12 bp, Homo sapiens
cctcctcagcct

SEQ ID NO: 2423220 - DNA, 17 bp, Homo sapiens
cctcctcaggcacacag

SEQ ID NO: 2423221 - DNA, 23 bp, Homo sapiens
cctcctcatcccgtgttctcctt

SEQ ID NO: 2423222 - DNA, 12 bp, Homo sapiens
cctcctccaggg

SEQ ID NO: 2423223 - DNA, 15 bp, Homo sapiens
cctcctccagggaca

SEQ ID NO: 2423224 - DNA, 21 bp, Homo sapiens
cctcctctgcactcccacctg

SEQ ID NO: 2423225 - DNA, 22 bp, Homo sapiens
cctcctgacacccttctcccac

SEQ ID NO: 2423226 - DNA, 18 bp, Homo sapiens
cctcctgcctctactggg

SEQ ID NO: 2423227 - DNA, 21 bp, Homo sapiens
cctcctgggccctctctgctc

SEQ ID NO: 2423228 - DNA, 15 bp, Homo sapiens
cctcctgtgctcagc

SEQ ID NO: 2423229 - DNA, 18 bp, Homo sapiens
cctcctgtgctcagccct

SEQ ID NO: 2423230 - DNA, 19 bp, Homo sapiens
cctcctgtgctcagccctg

SEQ ID NO: 2423231 - DNA, 20 bp, Homo sapiens
cctccttccctctctggaga

SEQ ID NO: 2423232 - DNA, 17 bp, Homo sapiens
cctccttctcccttttt

SEQ ID NO: 2423233 - DNA, 21 bp, Homo sapiens
cctccttctgagctcctgtcc

SEQ ID NO: 2423234 - DNA, 22 bp, Homo sapiens
cctccttctgagctcctgtccc

SEQ ID NO: 2423235 - DNA, 18 bp, Homo sapiens
cctcgctccccactctgc

SEQ ID NO: 2423236 - DNA, 19 bp, Homo sapiens
cctcgctccccactctgct

SEQ ID NO: 2423237 - DNA, 22 bp, Homo sapiens
cctcggcctcccaaagtgctgg

SEQ ID NO: 2423238 - DNA, 18 bp, Homo sapiens
cctcgtactcaggagccc

SEQ ID NO: 2423239 - DNA, 19 bp, Homo sapiens
cctctaaggttgggcaggg

SEQ ID NO: 2423240 - DNA, 18 bp, Homo sapiens
cctctacagagcttccct

SEQ ID NO: 2423241 - DNA, 20 bp, Homo sapiens
cctctacagagcttccctga

SEQ ID NO: 2423242 - DNA, 11 bp, Homo sapiens
cctctacaggg

SEQ ID NO: 2423243 - DNA, 14 bp, Homo sapiens
cctctactgggaag

SEQ ID NO: 2423244 - DNA, 22 bp, Homo sapiens
cctctagagaaataagatcttt

SEQ ID NO: 2423245 - DNA, 13 bp, Homo sapiens
cctctcagccctc

SEQ ID NO: 2423246 - DNA, 14 bp, Homo sapiens
cctctcagccctca

SEQ ID NO: 2423247 - DNA, 13 bp, Homo sapiens
cctctcagctcca

SEQ ID NO: 2423248 - DNA, 18 bp, Homo sapiens
cctctcaggatccaagct

SEQ ID NO: 2423249 - DNA, 19 bp, Homo sapiens
cctctcatttagcctgtcc

SEQ ID NO: 2423250 - DNA, 20 bp, Homo sapiens
cctctcatttagcctgtcct

SEQ ID NO: 2423251 - DNA, 18 bp, Homo sapiens
cctctccacacagtgctc

SEQ ID NO: 2423252 - DNA, 14 bp, Homo sapiens
cctctcccaccctc

SEQ ID NO: 2423253 - DNA, 13 bp, Homo sapiens
cctctcccaggcc

SEQ ID NO: 2423254 - DNA, 18 bp, Homo sapiens
cctctcccaggccccatg

SEQ ID NO: 2423255 - DNA, 23 bp, Homo sapiens
cctctcccaggccccatgacctc

SEQ ID NO: 2423256 - DNA, 12 bp, Homo sapiens
cctctcccagtt

SEQ ID NO: 2423257 - DNA, 19 bp, Homo sapiens
cctctccccagcccagaga

SEQ ID NO: 2423258 - DNA, 12 bp, Homo sapiens
cctctcccctca

SEQ ID NO: 2423259 - DNA, 16 bp, Homo sapiens
cctctcccctcagcct

SEQ ID NO: 2423260 - DNA, 18 bp, Homo sapiens
cctctcccctcagcctct

SEQ ID NO: 2423261 - DNA, 16 bp, Homo sapiens
cctctcccctgccccc

SEQ ID NO: 2423262 - DNA, 23 bp, Homo sapiens
cctctcccctgccccctgcagga

SEQ ID NO: 2423263 - DNA, 15 bp, Homo sapiens
cctctcccctgcctg

SEQ ID NO: 2423264 - DNA, 18 bp, Homo sapiens
cctctcccctgcctgccc

SEQ ID NO: 2423265 - DNA, 10 bp, Homo sapiens
cctctccctg

SEQ ID NO: 2423266 - DNA, 13 bp, Homo sapiens
cctctccctgttg

SEQ ID NO: 2423267 - DNA, 19 bp, Homo sapiens
cctctcccttgggctctga

SEQ ID NO: 2423268 - DNA, 23 bp, Homo sapiens
cctctccttcatgacagcctcca

SEQ ID NO: 2423269 - DNA, 13 bp, Homo sapiens
cctctccttcctg

SEQ ID NO: 2423270 - DNA, 21 bp, Homo sapiens
cacagcagttctgcagaggac

SEQ ID NO: 2423271 - DNA, 22 bp, Homo sapiens
cacagccaacacgcacctgcct

SEQ ID NO: 2423272 - DNA, 15 bp, Homo sapiens
cacagccagcacctg

SEQ ID NO: 2423273 - DNA, 20 bp, Homo sapiens
cacagccagcacctggcatc

SEQ ID NO: 2423274 - DNA, 19 bp, Homo sapiens
cacagccaggggagcagag

SEQ ID NO: 2423275 - DNA, 14 bp, Homo sapiens
cacagcccagcccg

SEQ ID NO: 2423276 - DNA, 14 bp, Homo sapiens
cacagccctgtcag

SEQ ID NO: 2423277 - DNA, 16 bp, Homo sapiens
cacagccctgtcagca

SEQ ID NO: 2423278 - DNA, 18 bp, Homo sapiens
cacagccctgtcagcatg

SEQ ID NO: 2423279 - DNA, 23 bp, Homo sapiens
cacagcccttatgcggttaattt

SEQ ID NO: 2423280 - DNA, 20 bp, Homo sapiens
cacagcggaggtgtggagcc

SEQ ID NO: 2423281 - DNA, 10 bp, Homo sapiens
cacagctcct

SEQ ID NO: 2423282 - DNA, 15 bp, Homo sapiens
cacagcttagatttc

SEQ ID NO: 2423283 - DNA, 13 bp, Homo sapiens
cacagcttgtctc

SEQ ID NO: 2423284 - DNA, 12 bp, Homo sapiens
cacagcttttgc

SEQ ID NO: 2423285 - DNA, 14 bp, Homo sapiens
cacagcttttgcaa

SEQ ID NO: 2423286 - DNA, 22 bp, Homo sapiens
cacaggagtgtcctcttccctc

SEQ ID NO: 2423287 - DNA, 15 bp, Homo sapiens
cacaggcagccagtg

SEQ ID NO: 2423288 - DNA, 16 bp, Homo sapiens
cacaggcagccagtgc

SEQ ID NO: 2423289 - DNA, 17 bp, Homo sapiens
cacaggcagccagtgcc

SEQ ID NO: 2423290 - DNA, 20 bp, Homo sapiens
cacaggcatttcctgggtgg

SEQ ID NO: 2423291 - DNA, 13 bp, Homo sapiens
cacaggccccctt

SEQ ID NO: 2423292 - DNA, 13 bp, Homo sapiens
cacaggctcaggc

SEQ ID NO: 2423293 - DNA, 18 bp, Homo sapiens
cacaggcttctgagcagc

SEQ ID NO: 2423294 - DNA, 11 bp, Homo sapiens
cacagggcagt

SEQ ID NO: 2423295 - DNA, 21 bp, Homo sapiens
cacagggcagtacctgagggt

SEQ ID NO: 2423296 - DNA, 21 bp, Homo sapiens
cacagggtccccgagtgccta

SEQ ID NO: 2423297 - DNA, 23 bp, Homo sapiens
cacagggtctgctctttctctgc

SEQ ID NO: 2423298 - DNA, 14 bp, Homo sapiens
cacaggtcccaaat

SEQ ID NO: 2423299 - DNA, 21 bp, Homo sapiens
cacaggtcccaaatggccctg

SEQ ID NO: 2423300 - DNA, 19 bp, Homo sapiens
cacaggtgcaacagacttg

SEQ ID NO: 2423301 - DNA, 19 bp, Homo sapiens
cacagtattgctcacccag

SEQ ID NO: 2423302 - DNA, 14 bp, Homo sapiens
cacagtatttgtaa

SEQ ID NO: 2423303 - DNA, 17 bp, Homo sapiens
cacagtgtcaggcactg

SEQ ID NO: 2423304 - DNA, 19 bp, Homo sapiens
cacataccctcttcatgga

SEQ ID NO: 2423305 - DNA, 22 bp, Homo sapiens
cacataccctcttcatggatgg

SEQ ID NO: 2423306 - DNA, 18 bp, Homo sapiens
cacataccctgacctggc

SEQ ID NO: 2423307 - DNA, 17 bp, Homo sapiens
cacatagcccacttaca

SEQ ID NO: 2423308 - DNA, 21 bp, Homo sapiens
cacatagcccacttacattta

SEQ ID NO: 2423309 - DNA, 14 bp, Homo sapiens
cacatattttaaaa

SEQ ID NO: 2423310 - DNA, 13 bp, Homo sapiens
cacatcaaagagg

SEQ ID NO: 2423311 - DNA, 12 bp, Homo sapiens
cacatccctggg

SEQ ID NO: 2423312 - DNA, 15 bp, Homo sapiens
cacatccctgggcct

SEQ ID NO: 2423313 - DNA, 17 bp, Homo sapiens
cacatccctgggcctgc

SEQ ID NO: 2423314 - DNA, 21 bp, Homo sapiens
cacatccctgggcctgctgct

SEQ ID NO: 2423315 - DNA, 22 bp, Homo sapiens
cacatccctgggcctgctgctg

SEQ ID NO: 2423316 - DNA, 12 bp, Homo sapiens
cacatctgtgtc

SEQ ID NO: 2423317 - DNA, 18 bp, Homo sapiens
cacatctgtgtcttgttt

SEQ ID NO: 2423318 - DNA, 18 bp, Homo sapiens
cacatgaattattacagt

SEQ ID NO: 2423319 - DNA, 20 bp, Homo sapiens
cacatgactcgggggtgggg

SEQ ID NO: 2423320 - DNA, 21 bp, Homo sapiens
cacatgccccatcccatgctg

SEQ ID NO: 2423321 - DNA, 20 bp, Homo sapiens
cacatgtcagtaccttcaaa

SEQ ID NO: 2423322 - DNA, 14 bp, Homo sapiens
cacatgtgctgccc

SEQ ID NO: 2423323 - DNA, 15 bp, Homo sapiens
cacatgttttctctg

SEQ ID NO: 2423324 - DNA, 21 bp, Homo sapiens
cacattagaagacaattgaca

SEQ ID NO: 2423325 - DNA, 22 bp, Homo sapiens
cacattcaaaatagggtatatt

SEQ ID NO: 2423326 - DNA, 23 bp, Homo sapiens
cacattcagggctattttttccc

SEQ ID NO: 2423327 - DNA, 20 bp, Homo sapiens
cacattgctgtgaacaggaa

SEQ ID NO: 2423328 - DNA, 13 bp, Homo sapiens
cacatttctaaaa

SEQ ID NO: 2423329 - DNA, 16 bp, Homo sapiens
cacatttggaatactt

SEQ ID NO: 2423330 - DNA, 20 bp, Homo sapiens
tgggcttgtggggcctggga

SEQ ID NO: 2423331 - DNA, 21 bp, Homo sapiens
tggggaaaggggtcggctgac

SEQ ID NO: 2423332 - DNA, 13 bp, Homo sapiens
tggggaagacagt

SEQ ID NO: 2423333 - DNA, 14 bp, Homo sapiens
tggggaagacagtg

SEQ ID NO: 2423334 - DNA, 18 bp, Homo sapiens
tggggaagacagtggccc

SEQ ID NO: 2423335 - DNA, 14 bp, Homo sapiens
tggggacttggcct

SEQ ID NO: 2423336 - DNA, 23 bp, Homo sapiens
tggggagacataaccactgcttc

SEQ ID NO: 2423337 - DNA, 21 bp, Homo sapiens
tggggagcccgtctcagtgtt

SEQ ID NO: 2423338 - DNA, 16 bp, Homo sapiens
tggggagttaagacct

SEQ ID NO: 2423339 - DNA, 18 bp, Homo sapiens
tggggagttaagacctgg

SEQ ID NO: 2423340 - DNA, 12 bp, Homo sapiens
tggggcaggagt

SEQ ID NO: 2423341 - DNA, 13 bp, Homo sapiens
tggggcaggagta

SEQ ID NO: 2423342 - DNA, 18 bp, Homo sapiens
tggggcaggagtagctga

SEQ ID NO: 2423343 - DNA, 17 bp, Homo sapiens
tggggcaggctgggcca

SEQ ID NO: 2423344 - DNA, 18 bp, Homo sapiens
tggggcaggctgggccat

SEQ ID NO: 2423345 - DNA, 16 bp, Homo sapiens
tggggccagatccagc

SEQ ID NO: 2423346 - DNA, 21 bp, Homo sapiens
tggggccagatccagcctggg

SEQ ID NO: 2423347 - DNA, 17 bp, Homo sapiens
tggggcccaggcccgga

SEQ ID NO: 2423348 - DNA, 14 bp, Homo sapiens
tggggcctgggaca

SEQ ID NO: 2423349 - DNA, 13 bp, Homo sapiens
tggggcctgggag

SEQ ID NO: 2423350 - DNA, 11 bp, Homo sapiens
tggggcctgta

SEQ ID NO: 2423351 - DNA, 20 bp, Homo sapiens
tggggcctgtactgcctgct

SEQ ID NO: 2423352 - DNA, 17 bp, Homo sapiens
tggggctcagagccggg

SEQ ID NO: 2423353 - DNA, 18 bp, Homo sapiens
tggggctctaacgcctga

SEQ ID NO: 2423354 - DNA, 19 bp, Homo sapiens
tggggctctaacgcctgag

SEQ ID NO: 2423355 - DNA, 22 bp, Homo sapiens
tggggctctaacgcctgagccc

SEQ ID NO: 2423356 - DNA, 23 bp, Homo sapiens
tggggctctaacgcctgagccca

SEQ ID NO: 2423357 - DNA, 15 bp, Homo sapiens
tgggggaaagcaaag

SEQ ID NO: 2423358 - DNA, 17 bp, Homo sapiens
tgggggaaagcaaagca

SEQ ID NO: 2423359 - DNA, 21 bp, Homo sapiens
tgggggaaagcaaagcacaga

SEQ ID NO: 2423360 - DNA, 18 bp, Homo sapiens
tgggggaactcagatcca

SEQ ID NO: 2423361 - DNA, 16 bp, Homo sapiens
tgggggactgtaagtt

SEQ ID NO: 2423362 - DNA, 18 bp, Homo sapiens
tgggggcagcacaggagg

SEQ ID NO: 2423363 - DNA, 13 bp, Homo sapiens
tgggggcctggct

SEQ ID NO: 2423364 - DNA, 15 bp, Homo sapiens
tgggggcctggctgg

SEQ ID NO: 2423365 - DNA, 17 bp, Homo sapiens
tgggggcctggctggct

SEQ ID NO: 2423366 - DNA, 20 bp, Homo sapiens
tgggggcctggctggctgag

SEQ ID NO: 2423367 - DNA, 23 bp, Homo sapiens
tgggggggtggccgctgagtggc

SEQ ID NO: 2423368 - DNA, 10 bp, Homo sapiens
tgggggtggg

SEQ ID NO: 2423369 - DNA, 14 bp, Homo sapiens
tggggtcccagcag

SEQ ID NO: 2423370 - DNA, 15 bp, Homo sapiens
tggggtcccagcagc

SEQ ID NO: 2423371 - DNA, 14 bp, Homo sapiens
tggggtctggcagc

SEQ ID NO: 2423372 - DNA, 18 bp, Homo sapiens
tggggtctggcagcctcc

SEQ ID NO: 2423373 - DNA, 23 bp, Homo sapiens
tggggtgacccggcaccccctgc

SEQ ID NO: 2423374 - DNA, 12 bp, Homo sapiens
tggggtggctgc

SEQ ID NO: 2423375 - DNA, 13 bp, Homo sapiens
tggggtggctgca

SEQ ID NO: 2423376 - DNA, 19 bp, Homo sapiens
tggggtggctgcagcctca

SEQ ID NO: 2423377 - DNA, 20 bp, Homo sapiens
tggggtggctgcagcctcag

SEQ ID NO: 2423378 - DNA, 13 bp, Homo sapiens
tggggtgtgctgg

SEQ ID NO: 2423379 - DNA, 15 bp, Homo sapiens
tgggtaaaatacttt

SEQ ID NO: 2423380 - DNA, 19 bp, Homo sapiens
tgggtacttcttgaaggtg

SEQ ID NO: 2423381 - DNA, 18 bp, Homo sapiens
tgggtagggtaaatcagt

SEQ ID NO: 2423382 - DNA, 13 bp, Homo sapiens
tgggtcaggcagg

SEQ ID NO: 2423383 - DNA, 17 bp, Homo sapiens
tgggtccatgggcagag

SEQ ID NO: 2423384 - DNA, 20 bp, Homo sapiens
tgggtctcgctttgttgccc

SEQ ID NO: 2423385 - DNA, 19 bp, Homo sapiens
tgggtggctactctgtgcc

SEQ ID NO: 2423386 - DNA, 23 bp, Homo sapiens
tgggtggctactctgtgccagag

SEQ ID NO: 2423387 - DNA, 14 bp, Homo sapiens
tgggtggctcactc

SEQ ID NO: 2423388 - DNA, 14 bp, Homo sapiens
tgggtggtaccctc

SEQ ID NO: 2423389 - DNA, 22 bp, Homo sapiens
tgggtgttatcacctagctgaa

SEQ ID NO: 2423390 - DNA, 16 bp, Homo sapiens
tgggttctgcctgcca

SEQ ID NO: 2423391 - DNA, 16 bp, Homo sapiens
tgggttgcagacagga

SEQ ID NO: 2423392 - DNA, 19 bp, Homo sapiens
tgggttttgtattctctga

SEQ ID NO: 2423393 - DNA, 17 bp, Homo sapiens
tggtaaagactggcttt

SEQ ID NO: 2423394 - DNA, 14 bp, Homo sapiens
tggtaacttttgtg

SEQ ID NO: 2423395 - DNA, 24 bp, Homo sapiens
tggtaacttttgtgaattaggctg

SEQ ID NO: 2423396 - DNA, 19 bp, Homo sapiens
tggtaagcaacatggcttt

SEQ ID NO: 2423397 - DNA, 20 bp, Homo sapiens
tggtaagcaacatggctttg

SEQ ID NO: 2423398 - DNA, 14 bp, Homo sapiens
tggtaatattgact

SEQ ID NO: 2423399 - DNA, 14 bp, Homo sapiens
tggtaattgtacta

SEQ ID NO: 2423400 - DNA, 11 bp, Homo sapiens
tggtacagaga

SEQ ID NO: 2423401 - DNA, 12 bp, Homo sapiens
tggtacagagaa

SEQ ID NO: 2423402 - DNA, 13 bp, Homo sapiens
tggtacagagaag

SEQ ID NO: 2423403 - DNA, 14 bp, Homo sapiens
tggtacagagaagc

SEQ ID NO: 2423404 - DNA, 17 bp, Homo sapiens
tggtacagagaagccag

SEQ ID NO: 2423405 - DNA, 18 bp, Homo sapiens
tggtaccagataactttt

SEQ ID NO: 2423406 - DNA, 15 bp, Homo sapiens
tggtaccctcctggc

SEQ ID NO: 2423407 - DNA, 17 bp, Homo sapiens
tggtactgactttgctt

SEQ ID NO: 2423408 - DNA, 18 bp, Homo sapiens
tggtaggaatagcatgtc

SEQ ID NO: 2423409 - DNA, 16 bp, Homo sapiens
tggtaggaccaagcat

SEQ ID NO: 2423410 - DNA, 22 bp, Homo sapiens
tggtaggaccaagcatcttggg

SEQ ID NO: 2423411 - DNA, 16 bp, Homo sapiens
tggtaggcatttccta

SEQ ID NO: 2423412 - DNA, 18 bp, Homo sapiens
tggtagttttttcatctt

SEQ ID NO: 2423413 - DNA, 16 bp, Homo sapiens
tggtatctcagaaagt

SEQ ID NO: 2423414 - DNA, 14 bp, Homo sapiens
tggtcacacactga

SEQ ID NO: 2423415 - DNA, 13 bp, Homo sapiens
tggtcacagctgt

SEQ ID NO: 2423416 - DNA, 14 bp, Homo sapiens
tggtcacagctgta

SEQ ID NO: 2423417 - DNA, 21 bp, Homo sapiens
tggtcacctaggaagcctcag

SEQ ID NO: 2423418 - DNA, 22 bp, Homo sapiens
tggtcagccctagggtggagag

SEQ ID NO: 2423419 - DNA, 15 bp, Homo sapiens
tggtccaagattccg

SEQ ID NO: 2423420 - DNA, 23 bp, Homo sapiens
tggtccaattagtttccttttta

SEQ ID NO: 2423421 - DNA, 21 bp, Homo sapiens
tggtccagggctagtgacttg

SEQ ID NO: 2423422 - DNA, 15 bp, Homo sapiens
tggtcccacatccct

SEQ ID NO: 2423423 - DNA, 21 bp, Homo sapiens
tggtcccacatccctgggcct

SEQ ID NO: 2423424 - DNA, 22 bp, Homo sapiens
tggtcccacatccctgggcctg

SEQ ID NO: 2423425 - DNA, 20 bp, Homo sapiens
tggtccgtgggacggtgccc

SEQ ID NO: 2423426 - DNA, 23 bp, Homo sapiens
tggtcgagaaagaggcaccagga

SEQ ID NO: 2423427 - DNA, 16 bp, Homo sapiens
tggtcgaggagtaaca

SEQ ID NO: 2423428 - DNA, 20 bp, Homo sapiens
tggtcgaggagtaacaatac

SEQ ID NO: 2423429 - DNA, 18 bp, Homo sapiens
tggtctaagtccagtcca

SEQ ID NO: 2423430 - DNA, 23 bp, Homo sapiens
tggtctcaaactcctgacctcag

SEQ ID NO: 2423431 - DNA, 16 bp, Homo sapiens
tggtgcaagttgagga

SEQ ID NO: 2423432 - DNA, 18 bp, Homo sapiens
tggtgccccaggaccagc

SEQ ID NO: 2423433 - DNA, 23 bp, Homo sapiens
tggtgccccaggaccagctcagg

SEQ ID NO: 2423434 - DNA, 16 bp, Homo sapiens
tggtgcggctggccat

SEQ ID NO: 2423435 - DNA, 14 bp, Homo sapiens
aagcgattctcctg

SEQ ID NO: 2423436 - DNA, 21 bp, Homo sapiens
aagctaaatcctttactgtta

SEQ ID NO: 2423437 - DNA, 15 bp, Homo sapiens
aagctaatttgcatt

SEQ ID NO: 2423438 - DNA, 19 bp, Homo sapiens
aagctactgtgtgtgtgaa

SEQ ID NO: 2423439 - DNA, 19 bp, Homo sapiens
aagctagaattgagtgttt

SEQ ID NO: 2423440 - DNA, 16 bp, Homo sapiens
aagctagacacatgaa

SEQ ID NO: 2423441 - DNA, 20 bp, Homo sapiens
aagctagacacatgaaggta

SEQ ID NO: 2423442 - DNA, 16 bp, Homo sapiens
aagctagtcttttgct

SEQ ID NO: 2423443 - DNA, 13 bp, Homo sapiens
aagctatttaaag

SEQ ID NO: 2423444 - DNA, 18 bp, Homo sapiens
aagctatttgatgtaata

SEQ ID NO: 2423445 - DNA, 13 bp, Homo sapiens
aagctatttttct

SEQ ID NO: 2423446 - DNA, 20 bp, Homo sapiens
aagctcaaaggtttggaagg

SEQ ID NO: 2423447 - DNA, 21 bp, Homo sapiens
aagctcaaaggtttggaagga

SEQ ID NO: 2423448 - DNA, 23 bp, Homo sapiens
aagctcagaggcgcactgtgacc

SEQ ID NO: 2423449 - DNA, 16 bp, Homo sapiens
aagctcctctccccag

SEQ ID NO: 2423450 - DNA, 19 bp, Homo sapiens
aagctcctctccccagccc

SEQ ID NO: 2423451 - DNA, 23 bp, Homo sapiens
aagctcctctccccagcccagag

SEQ ID NO: 2423452 - DNA, 23 bp, Homo sapiens
aagctcgatgtggtcacagctgt

SEQ ID NO: 2423453 - DNA, 9 bp, Homo sapiens
aagctctga

SEQ ID NO: 2423454 - DNA, 15 bp, Homo sapiens
aagctctgagctgtc

SEQ ID NO: 2423455 - DNA, 13 bp, Homo sapiens
aagctctgaggga

SEQ ID NO: 2423456 - DNA, 14 bp, Homo sapiens
aagctctgctatta

SEQ ID NO: 2423457 - DNA, 15 bp, Homo sapiens
aagctgacttggctg

SEQ ID NO: 2423458 - DNA, 20 bp, Homo sapiens
aagctgacttggctggtgtg

SEQ ID NO: 2423459 - DNA, 21 bp, Homo sapiens
aagcttaatggctgataattt

SEQ ID NO: 2423460 - DNA, 15 bp, Homo sapiens
aagcttccatgattc

SEQ ID NO: 2423461 - DNA, 20 bp, Homo sapiens
aagcttccatgattctattt

SEQ ID NO: 2423462 - DNA, 16 bp, Homo sapiens
aagctttcctgcccca

SEQ ID NO: 2423463 - DNA, 18 bp, Homo sapiens
aagctttcctgccccagg

SEQ ID NO: 2423464 - DNA, 17 bp, Homo sapiens
aagcttttctattttaa

SEQ ID NO: 2423465 - DNA, 19 bp, Homo sapiens
aagcttttgtctacacacc

SEQ ID NO: 2423466 - DNA, 20 bp, Homo sapiens
aaggaaacaaccatgtcatt

SEQ ID NO: 2423467 - DNA, 16 bp, Homo sapiens
aaggaaatctcacccc

SEQ ID NO: 2423468 - DNA, 22 bp, Homo sapiens
aaggaagcattgtaaaataatt

SEQ ID NO: 2423469 - DNA, 12 bp, Homo sapiens
aaggaaggtgga

SEQ ID NO: 2423470 - DNA, 17 bp, Homo sapiens
aaggaaggtggatggcc

SEQ ID NO: 2423471 - DNA, 21 bp, Homo sapiens
aaggaagtcaaagcaaggaaa

SEQ ID NO: 2423472 - DNA, 20 bp, Homo sapiens
aaggaatttcttaacttctt

SEQ ID NO: 2423473 - DNA, 14 bp, Homo sapiens
aaggaccctgtgag

SEQ ID NO: 2423474 - DNA, 19 bp, Homo sapiens
aaggacctgaaattccaaa

SEQ ID NO: 2423475 - DNA, 14 bp, Homo sapiens
aaggacgcactgag

SEQ ID NO: 2423476 - DNA, 15 bp, Homo sapiens
aaggactcctgaaaa

SEQ ID NO: 2423477 - DNA, 20 bp, Homo sapiens
aaggacttcctgtccagctc

SEQ ID NO: 2423478 - DNA, 23 bp, Homo sapiens
aaggacttcctgtccagctccaa

SEQ ID NO: 2423479 - DNA, 17 bp, Homo sapiens
aaggactttgtacattt

SEQ ID NO: 2423480 - DNA, 17 bp, Homo sapiens
aaggagccccattcctg

SEQ ID NO: 2423481 - DNA, 11 bp, Homo sapiens
aaggagctgcc

SEQ ID NO: 2423482 - DNA, 12 bp, Homo sapiens
aaggagctgcct

SEQ ID NO: 2423483 - DNA, 13 bp, Homo sapiens
aaggagctgcctg

SEQ ID NO: 2423484 - DNA, 22 bp, Homo sapiens
aaggaggagcctgtcctgcctg

SEQ ID NO: 2423485 - DNA, 12 bp, Homo sapiens
aaggagtttatg

SEQ ID NO: 2423486 - DNA, 13 bp, Homo sapiens
aaggagtttatgt

SEQ ID NO: 2423487 - DNA, 15 bp, Homo sapiens
aaggatagatgctgg

SEQ ID NO: 2423488 - DNA, 20 bp, Homo sapiens
aaggatagatgctggcccag

SEQ ID NO: 2423489 - DNA, 22 bp, Homo sapiens
aaggataggccttcattaacaa

SEQ ID NO: 2423490 - DNA, 15 bp, Homo sapiens
aaggatgtgattgtg

SEQ ID NO: 2423491 - DNA, 14 bp, Homo sapiens
aaggcaaaattgca

SEQ ID NO: 2423492 - DNA, 15 bp, Homo sapiens
aaggcaaaattgcaa

SEQ ID NO: 2423493 - DNA, 21 bp, Homo sapiens
aaggcaacaaaagaagcccgg

SEQ ID NO: 2423494 - DNA, 16 bp, Homo sapiens
aaggcacatgtcacct

SEQ ID NO: 2423495 - DNA, 22 bp, Homo sapiens
aaggcacccatctgtctgccaa

SEQ ID NO: 2423496 - DNA, 19 bp, Homo sapiens
aaggcacccccgtcaagag

SEQ ID NO: 2423497 - DNA, 19 bp, Homo sapiens
aaggcactctagattccat

SEQ ID NO: 2423498 - DNA, 14 bp, Homo sapiens
aaggcagaggcctg

SEQ ID NO: 2423499 - DNA, 17 bp, Homo sapiens
aaggcagaggcctgggc

SEQ ID NO: 2423500 - DNA, 19 bp, Homo sapiens
aaggcagcaaggcccgagc

SEQ ID NO: 2423501 - DNA, 22 bp, Homo sapiens
aaggcagttaccattaaaccat

SEQ ID NO: 2423502 - DNA, 24 bp, Homo sapiens
aaggccataaaacaggtaatataa

SEQ ID NO: 2423503 - DNA, 22 bp, Homo sapiens
aaggccatctgggctcctccag

SEQ ID NO: 2423504 - DNA, 14 bp, Homo sapiens
aaggcccgagcagc

SEQ ID NO: 2423505 - DNA, 16 bp, Homo sapiens
aaggcccgagcagctg

SEQ ID NO: 2423506 - DNA, 20 bp, Homo sapiens
aaggcccgagcagctgagca

SEQ ID NO: 2423507 - DNA, 15 bp, Homo sapiens
aaggcctaggattct

SEQ ID NO: 2423508 - DNA, 17 bp, Homo sapiens
aaggcctggggtgaccc

SEQ ID NO: 2423509 - DNA, 18 bp, Homo sapiens
aaggccttcaacccgaga

SEQ ID NO: 2423510 - DNA, 21 bp, Homo sapiens
aaggctctatgagtctagatg

SEQ ID NO: 2423511 - DNA, 13 bp, Homo sapiens
aaggctctgagag

SEQ ID NO: 2423512 - DNA, 16 bp, Homo sapiens
aaggctctgagagtct

SEQ ID NO: 2423513 - DNA, 22 bp, Homo sapiens
aaggctctgagagtctagattc

SEQ ID NO: 2423514 - DNA, 16 bp, Homo sapiens
aaggctgatgtcaatt

SEQ ID NO: 2423515 - DNA, 22 bp, Homo sapiens
aaggctgttaaatacaggaaac

SEQ ID NO: 2423516 - DNA, 18 bp, Homo sapiens
aaggcttctctctgtggg

SEQ ID NO: 2423517 - DNA, 20 bp, Homo sapiens
aaggcttgttgtgcttttag

SEQ ID NO: 2423518 - DNA, 13 bp, Homo sapiens
aagggagccaagg

SEQ ID NO: 2423519 - DNA, 14 bp, Homo sapiens
aagggagccaaggg

SEQ ID NO: 2423520 - DNA, 18 bp, Homo sapiens
aagggagccaagggatgg

SEQ ID NO: 2423521 - DNA, 21 bp, Homo sapiens
aagggagccaagggatggaca

SEQ ID NO: 2423522 - DNA, 13 bp, Homo sapiens
aagggagggcaga

SEQ ID NO: 2423523 - DNA, 16 bp, Homo sapiens
aagggagggctctgag

SEQ ID NO: 2423524 - DNA, 21 bp, Homo sapiens
aagggagggctctgaggcgcc

SEQ ID NO: 2423525 - DNA, 17 bp, Homo sapiens
aagggaggtgggccgtg

SEQ ID NO: 2423526 - DNA, 20 bp, Homo sapiens
aagggcaacagatcagtaaa

SEQ ID NO: 2423527 - DNA, 13 bp, Homo sapiens
aagggcacacaca

SEQ ID NO: 2423528 - DNA, 16 bp, Homo sapiens
aagggccctccttcct

SEQ ID NO: 2423529 - DNA, 16 bp, Homo sapiens
aagttttatatattat

SEQ ID NO: 2423530 - DNA, 15 bp, Homo sapiens
aataaaaaagatccc

SEQ ID NO: 2423531 - DNA, 13 bp, Homo sapiens
aataaaaagcttt

SEQ ID NO: 2423532 - DNA, 20 bp, Homo sapiens
aataaaacccgttgattact

SEQ ID NO: 2423533 - DNA, 12 bp, Homo sapiens
aataaaatttgt

SEQ ID NO: 2423534 - DNA, 18 bp, Homo sapiens
aataaactaataattgca

SEQ ID NO: 2423535 - DNA, 13 bp, Homo sapiens
aataaactttaat

SEQ ID NO: 2423536 - DNA, 13 bp, Homo sapiens
aataaagaaaaga

SEQ ID NO: 2423537 - DNA, 15 bp, Homo sapiens
aataaagaaaagatg

SEQ ID NO: 2423538 - DNA, 20 bp, Homo sapiens
aataaagaaaagatgcactt

SEQ ID NO: 2423539 - DNA, 18 bp, Homo sapiens
aataaaggcagttttcta

SEQ ID NO: 2423540 - DNA, 19 bp, Homo sapiens
aataaaggcagttttctaa

SEQ ID NO: 2423541 - DNA, 23 bp, Homo sapiens
aataaatatatctaccccagact

SEQ ID NO: 2423542 - DNA, 15 bp, Homo sapiens
aataaatgtcacttt

SEQ ID NO: 2423543 - DNA, 20 bp, Homo sapiens
aataaatttattttcttgga

SEQ ID NO: 2423544 - DNA, 20 bp, Homo sapiens
aataaatttgacttttctgt

SEQ ID NO: 2423545 - DNA, 21 bp, Homo sapiens
aataaatttgacttttctgta

SEQ ID NO: 2423546 - DNA, 14 bp, Homo sapiens
aataactcctccca

SEQ ID NO: 2423547 - DNA, 18 bp, Homo sapiens
aataactggaaaacagaa

SEQ ID NO: 2423548 - DNA, 13 bp, Homo sapiens
aataagaatagaa

SEQ ID NO: 2423549 - DNA, 14 bp, Homo sapiens
aataagatcttttt

SEQ ID NO: 2423550 - DNA, 12 bp, Homo sapiens
aataagattcta

SEQ ID NO: 2423551 - DNA, 13 bp, Homo sapiens
aataagattctaa

SEQ ID NO: 2423552 - DNA, 18 bp, Homo sapiens
aataagctatttgatgta

SEQ ID NO: 2423553 - DNA, 15 bp, Homo sapiens
aataaggtacaagaa

SEQ ID NO: 2423554 - DNA, 19 bp, Homo sapiens
aataaggtacaagaagcat

SEQ ID NO: 2423555 - DNA, 15 bp, Homo sapiens
aataagtcaacagta

SEQ ID NO: 2423556 - DNA, 18 bp, Homo sapiens
aataagtgccctctccca

SEQ ID NO: 2423557 - DNA, 14 bp, Homo sapiens
aataagttattgca

SEQ ID NO: 2423558 - DNA, 18 bp, Homo sapiens
aataagttattgcagttt

SEQ ID NO: 2423559 - DNA, 20 bp, Homo sapiens
aataagtttttgtttcacag

SEQ ID NO: 2423560 - DNA, 17 bp, Homo sapiens
aataatatattttctgt

SEQ ID NO: 2423561 - DNA, 19 bp, Homo sapiens
aataatatattttctgttt

SEQ ID NO: 2423562 - DNA, 19 bp, Homo sapiens
aataatgtgtagttcatgt

SEQ ID NO: 2423563 - DNA, 22 bp, Homo sapiens
aataatgtgtagttcatgtaaa

SEQ ID NO: 2423564 - DNA, 22 bp, Homo sapiens
aataattgttgttctgttaact

SEQ ID NO: 2423565 - DNA, 15 bp, Homo sapiens
aataatttctaatgt

SEQ ID NO: 2423566 - DNA, 15 bp, Homo sapiens
aataattttgtaatg

SEQ ID NO: 2423567 - DNA, 12 bp, Homo sapiens
aatacagatata

SEQ ID NO: 2423568 - DNA, 14 bp, Homo sapiens
aatacagatatatt

SEQ ID NO: 2423569 - DNA, 16 bp, Homo sapiens
aatacaggaaacagtt

SEQ ID NO: 2423570 - DNA, 16 bp, Homo sapiens
aatacagggcattttg

SEQ ID NO: 2423571 - DNA, 16 bp, Homo sapiens
aatacagttctgctct

SEQ ID NO: 2423572 - DNA, 17 bp, Homo sapiens
aatacagttctgctctg

SEQ ID NO: 2423573 - DNA, 22 bp, Homo sapiens
aatacataccacgctagggctg

SEQ ID NO: 2423574 - DNA, 19 bp, Homo sapiens
aatacatagggatatgcgt

SEQ ID NO: 2423575 - DNA, 23 bp, Homo sapiens
aatacatgacatttatttttcat

SEQ ID NO: 2423576 - DNA, 21 bp, Homo sapiens
aatacatttaaaacattaaaa

SEQ ID NO: 2423577 - DNA, 18 bp, Homo sapiens
aataccactctgtaattg

SEQ ID NO: 2423578 - DNA, 12 bp, Homo sapiens
aatacctgctca

SEQ ID NO: 2423579 - DNA, 15 bp, Homo sapiens
aatactaaggaacca

SEQ ID NO: 2423580 - DNA, 17 bp, Homo sapiens
aatactaccttgaaaat

SEQ ID NO: 2423581 - DNA, 13 bp, Homo sapiens
aatactcaaatga

SEQ ID NO: 2423582 - DNA, 20 bp, Homo sapiens
aatactcaaatgagtaacat

SEQ ID NO: 2423583 - DNA, 14 bp, Homo sapiens
aatactgcaaatca

SEQ ID NO: 2423584 - DNA, 16 bp, Homo sapiens
aatacttctcattttt

SEQ ID NO: 2423585 - DNA, 14 bp, Homo sapiens
aatacttcttgtgt

SEQ ID NO: 2423586 - DNA, 16 bp, Homo sapiens
aatactttgaatgtgt

SEQ ID NO: 2423587 - DNA, 17 bp, Homo sapiens
aatactttgaatgtgtt

SEQ ID NO: 2423588 - DNA, 20 bp, Homo sapiens
aatactttgaatgtgtttca

SEQ ID NO: 2423589 - DNA, 10 bp, Homo sapiens
aatacttttt

SEQ ID NO: 2423590 - DNA, 22 bp, Homo sapiens
aatagacaaatagaaaatggtc

SEQ ID NO: 2423591 - DNA, 18 bp, Homo sapiens
aatagatatgaaagctga

SEQ ID NO: 2423592 - DNA, 22 bp, Homo sapiens
aatagatgtttgatagattttc

SEQ ID NO: 2423593 - DNA, 13 bp, Homo sapiens
aatagcaaaagaa

SEQ ID NO: 2423594 - DNA, 16 bp, Homo sapiens
aatagcaaaagaagaa

SEQ ID NO: 2423595 - DNA, 20 bp, Homo sapiens
aatagccacatttggaatac

SEQ ID NO: 2423596 - DNA, 22 bp, Homo sapiens
aatagccacatttggaatactt

SEQ ID NO: 2423597 - DNA, 23 bp, Homo sapiens
aatagccacatttggaatacttt

SEQ ID NO: 2423598 - DNA, 22 bp, Homo sapiens
aatagccatatttgtaaaatga

SEQ ID NO: 2423599 - DNA, 18 bp, Homo sapiens
aatagcgttcttgtaatt

SEQ ID NO: 2423600 - DNA, 21 bp, Homo sapiens
aatagctaaatacctcaatca

SEQ ID NO: 2423601 - DNA, 18 bp, Homo sapiens
aatagcttatgaaaagaa

SEQ ID NO: 2423602 - DNA, 19 bp, Homo sapiens
aatagcttatgaaaagaat

SEQ ID NO: 2423603 - DNA, 14 bp, Homo sapiens
aataggcaggaagc

SEQ ID NO: 2423604 - DNA, 19 bp, Homo sapiens
aataggcggggcttgcctt

SEQ ID NO: 2423605 - DNA, 19 bp, Homo sapiens
aatagggtatattttccta

SEQ ID NO: 2423606 - DNA, 15 bp, Homo sapiens
aatagtatttcccat

SEQ ID NO: 2423607 - DNA, 23 bp, Homo sapiens
aatagtgtcatcctcacagtgaa

SEQ ID NO: 2423608 - DNA, 21 bp, Homo sapiens
aatagttaagacatgatttcc

SEQ ID NO: 2423609 - DNA, 23 bp, Homo sapiens
aatagttaagacatgatttcctt

SEQ ID NO: 2423610 - DNA, 13 bp, Homo sapiens
aatagttcctgct

SEQ ID NO: 2423611 - DNA, 11 bp, Homo sapiens
aatataaagac

SEQ ID NO: 2423612 - DNA, 16 bp, Homo sapiens
aatataaagtattcaa

SEQ ID NO: 2423613 - DNA, 20 bp, Homo sapiens
aatataaagttttatatatt

SEQ ID NO: 2423614 - DNA, 22 bp, Homo sapiens
aatataaagttttatatattat

SEQ ID NO: 2423615 - DNA, 15 bp, Homo sapiens
aatataaatgcaaat

SEQ ID NO: 2423616 - DNA, 16 bp, Homo sapiens
aatataaatgcaaata

SEQ ID NO: 2423617 - DNA, 17 bp, Homo sapiens
aatatactatatttatg

SEQ ID NO: 2423618 - DNA, 13 bp, Homo sapiens
aatatatattata

SEQ ID NO: 2423619 - DNA, 14 bp, Homo sapiens
aatatatattatac

SEQ ID NO: 2423620 - DNA, 23 bp, Homo sapiens
aatatatattatacttgtaatta

SEQ ID NO: 2423621 - DNA, 16 bp, Homo sapiens
aatatatattatcttt

SEQ ID NO: 2423622 - DNA, 14 bp, Homo sapiens
aatatatgtatata

SEQ ID NO: 2423623 - DNA, 18 bp, Homo sapiens
aatatattattacttgta

SEQ ID NO: 2423624 - DNA, 16 bp, Homo sapiens
aatatatttaaaaata

SEQ ID NO: 2423625 - DNA, 15 bp, Homo sapiens
aatatatttaagata

SEQ ID NO: 2423626 - DNA, 19 bp, Homo sapiens
aatatatttaagataatta

SEQ ID NO: 2423627 - DNA, 15 bp, Homo sapiens
aatatattttctgtt

SEQ ID NO: 2423628 - DNA, 18 bp, Homo sapiens
aatatccctacatgtatt

SEQ ID NO: 2423629 - DNA, 12 bp, Homo sapiens
aatatccctcct

SEQ ID NO: 2423630 - DNA, 19 bp, Homo sapiens
aatatccctcctgttggga

SEQ ID NO: 2423631 - DNA, 22 bp, Homo sapiens
aatatccctcctgttgggagag

SEQ ID NO: 2423632 - DNA, 23 bp, Homo sapiens
aatatccctcctgttgggagagg

SEQ ID NO: 2423633 - DNA, 17 bp, Homo sapiens
aatatcctaaacatcat

SEQ ID NO: 2423634 - DNA, 17 bp, Homo sapiens
aaataatactgctgaga

SEQ ID NO: 2423635 - DNA, 21 bp, Homo sapiens
aaataattatataactgtatt

SEQ ID NO: 2423636 - DNA, 22 bp, Homo sapiens
aaataattatataactgtattt

SEQ ID NO: 2423637 - DNA, 23 bp, Homo sapiens
aaataattatataactgtatttg

SEQ ID NO: 2423638 - DNA, 12 bp, Homo sapiens
aaataattttgt

SEQ ID NO: 2423639 - DNA, 13 bp, Homo sapiens
aaataattttgta

SEQ ID NO: 2423640 - DNA, 13 bp, Homo sapiens
aaatacaattttt

SEQ ID NO: 2423641 - DNA, 13 bp, Homo sapiens
aaatacaggaaac

SEQ ID NO: 2423642 - DNA, 17 bp, Homo sapiens
aaatacatttaaaacat

SEQ ID NO: 2423643 - DNA, 20 bp, Homo sapiens
aaatactatttaaagcctcc

SEQ ID NO: 2423644 - DNA, 15 bp, Homo sapiens
aaatactgcaaatca

SEQ ID NO: 2423645 - DNA, 15 bp, Homo sapiens
aaatagacaaataga

SEQ ID NO: 2423646 - DNA, 17 bp, Homo sapiens
aaatagcaaaagaagaa

SEQ ID NO: 2423647 - DNA, 20 bp, Homo sapiens
aaatagcgttcttgtaattt

SEQ ID NO: 2423648 - DNA, 15 bp, Homo sapiens
aaatagcttatgaaa

SEQ ID NO: 2423649 - DNA, 14 bp, Homo sapiens
aaataggcaggaag

SEQ ID NO: 2423650 - DNA, 17 bp, Homo sapiens
aaatagttaagacatga

SEQ ID NO: 2423651 - DNA, 21 bp, Homo sapiens
aaatagtttggatatgtaaaa

SEQ ID NO: 2423652 - DNA, 13 bp, Homo sapiens
aaatataaaatat

SEQ ID NO: 2423653 - DNA, 10 bp, Homo sapiens
aaatataaag

SEQ ID NO: 2423654 - DNA, 13 bp, Homo sapiens
aaatatatattat

SEQ ID NO: 2423655 - DNA, 13 bp, Homo sapiens
aaatatattatta

SEQ ID NO: 2423656 - DNA, 21 bp, Homo sapiens
aaatatattattacttgtaaa

SEQ ID NO: 2423657 - DNA, 12 bp, Homo sapiens
aaatatatttaa

SEQ ID NO: 2423658 - DNA, 23 bp, Homo sapiens
aaatatccctcctgttgggagag

SEQ ID NO: 2423659 - DNA, 21 bp, Homo sapiens
aaatatgatgttaaaaaaata

SEQ ID NO: 2423660 - DNA, 20 bp, Homo sapiens
aaatatggacacttaatact

SEQ ID NO: 2423661 - DNA, 18 bp, Homo sapiens
aaatatggactgctcagg

SEQ ID NO: 2423662 - DNA, 12 bp, Homo sapiens
aaatatgtacat

SEQ ID NO: 2423663 - DNA, 13 bp, Homo sapiens
aaatatgtacatt

SEQ ID NO: 2423664 - DNA, 14 bp, Homo sapiens
aaatatgtacattt

SEQ ID NO: 2423665 - DNA, 16 bp, Homo sapiens
aaatatgtcctggggt

SEQ ID NO: 2423666 - DNA, 14 bp, Homo sapiens
aaatattttaaaga

SEQ ID NO: 2423667 - DNA, 16 bp, Homo sapiens
aaatattttaaagaat

SEQ ID NO: 2423668 - DNA, 21 bp, Homo sapiens
aaatattttgaatcaataata

SEQ ID NO: 2423669 - DNA, 22 bp, Homo sapiens
aaatatttttggtcattgtaat

SEQ ID NO: 2423670 - DNA, 13 bp, Homo sapiens
aaatcaaaatctc

SEQ ID NO: 2423671 - DNA, 15 bp, Homo sapiens
aaatcaaaatctctc

SEQ ID NO: 2423672 - DNA, 19 bp, Homo sapiens
aaatcaccacaaactgtaa

SEQ ID NO: 2423673 - DNA, 20 bp, Homo sapiens
aaatcaccacaaactgtaat

SEQ ID NO: 2423674 - DNA, 12 bp, Homo sapiens
aaatcagaagtc

SEQ ID NO: 2423675 - DNA, 18 bp, Homo sapiens
aaatcagaagtcatcttg

SEQ ID NO: 2423676 - DNA, 19 bp, Homo sapiens
aaatcagctattttgtgaa

SEQ ID NO: 2423677 - DNA, 22 bp, Homo sapiens
aaatcaggcttttgtttccttt

SEQ ID NO: 2423678 - DNA, 13 bp, Homo sapiens
aaatcagtaagag

SEQ ID NO: 2423679 - DNA, 19 bp, Homo sapiens
aaatcagtaagaggtgtta

SEQ ID NO: 2423680 - DNA, 21 bp, Homo sapiens
aaatccttagatctggcatgt

SEQ ID NO: 2423681 - DNA, 14 bp, Homo sapiens
aaatcttgatcagt

SEQ ID NO: 2423682 - DNA, 17 bp, Homo sapiens
aaatcttgtcatgtgta

SEQ ID NO: 2423683 - DNA, 18 bp, Homo sapiens
aaatcttgtcatgtgtat

SEQ ID NO: 2423684 - DNA, 21 bp, Homo sapiens
aaatcttgtcatgtgtataaa

SEQ ID NO: 2423685 - DNA, 18 bp, Homo sapiens
aaatcttttataggattt

SEQ ID NO: 2423686 - DNA, 16 bp, Homo sapiens
aaatgacaatcatgtg

SEQ ID NO: 2423687 - DNA, 14 bp, Homo sapiens
aaatgcaaataaca

SEQ ID NO: 2423688 - DNA, 21 bp, Homo sapiens
aaatgccttttcccaaaatgt

SEQ ID NO: 2423689 - DNA, 23 bp, Homo sapiens
aaatgcggttataaaaaatggtt

SEQ ID NO: 2423690 - DNA, 23 bp, Homo sapiens
aaatgctggctatagatgtcttt

SEQ ID NO: 2423691 - DNA, 21 bp, Homo sapiens
aaatggcgtctggaagtccaa

SEQ ID NO: 2423692 - DNA, 13 bp, Homo sapiens
aaatggggccaga

SEQ ID NO: 2423693 - DNA, 16 bp, Homo sapiens
aaatggggccagatcc

SEQ ID NO: 2423694 - DNA, 21 bp, Homo sapiens
aaatggtccaattagtttcct

SEQ ID NO: 2423695 - DNA, 20 bp, Homo sapiens
aaatgtaagattatagattc

SEQ ID NO: 2423696 - DNA, 13 bp, Homo sapiens
aaatgtaaggctg

SEQ ID NO: 2423697 - DNA, 18 bp, Homo sapiens
aaatgtaaggctgtgtaa

SEQ ID NO: 2423698 - DNA, 20 bp, Homo sapiens
aaatgtaaggctgtgtaaga

SEQ ID NO: 2423699 - DNA, 20 bp, Homo sapiens
aaatgtagttctgctccaga

SEQ ID NO: 2423700 - DNA, 15 bp, Homo sapiens
aaatgtattttatgt

SEQ ID NO: 2423701 - DNA, 18 bp, Homo sapiens
aaatgtattttatgttat

SEQ ID NO: 2423702 - DNA, 19 bp, Homo sapiens
aaatgtattttatgttata

SEQ ID NO: 2423703 - DNA, 13 bp, Homo sapiens
aaatgtcactttt

SEQ ID NO: 2423704 - DNA, 16 bp, Homo sapiens
aaatgtcactttttga

SEQ ID NO: 2423705 - DNA, 12 bp, Homo sapiens
aaatgtcttgtg

SEQ ID NO: 2423706 - DNA, 13 bp, Homo sapiens
aaatgtcttgtgt

SEQ ID NO: 2423707 - DNA, 14 bp, Homo sapiens
aaatgtctttaatg

SEQ ID NO: 2423708 - DNA, 15 bp, Homo sapiens
aaatgtgatgttcta

SEQ ID NO: 2423709 - DNA, 18 bp, Homo sapiens
aaatgtgatgttctaagg

SEQ ID NO: 2423710 - DNA, 19 bp, Homo sapiens
aaatgtgatgttctaaggc

SEQ ID NO: 2423711 - DNA, 22 bp, Homo sapiens
aaatgtgcctattgctagagct

SEQ ID NO: 2423712 - DNA, 16 bp, Homo sapiens
aaatgtgctttgagaa

SEQ ID NO: 2423713 - DNA, 22 bp, Homo sapiens
aaatgtgggattatgggtcaca

SEQ ID NO: 2423714 - DNA, 18 bp, Homo sapiens
aaatgttatcttctcaag

SEQ ID NO: 2423715 - DNA, 17 bp, Homo sapiens
aaatgttctaagtttct

SEQ ID NO: 2423716 - DNA, 19 bp, Homo sapiens
aaatgttctaagtttctaa

SEQ ID NO: 2423717 - DNA, 20 bp, Homo sapiens
aaatgtttttaataaaagaa

SEQ ID NO: 2423718 - DNA, 21 bp, Homo sapiens
aaatgtttttggtcttttata

SEQ ID NO: 2423719 - DNA, 23 bp, Homo sapiens
aaatgtttttggtcttttataat

SEQ ID NO: 2423720 - DNA, 15 bp, Homo sapiens
aaattacctgtggat

SEQ ID NO: 2423721 - DNA, 18 bp, Homo sapiens
aaattacctgtggatatt

SEQ ID NO: 2423722 - DNA, 18 bp, Homo sapiens
aaattattaatttatgca

SEQ ID NO: 2423723 - DNA, 12 bp, Homo sapiens
aaattattgttt

SEQ ID NO: 2423724 - DNA, 20 bp, Homo sapiens
aaattattgtttttcttttt

SEQ ID NO: 2423725 - DNA, 11 bp, Homo sapiens
aaattcaaata

SEQ ID NO: 2423726 - DNA, 15 bp, Homo sapiens
aaattcacaaacttt

SEQ ID NO: 2423727 - DNA, 14 bp, Homo sapiens
aaattcagtttcat

SEQ ID NO: 2423728 - DNA, 13 bp, Homo sapiens
aaattcatttttt

SEQ ID NO: 2423729 - DNA, 20 bp, Homo sapiens
aaattctttcccagtctgtc

SEQ ID NO: 2423730 - DNA, 13 bp, Homo sapiens
aaattgaaatgta

SEQ ID NO: 2423731 - DNA, 20 bp, Homo sapiens
aaattgaaatgtaaggctgt

SEQ ID NO: 2423732 - DNA, 12 bp, Homo sapiens
aaattgaacctt

SEQ ID NO: 2423733 - DNA, 18 bp, Homo sapiens
aaattgaatactttgaat

SEQ ID NO: 2423734 - DNA, 19 bp, Homo sapiens
aaattgaatactttgaatg

SEQ ID NO: 2423735 - DNA, 19 bp, Homo sapiens
aaattgatttttctcttca

SEQ ID NO: 2423736 - DNA, 13 bp, Homo sapiens
aaattgcaaatct

SEQ ID NO: 2423737 - DNA, 14 bp, Homo sapiens
aaattgcaaatctt

SEQ ID NO: 2423738 - DNA, 17 bp, Homo sapiens
aaccagcttccttcaga

SEQ ID NO: 2423739 - DNA, 20 bp, Homo sapiens
aaccagcttccttcagagag

SEQ ID NO: 2423740 - DNA, 19 bp, Homo sapiens
aaccagggaagctgtccct

SEQ ID NO: 2423741 - DNA, 18 bp, Homo sapiens
aaccatctccctggtgct

SEQ ID NO: 2423742 - DNA, 22 bp, Homo sapiens
aaccatgagaccactgttatca

SEQ ID NO: 2423743 - DNA, 17 bp, Homo sapiens
aaccatgtcatttcaga

SEQ ID NO: 2423744 - DNA, 20 bp, Homo sapiens
aaccatgtgttatgttttcg

SEQ ID NO: 2423745 - DNA, 12 bp, Homo sapiens
aaccatttcctc

SEQ ID NO: 2423746 - DNA, 16 bp, Homo sapiens
aaccatttcctcagac

SEQ ID NO: 2423747 - DNA, 19 bp, Homo sapiens
aacccactttaaaatatct

SEQ ID NO: 2423748 - DNA, 23 bp, Homo sapiens
aacccactttaaaatatctacat

SEQ ID NO: 2423749 - DNA, 14 bp, Homo sapiens
aacccagactcaga

SEQ ID NO: 2423750 - DNA, 20 bp, Homo sapiens
aacccagctcccttcttccc

SEQ ID NO: 2423751 - DNA, 21 bp, Homo sapiens
aacccatattgtaaaacaggt

SEQ ID NO: 2423752 - DNA, 19 bp, Homo sapiens
aaccccaactactgtgtta

SEQ ID NO: 2423753 - DNA, 20 bp, Homo sapiens
aacccctcccctccatccct

SEQ ID NO: 2423754 - DNA, 22 bp, Homo sapiens
aacccgaggctgagaatcagac

SEQ ID NO: 2423755 - DNA, 20 bp, Homo sapiens
aaccctcacatcagagtgac

SEQ ID NO: 2423756 - DNA, 11 bp, Homo sapiens
aaccctcaggg

SEQ ID NO: 2423757 - DNA, 20 bp, Homo sapiens
aaccctcagggcaaagccag

SEQ ID NO: 2423758 - DNA, 16 bp, Homo sapiens
aaccctttgtgtgctc

SEQ ID NO: 2423759 - DNA, 14 bp, Homo sapiens
aaccgccagctctg

SEQ ID NO: 2423760 - DNA, 19 bp, Homo sapiens
aaccgccctgcagcatccc

SEQ ID NO: 2423761 - DNA, 20 bp, Homo sapiens
aacctacagttttaactgtg

SEQ ID NO: 2423762 - DNA, 16 bp, Homo sapiens
aacctcagcctggcca

SEQ ID NO: 2423763 - DNA, 14 bp, Homo sapiens
aacctcagtaattt

SEQ ID NO: 2423764 - DNA, 13 bp, Homo sapiens
aacctccacctcc

SEQ ID NO: 2423765 - DNA, 19 bp, Homo sapiens
aacctcgctggactctcag

SEQ ID NO: 2423766 - DNA, 16 bp, Homo sapiens
aacctcgggcctgctg

SEQ ID NO: 2423767 - DNA, 18 bp, Homo sapiens
aacctcttcagaggccct

SEQ ID NO: 2423768 - DNA, 22 bp, Homo sapiens
aacctgcccaaagattgatttg

SEQ ID NO: 2423769 - DNA, 17 bp, Homo sapiens
aacctgctctcctcttc

SEQ ID NO: 2423770 - DNA, 17 bp, Homo sapiens
aacctgggttgcagaca

SEQ ID NO: 2423771 - DNA, 13 bp, Homo sapiens
aaccttctctatg

SEQ ID NO: 2423772 - DNA, 16 bp, Homo sapiens
aaccttgcctggtaca

SEQ ID NO: 2423773 - DNA, 19 bp, Homo sapiens
aaccttgcctggtacagta

SEQ ID NO: 2423774 - DNA, 13 bp, Homo sapiens
aaccttgttttgg

SEQ ID NO: 2423775 - DNA, 17 bp, Homo sapiens
aacgcctgagcccaggg

SEQ ID NO: 2423776 - DNA, 20 bp, Homo sapiens
aacgctctaggtacgatgac

SEQ ID NO: 2423777 - DNA, 15 bp, Homo sapiens
aacgctgatttaaag

SEQ ID NO: 2423778 - DNA, 14 bp, Homo sapiens
aacggaccaaagca

SEQ ID NO: 2423779 - DNA, 21 bp, Homo sapiens
aacggaccaaagcaagaccct

SEQ ID NO: 2423780 - DNA, 17 bp, Homo sapiens
aacgtgctctttgtttt

SEQ ID NO: 2423781 - DNA, 19 bp, Homo sapiens
aacgtgctctttgttttgt

SEQ ID NO: 2423782 - DNA, 16 bp, Homo sapiens
aacgtgttcaatattt

SEQ ID NO: 2423783 - DNA, 15 bp, Homo sapiens
aacgttttctaattg

SEQ ID NO: 2423784 - DNA, 17 bp, Homo sapiens
aacgttttctaattgct

SEQ ID NO: 2423785 - DNA, 17 bp, Homo sapiens
aactaaaataattttgt

SEQ ID NO: 2423786 - DNA, 19 bp, Homo sapiens
aactaaaataattttgtaa

SEQ ID NO: 2423787 - DNA, 18 bp, Homo sapiens
aactaaactcttaccata

SEQ ID NO: 2423788 - DNA, 14 bp, Homo sapiens
aactacagtctaaa

SEQ ID NO: 2423789 - DNA, 17 bp, Homo sapiens
aactactaatagaataa

SEQ ID NO: 2423790 - DNA, 20 bp, Homo sapiens
aactactacctgtaatgaca

SEQ ID NO: 2423791 - DNA, 15 bp, Homo sapiens
aactactttataact

SEQ ID NO: 2423792 - DNA, 20 bp, Homo sapiens
aactagacaccaaagttcta

SEQ ID NO: 2423793 - DNA, 16 bp, Homo sapiens
aactagcccctggggt

SEQ ID NO: 2423794 - DNA, 15 bp, Homo sapiens
aactaggaagtggct

SEQ ID NO: 2423795 - DNA, 22 bp, Homo sapiens
aactaggagctttgactcagga

SEQ ID NO: 2423796 - DNA, 22 bp, Homo sapiens
aactatgcatggtgccccagga

SEQ ID NO: 2423797 - DNA, 18 bp, Homo sapiens
aactatggatcagaatag

SEQ ID NO: 2423798 - DNA, 17 bp, Homo sapiens
aactattttcaaagact

SEQ ID NO: 2423799 - DNA, 22 bp, Homo sapiens
aactcaaatggggccagatcca

SEQ ID NO: 2423800 - DNA, 15 bp, Homo sapiens
aactcctagttctag

SEQ ID NO: 2423801 - DNA, 14 bp, Homo sapiens
aactcctcccaggg

SEQ ID NO: 2423802 - DNA, 17 bp, Homo sapiens
aactcctgacctcaggc

SEQ ID NO: 2423803 - DNA, 21 bp, Homo sapiens
aactcgtatagcatgcatctg

SEQ ID NO: 2423804 - DNA, 15 bp, Homo sapiens
aactcgttttttaca

SEQ ID NO: 2423805 - DNA, 19 bp, Homo sapiens
aactctcttattgcctcac

SEQ ID NO: 2423806 - DNA, 11 bp, Homo sapiens
aactcttgatt

SEQ ID NO: 2423807 - DNA, 17 bp, Homo sapiens
aactcttgattatccat

SEQ ID NO: 2423808 - DNA, 13 bp, Homo sapiens
aactctttcaaaa

SEQ ID NO: 2423809 - DNA, 13 bp, Homo sapiens
aactctttcggta

SEQ ID NO: 2423810 - DNA, 23 bp, Homo sapiens
aactctttgctgctgcccatgtt

SEQ ID NO: 2423811 - DNA, 19 bp, Homo sapiens
aactctttgttatttgaaa

SEQ ID NO: 2423812 - DNA, 18 bp, Homo sapiens
aactgaagcagcctctcc

SEQ ID NO: 2423813 - DNA, 21 bp, Homo sapiens
aactgaagcagcctctcccca

SEQ ID NO: 2423814 - DNA, 19 bp, Homo sapiens
aactgaagggggcggccta

SEQ ID NO: 2423815 - DNA, 14 bp, Homo sapiens
aactgaataccact

SEQ ID NO: 2423816 - DNA, 15 bp, Homo sapiens
aactgaataccactc

SEQ ID NO: 2423817 - DNA, 18 bp, Homo sapiens
aactgaataccactctgt

SEQ ID NO: 2423818 - DNA, 24 bp, Homo sapiens
aactgaataccactctgtaattgc

SEQ ID NO: 2423819 - DNA, 12 bp, Homo sapiens
aactgaatgaga

SEQ ID NO: 2423820 - DNA, 10 bp, Homo sapiens
aactgacaag

SEQ ID NO: 2423821 - DNA, 13 bp, Homo sapiens
aactgcaggccct

SEQ ID NO: 2423822 - DNA, 19 bp, Homo sapiens
aactgcaggccctggcctc

SEQ ID NO: 2423823 - DNA, 16 bp, Homo sapiens
aactgcatacactttt

SEQ ID NO: 2423824 - DNA, 18 bp, Homo sapiens
aactgccgtaatttaact

SEQ ID NO: 2423825 - DNA, 13 bp, Homo sapiens
aactgctcctcct

SEQ ID NO: 2423826 - DNA, 12 bp, Homo sapiens
aactgctgccac

SEQ ID NO: 2423827 - DNA, 14 bp, Homo sapiens
aactgctgccactg

SEQ ID NO: 2423828 - DNA, 18 bp, Homo sapiens
aactgctttctgttccaa

SEQ ID NO: 2423829 - DNA, 19 bp, Homo sapiens
aactggaaaacagaacact

SEQ ID NO: 2423830 - DNA, 20 bp, Homo sapiens
aactggaaaacagaacactt

SEQ ID NO: 2423831 - DNA, 21 bp, Homo sapiens
aactggaaaacagaacactta

SEQ ID NO: 2423832 - DNA, 19 bp, Homo sapiens
aactggccaagctgaggtg

SEQ ID NO: 2423833 - DNA, 18 bp, Homo sapiens
aactggccctatttagat

SEQ ID NO: 2423834 - DNA, 21 bp, Homo sapiens
aactgggaacccctttcccac

SEQ ID NO: 2423835 - DNA, 11 bp, Homo sapiens
aactgtacagt

SEQ ID NO: 2423836 - DNA, 21 bp, Homo sapiens
aactgtctcctacctctgctc

SEQ ID NO: 2423837 - DNA, 18 bp, Homo sapiens
aactgtggatattgttac

SEQ ID NO: 2423838 - DNA, 19 bp, Homo sapiens
aacttacctgggcattctt

SEQ ID NO: 2423839 - DNA, 16 bp, Homo sapiens
aacttctaattgccat

SEQ ID NO: 2423840 - DNA, 17 bp, Homo sapiens
aacttctaattgccatg

SEQ ID NO: 2423841 - DNA, 15 bp, Homo sapiens
aacttcttatggaat

SEQ ID NO: 2423842 - DNA, 16 bp, Homo sapiens
aacttcttatggaatt

SEQ ID NO: 2423843 - DNA, 18 bp, Homo sapiens
aacttcttgcttctttct

SEQ ID NO: 2423844 - DNA, 22 bp, Homo sapiens
aacttcttgcttctttctagaa

SEQ ID NO: 2423845 - DNA, 21 bp, Homo sapiens
aacttgaaatatcctgcttga

SEQ ID NO: 2423846 - DNA, 18 bp, Homo sapiens
aacttgaccctgagctga

SEQ ID NO: 2423847 - DNA, 13 bp, Homo sapiens
aacttgcctgcct

SEQ ID NO: 2423848 - DNA, 16 bp, Homo sapiens
aacttgcctgcctttc

SEQ ID NO: 2423849 - DNA, 23 bp, Homo sapiens
aacttggctcgaatctctgtgcc

SEQ ID NO: 2423850 - DNA, 18 bp, Homo sapiens
aacttggctgcaggaatc

SEQ ID NO: 2423851 - DNA, 19 bp, Homo sapiens
aacttggctgcaggaatct

SEQ ID NO: 2423852 - DNA, 21 bp, Homo sapiens
aacttggggagttaagacctg

SEQ ID NO: 2423853 - DNA, 16 bp, Homo sapiens
aacttggttttgctac

SEQ ID NO: 2423854 - DNA, 21 bp, Homo sapiens
aacttggttttgctacataat

SEQ ID NO: 2423855 - DNA, 16 bp, Homo sapiens
aacttgtgccctccct

SEQ ID NO: 2423856 - DNA, 19 bp, Homo sapiens
aactttaaagcgtttgcac

SEQ ID NO: 2423857 - DNA, 19 bp, Homo sapiens
aactttaatgttttttgcc

SEQ ID NO: 2423858 - DNA, 23 bp, Homo sapiens
aactttcaaaagggaagagtttt

SEQ ID NO: 2423859 - DNA, 12 bp, Homo sapiens
aactttgtttta

SEQ ID NO: 2423860 - DNA, 16 bp, Homo sapiens
aacttttctaacagaa

SEQ ID NO: 2423861 - DNA, 19 bp, Homo sapiens
aacttttctaacagaaagc

SEQ ID NO: 2423862 - DNA, 21 bp, Homo sapiens
aacttttcttaaaaagttata

SEQ ID NO: 2423863 - DNA, 18 bp, Homo sapiens
aacttttttttttcttta

SEQ ID NO: 2423864 - DNA, 16 bp, Homo sapiens
aagaaaaaaatgtatt

SEQ ID NO: 2423865 - DNA, 10 bp, Homo sapiens
aagaaaaaag

SEQ ID NO: 2423866 - DNA, 20 bp, Homo sapiens
aagaaaaacaaactcgtttt

SEQ ID NO: 2423867 - DNA, 16 bp, Homo sapiens
aagaaaaataaagaaa

SEQ ID NO: 2423868 - DNA, 17 bp, Homo sapiens
aagaaacccttgctgct

SEQ ID NO: 2423869 - DNA, 18 bp, Homo sapiens
aagaaacccttgctgctt

SEQ ID NO: 2423870 - DNA, 16 bp, Homo sapiens
aagaaacctactgccc

SEQ ID NO: 2423871 - DNA, 11 bp, Homo sapiens
aagaaactttc

SEQ ID NO: 2423872 - DNA, 16 bp, Homo sapiens
aagaaagacgcacttt

SEQ ID NO: 2423873 - DNA, 20 bp, Homo sapiens
aagaaaggaagcattgtaaa

SEQ ID NO: 2423874 - DNA, 20 bp, Homo sapiens
aagaaaggctgttaaataca

SEQ ID NO: 2423875 - DNA, 15 bp, Homo sapiens
aagaaagtgtatttg

SEQ ID NO: 2423876 - DNA, 18 bp, Homo sapiens
aagaaagtgtatttggaa

SEQ ID NO: 2423877 - DNA, 23 bp, Homo sapiens
aagaaataaaaggaagccaaaga

SEQ ID NO: 2423878 - DNA, 13 bp, Homo sapiens
aagaaatatacct

SEQ ID NO: 2423879 - DNA, 20 bp, Homo sapiens
aagaaccagtccccccaccc

SEQ ID NO: 2423880 - DNA, 22 bp, Homo sapiens
aagaactgcaggccctggcctc

SEQ ID NO: 2423881 - DNA, 20 bp, Homo sapiens
aagaactttgagctactgcc

SEQ ID NO: 2423882 - DNA, 22 bp, Homo sapiens
aagaagagcgagagatcaaaga

SEQ ID NO: 2423883 - DNA, 19 bp, Homo sapiens
aagaagcccggctcctggt

SEQ ID NO: 2423884 - DNA, 19 bp, Homo sapiens
aagaaggcaaaaatagttt

SEQ ID NO: 2423885 - DNA, 16 bp, Homo sapiens
aagaaggcaaaaatgt

SEQ ID NO: 2423886 - DNA, 23 bp, Homo sapiens
aagaaggcatcgtcatgcacagt

SEQ ID NO: 2423887 - DNA, 16 bp, Homo sapiens
aagaagggctggtatt

SEQ ID NO: 2423888 - DNA, 14 bp, Homo sapiens
aagaagtaaaagca

SEQ ID NO: 2423889 - DNA, 13 bp, Homo sapiens
aagaagttttaaa

SEQ ID NO: 2423890 - DNA, 23 bp, Homo sapiens
aagaagttttaaaaagccagttt

SEQ ID NO: 2423891 - DNA, 12 bp, Homo sapiens
aagaatacttct

SEQ ID NO: 2423892 - DNA, 18 bp, Homo sapiens
aagaatagcattgtaaaa

SEQ ID NO: 2423893 - DNA, 18 bp, Homo sapiens
aagaatccacatttctaa

SEQ ID NO: 2423894 - DNA, 15 bp, Homo sapiens
aagaatctttagaga

SEQ ID NO: 2423895 - DNA, 19 bp, Homo sapiens
aagaatgcacaagaatgga

SEQ ID NO: 2423896 - DNA, 21 bp, Homo sapiens
aagaatgcacaagaatggatc

SEQ ID NO: 2423897 - DNA, 15 bp, Homo sapiens
aagaattgagtaatg

SEQ ID NO: 2423898 - DNA, 22 bp, Homo sapiens
aagaattgtggtttatatattt

SEQ ID NO: 2423899 - DNA, 14 bp, Homo sapiens
aagacatgatttcc

SEQ ID NO: 2423900 - DNA, 20 bp, Homo sapiens
aagacatgatttccttgaat

SEQ ID NO: 2423901 - DNA, 21 bp, Homo sapiens
aagacatgatttccttgaatg

SEQ ID NO: 2423902 - DNA, 15 bp, Homo sapiens
aagacccctaaccct

SEQ ID NO: 2423903 - DNA, 18 bp, Homo sapiens
aagacctactgttctaaa

SEQ ID NO: 2423904 - DNA, 22 bp, Homo sapiens
aagacctactgttctaaagctc

SEQ ID NO: 2423905 - DNA, 22 bp, Homo sapiens
aagacgcactttggcttataat

SEQ ID NO: 2423906 - DNA, 17 bp, Homo sapiens
aagacgttttataagca

SEQ ID NO: 2423907 - DNA, 21 bp, Homo sapiens
aagactagaaaattagactgt

SEQ ID NO: 2423908 - DNA, 22 bp, Homo sapiens
aagactatcttactatttcaca

SEQ ID NO: 2423909 - DNA, 15 bp, Homo sapiens
aagactatgaaaatg

SEQ ID NO: 2423910 - DNA, 17 bp, Homo sapiens
aagactcaaatgttcta

SEQ ID NO: 2423911 - DNA, 19 bp, Homo sapiens
aagactctagagtccaagg

SEQ ID NO: 2423912 - DNA, 19 bp, Homo sapiens
aagactgctgtggccagga

SEQ ID NO: 2423913 - DNA, 22 bp, Homo sapiens
aagactgctgtggccaggaggt

SEQ ID NO: 2423914 - DNA, 14 bp, Homo sapiens
aagacttactctaa

SEQ ID NO: 2423915 - DNA, 16 bp, Homo sapiens
aagacttactctaaga

SEQ ID NO: 2423916 - DNA, 17 bp, Homo sapiens
aagacttactctaagat

SEQ ID NO: 2423917 - DNA, 19 bp, Homo sapiens
aagacttctctttgcctca

SEQ ID NO: 2423918 - DNA, 20 bp, Homo sapiens
aagacttctctttgcctcaa

SEQ ID NO: 2423919 - DNA, 11 bp, Homo sapiens
aagagaaaaag

SEQ ID NO: 2423920 - DNA, 20 bp, Homo sapiens
aagagaaacagttggtaact

SEQ ID NO: 2423921 - DNA, 14 bp, Homo sapiens
aagagacagtgata

SEQ ID NO: 2423922 - DNA, 18 bp, Homo sapiens
aagagagcctgcaggatc

SEQ ID NO: 2423923 - DNA, 22 bp, Homo sapiens
aagagcagcacctcctcagcct

SEQ ID NO: 2423924 - DNA, 18 bp, Homo sapiens
aagagcatcatgcctctg

SEQ ID NO: 2423925 - DNA, 21 bp, Homo sapiens
aagagcatcatgcctctgagg

SEQ ID NO: 2423926 - DNA, 23 bp, Homo sapiens
accattttgttattgactaacag

SEQ ID NO: 2423927 - DNA, 16 bp, Homo sapiens
acccaacgctccaaag

SEQ ID NO: 2423928 - DNA, 13 bp, Homo sapiens
acccaatccaaat

SEQ ID NO: 2423929 - DNA, 22 bp, Homo sapiens
acccacactcagatcctcctca

SEQ ID NO: 2423930 - DNA, 14 bp, Homo sapiens
acccacatgctcca

SEQ ID NO: 2423931 - DNA, 18 bp, Homo sapiens
acccaccgggccactcct

SEQ ID NO: 2423932 - DNA, 23 bp, Homo sapiens
acccaccgggccactccttcctg

SEQ ID NO: 2423933 - DNA, 15 bp, Homo sapiens
acccacttctgcact

SEQ ID NO: 2423934 - DNA, 22 bp, Homo sapiens
acccactttaaaatatctacat

SEQ ID NO: 2423935 - DNA, 14 bp, Homo sapiens
acccagccaggccc

SEQ ID NO: 2423936 - DNA, 15 bp, Homo sapiens
acccagcccaccccc

SEQ ID NO: 2423937 - DNA, 14 bp, Homo sapiens
acccaggatcccca

SEQ ID NO: 2423938 - DNA, 19 bp, Homo sapiens
acccaggccaggcatgtgg

SEQ ID NO: 2423939 - DNA, 20 bp, Homo sapiens
acccaggctggagtgcagtg

SEQ ID NO: 2423940 - DNA, 15 bp, Homo sapiens
acccagggctctgta

SEQ ID NO: 2423941 - DNA, 16 bp, Homo sapiens
acccagtccacaaaat

SEQ ID NO: 2423942 - DNA, 15 bp, Homo sapiens
acccagtgcccccac

SEQ ID NO: 2423943 - DNA, 20 bp, Homo sapiens
acccagtttctaaactggag

SEQ ID NO: 2423944 - DNA, 21 bp, Homo sapiens
acccagtttctaaactggaga

SEQ ID NO: 2423945 - DNA, 15 bp, Homo sapiens
acccattccttccca

SEQ ID NO: 2423946 - DNA, 23 bp, Homo sapiens
acccattccttcccagaggggcc

SEQ ID NO: 2423947 - DNA, 16 bp, Homo sapiens
accccaaacaccttcc

SEQ ID NO: 2423948 - DNA, 14 bp, Homo sapiens
accccaacctgctc

SEQ ID NO: 2423949 - DNA, 15 bp, Homo sapiens
accccaacctgctct

SEQ ID NO: 2423950 - DNA, 18 bp, Homo sapiens
accccaacctgctctcct

SEQ ID NO: 2423951 - DNA, 13 bp, Homo sapiens
accccacccttcc

SEQ ID NO: 2423952 - DNA, 14 bp, Homo sapiens
accccactcccaca

SEQ ID NO: 2423953 - DNA, 10 bp, Homo sapiens
accccagggc

SEQ ID NO: 2423954 - DNA, 12 bp, Homo sapiens
accccagggcac

SEQ ID NO: 2423955 - DNA, 15 bp, Homo sapiens
accccagggcacagg

SEQ ID NO: 2423956 - DNA, 16 bp, Homo sapiens
accccagggcacagga

SEQ ID NO: 2423957 - DNA, 17 bp, Homo sapiens
accccatccctccccag

SEQ ID NO: 2423958 - DNA, 21 bp, Homo sapiens
accccatggtgctaggaagag

SEQ ID NO: 2423959 - DNA, 12 bp, Homo sapiens
acccccagcact

SEQ ID NO: 2423960 - DNA, 16 bp, Homo sapiens
acccccagcctgggcc

SEQ ID NO: 2423961 - DNA, 20 bp, Homo sapiens
acccccagctcaatggactg

SEQ ID NO: 2423962 - DNA, 18 bp, Homo sapiens
acccccagctccggcctg

SEQ ID NO: 2423963 - DNA, 20 bp, Homo sapiens
acccccctttcacaggcagc

SEQ ID NO: 2423964 - DNA, 15 bp, Homo sapiens
accccctctccctgc

SEQ ID NO: 2423965 - DNA, 19 bp, Homo sapiens
accccgcctgccctcatgg

SEQ ID NO: 2423966 - DNA, 20 bp, Homo sapiens
accccggggtgcccacaggc

SEQ ID NO: 2423967 - DNA, 22 bp, Homo sapiens
acccctgctttgggcttgggcc

SEQ ID NO: 2423968 - DNA, 16 bp, Homo sapiens
acccctgtaggcctca

SEQ ID NO: 2423969 - DNA, 21 bp, Homo sapiens
accccttgtcgcccctccctc

SEQ ID NO: 2423970 - DNA, 16 bp, Homo sapiens
acccctttcccacccc

SEQ ID NO: 2423971 - DNA, 17 bp, Homo sapiens
acccctttcccacccca

SEQ ID NO: 2423972 - DNA, 16 bp, Homo sapiens
acccggcaccccctgc

SEQ ID NO: 2423973 - DNA, 22 bp, Homo sapiens
acccggcaccccctgcagcttg

SEQ ID NO: 2423974 - DNA, 23 bp, Homo sapiens
acccgtgccaagtccaggtcctg

SEQ ID NO: 2423975 - DNA, 13 bp, Homo sapiens
acccgtggaggct

SEQ ID NO: 2423976 - DNA, 15 bp, Homo sapiens
acccgtggaggctgc

SEQ ID NO: 2423977 - DNA, 19 bp, Homo sapiens
acccgtgtctagaggcagg

SEQ ID NO: 2423978 - DNA, 23 bp, Homo sapiens
acccgttcatgggggagggggca

SEQ ID NO: 2423979 - DNA, 21 bp, Homo sapiens
accctcactggctctcctggc

SEQ ID NO: 2423980 - DNA, 17 bp, Homo sapiens
accctcattctactgaa

SEQ ID NO: 2423981 - DNA, 20 bp, Homo sapiens
accctcggggatgtgtcctg

SEQ ID NO: 2423982 - DNA, 14 bp, Homo sapiens
accctctgaaatac

SEQ ID NO: 2423983 - DNA, 20 bp, Homo sapiens
accctctgttccttccctgt

SEQ ID NO: 2423984 - DNA, 12 bp, Homo sapiens
accctgaagggg

SEQ ID NO: 2423985 - DNA, 17 bp, Homo sapiens
accctgagctgaggcag

SEQ ID NO: 2423986 - DNA, 17 bp, Homo sapiens
accctgaggagtctgag

SEQ ID NO: 2423987 - DNA, 20 bp, Homo sapiens
accctgatttaggagaagcc

SEQ ID NO: 2423988 - DNA, 14 bp, Homo sapiens
accctgccttatct

SEQ ID NO: 2423989 - DNA, 18 bp, Homo sapiens
accctgctcatccactct

SEQ ID NO: 2423990 - DNA, 21 bp, Homo sapiens
accctggaggccccaaccctg

SEQ ID NO: 2423991 - DNA, 18 bp, Homo sapiens
accctggcccctctccct

SEQ ID NO: 2423992 - DNA, 15 bp, Homo sapiens
accctggtgggccaa

SEQ ID NO: 2423993 - DNA, 20 bp, Homo sapiens
accctgtactgttctgtgtc

SEQ ID NO: 2423994 - DNA, 14 bp, Homo sapiens
accctgttcctgct

SEQ ID NO: 2423995 - DNA, 14 bp, Homo sapiens
acccttctcccact

SEQ ID NO: 2423996 - DNA, 11 bp, Homo sapiens
acccttgacac

SEQ ID NO: 2423997 - DNA, 15 bp, Homo sapiens
acccttgctgcttta

SEQ ID NO: 2423998 - DNA, 16 bp, Homo sapiens
acccttgctgtgaatt

SEQ ID NO: 2423999 - DNA, 17 bp, Homo sapiens
acccttttcatgatttt

SEQ ID NO: 2424000 - DNA, 21 bp, Homo sapiens
acccttttgggtttctgccct

SEQ ID NO: 2424001 - DNA, 12 bp, Homo sapiens
accgaagcccag

SEQ ID NO: 2424002 - DNA, 18 bp, Homo sapiens
accgaagcccagagggtc

SEQ ID NO: 2424003 - DNA, 13 bp, Homo sapiens
accgccagctctg

SEQ ID NO: 2424004 - DNA, 14 bp, Homo sapiens
accgccagctctgt

SEQ ID NO: 2424005 - DNA, 20 bp, Homo sapiens
accgcccagcggcttgcctg

SEQ ID NO: 2424006 - DNA, 17 bp, Homo sapiens
accgcgtctaccctggg

SEQ ID NO: 2424007 - DNA, 13 bp, Homo sapiens
accgctaaaagaa

SEQ ID NO: 2424008 - DNA, 15 bp, Homo sapiens
accgctaaaagaaac

SEQ ID NO: 2424009 - DNA, 20 bp, Homo sapiens
accgctacaccactctggca

SEQ ID NO: 2424010 - DNA, 16 bp, Homo sapiens
accggcctgccaggag

SEQ ID NO: 2424011 - DNA, 16 bp, Homo sapiens
accggctctcacctgg

SEQ ID NO: 2424012 - DNA, 20 bp, Homo sapiens
accgggccactccttcctgc

SEQ ID NO: 2424013 - DNA, 17 bp, Homo sapiens
accgtggcccttcctgg

SEQ ID NO: 2424014 - DNA, 18 bp, Homo sapiens
accgtggcccttcctgga

SEQ ID NO: 2424015 - DNA, 20 bp, Homo sapiens
accgtggcccttcctggaca

SEQ ID NO: 2424016 - DNA, 22 bp, Homo sapiens
accgtggcccttcctggacagc

SEQ ID NO: 2424017 - DNA, 16 bp, Homo sapiens
accgtgggctccctga

SEQ ID NO: 2424018 - DNA, 22 bp, Homo sapiens
accgtttcttcctgccagcagg

SEQ ID NO: 2424019 - DNA, 17 bp, Homo sapiens
acctaaagaaaaacaaa

SEQ ID NO: 2424020 - DNA, 20 bp, Homo sapiens
acctaacaacattgtagcct

SEQ ID NO: 2424021 - DNA, 17 bp, Homo sapiens
acctaactcttctttca

SEQ ID NO: 2424022 - DNA, 21 bp, Homo sapiens
acctaatccaggcagatccag

SEQ ID NO: 2424023 - DNA, 19 bp, Homo sapiens
acctacagttttaactgtg

SEQ ID NO: 2424024 - DNA, 17 bp, Homo sapiens
acctacctgttgagcat

SEQ ID NO: 2424025 - DNA, 18 bp, Homo sapiens
acctactctggctagaag

SEQ ID NO: 2424026 - DNA, 19 bp, Homo sapiens
acctactgcccaggcactg

SEQ ID NO: 2424027 - DNA, 23 bp, Homo sapiens
acctactgcccaggcactgcaaa

SEQ ID NO: 2424028 - DNA, 17 bp, Homo sapiens
acctagatttaatataa

SEQ ID NO: 2424029 - DNA, 21 bp, Homo sapiens
acctagctgaatgtttttcta

SEQ ID NO: 2424030 - DNA, 15 bp, Homo sapiens
acctccccagcattc

SEQ ID NO: 2424031 - DNA, 12 bp, Homo sapiens
acctccccttgg

SEQ ID NO: 2424032 - DNA, 14 bp, Homo sapiens
acctccccttgggc

SEQ ID NO: 2424033 - DNA, 17 bp, Homo sapiens
acctcccttgggcacgt

SEQ ID NO: 2424034 - DNA, 19 bp, Homo sapiens
acctcctatgggttgtcac

SEQ ID NO: 2424035 - DNA, 15 bp, Homo sapiens
acctcctcagcctga

SEQ ID NO: 2424036 - DNA, 17 bp, Homo sapiens
acctcctgacacccttc

SEQ ID NO: 2424037 - DNA, 13 bp, Homo sapiens
acctccttccctc

SEQ ID NO: 2424038 - DNA, 17 bp, Homo sapiens
acctccttccctctctg

SEQ ID NO: 2424039 - DNA, 19 bp, Homo sapiens
acctcctttcatcacactg

SEQ ID NO: 2424040 - DNA, 22 bp, Homo sapiens
acctcctttcatcacactgggt

SEQ ID NO: 2424041 - DNA, 14 bp, Homo sapiens
acctcgctggactc

SEQ ID NO: 2424042 - DNA, 18 bp, Homo sapiens
acctcgctggactctcag

SEQ ID NO: 2424043 - DNA, 16 bp, Homo sapiens
acctcgtactcaggag

SEQ ID NO: 2424044 - DNA, 15 bp, Homo sapiens
acctctaacagcacc

SEQ ID NO: 2424045 - DNA, 16 bp, Homo sapiens
acctctaacagcacca

SEQ ID NO: 2424046 - DNA, 19 bp, Homo sapiens
acctctgacagcagcatct

SEQ ID NO: 2424047 - DNA, 21 bp, Homo sapiens
acctctgcactactgacatgt

SEQ ID NO: 2424048 - DNA, 15 bp, Homo sapiens
acctctgctgcctcc

SEQ ID NO: 2424049 - DNA, 16 bp, Homo sapiens
acctgaaattccaaag

SEQ ID NO: 2424050 - DNA, 15 bp, Homo sapiens
acctgaagggttgac

SEQ ID NO: 2424051 - DNA, 20 bp, Homo sapiens
acctgagatttattaaagaa

SEQ ID NO: 2424052 - DNA, 16 bp, Homo sapiens
acctgagcctgccgag

SEQ ID NO: 2424053 - DNA, 17 bp, Homo sapiens
acctgagcctgccgagc

SEQ ID NO: 2424054 - DNA, 12 bp, Homo sapiens
acctgaggctgt

SEQ ID NO: 2424055 - DNA, 14 bp, Homo sapiens
acctgaggctgtgg

SEQ ID NO: 2424056 - DNA, 15 bp, Homo sapiens
acctgagggtctgta

SEQ ID NO: 2424057 - DNA, 17 bp, Homo sapiens
acctgagggtctgtagg

SEQ ID NO: 2424058 - DNA, 17 bp, Homo sapiens
acctgccccaactctcc

SEQ ID NO: 2424059 - DNA, 19 bp, Homo sapiens
acctgccccacttgtcctt

SEQ ID NO: 2424060 - DNA, 22 bp, Homo sapiens
acctgccccacttgtccttagc

SEQ ID NO: 2424061 - DNA, 19 bp, Homo sapiens
acctgccctacctgcccca

SEQ ID NO: 2424062 - DNA, 21 bp, Homo sapiens
acctgcctcggcctcccaaag

SEQ ID NO: 2424063 - DNA, 23 bp, Homo sapiens
acctgcctcggcctcccaaagtg

SEQ ID NO: 2424064 - DNA, 21 bp, Homo sapiens
acctgcctgacatttggagtg

SEQ ID NO: 2424065 - DNA, 20 bp, Homo sapiens
acctgctcacgtcaaatgca

SEQ ID NO: 2424066 - DNA, 13 bp, Homo sapiens
acctgctctcctc

SEQ ID NO: 2424067 - DNA, 14 bp, Homo sapiens
acctgctctcctct

SEQ ID NO: 2424068 - DNA, 23 bp, Homo sapiens
acctgctctcctcttctactcac

SEQ ID NO: 2424069 - DNA, 16 bp, Homo sapiens
acctgctgagctctga

SEQ ID NO: 2424070 - DNA, 20 bp, Homo sapiens
acctgctgagctctgagagg

SEQ ID NO: 2424071 - DNA, 21 bp, Homo sapiens
acctgctgagctctgagaggc

SEQ ID NO: 2424072 - DNA, 23 bp, Homo sapiens
acctgctgagctctgagaggccc

SEQ ID NO: 2424073 - DNA, 21 bp, Homo sapiens
acctgctgtgatacgatgctt

SEQ ID NO: 2424074 - DNA, 14 bp, Homo sapiens
acctggatggggca

SEQ ID NO: 2424075 - DNA, 19 bp, Homo sapiens
acctggatggggcaggcca

SEQ ID NO: 2424076 - DNA, 17 bp, Homo sapiens
acctggcagctctggac

SEQ ID NO: 2424077 - DNA, 15 bp, Homo sapiens
acctggccctgcttc

SEQ ID NO: 2424078 - DNA, 17 bp, Homo sapiens
acctggccctgcttcct

SEQ ID NO: 2424079 - DNA, 18 bp, Homo sapiens
acctggccctgcttcctg

SEQ ID NO: 2424080 - DNA, 17 bp, Homo sapiens
acctggctctcacctct

SEQ ID NO: 2424081 - DNA, 20 bp, Homo sapiens
acctggctctcacctctagg

SEQ ID NO: 2424082 - DNA, 16 bp, Homo sapiens
acctgggccctggggc

SEQ ID NO: 2424083 - DNA, 20 bp, Homo sapiens
acctgggccctggggcctgt

SEQ ID NO: 2424084 - DNA, 18 bp, Homo sapiens
acctggtaccctcctggc

SEQ ID NO: 2424085 - DNA, 16 bp, Homo sapiens
acctggtgctgcctct

SEQ ID NO: 2424086 - DNA, 11 bp, Homo sapiens
acctgtccaat

SEQ ID NO: 2424087 - DNA, 14 bp, Homo sapiens
acctgtctcagcct

SEQ ID NO: 2424088 - DNA, 19 bp, Homo sapiens
acctgtgcttcgggccctt

SEQ ID NO: 2424089 - DNA, 13 bp, Homo sapiens
acctgtggatatt

SEQ ID NO: 2424090 - DNA, 16 bp, Homo sapiens
acctgtgtggacagga

SEQ ID NO: 2424091 - DNA, 20 bp, Homo sapiens
acctgtgtttcttgcctcat

SEQ ID NO: 2424092 - DNA, 19 bp, Homo sapiens
acctgttgagcatcacaga

SEQ ID NO: 2424093 - DNA, 20 bp, Homo sapiens
accttatagttactgtgtaa

SEQ ID NO: 2424094 - DNA, 14 bp, Homo sapiens
accttccagctcct

SEQ ID NO: 2424095 - DNA, 16 bp, Homo sapiens
accttcgggctgtgcc

SEQ ID NO: 2424096 - DNA, 17 bp, Homo sapiens
accttcgggctgtgccc

SEQ ID NO: 2424097 - DNA, 22 bp, Homo sapiens
accttctccccagctcccagga

SEQ ID NO: 2424098 - DNA, 23 bp, Homo sapiens
accttgaaaaaaaacagtggatc

SEQ ID NO: 2424099 - DNA, 20 bp, Homo sapiens
accttgaaaataagaataga

SEQ ID NO: 2424100 - DNA, 23 bp, Homo sapiens
accttgctgcaagcacagccctt

SEQ ID NO: 2424101 - DNA, 18 bp, Homo sapiens
accttggacatcctcctc

SEQ ID NO: 2424102 - DNA, 19 bp, Homo sapiens
accttggacatcctcctcc

SEQ ID NO: 2424103 - DNA, 18 bp, Homo sapiens
accttggcaccagacacc

SEQ ID NO: 2424104 - DNA, 21 bp, Homo sapiens
acctttattccttcatttcat

SEQ ID NO: 2424105 - DNA, 23 bp, Homo sapiens
acctttattccttcatttcatct

SEQ ID NO: 2424106 - DNA, 11 bp, Homo sapiens
acctttcatac

SEQ ID NO: 2424107 - DNA, 20 bp, Homo sapiens
acctttcttcaccaaatctt

SEQ ID NO: 2424108 - DNA, 17 bp, Homo sapiens
acctttgtgccctatca

SEQ ID NO: 2424109 - DNA, 20 bp, Homo sapiens
accttttatgtagtaattga

SEQ ID NO: 2424110 - DNA, 20 bp, Homo sapiens
accttttattgacacagaaa

SEQ ID NO: 2424111 - DNA, 23 bp, Homo sapiens
accttttttcaacagtgaagaca

SEQ ID NO: 2424112 - DNA, 14 bp, Homo sapiens
acgaatacttttgc

SEQ ID NO: 2424113 - DNA, 14 bp, Homo sapiens
acgacactgcagcc

SEQ ID NO: 2424114 - DNA, 17 bp, Homo sapiens
acgagagcagaggtctc

SEQ ID NO: 2424115 - DNA, 11 bp, Homo sapiens
acgagggctgg

SEQ ID NO: 2424116 - DNA, 16 bp, Homo sapiens
acgagggctggctggc

SEQ ID NO: 2424117 - DNA, 18 bp, Homo sapiens
acgaggggtgtcttgggc

SEQ ID NO: 2424118 - DNA, 22 bp, Homo sapiens
acgcaccaccatgccaggctaa

SEQ ID NO: 2424119 - DNA, 15 bp, Homo sapiens
acgcacctgcctcag

SEQ ID NO: 2424120 - DNA, 22 bp, Homo sapiens
acgcatctcaaaacagagggct

SEQ ID NO: 2424121 - DNA, 21 bp, Homo sapiens
acgcatgcagtgttggggatg

SEQ ID NO: 2424122 - DNA, 16 bp, Homo sapiens
acgcccgtcctgcctg

SEQ ID NO: 2424123 - DNA, 19 bp, Homo sapiens
acgcccgtcctgcctgtgg

SEQ ID NO: 2424124 - DNA, 20 bp, Homo sapiens
acgcccgtcctgcctgtggc

SEQ ID NO: 2424125 - DNA, 15 bp, Homo sapiens
acgcctcttgaccag

SEQ ID NO: 2424126 - DNA, 24 bp, Homo sapiens
acgcctcttgaccaggctgcctcc

SEQ ID NO: 2424127 - DNA, 13 bp, Homo sapiens
acgcctgagccca

SEQ ID NO: 2424128 - DNA, 16 bp, Homo sapiens
acgcctgagcccaggg

SEQ ID NO: 2424129 - DNA, 17 bp, Homo sapiens
acgcctgagcccaggga

SEQ ID NO: 2424130 - DNA, 17 bp, Homo sapiens
acgcctggctgctgatc

SEQ ID NO: 2424131 - DNA, 21 bp, Homo sapiens
acgcgccaccgagtgccttca

SEQ ID NO: 2424132 - DNA, 15 bp, Homo sapiens
acgcggtttggtttg

SEQ ID NO: 2424133 - DNA, 20 bp, Homo sapiens
acgcggtttggtttgcagcg

SEQ ID NO: 2424134 - DNA, 16 bp, Homo sapiens
aatatgatgttaaaaa

SEQ ID NO: 2424135 - DNA, 17 bp, Homo sapiens
aatatgcctttttgaag

SEQ ID NO: 2424136 - DNA, 16 bp, Homo sapiens
aatatgcttaaaataa

SEQ ID NO: 2424137 - DNA, 17 bp, Homo sapiens
aatatggacacttaata

SEQ ID NO: 2424138 - DNA, 13 bp, Homo sapiens
aatatgtacattt

SEQ ID NO: 2424139 - DNA, 17 bp, Homo sapiens
aatatgtacatttctca

SEQ ID NO: 2424140 - DNA, 15 bp, Homo sapiens
aatatgtaccaagaa

SEQ ID NO: 2424141 - DNA, 13 bp, Homo sapiens
aatatgtcctggg

SEQ ID NO: 2424142 - DNA, 13 bp, Homo sapiens
aatattaaatctg

SEQ ID NO: 2424143 - DNA, 21 bp, Homo sapiens
aatattaaatctgctggagtt

SEQ ID NO: 2424144 - DNA, 14 bp, Homo sapiens
aatattatgagatg

SEQ ID NO: 2424145 - DNA, 17 bp, Homo sapiens
aatattccctagaaact

SEQ ID NO: 2424146 - DNA, 14 bp, Homo sapiens
aatattgacttgta

SEQ ID NO: 2424147 - DNA, 12 bp, Homo sapiens
aatatttcttca

SEQ ID NO: 2424148 - DNA, 11 bp, Homo sapiens
aatattttaaa

SEQ ID NO: 2424149 - DNA, 18 bp, Homo sapiens
aatattttgaatcaataa

SEQ ID NO: 2424150 - DNA, 22 bp, Homo sapiens
aatattttgaatcaataatata

SEQ ID NO: 2424151 - DNA, 16 bp, Homo sapiens
aatcaaaatctctcca

SEQ ID NO: 2424152 - DNA, 13 bp, Homo sapiens
aatcaaacatttt

SEQ ID NO: 2424153 - DNA, 19 bp, Homo sapiens
aatcaaatttgtagggttt

SEQ ID NO: 2424154 - DNA, 13 bp, Homo sapiens
aatcaactttact

SEQ ID NO: 2424155 - DNA, 16 bp, Homo sapiens
aatcaactttactgta

SEQ ID NO: 2424156 - DNA, 17 bp, Homo sapiens
aatcaagtctgtttact

SEQ ID NO: 2424157 - DNA, 23 bp, Homo sapiens
aatcacatattttaaaatttgtt

SEQ ID NO: 2424158 - DNA, 16 bp, Homo sapiens
aatcacgctttttgaa

SEQ ID NO: 2424159 - DNA, 21 bp, Homo sapiens
aatcactctaattaattgtaa

SEQ ID NO: 2424160 - DNA, 11 bp, Homo sapiens
aatcagaactc

SEQ ID NO: 2424161 - DNA, 24 bp, Homo sapiens
aatcagaagtcatcttgctaccag

SEQ ID NO: 2424162 - DNA, 15 bp, Homo sapiens
aatcagctattttgt

SEQ ID NO: 2424163 - DNA, 18 bp, Homo sapiens
aatcagggaggtcatttt

SEQ ID NO: 2424164 - DNA, 19 bp, Homo sapiens
aatcagttcattagaaata

SEQ ID NO: 2424165 - DNA, 21 bp, Homo sapiens
aatcatataataaatgtacat

SEQ ID NO: 2424166 - DNA, 23 bp, Homo sapiens
aatcatcaagagaatttggggct

SEQ ID NO: 2424167 - DNA, 22 bp, Homo sapiens
aatcatcagaaaggaaaaacaa

SEQ ID NO: 2424168 - DNA, 20 bp, Homo sapiens
aatcatccatccttgccaat

SEQ ID NO: 2424169 - DNA, 13 bp, Homo sapiens
aatcatgtgtgtt

SEQ ID NO: 2424170 - DNA, 19 bp, Homo sapiens
aatcatttctatttctcct

SEQ ID NO: 2424171 - DNA, 17 bp, Homo sapiens
aatcatttgtttaaaaa

SEQ ID NO: 2424172 - DNA, 19 bp, Homo sapiens
aatcattttaattattatt

SEQ ID NO: 2424173 - DNA, 18 bp, Homo sapiens
aatccaggcagatccagg

SEQ ID NO: 2424174 - DNA, 21 bp, Homo sapiens
aatcccaaatttgattgattt

SEQ ID NO: 2424175 - DNA, 13 bp, Homo sapiens
aatccccttctcc

SEQ ID NO: 2424176 - DNA, 18 bp, Homo sapiens
aatcccttaacagttgta

SEQ ID NO: 2424177 - DNA, 22 bp, Homo sapiens
aatcccttaacagttgtattta

SEQ ID NO: 2424178 - DNA, 12 bp, Homo sapiens
aatcccttcata

SEQ ID NO: 2424179 - DNA, 12 bp, Homo sapiens
aatccgcccatc

SEQ ID NO: 2424180 - DNA, 14 bp, Homo sapiens
aatcctcccagaaa

SEQ ID NO: 2424181 - DNA, 19 bp, Homo sapiens
aatccttagatctggcatg

SEQ ID NO: 2424182 - DNA, 16 bp, Homo sapiens
aatctactcaaagcat

SEQ ID NO: 2424183 - DNA, 22 bp, Homo sapiens
aatctcaccccatcccacaccc

SEQ ID NO: 2424184 - DNA, 21 bp, Homo sapiens
aatctcagttgattttctgga

SEQ ID NO: 2424185 - DNA, 18 bp, Homo sapiens
aatctcccattttggaat

SEQ ID NO: 2424186 - DNA, 19 bp, Homo sapiens
aatctctccactttcagct

SEQ ID NO: 2424187 - DNA, 20 bp, Homo sapiens
aatctctccactttcagctg

SEQ ID NO: 2424188 - DNA, 20 bp, Homo sapiens
aatctctttttgctttcgaa

SEQ ID NO: 2424189 - DNA, 16 bp, Homo sapiens
aatctgcattattgga

SEQ ID NO: 2424190 - DNA, 18 bp, Homo sapiens
aatctgcattattggaat

SEQ ID NO: 2424191 - DNA, 14 bp, Homo sapiens
aatcttatagttct

SEQ ID NO: 2424192 - DNA, 13 bp, Homo sapiens
aatcttgcatgta

SEQ ID NO: 2424193 - DNA, 15 bp, Homo sapiens
aatcttgctttcttt

SEQ ID NO: 2424194 - DNA, 18 bp, Homo sapiens
aatcttgctttctttgtt

SEQ ID NO: 2424195 - DNA, 21 bp, Homo sapiens
aatcttttacaactgcctcga

SEQ ID NO: 2424196 - DNA, 23 bp, Homo sapiens
aatcttttacaactgcctcgaaa

SEQ ID NO: 2424197 - DNA, 16 bp, Homo sapiens
aatcttttataggatt

SEQ ID NO: 2424198 - DNA, 14 bp, Homo sapiens
aatgaaaaattcca

SEQ ID NO: 2424199 - DNA, 16 bp, Homo sapiens
aatgaaaatgtcttgt

SEQ ID NO: 2424200 - DNA, 18 bp, Homo sapiens
aatgaacaagagaagcat

SEQ ID NO: 2424201 - DNA, 18 bp, Homo sapiens
aatgaacactcttttgct

SEQ ID NO: 2424202 - DNA, 14 bp, Homo sapiens
aatgaacagaacat

SEQ ID NO: 2424203 - DNA, 23 bp, Homo sapiens
aatgaatttagtgagcataggtg

SEQ ID NO: 2424204 - DNA, 15 bp, Homo sapiens
aatgacaatcatgtg

SEQ ID NO: 2424205 - DNA, 13 bp, Homo sapiens
aatgacatgaatt

SEQ ID NO: 2424206 - DNA, 13 bp, Homo sapiens
aatgagaatctac

SEQ ID NO: 2424207 - DNA, 16 bp, Homo sapiens
aatgagattgaatttc

SEQ ID NO: 2424208 - DNA, 12 bp, Homo sapiens
aatgagcatgtt

SEQ ID NO: 2424209 - DNA, 24 bp, Homo sapiens
aatgaggcttggggctggagagga

SEQ ID NO: 2424210 - DNA, 15 bp, Homo sapiens
aatgatatgcttgta

SEQ ID NO: 2424211 - DNA, 17 bp, Homo sapiens
aatgatatgcttgtaac

SEQ ID NO: 2424212 - DNA, 23 bp, Homo sapiens
aatgatcctgtattcagacagat

SEQ ID NO: 2424213 - DNA, 13 bp, Homo sapiens
aatgattcagtgt

SEQ ID NO: 2424214 - DNA, 21 bp, Homo sapiens
aatgattcagtgttaaatgtg

SEQ ID NO: 2424215 - DNA, 17 bp, Homo sapiens
aatgcaaataacaaatg

SEQ ID NO: 2424216 - DNA, 18 bp, Homo sapiens
aatgcaaccatttgaaac

SEQ ID NO: 2424217 - DNA, 11 bp, Homo sapiens
aatgcactttc

SEQ ID NO: 2424218 - DNA, 14 bp, Homo sapiens
aatgcatacaagtt

SEQ ID NO: 2424219 - DNA, 14 bp, Homo sapiens
aatgcattcttctc

SEQ ID NO: 2424220 - DNA, 16 bp, Homo sapiens
aatgccaaattaaaaa

SEQ ID NO: 2424221 - DNA, 17 bp, Homo sapiens
aatgccaaattaaaaaa

SEQ ID NO: 2424222 - DNA, 14 bp, Homo sapiens
aatgccaagcactt

SEQ ID NO: 2424223 - DNA, 19 bp, Homo sapiens
aatgccaagcacttctttt

SEQ ID NO: 2424224 - DNA, 22 bp, Homo sapiens
aatgccactgccttcgcttctt

SEQ ID NO: 2424225 - DNA, 18 bp, Homo sapiens
aatgcgggtgagagtaat

SEQ ID NO: 2424226 - DNA, 15 bp, Homo sapiens
aatgctaggttctac

SEQ ID NO: 2424227 - DNA, 14 bp, Homo sapiens
aatgcttaatcaga

SEQ ID NO: 2424228 - DNA, 14 bp, Homo sapiens
aatgcttctaagta

SEQ ID NO: 2424229 - DNA, 20 bp, Homo sapiens
aatgcttctaagtaaataca

SEQ ID NO: 2424230 - DNA, 22 bp, Homo sapiens
aatgcttctaagtaaatacaat

SEQ ID NO: 2424231 - DNA, 20 bp, Homo sapiens
aatggagattcagttttcat

SEQ ID NO: 2424232 - DNA, 21 bp, Homo sapiens
aatggaggaactttccaaaca

SEQ ID NO: 2424233 - DNA, 17 bp, Homo sapiens
aatggatcacaagatgg

SEQ ID NO: 2424234 - DNA, 18 bp, Homo sapiens
aatggatcacaagatgga

SEQ ID NO: 2424235 - DNA, 20 bp, Homo sapiens
aatggcatgagaaatacaaa

SEQ ID NO: 2424236 - DNA, 21 bp, Homo sapiens
aatggccctgggtcccaggac

SEQ ID NO: 2424237 - DNA, 20 bp, Homo sapiens
acagtaaaccactgaaaaaa

SEQ ID NO: 2424238 - DNA, 13 bp, Homo sapiens
acagtaggagccc

SEQ ID NO: 2424239 - DNA, 19 bp, Homo sapiens
acagtatgggggttgtaaa

SEQ ID NO: 2424240 - DNA, 20 bp, Homo sapiens
acagtattatacgctggcaa

SEQ ID NO: 2424241 - DNA, 15 bp, Homo sapiens
acagtattgctcacc

SEQ ID NO: 2424242 - DNA, 22 bp, Homo sapiens
acagtattgctcacccagtgcc

SEQ ID NO: 2424243 - DNA, 14 bp, Homo sapiens
acagtatttgtaat

SEQ ID NO: 2424244 - DNA, 23 bp, Homo sapiens
agaagcaacctcagtaatttaga

SEQ ID NO: 2424245 - DNA, 19 bp, Homo sapiens
agaagcattttgtaagttg

SEQ ID NO: 2424246 - DNA, 23 bp, Homo sapiens
agaagccaactatgattattaac

SEQ ID NO: 2424247 - DNA, 23 bp, Homo sapiens
agaagcccccagctaagaacctg

SEQ ID NO: 2424248 - DNA, 13 bp, Homo sapiens
agaagcccggctc

SEQ ID NO: 2424249 - DNA, 16 bp, Homo sapiens
agaagcccggctcctg

SEQ ID NO: 2424250 - DNA, 21 bp, Homo sapiens
agaagcctgcataatgtttct

SEQ ID NO: 2424251 - DNA, 19 bp, Homo sapiens
agaagcctgggggcctggc

SEQ ID NO: 2424252 - DNA, 20 bp, Homo sapiens
agaagccttaatttgcacag

SEQ ID NO: 2424253 - DNA, 11 bp, Homo sapiens
agaagccttca

SEQ ID NO: 2424254 - DNA, 20 bp, Homo sapiens
agaagccttcaagctctgag

SEQ ID NO: 2424255 - DNA, 21 bp, Homo sapiens
agaagccttcaagctctgagg

SEQ ID NO: 2424256 - DNA, 18 bp, Homo sapiens
agaagctcagctgcattc

SEQ ID NO: 2424257 - DNA, 18 bp, Homo sapiens
agaagctcctctccccag

SEQ ID NO: 2424258 - DNA, 19 bp, Homo sapiens
agaaggcaaaaatagtttg

SEQ ID NO: 2424259 - DNA, 15 bp, Homo sapiens
agaagggaaagccca

SEQ ID NO: 2424260 - DNA, 16 bp, Homo sapiens
agaagggagggcagag

SEQ ID NO: 2424261 - DNA, 15 bp, Homo sapiens
agaaggggagatgga

SEQ ID NO: 2424262 - DNA, 22 bp, Homo sapiens
agaagtaaaagcaaaaaagaaa

SEQ ID NO: 2424263 - DNA, 14 bp, Homo sapiens
agaagtaccagact

SEQ ID NO: 2424264 - DNA, 23 bp, Homo sapiens
agaagtcacagggcagtacctga

SEQ ID NO: 2424265 - DNA, 13 bp, Homo sapiens
agaagtctcagct

SEQ ID NO: 2424266 - DNA, 14 bp, Homo sapiens
agaagtctcagcta

SEQ ID NO: 2424267 - DNA, 15 bp, Homo sapiens
agaagtgaagaatgc

SEQ ID NO: 2424268 - DNA, 16 bp, Homo sapiens
agaagtgaatgctggg

SEQ ID NO: 2424269 - DNA, 21 bp, Homo sapiens
agaagtgaatgctgggactca

SEQ ID NO: 2424270 - DNA, 16 bp, Homo sapiens
agaagtgacattgcat

SEQ ID NO: 2424271 - DNA, 19 bp, Homo sapiens
agaagttcaatataagctt

SEQ ID NO: 2424272 - DNA, 22 bp, Homo sapiens
agaagttggggacacatgtatt

SEQ ID NO: 2424273 - DNA, 21 bp, Homo sapiens
agaagttgtaaagtatgtatt

SEQ ID NO: 2424274 - DNA, 21 bp, Homo sapiens
agaagtttcatcattttttac

SEQ ID NO: 2424275 - DNA, 23 bp, Homo sapiens
agaagtttgcactatctttcagc

SEQ ID NO: 2424276 - DNA, 13 bp, Homo sapiens
actttccattaca

SEQ ID NO: 2424277 - DNA, 17 bp, Homo sapiens
actttccattacaagta

SEQ ID NO: 2424278 - DNA, 17 bp, Homo sapiens
actttccccaccagatg

SEQ ID NO: 2424279 - DNA, 19 bp, Homo sapiens
actttccccaccagatgct

SEQ ID NO: 2424280 - DNA, 21 bp, Homo sapiens
actttccccaccagatgctga

SEQ ID NO: 2424281 - DNA, 14 bp, Homo sapiens
actttcctgcaact

SEQ ID NO: 2424282 - DNA, 17 bp, Homo sapiens
actttctatcctctgta

SEQ ID NO: 2424283 - DNA, 19 bp, Homo sapiens
actttcttttctggaatgt

SEQ ID NO: 2424284 - DNA, 23 bp, Homo sapiens
actttcttttttgatatagaagt

SEQ ID NO: 2424285 - DNA, 22 bp, Homo sapiens
actttgaatgtgtttcacagtt

SEQ ID NO: 2424286 - DNA, 18 bp, Homo sapiens
actttgcactgatatatc

SEQ ID NO: 2424287 - DNA, 22 bp, Homo sapiens
actttgcagcacagctgagagg

SEQ ID NO: 2424288 - DNA, 11 bp, Homo sapiens
actttgcttgc

SEQ ID NO: 2424289 - DNA, 13 bp, Homo sapiens
actttgcttgctt

SEQ ID NO: 2424290 - DNA, 15 bp, Homo sapiens
actttgcttgctttg

SEQ ID NO: 2424291 - DNA, 22 bp, Homo sapiens
actttggaaccagactcttgcc

SEQ ID NO: 2424292 - DNA, 23 bp, Homo sapiens
actttggcttataattctttcaa

SEQ ID NO: 2424293 - DNA, 17 bp, Homo sapiens
actttggggctaattta

SEQ ID NO: 2424294 - DNA, 14 bp, Homo sapiens
actttgttttattt

SEQ ID NO: 2424295 - DNA, 13 bp, Homo sapiens
acttttaattcat

SEQ ID NO: 2424296 - DNA, 19 bp, Homo sapiens
acttttactctgcctacag

SEQ ID NO: 2424297 - DNA, 16 bp, Homo sapiens
acttttagtaaagtca

SEQ ID NO: 2424298 - DNA, 17 bp, Homo sapiens
acttttctattaaaagt

SEQ ID NO: 2424299 - DNA, 20 bp, Homo sapiens
acttttctgtaattcaggtt

SEQ ID NO: 2424300 - DNA, 17 bp, Homo sapiens
acttttcttaaaaagtt

SEQ ID NO: 2424301 - DNA, 22 bp, Homo sapiens
acttttgtgaattaggctgtaa

SEQ ID NO: 2424302 - DNA, 15 bp, Homo sapiens
actttttattgattt

SEQ ID NO: 2424303 - DNA, 11 bp, Homo sapiens
actttttctga

SEQ ID NO: 2424304 - DNA, 18 bp, Homo sapiens
actttttgttctggtcct

SEQ ID NO: 2424305 - DNA, 20 bp, Homo sapiens
actttttttctgtaccagtt

SEQ ID NO: 2424306 - DNA, 23 bp, Homo sapiens
ccagcctttgttccccactggag

SEQ ID NO: 2424307 - DNA, 22 bp, Homo sapiens
ccagcgagcgcccagctcctga

SEQ ID NO: 2424308 - DNA, 21 bp, Homo sapiens
ccagcgattccctctcccagg

SEQ ID NO: 2424309 - DNA, 23 bp, Homo sapiens
ccagcgattccctctcccaggcc

SEQ ID NO: 2424310 - DNA, 15 bp, Homo sapiens
ccagcggtgggacct

SEQ ID NO: 2424311 - DNA, 13 bp, Homo sapiens
ccagcgtcctcct

SEQ ID NO: 2424312 - DNA, 14 bp, Homo sapiens
ccagctaagaacct

SEQ ID NO: 2424313 - DNA, 19 bp, Homo sapiens
ccagctaagaacctggaac

SEQ ID NO: 2424314 - DNA, 17 bp, Homo sapiens
ccagctacttcctcctc

SEQ ID NO: 2424315 - DNA, 23 bp, Homo sapiens
ccagctaggaagagcaggactcc

SEQ ID NO: 2424316 - DNA, 21 bp, Homo sapiens
ccagctagtgacccacatgcc

SEQ ID NO: 2424317 - DNA, 22 bp, Homo sapiens
ccagctagtgacccacatgcca

SEQ ID NO: 2424318 - DNA, 22 bp, Homo sapiens
ccagctatgttatattgaaaaa

SEQ ID NO: 2424319 - DNA, 13 bp, Homo sapiens
ccagctcagcact

SEQ ID NO: 2424320 - DNA, 15 bp, Homo sapiens
ccagctcagcactgc

SEQ ID NO: 2424321 - DNA, 20 bp, Homo sapiens
ccagctcaggacagatgcca

SEQ ID NO: 2424322 - DNA, 23 bp, Homo sapiens
ccagctcaggacagatgccacac

SEQ ID NO: 2424323 - DNA, 13 bp, Homo sapiens
ccagctcccagga

SEQ ID NO: 2424324 - DNA, 20 bp, Homo sapiens
ccagctcccaggaccacagg

SEQ ID NO: 2424325 - DNA, 23 bp, Homo sapiens
ccagctcccaggaccacaggctc

SEQ ID NO: 2424326 - DNA, 19 bp, Homo sapiens
ccagctccctgtgccccca

SEQ ID NO: 2424327 - DNA, 18 bp, Homo sapiens
ccagctccggcctgtcct

SEQ ID NO: 2424328 - DNA, 19 bp, Homo sapiens
ccagctccggcctgtcctc

SEQ ID NO: 2424329 - DNA, 20 bp, Homo sapiens
ccagctccggcctgtcctcc

SEQ ID NO: 2424330 - DNA, 11 bp, Homo sapiens
ccagctcctga

SEQ ID NO: 2424331 - DNA, 15 bp, Homo sapiens
ccagctctgaaacca

SEQ ID NO: 2424332 - DNA, 12 bp, Homo sapiens
ccagctctgttc

SEQ ID NO: 2424333 - DNA, 13 bp, Homo sapiens
ccagctctgttct

SEQ ID NO: 2424334 - DNA, 14 bp, Homo sapiens
ccagctctgttctt

SEQ ID NO: 2424335 - DNA, 22 bp, Homo sapiens
ccagctctgttcttcctcagcc

SEQ ID NO: 2424336 - DNA, 20 bp, Homo sapiens
ccagctgagcgccaggatgg

SEQ ID NO: 2424337 - DNA, 14 bp, Homo sapiens
ccagctgcactgat

SEQ ID NO: 2424338 - DNA, 18 bp, Homo sapiens
ccagctgcactgatgctg

SEQ ID NO: 2424339 - DNA, 19 bp, Homo sapiens
ccagctgcactgatgctgc

SEQ ID NO: 2424340 - DNA, 22 bp, Homo sapiens
ccagctgcctagattcagggaa

SEQ ID NO: 2424341 - DNA, 22 bp, Homo sapiens
ccagctggaggcaggggcttcc

SEQ ID NO: 2424342 - DNA, 19 bp, Homo sapiens
ccagctgggctctgcaatt

SEQ ID NO: 2424343 - DNA, 16 bp, Homo sapiens
ccagctgggtcaggca

SEQ ID NO: 2424344 - DNA, 18 bp, Homo sapiens
ccagctgggtcaggcagg

SEQ ID NO: 2424345 - DNA, 15 bp, Homo sapiens
ccagctgtcccccca

SEQ ID NO: 2424346 - DNA, 14 bp, Homo sapiens
ccagctgtggtttt

SEQ ID NO: 2424347 - DNA, 13 bp, Homo sapiens
ccagcttccttca

SEQ ID NO: 2424348 - DNA, 15 bp, Homo sapiens
ccagcttccttcaga

SEQ ID NO: 2424349 - DNA, 23 bp, Homo sapiens
ccagcttccttcagagagcagtg

SEQ ID NO: 2424350 - DNA, 14 bp, Homo sapiens
ccagcttgtttaca

SEQ ID NO: 2424351 - DNA, 19 bp, Homo sapiens
ccagcttgtttacatgctt

SEQ ID NO: 2424352 - DNA, 13 bp, Homo sapiens
ccagcttttcaaa

SEQ ID NO: 2424353 - DNA, 18 bp, Homo sapiens
ccaggaacagcaaatgca

SEQ ID NO: 2424354 - DNA, 15 bp, Homo sapiens
ccaggaagctttggt

SEQ ID NO: 2424355 - DNA, 20 bp, Homo sapiens
ccaggaagtctcatctgggg

SEQ ID NO: 2424356 - DNA, 17 bp, Homo sapiens
ccaggaatttcccagga

SEQ ID NO: 2424357 - DNA, 18 bp, Homo sapiens
ccaggaatttcccaggac

SEQ ID NO: 2424358 - DNA, 11 bp, Homo sapiens
ccaaaactgct

SEQ ID NO: 2424359 - DNA, 22 bp, Homo sapiens
ccaaaagaagcccccagctaag

SEQ ID NO: 2424360 - DNA, 19 bp, Homo sapiens
ccaaaaggtttaagaaata

SEQ ID NO: 2424361 - DNA, 23 bp, Homo sapiens
ccaaaatgtaggcttagtttgtg

SEQ ID NO: 2424362 - DNA, 13 bp, Homo sapiens
ccaaacctcacca

SEQ ID NO: 2424363 - DNA, 15 bp, Homo sapiens
ccaaacctcaccaac

SEQ ID NO: 2424364 - DNA, 22 bp, Homo sapiens
ccaaacgccctttcctcctcag

SEQ ID NO: 2424365 - DNA, 12 bp, Homo sapiens
ccaaagaggctg

SEQ ID NO: 2424366 - DNA, 21 bp, Homo sapiens
ccaaagaggctgcccctctca

SEQ ID NO: 2424367 - DNA, 23 bp, Homo sapiens
ccaaagaggctgcccctctcacc

SEQ ID NO: 2424368 - DNA, 22 bp, Homo sapiens
ccaaagagtagaattgcattga

SEQ ID NO: 2424369 - DNA, 15 bp, Homo sapiens
ccaaagagtgatagt

SEQ ID NO: 2424370 - DNA, 14 bp, Homo sapiens
ccaaagcagacagc

SEQ ID NO: 2424371 - DNA, 16 bp, Homo sapiens
ccaaagctttcatgta

SEQ ID NO: 2424372 - DNA, 19 bp, Homo sapiens
ccaaaggacgcactgagca

SEQ ID NO: 2424373 - DNA, 16 bp, Homo sapiens
ccaaaggatgtgatat

SEQ ID NO: 2424374 - DNA, 19 bp, Homo sapiens
ccaaaggatgtgatatata

SEQ ID NO: 2424375 - DNA, 13 bp, Homo sapiens
ccaaagggagtct

SEQ ID NO: 2424376 - DNA, 19 bp, Homo sapiens
ccaaagggagtctgccagg

SEQ ID NO: 2424377 - DNA, 21 bp, Homo sapiens
ccaaagggagtctgccagggc

SEQ ID NO: 2424378 - DNA, 11 bp, Homo sapiens
ccaaagttcta

SEQ ID NO: 2424379 - DNA, 14 bp, Homo sapiens
ccaaagttctaata

SEQ ID NO: 2424380 - DNA, 15 bp, Homo sapiens
ccaaagttgttgtaa

SEQ ID NO: 2424381 - DNA, 15 bp, Homo sapiens
ccaaatatgtcctgg

SEQ ID NO: 2424382 - DNA, 20 bp, Homo sapiens
ccaaatccttagatctggca

SEQ ID NO: 2424383 - DNA, 18 bp, Homo sapiens
ccaaattaaaaaagataa

SEQ ID NO: 2424384 - DNA, 17 bp, Homo sapiens
ccaacaccaagcacagc

SEQ ID NO: 2424385 - DNA, 21 bp, Homo sapiens
ccaacacgcacctgcctcagg

SEQ ID NO: 2424386 - DNA, 23 bp, Homo sapiens
ccaacagcgcccaaaggacgcac

SEQ ID NO: 2424387 - DNA, 13 bp, Homo sapiens
ccaacatgcactg

SEQ ID NO: 2424388 - DNA, 14 bp, Homo sapiens
ccaaccatttcctc

SEQ ID NO: 2424389 - DNA, 14 bp, Homo sapiens
ccaacccgtggagg

SEQ ID NO: 2424390 - DNA, 15 bp, Homo sapiens
ccaacccgtggaggc

SEQ ID NO: 2424391 - DNA, 19 bp, Homo sapiens
ccaacctgcaaagatctgt

SEQ ID NO: 2424392 - DNA, 20 bp, Homo sapiens
ccaacctgctctcctcttct

SEQ ID NO: 2424393 - DNA, 15 bp, Homo sapiens
ccaacgctccaaagt

SEQ ID NO: 2424394 - DNA, 15 bp, Homo sapiens
ccaactagcccctgg

SEQ ID NO: 2424395 - DNA, 14 bp, Homo sapiens
ccaacttttctatt

SEQ ID NO: 2424396 - DNA, 13 bp, Homo sapiens
ccaagactctaga

SEQ ID NO: 2424397 - DNA, 15 bp, Homo sapiens
ccaagactctagagt

SEQ ID NO: 2424398 - DNA, 17 bp, Homo sapiens
ccaagactgctgtggcc

SEQ ID NO: 2424399 - DNA, 18 bp, Homo sapiens
ccaagactgctgtggcca

SEQ ID NO: 2424400 - DNA, 16 bp, Homo sapiens
ccaagagcatcatgcc

SEQ ID NO: 2424401 - DNA, 18 bp, Homo sapiens
ccaagagcatcatgcctc

SEQ ID NO: 2424402 - DNA, 19 bp, Homo sapiens
ccaagagcatcatgcctct

SEQ ID NO: 2424403 - DNA, 22 bp, Homo sapiens
ccaagagcatcatgcctctgag

SEQ ID NO: 2424404 - DNA, 11 bp, Homo sapiens
ccaagagtcta

SEQ ID NO: 2424405 - DNA, 18 bp, Homo sapiens
ccaagatacttaagtgct

SEQ ID NO: 2424406 - DNA, 14 bp, Homo sapiens
ccaagattctagat

SEQ ID NO: 2424407 - DNA, 21 bp, Homo sapiens
ccaagattggcctgaggctgc

SEQ ID NO: 2424408 - DNA, 12 bp, Homo sapiens
ccaagcacagca

SEQ ID NO: 2424409 - DNA, 13 bp, Homo sapiens
ccaagcacagcag

SEQ ID NO: 2424410 - DNA, 18 bp, Homo sapiens
ccaagcacagcagcctgg

SEQ ID NO: 2424411 - DNA, 23 bp, Homo sapiens
ccaagccaagggaacctgtgtcc

SEQ ID NO: 2424412 - DNA, 19 bp, Homo sapiens
ccaagccagaggctgggtt

SEQ ID NO: 2424413 - DNA, 20 bp, Homo sapiens
ccaagctaagcactgccact

SEQ ID NO: 2424414 - DNA, 15 bp, Homo sapiens
ccaagctccaagccc

SEQ ID NO: 2424415 - DNA, 17 bp, Homo sapiens
ccaagctccaagcccca

SEQ ID NO: 2424416 - DNA, 18 bp, Homo sapiens
cattaaattcacaaactt

SEQ ID NO: 2424417 - DNA, 15 bp, Homo sapiens
cattaatagcagcct

SEQ ID NO: 2424418 - DNA, 18 bp, Homo sapiens
cattaatagcagcctttc

SEQ ID NO: 2424419 - DNA, 20 bp, Homo sapiens
cattaatagcagcctttctc

SEQ ID NO: 2424420 - DNA, 20 bp, Homo sapiens
cattaatcagttcattagaa

SEQ ID NO: 2424421 - DNA, 12 bp, Homo sapiens
cattaattctat

SEQ ID NO: 2424422 - DNA, 17 bp, Homo sapiens
cattacaagtattttta

SEQ ID NO: 2424423 - DNA, 15 bp, Homo sapiens
cattaccatgtaatg

SEQ ID NO: 2424424 - DNA, 15 bp, Homo sapiens
cattactataagaac

SEQ ID NO: 2424425 - DNA, 17 bp, Homo sapiens
cattactataagaactt

SEQ ID NO: 2424426 - DNA, 14 bp, Homo sapiens
cattagaaatattt

SEQ ID NO: 2424427 - DNA, 18 bp, Homo sapiens
cattagaaatattttaaa

SEQ ID NO: 2424428 - DNA, 19 bp, Homo sapiens
cattaggaaaagttgctat

SEQ ID NO: 2424429 - DNA, 22 bp, Homo sapiens
cattagtctcagtgaagactat

SEQ ID NO: 2424430 - DNA, 19 bp, Homo sapiens
cattatatttctattttat

SEQ ID NO: 2424431 - DNA, 21 bp, Homo sapiens
cattatgtggttttagatttt

SEQ ID NO: 2424432 - DNA, 13 bp, Homo sapiens
cattattatcaac

SEQ ID NO: 2424433 - DNA, 18 bp, Homo sapiens
cattcaacagagactgaa

SEQ ID NO: 2424434 - DNA, 17 bp, Homo sapiens
cattcaagtgtaaaata

SEQ ID NO: 2424435 - DNA, 19 bp, Homo sapiens
cattcaagtgtaaaatatt

SEQ ID NO: 2424436 - DNA, 22 bp, Homo sapiens
cattcacagttctttgggccag

SEQ ID NO: 2424437 - DNA, 13 bp, Homo sapiens
cattcacctgccc

SEQ ID NO: 2424438 - DNA, 19 bp, Homo sapiens
cattcacctgccccaactc

SEQ ID NO: 2424439 - DNA, 18 bp, Homo sapiens
cattcagaagaaaaagaa

SEQ ID NO: 2424440 - DNA, 17 bp, Homo sapiens
cattcaggactgctggt

SEQ ID NO: 2424441 - DNA, 18 bp, Homo sapiens
cattccaagactctagag

SEQ ID NO: 2424442 - DNA, 17 bp, Homo sapiens
cattccatgtgcccagt

SEQ ID NO: 2424443 - DNA, 16 bp, Homo sapiens
cattcccgcagtggga

SEQ ID NO: 2424444 - DNA, 20 bp, Homo sapiens
cattccgcagcccccacccc

SEQ ID NO: 2424445 - DNA, 17 bp, Homo sapiens
cattcctcatgaatgta

SEQ ID NO: 2424446 - DNA, 21 bp, Homo sapiens
cattcctcatgaatgtaaatt

SEQ ID NO: 2424447 - DNA, 16 bp, Homo sapiens
cattcctgaagaacca

SEQ ID NO: 2424448 - DNA, 21 bp, Homo sapiens
cattcctgaagaaccagtccc

SEQ ID NO: 2424449 - DNA, 21 bp, Homo sapiens
cattcctgggaaatattccct

SEQ ID NO: 2424450 - DNA, 12 bp, Homo sapiens
cattccttccca

SEQ ID NO: 2424451 - DNA, 22 bp, Homo sapiens
cattcgacctataagaagcctt

SEQ ID NO: 2424452 - DNA, 14 bp, Homo sapiens
cattcgttctgtgg

SEQ ID NO: 2424453 - DNA, 15 bp, Homo sapiens
cattctactgaaaag

SEQ ID NO: 2424454 - DNA, 20 bp, Homo sapiens
cattctcacaggtcccaaat

SEQ ID NO: 2424455 - DNA, 17 bp, Homo sapiens
cattctccacagcaacc

SEQ ID NO: 2424456 - DNA, 13 bp, Homo sapiens
cattctgaatgct

SEQ ID NO: 2424457 - DNA, 16 bp, Homo sapiens
cattctgaatgcttct

SEQ ID NO: 2424458 - DNA, 12 bp, Homo sapiens
cattctgactcg

SEQ ID NO: 2424459 - DNA, 16 bp, Homo sapiens
cattctgactcggttt

SEQ ID NO: 2424460 - DNA, 21 bp, Homo sapiens
cattctgactcggtttctcca

SEQ ID NO: 2424461 - DNA, 18 bp, Homo sapiens
cattctgcctctctagga

SEQ ID NO: 2424462 - DNA, 17 bp, Homo sapiens
cattctggacctctggg

SEQ ID NO: 2424463 - DNA, 15 bp, Homo sapiens
cattgaaaagagctg

SEQ ID NO: 2424464 - DNA, 17 bp, Homo sapiens
cattgaacacaaactgt

SEQ ID NO: 2424465 - DNA, 18 bp, Homo sapiens
cattgaacacaaactgta

SEQ ID NO: 2424466 - DNA, 13 bp, Homo sapiens
cattgaaggctta

SEQ ID NO: 2424467 - DNA, 16 bp, Homo sapiens
cattgactttccccac

SEQ ID NO: 2424468 - DNA, 15 bp, Homo sapiens
cattgccaagggctt

SEQ ID NO: 2424469 - DNA, 23 bp, Homo sapiens
cattgcgtttgaccttttatgta

SEQ ID NO: 2424470 - DNA, 18 bp, Homo sapiens
cattggaaatttagcatt

SEQ ID NO: 2424471 - DNA, 16 bp, Homo sapiens
cattggaactggaggc

SEQ ID NO: 2424472 - DNA, 11 bp, Homo sapiens
cattggatatt

SEQ ID NO: 2424473 - DNA, 20 bp, Homo sapiens
cattggcacctaatccaggc

SEQ ID NO: 2424474 - DNA, 19 bp, Homo sapiens
cattggctatttaaaactt

SEQ ID NO: 2424475 - DNA, 14 bp, Homo sapiens
cattggtccaagat

SEQ ID NO: 2424476 - DNA, 23 bp, Homo sapiens
caggctcccagggacacctggga

SEQ ID NO: 2424477 - DNA, 22 bp, Homo sapiens
caggctcttagcagcttccaga

SEQ ID NO: 2424478 - DNA, 21 bp, Homo sapiens
caggctgaccacagcacagcc

SEQ ID NO: 2424479 - DNA, 16 bp, Homo sapiens
caggctgccgtggggc

SEQ ID NO: 2424480 - DNA, 11 bp, Homo sapiens
caggctgcctg

SEQ ID NO: 2424481 - DNA, 19 bp, Homo sapiens
caggctggaagatagctgt

SEQ ID NO: 2424482 - DNA, 19 bp, Homo sapiens
caggctggccagtccaggc

SEQ ID NO: 2424483 - DNA, 18 bp, Homo sapiens
caggctggctccagatgc

SEQ ID NO: 2424484 - DNA, 18 bp, Homo sapiens
caggctgggccatgtcca

SEQ ID NO: 2424485 - DNA, 17 bp, Homo sapiens
caggctggtctaaaact

SEQ ID NO: 2424486 - DNA, 22 bp, Homo sapiens
caggctgtgtttggctttcagg

SEQ ID NO: 2424487 - DNA, 23 bp, Homo sapiens
caggcttctgagcagcgagcctg

SEQ ID NO: 2424488 - DNA, 17 bp, Homo sapiens
caggcttctgctggggc

SEQ ID NO: 2424489 - DNA, 17 bp, Homo sapiens
cagggaagcagcagcct

SEQ ID NO: 2424490 - DNA, 18 bp, Homo sapiens
cagggaaggaggagcctg

SEQ ID NO: 2424491 - DNA, 21 bp, Homo sapiens
cagggaaggaggagcctgtcc

SEQ ID NO: 2424492 - DNA, 22 bp, Homo sapiens
cagggaaggaggagcctgtcct

SEQ ID NO: 2424493 - DNA, 17 bp, Homo sapiens
cagggaaggcaggcagg

SEQ ID NO: 2424494 - DNA, 14 bp, Homo sapiens
cagggacagaggcc

SEQ ID NO: 2424495 - DNA, 14 bp, Homo sapiens
cagggaccatggct

SEQ ID NO: 2424496 - DNA, 21 bp, Homo sapiens
cagggaccgccccctgtctct

SEQ ID NO: 2424497 - DNA, 14 bp, Homo sapiens
cagggagagcccag

SEQ ID NO: 2424498 - DNA, 15 bp, Homo sapiens
cagggagagcccagg

SEQ ID NO: 2424499 - DNA, 13 bp, Homo sapiens
cagggaggctggt

SEQ ID NO: 2424500 - DNA, 16 bp, Homo sapiens
cagggaggtcattttg

SEQ ID NO: 2424501 - DNA, 12 bp, Homo sapiens
cagggatgtggg

SEQ ID NO: 2424502 - DNA, 13 bp, Homo sapiens
cagggatgtgggt

SEQ ID NO: 2424503 - DNA, 21 bp, Homo sapiens
cagggatgtgggttccacaga

SEQ ID NO: 2424504 - DNA, 17 bp, Homo sapiens
cagggattaacctctgc

SEQ ID NO: 2424505 - DNA, 20 bp, Homo sapiens
cagggattaacctctgcact

SEQ ID NO: 2424506 - DNA, 16 bp, Homo sapiens
cagggcaaagccaggt

SEQ ID NO: 2424507 - DNA, 17 bp, Homo sapiens
cagggcaaagccaggtc

SEQ ID NO: 2424508 - DNA, 22 bp, Homo sapiens
cagggcaaagccaggtccctct

SEQ ID NO: 2424509 - DNA, 19 bp, Homo sapiens
cagggcacaggagctacct

SEQ ID NO: 2424510 - DNA, 19 bp, Homo sapiens
cagggcagagtgagaccca

SEQ ID NO: 2424511 - DNA, 13 bp, Homo sapiens
cagggcagccagg

SEQ ID NO: 2424512 - DNA, 18 bp, Homo sapiens
cagggcagccagggagag

SEQ ID NO: 2424513 - DNA, 23 bp, Homo sapiens
cagggcagccagggagagcccag

SEQ ID NO: 2424514 - DNA, 14 bp, Homo sapiens
cagggcagcgccag

SEQ ID NO: 2424515 - DNA, 19 bp, Homo sapiens
cagggcagcgccaggctga

SEQ ID NO: 2424516 - DNA, 22 bp, Homo sapiens
cagggcagcgccaggctgacca

SEQ ID NO: 2424517 - DNA, 23 bp, Homo sapiens
cagggcagtacctgagggtctgt

SEQ ID NO: 2424518 - DNA, 21 bp, Homo sapiens
cagggcagtcattggctgtct

SEQ ID NO: 2424519 - DNA, 19 bp, Homo sapiens
cagggcatctctgggctgg

SEQ ID NO: 2424520 - DNA, 16 bp, Homo sapiens
cagggccacgctccag

SEQ ID NO: 2424521 - DNA, 23 bp, Homo sapiens
cagggccacgctccagctgcccc

SEQ ID NO: 2424522 - DNA, 19 bp, Homo sapiens
cagggccagcctctagagc

SEQ ID NO: 2424523 - DNA, 14 bp, Homo sapiens
cagggccatgctga

SEQ ID NO: 2424524 - DNA, 17 bp, Homo sapiens
cagggccatgctgaggc

SEQ ID NO: 2424525 - DNA, 21 bp, Homo sapiens
cagggccatgctgaggcctgg

SEQ ID NO: 2424526 - DNA, 14 bp, Homo sapiens
cagggcccagagcc

SEQ ID NO: 2424527 - DNA, 16 bp, Homo sapiens
cagggcccagagccca

SEQ ID NO: 2424528 - DNA, 21 bp, Homo sapiens
cagggcccagagcccagctcc

SEQ ID NO: 2424529 - DNA, 22 bp, Homo sapiens
cagggcccagagcccagctcca

SEQ ID NO: 2424530 - DNA, 20 bp, Homo sapiens
cagggccccaggcattgcca

SEQ ID NO: 2424531 - DNA, 22 bp, Homo sapiens
cagggcccctcaccctgcctta

SEQ ID NO: 2424532 - DNA, 15 bp, Homo sapiens
cagggcccctctccc

SEQ ID NO: 2424533 - DNA, 23 bp, Homo sapiens
cagggccggggaactggccaagc

SEQ ID NO: 2424534 - DNA, 16 bp, Homo sapiens
cagggcctctgtcaat

SEQ ID NO: 2424535 - DNA, 17 bp, Homo sapiens
cagggcgggcagagggc

SEQ ID NO: 2424536 - DNA, 19 bp, Homo sapiens
cagggcgggcagagggctg

SEQ ID NO: 2424537 - DNA, 22 bp, Homo sapiens
cagggcggtaccttgtgcccag

SEQ ID NO: 2424538 - DNA, 23 bp, Homo sapiens
cagggctaccctgagctgaggca

SEQ ID NO: 2424539 - DNA, 24 bp, Homo sapiens
cagggctaccctgagctgaggcag

SEQ ID NO: 2424540 - DNA, 18 bp, Homo sapiens
cagggctagtgacttgtg

SEQ ID NO: 2424541 - DNA, 13 bp, Homo sapiens
cagggctccagcc

SEQ ID NO: 2424542 - DNA, 16 bp, Homo sapiens
cagggctccagcccct

SEQ ID NO: 2424543 - DNA, 14 bp, Homo sapiens
cagggctctcctgg

SEQ ID NO: 2424544 - DNA, 18 bp, Homo sapiens
cagggctctcctggcttc

SEQ ID NO: 2424545 - DNA, 18 bp, Homo sapiens
catggtgtgatcgtctga

SEQ ID NO: 2424546 - DNA, 15 bp, Homo sapiens
catggtgttctcctg

SEQ ID NO: 2424547 - DNA, 13 bp, Homo sapiens
catggttaagagt

SEQ ID NO: 2424548 - DNA, 17 bp, Homo sapiens
catggttaccatgtctt

SEQ ID NO: 2424549 - DNA, 13 bp, Homo sapiens
catggtttcagca

SEQ ID NO: 2424550 - DNA, 15 bp, Homo sapiens
catgtaaactgtgca

SEQ ID NO: 2424551 - DNA, 20 bp, Homo sapiens
catgtaacgcaagttcccag

SEQ ID NO: 2424552 - DNA, 20 bp, Homo sapiens
catgtacatgaagaagctaa

SEQ ID NO: 2424553 - DNA, 19 bp, Homo sapiens
catgtactgagccttgtaa

SEQ ID NO: 2424554 - DNA, 23 bp, Homo sapiens
catgtactgagccttgtaattct

SEQ ID NO: 2424555 - DNA, 22 bp, Homo sapiens
catgtagtaacactaatatatt

SEQ ID NO: 2424556 - DNA, 23 bp, Homo sapiens
catgtagtaacactaatatattt

SEQ ID NO: 2424557 - DNA, 17 bp, Homo sapiens
catgtattgcacattgt

SEQ ID NO: 2424558 - DNA, 22 bp, Homo sapiens
catgtcaacagcgttcctagag

SEQ ID NO: 2424559 - DNA, 20 bp, Homo sapiens
catgtcaagggttcaagatt

SEQ ID NO: 2424560 - DNA, 21 bp, Homo sapiens
catgtcgtggacacacacaga

SEQ ID NO: 2424561 - DNA, 13 bp, Homo sapiens
catgtgacattta

SEQ ID NO: 2424562 - DNA, 14 bp, Homo sapiens
catgtgacatttat

SEQ ID NO: 2424563 - DNA, 16 bp, Homo sapiens
catgtgaccactctgt

SEQ ID NO: 2424564 - DNA, 13 bp, Homo sapiens
catgtggctggaa

SEQ ID NO: 2424565 - DNA, 15 bp, Homo sapiens
catgtggggccaggt

SEQ ID NO: 2424566 - DNA, 17 bp, Homo sapiens
catgtggggccaggtca

SEQ ID NO: 2424567 - DNA, 23 bp, Homo sapiens
catgtggtggcacaggccccctt

SEQ ID NO: 2424568 - DNA, 17 bp, Homo sapiens
catgtgtataaaaataa

SEQ ID NO: 2424569 - DNA, 13 bp, Homo sapiens
catgtgtcccaga

SEQ ID NO: 2424570 - DNA, 15 bp, Homo sapiens
catgtgtcctggttc

SEQ ID NO: 2424571 - DNA, 12 bp, Homo sapiens
catgtgtggaag

SEQ ID NO: 2424572 - DNA, 12 bp, Homo sapiens
catgtgtgtcca

SEQ ID NO: 2424573 - DNA, 16 bp, Homo sapiens
catgtgttaagtattt

SEQ ID NO: 2424574 - DNA, 21 bp, Homo sapiens
catgttagttaccttatagtt

SEQ ID NO: 2424575 - DNA, 22 bp, Homo sapiens
catgttgaagccactgccttca

SEQ ID NO: 2424576 - DNA, 22 bp, Homo sapiens
catgttgcccccgtgagccaat

SEQ ID NO: 2424577 - DNA, 15 bp, Homo sapiens
catgttgggaaactt

SEQ ID NO: 2424578 - DNA, 20 bp, Homo sapiens
catgttgggaaacttggctc

SEQ ID NO: 2424579 - DNA, 19 bp, Homo sapiens
catgttgtctaagaaattg

SEQ ID NO: 2424580 - DNA, 19 bp, Homo sapiens
catgtttagactttaacat

SEQ ID NO: 2424581 - DNA, 15 bp, Homo sapiens
catgtttatctgctt

SEQ ID NO: 2424582 - DNA, 19 bp, Homo sapiens
catgtttatttttcttgtc

SEQ ID NO: 2424583 - DNA, 17 bp, Homo sapiens
catgtttccagcattcc

SEQ ID NO: 2424584 - DNA, 13 bp, Homo sapiens
cattaaaagaata

SEQ ID NO: 2424585 - DNA, 19 bp, Homo sapiens
cattaaaccatctccctgg

SEQ ID NO: 2424586 - DNA, 14 bp, Homo sapiens
cattaaagaagacc

SEQ ID NO: 2424587 - DNA, 13 bp, Homo sapiens
cattaaattcaca

SEQ ID NO: 2424588 - DNA, 13 bp, Homo sapiens
cacaggccctccc

SEQ ID NO: 2424589 - DNA, 13 bp, Homo sapiens
cacaggcctgtgt

SEQ ID NO: 2424590 - DNA, 22 bp, Homo sapiens
cacaggcctgtgtagctgtgac

SEQ ID NO: 2424591 - DNA, 24 bp, Homo sapiens
cacaggcctgtgtagctgtgacct

SEQ ID NO: 2424592 - DNA, 15 bp, Homo sapiens
cacagggcagtacct

SEQ ID NO: 2424593 - DNA, 14 bp, Homo sapiens
cacagggcggtacc

SEQ ID NO: 2424594 - DNA, 15 bp, Homo sapiens
cacagggtcccacag

SEQ ID NO: 2424595 - DNA, 17 bp, Homo sapiens
cacagggtcccacagcc

SEQ ID NO: 2424596 - DNA, 18 bp, Homo sapiens
cacagggtcccacagcca

SEQ ID NO: 2424597 - DNA, 19 bp, Homo sapiens
cacagtacgaacctacagt

SEQ ID NO: 2424598 - DNA, 13 bp, Homo sapiens
cacagtagtcttg

SEQ ID NO: 2424599 - DNA, 15 bp, Homo sapiens
cacagtcactgctct

SEQ ID NO: 2424600 - DNA, 17 bp, Homo sapiens
cacagtgacttctgaga

SEQ ID NO: 2424601 - DNA, 18 bp, Homo sapiens
cacagtgctcttttctcc

SEQ ID NO: 2424602 - DNA, 19 bp, Homo sapiens
cacagttctttgggccaga

SEQ ID NO: 2424603 - DNA, 21 bp, Homo sapiens
cacagttctttgggccagaca

SEQ ID NO: 2424604 - DNA, 16 bp, Homo sapiens
cacatacgtgcacagg

SEQ ID NO: 2424605 - DNA, 18 bp, Homo sapiens
cacatacgtgcacagggt

SEQ ID NO: 2424606 - DNA, 20 bp, Homo sapiens
cacatagcccacttacattt

SEQ ID NO: 2424607 - DNA, 17 bp, Homo sapiens
cacatatttcagtgagg

SEQ ID NO: 2424608 - DNA, 12 bp, Homo sapiens
cacatattttaa

SEQ ID NO: 2424609 - DNA, 17 bp, Homo sapiens
cacatattttaaaattt

SEQ ID NO: 2424610 - DNA, 20 bp, Homo sapiens
cacatcacaagactatgcca

SEQ ID NO: 2424611 - DNA, 16 bp, Homo sapiens
cacatccctgggcctg

SEQ ID NO: 2424612 - DNA, 20 bp, Homo sapiens
cacatccctgggcctgctgc

SEQ ID NO: 2424613 - DNA, 22 bp, Homo sapiens
cacatcctccacgttctgctca

SEQ ID NO: 2424614 - DNA, 14 bp, Homo sapiens
cacatctcaacagg

SEQ ID NO: 2424615 - DNA, 21 bp, Homo sapiens
cacatctcaacaggcctcagg

SEQ ID NO: 2424616 - DNA, 13 bp, Homo sapiens
cacatctgcattt

SEQ ID NO: 2424617 - DNA, 22 bp, Homo sapiens
cacatgaattattacagtgttt

SEQ ID NO: 2424618 - DNA, 12 bp, Homo sapiens
cacatgtgtggt

SEQ ID NO: 2424619 - DNA, 21 bp, Homo sapiens
cacattaggaaaagttgctat

SEQ ID NO: 2424620 - DNA, 17 bp, Homo sapiens
cacatttgtcagtattt

SEQ ID NO: 2424621 - DNA, 14 bp, Homo sapiens
caccaaatcaaaat

SEQ ID NO: 2424622 - DNA, 16 bp, Homo sapiens
caccaaatcaaaatct

SEQ ID NO: 2424623 - DNA, 18 bp, Homo sapiens
caccaaatcaaaatctct

SEQ ID NO: 2424624 - DNA, 16 bp, Homo sapiens
caccaaccctcagggc

SEQ ID NO: 2424625 - DNA, 21 bp, Homo sapiens
caccaagcaggaaatgaaaat

SEQ ID NO: 2424626 - DNA, 16 bp, Homo sapiens
caccaagctaggtgct

SEQ ID NO: 2424627 - DNA, 21 bp, Homo sapiens
caccaagtgcgggtccggcag

SEQ ID NO: 2424628 - DNA, 17 bp, Homo sapiens
caccaatgtacccaccg

SEQ ID NO: 2424629 - DNA, 13 bp, Homo sapiens
caccacagccagc

SEQ ID NO: 2424630 - DNA, 13 bp, Homo sapiens
caccaccaagcca

SEQ ID NO: 2424631 - DNA, 15 bp, Homo sapiens
caccagacacccagg

SEQ ID NO: 2424632 - DNA, 20 bp, Homo sapiens
caccagacacccaggactta

SEQ ID NO: 2424633 - DNA, 23 bp, Homo sapiens
caccagatgctgaaaatgtcctt

SEQ ID NO: 2424634 - DNA, 13 bp, Homo sapiens
caccaggccacct

SEQ ID NO: 2424635 - DNA, 16 bp, Homo sapiens
caccagggcatctctg

SEQ ID NO: 2424636 - DNA, 19 bp, Homo sapiens
caccagggttgaccccaga

SEQ ID NO: 2424637 - DNA, 23 bp, Homo sapiens
caccagggttgaccccagaggat

SEQ ID NO: 2424638 - DNA, 11 bp, Homo sapiens
caccagttctc

SEQ ID NO: 2424639 - DNA, 17 bp, Homo sapiens
caccatgattcctttaa

SEQ ID NO: 2424640 - DNA, 16 bp, Homo sapiens
caccatggccagccaa

SEQ ID NO: 2424641 - DNA, 15 bp, Homo sapiens
caccattgaaggctt

SEQ ID NO: 2424642 - DNA, 17 bp, Homo sapiens
caccatttggcaatgcc

SEQ ID NO: 2424643 - DNA, 23 bp, Homo sapiens
caccatttggcatccctgggcct

SEQ ID NO: 2424644 - DNA, 24 bp, Homo sapiens
caccatttggcatccctgggcctt

SEQ ID NO: 2424645 - DNA, 20 bp, Homo sapiens
cacccaccaaccctcagggc

SEQ ID NO: 2424646 - DNA, 14 bp, Homo sapiens
cacccacccctgca

SEQ ID NO: 2424647 - DNA, 16 bp, Homo sapiens
cacccacccctgcaca

SEQ ID NO: 2424648 - DNA, 23 bp, Homo sapiens
cacccagacataaaggaaaagac

SEQ ID NO: 2424649 - DNA, 14 bp, Homo sapiens
cacccaggggcagc

SEQ ID NO: 2424650 - DNA, 16 bp, Homo sapiens
cacccagtgccctctc

SEQ ID NO: 2424651 - DNA, 22 bp, Homo sapiens
cacccagtttccttgggagttg

SEQ ID NO: 2424652 - DNA, 18 bp, Homo sapiens
cacccatctgtctgccaa

SEQ ID NO: 2424653 - DNA, 19 bp, Homo sapiens
caccccaaagctttcctgc

SEQ ID NO: 2424654 - DNA, 20 bp, Homo sapiens
caccccaacctgctctcctc

SEQ ID NO: 2424655 - DNA, 15 bp, Homo sapiens
caccccaatcctccc

SEQ ID NO: 2424656 - DNA, 13 bp, Homo sapiens
caccccattcccg

SEQ ID NO: 2424657 - DNA, 17 bp, Homo sapiens
caccccattcccgcagt

SEQ ID NO: 2424658 - DNA, 19 bp, Homo sapiens
caccccattcccgcagtgg

SEQ ID NO: 2424659 - DNA, 11 bp, Homo sapiens
cacccccaccc

SEQ ID NO: 2424660 - DNA, 16 bp, Homo sapiens
cacccccagcctgggc

SEQ ID NO: 2424661 - DNA, 19 bp, Homo sapiens
cacccccagcctgggccta

SEQ ID NO: 2424662 - DNA, 14 bp, Homo sapiens
cacccccagctcaa

SEQ ID NO: 2424663 - DNA, 21 bp, Homo sapiens
cacccccggcagcagccccca

SEQ ID NO: 2424664 - DNA, 18 bp, Homo sapiens
cacccccttctccatcca

SEQ ID NO: 2424665 - DNA, 14 bp, Homo sapiens
caccccctttcctg

SEQ ID NO: 2424666 - DNA, 13 bp, Homo sapiens
cacccctgcacag

SEQ ID NO: 2424667 - DNA, 15 bp, Homo sapiens
cacccggctgcagag

SEQ ID NO: 2424668 - DNA, 20 bp, Homo sapiens
caccctcactggctctcctg

SEQ ID NO: 2424669 - DNA, 22 bp, Homo sapiens
caccctcggggatgtgtcctga

SEQ ID NO: 2424670 - DNA, 21 bp, Homo sapiens
caccctcttcctactggtctc

SEQ ID NO: 2424671 - DNA, 12 bp, Homo sapiens
caccctgagccg

SEQ ID NO: 2424672 - DNA, 14 bp, Homo sapiens
caccctgagccggc

SEQ ID NO: 2424673 - DNA, 21 bp, Homo sapiens
caccctgaggagtctgaggtc

SEQ ID NO: 2424674 - DNA, 13 bp, Homo sapiens
caccctgccttat

SEQ ID NO: 2424675 - DNA, 18 bp, Homo sapiens
caccctgccttatcttgc

SEQ ID NO: 2424676 - DNA, 23 bp, Homo sapiens
caccctggcctagaccagcagac

SEQ ID NO: 2424677 - DNA, 22 bp, Homo sapiens
caccctgggccctgggctggaa

SEQ ID NO: 2424678 - DNA, 23 bp, Homo sapiens
caccctgggccctgggctggaat

SEQ ID NO: 2424679 - DNA, 17 bp, Homo sapiens
caccctgtactgttctg

SEQ ID NO: 2424680 - DNA, 23 bp, Homo sapiens
caccctgtactgttctgtgtctt

SEQ ID NO: 2424681 - DNA, 15 bp, Homo sapiens
caccctgttcctgct

SEQ ID NO: 2424682 - DNA, 18 bp, Homo sapiens
caccctgttcctgctgct

SEQ ID NO: 2424683 - DNA, 14 bp, Homo sapiens
cacccttcccctcc

SEQ ID NO: 2424684 - DNA, 23 bp, Homo sapiens
cacccttcccctccttctccctt

SEQ ID NO: 2424685 - DNA, 22 bp, Homo sapiens
caccctttgctgtgaggctgtc

SEQ ID NO: 2424686 - DNA, 21 bp, Homo sapiens
cacccttttccagctggatga

SEQ ID NO: 2424687 - DNA, 21 bp, Homo sapiens
caccgaagcccagagggtctg

SEQ ID NO: 2424688 - DNA, 12 bp, Homo sapiens
caccgagtgggg

SEQ ID NO: 2424689 - DNA, 16 bp, Homo sapiens
caccggctctcacctg

SEQ ID NO: 2424690 - DNA, 12 bp, Homo sapiens
caccgggccact

SEQ ID NO: 2424691 - DNA, 13 bp, Homo sapiens
caccgtgggctcc

SEQ ID NO: 2424692 - DNA, 22 bp, Homo sapiens
cacctaatccaggcagatccag

SEQ ID NO: 2424693 - DNA, 21 bp, Homo sapiens
caaattggagcttcatggcag

SEQ ID NO: 2424694 - DNA, 18 bp, Homo sapiens
caaattgtgcagtacttt

SEQ ID NO: 2424695 - DNA, 14 bp, Homo sapiens
caacaaaagaagcc

SEQ ID NO: 2424696 - DNA, 15 bp, Homo sapiens
caacaaagaaacaaa

SEQ ID NO: 2424697 - DNA, 14 bp, Homo sapiens
caacaaagaacact

SEQ ID NO: 2424698 - DNA, 18 bp, Homo sapiens
caacaatttctactttga

SEQ ID NO: 2424699 - DNA, 13 bp, Homo sapiens
caacacaaagatt

SEQ ID NO: 2424700 - DNA, 15 bp, Homo sapiens
caacaccaagcacag

SEQ ID NO: 2424701 - DNA, 15 bp, Homo sapiens
caacacgcacctgcc

SEQ ID NO: 2424702 - DNA, 19 bp, Homo sapiens
caacacgcacctgcctcag

SEQ ID NO: 2424703 - DNA, 22 bp, Homo sapiens
caacactgtagtaaataatgct

SEQ ID NO: 2424704 - DNA, 15 bp, Homo sapiens
caacagcgcccaaag

SEQ ID NO: 2424705 - DNA, 23 bp, Homo sapiens
caacagcgttcctagagaagaca

SEQ ID NO: 2424706 - DNA, 15 bp, Homo sapiens
caacagtttaatgaa

SEQ ID NO: 2424707 - DNA, 13 bp, Homo sapiens
caacagttttcct

SEQ ID NO: 2424708 - DNA, 16 bp, Homo sapiens
caacatcacagcccag

SEQ ID NO: 2424709 - DNA, 18 bp, Homo sapiens
caacatgagtgtattttt

SEQ ID NO: 2424710 - DNA, 15 bp, Homo sapiens
caacatgatgaggta

SEQ ID NO: 2424711 - DNA, 19 bp, Homo sapiens
caacatgttgggaaacttg

SEQ ID NO: 2424712 - DNA, 22 bp, Homo sapiens
caacatgttgggaaacttggct

SEQ ID NO: 2424713 - DNA, 23 bp, Homo sapiens
caacatgttgggaaacttggctc

SEQ ID NO: 2424714 - DNA, 16 bp, Homo sapiens
caacattgtagcctca

SEQ ID NO: 2424715 - DNA, 16 bp, Homo sapiens
caacatttctcaataa

SEQ ID NO: 2424716 - DNA, 17 bp, Homo sapiens
caacatttctcaataat

SEQ ID NO: 2424717 - DNA, 14 bp, Homo sapiens
caaccacacccaca

SEQ ID NO: 2424718 - DNA, 23 bp, Homo sapiens
caaccatgagaccactgttatca

SEQ ID NO: 2424719 - DNA, 13 bp, Homo sapiens
caaccatttcctc

SEQ ID NO: 2424720 - DNA, 14 bp, Homo sapiens
caacccaatgggct

SEQ ID NO: 2424721 - DNA, 22 bp, Homo sapiens
caacccctcccctccatccctg

SEQ ID NO: 2424722 - DNA, 16 bp, Homo sapiens
caacccgtggaggctg

SEQ ID NO: 2424723 - DNA, 17 bp, Homo sapiens
caacccgtggaggctgc

SEQ ID NO: 2424724 - DNA, 21 bp, Homo sapiens
caaccctcagggcaaagccag

SEQ ID NO: 2424725 - DNA, 17 bp, Homo sapiens
caacccttccctcacct

SEQ ID NO: 2424726 - DNA, 18 bp, Homo sapiens
caacctcatcctccttct

SEQ ID NO: 2424727 - DNA, 15 bp, Homo sapiens
caacctcttggcctg

SEQ ID NO: 2424728 - DNA, 23 bp, Homo sapiens
caacctgcccaaagattgatttg

SEQ ID NO: 2424729 - DNA, 15 bp, Homo sapiens
caacctgctctcctc

SEQ ID NO: 2424730 - DNA, 16 bp, Homo sapiens
caacctgctctcctct

SEQ ID NO: 2424731 - DNA, 17 bp, Homo sapiens
caacctgctctcctctt

SEQ ID NO: 2424732 - DNA, 17 bp, Homo sapiens
caaccttagatgttcta

SEQ ID NO: 2424733 - DNA, 14 bp, Homo sapiens
caacgctattccag

SEQ ID NO: 2424734 - DNA, 17 bp, Homo sapiens
caactacccccagctgt

SEQ ID NO: 2424735 - DNA, 19 bp, Homo sapiens
caactactacctgtaatga

SEQ ID NO: 2424736 - DNA, 15 bp, Homo sapiens
caactaggatcagaa

SEQ ID NO: 2424737 - DNA, 16 bp, Homo sapiens
caactatggatcagaa

SEQ ID NO: 2424738 - DNA, 17 bp, Homo sapiens
caactattttcagatgt

SEQ ID NO: 2424739 - DNA, 21 bp, Homo sapiens
caactattttcagatgtgaac

SEQ ID NO: 2424740 - DNA, 15 bp, Homo sapiens
caactcactcctttt

SEQ ID NO: 2424741 - DNA, 17 bp, Homo sapiens
caactcactccttttaa

SEQ ID NO: 2424742 - DNA, 21 bp, Homo sapiens
caactcactccttttaaagaa

SEQ ID NO: 2424743 - DNA, 16 bp, Homo sapiens
caactcgtatagcatg

SEQ ID NO: 2424744 - DNA, 13 bp, Homo sapiens
caactctcttatt

SEQ ID NO: 2424745 - DNA, 21 bp, Homo sapiens
caactcttccccctctcccag

SEQ ID NO: 2424746 - DNA, 16 bp, Homo sapiens
caactctttgagaaac

SEQ ID NO: 2424747 - DNA, 23 bp, Homo sapiens
caactgcctcgaaacacagaaac

SEQ ID NO: 2424748 - DNA, 18 bp, Homo sapiens
caactggccctatttaga

SEQ ID NO: 2424749 - DNA, 23 bp, Homo sapiens
caactggccctatttagatgata

SEQ ID NO: 2424750 - DNA, 23 bp, Homo sapiens
caactgtctcgatgcaatgaaca

SEQ ID NO: 2424751 - DNA, 14 bp, Homo sapiens
caacttcgtttcct

SEQ ID NO: 2424752 - DNA, 14 bp, Homo sapiens
caacttctaattgc

SEQ ID NO: 2424753 - DNA, 18 bp, Homo sapiens
caacttgagcatgttact

SEQ ID NO: 2424754 - DNA, 19 bp, Homo sapiens
caacttgagcatgttactg

SEQ ID NO: 2424755 - DNA, 20 bp, Homo sapiens
caacttgtcctagcacagat

SEQ ID NO: 2424756 - DNA, 13 bp, Homo sapiens
caacttttctatt

SEQ ID NO: 2424757 - DNA, 20 bp, Homo sapiens
caagaaaaataaagaaaaga

SEQ ID NO: 2424758 - DNA, 17 bp, Homo sapiens
caagaaaacaggcactg

SEQ ID NO: 2424759 - DNA, 18 bp, Homo sapiens
caagaaaataagagctca

SEQ ID NO: 2424760 - DNA, 13 bp, Homo sapiens
caagaaataaaag

SEQ ID NO: 2424761 - DNA, 20 bp, Homo sapiens
caagaaataaaaggaagcca

SEQ ID NO: 2424762 - DNA, 21 bp, Homo sapiens
caagaaataaaaggaagccaa

SEQ ID NO: 2424763 - DNA, 14 bp, Homo sapiens
caagaagcagtggc

SEQ ID NO: 2424764 - DNA, 18 bp, Homo sapiens
caagaagcagtggcctta

SEQ ID NO: 2424765 - DNA, 23 bp, Homo sapiens
caagaagcattttgtaagttgaa

SEQ ID NO: 2424766 - DNA, 16 bp, Homo sapiens
caagaaggcaaaaata

SEQ ID NO: 2424767 - DNA, 18 bp, Homo sapiens
caagaatccacatttcta

SEQ ID NO: 2424768 - DNA, 13 bp, Homo sapiens
caagaatggatca

SEQ ID NO: 2424769 - DNA, 14 bp, Homo sapiens
caagaatggatcac

SEQ ID NO: 2424770 - DNA, 14 bp, Homo sapiens
caagacccccagca

SEQ ID NO: 2424771 - DNA, 21 bp, Homo sapiens
caagacccttttgggtttctg

SEQ ID NO: 2424772 - DNA, 18 bp, Homo sapiens
caagagcatcatgcctct

SEQ ID NO: 2424773 - DNA, 21 bp, Homo sapiens
caagagcatcatgcctctgag

SEQ ID NO: 2424774 - DNA, 22 bp, Homo sapiens
caagagctacgtatttaatagc

SEQ ID NO: 2424775 - DNA, 19 bp, Homo sapiens
caagagggacgcctggggg

SEQ ID NO: 2424776 - DNA, 14 bp, Homo sapiens
caagagtctaaaga

SEQ ID NO: 2424777 - DNA, 15 bp, Homo sapiens
caagagtctaaagat

SEQ ID NO: 2424778 - DNA, 18 bp, Homo sapiens
caagatgggcatcttttg

SEQ ID NO: 2424779 - DNA, 10 bp, Homo sapiens
caagattccg

SEQ ID NO: 2424780 - DNA, 18 bp, Homo sapiens
caagattccggatcctaa

SEQ ID NO: 2424781 - DNA, 12 bp, Homo sapiens
caagattctaga

SEQ ID NO: 2424782 - DNA, 17 bp, Homo sapiens
caagattctagatgatt

SEQ ID NO: 2424783 - DNA, 19 bp, Homo sapiens
caagattgagctctctgcc

SEQ ID NO: 2424784 - DNA, 22 bp, Homo sapiens
caagattggtgtttttttctat

SEQ ID NO: 2424785 - DNA, 17 bp, Homo sapiens
caagcacagcagcctgg

SEQ ID NO: 2424786 - DNA, 22 bp, Homo sapiens
caagcaccaccaaacacagtgt

SEQ ID NO: 2424787 - DNA, 22 bp, Homo sapiens
caagcagcgaccgccccctcct

SEQ ID NO: 2424788 - DNA, 13 bp, Homo sapiens
caagcagcttaga

SEQ ID NO: 2424789 - DNA, 18 bp, Homo sapiens
caagcagcttagagttgg

SEQ ID NO: 2424790 - DNA, 23 bp, Homo sapiens
caagcaggaaatgaaaatgtctt

SEQ ID NO: 2424791 - DNA, 15 bp, Homo sapiens
caaaacccagacctg

SEQ ID NO: 2424792 - DNA, 15 bp, Homo sapiens
caaaaccccccagat

SEQ ID NO: 2424793 - DNA, 19 bp, Homo sapiens
caaaaccccccagatatca

SEQ ID NO: 2424794 - DNA, 17 bp, Homo sapiens
caaaaccgccagctctg

SEQ ID NO: 2424795 - DNA, 18 bp, Homo sapiens
caaaaccgccagctctgt

SEQ ID NO: 2424796 - DNA, 15 bp, Homo sapiens
caaaagaagaagttt

SEQ ID NO: 2424797 - DNA, 17 bp, Homo sapiens
caaaagaagcccccagc

SEQ ID NO: 2424798 - DNA, 19 bp, Homo sapiens
caaaagaagcccccagcta

SEQ ID NO: 2424799 - DNA, 20 bp, Homo sapiens
caaaagaagcccggctcctg

SEQ ID NO: 2424800 - DNA, 22 bp, Homo sapiens
caaaagaagcccggctcctggt

SEQ ID NO: 2424801 - DNA, 18 bp, Homo sapiens
caaaagcttacaaatact

SEQ ID NO: 2424802 - DNA, 17 bp, Homo sapiens
caaaatagggtatattt

SEQ ID NO: 2424803 - DNA, 18 bp, Homo sapiens
caaaatagggtatatttt

SEQ ID NO: 2424804 - DNA, 16 bp, Homo sapiens
caaaatagtgccacta

SEQ ID NO: 2424805 - DNA, 20 bp, Homo sapiens
caaaatatattttgtttaca

SEQ ID NO: 2424806 - DNA, 16 bp, Homo sapiens
caaaatctctccactt

SEQ ID NO: 2424807 - DNA, 22 bp, Homo sapiens
caaaatcttgatcagttaagaa

SEQ ID NO: 2424808 - DNA, 16 bp, Homo sapiens
caaaattgcaaatctt

SEQ ID NO: 2424809 - DNA, 17 bp, Homo sapiens
caaaattgcaaatcttg

SEQ ID NO: 2424810 - DNA, 20 bp, Homo sapiens
caaacaaaaaggttctcagg

SEQ ID NO: 2424811 - DNA, 21 bp, Homo sapiens
caaacaaaaaggttctcaggt

SEQ ID NO: 2424812 - DNA, 21 bp, Homo sapiens
caaacaccttccagctcctgt

SEQ ID NO: 2424813 - DNA, 12 bp, Homo sapiens
caaacattttga

SEQ ID NO: 2424814 - DNA, 15 bp, Homo sapiens
caaacattttgaaag

SEQ ID NO: 2424815 - DNA, 20 bp, Homo sapiens
caaacattttgaaagtctgt

SEQ ID NO: 2424816 - DNA, 23 bp, Homo sapiens
caaaccagatacggacagagacc

SEQ ID NO: 2424817 - DNA, 17 bp, Homo sapiens
caaaccagtatcgctca

SEQ ID NO: 2424818 - DNA, 15 bp, Homo sapiens
caaaccctagccttg

SEQ ID NO: 2424819 - DNA, 23 bp, Homo sapiens
caaacgccctttcctcctcaggc

SEQ ID NO: 2424820 - DNA, 19 bp, Homo sapiens
caaactctttggtcgtttt

SEQ ID NO: 2424821 - DNA, 17 bp, Homo sapiens
caaactgaagcagcctc

SEQ ID NO: 2424822 - DNA, 23 bp, Homo sapiens
caaactgaagcagcctctcccca

SEQ ID NO: 2424823 - DNA, 13 bp, Homo sapiens
caaactgcatgcc

SEQ ID NO: 2424824 - DNA, 16 bp, Homo sapiens
caaactgcatgcccag

SEQ ID NO: 2424825 - DNA, 19 bp, Homo sapiens
caaactgcatgcccagaga

SEQ ID NO: 2424826 - DNA, 20 bp, Homo sapiens
caaactgtaaataaaaagaa

SEQ ID NO: 2424827 - DNA, 21 bp, Homo sapiens
caaactgtaaataaaaagaaa

SEQ ID NO: 2424828 - DNA, 14 bp, Homo sapiens
caaactgtaataca

SEQ ID NO: 2424829 - DNA, 20 bp, Homo sapiens
caaactttgcatctcagtat

SEQ ID NO: 2424830 - DNA, 16 bp, Homo sapiens
caaagaaagtgtattg

SEQ ID NO: 2424831 - DNA, 21 bp, Homo sapiens
caaagaaggcatttgcagggt

SEQ ID NO: 2424832 - DNA, 22 bp, Homo sapiens
caaagacttaagcccagtgcac

SEQ ID NO: 2424833 - DNA, 22 bp, Homo sapiens
caaagaggctgaggctggcaca

SEQ ID NO: 2424834 - DNA, 16 bp, Homo sapiens
caaagaggctgcccct

SEQ ID NO: 2424835 - DNA, 14 bp, Homo sapiens
caaagagtagaatt

SEQ ID NO: 2424836 - DNA, 15 bp, Homo sapiens
caaagagttcaagaa

SEQ ID NO: 2424837 - DNA, 17 bp, Homo sapiens
caaagagttcaagaaat

SEQ ID NO: 2424838 - DNA, 11 bp, Homo sapiens
caaagatgctg

SEQ ID NO: 2424839 - DNA, 13 bp, Homo sapiens
caaagcaaggaaa

SEQ ID NO: 2424840 - DNA, 19 bp, Homo sapiens
caaagcacagagagtctgg

SEQ ID NO: 2424841 - DNA, 22 bp, Homo sapiens
caaagcacgaaatgttattttt

SEQ ID NO: 2424842 - DNA, 12 bp, Homo sapiens
caaagcagacag

SEQ ID NO: 2424843 - DNA, 15 bp, Homo sapiens
caaagcagacagctc

SEQ ID NO: 2424844 - DNA, 12 bp, Homo sapiens
caaagcagccac

SEQ ID NO: 2424845 - DNA, 20 bp, Homo sapiens
caaagccagcgtcctcctct

SEQ ID NO: 2424846 - DNA, 18 bp, Homo sapiens
caaagccaggtccctctc

SEQ ID NO: 2424847 - DNA, 21 bp, Homo sapiens
caaagccaggtccctctcatt

SEQ ID NO: 2424848 - DNA, 16 bp, Homo sapiens
caaagcccccagagcc

SEQ ID NO: 2424849 - DNA, 17 bp, Homo sapiens
caaagcccccagagccc

SEQ ID NO: 2424850 - DNA, 18 bp, Homo sapiens
caaagcccccagagccca

SEQ ID NO: 2424851 - DNA, 12 bp, Homo sapiens
caaagctgcctg

SEQ ID NO: 2424852 - DNA, 14 bp, Homo sapiens
caaagctttcctgc

SEQ ID NO: 2424853 - DNA, 13 bp, Homo sapiens
caaaggacgcact

SEQ ID NO: 2424854 - DNA, 13 bp, Homo sapiens
caaaggagcctgt

SEQ ID NO: 2424855 - DNA, 23 bp, Homo sapiens
caaaggagcctgtgaacccagga

SEQ ID NO: 2424856 - DNA, 18 bp, Homo sapiens
caaaggagcgagcatgtc

SEQ ID NO: 2424857 - DNA, 13 bp, Homo sapiens
caaaggatgtgat

SEQ ID NO: 2424858 - DNA, 18 bp, Homo sapiens
caaagggagtctgccagg

SEQ ID NO: 2424859 - DNA, 12 bp, Homo sapiens
caaaggttctag

SEQ ID NO: 2424860 - DNA, 16 bp, Homo sapiens
caaaggtttaaatgaa

SEQ ID NO: 2424861 - DNA, 20 bp, Homo sapiens
caaaggtttaaatgaacaag

SEQ ID NO: 2424862 - DNA, 23 bp, Homo sapiens
caaagtcctttttttccatcttt

SEQ ID NO: 2424863 - DNA, 14 bp, Homo sapiens
caaagtctctaatt

SEQ ID NO: 2424864 - DNA, 15 bp, Homo sapiens
caaagtgctgagatt

SEQ ID NO: 2424865 - DNA, 15 bp, Homo sapiens
caaagtggaacgaaa

SEQ ID NO: 2424866 - DNA, 17 bp, Homo sapiens
caaatactaatgaaaac

SEQ ID NO: 2424867 - DNA, 15 bp, Homo sapiens
caaatagcataagtt

SEQ ID NO: 2424868 - DNA, 21 bp, Homo sapiens
caaatatttagatgtaatttt

SEQ ID NO: 2424869 - DNA, 18 bp, Homo sapiens
caaatcacatattttaaa

SEQ ID NO: 2424870 - DNA, 16 bp, Homo sapiens
caaatcatttgtttaa

SEQ ID NO: 2424871 - DNA, 19 bp, Homo sapiens
caaatcgtccagcgacctt

SEQ ID NO: 2424872 - DNA, 21 bp, Homo sapiens
caaatcgtccagcgaccttcc

SEQ ID NO: 2424873 - DNA, 19 bp, Homo sapiens
caaatcttgaaattaagaa

SEQ ID NO: 2424874 - DNA, 13 bp, Homo sapiens
caaatgagccatg

SEQ ID NO: 2424875 - DNA, 19 bp, Homo sapiens
caaatgagtaacatttgct

SEQ ID NO: 2424876 - DNA, 22 bp, Homo sapiens
caaatggattttgggagtgact

SEQ ID NO: 2424877 - DNA, 19 bp, Homo sapiens
caaatggcgtctggaagtc

SEQ ID NO: 2424878 - DNA, 14 bp, Homo sapiens
caaatggggccaga

SEQ ID NO: 2424879 - DNA, 16 bp, Homo sapiens
caaatggggccagatc

SEQ ID NO: 2424880 - DNA, 18 bp, Homo sapiens
caaatggggccagatcca

SEQ ID NO: 2424881 - DNA, 20 bp, Homo sapiens
caaatggggccagatccagc

SEQ ID NO: 2424882 - DNA, 13 bp, Homo sapiens
caaatggtatctt

SEQ ID NO: 2424883 - DNA, 17 bp, Homo sapiens
caaatgtcatgctgcct

SEQ ID NO: 2424884 - DNA, 18 bp, Homo sapiens
caaatgtcatgctgcctt

SEQ ID NO: 2424885 - DNA, 18 bp, Homo sapiens
caaatgtgctttgagaag

SEQ ID NO: 2424886 - DNA, 18 bp, Homo sapiens
caaatgttaaaatgtgtt

SEQ ID NO: 2424887 - DNA, 19 bp, Homo sapiens
caaatgttaaaatgtgttg

SEQ ID NO: 2424888 - DNA, 15 bp, Homo sapiens
caaatgttctaagtt

SEQ ID NO: 2424889 - DNA, 22 bp, Homo sapiens
caaatgttctaagtttctaaga

SEQ ID NO: 2424890 - DNA, 15 bp, Homo sapiens
caaattaaaaaagat

SEQ ID NO: 2424891 - DNA, 17 bp, Homo sapiens
caaattaaaaaagataa

SEQ ID NO: 2424892 - DNA, 14 bp, Homo sapiens
cagcaaagccccca

SEQ ID NO: 2424893 - DNA, 18 bp, Homo sapiens
cagcaaagcccccagagc

SEQ ID NO: 2424894 - DNA, 17 bp, Homo sapiens
cagcaaccccaggctga

SEQ ID NO: 2424895 - DNA, 20 bp, Homo sapiens
cagcaagacttctctttgcc

SEQ ID NO: 2424896 - DNA, 23 bp, Homo sapiens
cagcaagacttctctttgcctca

SEQ ID NO: 2424897 - DNA, 15 bp, Homo sapiens
cagcaaggcccgagc

SEQ ID NO: 2424898 - DNA, 20 bp, Homo sapiens
cagcacaaattagttatata

SEQ ID NO: 2424899 - DNA, 19 bp, Homo sapiens
cagcacacagggcagtgag

SEQ ID NO: 2424900 - DNA, 22 bp, Homo sapiens
cagcacagcttagatttcatag

SEQ ID NO: 2424901 - DNA, 15 bp, Homo sapiens
cagcacagcttgacc

SEQ ID NO: 2424902 - DNA, 16 bp, Homo sapiens
cagcacagcttgacct

SEQ ID NO: 2424903 - DNA, 20 bp, Homo sapiens
cagcacagcttgacctgagg

SEQ ID NO: 2424904 - DNA, 21 bp, Homo sapiens
cagcacagcttgacctgaggc

SEQ ID NO: 2424905 - DNA, 21 bp, Homo sapiens
cagcaccggaccagcctggcc

SEQ ID NO: 2424906 - DNA, 17 bp, Homo sapiens
cagcaccgttctgtgca

SEQ ID NO: 2424907 - DNA, 18 bp, Homo sapiens
cagcaccgttctgtgcac

SEQ ID NO: 2424908 - DNA, 12 bp, Homo sapiens
cagcacctgccc

SEQ ID NO: 2424909 - DNA, 21 bp, Homo sapiens
cagcactagccaaacctcacc

SEQ ID NO: 2424910 - DNA, 17 bp, Homo sapiens
cagcactgcctgctccc

SEQ ID NO: 2424911 - DNA, 18 bp, Homo sapiens
cagcactgcctgctccca

SEQ ID NO: 2424912 - DNA, 18 bp, Homo sapiens
cagcactgcttgaggaaa

SEQ ID NO: 2424913 - DNA, 20 bp, Homo sapiens
cagcactgtcccttgcctca

SEQ ID NO: 2424914 - DNA, 13 bp, Homo sapiens
cagcacttattta

SEQ ID NO: 2424915 - DNA, 23 bp, Homo sapiens
cagcacttgggggttcaggcccg

SEQ ID NO: 2424916 - DNA, 15 bp, Homo sapiens
cagcacttgtccagc

SEQ ID NO: 2424917 - DNA, 21 bp, Homo sapiens
cagcagacagagccaggagaa

SEQ ID NO: 2424918 - DNA, 23 bp, Homo sapiens
cagcagagaggtttgcagtccca

SEQ ID NO: 2424919 - DNA, 12 bp, Homo sapiens
cagcagcatctc

SEQ ID NO: 2424920 - DNA, 15 bp, Homo sapiens
cagcagccagccctg

SEQ ID NO: 2424921 - DNA, 18 bp, Homo sapiens
cagcagccccacaccagg

SEQ ID NO: 2424922 - DNA, 13 bp, Homo sapiens
cagcagcccccag

SEQ ID NO: 2424923 - DNA, 20 bp, Homo sapiens
cagcatccccttgaactctt

SEQ ID NO: 2424924 - DNA, 20 bp, Homo sapiens
cagcatccgcaggtgctggt

SEQ ID NO: 2424925 - DNA, 23 bp, Homo sapiens
cagcatccgcaggtgctggtccc

SEQ ID NO: 2424926 - DNA, 16 bp, Homo sapiens
cagcatctccaagcag

SEQ ID NO: 2424927 - DNA, 17 bp, Homo sapiens
cagcatctccaagcagc

SEQ ID NO: 2424928 - DNA, 13 bp, Homo sapiens
cagcatctgggcc

SEQ ID NO: 2424929 - DNA, 14 bp, Homo sapiens
cagcatctgggcct

SEQ ID NO: 2424930 - DNA, 15 bp, Homo sapiens
cagcatctgggcctt

SEQ ID NO: 2424931 - DNA, 15 bp, Homo sapiens
cagccaaaccctgtc

SEQ ID NO: 2424932 - DNA, 14 bp, Homo sapiens
cagccaaatttaaa

SEQ ID NO: 2424933 - DNA, 22 bp, Homo sapiens
cagccaaatttaaaactgttgg

SEQ ID NO: 2424934 - DNA, 22 bp, Homo sapiens
cagccaactagcccctggggtg

SEQ ID NO: 2424935 - DNA, 16 bp, Homo sapiens
cagccaagcacctcca

SEQ ID NO: 2424936 - DNA, 12 bp, Homo sapiens
cagccaccctga

SEQ ID NO: 2424937 - DNA, 16 bp, Homo sapiens
cagccaccctgaggag

SEQ ID NO: 2424938 - DNA, 19 bp, Homo sapiens
cagccaccctgaggagtct

SEQ ID NO: 2424939 - DNA, 18 bp, Homo sapiens
cagccacgaggtgcaaca

SEQ ID NO: 2424940 - DNA, 14 bp, Homo sapiens
cagccagcacctgg

SEQ ID NO: 2424941 - DNA, 15 bp, Homo sapiens
cagccagccctgcct

SEQ ID NO: 2424942 - DNA, 20 bp, Homo sapiens
cagccagccctgcctggagg

SEQ ID NO: 2424943 - DNA, 22 bp, Homo sapiens
cagccagccctgcctggaggac

SEQ ID NO: 2424944 - DNA, 11 bp, Homo sapiens
cagccagcctc

SEQ ID NO: 2424945 - DNA, 22 bp, Homo sapiens
cagccagcgtcggtctgtgccc

SEQ ID NO: 2424946 - DNA, 23 bp, Homo sapiens
cagccagcgtcggtctgtgcccc

SEQ ID NO: 2424947 - DNA, 13 bp, Homo sapiens
cagccaggcccag

SEQ ID NO: 2424948 - DNA, 21 bp, Homo sapiens
cagccaggcccagccgacccc

SEQ ID NO: 2424949 - DNA, 14 bp, Homo sapiens
cagccagggagagc

SEQ ID NO: 2424950 - DNA, 16 bp, Homo sapiens
cagccagggagagccc

SEQ ID NO: 2424951 - DNA, 18 bp, Homo sapiens
cagccagggagagcccag

SEQ ID NO: 2424952 - DNA, 19 bp, Homo sapiens
cagccagggagagcccagg

SEQ ID NO: 2424953 - DNA, 21 bp, Homo sapiens
cagccagggagagcccaggag

SEQ ID NO: 2424954 - DNA, 16 bp, Homo sapiens
cagccagggctcaatc

SEQ ID NO: 2424955 - DNA, 18 bp, Homo sapiens
cagccagtgccctgagcc

SEQ ID NO: 2424956 - DNA, 21 bp, Homo sapiens
cagccagtgccctgagccagg

SEQ ID NO: 2424957 - DNA, 18 bp, Homo sapiens
cagcccaagtgaggcagc

SEQ ID NO: 2424958 - DNA, 22 bp, Homo sapiens
cagcccaagtgaggcagccgag

SEQ ID NO: 2424959 - DNA, 20 bp, Homo sapiens
cagcccacccccggcagcag

SEQ ID NO: 2424960 - DNA, 22 bp, Homo sapiens
cagcccagagacatacttgaag

SEQ ID NO: 2424961 - DNA, 18 bp, Homo sapiens
cagcccagggctcctgca

SEQ ID NO: 2424962 - DNA, 14 bp, Homo sapiens
cagccccacaccag

SEQ ID NO: 2424963 - DNA, 21 bp, Homo sapiens
cagccccacaccagggccagc

SEQ ID NO: 2424964 - DNA, 23 bp, Homo sapiens
cagccccacaccagggccagcct

SEQ ID NO: 2424965 - DNA, 21 bp, Homo sapiens
cagccccaccccagggcagcc

SEQ ID NO: 2424966 - DNA, 11 bp, Homo sapiens
caggccacctc

SEQ ID NO: 2424967 - DNA, 19 bp, Homo sapiens
caggccacctccccagcat

SEQ ID NO: 2424968 - DNA, 17 bp, Homo sapiens
caggccacctggctctc

SEQ ID NO: 2424969 - DNA, 14 bp, Homo sapiens
caggccaggactct

SEQ ID NO: 2424970 - DNA, 16 bp, Homo sapiens
caggccaggactctgc

SEQ ID NO: 2424971 - DNA, 17 bp, Homo sapiens
caggccaggactctgca

SEQ ID NO: 2424972 - DNA, 21 bp, Homo sapiens
caggccaggactctgcagcct

SEQ ID NO: 2424973 - DNA, 17 bp, Homo sapiens
caggcccaaggctcccg

SEQ ID NO: 2424974 - DNA, 17 bp, Homo sapiens
caggcccactgtgcctc

SEQ ID NO: 2424975 - DNA, 21 bp, Homo sapiens
caggcccagccgaccccctct

SEQ ID NO: 2424976 - DNA, 20 bp, Homo sapiens
caggccccatgacctccagc

SEQ ID NO: 2424977 - DNA, 21 bp, Homo sapiens
caggccccgtgaggcaatggg

SEQ ID NO: 2424978 - DNA, 16 bp, Homo sapiens
caggcccggcagggcg

SEQ ID NO: 2424979 - DNA, 15 bp, Homo sapiens
caggccctggcctcc

SEQ ID NO: 2424980 - DNA, 22 bp, Homo sapiens
caggccctggcctcccctgcca

SEQ ID NO: 2424981 - DNA, 14 bp, Homo sapiens
caggccgccctgcg

SEQ ID NO: 2424982 - DNA, 17 bp, Homo sapiens
caggccgtgacgtctgg

SEQ ID NO: 2424983 - DNA, 18 bp, Homo sapiens
caggccgtgacgtctggg

SEQ ID NO: 2424984 - DNA, 19 bp, Homo sapiens
caggccgtgacgtctgggt

SEQ ID NO: 2424985 - DNA, 17 bp, Homo sapiens
caggcctcagggctcct

SEQ ID NO: 2424986 - DNA, 23 bp, Homo sapiens
caggcctgaaagaggctgaggcc

SEQ ID NO: 2424987 - DNA, 18 bp, Homo sapiens
caggcctgtgtagctgtg

SEQ ID NO: 2424988 - DNA, 21 bp, Homo sapiens
caggcctgtgtagctgtgacc

SEQ ID NO: 2424989 - DNA, 23 bp, Homo sapiens
caggcctgtgtagctgtgacctg

SEQ ID NO: 2424990 - DNA, 20 bp, Homo sapiens
caggcgatccacctgtctca

SEQ ID NO: 2424991 - DNA, 14 bp, Homo sapiens
caggctaggccagc

SEQ ID NO: 2424992 - DNA, 21 bp, Homo sapiens
caggctaggccagcaggggct

SEQ ID NO: 2424993 - DNA, 14 bp, Homo sapiens
caggctcaggcagg

SEQ ID NO: 2424994 - DNA, 15 bp, Homo sapiens
caggctcaggcaggg

SEQ ID NO: 2424995 - DNA, 19 bp, Homo sapiens
caggctcaggcaggggcct

SEQ ID NO: 2424996 - DNA, 14 bp, Homo sapiens
caggctcccaggga

SEQ ID NO: 2424997 - DNA, 16 bp, Homo sapiens
caggctcccagggaca

SEQ ID NO: 2424998 - DNA, 19 bp, Homo sapiens
cagaagcctgggggcctgg

SEQ ID NO: 2424999 - DNA, 22 bp, Homo sapiens
cagaagcctgggggcctggctg

SEQ ID NO: 2425000 - DNA, 23 bp, Homo sapiens
cagaagcctgggggcctggctgg

SEQ ID NO: 2425001 - DNA, 18 bp, Homo sapiens
cagaagctcccccagcaa

SEQ ID NO: 2425002 - DNA, 16 bp, Homo sapiens
cagaagggagggcaga

SEQ ID NO: 2425003 - DNA, 23 bp, Homo sapiens
cagaagggagggcagagctggtg

SEQ ID NO: 2425004 - DNA, 17 bp, Homo sapiens
cagaagtcatcttgcta

SEQ ID NO: 2425005 - DNA, 16 bp, Homo sapiens
cagaagttagtttgta

SEQ ID NO: 2425006 - DNA, 19 bp, Homo sapiens
cagaagttagtttgtatat

SEQ ID NO: 2425007 - DNA, 18 bp, Homo sapiens
cagaagtttgcactatct

SEQ ID NO: 2425008 - DNA, 15 bp, Homo sapiens
cagaataagttattg

SEQ ID NO: 2425009 - DNA, 21 bp, Homo sapiens
cagaatagccacatttggaat

SEQ ID NO: 2425010 - DNA, 13 bp, Homo sapiens
cagaatcccttaa

SEQ ID NO: 2425011 - DNA, 16 bp, Homo sapiens
cagaatgctgtacatc

SEQ ID NO: 2425012 - DNA, 21 bp, Homo sapiens
cagaatgtgataaggaaatca

SEQ ID NO: 2425013 - DNA, 23 bp, Homo sapiens
cagaattttatactttccctacc

SEQ ID NO: 2425014 - DNA, 17 bp, Homo sapiens
cagacacccaggactta

SEQ ID NO: 2425015 - DNA, 18 bp, Homo sapiens
cagacaccttggacatcc

SEQ ID NO: 2425016 - DNA, 23 bp, Homo sapiens
cagacagagccaggagaagctca

SEQ ID NO: 2425017 - DNA, 11 bp, Homo sapiens
cagacagatga

SEQ ID NO: 2425018 - DNA, 21 bp, Homo sapiens
cagacagctccaccctggccg

SEQ ID NO: 2425019 - DNA, 18 bp, Homo sapiens
cagacaggcaaataaaag

SEQ ID NO: 2425020 - DNA, 20 bp, Homo sapiens
cagacaggctcttagcagct

SEQ ID NO: 2425021 - DNA, 22 bp, Homo sapiens
cagacaggctcttagcagcttc

SEQ ID NO: 2425022 - DNA, 22 bp, Homo sapiens
cagacagggaattaggccccca

SEQ ID NO: 2425023 - DNA, 17 bp, Homo sapiens
ccgaggacccaggaaag

SEQ ID NO: 2425024 - DNA, 19 bp, Homo sapiens
ccgagtcattcgttctgtg

SEQ ID NO: 2425025 - DNA, 13 bp, Homo sapiens
ccgatgcccagag

SEQ ID NO: 2425026 - DNA, 16 bp, Homo sapiens
ccgatgcccagagaca

SEQ ID NO: 2425027 - DNA, 16 bp, Homo sapiens
ccgattgtaactcaaa

SEQ ID NO: 2425028 - DNA, 16 bp, Homo sapiens
ccgcagacaccttgga

SEQ ID NO: 2425029 - DNA, 16 bp, Homo sapiens
ccgcagtgggagcaaa

SEQ ID NO: 2425030 - DNA, 17 bp, Homo sapiens
ccgcagtgggagcaaac

SEQ ID NO: 2425031 - DNA, 16 bp, Homo sapiens
ccgccactggggctca

SEQ ID NO: 2425032 - DNA, 14 bp, Homo sapiens
ccgccagctctgtt

SEQ ID NO: 2425033 - DNA, 20 bp, Homo sapiens
ccgcccccagccccctcctg

SEQ ID NO: 2425034 - DNA, 12 bp, Homo sapiens
ccgccccctcct

SEQ ID NO: 2425035 - DNA, 13 bp, Homo sapiens
ccgccctgccact

SEQ ID NO: 2425036 - DNA, 17 bp, Homo sapiens
ccgcctgggtctcctaa

SEQ ID NO: 2425037 - DNA, 17 bp, Homo sapiens
ccgccttggcctgtgtt

SEQ ID NO: 2425038 - DNA, 22 bp, Homo sapiens
ccgcgatgtggaactgctgcca

SEQ ID NO: 2425039 - DNA, 18 bp, Homo sapiens
ccgctaaaagaaactttc

SEQ ID NO: 2425040 - DNA, 16 bp, Homo sapiens
ccgctacaccactctg

SEQ ID NO: 2425041 - DNA, 20 bp, Homo sapiens
ccgctacaccactctggcag

SEQ ID NO: 2425042 - DNA, 19 bp, Homo sapiens
ccgctctacatcttctgcc

SEQ ID NO: 2425043 - DNA, 20 bp, Homo sapiens
ccgctctacatcttctgcct

SEQ ID NO: 2425044 - DNA, 18 bp, Homo sapiens
ccgcttggagcagagggg

SEQ ID NO: 2425045 - DNA, 23 bp, Homo sapiens
ccgcttggagctattttccaggc

SEQ ID NO: 2425046 - DNA, 21 bp, Homo sapiens
ccgcttggcgatgccagccaa

SEQ ID NO: 2425047 - DNA, 13 bp, Homo sapiens
ccggagagccagc

SEQ ID NO: 2425048 - DNA, 14 bp, Homo sapiens
ccggagagtggggg

SEQ ID NO: 2425049 - DNA, 14 bp, Homo sapiens
ccggcaccccctgc

SEQ ID NO: 2425050 - DNA, 15 bp, Homo sapiens
ccggcaccccctgca

SEQ ID NO: 2425051 - DNA, 17 bp, Homo sapiens
ccggcacctcccttggg

SEQ ID NO: 2425052 - DNA, 20 bp, Homo sapiens
ccggcagcttctgccccctg

SEQ ID NO: 2425053 - DNA, 18 bp, Homo sapiens
ccggctaatttttgtaat

SEQ ID NO: 2425054 - DNA, 17 bp, Homo sapiens
ccggctctcacctggcc

SEQ ID NO: 2425055 - DNA, 15 bp, Homo sapiens
ccggctgcagaggcc

SEQ ID NO: 2425056 - DNA, 21 bp, Homo sapiens
ccgggaccaccctgagccggc

SEQ ID NO: 2425057 - DNA, 17 bp, Homo sapiens
ccgggacctggtgctgc

SEQ ID NO: 2425058 - DNA, 21 bp, Homo sapiens
ccgggccactccttcctgccc

SEQ ID NO: 2425059 - DNA, 18 bp, Homo sapiens
ccggggaactggccaagc

SEQ ID NO: 2425060 - DNA, 20 bp, Homo sapiens
ccggggaactggccaagctg

SEQ ID NO: 2425061 - DNA, 23 bp, Homo sapiens
ccgggtgtccccaacagcgccca

SEQ ID NO: 2425062 - DNA, 23 bp, Homo sapiens
ccggtcgccctttgctgcatggc

SEQ ID NO: 2425063 - DNA, 13 bp, Homo sapiens
ccggtgttctaag

SEQ ID NO: 2425064 - DNA, 15 bp, Homo sapiens
ccggtgttctaagat

SEQ ID NO: 2425065 - DNA, 23 bp, Homo sapiens
ccgtcaagagtgaattccctcac

SEQ ID NO: 2425066 - DNA, 21 bp, Homo sapiens
ccgtcaccacgactggccagg

SEQ ID NO: 2425067 - DNA, 15 bp, Homo sapiens
ccgtcccctagagtc

SEQ ID NO: 2425068 - DNA, 18 bp, Homo sapiens
ccgtcccctagagtccca

SEQ ID NO: 2425069 - DNA, 14 bp, Homo sapiens
ccgtcctgcctgtg

SEQ ID NO: 2425070 - DNA, 19 bp, Homo sapiens
ccgtgaatgggtgcccaca

SEQ ID NO: 2425071 - DNA, 15 bp, Homo sapiens
ccgtggaggctgctc

SEQ ID NO: 2425072 - DNA, 17 bp, Homo sapiens
ccgtggcccttcctgga

SEQ ID NO: 2425073 - DNA, 14 bp, Homo sapiens
ccgtggtcctttgg

SEQ ID NO: 2425074 - DNA, 13 bp, Homo sapiens
ccgtgtaaatatg

SEQ ID NO: 2425075 - DNA, 19 bp, Homo sapiens
ccgtgtaaatatgtacatt

SEQ ID NO: 2425076 - DNA, 12 bp, Homo sapiens
ccgtgtccaccc

SEQ ID NO: 2425077 - DNA, 22 bp, Homo sapiens
ccgtgtggtaagcaacatggct

SEQ ID NO: 2425078 - DNA, 23 bp, Homo sapiens
ccgtgtggtaagcaacatggctt

SEQ ID NO: 2425079 - DNA, 15 bp, Homo sapiens
ccgttagctcctgtg

SEQ ID NO: 2425080 - DNA, 14 bp, Homo sapiens
ccgttcacatgtgt

SEQ ID NO: 2425081 - DNA, 23 bp, Homo sapiens
ccgtttcatttagtcatgtgacc

SEQ ID NO: 2425082 - DNA, 14 bp, Homo sapiens
cctaaatggcctca

SEQ ID NO: 2425083 - DNA, 15 bp, Homo sapiens
cctaaattatttact

SEQ ID NO: 2425084 - DNA, 20 bp, Homo sapiens
cctaaattttcctgtcctct

SEQ ID NO: 2425085 - DNA, 21 bp, Homo sapiens
cctaacaacattgtagcctca

SEQ ID NO: 2425086 - DNA, 13 bp, Homo sapiens
cctaaccctttgt

SEQ ID NO: 2425087 - DNA, 17 bp, Homo sapiens
cctaagaatctttagag

SEQ ID NO: 2425088 - DNA, 13 bp, Homo sapiens
cctaagaggctgc

SEQ ID NO: 2425089 - DNA, 19 bp, Homo sapiens
cctaagaggctgccctcct

SEQ ID NO: 2425090 - DNA, 14 bp, Homo sapiens
cctaagcagaaagt

SEQ ID NO: 2425091 - DNA, 17 bp, Homo sapiens
cctaagcagaaagtgcc

SEQ ID NO: 2425092 - DNA, 19 bp, Homo sapiens
cctaagggtcgaaagctct

SEQ ID NO: 2425093 - DNA, 13 bp, Homo sapiens
cctaatccaggca

SEQ ID NO: 2425094 - DNA, 15 bp, Homo sapiens
cctaatccaggcaga

SEQ ID NO: 2425095 - DNA, 19 bp, Homo sapiens
cctaatccaggcagatcca

SEQ ID NO: 2425096 - DNA, 13 bp, Homo sapiens
cctccaggaagcc

SEQ ID NO: 2425097 - DNA, 13 bp, Homo sapiens
cctccagggacag

SEQ ID NO: 2425098 - DNA, 17 bp, Homo sapiens
cctccagggtgtgtgct

SEQ ID NO: 2425099 - DNA, 14 bp, Homo sapiens
cctcccaagcagtt

SEQ ID NO: 2425100 - DNA, 20 bp, Homo sapiens
cctcccaatttcagactccc

SEQ ID NO: 2425101 - DNA, 16 bp, Homo sapiens
cctcccagagcacctg

SEQ ID NO: 2425102 - DNA, 17 bp, Homo sapiens
cctcccagagcacctgc

SEQ ID NO: 2425103 - DNA, 20 bp, Homo sapiens
cctcccagagcacctgctgt

SEQ ID NO: 2425104 - DNA, 20 bp, Homo sapiens
cctcccagaggagccaccag

SEQ ID NO: 2425105 - DNA, 13 bp, Homo sapiens
cctcccagggttt

SEQ ID NO: 2425106 - DNA, 18 bp, Homo sapiens
cctcccagggttttaact

SEQ ID NO: 2425107 - DNA, 19 bp, Homo sapiens
cctcccagggttttaactt

SEQ ID NO: 2425108 - DNA, 22 bp, Homo sapiens
cctccccagcattccagcccct

SEQ ID NO: 2425109 - DNA, 15 bp, Homo sapiens
cctcccccccatgca

SEQ ID NO: 2425110 - DNA, 17 bp, Homo sapiens
cctcccccccatgcact

SEQ ID NO: 2425111 - DNA, 13 bp, Homo sapiens
cctcccctccagc

SEQ ID NO: 2425112 - DNA, 14 bp, Homo sapiens
cctcccctccatcc

SEQ ID NO: 2425113 - DNA, 20 bp, Homo sapiens
cctcccctccatccctggcc

SEQ ID NO: 2425114 - DNA, 17 bp, Homo sapiens
cctcccctctccttcct

SEQ ID NO: 2425115 - DNA, 14 bp, Homo sapiens
cctcccctgccacc

SEQ ID NO: 2425116 - DNA, 18 bp, Homo sapiens
cctcccctgccagggcag

SEQ ID NO: 2425117 - DNA, 22 bp, Homo sapiens
cctcccctggagggggaatggc

SEQ ID NO: 2425118 - DNA, 14 bp, Homo sapiens
cctcccgagctcct

SEQ ID NO: 2425119 - DNA, 19 bp, Homo sapiens
cctcccgagctcctcttcc

SEQ ID NO: 2425120 - DNA, 22 bp, Homo sapiens
cctccctctcgtaagatttcct

SEQ ID NO: 2425121 - DNA, 17 bp, Homo sapiens
cctgccacctggacccc

SEQ ID NO: 2425122 - DNA, 13 bp, Homo sapiens
cctgccagcccct

SEQ ID NO: 2425123 - DNA, 12 bp, Homo sapiens
cctgccagctgc

SEQ ID NO: 2425124 - DNA, 18 bp, Homo sapiens
cctgccagctgcactgat

SEQ ID NO: 2425125 - DNA, 12 bp, Homo sapiens
cctgccaggagg

SEQ ID NO: 2425126 - DNA, 13 bp, Homo sapiens
cctgccaggagga

SEQ ID NO: 2425127 - DNA, 22 bp, Homo sapiens
cctgccaggaggacccagggct

SEQ ID NO: 2425128 - DNA, 19 bp, Homo sapiens
cctgccagggcagggcccc

SEQ ID NO: 2425129 - DNA, 16 bp, Homo sapiens
cctgcccccaaggagg

SEQ ID NO: 2425130 - DNA, 18 bp, Homo sapiens
cctgcccccaaggaggca

SEQ ID NO: 2425131 - DNA, 20 bp, Homo sapiens
cctgcccccaaggaggcagc

SEQ ID NO: 2425132 - DNA, 22 bp, Homo sapiens
cctgcccccaaggaggcagcct

SEQ ID NO: 2425133 - DNA, 14 bp, Homo sapiens
cctgcccccacccc

SEQ ID NO: 2425134 - DNA, 19 bp, Homo sapiens
cctgccccctgcaggaagg

SEQ ID NO: 2425135 - DNA, 22 bp, Homo sapiens
cctgccgagcaaccgtggccct

SEQ ID NO: 2425136 - DNA, 13 bp, Homo sapiens
cctgccggctcct

SEQ ID NO: 2425137 - DNA, 22 bp, Homo sapiens
cctgggagaaatctggcttctg

SEQ ID NO: 2425138 - DNA, 23 bp, Homo sapiens
cctgggattcaggaaaaggcctg

SEQ ID NO: 2425139 - DNA, 15 bp, Homo sapiens
cctgggccctgggct

SEQ ID NO: 2425140 - DNA, 14 bp, Homo sapiens
cctgggccctgggg

SEQ ID NO: 2425141 - DNA, 20 bp, Homo sapiens
cctgggccctggggcctgta

SEQ ID NO: 2425142 - DNA, 13 bp, Homo sapiens
cctgggccgctgc

SEQ ID NO: 2425143 - DNA, 17 bp, Homo sapiens
cctgggccgctgccacg

SEQ ID NO: 2425144 - DNA, 20 bp, Homo sapiens
cctgggcctatggagagccc

SEQ ID NO: 2425145 - DNA, 23 bp, Homo sapiens
cctgggcctatggagagccctgg

SEQ ID NO: 2425146 - DNA, 13 bp, Homo sapiens
cctgggcctgctg

SEQ ID NO: 2425147 - DNA, 13 bp, Homo sapiens
cctgggctgggaa

SEQ ID NO: 2425148 - DNA, 16 bp, Homo sapiens
cctggggcctgtactg

SEQ ID NO: 2425149 - DNA, 18 bp, Homo sapiens
cctggggcctgtactgcc

SEQ ID NO: 2425150 - DNA, 20 bp, Homo sapiens
ccttatcctccctgtaactt

SEQ ID NO: 2425151 - DNA, 22 bp, Homo sapiens
ccttcaacaattctaaaatgat

SEQ ID NO: 2425152 - DNA, 21 bp, Homo sapiens
ccttcaacacagcttgtctct

SEQ ID NO: 2425153 - DNA, 14 bp, Homo sapiens
ccttcaagctctga

SEQ ID NO: 2425154 - DNA, 19 bp, Homo sapiens
ccttcactgtcaccaccct

SEQ ID NO: 2425155 - DNA, 22 bp, Homo sapiens
ccttcagagagcagtgcttttg

SEQ ID NO: 2425156 - DNA, 19 bp, Homo sapiens
ccttcagtaccctctcagc

SEQ ID NO: 2425157 - DNA, 20 bp, Homo sapiens
ccttcagtaccctctcagct

SEQ ID NO: 2425158 - DNA, 23 bp, Homo sapiens
ccttcagtaccctctcagctcca

SEQ ID NO: 2425159 - DNA, 24 bp, Homo sapiens
ccttcagtaccctctcagctccag

SEQ ID NO: 2425160 - DNA, 24 bp, Homo sapiens
cggattccaaagagtagaattgca

SEQ ID NO: 2425161 - DNA, 13 bp, Homo sapiens
cggattttttcca

SEQ ID NO: 2425162 - DNA, 16 bp, Homo sapiens
cggattttttccaaaa

SEQ ID NO: 2425163 - DNA, 17 bp, Homo sapiens
cggattttttccaaaat

SEQ ID NO: 2425164 - DNA, 14 bp, Homo sapiens
cggcacagggtctg

SEQ ID NO: 2425165 - DNA, 18 bp, Homo sapiens
cggcacagggtctgctct

SEQ ID NO: 2425166 - DNA, 21 bp, Homo sapiens
cggcacagggtctgctctttc

SEQ ID NO: 2425167 - DNA, 15 bp, Homo sapiens
cggcacctcccttgg

SEQ ID NO: 2425168 - DNA, 17 bp, Homo sapiens
cggcacctgggccctgg

SEQ ID NO: 2425169 - DNA, 20 bp, Homo sapiens
cggcacctgggccctggggc

SEQ ID NO: 2425170 - DNA, 23 bp, Homo sapiens
cggcacctgggccctggggcctg

SEQ ID NO: 2425171 - DNA, 13 bp, Homo sapiens
cggcagcagcccc

SEQ ID NO: 2425172 - DNA, 17 bp, Homo sapiens
cggcagcttctgccccc

SEQ ID NO: 2425173 - DNA, 23 bp, Homo sapiens
cggcagcttctgccccctgcaga

SEQ ID NO: 2425174 - DNA, 19 bp, Homo sapiens
cggcaggggcctggagatc

SEQ ID NO: 2425175 - DNA, 15 bp, Homo sapiens
cggccacacagctgc

SEQ ID NO: 2425176 - DNA, 18 bp, Homo sapiens
cggccacacagctgccgg

SEQ ID NO: 2425177 - DNA, 17 bp, Homo sapiens
cggcccaatccaaggtg

SEQ ID NO: 2425178 - DNA, 20 bp, Homo sapiens
cggccctagcattgcacttg

SEQ ID NO: 2425179 - DNA, 23 bp, Homo sapiens
cggccggccagcccctggcccca

SEQ ID NO: 2425180 - DNA, 17 bp, Homo sapiens
cggcctatgacttgggc

SEQ ID NO: 2425181 - DNA, 19 bp, Homo sapiens
cggcctatgacttgggcac

SEQ ID NO: 2425182 - DNA, 15 bp, Homo sapiens
cggcctcccaaagtg

SEQ ID NO: 2425183 - DNA, 20 bp, Homo sapiens
cggcctccttctgagctcct

SEQ ID NO: 2425184 - DNA, 13 bp, Homo sapiens
cggcctgccagga

SEQ ID NO: 2425185 - DNA, 12 bp, Homo sapiens
cggcctgtcctc

SEQ ID NO: 2425186 - DNA, 13 bp, Homo sapiens
cggctcctcaggg

SEQ ID NO: 2425187 - DNA, 11 bp, Homo sapiens
cggctcctggt

SEQ ID NO: 2425188 - DNA, 13 bp, Homo sapiens
cggctcctggtca

SEQ ID NO: 2425189 - DNA, 19 bp, Homo sapiens
cggctcctggtcacctagg

SEQ ID NO: 2425190 - DNA, 20 bp, Homo sapiens
cggctcggaggaagccccca

SEQ ID NO: 2425191 - DNA, 18 bp, Homo sapiens
cggctctcacctggccct

SEQ ID NO: 2425192 - DNA, 16 bp, Homo sapiens
cggctctgtccccagc

SEQ ID NO: 2425193 - DNA, 23 bp, Homo sapiens
cggctgaccatgctcatctgctg

SEQ ID NO: 2425194 - DNA, 11 bp, Homo sapiens
cggctgtgtgt

SEQ ID NO: 2425195 - DNA, 16 bp, Homo sapiens
cggcttcatgccagct

SEQ ID NO: 2425196 - DNA, 16 bp, Homo sapiens
cgggaccaccctgagc

SEQ ID NO: 2425197 - DNA, 13 bp, Homo sapiens
cgggacctggtgc

SEQ ID NO: 2425198 - DNA, 12 bp, Homo sapiens
cgggagacagca

SEQ ID NO: 2425199 - DNA, 22 bp, Homo sapiens
cgggagccatgcgccccctccg

SEQ ID NO: 2425200 - DNA, 19 bp, Homo sapiens
cgggccactccttcctgcc

SEQ ID NO: 2425201 - DNA, 20 bp, Homo sapiens
cgggccactccttcctgccc

SEQ ID NO: 2425202 - DNA, 21 bp, Homo sapiens
cgggcccttcccacaggacat

SEQ ID NO: 2425203 - DNA, 17 bp, Homo sapiens
cgggcctgtccacaggc

SEQ ID NO: 2425204 - DNA, 17 bp, Homo sapiens
cggggaactggccaagc

SEQ ID NO: 2425205 - DNA, 14 bp, Homo sapiens
cggggatgtgtcct

SEQ ID NO: 2425206 - DNA, 23 bp, Homo sapiens
cggggatgtgtcctgacactgca

SEQ ID NO: 2425207 - DNA, 17 bp, Homo sapiens
cggggcatctggcctgg

SEQ ID NO: 2425208 - DNA, 13 bp, Homo sapiens
cggggctgggaag

SEQ ID NO: 2425209 - DNA, 12 bp, Homo sapiens
cggggcttgcct

SEQ ID NO: 2425210 - DNA, 16 bp, Homo sapiens
cggggtgcacaggagg

SEQ ID NO: 2425211 - DNA, 17 bp, Homo sapiens
cggggtgcacaggaggg

SEQ ID NO: 2425212 - DNA, 22 bp, Homo sapiens
cggggtggggtggctgcagcct

SEQ ID NO: 2425213 - DNA, 13 bp, Homo sapiens
cgggtctgcctct

SEQ ID NO: 2425214 - DNA, 16 bp, Homo sapiens
cgggtgccagaagcta

SEQ ID NO: 2425215 - DNA, 15 bp, Homo sapiens
cggtagccagcacac

SEQ ID NO: 2425216 - DNA, 21 bp, Homo sapiens
cggtagccagcacacagggca

SEQ ID NO: 2425217 - DNA, 22 bp, Homo sapiens
cggtagccagcacacagggcag

SEQ ID NO: 2425218 - DNA, 18 bp, Homo sapiens
cggtatccccccatcttg

SEQ ID NO: 2425219 - DNA, 17 bp, Homo sapiens
cggtgcctttatttcca

SEQ ID NO: 2425220 - DNA, 16 bp, Homo sapiens
cggtgtgcaccagggt

SEQ ID NO: 2425221 - DNA, 13 bp, Homo sapiens
cggtgttctaaga

SEQ ID NO: 2425222 - DNA, 20 bp, Homo sapiens
cggttatgaaattcaccccc

SEQ ID NO: 2425223 - DNA, 20 bp, Homo sapiens
cggttcaggaaaattgaatg

SEQ ID NO: 2425224 - DNA, 21 bp, Homo sapiens
cggttgagttttgactgcttg

SEQ ID NO: 2425225 - DNA, 11 bp, Homo sapiens
cggtttctcca

SEQ ID NO: 2425226 - DNA, 14 bp, Homo sapiens
cgtaaagtacttgt

SEQ ID NO: 2425227 - DNA, 18 bp, Homo sapiens
cgtaaagtacttgtagtt

SEQ ID NO: 2425228 - DNA, 13 bp, Homo sapiens
cgtaagtacagag

SEQ ID NO: 2425229 - DNA, 14 bp, Homo sapiens
cgtaagtacagaga

SEQ ID NO: 2425230 - DNA, 15 bp, Homo sapiens
cgtaagtacagagaa

SEQ ID NO: 2425231 - DNA, 17 bp, Homo sapiens
cgtaagtacagagaagc

SEQ ID NO: 2425232 - DNA, 20 bp, Homo sapiens
cgtaagtacagagaagccat

SEQ ID NO: 2425233 - DNA, 13 bp, Homo sapiens
cgtaataaggttt

SEQ ID NO: 2425234 - DNA, 23 bp, Homo sapiens
cgtaataaggttttaatttagta

SEQ ID NO: 2425235 - DNA, 15 bp, Homo sapiens
cgtactcaggagccc

SEQ ID NO: 2425236 - DNA, 21 bp, Homo sapiens
cgtaggctacagagaagcctt

SEQ ID NO: 2425237 - DNA, 23 bp, Homo sapiens
cgtaggctacagagaagccttca

SEQ ID NO: 2425238 - DNA, 15 bp, Homo sapiens
cgtatttaatagcaa

SEQ ID NO: 2425239 - DNA, 23 bp, Homo sapiens
cgtcaagagtgaattccctcact

SEQ ID NO: 2425240 - DNA, 17 bp, Homo sapiens
cgtcagaagcacccagg

SEQ ID NO: 2425241 - DNA, 14 bp, Homo sapiens
cgtcagtgctgtgc

SEQ ID NO: 2425242 - DNA, 13 bp, Homo sapiens
cgtcctcctctgt

SEQ ID NO: 2425243 - DNA, 15 bp, Homo sapiens
cgtcctgcctgtggc

SEQ ID NO: 2425244 - DNA, 15 bp, Homo sapiens
cgtcggtctgtgccc

SEQ ID NO: 2425245 - DNA, 14 bp, Homo sapiens
cgtctccaggggct

SEQ ID NO: 2425246 - DNA, 19 bp, Homo sapiens
cgtctccaggggctgcttc

SEQ ID NO: 2425247 - DNA, 20 bp, Homo sapiens
cgtctccaggggctgcttcc

SEQ ID NO: 2425248 - DNA, 20 bp, Homo sapiens
cgtctcccccaacagctgga

SEQ ID NO: 2425249 - DNA, 20 bp, Homo sapiens
cgtgaccggacttttctgca

SEQ ID NO: 2425250 - DNA, 15 bp, Homo sapiens
cgtgacgtctgggtg

SEQ ID NO: 2425251 - DNA, 20 bp, Homo sapiens
cgtgacgtctgggtggccct

SEQ ID NO: 2425252 - DNA, 14 bp, Homo sapiens
cgtgagccacctcg

SEQ ID NO: 2425253 - DNA, 14 bp, Homo sapiens
cgtgagctgagcag

SEQ ID NO: 2425254 - DNA, 20 bp, Homo sapiens
cgtgagctgagcaggccaca

SEQ ID NO: 2425255 - DNA, 22 bp, Homo sapiens
cgtgagcttaaaatacaagact

SEQ ID NO: 2425256 - DNA, 23 bp, Homo sapiens
cgtgatcaagttgaggggcttcc

SEQ ID NO: 2425257 - DNA, 15 bp, Homo sapiens
cgtgccaagtccagg

SEQ ID NO: 2425258 - DNA, 15 bp, Homo sapiens
cgtgcctgtgtccat

SEQ ID NO: 2425259 - DNA, 14 bp, Homo sapiens
cgtgctctttgttt

SEQ ID NO: 2425260 - DNA, 14 bp, Homo sapiens
ctctgtgccagagc

SEQ ID NO: 2425261 - DNA, 13 bp, Homo sapiens
ctctgtgccttcg

SEQ ID NO: 2425262 - DNA, 18 bp, Homo sapiens
ctctgtgtctaagattct

SEQ ID NO: 2425263 - DNA, 23 bp, Homo sapiens
ctctgtgtctaagattctagatc

SEQ ID NO: 2425264 - DNA, 22 bp, Homo sapiens
ctctgttacactttttggaagt

SEQ ID NO: 2425265 - DNA, 13 bp, Homo sapiens
ctctgttcttcct

SEQ ID NO: 2425266 - DNA, 20 bp, Homo sapiens
ctctgttcttcctcagccag

SEQ ID NO: 2425267 - DNA, 17 bp, Homo sapiens
ctcttagcagcttccag

SEQ ID NO: 2425268 - DNA, 22 bp, Homo sapiens
ctcttagggacagtcaaaacca

SEQ ID NO: 2425269 - DNA, 17 bp, Homo sapiens
ctcttatgctgtaccca

SEQ ID NO: 2425270 - DNA, 17 bp, Homo sapiens
ctcttattgcctcactt

SEQ ID NO: 2425271 - DNA, 15 bp, Homo sapiens
ctcttattttacaat

SEQ ID NO: 2425272 - DNA, 17 bp, Homo sapiens
ctcttcagaggccctcg

SEQ ID NO: 2425273 - DNA, 21 bp, Homo sapiens
ctcttcatttttttttcaatc

SEQ ID NO: 2425274 - DNA, 22 bp, Homo sapiens
ctaaggctctatgagtctagat

SEQ ID NO: 2425275 - DNA, 11 bp, Homo sapiens
ctaaggttcta

SEQ ID NO: 2425276 - DNA, 18 bp, Homo sapiens
ctaagtaaatacaatttt

SEQ ID NO: 2425277 - DNA, 18 bp, Homo sapiens
ctaagtttctaagattct

SEQ ID NO: 2425278 - DNA, 22 bp, Homo sapiens
ctaagtttctaagattctaaag

SEQ ID NO: 2425279 - DNA, 23 bp, Homo sapiens
ctaagtttctaagattctaaagg

SEQ ID NO: 2425280 - DNA, 20 bp, Homo sapiens
ctaataaaaagcttttgtct

SEQ ID NO: 2425281 - DNA, 15 bp, Homo sapiens
ctaataaactaataa

SEQ ID NO: 2425282 - DNA, 19 bp, Homo sapiens
ctaataaactaataattgc

SEQ ID NO: 2425283 - DNA, 21 bp, Homo sapiens
ctaataaactaataattgcag

SEQ ID NO: 2425284 - DNA, 14 bp, Homo sapiens
ctaataatttctaa

SEQ ID NO: 2425285 - DNA, 21 bp, Homo sapiens
ctaatagaataaaggcagttt

SEQ ID NO: 2425286 - DNA, 13 bp, Homo sapiens
ctaatatatttaa

SEQ ID NO: 2425287 - DNA, 17 bp, Homo sapiens
ctaatatatttaaaaat

SEQ ID NO: 2425288 - DNA, 20 bp, Homo sapiens
ctaatcagggaggtcatttt

SEQ ID NO: 2425289 - DNA, 19 bp, Homo sapiens
ctaatccaggcagatccag

SEQ ID NO: 2425290 - DNA, 16 bp, Homo sapiens
ctaatggcatgagaaa

SEQ ID NO: 2425291 - DNA, 17 bp, Homo sapiens
ctaattaattgtaatct

SEQ ID NO: 2425292 - DNA, 16 bp, Homo sapiens
ctaattcaaggaattt

SEQ ID NO: 2425293 - DNA, 16 bp, Homo sapiens
ctaattcacagtgctc

SEQ ID NO: 2425294 - DNA, 13 bp, Homo sapiens
ctaattgccatgt

SEQ ID NO: 2425295 - DNA, 11 bp, Homo sapiens
ctaattgctta

SEQ ID NO: 2425296 - DNA, 12 bp, Homo sapiens
ctaattgcttat

SEQ ID NO: 2425297 - DNA, 12 bp, Homo sapiens
ctaatttataaa

SEQ ID NO: 2425298 - DNA, 17 bp, Homo sapiens
ctaatttcaaaatgctt

SEQ ID NO: 2425299 - DNA, 19 bp, Homo sapiens
ctaatttgcattaaattca

SEQ ID NO: 2425300 - DNA, 22 bp, Homo sapiens
ctaatttgtaggaaaaagcaag

SEQ ID NO: 2425301 - DNA, 22 bp, Homo sapiens
ctaatttttaagaattgagtaa

SEQ ID NO: 2425302 - DNA, 22 bp, Homo sapiens
ctaatttttattaattttagtt

SEQ ID NO: 2425303 - DNA, 23 bp, Homo sapiens
ctaatttttgtatttttagtaga

SEQ ID NO: 2425304 - DNA, 15 bp, Homo sapiens
ctacaaaggtttaaa

SEQ ID NO: 2425305 - DNA, 21 bp, Homo sapiens
ctacaaaggtttaaatgaaca

SEQ ID NO: 2425306 - DNA, 10 bp, Homo sapiens
ctacaaatca

SEQ ID NO: 2425307 - DNA, 15 bp, Homo sapiens
ctacaaccaatggaa

SEQ ID NO: 2425308 - DNA, 19 bp, Homo sapiens
ctacaagctaaaattagat

SEQ ID NO: 2425309 - DNA, 12 bp, Homo sapiens
ctacacaccctg

SEQ ID NO: 2425310 - DNA, 13 bp, Homo sapiens
ctacaccactctg

SEQ ID NO: 2425311 - DNA, 14 bp, Homo sapiens
ctacaccactctgg

SEQ ID NO: 2425312 - DNA, 20 bp, Homo sapiens
ctacaccactctggcagcca

SEQ ID NO: 2425313 - DNA, 22 bp, Homo sapiens
ctacaccactctggcagccaca

SEQ ID NO: 2425314 - DNA, 13 bp, Homo sapiens
ctacagaaaaacc

SEQ ID NO: 2425315 - DNA, 14 bp, Homo sapiens
ctacagaaaaacct

SEQ ID NO: 2425316 - DNA, 15 bp, Homo sapiens
ctacagaaaaacctt

SEQ ID NO: 2425317 - DNA, 11 bp, Homo sapiens
ctacagagaaa

SEQ ID NO: 2425318 - DNA, 16 bp, Homo sapiens
ctacagagaaaccagc

SEQ ID NO: 2425319 - DNA, 17 bp, Homo sapiens
ctacagagaaaccagct

SEQ ID NO: 2425320 - DNA, 22 bp, Homo sapiens
ctacagagaaaccagcttcctt

SEQ ID NO: 2425321 - DNA, 15 bp, Homo sapiens
ctacagagaagcctt

SEQ ID NO: 2425322 - DNA, 17 bp, Homo sapiens
ctacagagaagccttca

SEQ ID NO: 2425323 - DNA, 22 bp, Homo sapiens
ctacagagaagccttcaagctc

SEQ ID NO: 2425324 - DNA, 20 bp, Homo sapiens
ctacagagcttccctgactc

SEQ ID NO: 2425325 - DNA, 18 bp, Homo sapiens
ctacagcctcagaaacca

SEQ ID NO: 2425326 - DNA, 18 bp, Homo sapiens
ctacagctggggtgcagg

SEQ ID NO: 2425327 - DNA, 19 bp, Homo sapiens
ctacagggggtctggctgg

SEQ ID NO: 2425328 - DNA, 15 bp, Homo sapiens
ctacagtcaggaaag

SEQ ID NO: 2425329 - DNA, 21 bp, Homo sapiens
ctacagtcaggaaaggaatca

SEQ ID NO: 2425330 - DNA, 19 bp, Homo sapiens
ctacagttttaactgtgga

SEQ ID NO: 2425331 - DNA, 15 bp, Homo sapiens
ctacatcttctgcct

SEQ ID NO: 2425332 - DNA, 13 bp, Homo sapiens
ctacatgagaaca

SEQ ID NO: 2425333 - DNA, 18 bp, Homo sapiens
ctacatgtattgcacatt

SEQ ID NO: 2425334 - DNA, 21 bp, Homo sapiens
ctacatgtattgcacattgta

SEQ ID NO: 2425335 - DNA, 22 bp, Homo sapiens
ctacatgtattgcacattgtaa

SEQ ID NO: 2425336 - DNA, 22 bp, Homo sapiens
ctaccaggtcaaaatagtgcca

SEQ ID NO: 2425337 - DNA, 13 bp, Homo sapiens
ctaccagtattta

SEQ ID NO: 2425338 - DNA, 19 bp, Homo sapiens
ctaccagtatttagaagcc

SEQ ID NO: 2425339 - DNA, 19 bp, Homo sapiens
ctaccccatggtgctagga

SEQ ID NO: 2425340 - DNA, 13 bp, Homo sapiens
ctaccctctagag

SEQ ID NO: 2425341 - DNA, 18 bp, Homo sapiens
ctaccctttttctccagc

SEQ ID NO: 2425342 - DNA, 13 bp, Homo sapiens
ctaccgagttcaa

SEQ ID NO: 2425343 - DNA, 19 bp, Homo sapiens
ctacctgacactcccttgg

SEQ ID NO: 2425344 - DNA, 20 bp, Homo sapiens
ctacctgacactcccttggg

SEQ ID NO: 2425345 - DNA, 19 bp, Homo sapiens
ctacctgctcagccctgca

SEQ ID NO: 2425346 - DNA, 21 bp, Homo sapiens
ctacctgttgagcatcacaga

SEQ ID NO: 2425347 - DNA, 17 bp, Homo sapiens
ctactaattccacacct

SEQ ID NO: 2425348 - DNA, 23 bp, Homo sapiens
ctactcacacaggcatttcctgg

SEQ ID NO: 2425349 - DNA, 14 bp, Homo sapiens
ctactcacttttcc

SEQ ID NO: 2425350 - DNA, 17 bp, Homo sapiens
ctactctccccacgagg

SEQ ID NO: 2425351 - DNA, 21 bp, Homo sapiens
ctactctccccacgagggctg

SEQ ID NO: 2425352 - DNA, 15 bp, Homo sapiens
ctactgaatgtcatt

SEQ ID NO: 2425353 - DNA, 22 bp, Homo sapiens
ctactgacggagtcctgtgttt

SEQ ID NO: 2425354 - DNA, 15 bp, Homo sapiens
ctactggggaaactg

SEQ ID NO: 2425355 - DNA, 19 bp, Homo sapiens
ctactggggaaactggcca

SEQ ID NO: 2425356 - DNA, 22 bp, Homo sapiens
ctactggggaaactggccatgg

SEQ ID NO: 2425357 - DNA, 15 bp, Homo sapiens
ctactggtctctcta

SEQ ID NO: 2425358 - DNA, 20 bp, Homo sapiens
ctactggtctctctatgcct

SEQ ID NO: 2425359 - DNA, 17 bp, Homo sapiens
ctactgtgtgtgtgaat

SEQ ID NO: 2425360 - DNA, 19 bp, Homo sapiens
ctactgtgtgtgtgaatga

SEQ ID NO: 2425361 - DNA, 20 bp, Homo sapiens
ctactgtgtgtgtgaatgaa

SEQ ID NO: 2425362 - DNA, 23 bp, Homo sapiens
ctactgtgttatgcaaaagcaag

SEQ ID NO: 2425363 - DNA, 14 bp, Homo sapiens
ctactgttctaaag

SEQ ID NO: 2425364 - DNA, 15 bp, Homo sapiens
ctactgttctaaagc

SEQ ID NO: 2425365 - DNA, 22 bp, Homo sapiens
ctactgttctaaagctctgaca

SEQ ID NO: 2425366 - DNA, 18 bp, Homo sapiens
ctacttctgtaattgtgt

SEQ ID NO: 2425367 - DNA, 19 bp, Homo sapiens
ctactttataactaacatg

SEQ ID NO: 2425368 - DNA, 14 bp, Homo sapiens
ctagaaaaacaggc

SEQ ID NO: 2425369 - DNA, 15 bp, Homo sapiens
ctagaaaaacaggca

SEQ ID NO: 2425370 - DNA, 14 bp, Homo sapiens
ctagaaacaacact

SEQ ID NO: 2425371 - DNA, 17 bp, Homo sapiens
ctagaaacaacactgta

SEQ ID NO: 2425372 - DNA, 19 bp, Homo sapiens
ctagaaacaacactgtagt

SEQ ID NO: 2425373 - DNA, 20 bp, Homo sapiens
ctagaaacaacactgtagta

SEQ ID NO: 2425374 - DNA, 16 bp, Homo sapiens
ctagaattgagtgttt

SEQ ID NO: 2425375 - DNA, 21 bp, Homo sapiens
ctagaatttgattattaacat

SEQ ID NO: 2425376 - DNA, 13 bp, Homo sapiens
ctagacaagccag

SEQ ID NO: 2425377 - DNA, 22 bp, Homo sapiens
ctagacacatgaaggtaaataa

SEQ ID NO: 2425378 - DNA, 14 bp, Homo sapiens
ctcctccagggaca

SEQ ID NO: 2425379 - DNA, 15 bp, Homo sapiens
ctcctcccacccggc

SEQ ID NO: 2425380 - DNA, 14 bp, Homo sapiens
ctcctcccctggag

SEQ ID NO: 2425381 - DNA, 18 bp, Homo sapiens
ctcctctagctgtggggg

SEQ ID NO: 2425382 - DNA, 14 bp, Homo sapiens
ctcctctccccagc

SEQ ID NO: 2425383 - DNA, 15 bp, Homo sapiens
ctcctctccccagcc

SEQ ID NO: 2425384 - DNA, 17 bp, Homo sapiens
ctcctctccccagccca

SEQ ID NO: 2425385 - DNA, 13 bp, Homo sapiens
ctcctctgactca

SEQ ID NO: 2425386 - DNA, 19 bp, Homo sapiens
ctcctctgactcagggctc

SEQ ID NO: 2425387 - DNA, 20 bp, Homo sapiens
ctcctctgactcagggctcc

SEQ ID NO: 2425388 - DNA, 13 bp, Homo sapiens
ctgatccctctac

SEQ ID NO: 2425389 - DNA, 15 bp, Homo sapiens
ctgatccctctacag

SEQ ID NO: 2425390 - DNA, 18 bp, Homo sapiens
ctgatcctggaggcccag

SEQ ID NO: 2425391 - DNA, 16 bp, Homo sapiens
ctgatgcagcttatac

SEQ ID NO: 2425392 - DNA, 14 bp, Homo sapiens
ctgatgcatcagaa

SEQ ID NO: 2425393 - DNA, 19 bp, Homo sapiens
ctgatgtcaatttctgtgt

SEQ ID NO: 2425394 - DNA, 21 bp, Homo sapiens
ctgattaaaatgcttcctccc

SEQ ID NO: 2425395 - DNA, 16 bp, Homo sapiens
ctgattaaatgacact

SEQ ID NO: 2425396 - DNA, 18 bp, Homo sapiens
ctgatttaggagaagcca

SEQ ID NO: 2425397 - DNA, 19 bp, Homo sapiens
ctgatttgtaacccactga

SEQ ID NO: 2425398 - DNA, 21 bp, Homo sapiens
ctgattttaggagctaaggct

SEQ ID NO: 2425399 - DNA, 18 bp, Homo sapiens
ctgcaaaaggactctcag

SEQ ID NO: 2425400 - DNA, 13 bp, Homo sapiens
ctgcaaactggga

SEQ ID NO: 2425401 - DNA, 23 bp, Homo sapiens
ctgcaaactgggaacccctttcc

SEQ ID NO: 2425402 - DNA, 22 bp, Homo sapiens
ctgcaaagatctgtcctcagcc

SEQ ID NO: 2425403 - DNA, 23 bp, Homo sapiens
ctgcaaagatctgtcctcagcct

SEQ ID NO: 2425404 - DNA, 15 bp, Homo sapiens
ctgcaaatcaggctt

SEQ ID NO: 2425405 - DNA, 21 bp, Homo sapiens
ctgcaattcaaaagttccaag

SEQ ID NO: 2425406 - DNA, 22 bp, Homo sapiens
ctgcaattcaaaagttccaaga

SEQ ID NO: 2425407 - DNA, 17 bp, Homo sapiens
ctgcaattcccctctgc

SEQ ID NO: 2425408 - DNA, 22 bp, Homo sapiens
ctgcaattggcaccgaagccca

SEQ ID NO: 2425409 - DNA, 15 bp, Homo sapiens
ctgcacaataactcc

SEQ ID NO: 2425410 - DNA, 14 bp, Homo sapiens
ctgcacagtgactt

SEQ ID NO: 2425411 - DNA, 16 bp, Homo sapiens
ctgcacagtgacttct

SEQ ID NO: 2425412 - DNA, 18 bp, Homo sapiens
ctgcacagtgacttctga

SEQ ID NO: 2425413 - DNA, 15 bp, Homo sapiens
ctgcacagttgaagg

SEQ ID NO: 2425414 - DNA, 21 bp, Homo sapiens
ctgcacattaaggagaaatct

SEQ ID NO: 2425415 - DNA, 13 bp, Homo sapiens
ctgcacctgcctc

SEQ ID NO: 2425416 - DNA, 14 bp, Homo sapiens
ctgcacctgcctcc

SEQ ID NO: 2425417 - DNA, 20 bp, Homo sapiens
ctgcacctgcctccagccgc

SEQ ID NO: 2425418 - DNA, 17 bp, Homo sapiens
ctgcactcaaccttaag

SEQ ID NO: 2425419 - DNA, 16 bp, Homo sapiens
ctgcactcccacctga

SEQ ID NO: 2425420 - DNA, 18 bp, Homo sapiens
ctgcactcccacctgaca

SEQ ID NO: 2425421 - DNA, 18 bp, Homo sapiens
ctgcactgatgctgcccc

SEQ ID NO: 2425422 - DNA, 19 bp, Homo sapiens
ctgcactgatgctgcccct

SEQ ID NO: 2425423 - DNA, 22 bp, Homo sapiens
ctgcactggggagcccgtctca

SEQ ID NO: 2425424 - DNA, 11 bp, Homo sapiens
ctgcactgtaa

SEQ ID NO: 2425425 - DNA, 20 bp, Homo sapiens
ctgcactgtaaaatgtggga

SEQ ID NO: 2425426 - DNA, 19 bp, Homo sapiens
ctgcagaaccggagagcca

SEQ ID NO: 2425427 - DNA, 22 bp, Homo sapiens
ctgcagaaccggagagccagct

SEQ ID NO: 2425428 - DNA, 17 bp, Homo sapiens
ctgcagaccctgccctt

SEQ ID NO: 2425429 - DNA, 15 bp, Homo sapiens
ctgcagacttcccag

SEQ ID NO: 2425430 - DNA, 16 bp, Homo sapiens
ctgcagacttcccagc

SEQ ID NO: 2425431 - DNA, 13 bp, Homo sapiens
ctgcagcctcagg

SEQ ID NO: 2425432 - DNA, 18 bp, Homo sapiens
ctgcagcctttgcctccc

SEQ ID NO: 2425433 - DNA, 20 bp, Homo sapiens
ctgcagcctttgcctccccg

SEQ ID NO: 2425434 - DNA, 11 bp, Homo sapiens
ctgcagcttgt

SEQ ID NO: 2425435 - DNA, 16 bp, Homo sapiens
ctgcagcttgtagcca

SEQ ID NO: 2425436 - DNA, 17 bp, Homo sapiens
ctgcagcttgtagccag

SEQ ID NO: 2425437 - DNA, 18 bp, Homo sapiens
ctgcagcttgtagccagc

SEQ ID NO: 2425438 - DNA, 14 bp, Homo sapiens
ctgcaggaaggagc

SEQ ID NO: 2425439 - DNA, 20 bp, Homo sapiens
ctgcaggaaggagctgcctg

SEQ ID NO: 2425440 - DNA, 20 bp, Homo sapiens
ctgcaggatctcaccaggca

SEQ ID NO: 2425441 - DNA, 21 bp, Homo sapiens
ctgcaggccctggcctcccct

SEQ ID NO: 2425442 - DNA, 17 bp, Homo sapiens
ctgcagggcctctgtca

SEQ ID NO: 2425443 - DNA, 15 bp, Homo sapiens
ctgcagttcgactct

SEQ ID NO: 2425444 - DNA, 17 bp, Homo sapiens
ctgcagttcgactctgt

SEQ ID NO: 2425445 - DNA, 20 bp, Homo sapiens
ctgcagttcgactctgtgct

SEQ ID NO: 2425446 - DNA, 15 bp, Homo sapiens
ctgcataatgtttct

SEQ ID NO: 2425447 - DNA, 22 bp, Homo sapiens
ctgcataggagtttggaggaag

SEQ ID NO: 2425448 - DNA, 20 bp, Homo sapiens
ctgcatcctctggagccagc

SEQ ID NO: 2425449 - DNA, 16 bp, Homo sapiens
ctgcatgcccagagac

SEQ ID NO: 2425450 - DNA, 17 bp, Homo sapiens
ctgcatgcccagagacc

SEQ ID NO: 2425451 - DNA, 19 bp, Homo sapiens
ctgcatggcatcctccagc

SEQ ID NO: 2425452 - DNA, 22 bp, Homo sapiens
ctgcatggcatcctccagcccc

SEQ ID NO: 2425453 - DNA, 21 bp, Homo sapiens
ctgcattctgcctctctagga

SEQ ID NO: 2425454 - DNA, 18 bp, Homo sapiens
ctgcattcttctgagcac

SEQ ID NO: 2425455 - DNA, 22 bp, Homo sapiens
ctgcattgaaaagagctgaagg

SEQ ID NO: 2425456 - DNA, 23 bp, Homo sapiens
ctgcattggaactggaggcaggg

SEQ ID NO: 2425457 - DNA, 14 bp, Homo sapiens
ctgccaaaggatgt

SEQ ID NO: 2425458 - DNA, 18 bp, Homo sapiens
ctgccaaaggatgtgata

SEQ ID NO: 2425459 - DNA, 19 bp, Homo sapiens
ctgccaaaggatgtgatat

SEQ ID NO: 2425460 - DNA, 15 bp, Homo sapiens
ctgccaccaggccac

SEQ ID NO: 2425461 - DNA, 23 bp, Homo sapiens
ctgccaccaggccacctccccag

SEQ ID NO: 2425462 - DNA, 23 bp, Homo sapiens
ctgccacccagccccagccaggg

SEQ ID NO: 2425463 - DNA, 21 bp, Homo sapiens
ctgccacctccccccacaagt

SEQ ID NO: 2425464 - DNA, 15 bp, Homo sapiens
ctgccacctggaccc

SEQ ID NO: 2425465 - DNA, 21 bp, Homo sapiens
ctgccacctggacccctgcat

SEQ ID NO: 2425466 - DNA, 16 bp, Homo sapiens
ctgccactcactaggc

SEQ ID NO: 2425467 - DNA, 12 bp, Homo sapiens
ctgccactgtgt

SEQ ID NO: 2425468 - DNA, 13 bp, Homo sapiens
ctgccactgtgtg

SEQ ID NO: 2425469 - DNA, 12 bp, Homo sapiens
ctgccagcccct

SEQ ID NO: 2425470 - DNA, 21 bp, Homo sapiens
ctgccaggagggacaaaggag

SEQ ID NO: 2425471 - DNA, 23 bp, Homo sapiens
ctgccaggagggacaaaggagcc

SEQ ID NO: 2425472 - DNA, 17 bp, Homo sapiens
ctgccagggcccctctc

SEQ ID NO: 2425473 - DNA, 18 bp, Homo sapiens
ctgccagggcccctctcc

SEQ ID NO: 2425474 - DNA, 23 bp, Homo sapiens
ctgccagggcccctctccccagg

SEQ ID NO: 2425475 - DNA, 16 bp, Homo sapiens
ctgccagtgacagaca

SEQ ID NO: 2425476 - DNA, 22 bp, Homo sapiens
ctgccatgtttagtgaatgact

SEQ ID NO: 2425477 - DNA, 13 bp, Homo sapiens
ctgcccaaagcag

SEQ ID NO: 2425478 - DNA, 21 bp, Homo sapiens
ctgcccacctcagcctcccaa

SEQ ID NO: 2425479 - DNA, 14 bp, Homo sapiens
ctgcccaggcactg

SEQ ID NO: 2425480 - DNA, 16 bp, Homo sapiens
ctgcccaggcactgca

SEQ ID NO: 2425481 - DNA, 15 bp, Homo sapiens
ctgccccaactcctt

SEQ ID NO: 2425482 - DNA, 21 bp, Homo sapiens
ctgccccacttgtccttagcc

SEQ ID NO: 2425483 - DNA, 13 bp, Homo sapiens
ctgccccaggcct

SEQ ID NO: 2425484 - DNA, 14 bp, Homo sapiens
ctgccccaggcctg

SEQ ID NO: 2425485 - DNA, 16 bp, Homo sapiens
ctgcccccaaggaggc

SEQ ID NO: 2425486 - DNA, 21 bp, Homo sapiens
ctgccccccagcctctggcat

SEQ ID NO: 2425487 - DNA, 12 bp, Homo sapiens
ctgccccctgca

SEQ ID NO: 2425488 - DNA, 14 bp, Homo sapiens
ctgccccctgcagg

SEQ ID NO: 2425489 - DNA, 23 bp, Homo sapiens
ctgccccctgcaggaaggagctg

SEQ ID NO: 2425490 - DNA, 17 bp, Homo sapiens
ctgcccctctcaccaaa

SEQ ID NO: 2425491 - DNA, 19 bp, Homo sapiens
ctgccctcatggcccctct

SEQ ID NO: 2425492 - DNA, 16 bp, Homo sapiens
ctgccctcctgtgctc

SEQ ID NO: 2425493 - DNA, 21 bp, Homo sapiens
ctgccctcctgtgctcagccc

SEQ ID NO: 2425494 - DNA, 20 bp, Homo sapiens
ctgccctctgcatcctctgg

SEQ ID NO: 2425495 - DNA, 22 bp, Homo sapiens
ctgcccttgtttggggcaggag

SEQ ID NO: 2425496 - DNA, 13 bp, Homo sapiens
ctgccggggcagc

SEQ ID NO: 2425497 - DNA, 23 bp, Homo sapiens
ctgccggggcagccccctcacag

SEQ ID NO: 2425498 - DNA, 14 bp, Homo sapiens
ctgcctagaaacaa

SEQ ID NO: 2425499 - DNA, 18 bp, Homo sapiens
ctgcctagaaacaacact

SEQ ID NO: 2425500 - DNA, 23 bp, Homo sapiens
ctgcctagaaacaacactgtagt

SEQ ID NO: 2425501 - DNA, 19 bp, Homo sapiens
ctgcctagattcagggaaa

SEQ ID NO: 2425502 - DNA, 17 bp, Homo sapiens
ctgcctattatctgtca

SEQ ID NO: 2425503 - DNA, 22 bp, Homo sapiens
ctgcctccagccgccggctgtg

SEQ ID NO: 2425504 - DNA, 20 bp, Homo sapiens
ctgcctcccctctccttcct

SEQ ID NO: 2425505 - DNA, 16 bp, Homo sapiens
ctgcctcccttgtggc

SEQ ID NO: 2425506 - DNA, 21 bp, Homo sapiens
ctgcctcccttgtggcagcaa

SEQ ID NO: 2425507 - DNA, 15 bp, Homo sapiens
ctgcctctactggga

SEQ ID NO: 2425508 - DNA, 18 bp, Homo sapiens
ctgcctctactgggaagg

SEQ ID NO: 2425509 - DNA, 19 bp, Homo sapiens
ctgcctctactgggaaggc

SEQ ID NO: 2425510 - DNA, 21 bp, Homo sapiens
ctgcctctcgctcctcaaccc

SEQ ID NO: 2425511 - DNA, 14 bp, Homo sapiens
ctgcctctctagga

SEQ ID NO: 2425512 - DNA, 10 bp, Homo sapiens
ctgcctggag

SEQ ID NO: 2425513 - DNA, 22 bp, Homo sapiens
ctgcctggagacttagggcacc

SEQ ID NO: 2425514 - DNA, 11 bp, Homo sapiens
ctgcctggagg

SEQ ID NO: 2425515 - DNA, 15 bp, Homo sapiens
ctgcctggaggacct

SEQ ID NO: 2425516 - DNA, 19 bp, Homo sapiens
ctgcctggaggacctgagc

SEQ ID NO: 2425517 - DNA, 20 bp, Homo sapiens
ctgcctggaggacctgagcc

SEQ ID NO: 2425518 - DNA, 22 bp, Homo sapiens
ctgcctggaggacctgagcctg

SEQ ID NO: 2425519 - DNA, 23 bp, Homo sapiens
ctgcctggaggacctgagcctgc

SEQ ID NO: 2425520 - DNA, 24 bp, Homo sapiens
ctgcctgtccctaccccatggtgc

SEQ ID NO: 2425521 - DNA, 12 bp, Homo sapiens
ctgcctgtggcg

SEQ ID NO: 2425522 - DNA, 23 bp, Homo sapiens
ctgcctgtggcgccgtctccagg

SEQ ID NO: 2425523 - DNA, 15 bp, Homo sapiens
ctgccttcaccttca

SEQ ID NO: 2425524 - DNA, 14 bp, Homo sapiens
ctgcctttgccagg

SEQ ID NO: 2425525 - DNA, 17 bp, Homo sapiens
ctgcctttgccaggtga

SEQ ID NO: 2425526 - DNA, 14 bp, Homo sapiens
ctgcgactttctgc

SEQ ID NO: 2425527 - DNA, 18 bp, Homo sapiens
ctgcggcccaatccaagg

SEQ ID NO: 2425528 - DNA, 19 bp, Homo sapiens
ctgcgtgacaataaaacat

SEQ ID NO: 2425529 - DNA, 15 bp, Homo sapiens
ctgctaaataaaatt

SEQ ID NO: 2425530 - DNA, 16 bp, Homo sapiens
ctgctaaggtcttgga

SEQ ID NO: 2425531 - DNA, 23 bp, Homo sapiens
ctgctacacctattatcccagct

SEQ ID NO: 2425532 - DNA, 21 bp, Homo sapiens
ctgctacttatataattgcca

SEQ ID NO: 2425533 - DNA, 15 bp, Homo sapiens
ctgctaggccagagc

SEQ ID NO: 2425534 - DNA, 16 bp, Homo sapiens
ctgctcagctctgggc

SEQ ID NO: 2425535 - DNA, 22 bp, Homo sapiens
ctgctcagctctgggccattct

SEQ ID NO: 2425536 - DNA, 18 bp, Homo sapiens
ctgctcatcattctctgt

SEQ ID NO: 2425537 - DNA, 14 bp, Homo sapiens
ctgctccagacctg

SEQ ID NO: 2425538 - DNA, 15 bp, Homo sapiens
ctgctccagacctga

SEQ ID NO: 2425539 - DNA, 12 bp, Homo sapiens
ctgctcccaagg

SEQ ID NO: 2425540 - DNA, 18 bp, Homo sapiens
ctgctcccaaggggcctg

SEQ ID NO: 2425541 - DNA, 20 bp, Homo sapiens
ctgctcccaaggggcctgag

SEQ ID NO: 2425542 - DNA, 16 bp, Homo sapiens
ctgctcccacctcctg

SEQ ID NO: 2425543 - DNA, 19 bp, Homo sapiens
ctgctcccctaaagcctca

SEQ ID NO: 2425544 - DNA, 14 bp, Homo sapiens
ctgctcgctccctg

SEQ ID NO: 2425545 - DNA, 13 bp, Homo sapiens
ctgctcggggtgc

SEQ ID NO: 2425546 - DNA, 19 bp, Homo sapiens
ctgctcggggtgcacagga

SEQ ID NO: 2425547 - DNA, 20 bp, Homo sapiens
ctgctcggggtgcacaggag

SEQ ID NO: 2425548 - DNA, 21 bp, Homo sapiens
ctgctcggggtgcacaggagg

SEQ ID NO: 2425549 - DNA, 18 bp, Homo sapiens
ctgctcgtccccaagtga

SEQ ID NO: 2425550 - DNA, 12 bp, Homo sapiens
ctgctctaacag

SEQ ID NO: 2425551 - DNA, 11 bp, Homo sapiens
ctgctctcctc

SEQ ID NO: 2425552 - DNA, 14 bp, Homo sapiens
ctgctctcctcttc

SEQ ID NO: 2425553 - DNA, 16 bp, Homo sapiens
ctgctctgaacacgaa

SEQ ID NO: 2425554 - DNA, 19 bp, Homo sapiens
ctgctctgaacacgaagct

SEQ ID NO: 2425555 - DNA, 12 bp, Homo sapiens
ctgctctgagaa

SEQ ID NO: 2425556 - DNA, 13 bp, Homo sapiens
ctgctctgatgca

SEQ ID NO: 2425557 - DNA, 16 bp, Homo sapiens
ctgctcttggctggac

SEQ ID NO: 2425558 - DNA, 21 bp, Homo sapiens
ctgctctttctctgccagtga

SEQ ID NO: 2425559 - DNA, 15 bp, Homo sapiens
ctgctgacctgctga

SEQ ID NO: 2425560 - DNA, 21 bp, Homo sapiens
ctgctgacctgctgacctgtg

SEQ ID NO: 2425561 - DNA, 15 bp, Homo sapiens
ctgctgacctgtgca

SEQ ID NO: 2425562 - DNA, 14 bp, Homo sapiens
ctgctgagaacctg

SEQ ID NO: 2425563 - DNA, 15 bp, Homo sapiens
ctgctgagaacctgg

SEQ ID NO: 2425564 - DNA, 16 bp, Homo sapiens
ctgctgagaacctggc

SEQ ID NO: 2425565 - DNA, 20 bp, Homo sapiens
ctgctgagaacctggccttc

SEQ ID NO: 2425566 - DNA, 20 bp, Homo sapiens
ctgctgagatacatacagaa

SEQ ID NO: 2425567 - DNA, 17 bp, Homo sapiens
ctgctgagctctgagag

SEQ ID NO: 2425568 - DNA, 12 bp, Homo sapiens
ctgctgccagct

SEQ ID NO: 2425569 - DNA, 13 bp, Homo sapiens
ctgctgccagctt

SEQ ID NO: 2425570 - DNA, 15 bp, Homo sapiens
ctgctgcctccctct

SEQ ID NO: 2425571 - DNA, 16 bp, Homo sapiens
ctgctgctccctcaga

SEQ ID NO: 2425572 - DNA, 22 bp, Homo sapiens
ctgctgctcttggctggaccca

SEQ ID NO: 2425573 - DNA, 11 bp, Homo sapiens
ctgctgctgag

SEQ ID NO: 2425574 - DNA, 13 bp, Homo sapiens
ctgctgctgagaa

SEQ ID NO: 2425575 - DNA, 17 bp, Homo sapiens
ctgctgctgagaacctg

SEQ ID NO: 2425576 - DNA, 21 bp, Homo sapiens
ctgctgctgagaacctggcct

SEQ ID NO: 2425577 - DNA, 14 bp, Homo sapiens
ctgctgctgggctc

SEQ ID NO: 2425578 - DNA, 15 bp, Homo sapiens
ctgctgctgggctca

SEQ ID NO: 2425579 - DNA, 16 bp, Homo sapiens
ctgctgctgggctcag

SEQ ID NO: 2425580 - DNA, 20 bp, Homo sapiens
ctgctggagtttcatgtaca

SEQ ID NO: 2425581 - DNA, 15 bp, Homo sapiens
ctgctgggctcagtg

SEQ ID NO: 2425582 - DNA, 20 bp, Homo sapiens
ctgctggggaagacagtggc

SEQ ID NO: 2425583 - DNA, 13 bp, Homo sapiens
ctgctggggcctg

SEQ ID NO: 2425584 - DNA, 18 bp, Homo sapiens
ctgctggggcctgggaca

SEQ ID NO: 2425585 - DNA, 17 bp, Homo sapiens
ctgctgtccctccccct

SEQ ID NO: 2425586 - DNA, 18 bp, Homo sapiens
ctgctgtcgctctcagtt

SEQ ID NO: 2425587 - DNA, 13 bp, Homo sapiens
ctgctgtctgggt

SEQ ID NO: 2425588 - DNA, 16 bp, Homo sapiens
ctgctgtctgggtgct

SEQ ID NO: 2425589 - DNA, 21 bp, Homo sapiens
ctgctgtctgggtgctactgg

SEQ ID NO: 2425590 - DNA, 14 bp, Homo sapiens
ctgctgtggccagg

SEQ ID NO: 2425591 - DNA, 15 bp, Homo sapiens
ctgctgtggccagga

SEQ ID NO: 2425592 - DNA, 21 bp, Homo sapiens
ctgctgtttgacacctctttt

SEQ ID NO: 2425593 - DNA, 14 bp, Homo sapiens
ctgcttccagtgta

SEQ ID NO: 2425594 - DNA, 12 bp, Homo sapiens
ctgcttcctgct

SEQ ID NO: 2425595 - DNA, 19 bp, Homo sapiens
ctgcttctcccaggcaagg

SEQ ID NO: 2425596 - DNA, 21 bp, Homo sapiens
ctgcttctcccaggcaaggct

SEQ ID NO: 2425597 - DNA, 15 bp, Homo sapiens
gaccataatgttaca

SEQ ID NO: 2425598 - DNA, 20 bp, Homo sapiens
gaccataatgttacattatt

SEQ ID NO: 2425599 - DNA, 16 bp, Homo sapiens
gaccatctgattaaaa

SEQ ID NO: 2425600 - DNA, 23 bp, Homo sapiens
gacccacatgccatttgtactga

SEQ ID NO: 2425601 - DNA, 14 bp, Homo sapiens
gacccagccaggcc

SEQ ID NO: 2425602 - DNA, 15 bp, Homo sapiens
gacccagccaggccc

SEQ ID NO: 2425603 - DNA, 16 bp, Homo sapiens
gacccagccctcatcc

SEQ ID NO: 2425604 - DNA, 15 bp, Homo sapiens
gacccaggaaaggca

SEQ ID NO: 2425605 - DNA, 20 bp, Homo sapiens
gacccagtgcccccactgac

SEQ ID NO: 2425606 - DNA, 23 bp, Homo sapiens
gacccatgagttggggtctggca

SEQ ID NO: 2425607 - DNA, 15 bp, Homo sapiens
gacccattccttccc

SEQ ID NO: 2425608 - DNA, 12 bp, Homo sapiens
gaccccagagga

SEQ ID NO: 2425609 - DNA, 11 bp, Homo sapiens
gaccccagggc

SEQ ID NO: 2425610 - DNA, 19 bp, Homo sapiens
gaccccatcacctactcac

SEQ ID NO: 2425611 - DNA, 15 bp, Homo sapiens
gacccccctttcaca

SEQ ID NO: 2425612 - DNA, 19 bp, Homo sapiens
gacccggcaccccctgcag

SEQ ID NO: 2425613 - DNA, 17 bp, Homo sapiens
gaccctgaccagctccc

SEQ ID NO: 2425614 - DNA, 18 bp, Homo sapiens
gaccctgaccagctcccc

SEQ ID NO: 2425615 - DNA, 15 bp, Homo sapiens
gaccctgcccttgtt

SEQ ID NO: 2425616 - DNA, 16 bp, Homo sapiens
gaccctgcctctccca

SEQ ID NO: 2425617 - DNA, 21 bp, Homo sapiens
gaccctgcctctcccaggcag

SEQ ID NO: 2425618 - DNA, 23 bp, Homo sapiens
gaccctgcctctcccaggcaggg

SEQ ID NO: 2425619 - DNA, 21 bp, Homo sapiens
gacccttgacacctgctgaga

SEQ ID NO: 2425620 - DNA, 15 bp, Homo sapiens
gaccgccccctgtct

SEQ ID NO: 2425621 - DNA, 19 bp, Homo sapiens
gaccgctacaccactctgg

SEQ ID NO: 2425622 - DNA, 20 bp, Homo sapiens
gaccgctacaccactctggc

SEQ ID NO: 2425623 - DNA, 22 bp, Homo sapiens
gaccgctacaccactctggcag

SEQ ID NO: 2425624 - DNA, 15 bp, Homo sapiens
gaccggcctgccagg

SEQ ID NO: 2425625 - DNA, 21 bp, Homo sapiens
gacctacagggggtctggctg

SEQ ID NO: 2425626 - DNA, 18 bp, Homo sapiens
gacctactgttctaaagc

SEQ ID NO: 2425627 - DNA, 13 bp, Homo sapiens
gacctcagaagta

SEQ ID NO: 2425628 - DNA, 16 bp, Homo sapiens
gacctcagaagtaaag

SEQ ID NO: 2425629 - DNA, 18 bp, Homo sapiens
gacctcaggcaatctgcc

SEQ ID NO: 2425630 - DNA, 18 bp, Homo sapiens
gacctcgtactcaggagc

SEQ ID NO: 2425631 - DNA, 17 bp, Homo sapiens
gacctctgacagcagca

SEQ ID NO: 2425632 - DNA, 23 bp, Homo sapiens
gacctgaaattccaaagtctcta

SEQ ID NO: 2425633 - DNA, 16 bp, Homo sapiens
gacctgagacctgaag

SEQ ID NO: 2425634 - DNA, 13 bp, Homo sapiens
gacctgagcctgc

SEQ ID NO: 2425635 - DNA, 16 bp, Homo sapiens
gacctgagcctgccga

SEQ ID NO: 2425636 - DNA, 16 bp, Homo sapiens
gacctgcactggggag

SEQ ID NO: 2425637 - DNA, 18 bp, Homo sapiens
gacctgcctgcataggag

SEQ ID NO: 2425638 - DNA, 17 bp, Homo sapiens
gacctgctaggccagag

SEQ ID NO: 2425639 - DNA, 20 bp, Homo sapiens
gacctggaagggaggtgggc

SEQ ID NO: 2425640 - DNA, 17 bp, Homo sapiens
gacctggtaccctcctg

SEQ ID NO: 2425641 - DNA, 19 bp, Homo sapiens
gacctggtaccctcctggc

SEQ ID NO: 2425642 - DNA, 21 bp, Homo sapiens
gacctggtaccctcctggctc

SEQ ID NO: 2425643 - DNA, 16 bp, Homo sapiens
gacctgtgagcccagc

SEQ ID NO: 2425644 - DNA, 19 bp, Homo sapiens
gacctgtgagcccagctgg

SEQ ID NO: 2425645 - DNA, 14 bp, Homo sapiens
gaccttaaatgcaa

SEQ ID NO: 2425646 - DNA, 12 bp, Homo sapiens
gaccttcctcat

SEQ ID NO: 2425647 - DNA, 23 bp, Homo sapiens
gaccttcctcatccaccccatcc

SEQ ID NO: 2425648 - DNA, 18 bp, Homo sapiens
gacgaggggtgtcttggg

SEQ ID NO: 2425649 - DNA, 15 bp, Homo sapiens
gacgcactgagcaac

SEQ ID NO: 2425650 - DNA, 14 bp, Homo sapiens
gacgcctggctgct

SEQ ID NO: 2425651 - DNA, 17 bp, Homo sapiens
gacggggtttcaccatg

SEQ ID NO: 2425652 - DNA, 16 bp, Homo sapiens
gacggtgcccaagcca

SEQ ID NO: 2425653 - DNA, 18 bp, Homo sapiens
gacggtgcccaagccaga

SEQ ID NO: 2425654 - DNA, 23 bp, Homo sapiens
gacggtgcccaagccagaggctg

SEQ ID NO: 2425655 - DNA, 12 bp, Homo sapiens
gacgtggctcag

SEQ ID NO: 2425656 - DNA, 16 bp, Homo sapiens
gacgttttataagcat

SEQ ID NO: 2425657 - DNA, 20 bp, Homo sapiens
gactaaactttttttctgta

SEQ ID NO: 2425658 - DNA, 22 bp, Homo sapiens
gactaaactttttttctgtacc

SEQ ID NO: 2425659 - DNA, 19 bp, Homo sapiens
gactaacactcagaagcct

SEQ ID NO: 2425660 - DNA, 22 bp, Homo sapiens
gactaacactcagaagcctggg

SEQ ID NO: 2425661 - DNA, 21 bp, Homo sapiens
gactaactagacaccaaagtt

SEQ ID NO: 2425662 - DNA, 16 bp, Homo sapiens
gactaagagaagttgt

SEQ ID NO: 2425663 - DNA, 12 bp, Homo sapiens
gactaagccagc

SEQ ID NO: 2425664 - DNA, 22 bp, Homo sapiens
gactaatttcaaaatgcttttt

SEQ ID NO: 2425665 - DNA, 22 bp, Homo sapiens
gactacagctggggtgcaggga

SEQ ID NO: 2425666 - DNA, 19 bp, Homo sapiens
gactagacctccagctgtt

SEQ ID NO: 2425667 - DNA, 21 bp, Homo sapiens
gactagatgatggatgccaat

SEQ ID NO: 2425668 - DNA, 15 bp, Homo sapiens
gactatgaaaagcta

SEQ ID NO: 2425669 - DNA, 19 bp, Homo sapiens
gactatgaaaatgctggct

SEQ ID NO: 2425670 - DNA, 22 bp, Homo sapiens
gactattaggtgcaatttcaag

SEQ ID NO: 2425671 - DNA, 22 bp, Homo sapiens
gactattcttgatgtaaaatct

SEQ ID NO: 2425672 - DNA, 18 bp, Homo sapiens
gactcaagaagtgaagaa

SEQ ID NO: 2425673 - DNA, 18 bp, Homo sapiens
gactcagggcagcgccag

SEQ ID NO: 2425674 - DNA, 16 bp, Homo sapiens
gactcagggctcctgg

SEQ ID NO: 2425675 - DNA, 19 bp, Homo sapiens
gactcagggctcctgggtt

SEQ ID NO: 2425676 - DNA, 19 bp, Homo sapiens
gactcaggtggccctactg

SEQ ID NO: 2425677 - DNA, 14 bp, Homo sapiens
gactccaggcccaa

SEQ ID NO: 2425678 - DNA, 18 bp, Homo sapiens
gactccaggcccaaggct

SEQ ID NO: 2425679 - DNA, 13 bp, Homo sapiens
gactcctcctttt

SEQ ID NO: 2425680 - DNA, 19 bp, Homo sapiens
gactcggtttctccaaact

SEQ ID NO: 2425681 - DNA, 15 bp, Homo sapiens
gactctaaagtctgt

SEQ ID NO: 2425682 - DNA, 16 bp, Homo sapiens
gactctaagaaagaac

SEQ ID NO: 2425683 - DNA, 19 bp, Homo sapiens
gactctagagtccaaggtt

SEQ ID NO: 2425684 - DNA, 15 bp, Homo sapiens
gactctattctttaa

SEQ ID NO: 2425685 - DNA, 14 bp, Homo sapiens
gactctcagtctct

SEQ ID NO: 2425686 - DNA, 18 bp, Homo sapiens
gactctcagtctctgagc

SEQ ID NO: 2425687 - DNA, 16 bp, Homo sapiens
gactctgcagcctcag

SEQ ID NO: 2425688 - DNA, 21 bp, Homo sapiens
gactctgtgctggccagcgag

SEQ ID NO: 2425689 - DNA, 14 bp, Homo sapiens
gactgaccagcagc

SEQ ID NO: 2425690 - DNA, 17 bp, Homo sapiens
gactgatgtctcctaag

SEQ ID NO: 2425691 - DNA, 18 bp, Homo sapiens
gactgatgtctcctaagc

SEQ ID NO: 2425692 - DNA, 16 bp, Homo sapiens
gactgatttcagagtg

SEQ ID NO: 2425693 - DNA, 14 bp, Homo sapiens
gactgctaaataaa

SEQ ID NO: 2425694 - DNA, 16 bp, Homo sapiens
gactgctggtttgtag

SEQ ID NO: 2425695 - DNA, 15 bp, Homo sapiens
gactgctgtggccag

SEQ ID NO: 2425696 - DNA, 20 bp, Homo sapiens
gactgctgtggccaggaggt

SEQ ID NO: 2425697 - DNA, 15 bp, Homo sapiens
gactgcttgccctaa

SEQ ID NO: 2425698 - DNA, 18 bp, Homo sapiens
gactgcttgccctaagca

SEQ ID NO: 2425699 - DNA, 20 bp, Homo sapiens
gactgcttgccctaagcaga

SEQ ID NO: 2425700 - DNA, 22 bp, Homo sapiens
gactggcatactatgtggatgt

SEQ ID NO: 2425701 - DNA, 16 bp, Homo sapiens
ctttgaagtcatacca

SEQ ID NO: 2425702 - DNA, 14 bp, Homo sapiens
ctttgaataaatgt

SEQ ID NO: 2425703 - DNA, 19 bp, Homo sapiens
ctttgaataaatgtcactt

SEQ ID NO: 2425704 - DNA, 21 bp, Homo sapiens
ctttgacctaaattatttact

SEQ ID NO: 2425705 - DNA, 17 bp, Homo sapiens
ctttgagactgggtctc

SEQ ID NO: 2425706 - DNA, 16 bp, Homo sapiens
ctttgatgttccttcc

SEQ ID NO: 2425707 - DNA, 20 bp, Homo sapiens
ctttgattaaagactccagt

SEQ ID NO: 2425708 - DNA, 22 bp, Homo sapiens
ctttgcagccggcacagggtct

SEQ ID NO: 2425709 - DNA, 17 bp, Homo sapiens
ctttgcatggatttctt

SEQ ID NO: 2425710 - DNA, 22 bp, Homo sapiens
ctttgcatggatttctttgaaa

SEQ ID NO: 2425711 - DNA, 14 bp, Homo sapiens
ctttgcattttgga

SEQ ID NO: 2425712 - DNA, 13 bp, Homo sapiens
ctttgccaggtga

SEQ ID NO: 2425713 - DNA, 22 bp, Homo sapiens
ctttgccaggtgactgtctggg

SEQ ID NO: 2425714 - DNA, 13 bp, Homo sapiens
ctttgcgctcctg

SEQ ID NO: 2425715 - DNA, 20 bp, Homo sapiens
ctttgcgctcctggcccagc

SEQ ID NO: 2425716 - DNA, 22 bp, Homo sapiens
ctttgcgctcctggcccagcct

SEQ ID NO: 2425717 - DNA, 17 bp, Homo sapiens
ctttgctcttcaagaaa

SEQ ID NO: 2425718 - DNA, 13 bp, Homo sapiens
ctttgcttgcttt

SEQ ID NO: 2425719 - DNA, 18 bp, Homo sapiens
ctttgcttgctttgaagt

SEQ ID NO: 2425720 - DNA, 19 bp, Homo sapiens
ctttgcttgctttgaagta

SEQ ID NO: 2425721 - DNA, 19 bp, Homo sapiens
ctttgctttaatataaatg

SEQ ID NO: 2425722 - DNA, 21 bp, Homo sapiens
ctttgctttaatataaatgca

SEQ ID NO: 2425723 - DNA, 24 bp, Homo sapiens
ctttggaaagtacactctgctgtt

SEQ ID NO: 2425724 - DNA, 15 bp, Homo sapiens
ctttggaaccagact

SEQ ID NO: 2425725 - DNA, 13 bp, Homo sapiens
ctttggatttgac

SEQ ID NO: 2425726 - DNA, 16 bp, Homo sapiens
ctttggatttgacatt

SEQ ID NO: 2425727 - DNA, 17 bp, Homo sapiens
ctttggatttgacattg

SEQ ID NO: 2425728 - DNA, 13 bp, Homo sapiens
ctttggctcccct

SEQ ID NO: 2425729 - DNA, 18 bp, Homo sapiens
ctttggcttataattctt

SEQ ID NO: 2425730 - DNA, 21 bp, Homo sapiens
ctttggcttataattctttca

SEQ ID NO: 2425731 - DNA, 16 bp, Homo sapiens
ctttgggcttgggcct

SEQ ID NO: 2425732 - DNA, 18 bp, Homo sapiens
ctttggggctaatttaac

SEQ ID NO: 2425733 - DNA, 15 bp, Homo sapiens
ctttggtaccagata

SEQ ID NO: 2425734 - DNA, 16 bp, Homo sapiens
ctttggtctcttgctt

SEQ ID NO: 2425735 - DNA, 17 bp, Homo sapiens
ctttggtctcttgcttg

SEQ ID NO: 2425736 - DNA, 14 bp, Homo sapiens
ctttggttctaagg

SEQ ID NO: 2425737 - DNA, 15 bp, Homo sapiens
ctttggttctaagga

SEQ ID NO: 2425738 - DNA, 13 bp, Homo sapiens
ctttgtgcattct

SEQ ID NO: 2425739 - DNA, 18 bp, Homo sapiens
ctttgttaagactgctga

SEQ ID NO: 2425740 - DNA, 18 bp, Homo sapiens
ctttgttcatagcccagt

SEQ ID NO: 2425741 - DNA, 15 bp, Homo sapiens
ctttgttggagtcaa

SEQ ID NO: 2425742 - DNA, 17 bp, Homo sapiens
ctttgtttcgtggggag

SEQ ID NO: 2425743 - DNA, 14 bp, Homo sapiens
ctttgtttctcccc

SEQ ID NO: 2425744 - DNA, 15 bp, Homo sapiens
ctttgtttctccccc

SEQ ID NO: 2425745 - DNA, 16 bp, Homo sapiens
ctttgtttctccccca

SEQ ID NO: 2425746 - DNA, 15 bp, Homo sapiens
cttttaaagaaaaaa

SEQ ID NO: 2425747 - DNA, 21 bp, Homo sapiens
cttttaaagaaaaaaattgaa

SEQ ID NO: 2425748 - DNA, 22 bp, Homo sapiens
cttttaacagagtctgaaccta

SEQ ID NO: 2425749 - DNA, 21 bp, Homo sapiens
cttttaccctggcccctctcc

SEQ ID NO: 2425750 - DNA, 12 bp, Homo sapiens
cttttataattc

SEQ ID NO: 2425751 - DNA, 21 bp, Homo sapiens
cttttataattctcattaaaa

SEQ ID NO: 2425752 - DNA, 14 bp, Homo sapiens
gaactgcaggccct

SEQ ID NO: 2425753 - DNA, 18 bp, Homo sapiens
gaactgcaggccctggcc

SEQ ID NO: 2425754 - DNA, 13 bp, Homo sapiens
gaactgctgccac

SEQ ID NO: 2425755 - DNA, 17 bp, Homo sapiens
gaacttagattttacat

SEQ ID NO: 2425756 - DNA, 20 bp, Homo sapiens
gaacttagattttacatgaa

SEQ ID NO: 2425757 - DNA, 15 bp, Homo sapiens
gaacttgaccctgag

SEQ ID NO: 2425758 - DNA, 19 bp, Homo sapiens
gaacttgcctgcctttcca

SEQ ID NO: 2425759 - DNA, 22 bp, Homo sapiens
gaacttggggagttaagacctg

SEQ ID NO: 2425760 - DNA, 17 bp, Homo sapiens
gaagaaagaggtgaccc

SEQ ID NO: 2425761 - DNA, 23 bp, Homo sapiens
gaagaaagaggtgaccccagggc

SEQ ID NO: 2425762 - DNA, 13 bp, Homo sapiens
gaagaaccagtcc

SEQ ID NO: 2425763 - DNA, 15 bp, Homo sapiens
gaagaactgcaggcc

SEQ ID NO: 2425764 - DNA, 19 bp, Homo sapiens
gaagaactgcaggccctgg

SEQ ID NO: 2425765 - DNA, 14 bp, Homo sapiens
gaagaaggtgaata

SEQ ID NO: 2425766 - DNA, 23 bp, Homo sapiens
gaagaatacttctcattttttaa

SEQ ID NO: 2425767 - DNA, 14 bp, Homo sapiens
gaagacaattgaca

SEQ ID NO: 2425768 - DNA, 15 bp, Homo sapiens
gaagacagtggcccc

SEQ ID NO: 2425769 - DNA, 22 bp, Homo sapiens
gaagacccattccttcccagag

SEQ ID NO: 2425770 - DNA, 14 bp, Homo sapiens
gaagacctgagaat

SEQ ID NO: 2425771 - DNA, 17 bp, Homo sapiens
gaagacctgagaatgta

SEQ ID NO: 2425772 - DNA, 21 bp, Homo sapiens
gaagacgtgatgccaggacca

SEQ ID NO: 2425773 - DNA, 16 bp, Homo sapiens
gaagactggaagctaa

SEQ ID NO: 2425774 - DNA, 17 bp, Homo sapiens
gaagactggaagctaat

SEQ ID NO: 2425775 - DNA, 19 bp, Homo sapiens
gaagagccttccacccagg

SEQ ID NO: 2425776 - DNA, 22 bp, Homo sapiens
gaagagcgagagatcaaagatg

SEQ ID NO: 2425777 - DNA, 23 bp, Homo sapiens
gaagagtaagtcaacctgcctga

SEQ ID NO: 2425778 - DNA, 20 bp, Homo sapiens
gaagagtttttgtgatgggg

SEQ ID NO: 2425779 - DNA, 22 bp, Homo sapiens
gaagatcctgcgggtggggctt

SEQ ID NO: 2425780 - DNA, 13 bp, Homo sapiens
gaagatgactgag

SEQ ID NO: 2425781 - DNA, 14 bp, Homo sapiens
gaagattctttccc

SEQ ID NO: 2425782 - DNA, 21 bp, Homo sapiens
gaagcaaatgtcatgctgcct

SEQ ID NO: 2425783 - DNA, 16 bp, Homo sapiens
gaagcaagcttaatgg

SEQ ID NO: 2425784 - DNA, 18 bp, Homo sapiens
gaagcagcaacttgtcct

SEQ ID NO: 2425785 - DNA, 19 bp, Homo sapiens
gaagcagcaacttgtccta

SEQ ID NO: 2425786 - DNA, 21 bp, Homo sapiens
gaagcattctcattggaaatt

SEQ ID NO: 2425787 - DNA, 18 bp, Homo sapiens
gaagccagcttgtttaca

SEQ ID NO: 2425788 - DNA, 21 bp, Homo sapiens
gaagccaggaatttcccagga

SEQ ID NO: 2425789 - DNA, 17 bp, Homo sapiens
gaagccatcacctcaga

SEQ ID NO: 2425790 - DNA, 22 bp, Homo sapiens
gaagccatcacctcagatggca

SEQ ID NO: 2425791 - DNA, 14 bp, Homo sapiens
gaagcccagagggt

SEQ ID NO: 2425792 - DNA, 17 bp, Homo sapiens
gaagcccagagggtctg

SEQ ID NO: 2425793 - DNA, 21 bp, Homo sapiens
gaagcccccagctaagaacct

SEQ ID NO: 2425794 - DNA, 18 bp, Homo sapiens
gaagcccggctcctggtc

SEQ ID NO: 2425795 - DNA, 22 bp, Homo sapiens
gaagccgtcctggcgcctggca

SEQ ID NO: 2425796 - DNA, 19 bp, Homo sapiens
gaagcctcagattccttcc

SEQ ID NO: 2425797 - DNA, 21 bp, Homo sapiens
gaagcctcagattccttccca

SEQ ID NO: 2425798 - DNA, 17 bp, Homo sapiens
gaagcctgggggcctgg

SEQ ID NO: 2425799 - DNA, 20 bp, Homo sapiens
gaagccttcaagctctgagg

SEQ ID NO: 2425800 - DNA, 14 bp, Homo sapiens
gaagctaacaggga

SEQ ID NO: 2425801 - DNA, 17 bp, Homo sapiens
gaagctaacagggaagg

SEQ ID NO: 2425802 - DNA, 20 bp, Homo sapiens
gaagctaacagggaaggcag

SEQ ID NO: 2425803 - DNA, 23 bp, Homo sapiens
gaagctactgtgtgtgtgaatga

SEQ ID NO: 2425804 - DNA, 18 bp, Homo sapiens
gaagctagacacatgaag

SEQ ID NO: 2425805 - DNA, 12 bp, Homo sapiens
gaagctcagctg

SEQ ID NO: 2425806 - DNA, 21 bp, Homo sapiens
gaagctcagctgcattccgca

SEQ ID NO: 2425807 - DNA, 20 bp, Homo sapiens
gaagctcctctccccagccc

SEQ ID NO: 2425808 - DNA, 22 bp, Homo sapiens
gaagctcctctccccagcccag

SEQ ID NO: 2425809 - DNA, 23 bp, Homo sapiens
gaagctcctctccccagcccaga

SEQ ID NO: 2425810 - DNA, 12 bp, Homo sapiens
gaaggagctgcc

SEQ ID NO: 2425811 - DNA, 15 bp, Homo sapiens
gaaggagctgcctgg

SEQ ID NO: 2425812 - DNA, 13 bp, Homo sapiens
gaaggcaggcagg

SEQ ID NO: 2425813 - DNA, 16 bp, Homo sapiens
gaaggcaggcagggct

SEQ ID NO: 2425814 - DNA, 23 bp, Homo sapiens
gaaggcaggcagggctctcctgg

SEQ ID NO: 2425815 - DNA, 17 bp, Homo sapiens
gaaggcatttgcagggt

SEQ ID NO: 2425816 - DNA, 22 bp, Homo sapiens
gaaggctacttcggggctggga

SEQ ID NO: 2425817 - DNA, 21 bp, Homo sapiens
gaaggcttgggatttgctgtg

SEQ ID NO: 2425818 - DNA, 20 bp, Homo sapiens
gaaggcttgttgtgctttta

SEQ ID NO: 2425819 - DNA, 13 bp, Homo sapiens
gaagggagccaag

SEQ ID NO: 2425820 - DNA, 15 bp, Homo sapiens
gaagggagccaaggg

SEQ ID NO: 2425821 - DNA, 17 bp, Homo sapiens
gaagggagggcagagct

SEQ ID NO: 2425822 - DNA, 16 bp, Homo sapiens
gaagggccagagccag

SEQ ID NO: 2425823 - DNA, 22 bp, Homo sapiens
gaagggctgcttccctgaagct

SEQ ID NO: 2425824 - DNA, 17 bp, Homo sapiens
gaaggggttggattgca

SEQ ID NO: 2425825 - DNA, 13 bp, Homo sapiens
gaagggtaaacaa

SEQ ID NO: 2425826 - DNA, 17 bp, Homo sapiens
gaagggtaaacaatata

SEQ ID NO: 2425827 - DNA, 13 bp, Homo sapiens
gaaggtaaataaa

SEQ ID NO: 2425828 - DNA, 21 bp, Homo sapiens
gaaggtgaggagcttgaaacc

SEQ ID NO: 2425829 - DNA, 13 bp, Homo sapiens
gaagtcacagggc

SEQ ID NO: 2425830 - DNA, 20 bp, Homo sapiens
gaagtcacagggcagtacct

SEQ ID NO: 2425831 - DNA, 18 bp, Homo sapiens
gaagtcataccaatgaaa

SEQ ID NO: 2425832 - DNA, 22 bp, Homo sapiens
gaagtcgtccttactcctgtgg

SEQ ID NO: 2425833 - DNA, 23 bp, Homo sapiens
gaagtcgtccttactcctgtggg

SEQ ID NO: 2425834 - DNA, 24 bp, Homo sapiens
gaagtcgtccttactcctgtggga

SEQ ID NO: 2425835 - DNA, 14 bp, Homo sapiens
gaagtcttttgttc

SEQ ID NO: 2425836 - DNA, 15 bp, Homo sapiens
gaagtgaatgctggg

SEQ ID NO: 2425837 - DNA, 20 bp, Homo sapiens
gaagtgctgtttattaatct

SEQ ID NO: 2425838 - DNA, 17 bp, Homo sapiens
gaagttagctttaactt

SEQ ID NO: 2425839 - DNA, 15 bp, Homo sapiens
gaagttagtttgtat

SEQ ID NO: 2425840 - DNA, 16 bp, Homo sapiens
gaataaaggcagtttt

SEQ ID NO: 2425841 - DNA, 19 bp, Homo sapiens
gaataaattgtacagccgg

SEQ ID NO: 2425842 - DNA, 20 bp, Homo sapiens
gaataaattgtacagccggc

SEQ ID NO: 2425843 - DNA, 20 bp, Homo sapiens
gaataaggtacaagaagcat

SEQ ID NO: 2425844 - DNA, 16 bp, Homo sapiens
gaataagttattgcag

SEQ ID NO: 2425845 - DNA, 18 bp, Homo sapiens
gaataagttattgcagtt

SEQ ID NO: 2425846 - DNA, 19 bp, Homo sapiens
gaataagttattgcagttt

SEQ ID NO: 2425847 - DNA, 17 bp, Homo sapiens
gaataccactctgtaat

SEQ ID NO: 2425848 - DNA, 19 bp, Homo sapiens
gaataccactctgtaattg

SEQ ID NO: 2425849 - DNA, 13 bp, Homo sapiens
gaatacctgctca

SEQ ID NO: 2425850 - DNA, 22 bp, Homo sapiens
gaatactgaacatctgagtcct

SEQ ID NO: 2425851 - DNA, 13 bp, Homo sapiens
gaatactgctaca

SEQ ID NO: 2425852 - DNA, 24 bp, Homo sapiens
gaatactttgcagcacagctgaga

SEQ ID NO: 2425853 - DNA, 19 bp, Homo sapiens
gaatacttttgccctttga

SEQ ID NO: 2425854 - DNA, 15 bp, Homo sapiens
gaatagcatgtcact

SEQ ID NO: 2425855 - DNA, 14 bp, Homo sapiens
ctgcttctctgact

SEQ ID NO: 2425856 - DNA, 17 bp, Homo sapiens
ctgcttctctgacttct

SEQ ID NO: 2425857 - DNA, 22 bp, Homo sapiens
ctgcttctctgacttctgcctg

SEQ ID NO: 2425858 - DNA, 18 bp, Homo sapiens
ctgcttgccaaggcagag

SEQ ID NO: 2425859 - DNA, 22 bp, Homo sapiens
ctgcttggggggtgatgagggc

SEQ ID NO: 2425860 - DNA, 13 bp, Homo sapiens
ctgctttctgttc

SEQ ID NO: 2425861 - DNA, 15 bp, Homo sapiens
ctgctttctgttcca

SEQ ID NO: 2425862 - DNA, 17 bp, Homo sapiens
ctgctttctgttccaaa

SEQ ID NO: 2425863 - DNA, 18 bp, Homo sapiens
ctgctttctgttccaaat

SEQ ID NO: 2425864 - DNA, 22 bp, Homo sapiens
ctgctttttccaactcagaaat

SEQ ID NO: 2425865 - DNA, 16 bp, Homo sapiens
ctggaaaacagaacac

SEQ ID NO: 2425866 - DNA, 17 bp, Homo sapiens
ctggaaaataatactgc

SEQ ID NO: 2425867 - DNA, 20 bp, Homo sapiens
ctggaacactagacaagcca

SEQ ID NO: 2425868 - DNA, 21 bp, Homo sapiens
ctggaacactagacaagccag

SEQ ID NO: 2425869 - DNA, 14 bp, Homo sapiens
ctggaacccagact

SEQ ID NO: 2425870 - DNA, 16 bp, Homo sapiens
ctggaacccagactca

SEQ ID NO: 2425871 - DNA, 18 bp, Homo sapiens
ctggaacccagactcaga

SEQ ID NO: 2425872 - DNA, 18 bp, Homo sapiens
ctggaacctcagcctggc

SEQ ID NO: 2425873 - DNA, 14 bp, Homo sapiens
ctggaagatcctgc

SEQ ID NO: 2425874 - DNA, 22 bp, Homo sapiens
ctggaagctaatttgcattaaa

SEQ ID NO: 2425875 - DNA, 20 bp, Homo sapiens
ctggaagctgggaggtcagg

SEQ ID NO: 2425876 - DNA, 19 bp, Homo sapiens
ctggaatgagttgaggcca

SEQ ID NO: 2425877 - DNA, 15 bp, Homo sapiens
ctggaatgtaatcaa

SEQ ID NO: 2425878 - DNA, 14 bp, Homo sapiens
ctggacagctgtgc

SEQ ID NO: 2425879 - DNA, 16 bp, Homo sapiens
ctggacagctgtgcct

SEQ ID NO: 2425880 - DNA, 17 bp, Homo sapiens
ctggacagctgtgcctc

SEQ ID NO: 2425881 - DNA, 19 bp, Homo sapiens
ctggacagctgtgcctcgc

SEQ ID NO: 2425882 - DNA, 20 bp, Homo sapiens
ctggacagctgtgcctcgct

SEQ ID NO: 2425883 - DNA, 23 bp, Homo sapiens
ctggacatgaagattctttccca

SEQ ID NO: 2425884 - DNA, 20 bp, Homo sapiens
ctggacccagccaggcccag

SEQ ID NO: 2425885 - DNA, 22 bp, Homo sapiens
ctggacccagccaggcccagcc

SEQ ID NO: 2425886 - DNA, 15 bp, Homo sapiens
ctggacccctgcatt

SEQ ID NO: 2425887 - DNA, 19 bp, Homo sapiens
ctggacctctgacagcagc

SEQ ID NO: 2425888 - DNA, 17 bp, Homo sapiens
ctggactctcagtctct

SEQ ID NO: 2425889 - DNA, 20 bp, Homo sapiens
ctggactctcagtctctgag

SEQ ID NO: 2425890 - DNA, 18 bp, Homo sapiens
ctggacttaagcatctgg

SEQ ID NO: 2425891 - DNA, 14 bp, Homo sapiens
ctggactttcctgc

SEQ ID NO: 2425892 - DNA, 18 bp, Homo sapiens
ctggactttcctgcaact

SEQ ID NO: 2425893 - DNA, 23 bp, Homo sapiens
ctggagaaagggccctgggcctg

SEQ ID NO: 2425894 - DNA, 19 bp, Homo sapiens
ctggagaccaccagggcat

SEQ ID NO: 2425895 - DNA, 22 bp, Homo sapiens
ctggagaccaccagggcatctc

SEQ ID NO: 2425896 - DNA, 21 bp, Homo sapiens
ctggagacttagggcaccagg

SEQ ID NO: 2425897 - DNA, 23 bp, Homo sapiens
ctggagcacaaagaccctggctt

SEQ ID NO: 2425898 - DNA, 18 bp, Homo sapiens
ctggagcagaccaccccg

SEQ ID NO: 2425899 - DNA, 14 bp, Homo sapiens
ctggagcatttctc

SEQ ID NO: 2425900 - DNA, 12 bp, Homo sapiens
ctggaggacctg

SEQ ID NO: 2425901 - DNA, 19 bp, Homo sapiens
ctggaggacctgagcctgc

SEQ ID NO: 2425902 - DNA, 21 bp, Homo sapiens
ctggaggacctgagcctgccg

SEQ ID NO: 2425903 - DNA, 19 bp, Homo sapiens
ctggaggagcccaggccag

SEQ ID NO: 2425904 - DNA, 24 bp, Homo sapiens
ctggaggcacctggtggccatgct

SEQ ID NO: 2425905 - DNA, 20 bp, Homo sapiens
ctggaggcaggggcttcctg

SEQ ID NO: 2425906 - DNA, 13 bp, Homo sapiens
ctggaggcccagg

SEQ ID NO: 2425907 - DNA, 17 bp, Homo sapiens
ctggaggcccaggctgg

SEQ ID NO: 2425908 - DNA, 16 bp, Homo sapiens
ctggagttagggactg

SEQ ID NO: 2425909 - DNA, 15 bp, Homo sapiens
ctggagttgatctgg

SEQ ID NO: 2425910 - DNA, 16 bp, Homo sapiens
ctggagttgatctgga

SEQ ID NO: 2425911 - DNA, 13 bp, Homo sapiens
ctggagtttcatg

SEQ ID NO: 2425912 - DNA, 22 bp, Homo sapiens
ctggataacttccacagggtcc

SEQ ID NO: 2425913 - DNA, 13 bp, Homo sapiens
ctggatcagcgtg

SEQ ID NO: 2425914 - DNA, 17 bp, Homo sapiens
ctggatcagcgtggcct

SEQ ID NO: 2425915 - DNA, 14 bp, Homo sapiens
ctggatgagctccc

SEQ ID NO: 2425916 - DNA, 13 bp, Homo sapiens
ctggatggggcag

SEQ ID NO: 2425917 - DNA, 15 bp, Homo sapiens
ctggatgtaccacca

SEQ ID NO: 2425918 - DNA, 16 bp, Homo sapiens
ctggattattctgggg

SEQ ID NO: 2425919 - DNA, 14 bp, Homo sapiens
ctggcagagatgcc

SEQ ID NO: 2425920 - DNA, 17 bp, Homo sapiens
ctggcagagatgcctcc

SEQ ID NO: 2425921 - DNA, 18 bp, Homo sapiens
ctggcagagatgcctccc

SEQ ID NO: 2425922 - DNA, 12 bp, Homo sapiens
ctggcagcctcc

SEQ ID NO: 2425923 - DNA, 22 bp, Homo sapiens
ctggcagcctcccatccagggc

SEQ ID NO: 2425924 - DNA, 18 bp, Homo sapiens
ctggcagctctggacagc

SEQ ID NO: 2425925 - DNA, 22 bp, Homo sapiens
cttgtaactaaaataattttgt

SEQ ID NO: 2425926 - DNA, 18 bp, Homo sapiens
cttgtaattatggagtca

SEQ ID NO: 2425927 - DNA, 13 bp, Homo sapiens
cttgtaattctaa

SEQ ID NO: 2425928 - DNA, 15 bp, Homo sapiens
cttgtaattctaaat

SEQ ID NO: 2425929 - DNA, 16 bp, Homo sapiens
cttgtaattctaaatg

SEQ ID NO: 2425930 - DNA, 21 bp, Homo sapiens
cttgtagccctttccaagctt

SEQ ID NO: 2425931 - DNA, 13 bp, Homo sapiens
cttgtagctcctc

SEQ ID NO: 2425932 - DNA, 18 bp, Homo sapiens
cttgtagctcctcccctg

SEQ ID NO: 2425933 - DNA, 21 bp, Homo sapiens
cttgtagctcctcccctggag

SEQ ID NO: 2425934 - DNA, 17 bp, Homo sapiens
cttgtcaggagtgtgtg

SEQ ID NO: 2425935 - DNA, 18 bp, Homo sapiens
cttgtcatgtgtataaaa

SEQ ID NO: 2425936 - DNA, 22 bp, Homo sapiens
cttgtcattgttatataatcat

SEQ ID NO: 2425937 - DNA, 13 bp, Homo sapiens
cttgtccagctga

SEQ ID NO: 2425938 - DNA, 16 bp, Homo sapiens
cttgtcctagcacaga

SEQ ID NO: 2425939 - DNA, 14 bp, Homo sapiens
cttgtccttagcct

SEQ ID NO: 2425940 - DNA, 18 bp, Homo sapiens
cttgtccttagcctggac

SEQ ID NO: 2425941 - DNA, 19 bp, Homo sapiens
cttgtccttagcctggacc

SEQ ID NO: 2425942 - DNA, 15 bp, Homo sapiens
cttgtcctttccctt

SEQ ID NO: 2425943 - DNA, 22 bp, Homo sapiens
cttgtcgcccctccctcccaga

SEQ ID NO: 2425944 - DNA, 20 bp, Homo sapiens
cttgtctataaagcatttaa

SEQ ID NO: 2425945 - DNA, 15 bp, Homo sapiens
cttgtgcagtgttga

SEQ ID NO: 2425946 - DNA, 16 bp, Homo sapiens
cttgtggcagcaacgg

SEQ ID NO: 2425947 - DNA, 12 bp, Homo sapiens
cttgtgggcctg

SEQ ID NO: 2425948 - DNA, 15 bp, Homo sapiens
cttgtgggcctgggc

SEQ ID NO: 2425949 - DNA, 19 bp, Homo sapiens
cttgtgggcctgggctcct

SEQ ID NO: 2425950 - DNA, 21 bp, Homo sapiens
cttgtgggcctgggctcctgg

SEQ ID NO: 2425951 - DNA, 22 bp, Homo sapiens
cttgtgggcctgggctcctgga

SEQ ID NO: 2425952 - DNA, 23 bp, Homo sapiens
cttgtgggcctgggctcctggac

SEQ ID NO: 2425953 - DNA, 17 bp, Homo sapiens
cttgtggggcctgggag

SEQ ID NO: 2425954 - DNA, 18 bp, Homo sapiens
cttgtggggcctgggagg

SEQ ID NO: 2425955 - DNA, 14 bp, Homo sapiens
cttgttccctctcc

SEQ ID NO: 2425956 - DNA, 18 bp, Homo sapiens
cttgttgagccgtgggca

SEQ ID NO: 2425957 - DNA, 15 bp, Homo sapiens
cttgttgtgctttta

SEQ ID NO: 2425958 - DNA, 17 bp, Homo sapiens
cttgttgtgcttttagt

SEQ ID NO: 2425959 - DNA, 15 bp, Homo sapiens
cttgttgtttcttgc

SEQ ID NO: 2425960 - DNA, 18 bp, Homo sapiens
cttgtttacatgcttatt

SEQ ID NO: 2425961 - DNA, 13 bp, Homo sapiens
cttgtttgatttc

SEQ ID NO: 2425962 - DNA, 14 bp, Homo sapiens
cttgttttggatgc

SEQ ID NO: 2425963 - DNA, 18 bp, Homo sapiens
ctttaaaagatgctttta

SEQ ID NO: 2425964 - DNA, 19 bp, Homo sapiens
ctttaaaatgtaaagccat

SEQ ID NO: 2425965 - DNA, 22 bp, Homo sapiens
ctttaacaacatgtttccagca

SEQ ID NO: 2425966 - DNA, 22 bp, Homo sapiens
ctttaactcccattaccatgta

SEQ ID NO: 2425967 - DNA, 19 bp, Homo sapiens
ctttaagagtttaaaatca

SEQ ID NO: 2425968 - DNA, 20 bp, Homo sapiens
ctttaagagtttaaaatcat

SEQ ID NO: 2425969 - DNA, 22 bp, Homo sapiens
ctttaagagtttaaaatcatca

SEQ ID NO: 2425970 - DNA, 12 bp, Homo sapiens
ctttaatataaa

SEQ ID NO: 2425971 - DNA, 17 bp, Homo sapiens
ctttaatgttttttgcc

SEQ ID NO: 2425972 - DNA, 14 bp, Homo sapiens
ctttaattctgtat

SEQ ID NO: 2425973 - DNA, 18 bp, Homo sapiens
ctttacaaaacaaactca

SEQ ID NO: 2425974 - DNA, 23 bp, Homo sapiens
ctttacaaaacaaactcattcat

SEQ ID NO: 2425975 - DNA, 19 bp, Homo sapiens
ctttaccaaagatgaatga

SEQ ID NO: 2425976 - DNA, 16 bp, Homo sapiens
ctttacccatttgggt

SEQ ID NO: 2425977 - DNA, 14 bp, Homo sapiens
ctttagaaacagtg

SEQ ID NO: 2425978 - DNA, 17 bp, Homo sapiens
ctgaggtgcccaggaga

SEQ ID NO: 2425979 - DNA, 17 bp, Homo sapiens
ctgaggttactggaaat

SEQ ID NO: 2425980 - DNA, 19 bp, Homo sapiens
ctgaggttactggaaatta

SEQ ID NO: 2425981 - DNA, 16 bp, Homo sapiens
ctgagtattaaaatgt

SEQ ID NO: 2425982 - DNA, 22 bp, Homo sapiens
ctgagtattaaaatgtatgcat

SEQ ID NO: 2425983 - DNA, 18 bp, Homo sapiens
ctgagtcagagccatgtc

SEQ ID NO: 2425984 - DNA, 19 bp, Homo sapiens
ctgagtcagagccatgtct

SEQ ID NO: 2425985 - DNA, 17 bp, Homo sapiens
ctgagtcaggacttgaa

SEQ ID NO: 2425986 - DNA, 17 bp, Homo sapiens
ctgagtcgtgacctgct

SEQ ID NO: 2425987 - DNA, 20 bp, Homo sapiens
ctgagtcgtgacctgctagg

SEQ ID NO: 2425988 - DNA, 13 bp, Homo sapiens
ctgagtgggaagc

SEQ ID NO: 2425989 - DNA, 21 bp, Homo sapiens
ctgagtgggaagcccatcctg

SEQ ID NO: 2425990 - DNA, 20 bp, Homo sapiens
ctgagttggagctcattctg

SEQ ID NO: 2425991 - DNA, 21 bp, Homo sapiens
ctgagttggagctcattctgt

SEQ ID NO: 2425992 - DNA, 12 bp, Homo sapiens
ctgagtttccta

SEQ ID NO: 2425993 - DNA, 19 bp, Homo sapiens
ctgagtttcctatgggaac

SEQ ID NO: 2425994 - DNA, 20 bp, Homo sapiens
ctgagttttgtgtttgttgt

SEQ ID NO: 2425995 - DNA, 15 bp, Homo sapiens
ctgataattttaaat

SEQ ID NO: 2425996 - DNA, 12 bp, Homo sapiens
ctgatcaaggcc

SEQ ID NO: 2425997 - DNA, 15 bp, Homo sapiens
gcaaccaggaacagc

SEQ ID NO: 2425998 - DNA, 15 bp, Homo sapiens
gcaacccgtgccaag

SEQ ID NO: 2425999 - DNA, 19 bp, Homo sapiens
gcaacccgtgccaagtcca

SEQ ID NO: 2426000 - DNA, 22 bp, Homo sapiens
gcaacccgtgccaagtccaggt

SEQ ID NO: 2426001 - DNA, 22 bp, Homo sapiens
gcaaccgtggcccttcctggac

SEQ ID NO: 2426002 - DNA, 24 bp, Homo sapiens
gcaaccgtggcccttcctggacag

SEQ ID NO: 2426003 - DNA, 18 bp, Homo sapiens
gcaacgctattccagctg

SEQ ID NO: 2426004 - DNA, 15 bp, Homo sapiens
gcaactcttgattat

SEQ ID NO: 2426005 - DNA, 16 bp, Homo sapiens
gcaagaaggcaaaaat

SEQ ID NO: 2426006 - DNA, 20 bp, Homo sapiens
gcaagaaggcaaaaatagtt

SEQ ID NO: 2426007 - DNA, 21 bp, Homo sapiens
gcaagaaggcaaaaatagttt

SEQ ID NO: 2426008 - DNA, 21 bp, Homo sapiens
gcaagaatcagagaaggaaca

SEQ ID NO: 2426009 - DNA, 19 bp, Homo sapiens
gcaagacttctctttgcct

SEQ ID NO: 2426010 - DNA, 23 bp, Homo sapiens
gcaagaggccgtggctgctgtgg

SEQ ID NO: 2426011 - DNA, 23 bp, Homo sapiens
gcaagcaagaggccgtggctgct

SEQ ID NO: 2426012 - DNA, 15 bp, Homo sapiens
gcaagcacagccctt

SEQ ID NO: 2426013 - DNA, 17 bp, Homo sapiens
gcaagcattcagaagaa

SEQ ID NO: 2426014 - DNA, 18 bp, Homo sapiens
gcaagcattcagaagaaa

SEQ ID NO: 2426015 - DNA, 19 bp, Homo sapiens
gcaagctgattaaatgaca

SEQ ID NO: 2426016 - DNA, 14 bp, Homo sapiens
gcaaggcccgagca

SEQ ID NO: 2426017 - DNA, 20 bp, Homo sapiens
gcaaggcccgagcagctgag

SEQ ID NO: 2426018 - DNA, 22 bp, Homo sapiens
gcaaggcccgagcagctgagca

SEQ ID NO: 2426019 - DNA, 15 bp, Homo sapiens
gcaaggtactctggt

SEQ ID NO: 2426020 - DNA, 18 bp, Homo sapiens
gcaataaatctgacccag

SEQ ID NO: 2426021 - DNA, 19 bp, Homo sapiens
gcaataaatctgacccagt

SEQ ID NO: 2426022 - DNA, 16 bp, Homo sapiens
gcaatgatgaatgaga

SEQ ID NO: 2426023 - DNA, 13 bp, Homo sapiens
gcaatgccacagc

SEQ ID NO: 2426024 - DNA, 17 bp, Homo sapiens
gcaatgccacagccctg

SEQ ID NO: 2426025 - DNA, 19 bp, Homo sapiens
gcaatgggagctgaggcca

SEQ ID NO: 2426026 - DNA, 19 bp, Homo sapiens
gcaatgtaaatattttaaa

SEQ ID NO: 2426027 - DNA, 23 bp, Homo sapiens
gcaatgtaaatattttaaagaat

SEQ ID NO: 2426028 - DNA, 16 bp, Homo sapiens
gcaatgtgtataaaca

SEQ ID NO: 2426029 - DNA, 18 bp, Homo sapiens
gcaatgtgtgtatatgga

SEQ ID NO: 2426030 - DNA, 14 bp, Homo sapiens
gcaattcccctctg

SEQ ID NO: 2426031 - DNA, 12 bp, Homo sapiens
gcaattgccttt

SEQ ID NO: 2426032 - DNA, 13 bp, Homo sapiens
gcaattgcctttt

SEQ ID NO: 2426033 - DNA, 23 bp, Homo sapiens
gcaattggcaccgaagcccagag

SEQ ID NO: 2426034 - DNA, 12 bp, Homo sapiens
gcaattgtctga

SEQ ID NO: 2426035 - DNA, 19 bp, Homo sapiens
gcaatttctaatttttaag

SEQ ID NO: 2426036 - DNA, 13 bp, Homo sapiens
gcacaaaacccag

SEQ ID NO: 2426037 - DNA, 15 bp, Homo sapiens
gcacaagaatggatc

SEQ ID NO: 2426038 - DNA, 12 bp, Homo sapiens
gcacaagactga

SEQ ID NO: 2426039 - DNA, 18 bp, Homo sapiens
gcacaataaatggctgta

SEQ ID NO: 2426040 - DNA, 19 bp, Homo sapiens
gcacaataaatggctgtaa

SEQ ID NO: 2426041 - DNA, 22 bp, Homo sapiens
gcacaataactcctcccagggt

SEQ ID NO: 2426042 - DNA, 19 bp, Homo sapiens
gcacaatgtagataagtgt

SEQ ID NO: 2426043 - DNA, 13 bp, Homo sapiens
gcacacagctact

SEQ ID NO: 2426044 - DNA, 14 bp, Homo sapiens
gcacactttgccat

SEQ ID NO: 2426045 - DNA, 22 bp, Homo sapiens
gcacactttgccatattttcac

SEQ ID NO: 2426046 - DNA, 16 bp, Homo sapiens
gcacagagagtctgga

SEQ ID NO: 2426047 - DNA, 15 bp, Homo sapiens
gcacagcttagattt

SEQ ID NO: 2426048 - DNA, 17 bp, Homo sapiens
gcacagcttagatttca

SEQ ID NO: 2426049 - DNA, 14 bp, Homo sapiens
gcacagcttgacct

SEQ ID NO: 2426050 - DNA, 18 bp, Homo sapiens
gcacagcttgacctgagg

SEQ ID NO: 2426051 - DNA, 19 bp, Homo sapiens
gcacagcttgacctgaggc

SEQ ID NO: 2426052 - DNA, 22 bp, Homo sapiens
gcacagcttgacctgaggctgt

SEQ ID NO: 2426053 - DNA, 15 bp, Homo sapiens
gcacaggagctacct

SEQ ID NO: 2426054 - DNA, 21 bp, Homo sapiens
gcacaggagctacctgtgtgg

SEQ ID NO: 2426055 - DNA, 15 bp, Homo sapiens
gcacaggctaatttt

SEQ ID NO: 2426056 - DNA, 16 bp, Homo sapiens
gcacaggctaattttt

SEQ ID NO: 2426057 - DNA, 18 bp, Homo sapiens
gcacagggtctgctcttt

SEQ ID NO: 2426058 - DNA, 16 bp, Homo sapiens
gcacagtgacttctga

SEQ ID NO: 2426059 - DNA, 17 bp, Homo sapiens
gcacagtgacttctgag

SEQ ID NO: 2426060 - DNA, 18 bp, Homo sapiens
gcacatctcaacaggcct

SEQ ID NO: 2426061 - DNA, 13 bp, Homo sapiens
gcacatctgcatt

SEQ ID NO: 2426062 - DNA, 21 bp, Homo sapiens
gcacatctgcattttcacccc

SEQ ID NO: 2426063 - DNA, 21 bp, Homo sapiens
gcacatctgtaaatctacaca

SEQ ID NO: 2426064 - DNA, 14 bp, Homo sapiens
gcaccaaaagaagt

SEQ ID NO: 2426065 - DNA, 15 bp, Homo sapiens
gcaccaaaagaagta

SEQ ID NO: 2426066 - DNA, 16 bp, Homo sapiens
gcaccaaaagaagtaa

SEQ ID NO: 2426067 - DNA, 13 bp, Homo sapiens
gcaccaccaagcc

SEQ ID NO: 2426068 - DNA, 14 bp, Homo sapiens
gcaccagacaccca

SEQ ID NO: 2426069 - DNA, 15 bp, Homo sapiens
gcaccagacacccag

SEQ ID NO: 2426070 - DNA, 17 bp, Homo sapiens
gcaccagacacccagga

SEQ ID NO: 2426071 - DNA, 14 bp, Homo sapiens
gcaccaggaagccg

SEQ ID NO: 2426072 - DNA, 20 bp, Homo sapiens
gcaccatgctgctggggaag

SEQ ID NO: 2426073 - DNA, 23 bp, Homo sapiens
gcaccattctgactcggtttctc

SEQ ID NO: 2426074 - DNA, 21 bp, Homo sapiens
gcacccatctgtctgccaacc

SEQ ID NO: 2426075 - DNA, 20 bp, Homo sapiens
gcaccccaaagctttcctgc

SEQ ID NO: 2426076 - DNA, 13 bp, Homo sapiens
gcacccccagcct

SEQ ID NO: 2426077 - DNA, 14 bp, Homo sapiens
gcacccccagcctg

SEQ ID NO: 2426078 - DNA, 17 bp, Homo sapiens
gcacccccagcctgggc

SEQ ID NO: 2426079 - DNA, 20 bp, Homo sapiens
gcacccccagcctgggccta

SEQ ID NO: 2426080 - DNA, 16 bp, Homo sapiens
gcacccccgtcaagag

SEQ ID NO: 2426081 - DNA, 19 bp, Homo sapiens
gcaccccctgcagcttgta

SEQ ID NO: 2426082 - DNA, 14 bp, Homo sapiens
gcaccgaagcccag

SEQ ID NO: 2426083 - DNA, 16 bp, Homo sapiens
gcaccgaagcccagag

SEQ ID NO: 2426084 - DNA, 19 bp, Homo sapiens
gcaccggaccagcctggcc

SEQ ID NO: 2426085 - DNA, 21 bp, Homo sapiens
gcaccggaccagcctggccca

SEQ ID NO: 2426086 - DNA, 14 bp, Homo sapiens
gcaccgttctgtgc

SEQ ID NO: 2426087 - DNA, 16 bp, Homo sapiens
gcacctaatccaggca

SEQ ID NO: 2426088 - DNA, 16 bp, Homo sapiens
gcacctcctcagcctg

SEQ ID NO: 2426089 - DNA, 15 bp, Homo sapiens
gcacctgcctcagga

SEQ ID NO: 2426090 - DNA, 16 bp, Homo sapiens
gcacctgcctccagcc

SEQ ID NO: 2426091 - DNA, 17 bp, Homo sapiens
gcacctgcctccagccg

SEQ ID NO: 2426092 - DNA, 12 bp, Homo sapiens
gcacctgctgtc

SEQ ID NO: 2426093 - DNA, 17 bp, Homo sapiens
gcacctgggccctgggg

SEQ ID NO: 2426094 - DNA, 23 bp, Homo sapiens
gcacctgggccctggggcctgta

SEQ ID NO: 2426095 - DNA, 22 bp, Homo sapiens
gcacctggtggccatgctcctc

SEQ ID NO: 2426096 - DNA, 15 bp, Homo sapiens
gcacgaaatgttatt

SEQ ID NO: 2426097 - DNA, 20 bp, Homo sapiens
gcacgcggagtgagtttttt

SEQ ID NO: 2426098 - DNA, 22 bp, Homo sapiens
gcacggctctgtccccagcctg

SEQ ID NO: 2426099 - DNA, 21 bp, Homo sapiens
gcacgggtgtcacggccaggc

SEQ ID NO: 2426100 - DNA, 17 bp, Homo sapiens
gcacgtggcctcttgag

SEQ ID NO: 2426101 - DNA, 16 bp, Homo sapiens
gacaaatcacatattt

SEQ ID NO: 2426102 - DNA, 16 bp, Homo sapiens
gacaacacccattttt

SEQ ID NO: 2426103 - DNA, 17 bp, Homo sapiens
gacaaccactggtctgt

SEQ ID NO: 2426104 - DNA, 15 bp, Homo sapiens
gacaacgtgctcttt

SEQ ID NO: 2426105 - DNA, 22 bp, Homo sapiens
gacaactgctcccacctcctga

SEQ ID NO: 2426106 - DNA, 12 bp, Homo sapiens
gacaactggcag

SEQ ID NO: 2426107 - DNA, 16 bp, Homo sapiens
gacaactggcaggcag

SEQ ID NO: 2426108 - DNA, 21 bp, Homo sapiens
gacaagcatggtcccacatcc

SEQ ID NO: 2426109 - DNA, 20 bp, Homo sapiens
gacaagtggactcagggcag

SEQ ID NO: 2426110 - DNA, 15 bp, Homo sapiens
gacaatcatgtgtgt

SEQ ID NO: 2426111 - DNA, 14 bp, Homo sapiens
gacaatggaccgga

SEQ ID NO: 2426112 - DNA, 19 bp, Homo sapiens
gacacaaacacacacaaaa

SEQ ID NO: 2426113 - DNA, 15 bp, Homo sapiens
gacacaccaggcgct

SEQ ID NO: 2426114 - DNA, 18 bp, Homo sapiens
gacacaccaggcgctaat

SEQ ID NO: 2426115 - DNA, 15 bp, Homo sapiens
gacacactaaccaag

SEQ ID NO: 2426116 - DNA, 18 bp, Homo sapiens
gacacagaaaatgttgag

SEQ ID NO: 2426117 - DNA, 21 bp, Homo sapiens
gacacagaaaatgttgagaat

SEQ ID NO: 2426118 - DNA, 13 bp, Homo sapiens
gacacaggccctc

SEQ ID NO: 2426119 - DNA, 12 bp, Homo sapiens
gacacaggcctg

SEQ ID NO: 2426120 - DNA, 20 bp, Homo sapiens
gacacatgaaggtaaataaa

SEQ ID NO: 2426121 - DNA, 21 bp, Homo sapiens
gacacatgaaggtaaataaaa

SEQ ID NO: 2426122 - DNA, 19 bp, Homo sapiens
gacacattttttaggaaat

SEQ ID NO: 2426123 - DNA, 23 bp, Homo sapiens
gacacccttctcccactctccta

SEQ ID NO: 2426124 - DNA, 18 bp, Homo sapiens
gacacctaactcttcttt

SEQ ID NO: 2426125 - DNA, 13 bp, Homo sapiens
gacacctcttttt

SEQ ID NO: 2426126 - DNA, 18 bp, Homo sapiens
gacacctgggagaaatct

SEQ ID NO: 2426127 - DNA, 14 bp, Homo sapiens
gacaccttggacat

SEQ ID NO: 2426128 - DNA, 15 bp, Homo sapiens
gacacgggcctgtcc

SEQ ID NO: 2426129 - DNA, 20 bp, Homo sapiens
gacacgggcctgtccacagg

SEQ ID NO: 2426130 - DNA, 21 bp, Homo sapiens
gacactccccgaagtcttttg

SEQ ID NO: 2426131 - DNA, 15 bp, Homo sapiens
gacactcccttgggc

SEQ ID NO: 2426132 - DNA, 13 bp, Homo sapiens
gacactggcccct

SEQ ID NO: 2426133 - DNA, 15 bp, Homo sapiens
gacactggcccctca

SEQ ID NO: 2426134 - DNA, 14 bp, Homo sapiens
gacactggtgggga

SEQ ID NO: 2426135 - DNA, 12 bp, Homo sapiens
gacactgttctt

SEQ ID NO: 2426136 - DNA, 20 bp, Homo sapiens
gacacttaatactaccttga

SEQ ID NO: 2426137 - DNA, 22 bp, Homo sapiens
gacagaagtttgcactatcttt

SEQ ID NO: 2426138 - DNA, 19 bp, Homo sapiens
gacagagaggactgtaggg

SEQ ID NO: 2426139 - DNA, 15 bp, Homo sapiens
gacagagccaggaga

SEQ ID NO: 2426140 - DNA, 17 bp, Homo sapiens
gacagagccctgtgagg

SEQ ID NO: 2426141 - DNA, 19 bp, Homo sapiens
gacagatgcctccttcctc

SEQ ID NO: 2426142 - DNA, 14 bp, Homo sapiens
gacagcagcatctc

SEQ ID NO: 2426143 - DNA, 16 bp, Homo sapiens
gatcagagccgtggtc

SEQ ID NO: 2426144 - DNA, 23 bp, Homo sapiens
gatcagagccgtggtcctttggg

SEQ ID NO: 2426145 - DNA, 15 bp, Homo sapiens
gatcagcgtggcctt

SEQ ID NO: 2426146 - DNA, 17 bp, Homo sapiens
gatcagcgtggccttgt

SEQ ID NO: 2426147 - DNA, 21 bp, Homo sapiens
gatcatgtgtggaagttatta

SEQ ID NO: 2426148 - DNA, 22 bp, Homo sapiens
gatccaaaagaagcccccagct

SEQ ID NO: 2426149 - DNA, 17 bp, Homo sapiens
gatccaagctaagcact

SEQ ID NO: 2426150 - DNA, 22 bp, Homo sapiens
gatccaagctaagcactgccac

SEQ ID NO: 2426151 - DNA, 12 bp, Homo sapiens
gatccagcctgg

SEQ ID NO: 2426152 - DNA, 13 bp, Homo sapiens
gatccagcctggg

SEQ ID NO: 2426153 - DNA, 21 bp, Homo sapiens
gatccagcctggggtctggag

SEQ ID NO: 2426154 - DNA, 12 bp, Homo sapiens
gatccaggacta

SEQ ID NO: 2426155 - DNA, 13 bp, Homo sapiens
gatccaggagctc

SEQ ID NO: 2426156 - DNA, 19 bp, Homo sapiens
gatccaggagctccagtgt

SEQ ID NO: 2426157 - DNA, 14 bp, Homo sapiens
gatccagggacaga

SEQ ID NO: 2426158 - DNA, 18 bp, Homo sapiens
gatccctcatctgtccct

SEQ ID NO: 2426159 - DNA, 13 bp, Homo sapiens
gatccctcccccc

SEQ ID NO: 2426160 - DNA, 21 bp, Homo sapiens
gatccctcccccccatgcact

SEQ ID NO: 2426161 - DNA, 23 bp, Homo sapiens
gatccctctacagagcttccctg

SEQ ID NO: 2426162 - DNA, 18 bp, Homo sapiens
gatccgactgctttggac

SEQ ID NO: 2426163 - DNA, 14 bp, Homo sapiens
gatccggaaagaag

SEQ ID NO: 2426164 - DNA, 16 bp, Homo sapiens
gatcctaagcatctaa

SEQ ID NO: 2426165 - DNA, 22 bp, Homo sapiens
gatcctcctgcagaccacgccc

SEQ ID NO: 2426166 - DNA, 19 bp, Homo sapiens
gatcggcaggacaccctga

SEQ ID NO: 2426167 - DNA, 18 bp, Homo sapiens
gatcgtctgactggtgtt

SEQ ID NO: 2426168 - DNA, 15 bp, Homo sapiens
gatctcaccaggcag

SEQ ID NO: 2426169 - DNA, 16 bp, Homo sapiens
gatctcaccaggcagc

SEQ ID NO: 2426170 - DNA, 19 bp, Homo sapiens
gatctcaccaggcagcctc

SEQ ID NO: 2426171 - DNA, 20 bp, Homo sapiens
gatctcaccaggcagcctct

SEQ ID NO: 2426172 - DNA, 20 bp, Homo sapiens
gatctggaacccagactcag

SEQ ID NO: 2426173 - DNA, 16 bp, Homo sapiens
gatctgtcctcagcct

SEQ ID NO: 2426174 - DNA, 19 bp, Homo sapiens
gatctgttttgaaggcaaa

SEQ ID NO: 2426175 - DNA, 20 bp, Homo sapiens
gatctgttttgaaggcaaaa

SEQ ID NO: 2426176 - DNA, 14 bp, Homo sapiens
gatcttagattctc

SEQ ID NO: 2426177 - DNA, 14 bp, Homo sapiens
gatcttttattttg

SEQ ID NO: 2426178 - DNA, 16 bp, Homo sapiens
gatgaagggcccgaga

SEQ ID NO: 2426179 - DNA, 16 bp, Homo sapiens
gatgaagttttacatt

SEQ ID NO: 2426180 - DNA, 17 bp, Homo sapiens
gatgaagttttacattg

SEQ ID NO: 2426181 - DNA, 22 bp, Homo sapiens
gatgaagttttacattgttgag

SEQ ID NO: 2426182 - DNA, 15 bp, Homo sapiens
gatgacacttgtaca

SEQ ID NO: 2426183 - DNA, 17 bp, Homo sapiens
gatgacacttgtacaat

SEQ ID NO: 2426184 - DNA, 14 bp, Homo sapiens
gatgaccacttttt

SEQ ID NO: 2426185 - DNA, 22 bp, Homo sapiens
gatgacctcgtactcaggagcc

SEQ ID NO: 2426186 - DNA, 20 bp, Homo sapiens
gatgagctcccacaagcctg

SEQ ID NO: 2426187 - DNA, 21 bp, Homo sapiens
gatgaggccctccacacctgc

SEQ ID NO: 2426188 - DNA, 13 bp, Homo sapiens
gatgagggcagca

SEQ ID NO: 2426189 - DNA, 14 bp, Homo sapiens
gatgagggcagcag

SEQ ID NO: 2426190 - DNA, 21 bp, Homo sapiens
gatgagggcagcagccagccc

SEQ ID NO: 2426191 - DNA, 22 bp, Homo sapiens
gatgatttcagttctaggaaaa

SEQ ID NO: 2426192 - DNA, 23 bp, Homo sapiens
gatgatttcagttctaggaaaat

SEQ ID NO: 2426193 - DNA, 13 bp, Homo sapiens
gatgcaatgaaca

SEQ ID NO: 2426194 - DNA, 16 bp, Homo sapiens
gatgcaccaccaagcc

SEQ ID NO: 2426195 - DNA, 21 bp, Homo sapiens
gatgcactttgctttaatata

SEQ ID NO: 2426196 - DNA, 22 bp, Homo sapiens
gatgcactttgctttaatataa

SEQ ID NO: 2426197 - DNA, 17 bp, Homo sapiens
gatgcagaggcctgcag

SEQ ID NO: 2426198 - DNA, 21 bp, Homo sapiens
gatgcagaggcctgcagggcc

SEQ ID NO: 2426199 - DNA, 14 bp, Homo sapiens
gatgcagcttatac

SEQ ID NO: 2426200 - DNA, 15 bp, Homo sapiens
gatgccagccaagct

SEQ ID NO: 2426201 - DNA, 18 bp, Homo sapiens
gatgccagccaagctctg

SEQ ID NO: 2426202 - DNA, 22 bp, Homo sapiens
gatgccagccaagctctgcagt

SEQ ID NO: 2426203 - DNA, 17 bp, Homo sapiens
gatgctccaagattcta

SEQ ID NO: 2426204 - DNA, 20 bp, Homo sapiens
gatgctccaagattctagat

SEQ ID NO: 2426205 - DNA, 20 bp, Homo sapiens
gatgctgacattcacctgcc

SEQ ID NO: 2426206 - DNA, 13 bp, Homo sapiens
gatgctggcccag

SEQ ID NO: 2426207 - DNA, 15 bp, Homo sapiens
gatgctggcccaggg

SEQ ID NO: 2426208 - DNA, 17 bp, Homo sapiens
gatggaaaattcatttt

SEQ ID NO: 2426209 - DNA, 17 bp, Homo sapiens
gatggaacacggccaca

SEQ ID NO: 2426210 - DNA, 23 bp, Homo sapiens
gatggatgccaatattaaatctg

SEQ ID NO: 2426211 - DNA, 19 bp, Homo sapiens
gatggccagccccttagac

SEQ ID NO: 2426212 - DNA, 18 bp, Homo sapiens
gatggccggagaggaccg

SEQ ID NO: 2426213 - DNA, 13 bp, Homo sapiens
gatggctcccagg

SEQ ID NO: 2426214 - DNA, 13 bp, Homo sapiens
gatgggattctgg

SEQ ID NO: 2426215 - DNA, 18 bp, Homo sapiens
gatggggaccagcagccc

SEQ ID NO: 2426216 - DNA, 12 bp, Homo sapiens
gatggggctccc

SEQ ID NO: 2426217 - DNA, 16 bp, Homo sapiens
gatgggggaactcaga

SEQ ID NO: 2426218 - DNA, 16 bp, Homo sapiens
gatggtcttacagcag

SEQ ID NO: 2426219 - DNA, 17 bp, Homo sapiens
gatggtcttacagcagg

SEQ ID NO: 2426220 - DNA, 13 bp, Homo sapiens
gatgtaaaatctt

SEQ ID NO: 2426221 - DNA, 15 bp, Homo sapiens
gatgtaaaatcttgt

SEQ ID NO: 2426222 - DNA, 13 bp, Homo sapiens
gatgtaaagatgt

SEQ ID NO: 2426223 - DNA, 15 bp, Homo sapiens
gatgtaatacttctt

SEQ ID NO: 2426224 - DNA, 14 bp, Homo sapiens
gatgtaccagtttg

SEQ ID NO: 2426225 - DNA, 13 bp, Homo sapiens
gatgtccccagca

SEQ ID NO: 2426226 - DNA, 12 bp, Homo sapiens
gatgtgaagcca

SEQ ID NO: 2426227 - DNA, 11 bp, Homo sapiens
gatgtgatata

SEQ ID NO: 2426228 - DNA, 16 bp, Homo sapiens
gatgtgattgtggaat

SEQ ID NO: 2426229 - DNA, 18 bp, Homo sapiens
gatgtggaactgctgcca

SEQ ID NO: 2426230 - DNA, 16 bp, Homo sapiens
gatgtggtcacagctg

SEQ ID NO: 2426231 - DNA, 19 bp, Homo sapiens
gatgtgtcctgacactgca

SEQ ID NO: 2426232 - DNA, 21 bp, Homo sapiens
gatgtgtgttgatactgttgc

SEQ ID NO: 2426233 - DNA, 17 bp, Homo sapiens
gatgttcagcactgtcc

SEQ ID NO: 2426234 - DNA, 22 bp, Homo sapiens
gatgttcagcactgtcccttgc

SEQ ID NO: 2426235 - DNA, 16 bp, Homo sapiens
gatgttctaaggctct

SEQ ID NO: 2426236 - DNA, 18 bp, Homo sapiens
gatgttctaaggctctga

SEQ ID NO: 2426237 - DNA, 20 bp, Homo sapiens
gatgttctaaggctctgaga

SEQ ID NO: 2426238 - DNA, 19 bp, Homo sapiens
gatgttctaagtctttcca

SEQ ID NO: 2426239 - DNA, 17 bp, Homo sapiens
gattaaataagattcta

SEQ ID NO: 2426240 - DNA, 18 bp, Homo sapiens
gattaaataagattctaa

SEQ ID NO: 2426241 - DNA, 14 bp, Homo sapiens
gattaacctctgca

SEQ ID NO: 2426242 - DNA, 17 bp, Homo sapiens
gattaacctctgcacta

SEQ ID NO: 2426243 - DNA, 17 bp, Homo sapiens
gattacaaatcagaagt

SEQ ID NO: 2426244 - DNA, 21 bp, Homo sapiens
gattacaaatcagaagtcatc

SEQ ID NO: 2426245 - DNA, 17 bp, Homo sapiens
gattagagcctgtaaac

SEQ ID NO: 2426246 - DNA, 13 bp, Homo sapiens
gattatagattct

SEQ ID NO: 2426247 - DNA, 15 bp, Homo sapiens
gattatagattctaa

SEQ ID NO: 2426248 - DNA, 17 bp, Homo sapiens
gattatagattctaaag

SEQ ID NO: 2426249 - DNA, 13 bp, Homo sapiens
gattatgggtcac

SEQ ID NO: 2426250 - DNA, 16 bp, Homo sapiens
gattatgggtcacagg

SEQ ID NO: 2426251 - DNA, 13 bp, Homo sapiens
gattattcagtgt

SEQ ID NO: 2426252 - DNA, 19 bp, Homo sapiens
gattcaaaggttctaggtt

SEQ ID NO: 2426253 - DNA, 17 bp, Homo sapiens
gattcaggaaaaggcct

SEQ ID NO: 2426254 - DNA, 18 bp, Homo sapiens
gattcaggaaaaggcctg

SEQ ID NO: 2426255 - DNA, 19 bp, Homo sapiens
gattcaggaaaaggcctgg

SEQ ID NO: 2426256 - DNA, 22 bp, Homo sapiens
gattcagggaaagtgggacagc

SEQ ID NO: 2426257 - DNA, 15 bp, Homo sapiens
gattcagttttcatt

SEQ ID NO: 2426258 - DNA, 16 bp, Homo sapiens
gattcatagtaacttc

SEQ ID NO: 2426259 - DNA, 18 bp, Homo sapiens
gattccattggtccaaga

SEQ ID NO: 2426260 - DNA, 14 bp, Homo sapiens
gattccctctccca

SEQ ID NO: 2426261 - DNA, 20 bp, Homo sapiens
gattccctctcccaggcccc

SEQ ID NO: 2426262 - DNA, 15 bp, Homo sapiens
gattccggatcctaa

SEQ ID NO: 2426263 - DNA, 21 bp, Homo sapiens
gattcctttaacaacatgttt

SEQ ID NO: 2426264 - DNA, 16 bp, Homo sapiens
gattcggtatcccccc

SEQ ID NO: 2426265 - DNA, 11 bp, Homo sapiens
gattctaaaga

SEQ ID NO: 2426266 - DNA, 15 bp, Homo sapiens
gattctaaagattct

SEQ ID NO: 2426267 - DNA, 16 bp, Homo sapiens
gattctaaagattcta

SEQ ID NO: 2426268 - DNA, 20 bp, Homo sapiens
gattctaaagattctatagt

SEQ ID NO: 2426269 - DNA, 18 bp, Homo sapiens
gattctagatcagatgct

SEQ ID NO: 2426270 - DNA, 21 bp, Homo sapiens
gattctagatcagatgctcca

SEQ ID NO: 2426271 - DNA, 15 bp, Homo sapiens
gattctatagttcta

SEQ ID NO: 2426272 - DNA, 17 bp, Homo sapiens
gattctatagttctaga

SEQ ID NO: 2426273 - DNA, 22 bp, Homo sapiens
gattctctggctgtaaggctct

SEQ ID NO: 2426274 - DNA, 22 bp, Homo sapiens
gattctctgtgtctaagattct

SEQ ID NO: 2426275 - DNA, 14 bp, Homo sapiens
gattctcttgcctc

SEQ ID NO: 2426276 - DNA, 20 bp, Homo sapiens
gattctgaccttaaatgcaa

SEQ ID NO: 2426277 - DNA, 15 bp, Homo sapiens
gattctgcagtaaat

SEQ ID NO: 2426278 - DNA, 16 bp, Homo sapiens
gattctgcagtaaatc

SEQ ID NO: 2426279 - DNA, 19 bp, Homo sapiens
gattctgcagtaaatcttt

SEQ ID NO: 2426280 - DNA, 21 bp, Homo sapiens
gattctgcagtaaatctttta

SEQ ID NO: 2426281 - DNA, 15 bp, Homo sapiens
gattctgcctttgcc

SEQ ID NO: 2426282 - DNA, 17 bp, Homo sapiens
gattctgctggcctctg

SEQ ID NO: 2426283 - DNA, 22 bp, Homo sapiens
gattctgctggcctctgcgagt

SEQ ID NO: 2426284 - DNA, 12 bp, Homo sapiens
gattctgtacat

SEQ ID NO: 2426285 - DNA, 17 bp, Homo sapiens
gattctttccatttgca

SEQ ID NO: 2426286 - DNA, 22 bp, Homo sapiens
gattctttccatttgcatttgt

SEQ ID NO: 2426287 - DNA, 18 bp, Homo sapiens
gattgcaatatctgaagc

SEQ ID NO: 2426288 - DNA, 21 bp, Homo sapiens
gattgcaatatctgaagccct

SEQ ID NO: 2426289 - DNA, 16 bp, Homo sapiens
gattgcacgtggcctc

SEQ ID NO: 2426290 - DNA, 19 bp, Homo sapiens
gattgcacgtggcctcttg

SEQ ID NO: 2426291 - DNA, 23 bp, Homo sapiens
gattgcacgtggcctcttgagca

SEQ ID NO: 2426292 - DNA, 19 bp, Homo sapiens
gattgcagaaaattctgtg

SEQ ID NO: 2426293 - DNA, 22 bp, Homo sapiens
gattggggaagagagcctgcag

SEQ ID NO: 2426294 - DNA, 17 bp, Homo sapiens
gattggtgtttttttct

SEQ ID NO: 2426295 - DNA, 10 bp, Homo sapiens
gattgtattg

SEQ ID NO: 2426296 - DNA, 16 bp, Homo sapiens
gattgttacagaagct

SEQ ID NO: 2426297 - DNA, 15 bp, Homo sapiens
gattgttcctgcttt

SEQ ID NO: 2426298 - DNA, 16 bp, Homo sapiens
gatttaaaagcctgct

SEQ ID NO: 2426299 - DNA, 18 bp, Homo sapiens
gatttaacattatctagt

SEQ ID NO: 2426300 - DNA, 21 bp, Homo sapiens
gatttaatataaagttttata

SEQ ID NO: 2426301 - DNA, 13 bp, Homo sapiens
gatttagtttcag

SEQ ID NO: 2426302 - DNA, 15 bp, Homo sapiens
gatttagtttcagta

SEQ ID NO: 2426303 - DNA, 17 bp, Homo sapiens
gatttatcacacaaagc

SEQ ID NO: 2426304 - DNA, 20 bp, Homo sapiens
gatttatcacacaaagcaga

SEQ ID NO: 2426305 - DNA, 16 bp, Homo sapiens
gatttattaaagaaaa

SEQ ID NO: 2426306 - DNA, 17 bp, Homo sapiens
gatttattaaagaaaaa

SEQ ID NO: 2426307 - DNA, 21 bp, Homo sapiens
gatttattaatatatattatc

SEQ ID NO: 2426308 - DNA, 15 bp, Homo sapiens
gatttcatactgtaa

SEQ ID NO: 2426309 - DNA, 18 bp, Homo sapiens
gatttcatagttcagaat

SEQ ID NO: 2426310 - DNA, 13 bp, Homo sapiens
gatttcctaatac

SEQ ID NO: 2426311 - DNA, 12 bp, Homo sapiens
gatttccttctt

SEQ ID NO: 2426312 - DNA, 22 bp, Homo sapiens
gatttccttgaatgtggcttga

SEQ ID NO: 2426313 - DNA, 17 bp, Homo sapiens
gatttctttgaaaaaaa

SEQ ID NO: 2426314 - DNA, 19 bp, Homo sapiens
gatttgaagaacatgtgag

SEQ ID NO: 2426315 - DNA, 18 bp, Homo sapiens
gatttgtttttaaactgt

SEQ ID NO: 2426316 - DNA, 23 bp, Homo sapiens
gatttgtttttaaactgtacagt

SEQ ID NO: 2426317 - DNA, 21 bp, Homo sapiens
gattttaagtttctctgcaga

SEQ ID NO: 2426318 - DNA, 12 bp, Homo sapiens
gattttacatga

SEQ ID NO: 2426319 - DNA, 13 bp, Homo sapiens
gattttccaaatg

SEQ ID NO: 2426320 - DNA, 13 bp, Homo sapiens
gatttttaaaatg

SEQ ID NO: 2426321 - DNA, 15 bp, Homo sapiens
gatttttatgtctgg

SEQ ID NO: 2426322 - DNA, 14 bp, Homo sapiens
gatttttctcttca

SEQ ID NO: 2426323 - DNA, 14 bp, Homo sapiens
gatttttctttaca

SEQ ID NO: 2426324 - DNA, 16 bp, Homo sapiens
gattttttaataattt

SEQ ID NO: 2426325 - DNA, 12 bp, Homo sapiens
gattttttccaa

SEQ ID NO: 2426326 - DNA, 21 bp, Homo sapiens
gatttttttttttttttcctt

SEQ ID NO: 2426327 - DNA, 17 bp, Homo sapiens
gcaaaaaagaaaacctt

SEQ ID NO: 2426328 - DNA, 11 bp, Homo sapiens
gcaaaagaaga

SEQ ID NO: 2426329 - DNA, 17 bp, Homo sapiens
gcaaaattgcaaatctt

SEQ ID NO: 2426330 - DNA, 20 bp, Homo sapiens
gcaaactctttggtcgtttt

SEQ ID NO: 2426331 - DNA, 16 bp, Homo sapiens
gcaaactgcatgccca

SEQ ID NO: 2426332 - DNA, 20 bp, Homo sapiens
gcagctctggacagccccac

SEQ ID NO: 2426333 - DNA, 14 bp, Homo sapiens
gcagctgagcaggg

SEQ ID NO: 2426334 - DNA, 17 bp, Homo sapiens
gcagctgagcagggccg

SEQ ID NO: 2426335 - DNA, 18 bp, Homo sapiens
gcagctgagcagggccgg

SEQ ID NO: 2426336 - DNA, 19 bp, Homo sapiens
gcagcttagagttggccat

SEQ ID NO: 2426337 - DNA, 14 bp, Homo sapiens
gcagcttgtagcca

SEQ ID NO: 2426338 - DNA, 16 bp, Homo sapiens
gcagcttgtagccagc

SEQ ID NO: 2426339 - DNA, 21 bp, Homo sapiens
gcagcttgtagccagccgggg

SEQ ID NO: 2426340 - DNA, 23 bp, Homo sapiens
gcaggaaggactatgaaaagcta

SEQ ID NO: 2426341 - DNA, 17 bp, Homo sapiens
gcaggaaggagctgcct

SEQ ID NO: 2426342 - DNA, 18 bp, Homo sapiens
gcaggaaggagctgcctg

SEQ ID NO: 2426343 - DNA, 19 bp, Homo sapiens
gcaggaaggagctgcctgg

SEQ ID NO: 2426344 - DNA, 21 bp, Homo sapiens
gcaggaccttcgggctgtgcc

SEQ ID NO: 2426345 - DNA, 13 bp, Homo sapiens
gcaggactccagg

SEQ ID NO: 2426346 - DNA, 14 bp, Homo sapiens
gcctagaccagcag

SEQ ID NO: 2426347 - DNA, 16 bp, Homo sapiens
gcctagaccagcagac

SEQ ID NO: 2426348 - DNA, 15 bp, Homo sapiens
gcctaggattctaaa

SEQ ID NO: 2426349 - DNA, 18 bp, Homo sapiens
gcctatgacttgggcacc

SEQ ID NO: 2426350 - DNA, 21 bp, Homo sapiens
gcctatggagagccctgggac

SEQ ID NO: 2426351 - DNA, 22 bp, Homo sapiens
gcctatggagagccctgggacc

SEQ ID NO: 2426352 - DNA, 22 bp, Homo sapiens
gcctcaaagcaagcattcagaa

SEQ ID NO: 2426353 - DNA, 17 bp, Homo sapiens
gcctcaaaggcccgctc

SEQ ID NO: 2426354 - DNA, 20 bp, Homo sapiens
gcctcaaggttttaggttct

SEQ ID NO: 2426355 - DNA, 20 bp, Homo sapiens
gcctcacccacccctgcaca

SEQ ID NO: 2426356 - DNA, 17 bp, Homo sapiens
gcctcagaaaccagact

SEQ ID NO: 2426357 - DNA, 12 bp, Homo sapiens
gcctcagagacc

SEQ ID NO: 2426358 - DNA, 15 bp, Homo sapiens
gcctcagctcccaca

SEQ ID NO: 2426359 - DNA, 19 bp, Homo sapiens
gcctcatgtggctggaaga

SEQ ID NO: 2426360 - DNA, 22 bp, Homo sapiens
gcctccagaggggctcaggtca

SEQ ID NO: 2426361 - DNA, 18 bp, Homo sapiens
gcctccagccgccggctg

SEQ ID NO: 2426362 - DNA, 15 bp, Homo sapiens
gcctccatccaaggc

SEQ ID NO: 2426363 - DNA, 16 bp, Homo sapiens
gcctccatccaaggcc

SEQ ID NO: 2426364 - DNA, 12 bp, Homo sapiens
gcctcccacccc

SEQ ID NO: 2426365 - DNA, 19 bp, Homo sapiens
gcctcccctctccttcctg

SEQ ID NO: 2426366 - DNA, 14 bp, Homo sapiens
gcctcccctgccac

SEQ ID NO: 2426367 - DNA, 15 bp, Homo sapiens
gcctcccctgccagg

SEQ ID NO: 2426368 - DNA, 19 bp, Homo sapiens
gcctccccttaaaggggag

SEQ ID NO: 2426369 - DNA, 20 bp, Homo sapiens
gcctccccttaaaggggaga

SEQ ID NO: 2426370 - DNA, 16 bp, Homo sapiens
gcctccctcctgcccc

SEQ ID NO: 2426371 - DNA, 11 bp, Homo sapiens
gcctcctccct

SEQ ID NO: 2426372 - DNA, 19 bp, Homo sapiens
gcctcctccctccctctcc

SEQ ID NO: 2426373 - DNA, 20 bp, Homo sapiens
gcctcctccctccctctccg

SEQ ID NO: 2426374 - DNA, 17 bp, Homo sapiens
gcctcctgccggctcct

SEQ ID NO: 2426375 - DNA, 24 bp, Homo sapiens
gcctccttcctcttttccttccca

SEQ ID NO: 2426376 - DNA, 20 bp, Homo sapiens
gcctccttctgagctcctgt

SEQ ID NO: 2426377 - DNA, 22 bp, Homo sapiens
gcctccttctgagctcctgtcc

SEQ ID NO: 2426378 - DNA, 12 bp, Homo sapiens
gcctcgcaaccc

SEQ ID NO: 2426379 - DNA, 14 bp, Homo sapiens
gcctcgcccctggc

SEQ ID NO: 2426380 - DNA, 14 bp, Homo sapiens
gcctcgctccccac

SEQ ID NO: 2426381 - DNA, 15 bp, Homo sapiens
gcctctcccaggcag

SEQ ID NO: 2426382 - DNA, 18 bp, Homo sapiens
gcctctcccctgcctgcc

SEQ ID NO: 2426383 - DNA, 19 bp, Homo sapiens
gcctctcgctcctcaaccc

SEQ ID NO: 2426384 - DNA, 17 bp, Homo sapiens
gcctctgaggccagcct

SEQ ID NO: 2426385 - DNA, 19 bp, Homo sapiens
gcctctgaggccagcctgg

SEQ ID NO: 2426386 - DNA, 22 bp, Homo sapiens
gcctctgaggccagcctggcct

SEQ ID NO: 2426387 - DNA, 23 bp, Homo sapiens
gcctctgccaaaggatgtgatat

SEQ ID NO: 2426388 - DNA, 19 bp, Homo sapiens
gcctctgcgagtggtttct

SEQ ID NO: 2426389 - DNA, 21 bp, Homo sapiens
gcctctggggggtggccaggc

SEQ ID NO: 2426390 - DNA, 23 bp, Homo sapiens
gcctctggggggtggccaggccg

SEQ ID NO: 2426391 - DNA, 18 bp, Homo sapiens
gcctctgtcttctggact

SEQ ID NO: 2426392 - DNA, 19 bp, Homo sapiens
gcctctgtcttctggactg

SEQ ID NO: 2426393 - DNA, 14 bp, Homo sapiens
gcctcttgaccagg

SEQ ID NO: 2426394 - DNA, 16 bp, Homo sapiens
gcctcttgaccaggct

SEQ ID NO: 2426395 - DNA, 23 bp, Homo sapiens
gcctgaaagaggctgaggcctgg

SEQ ID NO: 2426396 - DNA, 17 bp, Homo sapiens
gcctgaactcctgccat

SEQ ID NO: 2426397 - DNA, 15 bp, Homo sapiens
gcctgaccaaacagc

SEQ ID NO: 2426398 - DNA, 19 bp, Homo sapiens
gcctgactagggagccatg

SEQ ID NO: 2426399 - DNA, 19 bp, Homo sapiens
gcctgagcagtccttggcc

SEQ ID NO: 2426400 - DNA, 12 bp, Homo sapiens
gcctgagcccag

SEQ ID NO: 2426401 - DNA, 15 bp, Homo sapiens
gcctgagcccaggga

SEQ ID NO: 2426402 - DNA, 18 bp, Homo sapiens
gcctgagcccagggaggc

SEQ ID NO: 2426403 - DNA, 19 bp, Homo sapiens
gcctgagcccagggaggcc

SEQ ID NO: 2426404 - DNA, 13 bp, Homo sapiens
gcctgagtactcc

SEQ ID NO: 2426405 - DNA, 16 bp, Homo sapiens
gcctgatcagaccacg

SEQ ID NO: 2426406 - DNA, 13 bp, Homo sapiens
gcctgcaggatct

SEQ ID NO: 2426407 - DNA, 24 bp, Homo sapiens
gcctgcaggatctcaccaggcagc

SEQ ID NO: 2426408 - DNA, 16 bp, Homo sapiens
gcctgccacctggacc

SEQ ID NO: 2426409 - DNA, 18 bp, Homo sapiens
gcctgccacctggacccc

SEQ ID NO: 2426410 - DNA, 15 bp, Homo sapiens
gcctgccactgtgtg

SEQ ID NO: 2426411 - DNA, 14 bp, Homo sapiens
gcctgccaggagga

SEQ ID NO: 2426412 - DNA, 19 bp, Homo sapiens
gcctgcccagttgcactca

SEQ ID NO: 2426413 - DNA, 20 bp, Homo sapiens
gcctgccctcatggcccctc

SEQ ID NO: 2426414 - DNA, 22 bp, Homo sapiens
gcctgccctcatggcccctctg

SEQ ID NO: 2426415 - DNA, 14 bp, Homo sapiens
gcctgccgagcaac

SEQ ID NO: 2426416 - DNA, 19 bp, Homo sapiens
gcctgccgagcaaccgtgg

SEQ ID NO: 2426417 - DNA, 20 bp, Homo sapiens
gcctgccgagcaaccgtggc

SEQ ID NO: 2426418 - DNA, 22 bp, Homo sapiens
gcctgcctttccatccatggcc

SEQ ID NO: 2426419 - DNA, 20 bp, Homo sapiens
gcctgctaaggtcttggaac

SEQ ID NO: 2426420 - DNA, 21 bp, Homo sapiens
gcctgctcccatcctgtgtgt

SEQ ID NO: 2426421 - DNA, 13 bp, Homo sapiens
gcctgctgctgag

SEQ ID NO: 2426422 - DNA, 15 bp, Homo sapiens
gcctggacctctgac

SEQ ID NO: 2426423 - DNA, 15 bp, Homo sapiens
gcctggactttcctg

SEQ ID NO: 2426424 - DNA, 17 bp, Homo sapiens
gcctggactttcctgca

SEQ ID NO: 2426425 - DNA, 18 bp, Homo sapiens
gcctggactttcctgcaa

SEQ ID NO: 2426426 - DNA, 17 bp, Homo sapiens
gcctggagatcctcctg

SEQ ID NO: 2426427 - DNA, 15 bp, Homo sapiens
gcctggagcacaaag

SEQ ID NO: 2426428 - DNA, 21 bp, Homo sapiens
gcctggaggacctgagcctgc

SEQ ID NO: 2426429 - DNA, 20 bp, Homo sapiens
gcctggcagtccgtgggacg

SEQ ID NO: 2426430 - DNA, 13 bp, Homo sapiens
gcctggccagaca

SEQ ID NO: 2426431 - DNA, 20 bp, Homo sapiens
gcctggccagacacaggccc

SEQ ID NO: 2426432 - DNA, 18 bp, Homo sapiens
gcctggccatactgtgtc

SEQ ID NO: 2426433 - DNA, 14 bp, Homo sapiens
gcctggcccacccc

SEQ ID NO: 2426434 - DNA, 21 bp, Homo sapiens
gcctggctggctgagggcagt

SEQ ID NO: 2426435 - DNA, 22 bp, Homo sapiens
gcctgggacaactgctcccacc

SEQ ID NO: 2426436 - DNA, 18 bp, Homo sapiens
gcctgggccgctgccacg

SEQ ID NO: 2426437 - DNA, 14 bp, Homo sapiens
gcctgggcctatgg

SEQ ID NO: 2426438 - DNA, 23 bp, Homo sapiens
gcctgggcctatggagagccctg

SEQ ID NO: 2426439 - DNA, 20 bp, Homo sapiens
gcctgggcgctggtcctttc

SEQ ID NO: 2426440 - DNA, 21 bp, Homo sapiens
gcctgggcgctggtcctttct

SEQ ID NO: 2426441 - DNA, 13 bp, Homo sapiens
gcctgggctcctg

SEQ ID NO: 2426442 - DNA, 14 bp, Homo sapiens
gcctgggctcctgg

SEQ ID NO: 2426443 - DNA, 17 bp, Homo sapiens
gcctgggctcctggacc

SEQ ID NO: 2426444 - DNA, 15 bp, Homo sapiens
gcctgggctgggaaa

SEQ ID NO: 2426445 - DNA, 21 bp, Homo sapiens
gcctggggctctaacgcctga

SEQ ID NO: 2426446 - DNA, 13 bp, Homo sapiens
gcctgggggcctg

SEQ ID NO: 2426447 - DNA, 16 bp, Homo sapiens
gcctgggggcctggct

SEQ ID NO: 2426448 - DNA, 21 bp, Homo sapiens
gcctgggtctcaccggctctc

SEQ ID NO: 2426449 - DNA, 12 bp, Homo sapiens
gctgtgacctgc

SEQ ID NO: 2426450 - DNA, 16 bp, Homo sapiens
gctgtgacctgctgag

SEQ ID NO: 2426451 - DNA, 18 bp, Homo sapiens
gctgtgacctgctgagct

SEQ ID NO: 2426452 - DNA, 16 bp, Homo sapiens
gctgtgaggctgtcct

SEQ ID NO: 2426453 - DNA, 17 bp, Homo sapiens
gctgtgaggctgtcctg

SEQ ID NO: 2426454 - DNA, 18 bp, Homo sapiens
gctgtgaggctgtcctgt

SEQ ID NO: 2426455 - DNA, 18 bp, Homo sapiens
gctgtgagttctccctgt

SEQ ID NO: 2426456 - DNA, 13 bp, Homo sapiens
gctgtgcagtcct

SEQ ID NO: 2426457 - DNA, 15 bp, Homo sapiens
gctgtgccaggcgag

SEQ ID NO: 2426458 - DNA, 19 bp, Homo sapiens
gctgtgccaggcgaggccc

SEQ ID NO: 2426459 - DNA, 18 bp, Homo sapiens
gctgtgcctcgctcccca

SEQ ID NO: 2426460 - DNA, 23 bp, Homo sapiens
gctgtgcctcgctccccactctg

SEQ ID NO: 2426461 - DNA, 17 bp, Homo sapiens
gctgtgcgcccagggct

SEQ ID NO: 2426462 - DNA, 16 bp, Homo sapiens
gctgtgctatggtgct

SEQ ID NO: 2426463 - DNA, 17 bp, Homo sapiens
gctgtgctatggtgctc

SEQ ID NO: 2426464 - DNA, 17 bp, Homo sapiens
gctgtgcttatggtacc

SEQ ID NO: 2426465 - DNA, 12 bp, Homo sapiens
gctgtggccagg

SEQ ID NO: 2426466 - DNA, 15 bp, Homo sapiens
gctgtggccaggagg

SEQ ID NO: 2426467 - DNA, 16 bp, Homo sapiens
gctgtggccaggaggt

SEQ ID NO: 2426468 - DNA, 20 bp, Homo sapiens
gctgtggccaggaggtgcca

SEQ ID NO: 2426469 - DNA, 13 bp, Homo sapiens
gctgtggttttct

SEQ ID NO: 2426470 - DNA, 15 bp, Homo sapiens
gctgtggttttcttt

SEQ ID NO: 2426471 - DNA, 23 bp, Homo sapiens
gctgtggttttcttttgccatga

SEQ ID NO: 2426472 - DNA, 18 bp, Homo sapiens
gctgtgtaagatttgttt

SEQ ID NO: 2426473 - DNA, 20 bp, Homo sapiens
gctgtgtgaatacctgctca

SEQ ID NO: 2426474 - DNA, 15 bp, Homo sapiens
gctgtttactaggga

SEQ ID NO: 2426475 - DNA, 12 bp, Homo sapiens
gcttaaaacttt

SEQ ID NO: 2426476 - DNA, 18 bp, Homo sapiens
gcttaaaactttgaagtt

SEQ ID NO: 2426477 - DNA, 18 bp, Homo sapiens
gcttaaaatacaagactg

SEQ ID NO: 2426478 - DNA, 12 bp, Homo sapiens
gcttacctggcc

SEQ ID NO: 2426479 - DNA, 14 bp, Homo sapiens
gcttagtttgtgtg

SEQ ID NO: 2426480 - DNA, 20 bp, Homo sapiens
gcttagtttgtgtgttgtct

SEQ ID NO: 2426481 - DNA, 16 bp, Homo sapiens
gcttataattctttca

SEQ ID NO: 2426482 - DNA, 11 bp, Homo sapiens
gcttatatctg

SEQ ID NO: 2426483 - DNA, 15 bp, Homo sapiens
gcttatatctggcct

SEQ ID NO: 2426484 - DNA, 17 bp, Homo sapiens
gcttatatctggcctct

SEQ ID NO: 2426485 - DNA, 20 bp, Homo sapiens
gcttatatctggcctctgct

SEQ ID NO: 2426486 - DNA, 15 bp, Homo sapiens
gcttatgaaaagaat

SEQ ID NO: 2426487 - DNA, 23 bp, Homo sapiens
gcttatgatagcaaatggcctca

SEQ ID NO: 2426488 - DNA, 20 bp, Homo sapiens
gcttatggtaccagatgcag

SEQ ID NO: 2426489 - DNA, 15 bp, Homo sapiens
gcttcaggtccaggc

SEQ ID NO: 2426490 - DNA, 18 bp, Homo sapiens
gcttcatgtgtcccagaa

SEQ ID NO: 2426491 - DNA, 14 bp, Homo sapiens
gcttccatgattct

SEQ ID NO: 2426492 - DNA, 15 bp, Homo sapiens
gcttccatgattcta

SEQ ID NO: 2426493 - DNA, 17 bp, Homo sapiens
gcttcccatccccagcg

SEQ ID NO: 2426494 - DNA, 13 bp, Homo sapiens
gcttccctgaagc

SEQ ID NO: 2426495 - DNA, 16 bp, Homo sapiens
gcttcctcctggaaat

SEQ ID NO: 2426496 - DNA, 13 bp, Homo sapiens
gcttcctgcttgc

SEQ ID NO: 2426497 - DNA, 12 bp, Homo sapiens
gcttcctggagc

SEQ ID NO: 2426498 - DNA, 13 bp, Homo sapiens
gcttcctggagca

SEQ ID NO: 2426499 - DNA, 22 bp, Homo sapiens
gcttcctggagcagaagcagca

SEQ ID NO: 2426500 - DNA, 16 bp, Homo sapiens
gcttcctggtgctgga

SEQ ID NO: 2426501 - DNA, 16 bp, Homo sapiens
gcttccttcagagagc

SEQ ID NO: 2426502 - DNA, 20 bp, Homo sapiens
gcttcgggcccttcccacag

SEQ ID NO: 2426503 - DNA, 19 bp, Homo sapiens
gcttctaagtaaatacaat

SEQ ID NO: 2426504 - DNA, 21 bp, Homo sapiens
gcttctaagtaaatacaattt

SEQ ID NO: 2426505 - DNA, 18 bp, Homo sapiens
gcttctataattttgcct

SEQ ID NO: 2426506 - DNA, 21 bp, Homo sapiens
gcttctctgacttctgcctgg

SEQ ID NO: 2426507 - DNA, 16 bp, Homo sapiens
gcttctgccccctgca

SEQ ID NO: 2426508 - DNA, 14 bp, Homo sapiens
gcttctggccagga

SEQ ID NO: 2426509 - DNA, 15 bp, Homo sapiens
gcttcttgcctctgt

SEQ ID NO: 2426510 - DNA, 16 bp, Homo sapiens
gcttcttgcctctgtg

SEQ ID NO: 2426511 - DNA, 17 bp, Homo sapiens
gcttcttgcctctgtgc

SEQ ID NO: 2426512 - DNA, 19 bp, Homo sapiens
gcttcttgcctctgtgctg

SEQ ID NO: 2426513 - DNA, 20 bp, Homo sapiens
gcttgatagaaatgccaagc

SEQ ID NO: 2426514 - DNA, 22 bp, Homo sapiens
gcttgatgggattctggacagg

SEQ ID NO: 2426515 - DNA, 20 bp, Homo sapiens
gcttgccaaggcagaggcct

SEQ ID NO: 2426516 - DNA, 16 bp, Homo sapiens
gcttgccctaagcaga

SEQ ID NO: 2426517 - DNA, 23 bp, Homo sapiens
gcttgccctaagcagaaagtgcc

SEQ ID NO: 2426518 - DNA, 23 bp, Homo sapiens
gcttgcttttcatgcaaactctt

SEQ ID NO: 2426519 - DNA, 16 bp, Homo sapiens
gcttggagcagagggg

SEQ ID NO: 2426520 - DNA, 18 bp, Homo sapiens
gcttggagcagaggggct

SEQ ID NO: 2426521 - DNA, 19 bp, Homo sapiens
gcttggcgatgccagccaa

SEQ ID NO: 2426522 - DNA, 14 bp, Homo sapiens
gcttgggatttgct

SEQ ID NO: 2426523 - DNA, 15 bp, Homo sapiens
gcttgggatttgctg

SEQ ID NO: 2426524 - DNA, 17 bp, Homo sapiens
gcttgggcagcatcccc

SEQ ID NO: 2426525 - DNA, 22 bp, Homo sapiens
gcttggggggtgatgagggcag

SEQ ID NO: 2426526 - DNA, 16 bp, Homo sapiens
gcttgtagccagccgg

SEQ ID NO: 2426527 - DNA, 15 bp, Homo sapiens
gcttgtctcttgcct

SEQ ID NO: 2426528 - DNA, 17 bp, Homo sapiens
gcttgtctcttgcctgc

SEQ ID NO: 2426529 - DNA, 19 bp, Homo sapiens
gcttgtctcttgcctgcca

SEQ ID NO: 2426530 - DNA, 13 bp, Homo sapiens
gcttgtggggcct

SEQ ID NO: 2426531 - DNA, 16 bp, Homo sapiens
gcttgtggggcctggg

SEQ ID NO: 2426532 - DNA, 18 bp, Homo sapiens
gcttgttccctctccctg

SEQ ID NO: 2426533 - DNA, 13 bp, Homo sapiens
gcttgttgtgctt

SEQ ID NO: 2426534 - DNA, 11 bp, Homo sapiens
gcttgtttaca

SEQ ID NO: 2426535 - DNA, 15 bp, Homo sapiens
gcttgtttacatgct

SEQ ID NO: 2426536 - DNA, 19 bp, Homo sapiens
gcttgtttacatgcttatt

SEQ ID NO: 2426537 - DNA, 15 bp, Homo sapiens
gctttaatataaatg

SEQ ID NO: 2426538 - DNA, 19 bp, Homo sapiens
gctttactccgtaacagat

SEQ ID NO: 2426539 - DNA, 20 bp, Homo sapiens
gctttagaaacagtgcaaca

SEQ ID NO: 2426540 - DNA, 20 bp, Homo sapiens
gctttatgataatagattct

SEQ ID NO: 2426541 - DNA, 13 bp, Homo sapiens
gctttcagggagg

SEQ ID NO: 2426542 - DNA, 12 bp, Homo sapiens
gctttcatgtaa

SEQ ID NO: 2426543 - DNA, 15 bp, Homo sapiens
gctttcatgtaaact

SEQ ID NO: 2426544 - DNA, 20 bp, Homo sapiens
gctttcatgtaaactgtgca

SEQ ID NO: 2426545 - DNA, 15 bp, Homo sapiens
gctttccatgggacc

SEQ ID NO: 2426546 - DNA, 19 bp, Homo sapiens
gctttccattcgtgaaaac

SEQ ID NO: 2426547 - DNA, 11 bp, Homo sapiens
gctttcctgcc

SEQ ID NO: 2426548 - DNA, 14 bp, Homo sapiens
gctttcctgcccca

SEQ ID NO: 2426549 - DNA, 19 bp, Homo sapiens
gctttcctgccccaggcct

SEQ ID NO: 2426550 - DNA, 19 bp, Homo sapiens
gctttctcctttaattgta

SEQ ID NO: 2426551 - DNA, 16 bp, Homo sapiens
gctttctgaacagctg

SEQ ID NO: 2426552 - DNA, 18 bp, Homo sapiens
gctttctgaacagctggt

SEQ ID NO: 2426553 - DNA, 15 bp, Homo sapiens
gctttctgtttctta

SEQ ID NO: 2426554 - DNA, 22 bp, Homo sapiens
gctttctgtttcttaagggcac

SEQ ID NO: 2426555 - DNA, 17 bp, Homo sapiens
gctttgaaattgaacct

SEQ ID NO: 2426556 - DNA, 20 bp, Homo sapiens
gctttgactcaggagcctgt

SEQ ID NO: 2426557 - DNA, 23 bp, Homo sapiens
gctttggaagtttagctctgaga

SEQ ID NO: 2426558 - DNA, 14 bp, Homo sapiens
gctttggaagtttt

SEQ ID NO: 2426559 - DNA, 22 bp, Homo sapiens
gctttggacctaaatggcctca

SEQ ID NO: 2426560 - DNA, 15 bp, Homo sapiens
gctttgggcttgggc

SEQ ID NO: 2426561 - DNA, 14 bp, Homo sapiens
gcttttcaaacaaa

SEQ ID NO: 2426562 - DNA, 19 bp, Homo sapiens
gcttttgtgatggagtgct

SEQ ID NO: 2426563 - DNA, 23 bp, Homo sapiens
gcttttgtgggggactgtaagtt

SEQ ID NO: 2426564 - DNA, 17 bp, Homo sapiens
gctttttttgtgtgtat

SEQ ID NO: 2426565 - DNA, 23 bp, Homo sapiens
ggaaaaagcaagttcgtctgttg

SEQ ID NO: 2426566 - DNA, 15 bp, Homo sapiens
ggaaaacagaacact

SEQ ID NO: 2426567 - DNA, 13 bp, Homo sapiens
ggaaaagacacat

SEQ ID NO: 2426568 - DNA, 12 bp, Homo sapiens
ggaaaaggcctg

SEQ ID NO: 2426569 - DNA, 16 bp, Homo sapiens
ggaaaaggcctggggt

SEQ ID NO: 2426570 - DNA, 12 bp, Homo sapiens
ggaaaattattt

SEQ ID NO: 2426571 - DNA, 14 bp, Homo sapiens
ggaaaattcatttt

SEQ ID NO: 2426572 - DNA, 21 bp, Homo sapiens
ggaaacagcatctccaagcag

SEQ ID NO: 2426573 - DNA, 17 bp, Homo sapiens
ggaaacagttgcatgta

SEQ ID NO: 2426574 - DNA, 18 bp, Homo sapiens
ggaaacagttgcatgtag

SEQ ID NO: 2426575 - DNA, 16 bp, Homo sapiens
ggaaactcctgtgacc

SEQ ID NO: 2426576 - DNA, 17 bp, Homo sapiens
ggaaactggccatggcc

SEQ ID NO: 2426577 - DNA, 13 bp, Homo sapiens
ggaaagcaaagca

SEQ ID NO: 2426578 - DNA, 16 bp, Homo sapiens
ggaaagcaaagcacag

SEQ ID NO: 2426579 - DNA, 17 bp, Homo sapiens
ggaaagcaaagcacaga

SEQ ID NO: 2426580 - DNA, 21 bp, Homo sapiens
ggaaagcaagaatcagagaag

SEQ ID NO: 2426581 - DNA, 11 bp, Homo sapiens
ggaaagcaggt

SEQ ID NO: 2426582 - DNA, 21 bp, Homo sapiens
ggaaagcttttctattttaat

SEQ ID NO: 2426583 - DNA, 21 bp, Homo sapiens
ggaaagggccctccttcctaa

SEQ ID NO: 2426584 - DNA, 22 bp, Homo sapiens
ggaaagggccctccttcctaaa

SEQ ID NO: 2426585 - DNA, 20 bp, Homo sapiens
ggaaaggtgtgagactggga

SEQ ID NO: 2426586 - DNA, 23 bp, Homo sapiens
ggaaagtggccaagaagcagtgg

SEQ ID NO: 2426587 - DNA, 23 bp, Homo sapiens
ggaaatatatattatacttgtaa

SEQ ID NO: 2426588 - DNA, 16 bp, Homo sapiens
ggaaatcaacttgctt

SEQ ID NO: 2426589 - DNA, 21 bp, Homo sapiens
ggaaatttaaagcaggttctt

SEQ ID NO: 2426590 - DNA, 17 bp, Homo sapiens
ggaaatttagcattgta

SEQ ID NO: 2426591 - DNA, 19 bp, Homo sapiens
ggaacaattgaagtaaact

SEQ ID NO: 2426592 - DNA, 12 bp, Homo sapiens
ggaaccagactc

SEQ ID NO: 2426593 - DNA, 19 bp, Homo sapiens
ggaaccagactcttgcctg

SEQ ID NO: 2426594 - DNA, 13 bp, Homo sapiens
ggaacccagactc

SEQ ID NO: 2426595 - DNA, 21 bp, Homo sapiens
ggaaccccggggtgcccacag

SEQ ID NO: 2426596 - DNA, 13 bp, Homo sapiens
ggaacccctttcc

SEQ ID NO: 2426597 - DNA, 19 bp, Homo sapiens
ggaacccctttcccacccc

SEQ ID NO: 2426598 - DNA, 23 bp, Homo sapiens
ggaaccctgcccactcccaggac

SEQ ID NO: 2426599 - DNA, 19 bp, Homo sapiens
ggaacctcagcctggccag

SEQ ID NO: 2426600 - DNA, 20 bp, Homo sapiens
ggaacctcagcctggccaga

SEQ ID NO: 2426601 - DNA, 20 bp, Homo sapiens
ggaactcagatccagggaca

SEQ ID NO: 2426602 - DNA, 11 bp, Homo sapiens
ggaactggagg

SEQ ID NO: 2426603 - DNA, 20 bp, Homo sapiens
ggaacttgcctgcctttcca

SEQ ID NO: 2426604 - DNA, 23 bp, Homo sapiens
ggaacttggggagttaagacctg

SEQ ID NO: 2426605 - DNA, 14 bp, Homo sapiens
ggaagacagtggcc

SEQ ID NO: 2426606 - DNA, 18 bp, Homo sapiens
ggaagagagcctgcagga

SEQ ID NO: 2426607 - DNA, 13 bp, Homo sapiens
ggaagagcaggac

SEQ ID NO: 2426608 - DNA, 17 bp, Homo sapiens
ggaagagccttccaccc

SEQ ID NO: 2426609 - DNA, 20 bp, Homo sapiens
ggaagagccttccacccagg

SEQ ID NO: 2426610 - DNA, 13 bp, Homo sapiens
ggaagagtttttg

SEQ ID NO: 2426611 - DNA, 22 bp, Homo sapiens
ggaagatcctgcgggtggggct

SEQ ID NO: 2426612 - DNA, 15 bp, Homo sapiens
ggaagcagcagcctc

SEQ ID NO: 2426613 - DNA, 14 bp, Homo sapiens
ggaagcccatcctg

SEQ ID NO: 2426614 - DNA, 15 bp, Homo sapiens
ggaagctagtctttt

SEQ ID NO: 2426615 - DNA, 17 bp, Homo sapiens
ggaagctagtcttttgc

SEQ ID NO: 2426616 - DNA, 21 bp, Homo sapiens
ggaagctcttggagctgtgag

SEQ ID NO: 2426617 - DNA, 14 bp, Homo sapiens
ggaagcttggggaa

SEQ ID NO: 2426618 - DNA, 19 bp, Homo sapiens
ggaaggagctgcctggacc

SEQ ID NO: 2426619 - DNA, 20 bp, Homo sapiens
ggaaggagctgcctggaccc

SEQ ID NO: 2426620 - DNA, 16 bp, Homo sapiens
ggaaggcaggcagggc

SEQ ID NO: 2426621 - DNA, 22 bp, Homo sapiens
ggaaggcaggcagggctctcct

SEQ ID NO: 2426622 - DNA, 22 bp, Homo sapiens
ggaaggctacttcggggctggg

SEQ ID NO: 2426623 - DNA, 19 bp, Homo sapiens
ggaaggcttgttgtgcttt

SEQ ID NO: 2426624 - DNA, 21 bp, Homo sapiens
ggaaggcttgttgtgctttta

SEQ ID NO: 2426625 - DNA, 15 bp, Homo sapiens
ggaagggagccaagg

SEQ ID NO: 2426626 - DNA, 17 bp, Homo sapiens
ggaaggggccagaggct

SEQ ID NO: 2426627 - DNA, 13 bp, Homo sapiens
ggaagtcaaagca

SEQ ID NO: 2426628 - DNA, 16 bp, Homo sapiens
ggaagtccaatgtggc

SEQ ID NO: 2426629 - DNA, 20 bp, Homo sapiens
ggaagtgaagactggaagct

SEQ ID NO: 2426630 - DNA, 22 bp, Homo sapiens
ggaagtggctgagtcaggactt

SEQ ID NO: 2426631 - DNA, 15 bp, Homo sapiens
ggaagtttagctctg

SEQ ID NO: 2426632 - DNA, 17 bp, Homo sapiens
ggaagtttagctctgag

SEQ ID NO: 2426633 - DNA, 13 bp, Homo sapiens
ggaataataccta

SEQ ID NO: 2426634 - DNA, 12 bp, Homo sapiens
ggaatacttttt

SEQ ID NO: 2426635 - DNA, 16 bp, Homo sapiens
ggaatggcagcagggg

SEQ ID NO: 2426636 - DNA, 18 bp, Homo sapiens
ggaattgatttgcattga

SEQ ID NO: 2426637 - DNA, 17 bp, Homo sapiens
ggaatttcccaggaccc

SEQ ID NO: 2426638 - DNA, 19 bp, Homo sapiens
ggaatttcccaggaccctg

SEQ ID NO: 2426639 - DNA, 14 bp, Homo sapiens
ggacaaaggagcct

SEQ ID NO: 2426640 - DNA, 16 bp, Homo sapiens
ggacaatggaccggag

SEQ ID NO: 2426641 - DNA, 23 bp, Homo sapiens
ggacaatggaccggagagtgggg

SEQ ID NO: 2426642 - DNA, 14 bp, Homo sapiens
ggacacaggcctgt

SEQ ID NO: 2426643 - DNA, 19 bp, Homo sapiens
ggacacctgggagaaatct

SEQ ID NO: 2426644 - DNA, 16 bp, Homo sapiens
ggacacgctcagtggg

SEQ ID NO: 2426645 - DNA, 14 bp, Homo sapiens
ggacactcagacct

SEQ ID NO: 2426646 - DNA, 20 bp, Homo sapiens
ggacagaggccccagcctcc

SEQ ID NO: 2426647 - DNA, 23 bp, Homo sapiens
ggacagaggccccagcctccctg

SEQ ID NO: 2426648 - DNA, 21 bp, Homo sapiens
ggacagatgcctccttcctct

SEQ ID NO: 2426649 - DNA, 17 bp, Homo sapiens
ggacagccccaccctgg

SEQ ID NO: 2426650 - DNA, 15 bp, Homo sapiens
ggacagctgtgcctc

SEQ ID NO: 2426651 - DNA, 20 bp, Homo sapiens
ggacagctgtgcctcgctcc

SEQ ID NO: 2426652 - DNA, 15 bp, Homo sapiens
ggacaggctggctcc

SEQ ID NO: 2426653 - DNA, 16 bp, Homo sapiens
ggacatcctcctccca

SEQ ID NO: 2426654 - DNA, 21 bp, Homo sapiens
ggacatgcggtagccagcaca

SEQ ID NO: 2426655 - DNA, 13 bp, Homo sapiens
ggacatgcttagc

SEQ ID NO: 2426656 - DNA, 14 bp, Homo sapiens
ggacatgcttagca

SEQ ID NO: 2426657 - DNA, 15 bp, Homo sapiens
ggaccagaagctccc

SEQ ID NO: 2426658 - DNA, 21 bp, Homo sapiens
ggaccagaagctcccccagca

SEQ ID NO: 2426659 - DNA, 15 bp, Homo sapiens
gctgtatagctgctt

SEQ ID NO: 2426660 - DNA, 17 bp, Homo sapiens
gctgtattaagccactt

SEQ ID NO: 2426661 - DNA, 17 bp, Homo sapiens
gctgtcacaaccaagaa

SEQ ID NO: 2426662 - DNA, 18 bp, Homo sapiens
gctgtcaggattgcgaga

SEQ ID NO: 2426663 - DNA, 22 bp, Homo sapiens
gctgtcaggattgcgagagatg

SEQ ID NO: 2426664 - DNA, 23 bp, Homo sapiens
gctgtcaggattgcgagagatgt

SEQ ID NO: 2426665 - DNA, 24 bp, Homo sapiens
gctgtcaggattgcgagagatgtg

SEQ ID NO: 2426666 - DNA, 16 bp, Homo sapiens
gctgtcatctgtgcac

SEQ ID NO: 2426667 - DNA, 14 bp, Homo sapiens
gctgtccccccact

SEQ ID NO: 2426668 - DNA, 15 bp, Homo sapiens
gctgtccccccactc

SEQ ID NO: 2426669 - DNA, 15 bp, Homo sapiens
gctgtccctccccct

SEQ ID NO: 2426670 - DNA, 16 bp, Homo sapiens
gctgtccctccccctt

SEQ ID NO: 2426671 - DNA, 19 bp, Homo sapiens
gctgtcctttttcctctcc

SEQ ID NO: 2426672 - DNA, 20 bp, Homo sapiens
gctgtctgggtgctactggg

SEQ ID NO: 2426673 - DNA, 23 bp, Homo sapiens
gctgtctgttgtattcattgtgg

SEQ ID NO: 2426674 - DNA, 18 bp, Homo sapiens
gctgaggaggcacctaca

SEQ ID NO: 2426675 - DNA, 12 bp, Homo sapiens
gctgaggcctgg

SEQ ID NO: 2426676 - DNA, 13 bp, Homo sapiens
gctgaggcctggg

SEQ ID NO: 2426677 - DNA, 14 bp, Homo sapiens
gctgaggcctgggc

SEQ ID NO: 2426678 - DNA, 16 bp, Homo sapiens
gctgaggcctgggccg

SEQ ID NO: 2426679 - DNA, 13 bp, Homo sapiens
gctgaggctggca

SEQ ID NO: 2426680 - DNA, 18 bp, Homo sapiens
gctgaggctggcacagga

SEQ ID NO: 2426681 - DNA, 16 bp, Homo sapiens
gctgaggtgcccagga

SEQ ID NO: 2426682 - DNA, 17 bp, Homo sapiens
gctgaggtgcccaggag

SEQ ID NO: 2426683 - DNA, 20 bp, Homo sapiens
gctgaggtgcccaggagaag

SEQ ID NO: 2426684 - DNA, 19 bp, Homo sapiens
gctgataattttaaattct

SEQ ID NO: 2426685 - DNA, 15 bp, Homo sapiens
gctgatcgccttccc

SEQ ID NO: 2426686 - DNA, 16 bp, Homo sapiens
gctgatcgccttcccc

SEQ ID NO: 2426687 - DNA, 19 bp, Homo sapiens
ggccaaggacctgagacct

SEQ ID NO: 2426688 - DNA, 15 bp, Homo sapiens
ggccaaggtgtccta

SEQ ID NO: 2426689 - DNA, 19 bp, Homo sapiens
ggccaaggtgtcctacaga

SEQ ID NO: 2426690 - DNA, 13 bp, Homo sapiens
ggccacacagctg

SEQ ID NO: 2426691 - DNA, 21 bp, Homo sapiens
ggccacactcagcacaaggcc

SEQ ID NO: 2426692 - DNA, 11 bp, Homo sapiens
ggccacagcca

SEQ ID NO: 2426693 - DNA, 18 bp, Homo sapiens
ggccacatgggaggctca

SEQ ID NO: 2426694 - DNA, 19 bp, Homo sapiens
ggccacatgggaggctcac

SEQ ID NO: 2426695 - DNA, 16 bp, Homo sapiens
ggccacctggctctca

SEQ ID NO: 2426696 - DNA, 16 bp, Homo sapiens
ggccactccttcctgc

SEQ ID NO: 2426697 - DNA, 17 bp, Homo sapiens
ggccactccttcctgcc

SEQ ID NO: 2426698 - DNA, 20 bp, Homo sapiens
ggccactccttcctgcccca

SEQ ID NO: 2426699 - DNA, 16 bp, Homo sapiens
ggccagaagtaccaga

SEQ ID NO: 2426700 - DNA, 14 bp, Homo sapiens
ggccagagccaagg

SEQ ID NO: 2426701 - DNA, 12 bp, Homo sapiens
ggccagagccag

SEQ ID NO: 2426702 - DNA, 13 bp, Homo sapiens
ggccagagccagg

SEQ ID NO: 2426703 - DNA, 14 bp, Homo sapiens
ggccagagccaggg

SEQ ID NO: 2426704 - DNA, 18 bp, Homo sapiens
ggccagaggcccccagcc

SEQ ID NO: 2426705 - DNA, 17 bp, Homo sapiens
ggccagatccagcctgg

SEQ ID NO: 2426706 - DNA, 21 bp, Homo sapiens
ggccagccgcgcatcagactg

SEQ ID NO: 2426707 - DNA, 22 bp, Homo sapiens
ggccagccgcgcatcagactgt

SEQ ID NO: 2426708 - DNA, 11 bp, Homo sapiens
ggccagcctct

SEQ ID NO: 2426709 - DNA, 11 bp, Homo sapiens
ggccagcctgg

SEQ ID NO: 2426710 - DNA, 16 bp, Homo sapiens
ggccagcctggcctcc

SEQ ID NO: 2426711 - DNA, 20 bp, Homo sapiens
ggccagcctggcctcctgcc

SEQ ID NO: 2426712 - DNA, 13 bp, Homo sapiens
ggccagctggagg

SEQ ID NO: 2426713 - DNA, 14 bp, Homo sapiens
ggccaggactctgc

SEQ ID NO: 2426714 - DNA, 15 bp, Homo sapiens
ggccaggactctgca

SEQ ID NO: 2426715 - DNA, 16 bp, Homo sapiens
ggccaggactctgcag

SEQ ID NO: 2426716 - DNA, 15 bp, Homo sapiens
ggccagggagaagct

SEQ ID NO: 2426717 - DNA, 16 bp, Homo sapiens
ggccagggagaagctc

SEQ ID NO: 2426718 - DNA, 13 bp, Homo sapiens
ggccagggcagag

SEQ ID NO: 2426719 - DNA, 21 bp, Homo sapiens
ggccagggccacgctccagct

SEQ ID NO: 2426720 - DNA, 23 bp, Homo sapiens
ggccagggcccctcaccctgcct

SEQ ID NO: 2426721 - DNA, 16 bp, Homo sapiens
ggccagtccaggctgc

SEQ ID NO: 2426722 - DNA, 19 bp, Homo sapiens
ggccagtgccctgatccca

SEQ ID NO: 2426723 - DNA, 20 bp, Homo sapiens
ggccagtgccctgatcccag

SEQ ID NO: 2426724 - DNA, 13 bp, Homo sapiens
ggccatctgctcc

SEQ ID NO: 2426725 - DNA, 16 bp, Homo sapiens
ggccatctgctcctgg

SEQ ID NO: 2426726 - DNA, 18 bp, Homo sapiens
ggccatgaccctgcctct

SEQ ID NO: 2426727 - DNA, 22 bp, Homo sapiens
ggccatgaccctgcctctccca

SEQ ID NO: 2426728 - DNA, 18 bp, Homo sapiens
ggccatgatggcaacaga

SEQ ID NO: 2426729 - DNA, 13 bp, Homo sapiens
ggccatgctcctc

SEQ ID NO: 2426730 - DNA, 17 bp, Homo sapiens
ggccatgctcctcttcc

SEQ ID NO: 2426731 - DNA, 22 bp, Homo sapiens
ggccatgctcctcttccccaga

SEQ ID NO: 2426732 - DNA, 18 bp, Homo sapiens
ggccatgctgaggcctgg

SEQ ID NO: 2426733 - DNA, 17 bp, Homo sapiens
ggccatggactctgtcc

SEQ ID NO: 2426734 - DNA, 18 bp, Homo sapiens
ggccatggactctgtcct

SEQ ID NO: 2426735 - DNA, 18 bp, Homo sapiens
ggccatggagaaagctga

SEQ ID NO: 2426736 - DNA, 15 bp, Homo sapiens
ggccatgtccaaaga

SEQ ID NO: 2426737 - DNA, 14 bp, Homo sapiens
ggcccaccagggtc

SEQ ID NO: 2426738 - DNA, 15 bp, Homo sapiens
ggcccaccagggtcc

SEQ ID NO: 2426739 - DNA, 18 bp, Homo sapiens
ggcccaccccacccactt

SEQ ID NO: 2426740 - DNA, 18 bp, Homo sapiens
ggcccactgtgcctcaga

SEQ ID NO: 2426741 - DNA, 21 bp, Homo sapiens
ggcccactgtgcctcagagac

SEQ ID NO: 2426742 - DNA, 12 bp, Homo sapiens
ggcccagagccc

SEQ ID NO: 2426743 - DNA, 14 bp, Homo sapiens
ggcccagagcccag

SEQ ID NO: 2426744 - DNA, 16 bp, Homo sapiens
ggcccagagcccagct

SEQ ID NO: 2426745 - DNA, 19 bp, Homo sapiens
ggcccagagcccagctcca

SEQ ID NO: 2426746 - DNA, 22 bp, Homo sapiens
ggcccagcccaagtgaggcagc

SEQ ID NO: 2426747 - DNA, 11 bp, Homo sapiens
ggcccagcctt

SEQ ID NO: 2426748 - DNA, 19 bp, Homo sapiens
ggcccagcctttgttcccc

SEQ ID NO: 2426749 - DNA, 14 bp, Homo sapiens
ggcccagggcccag

SEQ ID NO: 2426750 - DNA, 16 bp, Homo sapiens
ggcccagggcccagag

SEQ ID NO: 2426751 - DNA, 12 bp, Homo sapiens
ggccccaccctc

SEQ ID NO: 2426752 - DNA, 21 bp, Homo sapiens
ggccccaccctgggccctggg

SEQ ID NO: 2426753 - DNA, 23 bp, Homo sapiens
ggccccaccctgggccctgggct

SEQ ID NO: 2426754 - DNA, 16 bp, Homo sapiens
ggccccaggacctggc

SEQ ID NO: 2426755 - DNA, 18 bp, Homo sapiens
ggcccccacttgcctctt

SEQ ID NO: 2426756 - DNA, 18 bp, Homo sapiens
ggcccccagcccagggct

SEQ ID NO: 2426757 - DNA, 23 bp, Homo sapiens
ggcccccagcccagggctcctgc

SEQ ID NO: 2426758 - DNA, 19 bp, Homo sapiens
ggcccccatcatcctctgg

SEQ ID NO: 2426759 - DNA, 21 bp, Homo sapiens
ggcccccctggtcccctcctt

SEQ ID NO: 2426760 - DNA, 19 bp, Homo sapiens
ggcccccgccttggcctgt

SEQ ID NO: 2426761 - DNA, 16 bp, Homo sapiens
ggccccctccctggat

SEQ ID NO: 2426762 - DNA, 23 bp, Homo sapiens
ggcccctctcccttgggctctga

SEQ ID NO: 2426763 - DNA, 17 bp, Homo sapiens
ggctctaattcacagtg

SEQ ID NO: 2426764 - DNA, 17 bp, Homo sapiens
ggctctacttccccatg

SEQ ID NO: 2426765 - DNA, 18 bp, Homo sapiens
ggctctatgagtctagat

SEQ ID NO: 2426766 - DNA, 14 bp, Homo sapiens
ggctctcctggccc

SEQ ID NO: 2426767 - DNA, 16 bp, Homo sapiens
ggctctcctggcttcc

SEQ ID NO: 2426768 - DNA, 14 bp, Homo sapiens
ggctctgaggcgcc

SEQ ID NO: 2426769 - DNA, 19 bp, Homo sapiens
ggctctgaggtgcctgtcc

SEQ ID NO: 2426770 - DNA, 20 bp, Homo sapiens
ggctctgcaattcccctctg

SEQ ID NO: 2426771 - DNA, 16 bp, Homo sapiens
ggctctgtccccagcc

SEQ ID NO: 2426772 - DNA, 23 bp, Homo sapiens
ggctctgtccccagcctgggaaa

SEQ ID NO: 2426773 - DNA, 19 bp, Homo sapiens
ggctcttagcagcttccag

SEQ ID NO: 2426774 - DNA, 20 bp, Homo sapiens
ggctcttagcagcttccaga

SEQ ID NO: 2426775 - DNA, 16 bp, Homo sapiens
ggctgaaattctcctg

SEQ ID NO: 2426776 - DNA, 22 bp, Homo sapiens
ggctgaaattctcctggaggtc

SEQ ID NO: 2426777 - DNA, 16 bp, Homo sapiens
ggctgaatagcagaag

SEQ ID NO: 2426778 - DNA, 13 bp, Homo sapiens
ggctgaggagcag

SEQ ID NO: 2426779 - DNA, 13 bp, Homo sapiens
ggctgagggcagt

SEQ ID NO: 2426780 - DNA, 22 bp, Homo sapiens
ggctgagggcagttcgcagcca

SEQ ID NO: 2426781 - DNA, 18 bp, Homo sapiens
ggctgatgtcaatttctg

SEQ ID NO: 2426782 - DNA, 24 bp, Homo sapiens
ggctgatgtcaatttctgtgttgc

SEQ ID NO: 2426783 - DNA, 19 bp, Homo sapiens
ggctgcagaggccagaggc

SEQ ID NO: 2426784 - DNA, 16 bp, Homo sapiens
ggctgcagcctcagga

SEQ ID NO: 2426785 - DNA, 22 bp, Homo sapiens
ggctgcagttcgactctgtgct

SEQ ID NO: 2426786 - DNA, 23 bp, Homo sapiens
ggctgcagttcgactctgtgctg

SEQ ID NO: 2426787 - DNA, 13 bp, Homo sapiens
ggctgcccctctc

SEQ ID NO: 2426788 - DNA, 23 bp, Homo sapiens
ggctgccctcctgtgctcagccc

SEQ ID NO: 2426789 - DNA, 12 bp, Homo sapiens
ggctgcctgagt

SEQ ID NO: 2426790 - DNA, 23 bp, Homo sapiens
ggctgcctgagtcgtgacctgct

SEQ ID NO: 2426791 - DNA, 22 bp, Homo sapiens
ggctgctcggggtgcacaggag

SEQ ID NO: 2426792 - DNA, 23 bp, Homo sapiens
ggctgctgctgctcttggctgga

SEQ ID NO: 2426793 - DNA, 16 bp, Homo sapiens
ggctgctgctgggctc

SEQ ID NO: 2426794 - DNA, 19 bp, Homo sapiens
ggctgcttccctgaagctc

SEQ ID NO: 2426795 - DNA, 15 bp, Homo sapiens
ggctgcttcctcctg

SEQ ID NO: 2426796 - DNA, 18 bp, Homo sapiens
ggctggaagatagctgtg

SEQ ID NO: 2426797 - DNA, 15 bp, Homo sapiens
ggctggaagatcctg

SEQ ID NO: 2426798 - DNA, 22 bp, Homo sapiens
ggctggaagatcctgcgggtgg

SEQ ID NO: 2426799 - DNA, 15 bp, Homo sapiens
ggctggacccagcca

SEQ ID NO: 2426800 - DNA, 21 bp, Homo sapiens
ggctggacccagccaggccca

SEQ ID NO: 2426801 - DNA, 20 bp, Homo sapiens
ggctggagtgcagtggtgtg

SEQ ID NO: 2426802 - DNA, 13 bp, Homo sapiens
ggctggatgagct

SEQ ID NO: 2426803 - DNA, 15 bp, Homo sapiens
ggctggatgagctcc

SEQ ID NO: 2426804 - DNA, 15 bp, Homo sapiens
ggctggcacaggaca

SEQ ID NO: 2426805 - DNA, 20 bp, Homo sapiens
ggctggccagtccaggctgc

SEQ ID NO: 2426806 - DNA, 13 bp, Homo sapiens
ggctggccatgga

SEQ ID NO: 2426807 - DNA, 18 bp, Homo sapiens
ggctggccatggagaaag

SEQ ID NO: 2426808 - DNA, 20 bp, Homo sapiens
ggctggcctcccaaatgagc

SEQ ID NO: 2426809 - DNA, 15 bp, Homo sapiens
ggctggctgagggca

SEQ ID NO: 2426810 - DNA, 10 bp, Homo sapiens
ggctggctgg

SEQ ID NO: 2426811 - DNA, 17 bp, Homo sapiens
ggctgggaacagtgtgc

SEQ ID NO: 2426812 - DNA, 18 bp, Homo sapiens
ggctgggacgtggctcag

SEQ ID NO: 2426813 - DNA, 19 bp, Homo sapiens
ggctgggacgtggctcagc

SEQ ID NO: 2426814 - DNA, 23 bp, Homo sapiens
ggctgggacgtggctcagccagc

SEQ ID NO: 2426815 - DNA, 23 bp, Homo sapiens
ggctgggagtagttgtctttcct

SEQ ID NO: 2426816 - DNA, 16 bp, Homo sapiens
ggctggggtcccagca

SEQ ID NO: 2426817 - DNA, 18 bp, Homo sapiens
ggctggtatctcagaaag

SEQ ID NO: 2426818 - DNA, 13 bp, Homo sapiens
ggctggtccaggg

SEQ ID NO: 2426819 - DNA, 16 bp, Homo sapiens
ggctggtgtggtacag

SEQ ID NO: 2426820 - DNA, 19 bp, Homo sapiens
ggctggtgtggtacagaga

SEQ ID NO: 2426821 - DNA, 14 bp, Homo sapiens
ggctgtaaggctct

SEQ ID NO: 2426822 - DNA, 22 bp, Homo sapiens
ggctgtcctgtacattgtggga

SEQ ID NO: 2426823 - DNA, 17 bp, Homo sapiens
ggctgtctgttgtattc

SEQ ID NO: 2426824 - DNA, 17 bp, Homo sapiens
ggctgtggaccatggag

SEQ ID NO: 2426825 - DNA, 11 bp, Homo sapiens
ggctgtgtgtg

SEQ ID NO: 2426826 - DNA, 20 bp, Homo sapiens
ggcttacctggcccatcagg

SEQ ID NO: 2426827 - DNA, 17 bp, Homo sapiens
ggcttataattctttca

SEQ ID NO: 2426828 - DNA, 12 bp, Homo sapiens
ggcttcccaagg

SEQ ID NO: 2426829 - DNA, 20 bp, Homo sapiens
ggcttcccaagggctgccgg

SEQ ID NO: 2426830 - DNA, 18 bp, Homo sapiens
ggcttcccatccccagcg

SEQ ID NO: 2426831 - DNA, 15 bp, Homo sapiens
ggcttcctggagcag

SEQ ID NO: 2426832 - DNA, 16 bp, Homo sapiens
ggcttcctggagcaga

SEQ ID NO: 2426833 - DNA, 15 bp, Homo sapiens
ggatgtgacagtggc

SEQ ID NO: 2426834 - DNA, 23 bp, Homo sapiens
ggatgttcagcactgtcccttgc

SEQ ID NO: 2426835 - DNA, 20 bp, Homo sapiens
ggattaacccactagctctt

SEQ ID NO: 2426836 - DNA, 15 bp, Homo sapiens
ggattaacctctgca

SEQ ID NO: 2426837 - DNA, 19 bp, Homo sapiens
ggattattagaatcaaaca

SEQ ID NO: 2426838 - DNA, 21 bp, Homo sapiens
ggattcaggaaaaggcctggg

SEQ ID NO: 2426839 - DNA, 18 bp, Homo sapiens
ggattccccatctcaggc

SEQ ID NO: 2426840 - DNA, 19 bp, Homo sapiens
ggattctggttccagggtc

SEQ ID NO: 2426841 - DNA, 13 bp, Homo sapiens
ggattgagtctgt

SEQ ID NO: 2426842 - DNA, 15 bp, Homo sapiens
ggattgcacgtggcc

SEQ ID NO: 2426843 - DNA, 16 bp, Homo sapiens
ggattgcgagagatgt

SEQ ID NO: 2426844 - DNA, 17 bp, Homo sapiens
ggattgcgagagatgtg

SEQ ID NO: 2426845 - DNA, 12 bp, Homo sapiens
ggattttttcca

SEQ ID NO: 2426846 - DNA, 17 bp, Homo sapiens
ggcaaaggaaggtggat

SEQ ID NO: 2426847 - DNA, 19 bp, Homo sapiens
ggcaacaaaagaagcccgg

SEQ ID NO: 2426848 - DNA, 18 bp, Homo sapiens
ggcaacagatcagtaaag

SEQ ID NO: 2426849 - DNA, 18 bp, Homo sapiens
ggcaaggactttgtacat

SEQ ID NO: 2426850 - DNA, 20 bp, Homo sapiens
ggcaatgggagctgaggcca

SEQ ID NO: 2426851 - DNA, 21 bp, Homo sapiens
ggcaatgggagctgaggccac

SEQ ID NO: 2426852 - DNA, 17 bp, Homo sapiens
ggcacaggagctacctg

SEQ ID NO: 2426853 - DNA, 12 bp, Homo sapiens
ggcacagggtct

SEQ ID NO: 2426854 - DNA, 13 bp, Homo sapiens
ggcaccagacacc

SEQ ID NO: 2426855 - DNA, 20 bp, Homo sapiens
ggcaccagacacccaggact

SEQ ID NO: 2426856 - DNA, 14 bp, Homo sapiens
ggcaccaggaagcc

SEQ ID NO: 2426857 - DNA, 13 bp, Homo sapiens
gggtcctcttctg

SEQ ID NO: 2426858 - DNA, 22 bp, Homo sapiens
gggtccttttgacactgctcta

SEQ ID NO: 2426859 - DNA, 14 bp, Homo sapiens
gggtcgaaagctct

SEQ ID NO: 2426860 - DNA, 16 bp, Homo sapiens
gggtcgaaagctctag

SEQ ID NO: 2426861 - DNA, 20 bp, Homo sapiens
gggtcggctgaccatgctca

SEQ ID NO: 2426862 - DNA, 18 bp, Homo sapiens
gggtcgtggagagctagg

SEQ ID NO: 2426863 - DNA, 17 bp, Homo sapiens
gggtctgagctccagct

SEQ ID NO: 2426864 - DNA, 21 bp, Homo sapiens
gggtctgctcccaaggggcct

SEQ ID NO: 2426865 - DNA, 22 bp, Homo sapiens
gggtctggagttgatctggaac

SEQ ID NO: 2426866 - DNA, 18 bp, Homo sapiens
gggtctggctggtgttaa

SEQ ID NO: 2426867 - DNA, 20 bp, Homo sapiens
gggtgaacaaagcagccacg

SEQ ID NO: 2426868 - DNA, 20 bp, Homo sapiens
gggtgacccggcaccccctg

SEQ ID NO: 2426869 - DNA, 14 bp, Homo sapiens
gggtgaggagctgg

SEQ ID NO: 2426870 - DNA, 17 bp, Homo sapiens
gggtgagggtcccatgt

SEQ ID NO: 2426871 - DNA, 19 bp, Homo sapiens
gggtgctactggggaaact

SEQ ID NO: 2426872 - DNA, 12 bp, Homo sapiens
gggtggaagctt

SEQ ID NO: 2426873 - DNA, 18 bp, Homo sapiens
gggtggccaggccgggaa

SEQ ID NO: 2426874 - DNA, 17 bp, Homo sapiens
gggtggccgctgagtgg

SEQ ID NO: 2426875 - DNA, 23 bp, Homo sapiens
gggtggctactctgtgccagagc

SEQ ID NO: 2426876 - DNA, 13 bp, Homo sapiens
gggtggctgcagc

SEQ ID NO: 2426877 - DNA, 15 bp, Homo sapiens
gggtggctgcagcct

SEQ ID NO: 2426878 - DNA, 15 bp, Homo sapiens
gggtggtggcctggt

SEQ ID NO: 2426879 - DNA, 17 bp, Homo sapiens
gggtgtcacggccaggc

SEQ ID NO: 2426880 - DNA, 19 bp, Homo sapiens
gggtgtcacggccaggcag

SEQ ID NO: 2426881 - DNA, 16 bp, Homo sapiens
gggttaagaagacttt

SEQ ID NO: 2426882 - DNA, 13 bp, Homo sapiens
gggttatctctgt

SEQ ID NO: 2426883 - DNA, 13 bp, Homo sapiens
gggttcatttgtg

SEQ ID NO: 2426884 - DNA, 15 bp, Homo sapiens
gggtttattcactga

SEQ ID NO: 2426885 - DNA, 19 bp, Homo sapiens
gggtttctgccctgcccac

SEQ ID NO: 2426886 - DNA, 16 bp, Homo sapiens
gggttttaactttgtt

SEQ ID NO: 2426887 - DNA, 13 bp, Homo sapiens
ggtaaaatgccat

SEQ ID NO: 2426888 - DNA, 15 bp, Homo sapiens
ggtaaagactggctt

SEQ ID NO: 2426889 - DNA, 18 bp, Homo sapiens
ggtaactgctttctgttc

SEQ ID NO: 2426890 - DNA, 23 bp, Homo sapiens
ggtaagaagttttaaaaagccag

SEQ ID NO: 2426891 - DNA, 14 bp, Homo sapiens
ggtaccagatgcag

SEQ ID NO: 2426892 - DNA, 22 bp, Homo sapiens
ggtaccagatgcagctcaagag

SEQ ID NO: 2426893 - DNA, 14 bp, Homo sapiens
ggtaccctcctggc

SEQ ID NO: 2426894 - DNA, 20 bp, Homo sapiens
ggtactgtacagctggctct

SEQ ID NO: 2426895 - DNA, 16 bp, Homo sapiens
ggtacttcttgaaggt

SEQ ID NO: 2426896 - DNA, 22 bp, Homo sapiens
ggtagcgggggagggtaggcag

SEQ ID NO: 2426897 - DNA, 17 bp, Homo sapiens
ggtaggagggtgggaag

SEQ ID NO: 2426898 - DNA, 24 bp, Homo sapiens
ggtaggccaaggtgtcctacagaa

SEQ ID NO: 2426899 - DNA, 11 bp, Homo sapiens
ggtaggggctg

SEQ ID NO: 2426900 - DNA, 16 bp, Homo sapiens
ggtaggggctgggaac

SEQ ID NO: 2426901 - DNA, 13 bp, Homo sapiens
ggtagggggctgg

SEQ ID NO: 2426902 - DNA, 16 bp, Homo sapiens
ggtaggttcagccaag

SEQ ID NO: 2426903 - DNA, 19 bp, Homo sapiens
ggtaggttcagccaaggtt

SEQ ID NO: 2426904 - DNA, 12 bp, Homo sapiens
ggtatattttcc

SEQ ID NO: 2426905 - DNA, 13 bp, Homo sapiens
ggtatgaagagtg

SEQ ID NO: 2426906 - DNA, 17 bp, Homo sapiens
ggtatgaagagtgttat

SEQ ID NO: 2426907 - DNA, 21 bp, Homo sapiens
ggtatggcgtaagtacagaga

SEQ ID NO: 2426908 - DNA, 18 bp, Homo sapiens
ggtcaaaatagtgccact

SEQ ID NO: 2426909 - DNA, 21 bp, Homo sapiens
ggtcacagcggaggtgtggag

SEQ ID NO: 2426910 - DNA, 11 bp, Homo sapiens
ggtcaggcctt

SEQ ID NO: 2426911 - DNA, 12 bp, Homo sapiens
ggtcaggccttt

SEQ ID NO: 2426912 - DNA, 22 bp, Homo sapiens
ggtccaatgagctttctgaaca

SEQ ID NO: 2426913 - DNA, 18 bp, Homo sapiens
ggtccaattagtttcctt

SEQ ID NO: 2426914 - DNA, 23 bp, Homo sapiens
ggtccacaagcttctgtcctgcc

SEQ ID NO: 2426915 - DNA, 17 bp, Homo sapiens
ggttcccgtttctccac

SEQ ID NO: 2426916 - DNA, 21 bp, Homo sapiens
ggttccgcttggagcagaggg

SEQ ID NO: 2426917 - DNA, 23 bp, Homo sapiens
ggttccgcttggagcagaggggc

SEQ ID NO: 2426918 - DNA, 16 bp, Homo sapiens
ggttccggcatggaca

SEQ ID NO: 2426919 - DNA, 17 bp, Homo sapiens
ggttccgtgtccacccc

SEQ ID NO: 2426920 - DNA, 15 bp, Homo sapiens
ggttccttttattag

SEQ ID NO: 2426921 - DNA, 12 bp, Homo sapiens
ggttctaaggcc

SEQ ID NO: 2426922 - DNA, 19 bp, Homo sapiens
ggttctccgttagctcctg

SEQ ID NO: 2426923 - DNA, 14 bp, Homo sapiens
ggttcttgttggtg

SEQ ID NO: 2426924 - DNA, 15 bp, Homo sapiens
ggttgactttaccca

SEQ ID NO: 2426925 - DNA, 11 bp, Homo sapiens
ggttgaggaaa

SEQ ID NO: 2426926 - DNA, 14 bp, Homo sapiens
ggttgcagacagga

SEQ ID NO: 2426927 - DNA, 18 bp, Homo sapiens
ggttgctccgcctggcct

SEQ ID NO: 2426928 - DNA, 13 bp, Homo sapiens
ggttgttatgtga

SEQ ID NO: 2426929 - DNA, 14 bp, Homo sapiens
ggttgtttctgttc

SEQ ID NO: 2426930 - DNA, 20 bp, Homo sapiens
ggtttaaagagtctagattc

SEQ ID NO: 2426931 - DNA, 22 bp, Homo sapiens
ggtttaaagagtctagattcaa

SEQ ID NO: 2426932 - DNA, 22 bp, Homo sapiens
ggtttaaatgaacaagagaagc

SEQ ID NO: 2426933 - DNA, 16 bp, Homo sapiens
ggtttcaaagatgctg

SEQ ID NO: 2426934 - DNA, 19 bp, Homo sapiens
ggtttcaccatgttggcca

SEQ ID NO: 2426935 - DNA, 19 bp, Homo sapiens
ggtttcagcactagccaaa

SEQ ID NO: 2426936 - DNA, 21 bp, Homo sapiens
ggtttctaagcataaaagatg

SEQ ID NO: 2426937 - DNA, 21 bp, Homo sapiens
ggtttctcgcataggaccttt

SEQ ID NO: 2426938 - DNA, 14 bp, Homo sapiens
ggtttctgccctgc

SEQ ID NO: 2426939 - DNA, 21 bp, Homo sapiens
ggttttaatttagtaaaccaa

SEQ ID NO: 2426940 - DNA, 19 bp, Homo sapiens
ggtttttactgctctgaga

SEQ ID NO: 2426941 - DNA, 12 bp, Homo sapiens
ggtttttccctg

SEQ ID NO: 2426942 - DNA, 20 bp, Homo sapiens
gtaaaacatttattttgaca

SEQ ID NO: 2426943 - DNA, 18 bp, Homo sapiens
gtaaaagcaaaaaagaaa

SEQ ID NO: 2426944 - DNA, 12 bp, Homo sapiens
gtaaaatacttt

SEQ ID NO: 2426945 - DNA, 21 bp, Homo sapiens
gtaaaatattttgaatcaata

SEQ ID NO: 2426946 - DNA, 16 bp, Homo sapiens
gtaaaatcttgtcatg

SEQ ID NO: 2426947 - DNA, 14 bp, Homo sapiens
gtaaaccactgaaa

SEQ ID NO: 2426948 - DNA, 18 bp, Homo sapiens
gtaaaccactgaaaaaat

SEQ ID NO: 2426949 - DNA, 20 bp, Homo sapiens
gtaaaccactgaaaaaatat

SEQ ID NO: 2426950 - DNA, 14 bp, Homo sapiens
gtaaagactggctt

SEQ ID NO: 2426951 - DNA, 15 bp, Homo sapiens
gtaaagactggcttt

SEQ ID NO: 2426952 - DNA, 21 bp, Homo sapiens
gtaaagatgtttatttcaggc

SEQ ID NO: 2426953 - DNA, 12 bp, Homo sapiens
gtaaagccatgc

SEQ ID NO: 2426954 - DNA, 17 bp, Homo sapiens
gtaaagtatgtattatt

SEQ ID NO: 2426955 - DNA, 15 bp, Homo sapiens
gtaaataaaaagaaa

SEQ ID NO: 2426956 - DNA, 14 bp, Homo sapiens
gtaaataatacatt

SEQ ID NO: 2426957 - DNA, 13 bp, Homo sapiens
gtaaatataaaga

SEQ ID NO: 2426958 - DNA, 14 bp, Homo sapiens
gtaaatatgtacat

SEQ ID NO: 2426959 - DNA, 16 bp, Homo sapiens
gtaaatatgtacattt

SEQ ID NO: 2426960 - DNA, 13 bp, Homo sapiens
gtaaatattttaa

SEQ ID NO: 2426961 - DNA, 14 bp, Homo sapiens
gtaaatcagtaaga

SEQ ID NO: 2426962 - DNA, 13 bp, Homo sapiens
gtaaatctacaca

SEQ ID NO: 2426963 - DNA, 13 bp, Homo sapiens
gtaaatctgccac

SEQ ID NO: 2426964 - DNA, 15 bp, Homo sapiens
gtaaatttgtactat

SEQ ID NO: 2426965 - DNA, 14 bp, Homo sapiens
gtaacaatacaaat

SEQ ID NO: 2426966 - DNA, 15 bp, Homo sapiens
tttctccaagagcta

SEQ ID NO: 2426967 - DNA, 22 bp, Homo sapiens
tttctcgctgtcctttctagag

SEQ ID NO: 2426968 - DNA, 11 bp, Homo sapiens
tttctctgcca

SEQ ID NO: 2426969 - DNA, 11 bp, Homo sapiens
tttctcttcat

SEQ ID NO: 2426970 - DNA, 17 bp, Homo sapiens
tttctctttccatgaca

SEQ ID NO: 2426971 - DNA, 19 bp, Homo sapiens
tttctgaacagctggtgta

SEQ ID NO: 2426972 - DNA, 12 bp, Homo sapiens
tttatcattttc

SEQ ID NO: 2426973 - DNA, 21 bp, Homo sapiens
tttatcccaaagttgttgtaa

SEQ ID NO: 2426974 - DNA, 19 bp, Homo sapiens
tttatcgctgggaaatgag

SEQ ID NO: 2426975 - DNA, 19 bp, Homo sapiens
ttggggggaaggggaccct

SEQ ID NO: 2426976 - DNA, 19 bp, Homo sapiens
ttggggtataggtctcatc

SEQ ID NO: 2426977 - DNA, 21 bp, Homo sapiens
ttggggtataggtctcatctc

SEQ ID NO: 2426978 - DNA, 12 bp, Homo sapiens
ttgggtccagga

SEQ ID NO: 2426979 - DNA, 12 bp, Homo sapiens
ttgggttagacc

SEQ ID NO: 2426980 - DNA, 16 bp, Homo sapiens
ttgggttagacctaca

SEQ ID NO: 2426981 - DNA, 18 bp, Homo sapiens
ttgggttagacctacagg

SEQ ID NO: 2426982 - DNA, 15 bp, Homo sapiens
ttgggtttttttcct

SEQ ID NO: 2426983 - DNA, 12 bp, Homo sapiens
ttggtaactttt

SEQ ID NO: 2426984 - DNA, 14 bp, Homo sapiens
ttggtaccagataa

SEQ ID NO: 2426985 - DNA, 16 bp, Homo sapiens
ttggtgcacagcacaa

SEQ ID NO: 2426986 - DNA, 22 bp, Homo sapiens
ttggtgcacagcacaaattagt

SEQ ID NO: 2426987 - DNA, 18 bp, Homo sapiens
ttggttcccccactgatc

SEQ ID NO: 2426988 - DNA, 18 bp, Homo sapiens
ttggttggtagggtggga

SEQ ID NO: 2426989 - DNA, 18 bp, Homo sapiens
ttggtttaaagaaagtgt

SEQ ID NO: 2426990 - DNA, 13 bp, Homo sapiens
ttggttttcttct

SEQ ID NO: 2426991 - DNA, 16 bp, Homo sapiens
ttggttttgctacata

SEQ ID NO: 2426992 - DNA, 15 bp, Homo sapiens
ttgtaaaatgacaat

SEQ ID NO: 2426993 - DNA, 22 bp, Homo sapiens
ttgtaaacaaactgtgtaactg

SEQ ID NO: 2426994 - DNA, 17 bp, Homo sapiens
ttgtaaatataaagacg

SEQ ID NO: 2426995 - DNA, 12 bp, Homo sapiens
ttgtaaattggc

SEQ ID NO: 2426996 - DNA, 14 bp, Homo sapiens
ttgtaaattggcat

SEQ ID NO: 2426997 - DNA, 20 bp, Homo sapiens
ttgtaagagtggaaccaaca

SEQ ID NO: 2426998 - DNA, 15 bp, Homo sapiens
ttgtaatatgtaaat

SEQ ID NO: 2426999 - DNA, 14 bp, Homo sapiens
ttgtaattatggag

SEQ ID NO: 2427000 - DNA, 14 bp, Homo sapiens
ttgtaattctaaat

SEQ ID NO: 2427001 - DNA, 16 bp, Homo sapiens
ttgtactaaagccaaa

SEQ ID NO: 2427002 - DNA, 22 bp, Homo sapiens
ttgtactatttaactgactatt

SEQ ID NO: 2427003 - DNA, 15 bp, Homo sapiens
ttgtagccagccggg

SEQ ID NO: 2427004 - DNA, 21 bp, Homo sapiens
ttgtagcgtctttcttttttg

SEQ ID NO: 2427005 - DNA, 15 bp, Homo sapiens
ttgtagctcctcccc

SEQ ID NO: 2427006 - DNA, 21 bp, Homo sapiens
ttgtaggggaggggctccttt

SEQ ID NO: 2427007 - DNA, 19 bp, Homo sapiens
ttgtagtgccactgttgtt

SEQ ID NO: 2427008 - DNA, 23 bp, Homo sapiens
ttgtagtgctttgagagagaaag

SEQ ID NO: 2427009 - DNA, 12 bp, Homo sapiens
ttgtataaaata

SEQ ID NO: 2427010 - DNA, 21 bp, Homo sapiens
ttgtataattggatttcctaa

SEQ ID NO: 2427011 - DNA, 19 bp, Homo sapiens
ttgtatagttaacacacta

SEQ ID NO: 2427012 - DNA, 21 bp, Homo sapiens
ttgtatatattattataatct

SEQ ID NO: 2427013 - DNA, 14 bp, Homo sapiens
ttgtatattgtaat

SEQ ID NO: 2427014 - DNA, 16 bp, Homo sapiens
ttgtatgaaactaaag

SEQ ID NO: 2427015 - DNA, 16 bp, Homo sapiens
ttgtattctctgagct

SEQ ID NO: 2427016 - DNA, 16 bp, Homo sapiens
ttgtattgtttcaatt

SEQ ID NO: 2427017 - DNA, 17 bp, Homo sapiens
ttgtatttaacagaaat

SEQ ID NO: 2427018 - DNA, 18 bp, Homo sapiens
ttgtatttaacagaaatt

SEQ ID NO: 2427019 - DNA, 23 bp, Homo sapiens
ttgtcagggagtgttccctatcc

SEQ ID NO: 2427020 - DNA, 13 bp, Homo sapiens
ttgtcatgtgtat

SEQ ID NO: 2427021 - DNA, 13 bp, Homo sapiens
ttgtccattgtcc

SEQ ID NO: 2427022 - DNA, 23 bp, Homo sapiens
ttgtcctagcacagatggccagc

SEQ ID NO: 2427023 - DNA, 19 bp, Homo sapiens
ttgtccttttgcaaagaaa

SEQ ID NO: 2427024 - DNA, 19 bp, Homo sapiens
ttgtctaagaaattgaata

SEQ ID NO: 2427025 - DNA, 21 bp, Homo sapiens
ttgtctaagaaattgaatact

SEQ ID NO: 2427026 - DNA, 15 bp, Homo sapiens
ttgtctcatgccagt

SEQ ID NO: 2427027 - DNA, 17 bp, Homo sapiens
ttgtctcttgcctgcca

SEQ ID NO: 2427028 - DNA, 18 bp, Homo sapiens
ttgtctcttgcctgccac

SEQ ID NO: 2427029 - DNA, 14 bp, Homo sapiens
ttgtcttattccct

SEQ ID NO: 2427030 - DNA, 22 bp, Homo sapiens
ttgtgaagccatgagttccaga

SEQ ID NO: 2427031 - DNA, 22 bp, Homo sapiens
ttgtgagtttaccttgtatact

SEQ ID NO: 2427032 - DNA, 13 bp, Homo sapiens
ttgtgatatgcac

SEQ ID NO: 2427033 - DNA, 18 bp, Homo sapiens
ttgtgatgtcatacagag

SEQ ID NO: 2427034 - DNA, 19 bp, Homo sapiens
ttgtgcaatgtgtataaac

SEQ ID NO: 2427035 - DNA, 20 bp, Homo sapiens
ttgtgcccagggttttgccc

SEQ ID NO: 2427036 - DNA, 18 bp, Homo sapiens
ttgtgggggactgtaagt

SEQ ID NO: 2427037 - DNA, 18 bp, Homo sapiens
ttgtgtaagaaatacaga

SEQ ID NO: 2427038 - DNA, 13 bp, Homo sapiens
ttgtgtagccttt

SEQ ID NO: 2427039 - DNA, 16 bp, Homo sapiens
ttgtgtggattcttta

SEQ ID NO: 2427040 - DNA, 22 bp, Homo sapiens
ttgtgtgtatgcacatgaactt

SEQ ID NO: 2427041 - DNA, 14 bp, Homo sapiens
ttgtgtgtatttgc

SEQ ID NO: 2427042 - DNA, 13 bp, Homo sapiens
ttgtgtgttgtct

SEQ ID NO: 2427043 - DNA, 15 bp, Homo sapiens
ttgtgttctgttttg

SEQ ID NO: 2427044 - DNA, 12 bp, Homo sapiens
ttgttaaatttt

SEQ ID NO: 2427045 - DNA, 22 bp, Homo sapiens
ttgttaatttagaaaactttaa

SEQ ID NO: 2427046 - DNA, 14 bp, Homo sapiens
ttgttacttctgag

SEQ ID NO: 2427047 - DNA, 15 bp, Homo sapiens
ttgttcagcatgcaa

SEQ ID NO: 2427048 - DNA, 16 bp, Homo sapiens
ttgttcagcatgcaat

SEQ ID NO: 2427049 - DNA, 21 bp, Homo sapiens
ttgttccaaatactaatgaaa

SEQ ID NO: 2427050 - DNA, 14 bp, Homo sapiens
ttgttccctctccc

SEQ ID NO: 2427051 - DNA, 23 bp, Homo sapiens
ttgttctcagaatcccttaacag

SEQ ID NO: 2427052 - DNA, 14 bp, Homo sapiens
ttgttctgtcacca

SEQ ID NO: 2427053 - DNA, 15 bp, Homo sapiens
ttgttcttgtattta

SEQ ID NO: 2427054 - DNA, 22 bp, Homo sapiens
ttgttgaaaaagtttgtttttg

SEQ ID NO: 2427055 - DNA, 17 bp, Homo sapiens
ttgttgacattctgaat

SEQ ID NO: 2427056 - DNA, 20 bp, Homo sapiens
ttgttgacattctgaatgct

SEQ ID NO: 2427057 - DNA, 16 bp, Homo sapiens
ttgttgcgttcctttc

SEQ ID NO: 2427058 - DNA, 23 bp, Homo sapiens
ttgttggagtcaaaaagaaccac

SEQ ID NO: 2427059 - DNA, 18 bp, Homo sapiens
ttgttggcgtaggctaca

SEQ ID NO: 2427060 - DNA, 22 bp, Homo sapiens
ttgttggcgtaggctacagaga

SEQ ID NO: 2427061 - DNA, 23 bp, Homo sapiens
ttgttggcgtaggctacagagaa

SEQ ID NO: 2427062 - DNA, 20 bp, Homo sapiens
ttgttgtagattgattgtat

SEQ ID NO: 2427063 - DNA, 14 bp, Homo sapiens
ttgttgtccttttc

SEQ ID NO: 2427064 - DNA, 21 bp, Homo sapiens
ttgttgttctgttaactgaat

SEQ ID NO: 2427065 - DNA, 15 bp, Homo sapiens
ttgttgtttcttgcc

SEQ ID NO: 2427066 - DNA, 15 bp, Homo sapiens
ttgtttacatgctta

SEQ ID NO: 2427067 - DNA, 16 bp, Homo sapiens
ttgtttacatgcttat

SEQ ID NO: 2427068 - DNA, 23 bp, Homo sapiens
ttgtttacatgcttattccatga

SEQ ID NO: 2427069 - DNA, 16 bp, Homo sapiens
ttgtttcaattgcatc

SEQ ID NO: 2427070 - DNA, 23 bp, Homo sapiens
ttgtttcctcccctatctgtatt

SEQ ID NO: 2427071 - DNA, 18 bp, Homo sapiens
ttgtttcgctctttgaga

SEQ ID NO: 2427072 - DNA, 15 bp, Homo sapiens
ttgtttctgttccaa

SEQ ID NO: 2427073 - DNA, 12 bp, Homo sapiens
ttgtttcttaaa

SEQ ID NO: 2427074 - DNA, 23 bp, Homo sapiens
ttgtttcttaaataagaaacttt

SEQ ID NO: 2427075 - DNA, 14 bp, Homo sapiens
ttgtttgatttcaa

SEQ ID NO: 2427076 - DNA, 15 bp, Homo sapiens
tttaaaaaactaaaa

SEQ ID NO: 2427077 - DNA, 21 bp, Homo sapiens
tttaaaaaactaaaaactaga

SEQ ID NO: 2427078 - DNA, 17 bp, Homo sapiens
tttaaaaaagcttaaaa

SEQ ID NO: 2427079 - DNA, 23 bp, Homo sapiens
tttaaaaaagcttaaaactttga

SEQ ID NO: 2427080 - DNA, 14 bp, Homo sapiens
ttgcattgaacaca

SEQ ID NO: 2427081 - DNA, 19 bp, Homo sapiens
ttgcattgactttccccac

SEQ ID NO: 2427082 - DNA, 14 bp, Homo sapiens
ttgcatttgtttat

SEQ ID NO: 2427083 - DNA, 18 bp, Homo sapiens
ttgcatttgttttgttta

SEQ ID NO: 2427084 - DNA, 22 bp, Homo sapiens
ttgcatttgttttgtttacaga

SEQ ID NO: 2427085 - DNA, 18 bp, Homo sapiens
ttgccaaaaagtgaaata

SEQ ID NO: 2427086 - DNA, 16 bp, Homo sapiens
ttgccaaatatgtcct

SEQ ID NO: 2427087 - DNA, 22 bp, Homo sapiens
ttgccaagctccaagccccatc

SEQ ID NO: 2427088 - DNA, 13 bp, Homo sapiens
ttgccacagcttt

SEQ ID NO: 2427089 - DNA, 14 bp, Homo sapiens
ttgcccccctggcc

SEQ ID NO: 2427090 - DNA, 14 bp, Homo sapiens
ttgccctaagcaga

SEQ ID NO: 2427091 - DNA, 18 bp, Homo sapiens
ttgccctaagcagaaagt

SEQ ID NO: 2427092 - DNA, 19 bp, Homo sapiens
ttgcctgccactgtgtgaa

SEQ ID NO: 2427093 - DNA, 15 bp, Homo sapiens
ttgcctgcctttcca

SEQ ID NO: 2427094 - DNA, 15 bp, Homo sapiens
ttgcctggtacagta

SEQ ID NO: 2427095 - DNA, 22 bp, Homo sapiens
ttgccttccagaaaacaaaact

SEQ ID NO: 2427096 - DNA, 12 bp, Homo sapiens
ttgcgagagatg

SEQ ID NO: 2427097 - DNA, 14 bp, Homo sapiens
ttgcgagagatgtg

SEQ ID NO: 2427098 - DNA, 15 bp, Homo sapiens
ttgctaatttttatt

SEQ ID NO: 2427099 - DNA, 13 bp, Homo sapiens
ttgctacataatt

SEQ ID NO: 2427100 - DNA, 16 bp, Homo sapiens
ttgctaccagtattta

SEQ ID NO: 2427101 - DNA, 14 bp, Homo sapiens
ttgctagagctcct

SEQ ID NO: 2427102 - DNA, 16 bp, Homo sapiens
ttgctagagctcctcc

SEQ ID NO: 2427103 - DNA, 18 bp, Homo sapiens
ttgctagagctcctccct

SEQ ID NO: 2427104 - DNA, 15 bp, Homo sapiens
ttgctattctgtccc

SEQ ID NO: 2427105 - DNA, 16 bp, Homo sapiens
ttgctccgcctggcct

SEQ ID NO: 2427106 - DNA, 15 bp, Homo sapiens
ttgctgagaagcaaa

SEQ ID NO: 2427107 - DNA, 19 bp, Homo sapiens
ttgctgccccatcagtgct

SEQ ID NO: 2427108 - DNA, 20 bp, Homo sapiens
ttgctgccccatcagtgctc

SEQ ID NO: 2427109 - DNA, 13 bp, Homo sapiens
ttgctgcttctcc

SEQ ID NO: 2427110 - DNA, 19 bp, Homo sapiens
ttgctgtgaggctgtcctg

SEQ ID NO: 2427111 - DNA, 18 bp, Homo sapiens
ttgctgttttaaacatta

SEQ ID NO: 2427112 - DNA, 14 bp, Homo sapiens
ttgcttacctctca

SEQ ID NO: 2427113 - DNA, 14 bp, Homo sapiens
ttgcttcctcctcc

SEQ ID NO: 2427114 - DNA, 12 bp, Homo sapiens
ttgcttctttct

SEQ ID NO: 2427115 - DNA, 17 bp, Homo sapiens
ttgcttctttctagaaa

SEQ ID NO: 2427116 - DNA, 14 bp, Homo sapiens
ttgctttaatataa

SEQ ID NO: 2427117 - DNA, 17 bp, Homo sapiens
ttgctttaatataaatg

SEQ ID NO: 2427118 - DNA, 18 bp, Homo sapiens
ttgctttaatataaatgc

SEQ ID NO: 2427119 - DNA, 13 bp, Homo sapiens
ttgctttgccctt

SEQ ID NO: 2427120 - DNA, 13 bp, Homo sapiens
ttgcttttcatgc

SEQ ID NO: 2427121 - DNA, 21 bp, Homo sapiens
ttgctttttgtgatatgcaca

SEQ ID NO: 2427122 - DNA, 13 bp, Homo sapiens
ttggaaagcaggt

SEQ ID NO: 2427123 - DNA, 18 bp, Homo sapiens
ttggaaatttagcattgt

SEQ ID NO: 2427124 - DNA, 22 bp, Homo sapiens
ttggaacattggaatgttctca

SEQ ID NO: 2427125 - DNA, 14 bp, Homo sapiens
ttggaaccagactc

SEQ ID NO: 2427126 - DNA, 19 bp, Homo sapiens
ttggaaccttgttttggac

SEQ ID NO: 2427127 - DNA, 17 bp, Homo sapiens
ttggaactgaagggggc

SEQ ID NO: 2427128 - DNA, 14 bp, Homo sapiens
ttggaacttgcctg

SEQ ID NO: 2427129 - DNA, 17 bp, Homo sapiens
ttggaagagcagcacct

SEQ ID NO: 2427130 - DNA, 17 bp, Homo sapiens
ttggaagtttagctctg

SEQ ID NO: 2427131 - DNA, 18 bp, Homo sapiens
ttggaagtttagctctga

SEQ ID NO: 2427132 - DNA, 23 bp, Homo sapiens
ttggaatattgtccattgtccaa

SEQ ID NO: 2427133 - DNA, 14 bp, Homo sapiens
ttggacccttccat

SEQ ID NO: 2427134 - DNA, 19 bp, Homo sapiens
ttggacctaaatggcctca

SEQ ID NO: 2427135 - DNA, 13 bp, Homo sapiens
ttggacttctggg

SEQ ID NO: 2427136 - DNA, 16 bp, Homo sapiens
ttggagaagtctcagc

SEQ ID NO: 2427137 - DNA, 18 bp, Homo sapiens
ttggagaagtctcagcta

SEQ ID NO: 2427138 - DNA, 18 bp, Homo sapiens
ttggagagtttcctgaaa

SEQ ID NO: 2427139 - DNA, 21 bp, Homo sapiens
ttggagagtttcctgaaacaa

SEQ ID NO: 2427140 - DNA, 21 bp, Homo sapiens
ttggagtcactcttatgctgt

SEQ ID NO: 2427141 - DNA, 23 bp, Homo sapiens
ttggagtcccctcacctcctcta

SEQ ID NO: 2427142 - DNA, 19 bp, Homo sapiens
ttggagtgttccccttcca

SEQ ID NO: 2427143 - DNA, 20 bp, Homo sapiens
ttggatatgtaaaacattta

SEQ ID NO: 2427144 - DNA, 21 bp, Homo sapiens
ttggatttcctaatactgtca

SEQ ID NO: 2427145 - DNA, 17 bp, Homo sapiens
ttggcaccagacaccca

SEQ ID NO: 2427146 - DNA, 21 bp, Homo sapiens
ttggcaccagacacccaggac

SEQ ID NO: 2427147 - DNA, 23 bp, Homo sapiens
ttggcaccagacacccaggactt

SEQ ID NO: 2427148 - DNA, 19 bp, Homo sapiens
ttggcacctaatccaggca

SEQ ID NO: 2427149 - DNA, 12 bp, Homo sapiens
ttggcagccttg

SEQ ID NO: 2427150 - DNA, 13 bp, Homo sapiens
ttggcagccttgt

SEQ ID NO: 2427151 - DNA, 16 bp, Homo sapiens
ttggcatggaaattta

SEQ ID NO: 2427152 - DNA, 22 bp, Homo sapiens
ttggcatggaaatttaaagcag

SEQ ID NO: 2427153 - DNA, 22 bp, Homo sapiens
ttggccactccgagaggtgggc

SEQ ID NO: 2427154 - DNA, 16 bp, Homo sapiens
ttggcctggagcacaa

SEQ ID NO: 2427155 - DNA, 19 bp, Homo sapiens
ttggcctgtagagttgctg

SEQ ID NO: 2427156 - DNA, 17 bp, Homo sapiens
ttggcgatgccagccaa

SEQ ID NO: 2427157 - DNA, 22 bp, Homo sapiens
ttggcggggaggaggaaatccc

SEQ ID NO: 2427158 - DNA, 19 bp, Homo sapiens
ttggcgtaggctacagaga

SEQ ID NO: 2427159 - DNA, 20 bp, Homo sapiens
ttggcgtaggctacagagaa

SEQ ID NO: 2427160 - DNA, 18 bp, Homo sapiens
ttggctcacactcgacat

SEQ ID NO: 2427161 - DNA, 13 bp, Homo sapiens
ttggctctgccag

SEQ ID NO: 2427162 - DNA, 19 bp, Homo sapiens
ttggctgaaattctcctgg

SEQ ID NO: 2427163 - DNA, 20 bp, Homo sapiens
ttggctgaaattctcctgga

SEQ ID NO: 2427164 - DNA, 22 bp, Homo sapiens
ttggctgaaattctcctggagg

SEQ ID NO: 2427165 - DNA, 12 bp, Homo sapiens
ttggctggaccc

SEQ ID NO: 2427166 - DNA, 23 bp, Homo sapiens
ttggctggtgtggtacagagaag

SEQ ID NO: 2427167 - DNA, 14 bp, Homo sapiens
ttggcttacctggc

SEQ ID NO: 2427168 - DNA, 19 bp, Homo sapiens
ttggcttataattctttca

SEQ ID NO: 2427169 - DNA, 18 bp, Homo sapiens
ttgggaactgaactcact

SEQ ID NO: 2427170 - DNA, 14 bp, Homo sapiens
ttgggaattttatt

SEQ ID NO: 2427171 - DNA, 23 bp, Homo sapiens
ttgggagagacttgttttggatg

SEQ ID NO: 2427172 - DNA, 17 bp, Homo sapiens
ttgggcacccccagcct

SEQ ID NO: 2427173 - DNA, 21 bp, Homo sapiens
ttgggcacccccagcctgggc

SEQ ID NO: 2427174 - DNA, 21 bp, Homo sapiens
ttgggcagagctggctctgag

SEQ ID NO: 2427175 - DNA, 14 bp, Homo sapiens
ttgggccagaagta

SEQ ID NO: 2427176 - DNA, 18 bp, Homo sapiens
ttgggcttcagctgccag

SEQ ID NO: 2427177 - DNA, 17 bp, Homo sapiens
ttgggcttgctattctg

SEQ ID NO: 2427178 - DNA, 23 bp, Homo sapiens
ttgggcttgctattctgtcccta

SEQ ID NO: 2427179 - DNA, 19 bp, Homo sapiens
ttggggaaacagcatctcc

SEQ ID NO: 2427180 - DNA, 14 bp, Homo sapiens
ttggggaagaccca

SEQ ID NO: 2427181 - DNA, 14 bp, Homo sapiens
ttggggacacatgt

SEQ ID NO: 2427182 - DNA, 20 bp, Homo sapiens
ttggggacacatgtatttgg

SEQ ID NO: 2427183 - DNA, 17 bp, Homo sapiens
ttggggagttaagacct

SEQ ID NO: 2427184 - DNA, 20 bp, Homo sapiens
ttggggcaggagtagctgag

SEQ ID NO: 2427185 - DNA, 15 bp, Homo sapiens
ttctttctcactaaa

SEQ ID NO: 2427186 - DNA, 20 bp, Homo sapiens
ttctttgaaaaaaaataaat

SEQ ID NO: 2427187 - DNA, 14 bp, Homo sapiens
ttctttgaataaat

SEQ ID NO: 2427188 - DNA, 17 bp, Homo sapiens
ttctttgagactgggtc

SEQ ID NO: 2427189 - DNA, 13 bp, Homo sapiens
ttctttgggccag

SEQ ID NO: 2427190 - DNA, 22 bp, Homo sapiens
ttctttggtttcccaagagcta

SEQ ID NO: 2427191 - DNA, 17 bp, Homo sapiens
ttctttgtttctttctt

SEQ ID NO: 2427192 - DNA, 22 bp, Homo sapiens
ttcttttggtaaagactggctt

SEQ ID NO: 2427193 - DNA, 18 bp, Homo sapiens
ttctttttgaagtattta

SEQ ID NO: 2427194 - DNA, 23 bp, Homo sapiens
ttctttttgtagctggggctttg

SEQ ID NO: 2427195 - DNA, 23 bp, Homo sapiens
ttcttttttgatatagaagtata

SEQ ID NO: 2427196 - DNA, 16 bp, Homo sapiens
ttctttttttagagaa

SEQ ID NO: 2427197 - DNA, 21 bp, Homo sapiens
ttgaaaataagaatagaaata

SEQ ID NO: 2427198 - DNA, 15 bp, Homo sapiens
ttgaaacagaaaaat

SEQ ID NO: 2427199 - DNA, 14 bp, Homo sapiens
ttgaaagaatagaa

SEQ ID NO: 2427200 - DNA, 22 bp, Homo sapiens
ttgaaaggttttttttcagttg

SEQ ID NO: 2427201 - DNA, 21 bp, Homo sapiens
ttgaaataagaattcagacat

SEQ ID NO: 2427202 - DNA, 20 bp, Homo sapiens
ttgaaatgtaaggctgtgta

SEQ ID NO: 2427203 - DNA, 20 bp, Homo sapiens
ttgaaattaagaaggcaaaa

SEQ ID NO: 2427204 - DNA, 14 bp, Homo sapiens
ttgaacacaaactg

SEQ ID NO: 2427205 - DNA, 17 bp, Homo sapiens
ttgaacgttttctaatt

SEQ ID NO: 2427206 - DNA, 14 bp, Homo sapiens
ttgaagcacgtaca

SEQ ID NO: 2427207 - DNA, 14 bp, Homo sapiens
ttgaaggactaata

SEQ ID NO: 2427208 - DNA, 17 bp, Homo sapiens
ttgaagggccagagcca

SEQ ID NO: 2427209 - DNA, 23 bp, Homo sapiens
ttgaaggtgctgacggccaggga

SEQ ID NO: 2427210 - DNA, 15 bp, Homo sapiens
ttgaagtaaactttt

SEQ ID NO: 2427211 - DNA, 16 bp, Homo sapiens
ttgaagtagctctttt

SEQ ID NO: 2427212 - DNA, 13 bp, Homo sapiens
ttgaataaatgtc

SEQ ID NO: 2427213 - DNA, 14 bp, Homo sapiens
ttgaataaatgtca

SEQ ID NO: 2427214 - DNA, 17 bp, Homo sapiens
ttgaataaatgtcactt

SEQ ID NO: 2427215 - DNA, 15 bp, Homo sapiens
ttgaatactttgaat

SEQ ID NO: 2427216 - DNA, 13 bp, Homo sapiens
ttgaatacttttt

SEQ ID NO: 2427217 - DNA, 22 bp, Homo sapiens
ttgaatcaataatatattttct

SEQ ID NO: 2427218 - DNA, 22 bp, Homo sapiens
ttgaatgtggcttgagaaatat

SEQ ID NO: 2427219 - DNA, 20 bp, Homo sapiens
ttgaatgtgtttcacagttt

SEQ ID NO: 2427220 - DNA, 23 bp, Homo sapiens
ttgaattaatatccctacatgta

SEQ ID NO: 2427221 - DNA, 17 bp, Homo sapiens
ttgaatttcactgtctt

SEQ ID NO: 2427222 - DNA, 18 bp, Homo sapiens
ttgacaaaggcaagcact

SEQ ID NO: 2427223 - DNA, 19 bp, Homo sapiens
ttgacaattactcaggttt

SEQ ID NO: 2427224 - DNA, 23 bp, Homo sapiens
ttgacactgctctaacagccctc

SEQ ID NO: 2427225 - DNA, 15 bp, Homo sapiens
ttgacattctgaatg

SEQ ID NO: 2427226 - DNA, 16 bp, Homo sapiens
ttgacattctgaatgc

SEQ ID NO: 2427227 - DNA, 18 bp, Homo sapiens
ttgacattgcgtttgacc

SEQ ID NO: 2427228 - DNA, 17 bp, Homo sapiens
ttgaccccgatatattt

SEQ ID NO: 2427229 - DNA, 16 bp, Homo sapiens
ttgacccttgctgtga

SEQ ID NO: 2427230 - DNA, 19 bp, Homo sapiens
ttgacttttctgtaattca

SEQ ID NO: 2427231 - DNA, 17 bp, Homo sapiens
ttgagatagttttcatc

SEQ ID NO: 2427232 - DNA, 21 bp, Homo sapiens
ttgagatattaatgcccagac

SEQ ID NO: 2427233 - DNA, 19 bp, Homo sapiens
ttgagcagtggctggtcca

SEQ ID NO: 2427234 - DNA, 15 bp, Homo sapiens
ttgagcatcacagaa

SEQ ID NO: 2427235 - DNA, 15 bp, Homo sapiens
ttgagctctctgccc

SEQ ID NO: 2427236 - DNA, 23 bp, Homo sapiens
ttgaggaaaacaagcattcacaa

SEQ ID NO: 2427237 - DNA, 16 bp, Homo sapiens
ttgaggagccccagct

SEQ ID NO: 2427238 - DNA, 19 bp, Homo sapiens
ttgaggtgtcagagaaaat

SEQ ID NO: 2427239 - DNA, 15 bp, Homo sapiens
ttgagtgctctgatc

SEQ ID NO: 2427240 - DNA, 23 bp, Homo sapiens
ttgagtggggttatctctgtgtt

SEQ ID NO: 2427241 - DNA, 11 bp, Homo sapiens
ttgagtttgtc

SEQ ID NO: 2427242 - DNA, 18 bp, Homo sapiens
ttgagttttgactgcttg

SEQ ID NO: 2427243 - DNA, 16 bp, Homo sapiens
ttgataagatctttta

SEQ ID NO: 2427244 - DNA, 14 bp, Homo sapiens
ttgatactgttgca

SEQ ID NO: 2427245 - DNA, 16 bp, Homo sapiens
ttgatactgttgcacg

SEQ ID NO: 2427246 - DNA, 18 bp, Homo sapiens
ttgatactgttgcacgtg

SEQ ID NO: 2427247 - DNA, 20 bp, Homo sapiens
ttgatactgttgcacgtgtg

SEQ ID NO: 2427248 - DNA, 15 bp, Homo sapiens
ttgatccatttctaa

SEQ ID NO: 2427249 - DNA, 14 bp, Homo sapiens
ttgatctggaaccc

SEQ ID NO: 2427250 - DNA, 15 bp, Homo sapiens
ttgatctggaaccca

SEQ ID NO: 2427251 - DNA, 22 bp, Homo sapiens
ttgatgccaaaaaaaaatacat

SEQ ID NO: 2427252 - DNA, 17 bp, Homo sapiens
ttgatgggattctggac

SEQ ID NO: 2427253 - DNA, 15 bp, Homo sapiens
ttgatgtaaaatctt

SEQ ID NO: 2427254 - DNA, 17 bp, Homo sapiens
ttgattattcagtgtca

SEQ ID NO: 2427255 - DNA, 19 bp, Homo sapiens
ttgattcatagtaacttct

SEQ ID NO: 2427256 - DNA, 13 bp, Homo sapiens
ttgattgatttga

SEQ ID NO: 2427257 - DNA, 14 bp, Homo sapiens
ttgattgatttgaa

SEQ ID NO: 2427258 - DNA, 12 bp, Homo sapiens
ttgatttcaaca

SEQ ID NO: 2427259 - DNA, 13 bp, Homo sapiens
ttgatttgaagaa

SEQ ID NO: 2427260 - DNA, 18 bp, Homo sapiens
ttgatttgaagaacatgt

SEQ ID NO: 2427261 - DNA, 14 bp, Homo sapiens
ttgatttgcattga

SEQ ID NO: 2427262 - DNA, 15 bp, Homo sapiens
ttgatttgcattgaa

SEQ ID NO: 2427263 - DNA, 20 bp, Homo sapiens
ttgatttttctcttcatttt

SEQ ID NO: 2427264 - DNA, 19 bp, Homo sapiens
ttgcaaaaaatgtttttgg

SEQ ID NO: 2427265 - DNA, 20 bp, Homo sapiens
ttgcaaaaactacaaccaat

SEQ ID NO: 2427266 - DNA, 13 bp, Homo sapiens
ttgcaaagaaaga

SEQ ID NO: 2427267 - DNA, 19 bp, Homo sapiens
ttgcaaagaaagaaaaaaa

SEQ ID NO: 2427268 - DNA, 12 bp, Homo sapiens
ttgcaaatcttg

SEQ ID NO: 2427269 - DNA, 17 bp, Homo sapiens
ttgcaaatcttgaaatt

SEQ ID NO: 2427270 - DNA, 13 bp, Homo sapiens
ttgcaagggaaaa

SEQ ID NO: 2427271 - DNA, 15 bp, Homo sapiens
ttgcaatatctgaag

SEQ ID NO: 2427272 - DNA, 18 bp, Homo sapiens
ttgcaatcccttaatatc

SEQ ID NO: 2427273 - DNA, 14 bp, Homo sapiens
ttgcacactttggt

SEQ ID NO: 2427274 - DNA, 20 bp, Homo sapiens
ttgcacactttggtaccaga

SEQ ID NO: 2427275 - DNA, 19 bp, Homo sapiens
ttgcacagccaaatttaaa

SEQ ID NO: 2427276 - DNA, 16 bp, Homo sapiens
ttgcacatgtttcctc

SEQ ID NO: 2427277 - DNA, 15 bp, Homo sapiens
ttgcacgtggcctct

SEQ ID NO: 2427278 - DNA, 21 bp, Homo sapiens
ttgcacgtgtgtttttctatt

SEQ ID NO: 2427279 - DNA, 11 bp, Homo sapiens
ttgcagacagg

SEQ ID NO: 2427280 - DNA, 15 bp, Homo sapiens
ttgcagacaggaatc

SEQ ID NO: 2427281 - DNA, 18 bp, Homo sapiens
ttgcagacaggaatctta

SEQ ID NO: 2427282 - DNA, 18 bp, Homo sapiens
ttgcagccggcacagggt

SEQ ID NO: 2427283 - DNA, 20 bp, Homo sapiens
ttgcagccggcacagggtct

SEQ ID NO: 2427284 - DNA, 13 bp, Homo sapiens
ttgcagtaactgt

SEQ ID NO: 2427285 - DNA, 14 bp, Homo sapiens
ttgcagtcactcta

SEQ ID NO: 2427286 - DNA, 22 bp, Homo sapiens
ttgcagtcactctagtcaatga

SEQ ID NO: 2427287 - DNA, 21 bp, Homo sapiens
ttgcagttcccacattaaaga

SEQ ID NO: 2427288 - DNA, 22 bp, Homo sapiens
ttgcatcacttaacggaccaaa

SEQ ID NO: 2427289 - DNA, 13 bp, Homo sapiens
ttgcattaaattc

SEQ ID NO: 2427290 - DNA, 19 bp, Homo sapiens
ttcctggacactcagacct

SEQ ID NO: 2427291 - DNA, 15 bp, Homo sapiens
ttcctggacagctgt

SEQ ID NO: 2427292 - DNA, 21 bp, Homo sapiens
ttcctggacagctgtgcctcg

SEQ ID NO: 2427293 - DNA, 17 bp, Homo sapiens
ttcctgggtggctactc

SEQ ID NO: 2427294 - DNA, 20 bp, Homo sapiens
ttcctgtatttgttcccaag

SEQ ID NO: 2427295 - DNA, 19 bp, Homo sapiens
ttcctgtcctctttcagct

SEQ ID NO: 2427296 - DNA, 21 bp, Homo sapiens
ttcctgtcctctttcagctcc

SEQ ID NO: 2427297 - DNA, 24 bp, Homo sapiens
ttcctgtcctctttcagctcctga

SEQ ID NO: 2427298 - DNA, 22 bp, Homo sapiens
ttcctgtgtgtccaaaactgcc

SEQ ID NO: 2427299 - DNA, 17 bp, Homo sapiens
ttcctgttgtcaagaat

SEQ ID NO: 2427300 - DNA, 15 bp, Homo sapiens
ttcaaaatgttatct

SEQ ID NO: 2427301 - DNA, 13 bp, Homo sapiens
ttcaaactacttt

SEQ ID NO: 2427302 - DNA, 22 bp, Homo sapiens
ttcaaactactttgctgctaat

SEQ ID NO: 2427303 - DNA, 23 bp, Homo sapiens
ttcaaagccagcgtcctcctctg

SEQ ID NO: 2427304 - DNA, 16 bp, Homo sapiens
ttcaaaggttctaggt

SEQ ID NO: 2427305 - DNA, 14 bp, Homo sapiens
ttcaaagtttaata

SEQ ID NO: 2427306 - DNA, 18 bp, Homo sapiens
ttcaacaattctaaaatg

SEQ ID NO: 2427307 - DNA, 19 bp, Homo sapiens
ttcaacaattctaaaatga

SEQ ID NO: 2427308 - DNA, 17 bp, Homo sapiens
ttcaacaatttcaataa

SEQ ID NO: 2427309 - DNA, 17 bp, Homo sapiens
ttcaacacagcttgtct

SEQ ID NO: 2427310 - DNA, 20 bp, Homo sapiens
ttcaacacagcttgtctctt

SEQ ID NO: 2427311 - DNA, 17 bp, Homo sapiens
ttcaacatgagtgtatt

SEQ ID NO: 2427312 - DNA, 17 bp, Homo sapiens
ttcaacatgttatttgt

SEQ ID NO: 2427313 - DNA, 21 bp, Homo sapiens
ttcaagaggagcccccaccct

SEQ ID NO: 2427314 - DNA, 23 bp, Homo sapiens
ttcaagcagtcgtgcctgtgtcc

SEQ ID NO: 2427315 - DNA, 16 bp, Homo sapiens
ttcaagctctgaggga

SEQ ID NO: 2427316 - DNA, 16 bp, Homo sapiens
ttcaaggaatttctta

SEQ ID NO: 2427317 - DNA, 19 bp, Homo sapiens
ttcaaggaatttcttaact

SEQ ID NO: 2427318 - DNA, 14 bp, Homo sapiens
ttcaaggttctaac

SEQ ID NO: 2427319 - DNA, 19 bp, Homo sapiens
ttcaagtgtaaaatatttt

SEQ ID NO: 2427320 - DNA, 14 bp, Homo sapiens
ttcaatagccacta

SEQ ID NO: 2427321 - DNA, 19 bp, Homo sapiens
ttcaatataagcttttctt

SEQ ID NO: 2427322 - DNA, 17 bp, Homo sapiens
ttcaattgcatctccca

SEQ ID NO: 2427323 - DNA, 17 bp, Homo sapiens
ttcacaaacttttatac

SEQ ID NO: 2427324 - DNA, 13 bp, Homo sapiens
ttcacaatgttaa

SEQ ID NO: 2427325 - DNA, 13 bp, Homo sapiens
ttcacagctcctc

SEQ ID NO: 2427326 - DNA, 17 bp, Homo sapiens
ttcacagctcctcccac

SEQ ID NO: 2427327 - DNA, 13 bp, Homo sapiens
ttcacaggcagcc

SEQ ID NO: 2427328 - DNA, 16 bp, Homo sapiens
ttcacaggcagccagt

SEQ ID NO: 2427329 - DNA, 16 bp, Homo sapiens
ttcacagtttgaaata

SEQ ID NO: 2427330 - DNA, 17 bp, Homo sapiens
ttcacagtttgaaataa

SEQ ID NO: 2427331 - DNA, 22 bp, Homo sapiens
ttcacagtttgaaataagctat

SEQ ID NO: 2427332 - DNA, 15 bp, Homo sapiens
ttcacattagaagac

SEQ ID NO: 2427333 - DNA, 14 bp, Homo sapiens
ttcaccaaatcttg

SEQ ID NO: 2427334 - DNA, 14 bp, Homo sapiens
ttcaccccaccctt

SEQ ID NO: 2427335 - DNA, 16 bp, Homo sapiens
ttcaccccctttcctg

SEQ ID NO: 2427336 - DNA, 18 bp, Homo sapiens
ttcacctgccccaactct

SEQ ID NO: 2427337 - DNA, 14 bp, Homo sapiens
ttcactggagcaca

SEQ ID NO: 2427338 - DNA, 15 bp, Homo sapiens
ttcactggagcacaa

SEQ ID NO: 2427339 - DNA, 17 bp, Homo sapiens
ttcactggagcacaata

SEQ ID NO: 2427340 - DNA, 20 bp, Homo sapiens
ttcacttttgacaaaggcaa

SEQ ID NO: 2427341 - DNA, 12 bp, Homo sapiens
ttcagaagaaaa

SEQ ID NO: 2427342 - DNA, 14 bp, Homo sapiens
ttcagaagaaaaag

SEQ ID NO: 2427343 - DNA, 15 bp, Homo sapiens
ttcagaagttagttt

SEQ ID NO: 2427344 - DNA, 16 bp, Homo sapiens
ttcagaattaaacttt

SEQ ID NO: 2427345 - DNA, 13 bp, Homo sapiens
ttcagaatttagt

SEQ ID NO: 2427346 - DNA, 15 bp, Homo sapiens
ttcagaatttagtgt

SEQ ID NO: 2427347 - DNA, 23 bp, Homo sapiens
ttcagaattttatactttcccta

SEQ ID NO: 2427348 - DNA, 21 bp, Homo sapiens
ttcagactcccattcctgaag

SEQ ID NO: 2427349 - DNA, 18 bp, Homo sapiens
ttcagagagcagtgcttt

SEQ ID NO: 2427350 - DNA, 22 bp, Homo sapiens
ttcagaggctcagattgtaata

SEQ ID NO: 2427351 - DNA, 16 bp, Homo sapiens
ttcagatgtgaaccat

SEQ ID NO: 2427352 - DNA, 18 bp, Homo sapiens
ttcagatgtgaaccatta

SEQ ID NO: 2427353 - DNA, 17 bp, Homo sapiens
ttcagcactagccaaac

SEQ ID NO: 2427354 - DNA, 23 bp, Homo sapiens
ttcagcactagccaaacctcacc

SEQ ID NO: 2427355 - DNA, 15 bp, Homo sapiens
ttcagcactgtccct

SEQ ID NO: 2427356 - DNA, 23 bp, Homo sapiens
ttcagcatccgcaggtgctggtc

SEQ ID NO: 2427357 - DNA, 11 bp, Homo sapiens
ttcagccaagg

SEQ ID NO: 2427358 - DNA, 13 bp, Homo sapiens
ttcagctcctgac

SEQ ID NO: 2427359 - DNA, 23 bp, Homo sapiens
ttcagctgccagtgtcctgagcc

SEQ ID NO: 2427360 - DNA, 16 bp, Homo sapiens
ttcaggaaaaggcctg

SEQ ID NO: 2427361 - DNA, 19 bp, Homo sapiens
ttcaggaaaaggcctgggg

SEQ ID NO: 2427362 - DNA, 23 bp, Homo sapiens
ttcaggatctatttttggaggtt

SEQ ID NO: 2427363 - DNA, 20 bp, Homo sapiens
ttcagggaaggaggagcctg

SEQ ID NO: 2427364 - DNA, 16 bp, Homo sapiens
ttcaggtttttccttt

SEQ ID NO: 2427365 - DNA, 12 bp, Homo sapiens
ttcagtgttaaa

SEQ ID NO: 2427366 - DNA, 19 bp, Homo sapiens
ttcagttctaggaaaataa

SEQ ID NO: 2427367 - DNA, 15 bp, Homo sapiens
ttcagttgtctctga

SEQ ID NO: 2427368 - DNA, 15 bp, Homo sapiens
ttcataggtctgaaa

SEQ ID NO: 2427369 - DNA, 22 bp, Homo sapiens
ttcataggtctgaaatttttct

SEQ ID NO: 2427370 - DNA, 17 bp, Homo sapiens
ttcatagtaacttctta

SEQ ID NO: 2427371 - DNA, 14 bp, Homo sapiens
ttcatagttcagaa

SEQ ID NO: 2427372 - DNA, 17 bp, Homo sapiens
ttcatagttcagaattt

SEQ ID NO: 2427373 - DNA, 20 bp, Homo sapiens
ttcatagttcagaatttagt

SEQ ID NO: 2427374 - DNA, 14 bp, Homo sapiens
ttcatataaagtat

SEQ ID NO: 2427375 - DNA, 21 bp, Homo sapiens
ttcatattttaaacagaggat

SEQ ID NO: 2427376 - DNA, 14 bp, Homo sapiens
ttcatcatttttta

SEQ ID NO: 2427377 - DNA, 17 bp, Homo sapiens
ttcatccataactgaac

SEQ ID NO: 2427378 - DNA, 20 bp, Homo sapiens
ttcatcgaatctactaattc

SEQ ID NO: 2427379 - DNA, 23 bp, Homo sapiens
ttcatcgaatctactaattccac

SEQ ID NO: 2427380 - DNA, 20 bp, Homo sapiens
ttcatctaccattttctggt

SEQ ID NO: 2427381 - DNA, 16 bp, Homo sapiens
ttcatgacagcctcca

SEQ ID NO: 2427382 - DNA, 15 bp, Homo sapiens
ttcatgattagaaat

SEQ ID NO: 2427383 - DNA, 23 bp, Homo sapiens
ttcatgattagaaattacctgtg

SEQ ID NO: 2427384 - DNA, 15 bp, Homo sapiens
ttcatgcagctgtgg

SEQ ID NO: 2427385 - DNA, 22 bp, Homo sapiens
ttcatgccaccatggccagcca

SEQ ID NO: 2427386 - DNA, 22 bp, Homo sapiens
ttcatgccagctacttcctcct

SEQ ID NO: 2427387 - DNA, 23 bp, Homo sapiens
ttcatgcgatgacacttgtacaa

SEQ ID NO: 2427388 - DNA, 17 bp, Homo sapiens
ttcatgtaaactgtgca

SEQ ID NO: 2427389 - DNA, 13 bp, Homo sapiens
ttagtttttcatt

SEQ ID NO: 2427390 - DNA, 14 bp, Homo sapiens
ttataaaaaatggt

SEQ ID NO: 2427391 - DNA, 18 bp, Homo sapiens
ttataaaaaatggttcag

SEQ ID NO: 2427392 - DNA, 13 bp, Homo sapiens
ttataagactctc

SEQ ID NO: 2427393 - DNA, 14 bp, Homo sapiens
ttataagactctca

SEQ ID NO: 2427394 - DNA, 20 bp, Homo sapiens
ttataagactctcacactca

SEQ ID NO: 2427395 - DNA, 13 bp, Homo sapiens
ttataagcatcat

SEQ ID NO: 2427396 - DNA, 21 bp, Homo sapiens
ttataagcatcattatttatg

SEQ ID NO: 2427397 - DNA, 14 bp, Homo sapiens
ttataattctttca

SEQ ID NO: 2427398 - DNA, 16 bp, Homo sapiens
ttataattttcctaat

SEQ ID NO: 2427399 - DNA, 20 bp, Homo sapiens
ttatacactgtgtaaatacc

SEQ ID NO: 2427400 - DNA, 17 bp, Homo sapiens
ttatacgaaataattgt

SEQ ID NO: 2427401 - DNA, 16 bp, Homo sapiens
ttatactctttctgta

SEQ ID NO: 2427402 - DNA, 15 bp, Homo sapiens
ttatacttgtaatta

SEQ ID NO: 2427403 - DNA, 19 bp, Homo sapiens
ttatacttgtaattatgga

SEQ ID NO: 2427404 - DNA, 23 bp, Homo sapiens
ttatactttccctaccctctaga

SEQ ID NO: 2427405 - DNA, 15 bp, Homo sapiens
ttatagattctaaag

SEQ ID NO: 2427406 - DNA, 16 bp, Homo sapiens
ttatagattctaaaga

SEQ ID NO: 2427407 - DNA, 15 bp, Homo sapiens
ttatagtgaatactg

SEQ ID NO: 2427408 - DNA, 13 bp, Homo sapiens
ttatagttactgt

SEQ ID NO: 2427409 - DNA, 13 bp, Homo sapiens
ttatagtttctga

SEQ ID NO: 2427410 - DNA, 16 bp, Homo sapiens
ttatataactgtattt

SEQ ID NO: 2427411 - DNA, 16 bp, Homo sapiens
ttatataatcattatt

SEQ ID NO: 2427412 - DNA, 20 bp, Homo sapiens
ttatataatcattattactt

SEQ ID NO: 2427413 - DNA, 22 bp, Homo sapiens
ttatataattgccaaaaagtga

SEQ ID NO: 2427414 - DNA, 23 bp, Homo sapiens
ttatatataaatatattattact

SEQ ID NO: 2427415 - DNA, 13 bp, Homo sapiens
ttatatattatat

SEQ ID NO: 2427416 - DNA, 16 bp, Homo sapiens
ttatatatttaaaagt

SEQ ID NO: 2427417 - DNA, 15 bp, Homo sapiens
ttatatggaaatata

SEQ ID NO: 2427418 - DNA, 16 bp, Homo sapiens
ttatatgtacatgaga

SEQ ID NO: 2427419 - DNA, 19 bp, Homo sapiens
ttatatgtacatgagaagg

SEQ ID NO: 2427420 - DNA, 19 bp, Homo sapiens
ttatatgtaccctctgaaa

SEQ ID NO: 2427421 - DNA, 18 bp, Homo sapiens
ttatatgttgtaatattt

SEQ ID NO: 2427422 - DNA, 17 bp, Homo sapiens
ttatattaaccagatat

SEQ ID NO: 2427423 - DNA, 13 bp, Homo sapiens
ttatatttaactc

SEQ ID NO: 2427424 - DNA, 15 bp, Homo sapiens
ttatattttgcagtt

SEQ ID NO: 2427425 - DNA, 15 bp, Homo sapiens
ttatcaacaatagtg

SEQ ID NO: 2427426 - DNA, 18 bp, Homo sapiens
ttatcaccgtgggctccc

SEQ ID NO: 2427427 - DNA, 23 bp, Homo sapiens
ttatcacctagctgaatgttttt

SEQ ID NO: 2427428 - DNA, 16 bp, Homo sapiens
ttatcagtaaataact

SEQ ID NO: 2427429 - DNA, 21 bp, Homo sapiens
ttatcagtcataactaaataa

SEQ ID NO: 2427430 - DNA, 18 bp, Homo sapiens
ttatcattcaagtgtaaa

SEQ ID NO: 2427431 - DNA, 12 bp, Homo sapiens
ttatcattttca

SEQ ID NO: 2427432 - DNA, 17 bp, Homo sapiens
ttatccatattgagtca

SEQ ID NO: 2427433 - DNA, 15 bp, Homo sapiens
ttatccctcacctgt

SEQ ID NO: 2427434 - DNA, 14 bp, Homo sapiens
ttatcctccctgta

SEQ ID NO: 2427435 - DNA, 18 bp, Homo sapiens
ttatcgttttcttaaagt

SEQ ID NO: 2427436 - DNA, 15 bp, Homo sapiens
ttatctataatttac

SEQ ID NO: 2427437 - DNA, 18 bp, Homo sapiens
ttatctgaatttttaaac

SEQ ID NO: 2427438 - DNA, 14 bp, Homo sapiens
ttatctgatcagaa

SEQ ID NO: 2427439 - DNA, 19 bp, Homo sapiens
ttatgaaattcaccccctt

SEQ ID NO: 2427440 - DNA, 22 bp, Homo sapiens
ttatgaagaaggtgaatagcca

SEQ ID NO: 2427441 - DNA, 18 bp, Homo sapiens
ttatgaatgtgaagcctt

SEQ ID NO: 2427442 - DNA, 22 bp, Homo sapiens
ttatgagaaacttaaatgttat

SEQ ID NO: 2427443 - DNA, 16 bp, Homo sapiens
ttatgataatagattc

SEQ ID NO: 2427444 - DNA, 15 bp, Homo sapiens
ttatgcaaaagcaag

SEQ ID NO: 2427445 - DNA, 17 bp, Homo sapiens
ttatgcaaaagcaagct

SEQ ID NO: 2427446 - DNA, 19 bp, Homo sapiens
ttatggaattgatttgcat

SEQ ID NO: 2427447 - DNA, 18 bp, Homo sapiens
ttatggagtcatttttac

SEQ ID NO: 2427448 - DNA, 23 bp, Homo sapiens
ttatgggaaccccttcatcctct

SEQ ID NO: 2427449 - DNA, 13 bp, Homo sapiens
ttatgggtcacag

SEQ ID NO: 2427450 - DNA, 23 bp, Homo sapiens
ttatggtaactgctttctgttcc

SEQ ID NO: 2427451 - DNA, 13 bp, Homo sapiens
ttatgtaatttca

SEQ ID NO: 2427452 - DNA, 19 bp, Homo sapiens
ttatgtggttttagatttt

SEQ ID NO: 2427453 - DNA, 17 bp, Homo sapiens
ttatgttatatataaat

SEQ ID NO: 2427454 - DNA, 22 bp, Homo sapiens
ttatgttttcgaaaatcaaatg

SEQ ID NO: 2427455 - DNA, 14 bp, Homo sapiens
ttattaaacccctt

SEQ ID NO: 2427456 - DNA, 21 bp, Homo sapiens
ttattaaagaaaaaaatgtat

SEQ ID NO: 2427457 - DNA, 19 bp, Homo sapiens
ttattaacaattaggcaga

SEQ ID NO: 2427458 - DNA, 18 bp, Homo sapiens
ttattaacataggtgaaa

SEQ ID NO: 2427459 - DNA, 13 bp, Homo sapiens
ttattaatgcact

SEQ ID NO: 2427460 - DNA, 17 bp, Homo sapiens
ttattaatgcactttct

SEQ ID NO: 2427461 - DNA, 20 bp, Homo sapiens
ttattacttgtaaatataaa

SEQ ID NO: 2427462 - DNA, 18 bp, Homo sapiens
ttattagaatcaaacatt

SEQ ID NO: 2427463 - DNA, 20 bp, Homo sapiens
ttattagaatcaaacatttt

SEQ ID NO: 2427464 - DNA, 21 bp, Homo sapiens
ttattagagattacctcctga

SEQ ID NO: 2427465 - DNA, 19 bp, Homo sapiens
ttattagtattgttgtcct

SEQ ID NO: 2427466 - DNA, 13 bp, Homo sapiens
ttattatgaagaa

SEQ ID NO: 2427467 - DNA, 14 bp, Homo sapiens
ttattcagtgtcac

SEQ ID NO: 2427468 - DNA, 13 bp, Homo sapiens
ttattccatgact

SEQ ID NO: 2427469 - DNA, 12 bp, Homo sapiens
ttattcttggtt

SEQ ID NO: 2427470 - DNA, 16 bp, Homo sapiens
ttattgcagtttatca

SEQ ID NO: 2427471 - DNA, 21 bp, Homo sapiens
ttattgcagtttatcattcaa

SEQ ID NO: 2427472 - DNA, 22 bp, Homo sapiens
ttattgcagtttatcattcaag

SEQ ID NO: 2427473 - DNA, 15 bp, Homo sapiens
ttattggttttgcag

SEQ ID NO: 2427474 - DNA, 12 bp, Homo sapiens
ttattgtacttg

SEQ ID NO: 2427475 - DNA, 17 bp, Homo sapiens
ttatttaaaaaactaaa

SEQ ID NO: 2427476 - DNA, 15 bp, Homo sapiens
ttatttaaaatagca

SEQ ID NO: 2427477 - DNA, 22 bp, Homo sapiens
tgtgtctttcacagctcctccc

SEQ ID NO: 2427478 - DNA, 17 bp, Homo sapiens
tgtgtgaaactttcatt

SEQ ID NO: 2427479 - DNA, 16 bp, Homo sapiens
tgtgtgaatgaacact

SEQ ID NO: 2427480 - DNA, 17 bp, Homo sapiens
tgtgtgaatgaacactc

SEQ ID NO: 2427481 - DNA, 20 bp, Homo sapiens
tgtgtgccctctgggctctg

SEQ ID NO: 2427482 - DNA, 21 bp, Homo sapiens
tgtgtgcgtgtttgggttttt

SEQ ID NO: 2427483 - DNA, 21 bp, Homo sapiens
tgtgtggagagggaatgtgaa

SEQ ID NO: 2427484 - DNA, 16 bp, Homo sapiens
tgtgtgtccaaaactg

SEQ ID NO: 2427485 - DNA, 20 bp, Homo sapiens
tgtgtgtgaatgaacactct

SEQ ID NO: 2427486 - DNA, 15 bp, Homo sapiens
tgtgtgttgatactg

SEQ ID NO: 2427487 - DNA, 19 bp, Homo sapiens
tgtgtgttgatactgttgc

SEQ ID NO: 2427488 - DNA, 20 bp, Homo sapiens
tgtgtgttgatactgttgca

SEQ ID NO: 2427489 - DNA, 21 bp, Homo sapiens
tgtgtgttgatactgttgcac

SEQ ID NO: 2427490 - DNA, 13 bp, Homo sapiens
tgtgtgtttggaa

SEQ ID NO: 2427491 - DNA, 19 bp, Homo sapiens
tgtgttaagctctgctatt

SEQ ID NO: 2427492 - DNA, 21 bp, Homo sapiens
tgtgttaagctctgctattag

SEQ ID NO: 2427493 - DNA, 23 bp, Homo sapiens
tgtgttacctgaaaacactgtgc

SEQ ID NO: 2427494 - DNA, 19 bp, Homo sapiens
tgtgttgatactgttgcac

SEQ ID NO: 2427495 - DNA, 21 bp, Homo sapiens
tgtgttgatactgttgcacgt

SEQ ID NO: 2427496 - DNA, 19 bp, Homo sapiens
tgtgttgtctcttgagttt

SEQ ID NO: 2427497 - DNA, 14 bp, Homo sapiens
tgtgtttgctttct

SEQ ID NO: 2427498 - DNA, 15 bp, Homo sapiens
tgtgtttggctttca

SEQ ID NO: 2427499 - DNA, 15 bp, Homo sapiens
tgtgtttgtgtattt

SEQ ID NO: 2427500 - DNA, 15 bp, Homo sapiens
tgtttatcctttcat

SEQ ID NO: 2427501 - DNA, 13 bp, Homo sapiens
tgtttatggtaaa

SEQ ID NO: 2427502 - DNA, 15 bp, Homo sapiens
tgtttattaatctta

SEQ ID NO: 2427503 - DNA, 17 bp, Homo sapiens
tgtttattaatcttagt

SEQ ID NO: 2427504 - DNA, 17 bp, Homo sapiens
tgtttattcttctagag

SEQ ID NO: 2427505 - DNA, 13 bp, Homo sapiens
tgtttatttcagg

SEQ ID NO: 2427506 - DNA, 19 bp, Homo sapiens
tgtttcaagaggagccccc

SEQ ID NO: 2427507 - DNA, 15 bp, Homo sapiens
tgtttcaaggcactc

SEQ ID NO: 2427508 - DNA, 13 bp, Homo sapiens
tgtttccagcatt

SEQ ID NO: 2427509 - DNA, 20 bp, Homo sapiens
tgtttccagcattcccaggt

SEQ ID NO: 2427510 - DNA, 17 bp, Homo sapiens
tgtttctggatttcata

SEQ ID NO: 2427511 - DNA, 15 bp, Homo sapiens
tgtttctgttccaaa

SEQ ID NO: 2427512 - DNA, 16 bp, Homo sapiens
tgtttctgttccaaat

SEQ ID NO: 2427513 - DNA, 20 bp, Homo sapiens
tgtttctttctctgaggaca

SEQ ID NO: 2427514 - DNA, 11 bp, Homo sapiens
tgtttgatttc

SEQ ID NO: 2427515 - DNA, 13 bp, Homo sapiens
tgtttgatttcaa

SEQ ID NO: 2427516 - DNA, 21 bp, Homo sapiens
tgtttgcttcatgtgtcccag

SEQ ID NO: 2427517 - DNA, 12 bp, Homo sapiens
tgtttgctttct

SEQ ID NO: 2427518 - DNA, 22 bp, Homo sapiens
tgtttgctttctgatcaaggcc

SEQ ID NO: 2427519 - DNA, 11 bp, Homo sapiens
tgtttggctgg

SEQ ID NO: 2427520 - DNA, 13 bp, Homo sapiens
tgtttgtgctgtg

SEQ ID NO: 2427521 - DNA, 12 bp, Homo sapiens
tgtttgtgtatt

SEQ ID NO: 2427522 - DNA, 22 bp, Homo sapiens
tgttttaatttaaacacctcct

SEQ ID NO: 2427523 - DNA, 20 bp, Homo sapiens
tgttttacaagttggagtca

SEQ ID NO: 2427524 - DNA, 15 bp, Homo sapiens
tgttttatgagaaag

SEQ ID NO: 2427525 - DNA, 21 bp, Homo sapiens
tgttttctctggagtattcta

SEQ ID NO: 2427526 - DNA, 19 bp, Homo sapiens
tgttttgttgacattctga

SEQ ID NO: 2427527 - DNA, 15 bp, Homo sapiens
tgttttgtttttaca

SEQ ID NO: 2427528 - DNA, 16 bp, Homo sapiens
tgtttttaaactgtac

SEQ ID NO: 2427529 - DNA, 13 bp, Homo sapiens
tgtttttctatta

SEQ ID NO: 2427530 - DNA, 14 bp, Homo sapiens
tgtttttctattaa

SEQ ID NO: 2427531 - DNA, 21 bp, Homo sapiens
tgtttttctattaaaagactc

SEQ ID NO: 2427532 - DNA, 22 bp, Homo sapiens
tgtttttctattaaaagactca

SEQ ID NO: 2427533 - DNA, 10 bp, Homo sapiens
tgtttttggg

SEQ ID NO: 2427534 - DNA, 19 bp, Homo sapiens
tgttttttgccacagcttt

SEQ ID NO: 2427535 - DNA, 23 bp, Homo sapiens
tgttttttgccacagcttttgca

SEQ ID NO: 2427536 - DNA, 18 bp, Homo sapiens
ttaaaaaaaaagatctgt

SEQ ID NO: 2427537 - DNA, 17 bp, Homo sapiens
ttaaaaaagataaacac

SEQ ID NO: 2427538 - DNA, 18 bp, Homo sapiens
ttaaaaaagataaacaca

SEQ ID NO: 2427539 - DNA, 21 bp, Homo sapiens
ttaaaaaagataaacacaaga

SEQ ID NO: 2427540 - DNA, 21 bp, Homo sapiens
ttaaaaaagcttaaaactttg

SEQ ID NO: 2427541 - DNA, 15 bp, Homo sapiens
ttaaaacttgtaatt

SEQ ID NO: 2427542 - DNA, 13 bp, Homo sapiens
ttaaaagactcat

SEQ ID NO: 2427543 - DNA, 20 bp, Homo sapiens
ttaaaagatgcttttaacag

SEQ ID NO: 2427544 - DNA, 13 bp, Homo sapiens
ttaaaagcctgct

SEQ ID NO: 2427545 - DNA, 11 bp, Homo sapiens
ttaaaatacaa

SEQ ID NO: 2427546 - DNA, 21 bp, Homo sapiens
ttaaaatagcaaaagaagaag

SEQ ID NO: 2427547 - DNA, 23 bp, Homo sapiens
ttaaaatagcaaaagaagaagtt

SEQ ID NO: 2427548 - DNA, 16 bp, Homo sapiens
ttaaaatgtaaagcca

SEQ ID NO: 2427549 - DNA, 17 bp, Homo sapiens
ttaaaatgtaagattat

SEQ ID NO: 2427550 - DNA, 22 bp, Homo sapiens
ttaaaattgatttttctcttca

SEQ ID NO: 2427551 - DNA, 19 bp, Homo sapiens
ttaaacattaatagcagcc

SEQ ID NO: 2427552 - DNA, 15 bp, Homo sapiens
ttaaaccatctccct

SEQ ID NO: 2427553 - DNA, 23 bp, Homo sapiens
ttaaaccatctccctggtgctta

SEQ ID NO: 2427554 - DNA, 12 bp, Homo sapiens
ttaaactgtaca

SEQ ID NO: 2427555 - DNA, 19 bp, Homo sapiens
ttaaagaaaaaaatgtatt

SEQ ID NO: 2427556 - DNA, 21 bp, Homo sapiens
ttaaagaaaaaaatgtatttt

SEQ ID NO: 2427557 - DNA, 17 bp, Homo sapiens
ttaaagaaaaaaattga

SEQ ID NO: 2427558 - DNA, 22 bp, Homo sapiens
ttaaagaaaaaaattgaaatgt

SEQ ID NO: 2427559 - DNA, 18 bp, Homo sapiens
ttaaagaatatgaaacat

SEQ ID NO: 2427560 - DNA, 15 bp, Homo sapiens
ttaaagagtctagat

SEQ ID NO: 2427561 - DNA, 19 bp, Homo sapiens
ttaaagagtctagattcaa

SEQ ID NO: 2427562 - DNA, 23 bp, Homo sapiens
ttaaaggggagacctcagaagta

SEQ ID NO: 2427563 - DNA, 19 bp, Homo sapiens
ttaaagtgctaaggttcta

SEQ ID NO: 2427564 - DNA, 22 bp, Homo sapiens
ttaaagtgctaaggttctaagg

SEQ ID NO: 2427565 - DNA, 20 bp, Homo sapiens
ttaaagttagtatcttttga

SEQ ID NO: 2427566 - DNA, 13 bp, Homo sapiens
ttaaataagattc

SEQ ID NO: 2427567 - DNA, 10 bp, Homo sapiens
ttaaatacag

SEQ ID NO: 2427568 - DNA, 15 bp, Homo sapiens
ttaaatacaggaaac

SEQ ID NO: 2427569 - DNA, 20 bp, Homo sapiens
ttaaatgaacaagagaagca

SEQ ID NO: 2427570 - DNA, 22 bp, Homo sapiens
ttaaatgacactcatataatta

SEQ ID NO: 2427571 - DNA, 19 bp, Homo sapiens
ttaaattcccgttttgtca

SEQ ID NO: 2427572 - DNA, 23 bp, Homo sapiens
ttaaattctctctcttgcaggaa

SEQ ID NO: 2427573 - DNA, 16 bp, Homo sapiens
ttaaattggaaagcag

SEQ ID NO: 2427574 - DNA, 18 bp, Homo sapiens
ttaaattttttgttgaca

SEQ ID NO: 2427575 - DNA, 21 bp, Homo sapiens
ttaacagaaactttcaaaagg

SEQ ID NO: 2427576 - DNA, 19 bp, Homo sapiens
ttaacagaaattgtatatt

SEQ ID NO: 2427577 - DNA, 21 bp, Homo sapiens
ttaacagaaattgtatattgt

SEQ ID NO: 2427578 - DNA, 19 bp, Homo sapiens
ttaacagagtctgaaccta

SEQ ID NO: 2427579 - DNA, 16 bp, Homo sapiens
ttaacataagctattt

SEQ ID NO: 2427580 - DNA, 13 bp, Homo sapiens
ttaacattccaag

SEQ ID NO: 2427581 - DNA, 19 bp, Homo sapiens
ttaacattccaagactcta

SEQ ID NO: 2427582 - DNA, 22 bp, Homo sapiens
ttaactcccattaccatgtaat

SEQ ID NO: 2427583 - DNA, 14 bp, Homo sapiens
tgtcagcatgaatt

SEQ ID NO: 2427584 - DNA, 23 bp, Homo sapiens
tgtcagctgcaaggtactctggt

SEQ ID NO: 2427585 - DNA, 13 bp, Homo sapiens
tgtcaggattgcg

SEQ ID NO: 2427586 - DNA, 23 bp, Homo sapiens
tgtcaggattgcgagagatgtgt

SEQ ID NO: 2427587 - DNA, 23 bp, Homo sapiens
tgtcagggagtgttccctatcca

SEQ ID NO: 2427588 - DNA, 16 bp, Homo sapiens
tgtcagtatttttgcc

SEQ ID NO: 2427589 - DNA, 17 bp, Homo sapiens
tgtcagtatttttgccg

SEQ ID NO: 2427590 - DNA, 12 bp, Homo sapiens
tgtcatacagag

SEQ ID NO: 2427591 - DNA, 21 bp, Homo sapiens
tgtcatcatcatggccagctg

SEQ ID NO: 2427592 - DNA, 22 bp, Homo sapiens
tgtcatcctcaaagaaagtgta

SEQ ID NO: 2427593 - DNA, 15 bp, Homo sapiens
tgtcatgctgcctta

SEQ ID NO: 2427594 - DNA, 11 bp, Homo sapiens
tgtcatgtgta

SEQ ID NO: 2427595 - DNA, 16 bp, Homo sapiens
tgtcatttcagaagtt

SEQ ID NO: 2427596 - DNA, 15 bp, Homo sapiens
tgtcattttttttct

SEQ ID NO: 2427597 - DNA, 16 bp, Homo sapiens
tgtccaaaactgcctc

SEQ ID NO: 2427598 - DNA, 19 bp, Homo sapiens
tgtccaaagaggctgcccc

SEQ ID NO: 2427599 - DNA, 20 bp, Homo sapiens
tgtccaaagaggctgcccct

SEQ ID NO: 2427600 - DNA, 17 bp, Homo sapiens
tgtccacataggtttag

SEQ ID NO: 2427601 - DNA, 12 bp, Homo sapiens
tgtccaccccca

SEQ ID NO: 2427602 - DNA, 17 bp, Homo sapiens
tgtccacgactgtctcc

SEQ ID NO: 2427603 - DNA, 19 bp, Homo sapiens
tgtccacgactgtctccat

SEQ ID NO: 2427604 - DNA, 11 bp, Homo sapiens
tgtccagctcc

SEQ ID NO: 2427605 - DNA, 12 bp, Homo sapiens
tgtccagctcca

SEQ ID NO: 2427606 - DNA, 23 bp, Homo sapiens
tgtccagctccaacctgcaaaga

SEQ ID NO: 2427607 - DNA, 17 bp, Homo sapiens
tgtccagctgagcgcca

SEQ ID NO: 2427608 - DNA, 18 bp, Homo sapiens
tgtccatgcgctcagggc

SEQ ID NO: 2427609 - DNA, 22 bp, Homo sapiens
tgtccatgcgctcagggccatg

SEQ ID NO: 2427610 - DNA, 17 bp, Homo sapiens
tgtcccatgatccctgt

SEQ ID NO: 2427611 - DNA, 20 bp, Homo sapiens
tgtccccaacagcgcccaaa

SEQ ID NO: 2427612 - DNA, 13 bp, Homo sapiens
tccctcacctgta

SEQ ID NO: 2427613 - DNA, 15 bp, Homo sapiens
tccctcaccttctga

SEQ ID NO: 2427614 - DNA, 20 bp, Homo sapiens
tccctcaccttggcaccaga

SEQ ID NO: 2427615 - DNA, 18 bp, Homo sapiens
tccctcactcgtctcccc

SEQ ID NO: 2427616 - DNA, 19 bp, Homo sapiens
tccctcactcgtctccccc

SEQ ID NO: 2427617 - DNA, 21 bp, Homo sapiens
tccctcactcgtctcccccaa

SEQ ID NO: 2427618 - DNA, 22 bp, Homo sapiens
tccctcactcgtctcccccaac

SEQ ID NO: 2427619 - DNA, 16 bp, Homo sapiens
tccctcatctgtccct

SEQ ID NO: 2427620 - DNA, 14 bp, Homo sapiens
tccctcccccccat

SEQ ID NO: 2427621 - DNA, 16 bp, Homo sapiens
tccctcccctgccatt

SEQ ID NO: 2427622 - DNA, 14 bp, Homo sapiens
tccctccgccccca

SEQ ID NO: 2427623 - DNA, 17 bp, Homo sapiens
tccctctcaacacccag

SEQ ID NO: 2427624 - DNA, 22 bp, Homo sapiens
tccctctcatttagcctgtcct

SEQ ID NO: 2427625 - DNA, 12 bp, Homo sapiens
tccctctcccag

SEQ ID NO: 2427626 - DNA, 17 bp, Homo sapiens
tccctctcccaggcccc

SEQ ID NO: 2427627 - DNA, 21 bp, Homo sapiens
tccctctcccaggccccatga

SEQ ID NO: 2427628 - DNA, 12 bp, Homo sapiens
tccctctccctg

SEQ ID NO: 2427629 - DNA, 14 bp, Homo sapiens
tccctctcgtaaga

SEQ ID NO: 2427630 - DNA, 11 bp, Homo sapiens
tccctctggga

SEQ ID NO: 2427631 - DNA, 14 bp, Homo sapiens
tccctgactcattc

SEQ ID NO: 2427632 - DNA, 15 bp, Homo sapiens
tccctgaggactgat

SEQ ID NO: 2427633 - DNA, 20 bp, Homo sapiens
tccctgaggactgatttcag

SEQ ID NO: 2427634 - DNA, 21 bp, Homo sapiens
tccctgaggactgatttcaga

SEQ ID NO: 2427635 - DNA, 21 bp, Homo sapiens
agccaagggaacctgtgtccg

SEQ ID NO: 2427636 - DNA, 14 bp, Homo sapiens
agccaagggatgga

SEQ ID NO: 2427637 - DNA, 20 bp, Homo sapiens
agccaagggatggacatctt

SEQ ID NO: 2427638 - DNA, 16 bp, Homo sapiens
agccaaggggcttcag

SEQ ID NO: 2427639 - DNA, 18 bp, Homo sapiens
agccaattcagacaggca

SEQ ID NO: 2427640 - DNA, 13 bp, Homo sapiens
agccacaccagga

SEQ ID NO: 2427641 - DNA, 18 bp, Homo sapiens
agccacacttctcaggac

SEQ ID NO: 2427642 - DNA, 23 bp, Homo sapiens
agccacacttctcaggacacagg

SEQ ID NO: 2427643 - DNA, 20 bp, Homo sapiens
agccacatttggaatacttt

SEQ ID NO: 2427644 - DNA, 17 bp, Homo sapiens
agccaccacgtccagct

SEQ ID NO: 2427645 - DNA, 20 bp, Homo sapiens
agccaccctgaggagtctga

SEQ ID NO: 2427646 - DNA, 22 bp, Homo sapiens
agccaccctgaggagtctgagg

SEQ ID NO: 2427647 - DNA, 21 bp, Homo sapiens
agccaccgaagccgcctgtgg

SEQ ID NO: 2427648 - DNA, 15 bp, Homo sapiens
agccacttgcctgtg

SEQ ID NO: 2427649 - DNA, 13 bp, Homo sapiens
agccagcacacag

SEQ ID NO: 2427650 - DNA, 16 bp, Homo sapiens
agccagcaccggacca

SEQ ID NO: 2427651 - DNA, 14 bp, Homo sapiens
agccagcacctggc

SEQ ID NO: 2427652 - DNA, 15 bp, Homo sapiens
agccagccctgcctg

SEQ ID NO: 2427653 - DNA, 21 bp, Homo sapiens
agccagccctgcctggaggac

SEQ ID NO: 2427654 - DNA, 24 bp, Homo sapiens
agccagccctgcctggaggacctg

SEQ ID NO: 2427655 - DNA, 19 bp, Homo sapiens
agccagccgagcaggaggc

SEQ ID NO: 2427656 - DNA, 16 bp, Homo sapiens
agccagccggggcgag

SEQ ID NO: 2427657 - DNA, 21 bp, Homo sapiens
agccagcgtcctcctctgtga

SEQ ID NO: 2427658 - DNA, 17 bp, Homo sapiens
agccaggaatttcccag

SEQ ID NO: 2427659 - DNA, 20 bp, Homo sapiens
agccaggaatttcccaggac

SEQ ID NO: 2427660 - DNA, 21 bp, Homo sapiens
agccaggaatttcccaggacc

SEQ ID NO: 2427661 - DNA, 15 bp, Homo sapiens
agccaggagaagctc

SEQ ID NO: 2427662 - DNA, 16 bp, Homo sapiens
agccagggagagccca

SEQ ID NO: 2427663 - DNA, 21 bp, Homo sapiens
agccagggagagcccaggagc

SEQ ID NO: 2427664 - DNA, 22 bp, Homo sapiens
agccagggagagcccaggagct

SEQ ID NO: 2427665 - DNA, 23 bp, Homo sapiens
agccaggggagcagaggggcaga

SEQ ID NO: 2427666 - DNA, 19 bp, Homo sapiens
agccagggggagctgggcc

SEQ ID NO: 2427667 - DNA, 21 bp, Homo sapiens
agccagggggagctgggcctg

SEQ ID NO: 2427668 - DNA, 15 bp, Homo sapiens
agccagggtctccag

SEQ ID NO: 2427669 - DNA, 16 bp, Homo sapiens
agccagggtctccaga

SEQ ID NO: 2427670 - DNA, 18 bp, Homo sapiens
agccaggttccacagagg

SEQ ID NO: 2427671 - DNA, 16 bp, Homo sapiens
agccagtgccctgagc

SEQ ID NO: 2427672 - DNA, 22 bp, Homo sapiens
agccagtttgggtaaaatactt

SEQ ID NO: 2427673 - DNA, 15 bp, Homo sapiens
agccatcacctcaga

SEQ ID NO: 2427674 - DNA, 18 bp, Homo sapiens
agccatcacctcagatgg

SEQ ID NO: 2427675 - DNA, 21 bp, Homo sapiens
agccatcacctcagatggcag

SEQ ID NO: 2427676 - DNA, 22 bp, Homo sapiens
agccatcacctcagatggcagc

SEQ ID NO: 2427677 - DNA, 16 bp, Homo sapiens
agccatgcgccccctc

SEQ ID NO: 2427678 - DNA, 18 bp, Homo sapiens
agccatgctggaaaataa

SEQ ID NO: 2427679 - DNA, 18 bp, Homo sapiens
tattgtttcaattgcatc

SEQ ID NO: 2427680 - DNA, 21 bp, Homo sapiens
tatttaaaaaactaaaaacta

SEQ ID NO: 2427681 - DNA, 12 bp, Homo sapiens
tatttaaaactt

SEQ ID NO: 2427682 - DNA, 14 bp, Homo sapiens
tatttaaaatagca

SEQ ID NO: 2427683 - DNA, 23 bp, Homo sapiens
tatttaaaatagcaaaagaagaa

SEQ ID NO: 2427684 - DNA, 19 bp, Homo sapiens
tatttaaaccgctaaaaga

SEQ ID NO: 2427685 - DNA, 12 bp, Homo sapiens
tatttaacagaa

SEQ ID NO: 2427686 - DNA, 13 bp, Homo sapiens
tatttaacagaaa

SEQ ID NO: 2427687 - DNA, 16 bp, Homo sapiens
tatttaacagaaattg

SEQ ID NO: 2427688 - DNA, 13 bp, Homo sapiens
tatttaactaatt

SEQ ID NO: 2427689 - DNA, 17 bp, Homo sapiens
tatttaagataattata

SEQ ID NO: 2427690 - DNA, 20 bp, Homo sapiens
tatttaatagcaaagaattg

SEQ ID NO: 2427691 - DNA, 21 bp, Homo sapiens
tatttaatgccgatatactct

SEQ ID NO: 2427692 - DNA, 17 bp, Homo sapiens
tatttacccctccccta

SEQ ID NO: 2427693 - DNA, 15 bp, Homo sapiens
tatttacctcagcct

SEQ ID NO: 2427694 - DNA, 17 bp, Homo sapiens
tatttacctcagcctgg

SEQ ID NO: 2427695 - DNA, 19 bp, Homo sapiens
tatttacgctttgattcat

SEQ ID NO: 2427696 - DNA, 20 bp, Homo sapiens
tatttatgtattgtgcaatg

SEQ ID NO: 2427697 - DNA, 14 bp, Homo sapiens
tatttattggtttt

SEQ ID NO: 2427698 - DNA, 13 bp, Homo sapiens
tatttattgtatt

SEQ ID NO: 2427699 - DNA, 14 bp, Homo sapiens
tatttcactggagc

SEQ ID NO: 2427700 - DNA, 21 bp, Homo sapiens
tatttcatgtttttgatcaaa

SEQ ID NO: 2427701 - DNA, 14 bp, Homo sapiens
tatttctgcctccc

SEQ ID NO: 2427702 - DNA, 13 bp, Homo sapiens
tatttcttaaaca

SEQ ID NO: 2427703 - DNA, 16 bp, Homo sapiens
tatttcttaaacactt

SEQ ID NO: 2427704 - DNA, 21 bp, Homo sapiens
tatttgcataacaattcctct

SEQ ID NO: 2427705 - DNA, 14 bp, Homo sapiens
tatttgctaatttt

SEQ ID NO: 2427706 - DNA, 11 bp, Homo sapiens
tatttgctttt

SEQ ID NO: 2427707 - DNA, 23 bp, Homo sapiens
tatttgggcctgctccagacctg

SEQ ID NO: 2427708 - DNA, 23 bp, Homo sapiens
tatttgtaaaatgacaatcatgt

SEQ ID NO: 2427709 - DNA, 12 bp, Homo sapiens
tatttgtaatta

SEQ ID NO: 2427710 - DNA, 15 bp, Homo sapiens
tatttgtaattaaaa

SEQ ID NO: 2427711 - DNA, 21 bp, Homo sapiens
tatttgtgttttaatttaaac

SEQ ID NO: 2427712 - DNA, 17 bp, Homo sapiens
tatttgttcccaagagc

SEQ ID NO: 2427713 - DNA, 23 bp, Homo sapiens
tattttaaaatagcgttcttgta

SEQ ID NO: 2427714 - DNA, 18 bp, Homo sapiens
tattttaaaatctgtcac

SEQ ID NO: 2427715 - DNA, 14 bp, Homo sapiens
tattttaaagaatt

SEQ ID NO: 2427716 - DNA, 17 bp, Homo sapiens
tattttcaaaaccaggt

SEQ ID NO: 2427717 - DNA, 18 bp, Homo sapiens
tattttcaatagccacta

SEQ ID NO: 2427718 - DNA, 13 bp, Homo sapiens
tattttccaggct

SEQ ID NO: 2427719 - DNA, 13 bp, Homo sapiens
tattttcttggat

SEQ ID NO: 2427720 - DNA, 15 bp, Homo sapiens
tattttgaatcaata

SEQ ID NO: 2427721 - DNA, 23 bp, Homo sapiens
tattttgaatcaataatatattt

SEQ ID NO: 2427722 - DNA, 17 bp, Homo sapiens
tattttgacataaagtt

SEQ ID NO: 2427723 - DNA, 21 bp, Homo sapiens
tattttgcagttcccacatta

SEQ ID NO: 2427724 - DNA, 23 bp, Homo sapiens
tattttgccaagggcataaatta

SEQ ID NO: 2427725 - DNA, 23 bp, Homo sapiens
tattttggattgtatattgtgtt

SEQ ID NO: 2427726 - DNA, 16 bp, Homo sapiens
tatttttctaactaca

SEQ ID NO: 2427727 - DNA, 12 bp, Homo sapiens
tatttttggagg

SEQ ID NO: 2427728 - DNA, 17 bp, Homo sapiens
tcaaaaactttggagtc

SEQ ID NO: 2427729 - DNA, 15 bp, Homo sapiens
tcaaaaccttttgaa

SEQ ID NO: 2427730 - DNA, 22 bp, Homo sapiens
tcaaaagctatttaaagcatct

SEQ ID NO: 2427731 - DNA, 14 bp, Homo sapiens
tcaaaagttccaag

SEQ ID NO: 2427732 - DNA, 15 bp, Homo sapiens
tcaaaagttccaaga

SEQ ID NO: 2427733 - DNA, 22 bp, Homo sapiens
tcaaaatagggactatctatct

SEQ ID NO: 2427734 - DNA, 22 bp, Homo sapiens
tcaaaatctctccactttcagc

SEQ ID NO: 2427735 - DNA, 22 bp, Homo sapiens
tcaaaatgttatcttctcaagt

SEQ ID NO: 2427736 - DNA, 21 bp, Homo sapiens
tcaaaatttaacagttacctg

SEQ ID NO: 2427737 - DNA, 21 bp, Homo sapiens
tcaaacaccaacataaaaatg

SEQ ID NO: 2427738 - DNA, 13 bp, Homo sapiens
tcaaacattttct

SEQ ID NO: 2427739 - DNA, 18 bp, Homo sapiens
tcaaacattttgaaagtc

SEQ ID NO: 2427740 - DNA, 17 bp, Homo sapiens
tcaaaccctagccttgc

SEQ ID NO: 2427741 - DNA, 16 bp, Homo sapiens
tcaaactactttgctg

SEQ ID NO: 2427742 - DNA, 20 bp, Homo sapiens
tcaaactcctgacctcaggc

SEQ ID NO: 2427743 - DNA, 21 bp, Homo sapiens
tcaaactcctgacctcaggca

SEQ ID NO: 2427744 - DNA, 12 bp, Homo sapiens
tcaaacttggat

SEQ ID NO: 2427745 - DNA, 14 bp, Homo sapiens
tcaaagaaagtgta

SEQ ID NO: 2427746 - DNA, 16 bp, Homo sapiens
tcaaagaaagtgtatt

SEQ ID NO: 2427747 - DNA, 14 bp, Homo sapiens
tcaaagaaggcatt

SEQ ID NO: 2427748 - DNA, 19 bp, Homo sapiens
tcaaagatgctgtgagtct

SEQ ID NO: 2427749 - DNA, 15 bp, Homo sapiens
tcaaagcaaggaaac

SEQ ID NO: 2427750 - DNA, 20 bp, Homo sapiens
tcaaagcatgggattattag

SEQ ID NO: 2427751 - DNA, 22 bp, Homo sapiens
tcaaagccagcgtcctcctctg

SEQ ID NO: 2427752 - DNA, 11 bp, Homo sapiens
tcaaagctgcc

SEQ ID NO: 2427753 - DNA, 19 bp, Homo sapiens
tcaaagctgtgtgtttgga

SEQ ID NO: 2427754 - DNA, 21 bp, Homo sapiens
tcaaatggtaggcatttccta

SEQ ID NO: 2427755 - DNA, 14 bp, Homo sapiens
tcaaatgttctaag

SEQ ID NO: 2427756 - DNA, 13 bp, Homo sapiens
tcaaattcaaata

SEQ ID NO: 2427757 - DNA, 15 bp, Homo sapiens
tcaacacagcttgtc

SEQ ID NO: 2427758 - DNA, 16 bp, Homo sapiens
tcaacagagactgaat

SEQ ID NO: 2427759 - DNA, 22 bp, Homo sapiens
tcaacagcgttcctagagaaga

SEQ ID NO: 2427760 - DNA, 21 bp, Homo sapiens
tcaacaggcctcagggctcct

SEQ ID NO: 2427761 - DNA, 14 bp, Homo sapiens
tcaacagtaaacca

SEQ ID NO: 2427762 - DNA, 23 bp, Homo sapiens
tcaacagttttcctatgctttga

SEQ ID NO: 2427763 - DNA, 15 bp, Homo sapiens
tcaacatcttttaca

SEQ ID NO: 2427764 - DNA, 12 bp, Homo sapiens
tcaacctcccaa

SEQ ID NO: 2427765 - DNA, 18 bp, Homo sapiens
tcaacctgggcaaagcct

SEQ ID NO: 2427766 - DNA, 15 bp, Homo sapiens
tcaactaggatcaga

SEQ ID NO: 2427767 - DNA, 22 bp, Homo sapiens
tcaactgtctcctacctctgct

SEQ ID NO: 2427768 - DNA, 23 bp, Homo sapiens
tcaagaaaacaggcactgccctg

SEQ ID NO: 2427769 - DNA, 20 bp, Homo sapiens
tcaagaaataaaaggaagcc

SEQ ID NO: 2427770 - DNA, 17 bp, Homo sapiens
tcaagaaataagttttt

SEQ ID NO: 2427771 - DNA, 19 bp, Homo sapiens
tcaagaatagcattgtaaa

SEQ ID NO: 2427772 - DNA, 20 bp, Homo sapiens
tcaagaggagcccccaccct

SEQ ID NO: 2427773 - DNA, 20 bp, Homo sapiens
tcaagagtgaattccctcac

SEQ ID NO: 2427774 - DNA, 22 bp, Homo sapiens
tcaagcagcgaccgccccctcc

SEQ ID NO: 2427775 - DNA, 23 bp, Homo sapiens
tcaagcagtcgtgcctgtgtcca

SEQ ID NO: 2427776 - DNA, 12 bp, Homo sapiens
tcaagctctgag

SEQ ID NO: 2427777 - DNA, 13 bp, Homo sapiens
tcaagctctgagg

SEQ ID NO: 2427778 - DNA, 15 bp, Homo sapiens
tcaagctctgaggga

SEQ ID NO: 2427779 - DNA, 20 bp, Homo sapiens
tcaagctgagtattaaaatg

SEQ ID NO: 2427780 - DNA, 21 bp, Homo sapiens
tcaaggaatttcttaacttct

SEQ ID NO: 2427781 - DNA, 14 bp, Homo sapiens
tcaaggcactctag

SEQ ID NO: 2427782 - DNA, 17 bp, Homo sapiens
tcaaggcactctagatt

SEQ ID NO: 2427783 - DNA, 17 bp, Homo sapiens
tcatacagagaagtcac

SEQ ID NO: 2427784 - DNA, 14 bp, Homo sapiens
tcatacttgaacgt

SEQ ID NO: 2427785 - DNA, 19 bp, Homo sapiens
tcatacttgaacgttttct

SEQ ID NO: 2427786 - DNA, 21 bp, Homo sapiens
tcatacttgaacgttttctaa

SEQ ID NO: 2427787 - DNA, 17 bp, Homo sapiens
tcatagcaatacttgga

SEQ ID NO: 2427788 - DNA, 14 bp, Homo sapiens
tcataggtctgaaa

SEQ ID NO: 2427789 - DNA, 14 bp, Homo sapiens
tcatagtaacttct

SEQ ID NO: 2427790 - DNA, 21 bp, Homo sapiens
tcatagtaacttcttatggaa

SEQ ID NO: 2427791 - DNA, 16 bp, Homo sapiens
tcatataataaatgta

SEQ ID NO: 2427792 - DNA, 17 bp, Homo sapiens
tcatatatatcacccag

SEQ ID NO: 2427793 - DNA, 16 bp, Homo sapiens
tcatatcatccacaca

SEQ ID NO: 2427794 - DNA, 21 bp, Homo sapiens
tcatatgtaccatgtacatga

SEQ ID NO: 2427795 - DNA, 22 bp, Homo sapiens
tcatatgtaccatgtacatgaa

SEQ ID NO: 2427796 - DNA, 16 bp, Homo sapiens
tcatcatcatggccag

SEQ ID NO: 2427797 - DNA, 14 bp, Homo sapiens
tcatcattctctgt

SEQ ID NO: 2427798 - DNA, 20 bp, Homo sapiens
tcatcattctctgtctcatc

SEQ ID NO: 2427799 - DNA, 22 bp, Homo sapiens
tcatcattctctgtctcatcca

SEQ ID NO: 2427800 - DNA, 12 bp, Homo sapiens
tcatccatcatc

SEQ ID NO: 2427801 - DNA, 23 bp, Homo sapiens
tcatcccaaaggacagccgcctg

SEQ ID NO: 2427802 - DNA, 14 bp, Homo sapiens
tcatcctcaaagaa

SEQ ID NO: 2427803 - DNA, 11 bp, Homo sapiens
tcatcctctgg

SEQ ID NO: 2427804 - DNA, 13 bp, Homo sapiens
tcatccttgtctt

SEQ ID NO: 2427805 - DNA, 21 bp, Homo sapiens
tcatcgaatctactaattcca

SEQ ID NO: 2427806 - DNA, 22 bp, Homo sapiens
tcatctaccattttctggttct

SEQ ID NO: 2427807 - DNA, 23 bp, Homo sapiens
tcatctcctgccttcctcctggg

SEQ ID NO: 2427808 - DNA, 12 bp, Homo sapiens
tcatctcttcag

SEQ ID NO: 2427809 - DNA, 20 bp, Homo sapiens
tcatctggggagcaggcagc

SEQ ID NO: 2427810 - DNA, 17 bp, Homo sapiens
tcatctgtccctccggg

SEQ ID NO: 2427811 - DNA, 12 bp, Homo sapiens
tcatctgtgcac

SEQ ID NO: 2427812 - DNA, 16 bp, Homo sapiens
tcatcttcttcaccat

SEQ ID NO: 2427813 - DNA, 11 bp, Homo sapiens
tcatcttgcta

SEQ ID NO: 2427814 - DNA, 17 bp, Homo sapiens
tcatcttgctaccagta

SEQ ID NO: 2427815 - DNA, 12 bp, Homo sapiens
tcatgaatgtaa

SEQ ID NO: 2427816 - DNA, 13 bp, Homo sapiens
tcatgaatgtaaa

SEQ ID NO: 2427817 - DNA, 19 bp, Homo sapiens
tcatgaatgtaaatttgta

SEQ ID NO: 2427818 - DNA, 16 bp, Homo sapiens
tcatgaggagattctg

SEQ ID NO: 2427819 - DNA, 20 bp, Homo sapiens
tcatgaggagattctgcctt

SEQ ID NO: 2427820 - DNA, 17 bp, Homo sapiens
tcatgatttcatttcaa

SEQ ID NO: 2427821 - DNA, 23 bp, Homo sapiens
tcatgatttcatttcaactgttt

SEQ ID NO: 2427822 - DNA, 13 bp, Homo sapiens
tcatgcaaactct

SEQ ID NO: 2427823 - DNA, 17 bp, Homo sapiens
tcatgcacagtatttgt

SEQ ID NO: 2427824 - DNA, 12 bp, Homo sapiens
tcatgcagctgt

SEQ ID NO: 2427825 - DNA, 19 bp, Homo sapiens
tcatgccaccatggccagc

SEQ ID NO: 2427826 - DNA, 15 bp, Homo sapiens
tcatgccctgtgcaa

SEQ ID NO: 2427827 - DNA, 14 bp, Homo sapiens
tcatgcctctgagg

SEQ ID NO: 2427828 - DNA, 15 bp, Homo sapiens
tcatgcctctgaggc

SEQ ID NO: 2427829 - DNA, 21 bp, Homo sapiens
tcatgcctctgaggccagcct

SEQ ID NO: 2427830 - DNA, 19 bp, Homo sapiens
tcatgcgatgacacttgta

SEQ ID NO: 2427831 - DNA, 22 bp, Homo sapiens
tcatgcgatgacacttgtacaa

SEQ ID NO: 2427832 - DNA, 18 bp, Homo sapiens
tcatgctgggatttccaa

SEQ ID NO: 2427833 - DNA, 20 bp, Homo sapiens
tcatgctgggatttccaact

SEQ ID NO: 2427834 - DNA, 22 bp, Homo sapiens
tcatggcagaaggcaaacccat

SEQ ID NO: 2427835 - DNA, 19 bp, Homo sapiens
tcatgggccactgcttttc

SEQ ID NO: 2427836 - DNA, 15 bp, Homo sapiens
tcatgtaatcctcaa

SEQ ID NO: 2427837 - DNA, 18 bp, Homo sapiens
tcatgtacaagatgaagg

SEQ ID NO: 2427838 - DNA, 23 bp, Homo sapiens
tcatgtcaaatatttagatgtaa

SEQ ID NO: 2427839 - DNA, 17 bp, Homo sapiens
tcatgtgaccactctgt

SEQ ID NO: 2427840 - DNA, 16 bp, Homo sapiens
tcatgtggctggaaga

SEQ ID NO: 2427841 - DNA, 15 bp, Homo sapiens
tcatgtgtataaaaa

SEQ ID NO: 2427842 - DNA, 17 bp, Homo sapiens
tcatgtgtcccagaaga

SEQ ID NO: 2427843 - DNA, 18 bp, Homo sapiens
tcatgtgtcccagaagat

SEQ ID NO: 2427844 - DNA, 20 bp, Homo sapiens
tcatgtgtgcaacagggtat

SEQ ID NO: 2427845 - DNA, 12 bp, Homo sapiens
tcatgtgtgtcc

SEQ ID NO: 2427846 - DNA, 16 bp, Homo sapiens
tcatgtgtgtccacga

SEQ ID NO: 2427847 - DNA, 21 bp, Homo sapiens
tcatgtgtgtccacgactgtc

SEQ ID NO: 2427848 - DNA, 22 bp, Homo sapiens
tcatgttaaataggcggggctt

SEQ ID NO: 2427849 - DNA, 15 bp, Homo sapiens
tcatgttagttacct

SEQ ID NO: 2427850 - DNA, 19 bp, Homo sapiens
tcatgttagttaccttata

SEQ ID NO: 2427851 - DNA, 12 bp, Homo sapiens
tcatgtttttga

SEQ ID NO: 2427852 - DNA, 13 bp, Homo sapiens
tcattaaataaat

SEQ ID NO: 2427853 - DNA, 17 bp, Homo sapiens
tcattaatctgcctccc

SEQ ID NO: 2427854 - DNA, 16 bp, Homo sapiens
tcattatttatgtatt

SEQ ID NO: 2427855 - DNA, 18 bp, Homo sapiens
tcattctctgtctcatcc

SEQ ID NO: 2427856 - DNA, 14 bp, Homo sapiens
tcattggaaattta

SEQ ID NO: 2427857 - DNA, 15 bp, Homo sapiens
tcattggaaatttag

SEQ ID NO: 2427858 - DNA, 21 bp, Homo sapiens
tcattggaaatttagcattgt

SEQ ID NO: 2427859 - DNA, 14 bp, Homo sapiens
tcattgtatgtggt

SEQ ID NO: 2427860 - DNA, 20 bp, Homo sapiens
tcattgtgttacctgtagat

SEQ ID NO: 2427861 - DNA, 22 bp, Homo sapiens
tcatttaatcctcccttcctcc

SEQ ID NO: 2427862 - DNA, 17 bp, Homo sapiens
tcatttagcatgttgtt

SEQ ID NO: 2427863 - DNA, 15 bp, Homo sapiens
tcatttagcctgtcc

SEQ ID NO: 2427864 - DNA, 12 bp, Homo sapiens
tcatttatctat

SEQ ID NO: 2427865 - DNA, 13 bp, Homo sapiens
tcatttcagaagt

SEQ ID NO: 2427866 - DNA, 21 bp, Homo sapiens
tcatttcagaagttagtttgt

SEQ ID NO: 2427867 - DNA, 23 bp, Homo sapiens
tcatttctttttgggagagactt

SEQ ID NO: 2427868 - DNA, 14 bp, Homo sapiens
tcatttgctttgga

SEQ ID NO: 2427869 - DNA, 20 bp, Homo sapiens
tcatttggttcattaattct

SEQ ID NO: 2427870 - DNA, 12 bp, Homo sapiens
tcatttgtttaa

SEQ ID NO: 2427871 - DNA, 13 bp, Homo sapiens
tcattttaattat

SEQ ID NO: 2427872 - DNA, 14 bp, Homo sapiens
tcattttctctcag

SEQ ID NO: 2427873 - DNA, 20 bp, Homo sapiens
tcatttttacaatgtaatta

SEQ ID NO: 2427874 - DNA, 15 bp, Homo sapiens
tcatttttttccttg

SEQ ID NO: 2427875 - DNA, 18 bp, Homo sapiens
tcatttttttccttgcaa

SEQ ID NO: 2427876 - DNA, 20 bp, Homo sapiens
tcattttttttctttgaata

SEQ ID NO: 2427877 - DNA, 23 bp, Homo sapiens
tcattttttttctttgaataaat

SEQ ID NO: 2427878 - DNA, 17 bp, Homo sapiens
tcatttttttttcaatc

SEQ ID NO: 2427879 - DNA, 22 bp, Homo sapiens
tccaaaaccgccagctctgttc

SEQ ID NO: 2427880 - DNA, 18 bp, Homo sapiens
tccaaagaggctgcccct

SEQ ID NO: 2427881 - DNA, 22 bp, Homo sapiens
tccaaagagtagaattgcattg

SEQ ID NO: 2427882 - DNA, 13 bp, Homo sapiens
tccaaagtctcta

SEQ ID NO: 2427883 - DNA, 17 bp, Homo sapiens
tccaaagtctctaattc

SEQ ID NO: 2427884 - DNA, 18 bp, Homo sapiens
tccaaatggcgtctggaa

SEQ ID NO: 2427885 - DNA, 20 bp, Homo sapiens
tccaaatggcgtctggaagt

SEQ ID NO: 2427886 - DNA, 16 bp, Homo sapiens
tccaaattcagtttca

SEQ ID NO: 2427887 - DNA, 22 bp, Homo sapiens
aaagttgctatttgaacttttt

SEQ ID NO: 2427888 - DNA, 15 bp, Homo sapiens
aaagtttaataaatt

SEQ ID NO: 2427889 - DNA, 16 bp, Homo sapiens
aaagttttatatatta

SEQ ID NO: 2427890 - DNA, 17 bp, Homo sapiens
aaagttttatatattat

SEQ ID NO: 2427891 - DNA, 21 bp, Homo sapiens
aaagttttatatattatatgg

SEQ ID NO: 2427892 - DNA, 11 bp, Homo sapiens
aaagtttttta

SEQ ID NO: 2427893 - DNA, 19 bp, Homo sapiens
aaataaaaagaaaggctgt

SEQ ID NO: 2427894 - DNA, 18 bp, Homo sapiens
aaataaaaggaagccaaa

SEQ ID NO: 2427895 - DNA, 18 bp, Homo sapiens
aaataaaatttgttgcat

SEQ ID NO: 2427896 - DNA, 13 bp, Homo sapiens
aaataactggaaa

SEQ ID NO: 2427897 - DNA, 16 bp, Homo sapiens
aaataactggaaaaca

SEQ ID NO: 2427898 - DNA, 20 bp, Homo sapiens
aaataactggaaaacagaac

SEQ ID NO: 2427899 - DNA, 24 bp, Homo sapiens
aaataagaaacaactctttgagaa

SEQ ID NO: 2427900 - DNA, 15 bp, Homo sapiens
aaataagaagaatgc

SEQ ID NO: 2427901 - DNA, 14 bp, Homo sapiens
aaataagattctaa

SEQ ID NO: 2427902 - DNA, 16 bp, Homo sapiens
aaataagattctaacg

SEQ ID NO: 2427903 - DNA, 13 bp, Homo sapiens
aaataagcaggtg

SEQ ID NO: 2427904 - DNA, 12 bp, Homo sapiens
aaataagctatt

SEQ ID NO: 2427905 - DNA, 17 bp, Homo sapiens
aaataagctatttgatg

SEQ ID NO: 2427906 - DNA, 19 bp, Homo sapiens
aaataaggcacccatctgt

SEQ ID NO: 2427907 - DNA, 13 bp, Homo sapiens
aaataagtttttg

SEQ ID NO: 2427908 - DNA, 12 bp, Homo sapiens
aaataatgcttt

SEQ ID NO: 2427909 - DNA, 13 bp, Homo sapiens
aaatacaagactg

SEQ ID NO: 2427910 - DNA, 15 bp, Homo sapiens
aaatacagactggat

SEQ ID NO: 2427911 - DNA, 16 bp, Homo sapiens
aaatacaggaaacagt

SEQ ID NO: 2427912 - DNA, 22 bp, Homo sapiens
aaatacagtcttccatttgcaa

SEQ ID NO: 2427913 - DNA, 13 bp, Homo sapiens
aaatacatgctaa

SEQ ID NO: 2427914 - DNA, 18 bp, Homo sapiens
aaatacatgctaagagaa

SEQ ID NO: 2427915 - DNA, 15 bp, Homo sapiens
aaatacggtgggggt

SEQ ID NO: 2427916 - DNA, 17 bp, Homo sapiens
aaatacttttactctgc

SEQ ID NO: 2427917 - DNA, 16 bp, Homo sapiens
aaatagcaaaagaaga

SEQ ID NO: 2427918 - DNA, 15 bp, Homo sapiens
aaatagcgttcttgt

SEQ ID NO: 2427919 - DNA, 16 bp, Homo sapiens
aaatagcttatgaaaa

SEQ ID NO: 2427920 - DNA, 15 bp, Homo sapiens
aaatagggtatattt

SEQ ID NO: 2427921 - DNA, 12 bp, Homo sapiens
aaatagtatttc

SEQ ID NO: 2427922 - DNA, 14 bp, Homo sapiens
aaatagtttggata

SEQ ID NO: 2427923 - DNA, 20 bp, Homo sapiens
aaatagtttggatatgtaaa

SEQ ID NO: 2427924 - DNA, 13 bp, Homo sapiens
aaatataaagacg

SEQ ID NO: 2427925 - DNA, 24 bp, Homo sapiens
aaatataaagacgttttataagca

SEQ ID NO: 2427926 - DNA, 17 bp, Homo sapiens
aaatatatattatactt

SEQ ID NO: 2427927 - DNA, 20 bp, Homo sapiens
aaatatatttaagataatta

SEQ ID NO: 2427928 - DNA, 21 bp, Homo sapiens
aaatatatttaagataattat

SEQ ID NO: 2427929 - DNA, 19 bp, Homo sapiens
aaatattccctagaaactt

SEQ ID NO: 2427930 - DNA, 22 bp, Homo sapiens
aaatatttagatgtaattttgt

SEQ ID NO: 2427931 - DNA, 19 bp, Homo sapiens
aaatattttaaaatcagct

SEQ ID NO: 2427932 - DNA, 15 bp, Homo sapiens
aaatattttaaagaa

SEQ ID NO: 2427933 - DNA, 18 bp, Homo sapiens
aaatattttaaagaattg

SEQ ID NO: 2427934 - DNA, 22 bp, Homo sapiens
aaatattttgaatcaataatat

SEQ ID NO: 2427935 - DNA, 14 bp, Homo sapiens
aaatcaaaatctct

SEQ ID NO: 2427936 - DNA, 16 bp, Homo sapiens
aaatcaaaatctctcc

SEQ ID NO: 2427937 - DNA, 20 bp, Homo sapiens
aaatcaaatggtatcttttg

SEQ ID NO: 2427938 - DNA, 23 bp, Homo sapiens
aaatcaagtatttgggaagtgaa

SEQ ID NO: 2427939 - DNA, 20 bp, Homo sapiens
aaatcacgctttttgaaaaa

SEQ ID NO: 2427940 - DNA, 16 bp, Homo sapiens
aaatcagtaagaggtg

SEQ ID NO: 2427941 - DNA, 15 bp, Homo sapiens
aaatcatgggccaga

SEQ ID NO: 2427942 - DNA, 14 bp, Homo sapiens
aaatcattttgcaa

SEQ ID NO: 2427943 - DNA, 19 bp, Homo sapiens
aaatccttagatctggcat

SEQ ID NO: 2427944 - DNA, 16 bp, Homo sapiens
aaatcctttactgtta

SEQ ID NO: 2427945 - DNA, 13 bp, Homo sapiens
aaatcgaatgaaa

SEQ ID NO: 2427946 - DNA, 20 bp, Homo sapiens
aaatcgaatgaaattaactg

SEQ ID NO: 2427947 - DNA, 17 bp, Homo sapiens
aaatctcaccccatccc

SEQ ID NO: 2427948 - DNA, 16 bp, Homo sapiens
aaatctcccattttgg

SEQ ID NO: 2427949 - DNA, 18 bp, Homo sapiens
aaatctcccattttggaa

SEQ ID NO: 2427950 - DNA, 21 bp, Homo sapiens
aaatctcccattttggaattt

SEQ ID NO: 2427951 - DNA, 13 bp, Homo sapiens
aaatctctccact

SEQ ID NO: 2427952 - DNA, 20 bp, Homo sapiens
aaatctctccactttcagct

SEQ ID NO: 2427953 - DNA, 21 bp, Homo sapiens
aaatctctccactttcagctg

SEQ ID NO: 2427954 - DNA, 14 bp, Homo sapiens
aaatctgacccagt

SEQ ID NO: 2427955 - DNA, 18 bp, Homo sapiens
aaatctgacccagtgccc

SEQ ID NO: 2427956 - DNA, 12 bp, Homo sapiens
aaatctggaagc

SEQ ID NO: 2427957 - DNA, 14 bp, Homo sapiens
aaatctggcttctg

SEQ ID NO: 2427958 - DNA, 21 bp, Homo sapiens
aaatctggcttctggccagga

SEQ ID NO: 2427959 - DNA, 19 bp, Homo sapiens
aaatctgtgcctgagaaca

SEQ ID NO: 2427960 - DNA, 20 bp, Homo sapiens
aaatcttatagttctaggca

SEQ ID NO: 2427961 - DNA, 13 bp, Homo sapiens
aaatcttgaaatt

SEQ ID NO: 2427962 - DNA, 16 bp, Homo sapiens
aaatcttgtcatgtgt

SEQ ID NO: 2427963 - DNA, 19 bp, Homo sapiens
aaatcttgtcatgtgtata

SEQ ID NO: 2427964 - DNA, 15 bp, Homo sapiens
aaatgaaaatgtctt

SEQ ID NO: 2427965 - DNA, 17 bp, Homo sapiens
aaatgaaaatgtcttgt

SEQ ID NO: 2427966 - DNA, 13 bp, Homo sapiens
aaatgaacaagag

SEQ ID NO: 2427967 - DNA, 19 bp, Homo sapiens
aaatgacaatcatgtgtgt

SEQ ID NO: 2427968 - DNA, 21 bp, Homo sapiens
aaatgacaatcatgtgtgtta

SEQ ID NO: 2427969 - DNA, 13 bp, Homo sapiens
aaatgagccatga

SEQ ID NO: 2427970 - DNA, 20 bp, Homo sapiens
aaatgaggccatggactctg

SEQ ID NO: 2427971 - DNA, 18 bp, Homo sapiens
aaatgagtaacatttgct

SEQ ID NO: 2427972 - DNA, 14 bp, Homo sapiens
aaatgattgtagta

SEQ ID NO: 2427973 - DNA, 19 bp, Homo sapiens
aaatgcaaaaactctttga

SEQ ID NO: 2427974 - DNA, 16 bp, Homo sapiens
aaatgccaaattaaaa

SEQ ID NO: 2427975 - DNA, 16 bp, Homo sapiens
aaatgccttttcccaa

SEQ ID NO: 2427976 - DNA, 15 bp, Homo sapiens
aaatgcggttataaa

SEQ ID NO: 2427977 - DNA, 15 bp, Homo sapiens
aaatgctaggttcta

SEQ ID NO: 2427978 - DNA, 18 bp, Homo sapiens
aaatgctaggttctacct

SEQ ID NO: 2427979 - DNA, 15 bp, Homo sapiens
aaatggcctcatgtg

SEQ ID NO: 2427980 - DNA, 22 bp, Homo sapiens
aaatggcctcatgtggctggaa

SEQ ID NO: 2427981 - DNA, 20 bp, Homo sapiens
aaatgggcacttaaagcttt

SEQ ID NO: 2427982 - DNA, 22 bp, Homo sapiens
aaatggggccagatccagcctg

SEQ ID NO: 2427983 - DNA, 19 bp, Homo sapiens
aaatggtaggcatttccta

SEQ ID NO: 2427984 - DNA, 22 bp, Homo sapiens
aaatgtaagattatagattcta

SEQ ID NO: 2427985 - DNA, 20 bp, Homo sapiens
aaatgtaggcttagtttgtg

SEQ ID NO: 2427986 - DNA, 20 bp, Homo sapiens
aaatgtatgcatgttgtcta

SEQ ID NO: 2427987 - DNA, 14 bp, Homo sapiens
aaatgtcacttttt

SEQ ID NO: 2427988 - DNA, 20 bp, Homo sapiens
aaatgtcactttttgaggca

SEQ ID NO: 2427989 - DNA, 16 bp, Homo sapiens
aaatgtcatgctgcct

SEQ ID NO: 2427990 - DNA, 18 bp, Homo sapiens
aaatgtctttaatgcaat

SEQ ID NO: 2427991 - DNA, 23 bp, Homo sapiens
aagcccccagctaagaacctgga

SEQ ID NO: 2427992 - DNA, 13 bp, Homo sapiens
aagccctcccagg

SEQ ID NO: 2427993 - DNA, 14 bp, Homo sapiens
aagcctaagaatct

SEQ ID NO: 2427994 - DNA, 22 bp, Homo sapiens
aagcctagtgaaggcttctctc

SEQ ID NO: 2427995 - DNA, 16 bp, Homo sapiens
aagcctcaaaacaaag

SEQ ID NO: 2427996 - DNA, 23 bp, Homo sapiens
aagcctcaaggttttaggttcta

SEQ ID NO: 2427997 - DNA, 20 bp, Homo sapiens
aagcctcagattccttccca

SEQ ID NO: 2427998 - DNA, 21 bp, Homo sapiens
aagcctgagggaaaggccagc

SEQ ID NO: 2427999 - DNA, 22 bp, Homo sapiens
aagcctgagggaaaggccagca

SEQ ID NO: 2428000 - DNA, 21 bp, Homo sapiens
aagccttcaagctctgaggga

SEQ ID NO: 2428001 - DNA, 21 bp, Homo sapiens
aagccttccccttatcctccc

SEQ ID NO: 2428002 - DNA, 21 bp, Homo sapiens
aagctaacagggaaggcaggc

SEQ ID NO: 2428003 - DNA, 17 bp, Homo sapiens
aagctaaggtttagata

SEQ ID NO: 2428004 - DNA, 22 bp, Homo sapiens
aagctaatttgcattaaattca

SEQ ID NO: 2428005 - DNA, 17 bp, Homo sapiens
aagctagacacatgaag

SEQ ID NO: 2428006 - DNA, 18 bp, Homo sapiens
aagctagacacatgaagg

SEQ ID NO: 2428007 - DNA, 22 bp, Homo sapiens
aagctagacacatgaaggtaaa

SEQ ID NO: 2428008 - DNA, 23 bp, Homo sapiens
aagctaggtgctatttgtcatct

SEQ ID NO: 2428009 - DNA, 14 bp, Homo sapiens
aagctagtcttttg

SEQ ID NO: 2428010 - DNA, 15 bp, Homo sapiens
aagctagtcttttgc

SEQ ID NO: 2428011 - DNA, 21 bp, Homo sapiens
aagctagtcttttgcttttgc

SEQ ID NO: 2428012 - DNA, 15 bp, Homo sapiens
aagctataaagcagt

SEQ ID NO: 2428013 - DNA, 18 bp, Homo sapiens
aagctatttaaagcatct

SEQ ID NO: 2428014 - DNA, 23 bp, Homo sapiens
aagctatttgatgtaatacttct

SEQ ID NO: 2428015 - DNA, 16 bp, Homo sapiens
aagctatttttctaac

SEQ ID NO: 2428016 - DNA, 15 bp, Homo sapiens
aagctcacgtcctga

SEQ ID NO: 2428017 - DNA, 19 bp, Homo sapiens
aagctcacgtcctgagaaa

SEQ ID NO: 2428018 - DNA, 15 bp, Homo sapiens
aagctcccccagcaa

SEQ ID NO: 2428019 - DNA, 23 bp, Homo sapiens
aagctcccccagcaaagccccca

SEQ ID NO: 2428020 - DNA, 21 bp, Homo sapiens
aagctcctctccccagcccag

SEQ ID NO: 2428021 - DNA, 22 bp, Homo sapiens
aagctcgatgtggtcacagctg

SEQ ID NO: 2428022 - DNA, 15 bp, Homo sapiens
aagctctagaatctg

SEQ ID NO: 2428023 - DNA, 12 bp, Homo sapiens
aagctctgacat

SEQ ID NO: 2428024 - DNA, 11 bp, Homo sapiens
aagctctgagc

SEQ ID NO: 2428025 - DNA, 12 bp, Homo sapiens
aagctctgagct

SEQ ID NO: 2428026 - DNA, 16 bp, Homo sapiens
aagctctgagctgtca

SEQ ID NO: 2428027 - DNA, 12 bp, Homo sapiens
aagctcttcctt

SEQ ID NO: 2428028 - DNA, 18 bp, Homo sapiens
aagctgacttggctggtg

SEQ ID NO: 2428029 - DNA, 20 bp, Homo sapiens
aagctgaggtgcccaggaga

SEQ ID NO: 2428030 - DNA, 15 bp, Homo sapiens
aagctgagtttccta

SEQ ID NO: 2428031 - DNA, 18 bp, Homo sapiens
aagctgattttttttaat

SEQ ID NO: 2428032 - DNA, 16 bp, Homo sapiens
aagctggtttaatgtt

SEQ ID NO: 2428033 - DNA, 14 bp, Homo sapiens
aagcttaaaacttt

SEQ ID NO: 2428034 - DNA, 15 bp, Homo sapiens
aagcttaaaactttg

SEQ ID NO: 2428035 - DNA, 17 bp, Homo sapiens
aagcttaaaactttgaa

SEQ ID NO: 2428036 - DNA, 19 bp, Homo sapiens
aagcttaatggctgataat

SEQ ID NO: 2428037 - DNA, 14 bp, Homo sapiens
aagcttagtataaa

SEQ ID NO: 2428038 - DNA, 21 bp, Homo sapiens
aagcttccatgattctattta

SEQ ID NO: 2428039 - DNA, 16 bp, Homo sapiens
aagctttcagaatatg

SEQ ID NO: 2428040 - DNA, 22 bp, Homo sapiens
aagctttcatgtaaactgtgca

SEQ ID NO: 2428041 - DNA, 22 bp, Homo sapiens
aagctttggtgagaacctgggt

SEQ ID NO: 2428042 - DNA, 15 bp, Homo sapiens
aaggaaaaacaaact

SEQ ID NO: 2428043 - DNA, 13 bp, Homo sapiens
aaggaaccaacaa

SEQ ID NO: 2428044 - DNA, 16 bp, Homo sapiens
aaggaatttcttaact

SEQ ID NO: 2428045 - DNA, 19 bp, Homo sapiens
aaggaatttcttaacttct

SEQ ID NO: 2428046 - DNA, 16 bp, Homo sapiens
aaggactataagaata

SEQ ID NO: 2428047 - DNA, 21 bp, Homo sapiens
aaggactatgaaaagctagaa

SEQ ID NO: 2428048 - DNA, 17 bp, Homo sapiens
aaggacttcctgtccag

SEQ ID NO: 2428049 - DNA, 22 bp, Homo sapiens
aaggacttcctgtccagctcca

SEQ ID NO: 2428050 - DNA, 10 bp, Homo sapiens
aaggagcctg

SEQ ID NO: 2428051 - DNA, 21 bp, Homo sapiens
aaggagcctgtgaacccagga

SEQ ID NO: 2428052 - DNA, 18 bp, Homo sapiens
aaggagctgcctggaccc

SEQ ID NO: 2428053 - DNA, 19 bp, Homo sapiens
aaggagctgcctggacccg

SEQ ID NO: 2428054 - DNA, 17 bp, Homo sapiens
aaggagtcaaaactaca

SEQ ID NO: 2428055 - DNA, 20 bp, Homo sapiens
aaggagtcagacattttaag

SEQ ID NO: 2428056 - DNA, 14 bp, Homo sapiens
aaggagtttatgtt

SEQ ID NO: 2428057 - DNA, 19 bp, Homo sapiens
aaggatagatgctggccca

SEQ ID NO: 2428058 - DNA, 19 bp, Homo sapiens
aaggatgaagggcccgaga

SEQ ID NO: 2428059 - DNA, 22 bp, Homo sapiens
aaggatgtgattgtggaatgga

SEQ ID NO: 2428060 - DNA, 14 bp, Homo sapiens
aaggcaaaaatgta

SEQ ID NO: 2428061 - DNA, 20 bp, Homo sapiens
aaggcaaacccatcaacaaa

SEQ ID NO: 2428062 - DNA, 22 bp, Homo sapiens
aaggcaacaaaagaagcccggc

SEQ ID NO: 2428063 - DNA, 16 bp, Homo sapiens
aaggcacttgaggggg

SEQ ID NO: 2428064 - DNA, 18 bp, Homo sapiens
aaggcagaggcctgggct

SEQ ID NO: 2428065 - DNA, 14 bp, Homo sapiens
aaggcagcaaggcc

SEQ ID NO: 2428066 - DNA, 16 bp, Homo sapiens
aaggcagcaaggcccg

SEQ ID NO: 2428067 - DNA, 19 bp, Homo sapiens
aaggcagccgtgggcccca

SEQ ID NO: 2428068 - DNA, 21 bp, Homo sapiens
aaggccaattcctatacgcag

SEQ ID NO: 2428069 - DNA, 18 bp, Homo sapiens
aaggccataaaacaggta

SEQ ID NO: 2428070 - DNA, 22 bp, Homo sapiens
aaggcctaattctatgcctgtc

SEQ ID NO: 2428071 - DNA, 21 bp, Homo sapiens
aaggcctggggtgacccggca

SEQ ID NO: 2428072 - DNA, 22 bp, Homo sapiens
aaggcctggggtgacccggcac

SEQ ID NO: 2428073 - DNA, 11 bp, Homo sapiens
aaggctctaga

SEQ ID NO: 2428074 - DNA, 12 bp, Homo sapiens
aaggctctagat

SEQ ID NO: 2428075 - DNA, 20 bp, Homo sapiens
aaggctctgagagtctagat

SEQ ID NO: 2428076 - DNA, 21 bp, Homo sapiens
aaggctctgagagtctagatt

SEQ ID NO: 2428077 - DNA, 13 bp, Homo sapiens
aaggctgtgtaag

SEQ ID NO: 2428078 - DNA, 14 bp, Homo sapiens
aaggctgtgtaaga

SEQ ID NO: 2428079 - DNA, 20 bp, Homo sapiens
aaggctgttaaatacaggaa

SEQ ID NO: 2428080 - DNA, 21 bp, Homo sapiens
aaggctgttaaatacaggaaa

SEQ ID NO: 2428081 - DNA, 17 bp, Homo sapiens
aaggcttgttgtgcttt

SEQ ID NO: 2428082 - DNA, 19 bp, Homo sapiens
aaggcttgttgtgctttta

SEQ ID NO: 2428083 - DNA, 16 bp, Homo sapiens
aagggaggctgctgct

SEQ ID NO: 2428084 - DNA, 13 bp, Homo sapiens
aagggagggctct

SEQ ID NO: 2428085 - DNA, 18 bp, Homo sapiens
aagggagggctctgaggc

SEQ ID NO: 2428086 - DNA, 15 bp, Homo sapiens
aagggagtctgccag

SEQ ID NO: 2428087 - DNA, 12 bp, Homo sapiens
aagggccagagc

SEQ ID NO: 2428088 - DNA, 13 bp, Homo sapiens
aagggccagagcc

SEQ ID NO: 2428089 - DNA, 15 bp, Homo sapiens
aagggccagagccag

SEQ ID NO: 2428090 - DNA, 17 bp, Homo sapiens
aagggccagagccaggg

SEQ ID NO: 2428091 - DNA, 12 bp, Homo sapiens
aagggccctggg

SEQ ID NO: 2428092 - DNA, 18 bp, Homo sapiens
aagggctttgttttgcac

SEQ ID NO: 2428093 - DNA, 16 bp, Homo sapiens
aaggggagcccactgt

SEQ ID NO: 2428094 - DNA, 13 bp, Homo sapiens
aaggggcttcagg

SEQ ID NO: 2428095 - DNA, 19 bp, Homo sapiens
aatgcattcttctctgttg

SEQ ID NO: 2428096 - DNA, 21 bp, Homo sapiens
aatgccaaattaaaaaagata

SEQ ID NO: 2428097 - DNA, 22 bp, Homo sapiens
aatgccaaattaaaaaagataa

SEQ ID NO: 2428098 - DNA, 15 bp, Homo sapiens
aatgccacagccctg

SEQ ID NO: 2428099 - DNA, 18 bp, Homo sapiens
aatgccacagccctgtca

SEQ ID NO: 2428100 - DNA, 11 bp, Homo sapiens
aatgcccagac

SEQ ID NO: 2428101 - DNA, 12 bp, Homo sapiens
aatgcccagaca

SEQ ID NO: 2428102 - DNA, 14 bp, Homo sapiens
aatgcccttcactg

SEQ ID NO: 2428103 - DNA, 17 bp, Homo sapiens
aatgcccttcactgtca

SEQ ID NO: 2428104 - DNA, 15 bp, Homo sapiens
aatgccttttcccaa

SEQ ID NO: 2428105 - DNA, 21 bp, Homo sapiens
aatgcggttataaaaaatggt

SEQ ID NO: 2428106 - DNA, 19 bp, Homo sapiens
aatgcttctaagtaaatac

SEQ ID NO: 2428107 - DNA, 23 bp, Homo sapiens
aatggcatgagaaatacaaaaat

SEQ ID NO: 2428108 - DNA, 15 bp, Homo sapiens
aatggcctcatgtgg

SEQ ID NO: 2428109 - DNA, 20 bp, Homo sapiens
aatggcctcatgtggctgga

SEQ ID NO: 2428110 - DNA, 17 bp, Homo sapiens
aatggccttcatatcat

SEQ ID NO: 2428111 - DNA, 15 bp, Homo sapiens
aatggctgataattt

SEQ ID NO: 2428112 - DNA, 17 bp, Homo sapiens
aatggctgataatttta

SEQ ID NO: 2428113 - DNA, 20 bp, Homo sapiens
aatggctgcacctttttgca

SEQ ID NO: 2428114 - DNA, 21 bp, Homo sapiens
aatgggagctgaggccacact

SEQ ID NO: 2428115 - DNA, 14 bp, Homo sapiens
aatgggcacttaaa

SEQ ID NO: 2428116 - DNA, 12 bp, Homo sapiens
aatggggccaga

SEQ ID NO: 2428117 - DNA, 16 bp, Homo sapiens
aatgggtttttccctg

SEQ ID NO: 2428118 - DNA, 18 bp, Homo sapiens
aatggtaggcatttccta

SEQ ID NO: 2428119 - DNA, 12 bp, Homo sapiens
aatggtatcttt

SEQ ID NO: 2428120 - DNA, 15 bp, Homo sapiens
aatgtaaagacaaaa

SEQ ID NO: 2428121 - DNA, 14 bp, Homo sapiens
aatgtaaagccatg

SEQ ID NO: 2428122 - DNA, 23 bp, Homo sapiens
aatgtaaaggagtcaaaactaca

SEQ ID NO: 2428123 - DNA, 15 bp, Homo sapiens
aatgtaaatttgtac

SEQ ID NO: 2428124 - DNA, 16 bp, Homo sapiens
aatgtaagattataga

SEQ ID NO: 2428125 - DNA, 18 bp, Homo sapiens
aatgtaaggctgtgtaag

SEQ ID NO: 2428126 - DNA, 22 bp, Homo sapiens
aatgtaattatttatgtatggt

SEQ ID NO: 2428127 - DNA, 22 bp, Homo sapiens
aatgtacccaccgggccactcc

SEQ ID NO: 2428128 - DNA, 18 bp, Homo sapiens
aatgtagataagtgttct

SEQ ID NO: 2428129 - DNA, 19 bp, Homo sapiens
aatgtaggcttagtttgtg

SEQ ID NO: 2428130 - DNA, 22 bp, Homo sapiens
aatgtaggcttagtttgtgtgt

SEQ ID NO: 2428131 - DNA, 14 bp, Homo sapiens
aatgtatatgcact

SEQ ID NO: 2428132 - DNA, 19 bp, Homo sapiens
aatgtatgcatgttgtcta

SEQ ID NO: 2428133 - DNA, 19 bp, Homo sapiens
aatgtattttatgttatat

SEQ ID NO: 2428134 - DNA, 16 bp, Homo sapiens
aatgtcatgctgcctt

SEQ ID NO: 2428135 - DNA, 20 bp, Homo sapiens
aatgtctggagaccaccagg

SEQ ID NO: 2428136 - DNA, 20 bp, Homo sapiens
aatgtcttgatgcatgcact

SEQ ID NO: 2428137 - DNA, 11 bp, Homo sapiens
aatgtcttgtg

SEQ ID NO: 2428138 - DNA, 13 bp, Homo sapiens
aatgtcttgtgtt

SEQ ID NO: 2428139 - DNA, 21 bp, Homo sapiens
aatgtctttaatgcaatatac

SEQ ID NO: 2428140 - DNA, 22 bp, Homo sapiens
aatgtgaaaatggtccaggaga

SEQ ID NO: 2428141 - DNA, 13 bp, Homo sapiens
aatgtgatgttct

SEQ ID NO: 2428142 - DNA, 15 bp, Homo sapiens
aatgtgatgttctaa

SEQ ID NO: 2428143 - DNA, 21 bp, Homo sapiens
aatgtgcctattgctagagct

SEQ ID NO: 2428144 - DNA, 16 bp, Homo sapiens
aatgtggcttgagaaa

SEQ ID NO: 2428145 - DNA, 21 bp, Homo sapiens
aatgtgtagttcatgtaaata

SEQ ID NO: 2428146 - DNA, 14 bp, Homo sapiens
aatgtgtctttaga

SEQ ID NO: 2428147 - DNA, 15 bp, Homo sapiens
aatgtgtctttagat

SEQ ID NO: 2428148 - DNA, 13 bp, Homo sapiens
aatgtgtgtatat

SEQ ID NO: 2428149 - DNA, 16 bp, Homo sapiens
aatgttaaaatgtgtt

SEQ ID NO: 2428150 - DNA, 15 bp, Homo sapiens
aatgttacattatta

SEQ ID NO: 2428151 - DNA, 17 bp, Homo sapiens
aatgttatcttctcaag

SEQ ID NO: 2428152 - DNA, 20 bp, Homo sapiens
aatgttattttttaattatt

SEQ ID NO: 2428153 - DNA, 13 bp, Homo sapiens
aatgttctaagtt

SEQ ID NO: 2428154 - DNA, 20 bp, Homo sapiens
aatgttctaagtttctaaga

SEQ ID NO: 2428155 - DNA, 11 bp, Homo sapiens
aatgttctttg

SEQ ID NO: 2428156 - DNA, 15 bp, Homo sapiens
aatgttgaaatatga

SEQ ID NO: 2428157 - DNA, 13 bp, Homo sapiens
aatgttgggactg

SEQ ID NO: 2428158 - DNA, 13 bp, Homo sapiens
aatgtttaaaaca

SEQ ID NO: 2428159 - DNA, 15 bp, Homo sapiens
aatgtttaaaccttt

SEQ ID NO: 2428160 - DNA, 20 bp, Homo sapiens
aatgtttacactctttgtaa

SEQ ID NO: 2428161 - DNA, 13 bp, Homo sapiens
aatgttttttgcc

SEQ ID NO: 2428162 - DNA, 15 bp, Homo sapiens
aatgttttttgccac

SEQ ID NO: 2428163 - DNA, 21 bp, Homo sapiens
aattaaaaaaaaagatctgtt

SEQ ID NO: 2428164 - DNA, 21 bp, Homo sapiens
aattaaaagcaaatcatttgt

SEQ ID NO: 2428165 - DNA, 19 bp, Homo sapiens
aattaaacttttaattcat

SEQ ID NO: 2428166 - DNA, 14 bp, Homo sapiens
aattaagaaggcaa

SEQ ID NO: 2428167 - DNA, 21 bp, Homo sapiens
aattaccatgcttcacaatgt

SEQ ID NO: 2428168 - DNA, 14 bp, Homo sapiens
aattacctgtggat

SEQ ID NO: 2428169 - DNA, 23 bp, Homo sapiens
aattactgtttattaaagtacaa

SEQ ID NO: 2428170 - DNA, 15 bp, Homo sapiens
aattagactgtgatt

SEQ ID NO: 2428171 - DNA, 19 bp, Homo sapiens
aattagactgtgattcaga

SEQ ID NO: 2428172 - DNA, 21 bp, Homo sapiens
aattaggcccccatcatcctc

SEQ ID NO: 2428173 - DNA, 15 bp, Homo sapiens
aattaggctgtaact

SEQ ID NO: 2428174 - DNA, 22 bp, Homo sapiens
aattaggctgtaactactttat

SEQ ID NO: 2428175 - DNA, 12 bp, Homo sapiens
aattagtttcct

SEQ ID NO: 2428176 - DNA, 13 bp, Homo sapiens
aattagtttcctt

SEQ ID NO: 2428177 - DNA, 19 bp, Homo sapiens
aattataactggaaagaag

SEQ ID NO: 2428178 - DNA, 17 bp, Homo sapiens
aattatagtttctgagg

SEQ ID NO: 2428179 - DNA, 19 bp, Homo sapiens
aattatataactgtatttg

SEQ ID NO: 2428180 - DNA, 21 bp, Homo sapiens
aattatataactgtatttgaa

SEQ ID NO: 2428181 - DNA, 14 bp, Homo sapiens
aattatatgttgta

SEQ ID NO: 2428182 - DNA, 13 bp, Homo sapiens
aattatccaggaa

SEQ ID NO: 2428183 - DNA, 14 bp, Homo sapiens
aattatctaattta

SEQ ID NO: 2428184 - DNA, 18 bp, Homo sapiens
aattatcttttcaaaggt

SEQ ID NO: 2428185 - DNA, 15 bp, Homo sapiens
aattatgtaaattat

SEQ ID NO: 2428186 - DNA, 17 bp, Homo sapiens
aattatgtaaattatca

SEQ ID NO: 2428187 - DNA, 17 bp, Homo sapiens
aattatgtaaattatgt

SEQ ID NO: 2428188 - DNA, 13 bp, Homo sapiens
aattatgtagctc

SEQ ID NO: 2428189 - DNA, 16 bp, Homo sapiens
aattattaatgaaaat

SEQ ID NO: 2428190 - DNA, 14 bp, Homo sapiens
aattattacagtgt

SEQ ID NO: 2428191 - DNA, 15 bp, Homo sapiens
aattattatttgtgt

SEQ ID NO: 2428192 - DNA, 16 bp, Homo sapiens
aattattgtttttctt

SEQ ID NO: 2428193 - DNA, 22 bp, Homo sapiens
aattatttaaaccgctaaaaga

SEQ ID NO: 2428194 - DNA, 22 bp, Homo sapiens
aattcaaaagttccaagagtct

SEQ ID NO: 2428195 - DNA, 16 bp, Homo sapiens
aattcaaggaatttct

SEQ ID NO: 2428196 - DNA, 17 bp, Homo sapiens
aattcaaggaatttctt

SEQ ID NO: 2428197 - DNA, 22 bp, Homo sapiens
aattcacatctaacctcatctt

SEQ ID NO: 2428198 - DNA, 23 bp, Homo sapiens
aattcactctgagtgttttatga

SEQ ID NO: 2428199 - DNA, 22 bp, Homo sapiens
acagggataaggcctgtggggg

SEQ ID NO: 2428200 - DNA, 16 bp, Homo sapiens
acagggcgggggtggc

SEQ ID NO: 2428201 - DNA, 17 bp, Homo sapiens
acagggggtctggctgg

SEQ ID NO: 2428202 - DNA, 21 bp, Homo sapiens
acagggggtctggctggtgtt

SEQ ID NO: 2428203 - DNA, 21 bp, Homo sapiens
acagggtccccgagtgcctag

SEQ ID NO: 2428204 - DNA, 22 bp, Homo sapiens
acagggtctgctctttctctgc

SEQ ID NO: 2428205 - DNA, 18 bp, Homo sapiens
acaggttataacagtgtt

SEQ ID NO: 2428206 - DNA, 16 bp, Homo sapiens
acagtaaaccactgaa

SEQ ID NO: 2428207 - DNA, 19 bp, Homo sapiens
acagtaaaccactgaaaaa

SEQ ID NO: 2428208 - DNA, 21 bp, Homo sapiens
acagtatgggggttgtaaatt

SEQ ID NO: 2428209 - DNA, 22 bp, Homo sapiens
acagtatgggggttgtaaattg

SEQ ID NO: 2428210 - DNA, 12 bp, Homo sapiens
acagtattgctc

SEQ ID NO: 2428211 - DNA, 16 bp, Homo sapiens
acagtattgctcaccc

SEQ ID NO: 2428212 - DNA, 17 bp, Homo sapiens
acagtatttgtaattaa

SEQ ID NO: 2428213 - DNA, 18 bp, Homo sapiens
acagtccctatggaaaga

SEQ ID NO: 2428214 - DNA, 21 bp, Homo sapiens
acagtgaagacagaagtttgc

SEQ ID NO: 2428215 - DNA, 18 bp, Homo sapiens
acagtgatattggaactt

SEQ ID NO: 2428216 - DNA, 15 bp, Homo sapiens
acagtgctcttttct

SEQ ID NO: 2428217 - DNA, 16 bp, Homo sapiens
acagtgctcttttctc

SEQ ID NO: 2428218 - DNA, 15 bp, Homo sapiens
acagtggatcacaaa

SEQ ID NO: 2428219 - DNA, 17 bp, Homo sapiens
acagtggatcacaaagt

SEQ ID NO: 2428220 - DNA, 21 bp, Homo sapiens
acagtggctcacgcctgtaat

SEQ ID NO: 2428221 - DNA, 11 bp, Homo sapiens
acagtgtcttt

SEQ ID NO: 2428222 - DNA, 12 bp, Homo sapiens
acagtgtctttt

SEQ ID NO: 2428223 - DNA, 19 bp, Homo sapiens
acagtgtctttttttgtat

SEQ ID NO: 2428224 - DNA, 18 bp, Homo sapiens
acagtgtttatcctttca

SEQ ID NO: 2428225 - DNA, 20 bp, Homo sapiens
acagtgtttatcctttcata

SEQ ID NO: 2428226 - DNA, 21 bp, Homo sapiens
acagttctgctctggttgttt

SEQ ID NO: 2428227 - DNA, 18 bp, Homo sapiens
acagttctttgggccaga

SEQ ID NO: 2428228 - DNA, 22 bp, Homo sapiens
acagttctttgggccagacatg

SEQ ID NO: 2428229 - DNA, 12 bp, Homo sapiens
acagttgtattt

SEQ ID NO: 2428230 - DNA, 13 bp, Homo sapiens
acagttgtattta

SEQ ID NO: 2428231 - DNA, 18 bp, Homo sapiens
acagttgtatttaacaga

SEQ ID NO: 2428232 - DNA, 13 bp, Homo sapiens
acagtttgaaata

SEQ ID NO: 2428233 - DNA, 20 bp, Homo sapiens
acagtttgaaataagctatt

SEQ ID NO: 2428234 - DNA, 13 bp, Homo sapiens
acagttttaactg

SEQ ID NO: 2428235 - DNA, 21 bp, Homo sapiens
acagttttaactgtggatatt

SEQ ID NO: 2428236 - DNA, 12 bp, Homo sapiens
acataaaggaaa

SEQ ID NO: 2428237 - DNA, 17 bp, Homo sapiens
acataaaggaaaagaca

SEQ ID NO: 2428238 - DNA, 22 bp, Homo sapiens
acataaaggaaaagacacattt

SEQ ID NO: 2428239 - DNA, 15 bp, Homo sapiens
acataaagttgataa

SEQ ID NO: 2428240 - DNA, 15 bp, Homo sapiens
acataagccattatt

SEQ ID NO: 2428241 - DNA, 17 bp, Homo sapiens
acataagctatttttct

SEQ ID NO: 2428242 - DNA, 20 bp, Homo sapiens
acataattcactctgagtgt

SEQ ID NO: 2428243 - DNA, 12 bp, Homo sapiens
acatactcattt

SEQ ID NO: 2428244 - DNA, 17 bp, Homo sapiens
acatagacagaagaaac

SEQ ID NO: 2428245 - DNA, 18 bp, Homo sapiens
acatagacagaagaaaca

SEQ ID NO: 2428246 - DNA, 19 bp, Homo sapiens
acatagagccgggtgtccc

SEQ ID NO: 2428247 - DNA, 19 bp, Homo sapiens
acatagcccacttacattt

SEQ ID NO: 2428248 - DNA, 19 bp, Homo sapiens
acatagtattcatgactat

SEQ ID NO: 2428249 - DNA, 23 bp, Homo sapiens
acatataatgttgttatttaaag

SEQ ID NO: 2428250 - DNA, 16 bp, Homo sapiens
acatatgatctgtctg

SEQ ID NO: 2428251 - DNA, 12 bp, Homo sapiens
acatcagccctt

SEQ ID NO: 2428252 - DNA, 18 bp, Homo sapiens
acatcattactataagaa

SEQ ID NO: 2428253 - DNA, 21 bp, Homo sapiens
acatcattactataagaactt

SEQ ID NO: 2428254 - DNA, 15 bp, Homo sapiens
acatcattcattttt

SEQ ID NO: 2428255 - DNA, 16 bp, Homo sapiens
acatccaaagcagaca

SEQ ID NO: 2428256 - DNA, 18 bp, Homo sapiens
acatccaaagcagacagc

SEQ ID NO: 2428257 - DNA, 14 bp, Homo sapiens
acatcccactgcca

SEQ ID NO: 2428258 - DNA, 21 bp, Homo sapiens
acatccctgggcctgctgctg

SEQ ID NO: 2428259 - DNA, 17 bp, Homo sapiens
acatctaacctcatctt

SEQ ID NO: 2428260 - DNA, 23 bp, Homo sapiens
acatctattttggattgtatatt

SEQ ID NO: 2428261 - DNA, 23 bp, Homo sapiens
acatctcccttttccatgactgt

SEQ ID NO: 2428262 - DNA, 20 bp, Homo sapiens
acatgaacttagattttaca

SEQ ID NO: 2428263 - DNA, 15 bp, Homo sapiens
acatgaagattcttt

SEQ ID NO: 2428264 - DNA, 17 bp, Homo sapiens
acatgaagattctttcc

SEQ ID NO: 2428265 - DNA, 18 bp, Homo sapiens
acatgaagattctttccc

SEQ ID NO: 2428266 - DNA, 16 bp, Homo sapiens
acatgaaggtaaataa

SEQ ID NO: 2428267 - DNA, 21 bp, Homo sapiens
acatgaaggtaaataaaaaga

SEQ ID NO: 2428268 - DNA, 14 bp, Homo sapiens
acatgaagtatttt

SEQ ID NO: 2428269 - DNA, 21 bp, Homo sapiens
acatgaattattacagtgttt

SEQ ID NO: 2428270 - DNA, 19 bp, Homo sapiens
acatgaattttagcttttg

SEQ ID NO: 2428271 - DNA, 22 bp, Homo sapiens
acatgaggactctattctttaa

SEQ ID NO: 2428272 - DNA, 15 bp, Homo sapiens
acatgaggccactgg

SEQ ID NO: 2428273 - DNA, 17 bp, Homo sapiens
acatgatttccttgaat

SEQ ID NO: 2428274 - DNA, 21 bp, Homo sapiens
acatgatttccttgaatgtgg

SEQ ID NO: 2428275 - DNA, 14 bp, Homo sapiens
acatgccacaagga

SEQ ID NO: 2428276 - DNA, 21 bp, Homo sapiens
acatgccatttgtactgaccc

SEQ ID NO: 2428277 - DNA, 18 bp, Homo sapiens
acatgcggtagccagcac

SEQ ID NO: 2428278 - DNA, 20 bp, Homo sapiens
acatgcggtagccagcacac

SEQ ID NO: 2428279 - DNA, 23 bp, Homo sapiens
acatgcggtagccagcacacagg

SEQ ID NO: 2428280 - DNA, 19 bp, Homo sapiens
acatgctaagagaagtaga

SEQ ID NO: 2428281 - DNA, 23 bp, Homo sapiens
acatgcttagcagtccccttccc

SEQ ID NO: 2428282 - DNA, 15 bp, Homo sapiens
acatgcttattccat

SEQ ID NO: 2428283 - DNA, 17 bp, Homo sapiens
acatgcttattccatga

SEQ ID NO: 2428284 - DNA, 22 bp, Homo sapiens
acatgcttattccatgactgct

SEQ ID NO: 2428285 - DNA, 23 bp, Homo sapiens
acatgggagccgggtctgcctct

SEQ ID NO: 2428286 - DNA, 23 bp, Homo sapiens
acatggtgctgggagaggcagcc

SEQ ID NO: 2428287 - DNA, 19 bp, Homo sapiens
acatggtgggtccatgggc

SEQ ID NO: 2428288 - DNA, 17 bp, Homo sapiens
acatgtaggaagtagga

SEQ ID NO: 2428289 - DNA, 18 bp, Homo sapiens
acatgtattgcacattgt

SEQ ID NO: 2428290 - DNA, 21 bp, Homo sapiens
acatgtattgcacattgtaaa

SEQ ID NO: 2428291 - DNA, 12 bp, Homo sapiens
acatgtcaatct

SEQ ID NO: 2428292 - DNA, 18 bp, Homo sapiens
acatgtcagtaccttcaa

SEQ ID NO: 2428293 - DNA, 19 bp, Homo sapiens
acatgtcagtaccttcaaa

SEQ ID NO: 2428294 - DNA, 14 bp, Homo sapiens
acatgtgaaaagaa

SEQ ID NO: 2428295 - DNA, 20 bp, Homo sapiens
acatgtgttaagtattttca

SEQ ID NO: 2428296 - DNA, 18 bp, Homo sapiens
acattaatagcagccttt

SEQ ID NO: 2428297 - DNA, 19 bp, Homo sapiens
acattaatagcagcctttc

SEQ ID NO: 2428298 - DNA, 20 bp, Homo sapiens
acattatatttctattttat

SEQ ID NO: 2428299 - DNA, 20 bp, Homo sapiens
acattcacctgccccaactc

SEQ ID NO: 2428300 - DNA, 17 bp, Homo sapiens
acattcctcatgaatgt

SEQ ID NO: 2428301 - DNA, 18 bp, Homo sapiens
acattcctcatgaatgta

SEQ ID NO: 2428302 - DNA, 17 bp, Homo sapiens
acccagccccagccagg

SEQ ID NO: 2428303 - DNA, 15 bp, Homo sapiens
acccagccctcatcc

SEQ ID NO: 2428304 - DNA, 20 bp, Homo sapiens
acccagctcccttcttccct

SEQ ID NO: 2428305 - DNA, 12 bp, Homo sapiens
acccagggctct

SEQ ID NO: 2428306 - DNA, 21 bp, Homo sapiens
acccaggggcagccccaggcc

SEQ ID NO: 2428307 - DNA, 14 bp, Homo sapiens
acccaggtctccct

SEQ ID NO: 2428308 - DNA, 14 bp, Homo sapiens
acccagtgccctct

SEQ ID NO: 2428309 - DNA, 22 bp, Homo sapiens
acccagtgccctctcccctcag

SEQ ID NO: 2428310 - DNA, 23 bp, Homo sapiens
acccagtttctaaactggagact

SEQ ID NO: 2428311 - DNA, 20 bp, Homo sapiens
acccatattgtaaaacaggt

SEQ ID NO: 2428312 - DNA, 15 bp, Homo sapiens
acccatcaacaaaaa

SEQ ID NO: 2428313 - DNA, 18 bp, Homo sapiens
accccaaacaccttccag

SEQ ID NO: 2428314 - DNA, 18 bp, Homo sapiens
accccaaagctttcctgc

SEQ ID NO: 2428315 - DNA, 13 bp, Homo sapiens
accccaacctgct

SEQ ID NO: 2428316 - DNA, 13 bp, Homo sapiens
accccaatcctcc

SEQ ID NO: 2428317 - DNA, 20 bp, Homo sapiens
accccaatttcggatttttt

SEQ ID NO: 2428318 - DNA, 21 bp, Homo sapiens
accccaatttcggattttttc

SEQ ID NO: 2428319 - DNA, 21 bp, Homo sapiens
accccacctttattccttcat

SEQ ID NO: 2428320 - DNA, 16 bp, Homo sapiens
accccacgccttatcc

SEQ ID NO: 2428321 - DNA, 12 bp, Homo sapiens
accccactccca

SEQ ID NO: 2428322 - DNA, 20 bp, Homo sapiens
accccaggctgaagcaggtt

SEQ ID NO: 2428323 - DNA, 11 bp, Homo sapiens
accccagggca

SEQ ID NO: 2428324 - DNA, 19 bp, Homo sapiens
accccagggcacaggagct

SEQ ID NO: 2428325 - DNA, 15 bp, Homo sapiens
accccagggcagcca

SEQ ID NO: 2428326 - DNA, 21 bp, Homo sapiens
accccagggcagccagggaga

SEQ ID NO: 2428327 - DNA, 23 bp, Homo sapiens
accccagggctgtaactgccagg

SEQ ID NO: 2428328 - DNA, 23 bp, Homo sapiens
accccatcacctactcacacagg

SEQ ID NO: 2428329 - DNA, 13 bp, Homo sapiens
accccattcccgc

SEQ ID NO: 2428330 - DNA, 15 bp, Homo sapiens
accccattcccgcag

SEQ ID NO: 2428331 - DNA, 13 bp, Homo sapiens
acccccagcctgg

SEQ ID NO: 2428332 - DNA, 14 bp, Homo sapiens
acccccagcctggg

SEQ ID NO: 2428333 - DNA, 12 bp, Homo sapiens
acccccagctca

SEQ ID NO: 2428334 - DNA, 11 bp, Homo sapiens
acccccctctg

SEQ ID NO: 2428335 - DNA, 14 bp, Homo sapiens
acccccctgtacac

SEQ ID NO: 2428336 - DNA, 17 bp, Homo sapiens
acccccgtcaagagtga

SEQ ID NO: 2428337 - DNA, 17 bp, Homo sapiens
accccctcacccctcca

SEQ ID NO: 2428338 - DNA, 13 bp, Homo sapiens
accccctgcagct

SEQ ID NO: 2428339 - DNA, 15 bp, Homo sapiens
accccctgcagcttg

SEQ ID NO: 2428340 - DNA, 15 bp, Homo sapiens
accccgcagacacct

SEQ ID NO: 2428341 - DNA, 23 bp, Homo sapiens
accccggggtgcccacaggccgc

SEQ ID NO: 2428342 - DNA, 12 bp, Homo sapiens
acccctcccctc

SEQ ID NO: 2428343 - DNA, 13 bp, Homo sapiens
acccctcccctcc

SEQ ID NO: 2428344 - DNA, 19 bp, Homo sapiens
acccctcccctccatccct

SEQ ID NO: 2428345 - DNA, 22 bp, Homo sapiens
acccctgcattggaactggagg

SEQ ID NO: 2428346 - DNA, 15 bp, Homo sapiens
acccctgtaggcctc

SEQ ID NO: 2428347 - DNA, 14 bp, Homo sapiens
acccctttcccacc

SEQ ID NO: 2428348 - DNA, 16 bp, Homo sapiens
acccgaggctgagaat

SEQ ID NO: 2428349 - DNA, 18 bp, Homo sapiens
acccgtgccaagtccagg

SEQ ID NO: 2428350 - DNA, 21 bp, Homo sapiens
acccgtgccaagtccaggtcc

SEQ ID NO: 2428351 - DNA, 17 bp, Homo sapiens
acccgtggaggctgctc

SEQ ID NO: 2428352 - DNA, 18 bp, Homo sapiens
acccgtgtctagaggcag

SEQ ID NO: 2428353 - DNA, 16 bp, Homo sapiens
acccgttcatggggga

SEQ ID NO: 2428354 - DNA, 17 bp, Homo sapiens
accctagccttgcttgt

SEQ ID NO: 2428355 - DNA, 15 bp, Homo sapiens
accctagttctacct

SEQ ID NO: 2428356 - DNA, 15 bp, Homo sapiens
accctcactggctct

SEQ ID NO: 2428357 - DNA, 22 bp, Homo sapiens
accctcactggctctcctggcc

SEQ ID NO: 2428358 - DNA, 18 bp, Homo sapiens
accctcagggcaaagcca

SEQ ID NO: 2428359 - DNA, 21 bp, Homo sapiens
accctcagggcaaagccaggt

SEQ ID NO: 2428360 - DNA, 13 bp, Homo sapiens
accctcctggctc

SEQ ID NO: 2428361 - DNA, 16 bp, Homo sapiens
accctctcagctccag

SEQ ID NO: 2428362 - DNA, 16 bp, Homo sapiens
accctgacctggcccc

SEQ ID NO: 2428363 - DNA, 22 bp, Homo sapiens
accctgagctgaggcagcagtg

SEQ ID NO: 2428364 - DNA, 23 bp, Homo sapiens
accctgagctgaggcagcagtgt

SEQ ID NO: 2428365 - DNA, 22 bp, Homo sapiens
accctgatttaggagaagccag

SEQ ID NO: 2428366 - DNA, 16 bp, Homo sapiens
accctgcctctcccag

SEQ ID NO: 2428367 - DNA, 18 bp, Homo sapiens
accctgccttatcttgca

SEQ ID NO: 2428368 - DNA, 19 bp, Homo sapiens
accctggcccctctccctt

SEQ ID NO: 2428369 - DNA, 18 bp, Homo sapiens
accctggccgagtccaag

SEQ ID NO: 2428370 - DNA, 19 bp, Homo sapiens
accctggccgccccctgcc

SEQ ID NO: 2428371 - DNA, 15 bp, Homo sapiens
accctggctccttgt

SEQ ID NO: 2428372 - DNA, 15 bp, Homo sapiens
accctgggccctggg

SEQ ID NO: 2428373 - DNA, 18 bp, Homo sapiens
accctgggccctgggctg

SEQ ID NO: 2428374 - DNA, 22 bp, Homo sapiens
accctgggccctgggctggaat

SEQ ID NO: 2428375 - DNA, 13 bp, Homo sapiens
accctgttcctgc

SEQ ID NO: 2428376 - DNA, 16 bp, Homo sapiens
accctgttcctgctgc

SEQ ID NO: 2428377 - DNA, 18 bp, Homo sapiens
accctgttcctgctgctg

SEQ ID NO: 2428378 - DNA, 13 bp, Homo sapiens
acccttacagtag

SEQ ID NO: 2428379 - DNA, 15 bp, Homo sapiens
acccttctcccactc

SEQ ID NO: 2428380 - DNA, 16 bp, Homo sapiens
acccttctcccactct

SEQ ID NO: 2428381 - DNA, 20 bp, Homo sapiens
acccttctcccactctccta

SEQ ID NO: 2428382 - DNA, 22 bp, Homo sapiens
accctttgctgtgaggctgtcc

SEQ ID NO: 2428383 - DNA, 23 bp, Homo sapiens
accctttgctgtgaggctgtcct

SEQ ID NO: 2428384 - DNA, 19 bp, Homo sapiens
acccttttgggtttctgcc

SEQ ID NO: 2428385 - DNA, 17 bp, Homo sapiens
accctttttctccagct

SEQ ID NO: 2428386 - DNA, 15 bp, Homo sapiens
accgaatgtgtcttt

SEQ ID NO: 2428387 - DNA, 16 bp, Homo sapiens
accgaatgtgtcttta

SEQ ID NO: 2428388 - DNA, 21 bp, Homo sapiens
accgccagctctgttcttcct

SEQ ID NO: 2428389 - DNA, 12 bp, Homo sapiens
accgccccctcc

SEQ ID NO: 2428390 - DNA, 20 bp, Homo sapiens
accgcgactaatttcaaaat

SEQ ID NO: 2428391 - DNA, 18 bp, Homo sapiens
accgcgtctaccctggga

SEQ ID NO: 2428392 - DNA, 14 bp, Homo sapiens
accgctacaccact

SEQ ID NO: 2428393 - DNA, 17 bp, Homo sapiens
accgctacaccactctg

SEQ ID NO: 2428394 - DNA, 15 bp, Homo sapiens
accggaccagcctgg

SEQ ID NO: 2428395 - DNA, 16 bp, Homo sapiens
accggaccagcctggc

SEQ ID NO: 2428396 - DNA, 19 bp, Homo sapiens
accggagagtgggggtggg

SEQ ID NO: 2428397 - DNA, 13 bp, Homo sapiens
accggcctgccag

SEQ ID NO: 2428398 - DNA, 15 bp, Homo sapiens
accggcctgccagga

SEQ ID NO: 2428399 - DNA, 17 bp, Homo sapiens
accggcctgccaggagg

SEQ ID NO: 2428400 - DNA, 14 bp, Homo sapiens
accggctctcacct

SEQ ID NO: 2428401 - DNA, 21 bp, Homo sapiens
accgggccactccttcctgcc

SEQ ID NO: 2428402 - DNA, 14 bp, Homo sapiens
accggtggggctgg

SEQ ID NO: 2428403 - DNA, 16 bp, Homo sapiens
accgtggcccttcctg

SEQ ID NO: 2428404 - DNA, 19 bp, Homo sapiens
accgtggcccttcctggac

SEQ ID NO: 2428405 - DNA, 16 bp, Homo sapiens
accgtgggcagggagc

SEQ ID NO: 2428406 - DNA, 19 bp, Homo sapiens
actgtttgtttacaaaatc

SEQ ID NO: 2428407 - DNA, 16 bp, Homo sapiens
acttaaagctttcaga

SEQ ID NO: 2428408 - DNA, 13 bp, Homo sapiens
acttaatgtatgt

SEQ ID NO: 2428409 - DNA, 15 bp, Homo sapiens
acttacatcatgtgt

SEQ ID NO: 2428410 - DNA, 14 bp, Homo sapiens
acttactctaagat

SEQ ID NO: 2428411 - DNA, 14 bp, Homo sapiens
acttacttgcttat

SEQ ID NO: 2428412 - DNA, 16 bp, Homo sapiens
acttacttgcttattt

SEQ ID NO: 2428413 - DNA, 18 bp, Homo sapiens
acttagattttacatgaa

SEQ ID NO: 2428414 - DNA, 16 bp, Homo sapiens
acttagctagttttat

SEQ ID NO: 2428415 - DNA, 23 bp, Homo sapiens
acttagggcaccaggggtttctc

SEQ ID NO: 2428416 - DNA, 17 bp, Homo sapiens
acttataattttcctaa

SEQ ID NO: 2428417 - DNA, 21 bp, Homo sapiens
acttatagcctctgtctggca

SEQ ID NO: 2428418 - DNA, 15 bp, Homo sapiens
acttatttaaactct

SEQ ID NO: 2428419 - DNA, 18 bp, Homo sapiens
acttcaaactactttgct

SEQ ID NO: 2428420 - DNA, 19 bp, Homo sapiens
acttcaagcatggctattt

SEQ ID NO: 2428421 - DNA, 22 bp, Homo sapiens
acttcagtttcacagaaaataa

SEQ ID NO: 2428422 - DNA, 21 bp, Homo sapiens
acttccacagggtcccacagc

SEQ ID NO: 2428423 - DNA, 17 bp, Homo sapiens
acttcctcctccccact

SEQ ID NO: 2428424 - DNA, 18 bp, Homo sapiens
acttcctcctccccactt

SEQ ID NO: 2428425 - DNA, 22 bp, Homo sapiens
acttcctctcgcggccctcagt

SEQ ID NO: 2428426 - DNA, 18 bp, Homo sapiens
acttcctgtccagctcca

SEQ ID NO: 2428427 - DNA, 21 bp, Homo sapiens
acttctctttgcctcaaataa

SEQ ID NO: 2428428 - DNA, 14 bp, Homo sapiens
acttctgacagcct

SEQ ID NO: 2428429 - DNA, 21 bp, Homo sapiens
acttctgtaattgtgtggatt

SEQ ID NO: 2428430 - DNA, 17 bp, Homo sapiens
acttcttatggaattga

SEQ ID NO: 2428431 - DNA, 21 bp, Homo sapiens
acttcttatggaattgatttg

SEQ ID NO: 2428432 - DNA, 20 bp, Homo sapiens
acttcttgaaggtgctgacg

SEQ ID NO: 2428433 - DNA, 19 bp, Homo sapiens
acttcttgctggtctagtc

SEQ ID NO: 2428434 - DNA, 15 bp, Homo sapiens
acttcttgtgtgtat

SEQ ID NO: 2428435 - DNA, 17 bp, Homo sapiens
acttgaacgttttctaa

SEQ ID NO: 2428436 - DNA, 17 bp, Homo sapiens
acttgaagggccagagc

SEQ ID NO: 2428437 - DNA, 20 bp, Homo sapiens
acttgaagggccagagccag

SEQ ID NO: 2428438 - DNA, 13 bp, Homo sapiens
acttgaatgaaaa

SEQ ID NO: 2428439 - DNA, 14 bp, Homo sapiens
acttgaccctgagc

SEQ ID NO: 2428440 - DNA, 15 bp, Homo sapiens
acttgaccctgagct

SEQ ID NO: 2428441 - DNA, 12 bp, Homo sapiens
acttgagcatgt

SEQ ID NO: 2428442 - DNA, 18 bp, Homo sapiens
acttgatccatttctaat

SEQ ID NO: 2428443 - DNA, 20 bp, Homo sapiens
acttgctcaggtacttgtaa

SEQ ID NO: 2428444 - DNA, 22 bp, Homo sapiens
acttgctcaggtacttgtaaat

SEQ ID NO: 2428445 - DNA, 19 bp, Homo sapiens
acttgcttatcaacttcct

SEQ ID NO: 2428446 - DNA, 15 bp, Homo sapiens
acttggagggcccag

SEQ ID NO: 2428447 - DNA, 18 bp, Homo sapiens
acttggatacttggattt

SEQ ID NO: 2428448 - DNA, 16 bp, Homo sapiens
acttggattctttcca

SEQ ID NO: 2428449 - DNA, 17 bp, Homo sapiens
acttggattctttccat

SEQ ID NO: 2428450 - DNA, 18 bp, Homo sapiens
acttggattctttccatt

SEQ ID NO: 2428451 - DNA, 17 bp, Homo sapiens
acttggcagccttgtga

SEQ ID NO: 2428452 - DNA, 20 bp, Homo sapiens
acttggctcgaatctctgtg

SEQ ID NO: 2428453 - DNA, 23 bp, Homo sapiens
acttggctcgaatctctgtgcct

SEQ ID NO: 2428454 - DNA, 13 bp, Homo sapiens
acttggctggtgt

SEQ ID NO: 2428455 - DNA, 17 bp, Homo sapiens
acttgggcacccccagc

SEQ ID NO: 2428456 - DNA, 20 bp, Homo sapiens
acttgggcacccccagcctg

SEQ ID NO: 2428457 - DNA, 23 bp, Homo sapiens
acttgggcacccccagcctgggc

SEQ ID NO: 2428458 - DNA, 20 bp, Homo sapiens
acttgggggttcaggcccgg

SEQ ID NO: 2428459 - DNA, 13 bp, Homo sapiens
acttgtaaatata

SEQ ID NO: 2428460 - DNA, 14 bp, Homo sapiens
acttgtaaatataa

SEQ ID NO: 2428461 - DNA, 15 bp, Homo sapiens
acttgtaattatgga

SEQ ID NO: 2428462 - DNA, 21 bp, Homo sapiens
acttgtccttagcctggacct

SEQ ID NO: 2428463 - DNA, 21 bp, Homo sapiens
acttgtgccctccctgtcctt

SEQ ID NO: 2428464 - DNA, 13 bp, Homo sapiens
acttgttttggat

SEQ ID NO: 2428465 - DNA, 16 bp, Homo sapiens
acttgttttggatgcc

SEQ ID NO: 2428466 - DNA, 12 bp, Homo sapiens
actttaaagcgt

SEQ ID NO: 2428467 - DNA, 23 bp, Homo sapiens
actttaacataagctatttttct

SEQ ID NO: 2428468 - DNA, 16 bp, Homo sapiens
actttagaagcctgca

SEQ ID NO: 2428469 - DNA, 13 bp, Homo sapiens
actttatcactta

SEQ ID NO: 2428470 - DNA, 13 bp, Homo sapiens
actttatgtagtt

SEQ ID NO: 2428471 - DNA, 13 bp, Homo sapiens
actttcagctgtc

SEQ ID NO: 2428472 - DNA, 15 bp, Homo sapiens
actttcagctgtctt

SEQ ID NO: 2428473 - DNA, 14 bp, Homo sapiens
actttccattacaa

SEQ ID NO: 2428474 - DNA, 23 bp, Homo sapiens
actttccccaccagatgctgaaa

SEQ ID NO: 2428475 - DNA, 14 bp, Homo sapiens
actttccctctggg

SEQ ID NO: 2428476 - DNA, 22 bp, Homo sapiens
actttcttttttttctatttca

SEQ ID NO: 2428477 - DNA, 23 bp, Homo sapiens
actttcttttttttctatttcac

SEQ ID NO: 2428478 - DNA, 14 bp, Homo sapiens
actttgaagttagc

SEQ ID NO: 2428479 - DNA, 12 bp, Homo sapiens
actttgaatgtg

SEQ ID NO: 2428480 - DNA, 18 bp, Homo sapiens
actttgacagtgttttta

SEQ ID NO: 2428481 - DNA, 20 bp, Homo sapiens
actttgacctaaattattta

SEQ ID NO: 2428482 - DNA, 20 bp, Homo sapiens
actttgctaaagacatgaag

SEQ ID NO: 2428483 - DNA, 17 bp, Homo sapiens
actttgctttaatataa

SEQ ID NO: 2428484 - DNA, 18 bp, Homo sapiens
actttgctttaatataaa

SEQ ID NO: 2428485 - DNA, 16 bp, Homo sapiens
actttggaaccagact

SEQ ID NO: 2428486 - DNA, 21 bp, Homo sapiens
actttggaaccagactcttgc

SEQ ID NO: 2428487 - DNA, 23 bp, Homo sapiens
actttggaaccagactcttgcct

SEQ ID NO: 2428488 - DNA, 16 bp, Homo sapiens
actttggtaccagata

SEQ ID NO: 2428489 - DNA, 19 bp, Homo sapiens
actttggtaccagataact

SEQ ID NO: 2428490 - DNA, 20 bp, Homo sapiens
actttgtcgcccaggctgga

SEQ ID NO: 2428491 - DNA, 18 bp, Homo sapiens
actttgtgcattctggat

SEQ ID NO: 2428492 - DNA, 15 bp, Homo sapiens
acttttactctgcct

SEQ ID NO: 2428493 - DNA, 21 bp, Homo sapiens
acttttactctgcctacagaa

SEQ ID NO: 2428494 - DNA, 15 bp, Homo sapiens
acttttcccactcca

SEQ ID NO: 2428495 - DNA, 11 bp, Homo sapiens
acttttctgta

SEQ ID NO: 2428496 - DNA, 12 bp, Homo sapiens
acttttgacaaa

SEQ ID NO: 2428497 - DNA, 12 bp, Homo sapiens
acttttgtgaaa

SEQ ID NO: 2428498 - DNA, 12 bp, Homo sapiens
actttttatata

SEQ ID NO: 2428499 - DNA, 13 bp, Homo sapiens
actttttatatat

SEQ ID NO: 2428500 - DNA, 14 bp, Homo sapiens
actttttatatata

SEQ ID NO: 2428501 - DNA, 12 bp, Homo sapiens
actttttctgat

SEQ ID NO: 2428502 - DNA, 22 bp, Homo sapiens
agaaaaaaatgtattttatgtt

SEQ ID NO: 2428503 - DNA, 17 bp, Homo sapiens
agaaaaaaattgaaatg

SEQ ID NO: 2428504 - DNA, 16 bp, Homo sapiens
agaaaaatatgtacca

SEQ ID NO: 2428505 - DNA, 20 bp, Homo sapiens
agaaaaccagctcagcactg

SEQ ID NO: 2428506 - DNA, 19 bp, Homo sapiens
agaaaacccttgggccaga

SEQ ID NO: 2428507 - DNA, 13 bp, Homo sapiens
agaaaagatgcac

SEQ ID NO: 2428508 - DNA, 15 bp, Homo sapiens
agaaaagtatgttct

SEQ ID NO: 2428509 - DNA, 17 bp, Homo sapiens
agaaaagtatgttctaa

SEQ ID NO: 2428510 - DNA, 22 bp, Homo sapiens
agagctggtgcggctggccatg

SEQ ID NO: 2428511 - DNA, 13 bp, Homo sapiens
agagcttccctga

SEQ ID NO: 2428512 - DNA, 20 bp, Homo sapiens
agagcttccctgactcattc

SEQ ID NO: 2428513 - DNA, 15 bp, Homo sapiens
agaggaaggggccag

SEQ ID NO: 2428514 - DNA, 23 bp, Homo sapiens
agaggaaggggccagaggctcgt

SEQ ID NO: 2428515 - DNA, 15 bp, Homo sapiens
agaggaccggcggct

SEQ ID NO: 2428516 - DNA, 14 bp, Homo sapiens
agaggcaccaggaa

SEQ ID NO: 2428517 - DNA, 17 bp, Homo sapiens
agaggcaccaggaagcc

SEQ ID NO: 2428518 - DNA, 14 bp, Homo sapiens
agaggcagcccagg

SEQ ID NO: 2428519 - DNA, 19 bp, Homo sapiens
agaggcagcccaggaagtc

SEQ ID NO: 2428520 - DNA, 16 bp, Homo sapiens
agaggcagcccgcaca

SEQ ID NO: 2428521 - DNA, 13 bp, Homo sapiens
agaggcagtacct

SEQ ID NO: 2428522 - DNA, 13 bp, Homo sapiens
agaggccagaggc

SEQ ID NO: 2428523 - DNA, 14 bp, Homo sapiens
agaggccccagcct

SEQ ID NO: 2428524 - DNA, 20 bp, Homo sapiens
agaggcccccagcccagggc

SEQ ID NO: 2428525 - DNA, 14 bp, Homo sapiens
agaggccctcaagt

SEQ ID NO: 2428526 - DNA, 14 bp, Homo sapiens
agaggccctcgctg

SEQ ID NO: 2428527 - DNA, 19 bp, Homo sapiens
agaggccctcgctgccagc

SEQ ID NO: 2428528 - DNA, 23 bp, Homo sapiens
agaggccctggatcagcgtggcc

SEQ ID NO: 2428529 - DNA, 14 bp, Homo sapiens
agaggcctgggctg

SEQ ID NO: 2428530 - DNA, 20 bp, Homo sapiens
agaggcctgtttggcctctc

SEQ ID NO: 2428531 - DNA, 18 bp, Homo sapiens
agaggctcagattgtaat

SEQ ID NO: 2428532 - DNA, 17 bp, Homo sapiens
agaggctgaggcctgga

SEQ ID NO: 2428533 - DNA, 18 bp, Homo sapiens
agaggctgaggcctggac

SEQ ID NO: 2428534 - DNA, 16 bp, Homo sapiens
agaggctgaggctggc

SEQ ID NO: 2428535 - DNA, 14 bp, Homo sapiens
agaggctgcccctc

SEQ ID NO: 2428536 - DNA, 18 bp, Homo sapiens
agagggaatgtgaaattt

SEQ ID NO: 2428537 - DNA, 11 bp, Homo sapiens
agagggctgga

SEQ ID NO: 2428538 - DNA, 17 bp, Homo sapiens
agagggctggaggccca

SEQ ID NO: 2428539 - DNA, 18 bp, Homo sapiens
agagggctggaggcccag

SEQ ID NO: 2428540 - DNA, 19 bp, Homo sapiens
agagggctggaggcccagg

SEQ ID NO: 2428541 - DNA, 20 bp, Homo sapiens
agaggggccgatgcccagag

SEQ ID NO: 2428542 - DNA, 21 bp, Homo sapiens
agaggggcctgccacctggac

SEQ ID NO: 2428543 - DNA, 22 bp, Homo sapiens
agaggggcctgccacctggacc

SEQ ID NO: 2428544 - DNA, 21 bp, Homo sapiens
agaggggctgaatagcagaag

SEQ ID NO: 2428545 - DNA, 16 bp, Homo sapiens
agagggggctggtggg

SEQ ID NO: 2428546 - DNA, 17 bp, Homo sapiens
agaggtgaccccagggc

SEQ ID NO: 2428547 - DNA, 23 bp, Homo sapiens
agaggtgaccccagggcacagga

SEQ ID NO: 2428548 - DNA, 16 bp, Homo sapiens
agaggtgttatttgga

SEQ ID NO: 2428549 - DNA, 17 bp, Homo sapiens
agagtagaattgcattg

SEQ ID NO: 2428550 - DNA, 19 bp, Homo sapiens
agagtcccaggttggctct

SEQ ID NO: 2428551 - DNA, 17 bp, Homo sapiens
agagtctaaagatggag

SEQ ID NO: 2428552 - DNA, 11 bp, Homo sapiens
agagtctagat

SEQ ID NO: 2428553 - DNA, 13 bp, Homo sapiens
agagtctagattc

SEQ ID NO: 2428554 - DNA, 21 bp, Homo sapiens
agagtctagattcaaaggttc

SEQ ID NO: 2428555 - DNA, 16 bp, Homo sapiens
agagtctgaacagctg

SEQ ID NO: 2428556 - DNA, 16 bp, Homo sapiens
agagtctgaacctatt

SEQ ID NO: 2428557 - DNA, 22 bp, Homo sapiens
agagtgatagtcttttgctttt

SEQ ID NO: 2428558 - DNA, 14 bp, Homo sapiens
agagtgggggtggg

SEQ ID NO: 2428559 - DNA, 15 bp, Homo sapiens
agagttacagttctg

SEQ ID NO: 2428560 - DNA, 16 bp, Homo sapiens
agagttacagttctgt

SEQ ID NO: 2428561 - DNA, 14 bp, Homo sapiens
agagttcaagaaat

SEQ ID NO: 2428562 - DNA, 13 bp, Homo sapiens
agagttggccata

SEQ ID NO: 2428563 - DNA, 14 bp, Homo sapiens
agagtttaaaatca

SEQ ID NO: 2428564 - DNA, 18 bp, Homo sapiens
agataaggtaaaatgcca

SEQ ID NO: 2428565 - DNA, 19 bp, Homo sapiens
agataattacctactctgg

SEQ ID NO: 2428566 - DNA, 12 bp, Homo sapiens
agataattataa

SEQ ID NO: 2428567 - DNA, 20 bp, Homo sapiens
agatacagaactctttcaaa

SEQ ID NO: 2428568 - DNA, 14 bp, Homo sapiens
agatacatacagaa

SEQ ID NO: 2428569 - DNA, 15 bp, Homo sapiens
agatacatacagaat

SEQ ID NO: 2428570 - DNA, 19 bp, Homo sapiens
agataccagcgaggaggct

SEQ ID NO: 2428571 - DNA, 18 bp, Homo sapiens
agatactaaggacgttgt

SEQ ID NO: 2428572 - DNA, 19 bp, Homo sapiens
agatagccctgtcctggtg

SEQ ID NO: 2428573 - DNA, 20 bp, Homo sapiens
agatagccctgtcctggtgg

SEQ ID NO: 2428574 - DNA, 14 bp, Homo sapiens
agatagctgtgact

SEQ ID NO: 2428575 - DNA, 14 bp, Homo sapiens
agatatatattcat

SEQ ID NO: 2428576 - DNA, 23 bp, Homo sapiens
agatatcatctacctagatttaa

SEQ ID NO: 2428577 - DNA, 21 bp, Homo sapiens
agatatcttggacaaatcaca

SEQ ID NO: 2428578 - DNA, 18 bp, Homo sapiens
agatcagatgctccaaga

SEQ ID NO: 2428579 - DNA, 13 bp, Homo sapiens
agatcagtaaaga

SEQ ID NO: 2428580 - DNA, 18 bp, Homo sapiens
agatcagtgtaccatttg

SEQ ID NO: 2428581 - DNA, 21 bp, Homo sapiens
agatcagtgtaccatttgcct

SEQ ID NO: 2428582 - DNA, 14 bp, Homo sapiens
agatccagcctggg

SEQ ID NO: 2428583 - DNA, 14 bp, Homo sapiens
agatccaggagctc

SEQ ID NO: 2428584 - DNA, 10 bp, Homo sapiens
agatcccaaa

SEQ ID NO: 2428585 - DNA, 16 bp, Homo sapiens
agatcctagatcctaa

SEQ ID NO: 2428586 - DNA, 12 bp, Homo sapiens
agatcctcctca

SEQ ID NO: 2428587 - DNA, 18 bp, Homo sapiens
agatctaaataaaatgct

SEQ ID NO: 2428588 - DNA, 23 bp, Homo sapiens
agatctgatttgtaacccactga

SEQ ID NO: 2428589 - DNA, 14 bp, Homo sapiens
agatctggaacctc

SEQ ID NO: 2428590 - DNA, 15 bp, Homo sapiens
agatctgtcctcagc

SEQ ID NO: 2428591 - DNA, 16 bp, Homo sapiens
agatcttttattttgc

SEQ ID NO: 2428592 - DNA, 18 bp, Homo sapiens
agatcttttattttgcca

SEQ ID NO: 2428593 - DNA, 15 bp, Homo sapiens
agatgaagttttaca

SEQ ID NO: 2428594 - DNA, 19 bp, Homo sapiens
agatgaatgaagcaaatgt

SEQ ID NO: 2428595 - DNA, 14 bp, Homo sapiens
agatgataaagaga

SEQ ID NO: 2428596 - DNA, 18 bp, Homo sapiens
agatgataaagagacagt

SEQ ID NO: 2428597 - DNA, 16 bp, Homo sapiens
agatgatacatccaaa

SEQ ID NO: 2428598 - DNA, 20 bp, Homo sapiens
agatgattaaataagattct

SEQ ID NO: 2428599 - DNA, 19 bp, Homo sapiens
agatgcatttgggtccagg

SEQ ID NO: 2428600 - DNA, 15 bp, Homo sapiens
agatgcccaaatcct

SEQ ID NO: 2428601 - DNA, 20 bp, Homo sapiens
agatgctccaagattctaga

SEQ ID NO: 2428602 - DNA, 23 bp, Homo sapiens
agatgctccaagattctagatga

SEQ ID NO: 2428603 - DNA, 15 bp, Homo sapiens
agatgctccttgggc

SEQ ID NO: 2428604 - DNA, 16 bp, Homo sapiens
agatgctgaaaatgtc

SEQ ID NO: 2428605 - DNA, 14 bp, Homo sapiens
agatgctggcccag

SEQ ID NO: 2428606 - DNA, 18 bp, Homo sapiens
agatgctggcccagggcc

SEQ ID NO: 2428607 - DNA, 23 bp, Homo sapiens
agatgctggcccagggcccagag

SEQ ID NO: 2428608 - DNA, 20 bp, Homo sapiens
agatgctgtgagtctttggt

SEQ ID NO: 2428609 - DNA, 11 bp, Homo sapiens
agatgctttta

SEQ ID NO: 2428610 - DNA, 22 bp, Homo sapiens
agatggaaaattcattttttaa

SEQ ID NO: 2428611 - DNA, 12 bp, Homo sapiens
agatggcagctt

SEQ ID NO: 2428612 - DNA, 15 bp, Homo sapiens
agatggcccatcctg

SEQ ID NO: 2428613 - DNA, 16 bp, Homo sapiens
agatgggggaaagcaa

SEQ ID NO: 2428614 - DNA, 22 bp, Homo sapiens
agatggtgaggctgtcagtgta

SEQ ID NO: 2428615 - DNA, 22 bp, Homo sapiens
agcctcccctgccagggcaggg

SEQ ID NO: 2428616 - DNA, 14 bp, Homo sapiens
agcctccctgaagc

SEQ ID NO: 2428617 - DNA, 20 bp, Homo sapiens
agcctcctcatcccgtgttc

SEQ ID NO: 2428618 - DNA, 18 bp, Homo sapiens
agcctcgcaacccgtgcc

SEQ ID NO: 2428619 - DNA, 14 bp, Homo sapiens
agcctcgcccctgg

SEQ ID NO: 2428620 - DNA, 18 bp, Homo sapiens
agcctcgcccctggcaga

SEQ ID NO: 2428621 - DNA, 20 bp, Homo sapiens
agcctcgcccctggcagaga

SEQ ID NO: 2428622 - DNA, 23 bp, Homo sapiens
agcctctagagcagactacagct

SEQ ID NO: 2428623 - DNA, 22 bp, Homo sapiens
agcctctgcagcggaatctgtt

SEQ ID NO: 2428624 - DNA, 20 bp, Homo sapiens
agcctctggggggtggccag

SEQ ID NO: 2428625 - DNA, 22 bp, Homo sapiens
agcctctggggggtggccaggc

SEQ ID NO: 2428626 - DNA, 14 bp, Homo sapiens
agcctctgtctggc

SEQ ID NO: 2428627 - DNA, 17 bp, Homo sapiens
agcctctgtctggcaat

SEQ ID NO: 2428628 - DNA, 22 bp, Homo sapiens
agcctgacatcaaaaaaggcag

SEQ ID NO: 2428629 - DNA, 21 bp, Homo sapiens
agcctgagcaactcttgatta

SEQ ID NO: 2428630 - DNA, 14 bp, Homo sapiens
agcctgagggaaag

SEQ ID NO: 2428631 - DNA, 15 bp, Homo sapiens
agcctgagggaaagg

SEQ ID NO: 2428632 - DNA, 19 bp, Homo sapiens
agcctgagtactccacact

SEQ ID NO: 2428633 - DNA, 22 bp, Homo sapiens
agcctgcaggatctcaccaggc

SEQ ID NO: 2428634 - DNA, 17 bp, Homo sapiens
agcctgccgagcaaccg

SEQ ID NO: 2428635 - DNA, 21 bp, Homo sapiens
agcctgcgccaccgcccagag

SEQ ID NO: 2428636 - DNA, 10 bp, Homo sapiens
agcctgctca

SEQ ID NO: 2428637 - DNA, 18 bp, Homo sapiens
agcctggacctctgacag

SEQ ID NO: 2428638 - DNA, 24 bp, Homo sapiens
agcctggacctctgacagcagcat

SEQ ID NO: 2428639 - DNA, 13 bp, Homo sapiens
agcctggccagac

SEQ ID NO: 2428640 - DNA, 15 bp, Homo sapiens
agcctggccagacac

SEQ ID NO: 2428641 - DNA, 16 bp, Homo sapiens
agcctggccagacaca

SEQ ID NO: 2428642 - DNA, 11 bp, Homo sapiens
agcctggcctc

SEQ ID NO: 2428643 - DNA, 16 bp, Homo sapiens
agcctggcctcctgcc

SEQ ID NO: 2428644 - DNA, 19 bp, Homo sapiens
agcctggcctcctgcctct

SEQ ID NO: 2428645 - DNA, 17 bp, Homo sapiens
agcctgggaaagcccct

SEQ ID NO: 2428646 - DNA, 15 bp, Homo sapiens
agcctgggggcctgg

SEQ ID NO: 2428647 - DNA, 16 bp, Homo sapiens
agcctgggggcctggc

SEQ ID NO: 2428648 - DNA, 18 bp, Homo sapiens
agcctgggggcctggctg

SEQ ID NO: 2428649 - DNA, 21 bp, Homo sapiens
agcctgggggcctggctggct

SEQ ID NO: 2428650 - DNA, 15 bp, Homo sapiens
agcctggggtctgga

SEQ ID NO: 2428651 - DNA, 22 bp, Homo sapiens
agcctgtcagatccaggagctc

SEQ ID NO: 2428652 - DNA, 24 bp, Homo sapiens
agcctgtcctgcctgtggccatga

SEQ ID NO: 2428653 - DNA, 15 bp, Homo sapiens
agcctgtgaacccag

SEQ ID NO: 2428654 - DNA, 20 bp, Homo sapiens
agcctgtgaacccaggacaa

SEQ ID NO: 2428655 - DNA, 22 bp, Homo sapiens
agcctgtgaacccaggacaagc

SEQ ID NO: 2428656 - DNA, 16 bp, Homo sapiens
agcctgttcatggcag

SEQ ID NO: 2428657 - DNA, 19 bp, Homo sapiens
agcctgttcatggcagatg

SEQ ID NO: 2428658 - DNA, 18 bp, Homo sapiens
agccttaatttgcacagt

SEQ ID NO: 2428659 - DNA, 20 bp, Homo sapiens
agccttcaagctctgaggga

SEQ ID NO: 2428660 - DNA, 15 bp, Homo sapiens
agccttccacccagg

SEQ ID NO: 2428661 - DNA, 21 bp, Homo sapiens
agccttccccttatcctccct

SEQ ID NO: 2428662 - DNA, 13 bp, Homo sapiens
agccttgccagag

SEQ ID NO: 2428663 - DNA, 23 bp, Homo sapiens
agcctttctctctttatacagct

SEQ ID NO: 2428664 - DNA, 16 bp, Homo sapiens
agcctttgcctccccg

SEQ ID NO: 2428665 - DNA, 18 bp, Homo sapiens
agccttttccctctttgg

SEQ ID NO: 2428666 - DNA, 21 bp, Homo sapiens
agcctttttgtataaaataga

SEQ ID NO: 2428667 - DNA, 20 bp, Homo sapiens
agccttttttccccagactt

SEQ ID NO: 2428668 - DNA, 23 bp, Homo sapiens
agccttttttccccagacttgtt

SEQ ID NO: 2428669 - DNA, 15 bp, Homo sapiens
agcgaggaggctcca

SEQ ID NO: 2428670 - DNA, 22 bp, Homo sapiens
agcgagtggagtctgccaccca

SEQ ID NO: 2428671 - DNA, 19 bp, Homo sapiens
agcgattccctctcccagg

SEQ ID NO: 2428672 - DNA, 21 bp, Homo sapiens
agcgattccctctcccaggcc

SEQ ID NO: 2428673 - DNA, 23 bp, Homo sapiens
agcgcagttttttttttcttgtc

SEQ ID NO: 2428674 - DNA, 13 bp, Homo sapiens
agcgctatctccc

SEQ ID NO: 2428675 - DNA, 17 bp, Homo sapiens
agcgctatctccctgcc

SEQ ID NO: 2428676 - DNA, 16 bp, Homo sapiens
agcgctgtcaggattg

SEQ ID NO: 2428677 - DNA, 13 bp, Homo sapiens
agcggcatcaggc

SEQ ID NO: 2428678 - DNA, 14 bp, Homo sapiens
agcggccctgtcat

SEQ ID NO: 2428679 - DNA, 22 bp, Homo sapiens
agcggccggccagcccctggcc

SEQ ID NO: 2428680 - DNA, 13 bp, Homo sapiens
agcgggtctgctc

SEQ ID NO: 2428681 - DNA, 14 bp, Homo sapiens
agcggtgtctctcc

SEQ ID NO: 2428682 - DNA, 17 bp, Homo sapiens
agcgtcctcctctgtga

SEQ ID NO: 2428683 - DNA, 20 bp, Homo sapiens
agcgtgagcttaaaatacaa

SEQ ID NO: 2428684 - DNA, 17 bp, Homo sapiens
agcgtgctttaaaaaat

SEQ ID NO: 2428685 - DNA, 22 bp, Homo sapiens
agcgtggccttgttctgtcacc

SEQ ID NO: 2428686 - DNA, 18 bp, Homo sapiens
agcgttcttgtaatttta

SEQ ID NO: 2428687 - DNA, 18 bp, Homo sapiens
agctaaacggattccaaa

SEQ ID NO: 2428688 - DNA, 21 bp, Homo sapiens
agctaacagggaaggcaggca

SEQ ID NO: 2428689 - DNA, 23 bp, Homo sapiens
agctaagctcacgtcctgagaaa

SEQ ID NO: 2428690 - DNA, 16 bp, Homo sapiens
agctaataactgatct

SEQ ID NO: 2428691 - DNA, 21 bp, Homo sapiens
agctaattctactcacagtgc

SEQ ID NO: 2428692 - DNA, 15 bp, Homo sapiens
agctacataatttag

SEQ ID NO: 2428693 - DNA, 20 bp, Homo sapiens
agctaccctttttctccagc

SEQ ID NO: 2428694 - DNA, 21 bp, Homo sapiens
agctaccctttttctccagct

SEQ ID NO: 2428695 - DNA, 22 bp, Homo sapiens
agctacctgctcagccctgcac

SEQ ID NO: 2428696 - DNA, 22 bp, Homo sapiens
agctactctccccacgagggct

SEQ ID NO: 2428697 - DNA, 23 bp, Homo sapiens
agctactgccgtcagtgctgtgc

SEQ ID NO: 2428698 - DNA, 19 bp, Homo sapiens
agctactgtgtgtgtgaat

SEQ ID NO: 2428699 - DNA, 21 bp, Homo sapiens
agctacttcctcctccccact

SEQ ID NO: 2428700 - DNA, 15 bp, Homo sapiens
agctagaaccctctg

SEQ ID NO: 2428701 - DNA, 15 bp, Homo sapiens
agctagacacatgaa

SEQ ID NO: 2428702 - DNA, 17 bp, Homo sapiens
agctagacacatgaagg

SEQ ID NO: 2428703 - DNA, 21 bp, Homo sapiens
agctaggaagagcaggactcc

SEQ ID NO: 2428704 - DNA, 15 bp, Homo sapiens
agctaggagcaaagc

SEQ ID NO: 2428705 - DNA, 16 bp, Homo sapiens
agctaggagcaaagcc

SEQ ID NO: 2428706 - DNA, 17 bp, Homo sapiens
agctaggagcaaagcct

SEQ ID NO: 2428707 - DNA, 20 bp, Homo sapiens
agctaggagcaaagcctgtt

SEQ ID NO: 2428708 - DNA, 19 bp, Homo sapiens
agctagtcttttgcttttg

SEQ ID NO: 2428709 - DNA, 21 bp, Homo sapiens
agctagtgacccacatgccat

SEQ ID NO: 2428710 - DNA, 20 bp, Homo sapiens
agctatcattgcttcctcct

SEQ ID NO: 2428711 - DNA, 20 bp, Homo sapiens
agctatgttatattgaaaaa

SEQ ID NO: 2428712 - DNA, 22 bp, Homo sapiens
agctatgttatattgaaaaaat

SEQ ID NO: 2428713 - DNA, 17 bp, Homo sapiens
agctatttgatgtaata

SEQ ID NO: 2428714 - DNA, 21 bp, Homo sapiens
agctattttccaggcttctgc

SEQ ID NO: 2428715 - DNA, 13 bp, Homo sapiens
agctattttgtga

SEQ ID NO: 2428716 - DNA, 20 bp, Homo sapiens
agctatttttctaactacaa

SEQ ID NO: 2428717 - DNA, 14 bp, Homo sapiens
agctcaaaggtttg

SEQ ID NO: 2428718 - DNA, 19 bp, Homo sapiens
agggatccctcatctgtcc

SEQ ID NO: 2428719 - DNA, 19 bp, Homo sapiens
agggattaacctctgcact

SEQ ID NO: 2428720 - DNA, 20 bp, Homo sapiens
agggattctggttccagggt

SEQ ID NO: 2428721 - DNA, 11 bp, Homo sapiens
agggcaaagcc

SEQ ID NO: 2428722 - DNA, 18 bp, Homo sapiens
agggcaacagatcagtaa

SEQ ID NO: 2428723 - DNA, 12 bp, Homo sapiens
agggcacaggag

SEQ ID NO: 2428724 - DNA, 14 bp, Homo sapiens
agggcacaggagct

SEQ ID NO: 2428725 - DNA, 22 bp, Homo sapiens
agggcacaggagctacctgtgt

SEQ ID NO: 2428726 - DNA, 21 bp, Homo sapiens
agggcaccaggggtttctcgc

SEQ ID NO: 2428727 - DNA, 14 bp, Homo sapiens
agggcagagctggt

SEQ ID NO: 2428728 - DNA, 14 bp, Homo sapiens
agggcagcagccag

SEQ ID NO: 2428729 - DNA, 16 bp, Homo sapiens
agggcagcagccagcc

SEQ ID NO: 2428730 - DNA, 14 bp, Homo sapiens
agggcagccaggga

SEQ ID NO: 2428731 - DNA, 22 bp, Homo sapiens
agggcagggaccacaccctgta

SEQ ID NO: 2428732 - DNA, 12 bp, Homo sapiens
agggcagggccc

SEQ ID NO: 2428733 - DNA, 18 bp, Homo sapiens
agggcagtacctgagggt

SEQ ID NO: 2428734 - DNA, 17 bp, Homo sapiens
agggcagttcgcagcca

SEQ ID NO: 2428735 - DNA, 18 bp, Homo sapiens
agggcagttcgcagccac

SEQ ID NO: 2428736 - DNA, 20 bp, Homo sapiens
agggccacatgggaggctca

SEQ ID NO: 2428737 - DNA, 13 bp, Homo sapiens
agggccagagcca

SEQ ID NO: 2428738 - DNA, 14 bp, Homo sapiens
agggccagagccag

SEQ ID NO: 2428739 - DNA, 18 bp, Homo sapiens
agggccagcctctagagc

SEQ ID NO: 2428740 - DNA, 13 bp, Homo sapiens
agggcccagagcc

SEQ ID NO: 2428741 - DNA, 14 bp, Homo sapiens
agggcccagagccc

SEQ ID NO: 2428742 - DNA, 18 bp, Homo sapiens
agggcccagcccaagtga

SEQ ID NO: 2428743 - DNA, 18 bp, Homo sapiens
agggcccctctccccagg

SEQ ID NO: 2428744 - DNA, 15 bp, Homo sapiens
agggccctccttcct

SEQ ID NO: 2428745 - DNA, 22 bp, Homo sapiens
agggccggggaactggccaagc

SEQ ID NO: 2428746 - DNA, 13 bp, Homo sapiens
agggcggcagggg

SEQ ID NO: 2428747 - DNA, 15 bp, Homo sapiens
agggcggcaggggcc

SEQ ID NO: 2428748 - DNA, 18 bp, Homo sapiens
agggcggcaggggcctgg

SEQ ID NO: 2428749 - DNA, 19 bp, Homo sapiens
agggcggcaggggcctgga

SEQ ID NO: 2428750 - DNA, 18 bp, Homo sapiens
agggcgggcagagggctg

SEQ ID NO: 2428751 - DNA, 17 bp, Homo sapiens
agggctaccctgagctg

SEQ ID NO: 2428752 - DNA, 22 bp, Homo sapiens
agggctaccctgagctgaggca

SEQ ID NO: 2428753 - DNA, 13 bp, Homo sapiens
agggctcactcag

SEQ ID NO: 2428754 - DNA, 20 bp, Homo sapiens
agggctccagcccctcttgg

SEQ ID NO: 2428755 - DNA, 23 bp, Homo sapiens
agggctccagcccctcttggaga

SEQ ID NO: 2428756 - DNA, 19 bp, Homo sapiens
agggctccttgtgggcctg

SEQ ID NO: 2428757 - DNA, 20 bp, Homo sapiens
agggctcgaggggtgggctg

SEQ ID NO: 2428758 - DNA, 12 bp, Homo sapiens
agggctctcctg

SEQ ID NO: 2428759 - DNA, 14 bp, Homo sapiens
agggctctcctggc

SEQ ID NO: 2428760 - DNA, 16 bp, Homo sapiens
agggctgagctgggga

SEQ ID NO: 2428761 - DNA, 16 bp, Homo sapiens
agggctggaggcccag

SEQ ID NO: 2428762 - DNA, 17 bp, Homo sapiens
agggctggaggcccagg

SEQ ID NO: 2428763 - DNA, 18 bp, Homo sapiens
agggctggaggcccaggc

SEQ ID NO: 2428764 - DNA, 19 bp, Homo sapiens
agggctggaggcccaggct

SEQ ID NO: 2428765 - DNA, 12 bp, Homo sapiens
agggctggctgg

SEQ ID NO: 2428766 - DNA, 20 bp, Homo sapiens
agggctggctggcctcaccc

SEQ ID NO: 2428767 - DNA, 12 bp, Homo sapiens
agggctgggagg

SEQ ID NO: 2428768 - DNA, 18 bp, Homo sapiens
agggctgtaactgccagg

SEQ ID NO: 2428769 - DNA, 18 bp, Homo sapiens
agggctgtcatctgtgca

SEQ ID NO: 2428770 - DNA, 15 bp, Homo sapiens
aggggaagaggcctg

SEQ ID NO: 2428771 - DNA, 15 bp, Homo sapiens
aggggaatcagaact

SEQ ID NO: 2428772 - DNA, 16 bp, Homo sapiens
aggggaccaggagtgg

SEQ ID NO: 2428773 - DNA, 17 bp, Homo sapiens
aggggaccaggagtggg

SEQ ID NO: 2428774 - DNA, 13 bp, Homo sapiens
aggggagcccact

SEQ ID NO: 2428775 - DNA, 21 bp, Homo sapiens
aggggagcccactgtcctggg

SEQ ID NO: 2428776 - DNA, 18 bp, Homo sapiens
aggggagggggatccgac

SEQ ID NO: 2428777 - DNA, 13 bp, Homo sapiens
aggggccagaggc

SEQ ID NO: 2428778 - DNA, 17 bp, Homo sapiens
aggggccagaggctcgt

SEQ ID NO: 2428779 - DNA, 13 bp, Homo sapiens
aggggcctgagca

SEQ ID NO: 2428780 - DNA, 21 bp, Homo sapiens
aggggcctgccacctggaccc

SEQ ID NO: 2428781 - DNA, 15 bp, Homo sapiens
aggggctgcttcctc

SEQ ID NO: 2428782 - DNA, 21 bp, Homo sapiens
aggggctgcttcctcctggaa

SEQ ID NO: 2428783 - DNA, 13 bp, Homo sapiens
aggggctgggaac

SEQ ID NO: 2428784 - DNA, 16 bp, Homo sapiens
aggggcttcaggtcca

SEQ ID NO: 2428785 - DNA, 14 bp, Homo sapiens
aggggcttcctggt

SEQ ID NO: 2428786 - DNA, 23 bp, Homo sapiens
aggggcttgactttttcaacttc

SEQ ID NO: 2428787 - DNA, 22 bp, Homo sapiens
agggggagccccttctgctcag

SEQ ID NO: 2428788 - DNA, 15 bp, Homo sapiens
agggggcgcctgtgg

SEQ ID NO: 2428789 - DNA, 15 bp, Homo sapiens
agggggcggcctatg

SEQ ID NO: 2428790 - DNA, 12 bp, Homo sapiens
agggggctggag

SEQ ID NO: 2428791 - DNA, 14 bp, Homo sapiens
agggggctggagga

SEQ ID NO: 2428792 - DNA, 17 bp, Homo sapiens
agggggctggaggagcc

SEQ ID NO: 2428793 - DNA, 18 bp, Homo sapiens
agggggctggaggagccc

SEQ ID NO: 2428794 - DNA, 17 bp, Homo sapiens
agggggctggtgggtgc

SEQ ID NO: 2428795 - DNA, 15 bp, Homo sapiens
agggggtcgtggaga

SEQ ID NO: 2428796 - DNA, 16 bp, Homo sapiens
agggggtcgtggagag

SEQ ID NO: 2428797 - DNA, 18 bp, Homo sapiens
agggggtcgtggagagct

SEQ ID NO: 2428798 - DNA, 23 bp, Homo sapiens
agggggtcgtggagagctaggag

SEQ ID NO: 2428799 - DNA, 14 bp, Homo sapiens
aggggtaggggctg

SEQ ID NO: 2428800 - DNA, 15 bp, Homo sapiens
aggggtcaagttatt

SEQ ID NO: 2428801 - DNA, 15 bp, Homo sapiens
aggggtcggctgacc

SEQ ID NO: 2428802 - DNA, 13 bp, Homo sapiens
aggggtgggctgg

SEQ ID NO: 2428803 - DNA, 15 bp, Homo sapiens
aggggttcctcccct

SEQ ID NO: 2428804 - DNA, 17 bp, Homo sapiens
agggtacatggtgctgg

SEQ ID NO: 2428805 - DNA, 16 bp, Homo sapiens
agggtaggctggagtt

SEQ ID NO: 2428806 - DNA, 17 bp, Homo sapiens
agggtatattttcctat

SEQ ID NO: 2428807 - DNA, 21 bp, Homo sapiens
agggtcagacgcctgaggaac

SEQ ID NO: 2428808 - DNA, 14 bp, Homo sapiens
agggtcaggccttt

SEQ ID NO: 2428809 - DNA, 17 bp, Homo sapiens
agggtccaacatagagc

SEQ ID NO: 2428810 - DNA, 20 bp, Homo sapiens
agggtccctctgtgtatttg

SEQ ID NO: 2428811 - DNA, 13 bp, Homo sapiens
agggtcctgggag

SEQ ID NO: 2428812 - DNA, 14 bp, Homo sapiens
agggtcgaaagctc

SEQ ID NO: 2428813 - DNA, 18 bp, Homo sapiens
agggtcgaaagctctaga

SEQ ID NO: 2428814 - DNA, 16 bp, Homo sapiens
agggtcggtgccttca

SEQ ID NO: 2428815 - DNA, 14 bp, Homo sapiens
agggtctgctcttt

SEQ ID NO: 2428816 - DNA, 21 bp, Homo sapiens
agggtctgctctttctctgcc

SEQ ID NO: 2428817 - DNA, 23 bp, Homo sapiens
agggtctgctctttctctgccag

SEQ ID NO: 2428818 - DNA, 20 bp, Homo sapiens
agggtgcagtatcatgccct

SEQ ID NO: 2428819 - DNA, 17 bp, Homo sapiens
agggtgggcttgtgggg

SEQ ID NO: 2428820 - DNA, 22 bp, Homo sapiens
agggtgggcttgtggggcctgg

SEQ ID NO: 2428821 - DNA, 21 bp, Homo sapiens
agggtttgtgacagggcgggg

SEQ ID NO: 2428822 - DNA, 15 bp, Homo sapiens
aggtaaaatgccatg

SEQ ID NO: 2428823 - DNA, 18 bp, Homo sapiens
atagcgttcttgtaattt

SEQ ID NO: 2428824 - DNA, 19 bp, Homo sapiens
atagctctggggtgggcag

SEQ ID NO: 2428825 - DNA, 22 bp, Homo sapiens
atagctctggggtgggcagttt

SEQ ID NO: 2428826 - DNA, 15 bp, Homo sapiens
atagctgtaaacttc

SEQ ID NO: 2428827 - DNA, 20 bp, Homo sapiens
ataggacctttccaccacag

SEQ ID NO: 2428828 - DNA, 16 bp, Homo sapiens
ataggatttatttaaa

SEQ ID NO: 2428829 - DNA, 22 bp, Homo sapiens
ataggatttatttaaaatagca

SEQ ID NO: 2428830 - DNA, 20 bp, Homo sapiens
ataggcaggaagcccaattg

SEQ ID NO: 2428831 - DNA, 20 bp, Homo sapiens
ataggcggggcttgccttct

SEQ ID NO: 2428832 - DNA, 20 bp, Homo sapiens
ataggtgatccatgtaactg

SEQ ID NO: 2428833 - DNA, 12 bp, Homo sapiens
ataggttatttt

SEQ ID NO: 2428834 - DNA, 13 bp, Homo sapiens
atagtaaatcacg

SEQ ID NO: 2428835 - DNA, 21 bp, Homo sapiens
atagtaacttcttatggaatt

SEQ ID NO: 2428836 - DNA, 20 bp, Homo sapiens
atagtgatgtaatcttgaat

SEQ ID NO: 2428837 - DNA, 19 bp, Homo sapiens
atagtgtagctgaggaggc

SEQ ID NO: 2428838 - DNA, 13 bp, Homo sapiens
atagttactgtgt

SEQ ID NO: 2428839 - DNA, 14 bp, Homo sapiens
atagttactgtgta

SEQ ID NO: 2428840 - DNA, 20 bp, Homo sapiens
atagttactgtgtaattagt

SEQ ID NO: 2428841 - DNA, 19 bp, Homo sapiens
atagtttctgaggctttat

SEQ ID NO: 2428842 - DNA, 13 bp, Homo sapiens
atagttttcatcc

SEQ ID NO: 2428843 - DNA, 22 bp, Homo sapiens
atagttttcatccataactgaa

SEQ ID NO: 2428844 - DNA, 19 bp, Homo sapiens
atataaagtagtcctgtga

SEQ ID NO: 2428845 - DNA, 13 bp, Homo sapiens
atataaagtttta

SEQ ID NO: 2428846 - DNA, 16 bp, Homo sapiens
atataaatatattatt

SEQ ID NO: 2428847 - DNA, 18 bp, Homo sapiens
atataaatgcaaataaca

SEQ ID NO: 2428848 - DNA, 23 bp, Homo sapiens
atataaatgcaaataacaaatgc

SEQ ID NO: 2428849 - DNA, 12 bp, Homo sapiens
atataagctttt

SEQ ID NO: 2428850 - DNA, 14 bp, Homo sapiens
atataatcattatt

SEQ ID NO: 2428851 - DNA, 22 bp, Homo sapiens
atataatgttgttatttaaaga

SEQ ID NO: 2428852 - DNA, 20 bp, Homo sapiens
atatacttttttttctttaa

SEQ ID NO: 2428853 - DNA, 17 bp, Homo sapiens
atatagaagtataaaga

SEQ ID NO: 2428854 - DNA, 16 bp, Homo sapiens
atatataagtgtacat

SEQ ID NO: 2428855 - DNA, 15 bp, Homo sapiens
atatatataaatata

SEQ ID NO: 2428856 - DNA, 21 bp, Homo sapiens
atatatcacccagacataaag

SEQ ID NO: 2428857 - DNA, 24 bp, Homo sapiens
atatatctaccccagactagatgt

SEQ ID NO: 2428858 - DNA, 21 bp, Homo sapiens
atatatggggatggtagtttt

SEQ ID NO: 2428859 - DNA, 22 bp, Homo sapiens
atatatggggatggtagttttt

SEQ ID NO: 2428860 - DNA, 15 bp, Homo sapiens
atatatgtatataca

SEQ ID NO: 2428861 - DNA, 19 bp, Homo sapiens
atatattatacttgtaatt

SEQ ID NO: 2428862 - DNA, 22 bp, Homo sapiens
atatattatacttgtaattatg

SEQ ID NO: 2428863 - DNA, 15 bp, Homo sapiens
atatattatatggaa

SEQ ID NO: 2428864 - DNA, 16 bp, Homo sapiens
atatattatcttttca

SEQ ID NO: 2428865 - DNA, 13 bp, Homo sapiens
atatattattata

SEQ ID NO: 2428866 - DNA, 16 bp, Homo sapiens
atatattattataatc

SEQ ID NO: 2428867 - DNA, 18 bp, Homo sapiens
atatattattataatctt

SEQ ID NO: 2428868 - DNA, 13 bp, Homo sapiens
atatattgaatta

SEQ ID NO: 2428869 - DNA, 14 bp, Homo sapiens
atatattgaattaa

SEQ ID NO: 2428870 - DNA, 16 bp, Homo sapiens
atatatttaaaaataa

SEQ ID NO: 2428871 - DNA, 23 bp, Homo sapiens
atatatttttttttaagctctga

SEQ ID NO: 2428872 - DNA, 18 bp, Homo sapiens
atatcacatgttttctct

SEQ ID NO: 2428873 - DNA, 20 bp, Homo sapiens
atatcacccagacataaagg

SEQ ID NO: 2428874 - DNA, 18 bp, Homo sapiens
atatcatccacacatgaa

SEQ ID NO: 2428875 - DNA, 20 bp, Homo sapiens
atatcatctacctagattta

SEQ ID NO: 2428876 - DNA, 21 bp, Homo sapiens
atatcatctacctagatttaa

SEQ ID NO: 2428877 - DNA, 21 bp, Homo sapiens
atatcatgagtgaataaatgt

SEQ ID NO: 2428878 - DNA, 22 bp, Homo sapiens
atatcctaaacatcattcattt

SEQ ID NO: 2428879 - DNA, 15 bp, Homo sapiens
atatctgaagccctc

SEQ ID NO: 2428880 - DNA, 13 bp, Homo sapiens
atatgaaagctga

SEQ ID NO: 2428881 - DNA, 17 bp, Homo sapiens
atatgaaagctgatttt

SEQ ID NO: 2428882 - DNA, 14 bp, Homo sapiens
atatgaagacataa

SEQ ID NO: 2428883 - DNA, 15 bp, Homo sapiens
atatgcgtattatac

SEQ ID NO: 2428884 - DNA, 16 bp, Homo sapiens
atatgctaccaccagc

SEQ ID NO: 2428885 - DNA, 17 bp, Homo sapiens
atatgctaccaccagct

SEQ ID NO: 2428886 - DNA, 16 bp, Homo sapiens
atatgcttaaaataag

SEQ ID NO: 2428887 - DNA, 23 bp, Homo sapiens
atatggaaatatatattatactt

SEQ ID NO: 2428888 - DNA, 19 bp, Homo sapiens
atatggaattttgcaaaga

SEQ ID NO: 2428889 - DNA, 12 bp, Homo sapiens
atatgtaaaaca

SEQ ID NO: 2428890 - DNA, 18 bp, Homo sapiens
atatgtaaaacatttatt

SEQ ID NO: 2428891 - DNA, 14 bp, Homo sapiens
atatgtacatgaga

SEQ ID NO: 2428892 - DNA, 17 bp, Homo sapiens
atatgtaccctctgaaa

SEQ ID NO: 2428893 - DNA, 21 bp, Homo sapiens
atatgtaccctctgaaataca

SEQ ID NO: 2428894 - DNA, 18 bp, Homo sapiens
atatgtgctggaattcta

SEQ ID NO: 2428895 - DNA, 19 bp, Homo sapiens
atatgtgctggaattctaa

SEQ ID NO: 2428896 - DNA, 16 bp, Homo sapiens
atatgttgtaatattt

SEQ ID NO: 2428897 - DNA, 12 bp, Homo sapiens
atattaaatctg

SEQ ID NO: 2428898 - DNA, 16 bp, Homo sapiens
atattaaattttttgt

SEQ ID NO: 2428899 - DNA, 18 bp, Homo sapiens
atattaaccagatatata

SEQ ID NO: 2428900 - DNA, 14 bp, Homo sapiens
atattatacttgta

SEQ ID NO: 2428901 - DNA, 19 bp, Homo sapiens
atattatacttgtaattat

SEQ ID NO: 2428902 - DNA, 22 bp, Homo sapiens
atattatacttgtaattatgga

SEQ ID NO: 2428903 - DNA, 18 bp, Homo sapiens
atattatatggaaatata

SEQ ID NO: 2428904 - DNA, 13 bp, Homo sapiens
atattatcttttc

SEQ ID NO: 2428905 - DNA, 15 bp, Homo sapiens
atattattacttgta

SEQ ID NO: 2428906 - DNA, 19 bp, Homo sapiens
atattattacttgtaaata

SEQ ID NO: 2428907 - DNA, 22 bp, Homo sapiens
atattattagttttgatttaat

SEQ ID NO: 2428908 - DNA, 22 bp, Homo sapiens
atattcctattgtgcaatgtaa

SEQ ID NO: 2428909 - DNA, 23 bp, Homo sapiens
atattcctattgtgcaatgtaaa

SEQ ID NO: 2428910 - DNA, 22 bp, Homo sapiens
atattctattacattttcagtg

SEQ ID NO: 2428911 - DNA, 13 bp, Homo sapiens
atattgatttatt

SEQ ID NO: 2428912 - DNA, 17 bp, Homo sapiens
atattggccaaggaaag

SEQ ID NO: 2428913 - DNA, 21 bp, Homo sapiens
atattgtgggtgttaattttt

SEQ ID NO: 2428914 - DNA, 16 bp, Homo sapiens
atatttaaaagtgtca

SEQ ID NO: 2428915 - DNA, 21 bp, Homo sapiens
atatttaaatgtaaagacaaa

SEQ ID NO: 2428916 - DNA, 19 bp, Homo sapiens
atatttacctcagcctggg

SEQ ID NO: 2428917 - DNA, 20 bp, Homo sapiens
atatttagatgtaattttgt

SEQ ID NO: 2428918 - DNA, 13 bp, Homo sapiens
atatttgtaaaat

SEQ ID NO: 2428919 - DNA, 16 bp, Homo sapiens
atatttgtaaaatgac

SEQ ID NO: 2428920 - DNA, 13 bp, Homo sapiens
atattttaaaatt

SEQ ID NO: 2428921 - DNA, 18 bp, Homo sapiens
atattttaaaatttgttc

SEQ ID NO: 2428922 - DNA, 14 bp, Homo sapiens
atattttaaacaga

SEQ ID NO: 2428923 - DNA, 14 bp, Homo sapiens
atattttaaagaat

SEQ ID NO: 2428924 - DNA, 13 bp, Homo sapiens
atattttcttttc

SEQ ID NO: 2428925 - DNA, 19 bp, Homo sapiens
atattttgaatcaataata

SEQ ID NO: 2428926 - DNA, 14 bp, Homo sapiens
atcaaacattttga

SEQ ID NO: 2428927 - DNA, 11 bp, Homo sapiens
atgcccagaga

SEQ ID NO: 2428928 - DNA, 17 bp, Homo sapiens
atgcccagagacccagc

SEQ ID NO: 2428929 - DNA, 18 bp, Homo sapiens
atgccccatcccatgctg

SEQ ID NO: 2428930 - DNA, 22 bp, Homo sapiens
atgccccctaatccccttctcc

SEQ ID NO: 2428931 - DNA, 12 bp, Homo sapiens
atgccctgtgca

SEQ ID NO: 2428932 - DNA, 12 bp, Homo sapiens
atgcccttcact

SEQ ID NO: 2428933 - DNA, 22 bp, Homo sapiens
atgccgtggattgcacgtggcc

SEQ ID NO: 2428934 - DNA, 19 bp, Homo sapiens
atgcctatggtggatccaa

SEQ ID NO: 2428935 - DNA, 14 bp, Homo sapiens
atgcctccctgagc

SEQ ID NO: 2428936 - DNA, 14 bp, Homo sapiens
atgcctctgaggcc

SEQ ID NO: 2428937 - DNA, 22 bp, Homo sapiens
atgcctctgaggccagcctggc

SEQ ID NO: 2428938 - DNA, 18 bp, Homo sapiens
atgcctctgccaaaggat

SEQ ID NO: 2428939 - DNA, 19 bp, Homo sapiens
atgcctctgtcttctggac

SEQ ID NO: 2428940 - DNA, 19 bp, Homo sapiens
atgcctgtcttaattttct

SEQ ID NO: 2428941 - DNA, 23 bp, Homo sapiens
atgccttttcccaaaatgttgaa

SEQ ID NO: 2428942 - DNA, 18 bp, Homo sapiens
atgcgccccctccgccct

SEQ ID NO: 2428943 - DNA, 22 bp, Homo sapiens
atgcgccccctccgccctgcca

SEQ ID NO: 2428944 - DNA, 15 bp, Homo sapiens
atgcgctcagggcca

SEQ ID NO: 2428945 - DNA, 21 bp, Homo sapiens
atgcggttataaaaaatggtt

SEQ ID NO: 2428946 - DNA, 19 bp, Homo sapiens
atgctaacatctaaaaata

SEQ ID NO: 2428947 - DNA, 15 bp, Homo sapiens
atgctaagagaagta

SEQ ID NO: 2428948 - DNA, 14 bp, Homo sapiens
atgctaccaccagc

SEQ ID NO: 2428949 - DNA, 17 bp, Homo sapiens
atgctaccaccagctgt

SEQ ID NO: 2428950 - DNA, 14 bp, Homo sapiens
atgctaggttctac

SEQ ID NO: 2428951 - DNA, 19 bp, Homo sapiens
atgctcaggtgctggggcc

SEQ ID NO: 2428952 - DNA, 19 bp, Homo sapiens
atgctccaagattctagat

SEQ ID NO: 2428953 - DNA, 22 bp, Homo sapiens
atgctccagattagagcctgta

SEQ ID NO: 2428954 - DNA, 15 bp, Homo sapiens
atgctccttgggccc

SEQ ID NO: 2428955 - DNA, 12 bp, Homo sapiens
atgctgaaaatg

SEQ ID NO: 2428956 - DNA, 20 bp, Homo sapiens
atgctgacattcacctgccc

SEQ ID NO: 2428957 - DNA, 15 bp, Homo sapiens
atgctgaggcctggg

SEQ ID NO: 2428958 - DNA, 19 bp, Homo sapiens
atgctgctggggaagacag

SEQ ID NO: 2428959 - DNA, 15 bp, Homo sapiens
atgctggagggaggc

SEQ ID NO: 2428960 - DNA, 19 bp, Homo sapiens
atgctggcccagggcccag

SEQ ID NO: 2428961 - DNA, 20 bp, Homo sapiens
atgctggcccagggcccaga

SEQ ID NO: 2428962 - DNA, 23 bp, Homo sapiens
atgctggcccagggcccagagcc

SEQ ID NO: 2428963 - DNA, 9 bp, Homo sapiens
atgctggga

SEQ ID NO: 2428964 - DNA, 21 bp, Homo sapiens
atgctgggtccatatcacaca

SEQ ID NO: 2428965 - DNA, 17 bp, Homo sapiens
atgcttagatgttccag

SEQ ID NO: 2428966 - DNA, 17 bp, Homo sapiens
atgcttattccatgact

SEQ ID NO: 2428967 - DNA, 15 bp, Homo sapiens
atgcttcctcccagc

SEQ ID NO: 2428968 - DNA, 21 bp, Homo sapiens
atgcttctaagtaaatacaat

SEQ ID NO: 2428969 - DNA, 23 bp, Homo sapiens
atgcttctaagtaaatacaattt

SEQ ID NO: 2428970 - DNA, 12 bp, Homo sapiens
atgcttgggaag

SEQ ID NO: 2428971 - DNA, 16 bp, Homo sapiens
atgctttgaaacagaa

SEQ ID NO: 2428972 - DNA, 17 bp, Homo sapiens
atgctttgaaacagaaa

SEQ ID NO: 2428973 - DNA, 15 bp, Homo sapiens
atggaaatatatatt

SEQ ID NO: 2428974 - DNA, 17 bp, Homo sapiens
atggaaatttaaagcag

SEQ ID NO: 2428975 - DNA, 14 bp, Homo sapiens
atggaacacttcga

SEQ ID NO: 2428976 - DNA, 14 bp, Homo sapiens
atggaattgatttg

SEQ ID NO: 2428977 - DNA, 15 bp, Homo sapiens
atggaattgatttgc

SEQ ID NO: 2428978 - DNA, 18 bp, Homo sapiens
atggaattgatttgcatt

SEQ ID NO: 2428979 - DNA, 19 bp, Homo sapiens
atggaattttgcaaagatt

SEQ ID NO: 2428980 - DNA, 16 bp, Homo sapiens
atggaccggagagtgg

SEQ ID NO: 2428981 - DNA, 13 bp, Homo sapiens
atggactatctgt

SEQ ID NO: 2428982 - DNA, 17 bp, Homo sapiens
atggactatctgtctgg

SEQ ID NO: 2428983 - DNA, 20 bp, Homo sapiens
atggactatctgtctggtgg

SEQ ID NO: 2428984 - DNA, 14 bp, Homo sapiens
atggactgctcagg

SEQ ID NO: 2428985 - DNA, 15 bp, Homo sapiens
atggagaaagctgac

SEQ ID NO: 2428986 - DNA, 15 bp, Homo sapiens
atggagagccctggg

SEQ ID NO: 2428987 - DNA, 15 bp, Homo sapiens
atggaggttctaagg

SEQ ID NO: 2428988 - DNA, 16 bp, Homo sapiens
atggaggttctaaggc

SEQ ID NO: 2428989 - DNA, 17 bp, Homo sapiens
atggaggttctaaggcc

SEQ ID NO: 2428990 - DNA, 15 bp, Homo sapiens
atggatcacaagatg

SEQ ID NO: 2428991 - DNA, 16 bp, Homo sapiens
atggatcacaagatgg

SEQ ID NO: 2428992 - DNA, 13 bp, Homo sapiens
atggatgccaata

SEQ ID NO: 2428993 - DNA, 12 bp, Homo sapiens
atggattctaaa

SEQ ID NO: 2428994 - DNA, 15 bp, Homo sapiens
atggatttttcttta

SEQ ID NO: 2428995 - DNA, 16 bp, Homo sapiens
atggatttttctttaa

SEQ ID NO: 2428996 - DNA, 22 bp, Homo sapiens
atggcaatcaaacattttctgg

SEQ ID NO: 2428997 - DNA, 13 bp, Homo sapiens
atggcagaaggca

SEQ ID NO: 2428998 - DNA, 20 bp, Homo sapiens
atggcagaaggcaaacccat

SEQ ID NO: 2428999 - DNA, 19 bp, Homo sapiens
atggcagatgtaggaggga

SEQ ID NO: 2429000 - DNA, 20 bp, Homo sapiens
atggcagatgtaggagggac

SEQ ID NO: 2429001 - DNA, 21 bp, Homo sapiens
atggcagatgtaggagggact

SEQ ID NO: 2429002 - DNA, 17 bp, Homo sapiens
atggcaggaaggcttgt

SEQ ID NO: 2429003 - DNA, 19 bp, Homo sapiens
atggcagggggctgctgct

SEQ ID NO: 2429004 - DNA, 20 bp, Homo sapiens
atggcagggggctgctgctg

SEQ ID NO: 2429005 - DNA, 15 bp, Homo sapiens
atggcagttatattt

SEQ ID NO: 2429006 - DNA, 17 bp, Homo sapiens
atggcatgagaaataca

SEQ ID NO: 2429007 - DNA, 17 bp, Homo sapiens
atggccagccccttaga

SEQ ID NO: 2429008 - DNA, 14 bp, Homo sapiens
atggccccagcaca

SEQ ID NO: 2429009 - DNA, 15 bp, Homo sapiens
atggccccagcacag

SEQ ID NO: 2429010 - DNA, 17 bp, Homo sapiens
atggccccagcacagct

SEQ ID NO: 2429011 - DNA, 18 bp, Homo sapiens
atggccgtgaatgggtgc

SEQ ID NO: 2429012 - DNA, 17 bp, Homo sapiens
atggcctcatgtggctg

SEQ ID NO: 2429013 - DNA, 20 bp, Homo sapiens
atggcctcatgtggctggaa

SEQ ID NO: 2429014 - DNA, 23 bp, Homo sapiens
atggccttcatatcatccacaca

SEQ ID NO: 2429015 - DNA, 17 bp, Homo sapiens
atggcgtaagtacagag

SEQ ID NO: 2429016 - DNA, 19 bp, Homo sapiens
atggctatgtttttaatgt

SEQ ID NO: 2429017 - DNA, 12 bp, Homo sapiens
atggctcccagg

SEQ ID NO: 2429018 - DNA, 20 bp, Homo sapiens
atggctgataattttaaatt

SEQ ID NO: 2429019 - DNA, 23 bp, Homo sapiens
atgggagctgaggccacactcag

SEQ ID NO: 2429020 - DNA, 18 bp, Homo sapiens
atgggagggaggctcagg

SEQ ID NO: 2429021 - DNA, 18 bp, Homo sapiens
atgggatggtggagggcc

SEQ ID NO: 2429022 - DNA, 17 bp, Homo sapiens
atgggcatcttttgtat

SEQ ID NO: 2429023 - DNA, 14 bp, Homo sapiens
atgggcccaggcct

SEQ ID NO: 2429024 - DNA, 14 bp, Homo sapiens
atggggaccagcag

SEQ ID NO: 2429025 - DNA, 13 bp, Homo sapiens
atggggaggacaa

SEQ ID NO: 2429026 - DNA, 23 bp, Homo sapiens
atgggggaaagcaaagcacagag

SEQ ID NO: 2429027 - DNA, 18 bp, Homo sapiens
atgggggagggggcagaa

SEQ ID NO: 2429028 - DNA, 17 bp, Homo sapiens
atgggtagggtaaatca

SEQ ID NO: 2429029 - DNA, 14 bp, Homo sapiens
atggtaactgcttt

SEQ ID NO: 2429030 - DNA, 15 bp, Homo sapiens
atggtaactgctttc

SEQ ID NO: 2429031 - DNA, 14 bp, Homo sapiens
attccatgactgct

SEQ ID NO: 2429032 - DNA, 23 bp, Homo sapiens
attcccaggtaggccaaggtgtc

SEQ ID NO: 2429033 - DNA, 16 bp, Homo sapiens
attccccatctcaggc

SEQ ID NO: 2429034 - DNA, 15 bp, Homo sapiens
attcccctctgctgc

SEQ ID NO: 2429035 - DNA, 16 bp, Homo sapiens
attcccgttttgtcac

SEQ ID NO: 2429036 - DNA, 18 bp, Homo sapiens
attcccgttttgtcactt

SEQ ID NO: 2429037 - DNA, 21 bp, Homo sapiens
attcccgttttgtcacttttt

SEQ ID NO: 2429038 - DNA, 21 bp, Homo sapiens
attccctagaaacttccaaat

SEQ ID NO: 2429039 - DNA, 17 bp, Homo sapiens
attccctcactcgtctc

SEQ ID NO: 2429040 - DNA, 20 bp, Homo sapiens
attccctcactcgtctcccc

SEQ ID NO: 2429041 - DNA, 14 bp, Homo sapiens
attccctctcccag

SEQ ID NO: 2429042 - DNA, 19 bp, Homo sapiens
attccggatcctaagcatc

SEQ ID NO: 2429043 - DNA, 17 bp, Homo sapiens
attcctcaacgtattgt

SEQ ID NO: 2429044 - DNA, 19 bp, Homo sapiens
attcctcatgaatgtaaat

SEQ ID NO: 2429045 - DNA, 22 bp, Homo sapiens
attcctcatgaatgtaaatttg

SEQ ID NO: 2429046 - DNA, 16 bp, Homo sapiens
attcctgaagaaccag

SEQ ID NO: 2429047 - DNA, 22 bp, Homo sapiens
attcctgggaaatattccctag

SEQ ID NO: 2429048 - DNA, 15 bp, Homo sapiens
attccttcagatttg

SEQ ID NO: 2429049 - DNA, 19 bp, Homo sapiens
attcgccacacagtatttt

SEQ ID NO: 2429050 - DNA, 16 bp, Homo sapiens
attctaaaatgattgt

SEQ ID NO: 2429051 - DNA, 14 bp, Homo sapiens
attctaaaatgcct

SEQ ID NO: 2429052 - DNA, 20 bp, Homo sapiens
attctaaaatgtgatgttct

SEQ ID NO: 2429053 - DNA, 22 bp, Homo sapiens
attctaaaatgtgatgttctaa

SEQ ID NO: 2429054 - DNA, 15 bp, Homo sapiens
attctaaagattcta

SEQ ID NO: 2429055 - DNA, 22 bp, Homo sapiens
attctaaagattctatagttct

SEQ ID NO: 2429056 - DNA, 14 bp, Homo sapiens
attctaaaggtcca

SEQ ID NO: 2429057 - DNA, 12 bp, Homo sapiens
attctaagactt

SEQ ID NO: 2429058 - DNA, 23 bp, Homo sapiens
attctagatcagatgctccaaga

SEQ ID NO: 2429059 - DNA, 14 bp, Homo sapiens
attctatagttcta

SEQ ID NO: 2429060 - DNA, 18 bp, Homo sapiens
attctattacattttcag

SEQ ID NO: 2429061 - DNA, 12 bp, Homo sapiens
attctcattaaa

SEQ ID NO: 2429062 - DNA, 13 bp, Homo sapiens
attctccacagca

SEQ ID NO: 2429063 - DNA, 15 bp, Homo sapiens
attctcccttgctct

SEQ ID NO: 2429064 - DNA, 17 bp, Homo sapiens
attctcctcctccctcc

SEQ ID NO: 2429065 - DNA, 13 bp, Homo sapiens
attctctgagctg

SEQ ID NO: 2429066 - DNA, 17 bp, Homo sapiens
attctctgagctgtgca

SEQ ID NO: 2429067 - DNA, 19 bp, Homo sapiens
attctctggctgtaaggct

SEQ ID NO: 2429068 - DNA, 20 bp, Homo sapiens
attctctggctgtaaggctc

SEQ ID NO: 2429069 - DNA, 22 bp, Homo sapiens
attctctgtgtctaagattcta

SEQ ID NO: 2429070 - DNA, 15 bp, Homo sapiens
attctcttgtataag

SEQ ID NO: 2429071 - DNA, 18 bp, Homo sapiens
attctcttgtataagatc

SEQ ID NO: 2429072 - DNA, 20 bp, Homo sapiens
attctcttgtataagatcct

SEQ ID NO: 2429073 - DNA, 22 bp, Homo sapiens
attctcttgtataagatcctag

SEQ ID NO: 2429074 - DNA, 15 bp, Homo sapiens
attctgaaggagccc

SEQ ID NO: 2429075 - DNA, 16 bp, Homo sapiens
attctgaaggagcccc

SEQ ID NO: 2429076 - DNA, 18 bp, Homo sapiens
attctgaccttaaatgca

SEQ ID NO: 2429077 - DNA, 18 bp, Homo sapiens
attctgactcggtttctc

SEQ ID NO: 2429078 - DNA, 22 bp, Homo sapiens
attctgagttttgtgtttgttg

SEQ ID NO: 2429079 - DNA, 14 bp, Homo sapiens
attctgcaagtata

SEQ ID NO: 2429080 - DNA, 17 bp, Homo sapiens
attctgcagtaaatctt

SEQ ID NO: 2429081 - DNA, 17 bp, Homo sapiens
attctgcctctctagga

SEQ ID NO: 2429082 - DNA, 16 bp, Homo sapiens
attctgcctttgccag

SEQ ID NO: 2429083 - DNA, 18 bp, Homo sapiens
attctgctggcctctgcg

SEQ ID NO: 2429084 - DNA, 16 bp, Homo sapiens
attctggacctctggg

SEQ ID NO: 2429085 - DNA, 17 bp, Homo sapiens
attctgggggctgcagt

SEQ ID NO: 2429086 - DNA, 20 bp, Homo sapiens
attctgtgccttgttttttg

SEQ ID NO: 2429087 - DNA, 15 bp, Homo sapiens
attcttctctgttgt

SEQ ID NO: 2429088 - DNA, 21 bp, Homo sapiens
attcttctcttccttttatca

SEQ ID NO: 2429089 - DNA, 17 bp, Homo sapiens
attcttctgagcactgt

SEQ ID NO: 2429090 - DNA, 16 bp, Homo sapiens
attcttgatgtaaaat

SEQ ID NO: 2429091 - DNA, 18 bp, Homo sapiens
attcttgatgtaaaatct

SEQ ID NO: 2429092 - DNA, 19 bp, Homo sapiens
attcttgatgtaaaatctt

SEQ ID NO: 2429093 - DNA, 18 bp, Homo sapiens
attcttggttgaggaaac

SEQ ID NO: 2429094 - DNA, 13 bp, Homo sapiens
attctttcaatac

SEQ ID NO: 2429095 - DNA, 20 bp, Homo sapiens
attctttcaatacagatata

SEQ ID NO: 2429096 - DNA, 20 bp, Homo sapiens
attctttcccagtctgtcga

SEQ ID NO: 2429097 - DNA, 22 bp, Homo sapiens
attgaaaaaatagagcctgagg

SEQ ID NO: 2429098 - DNA, 22 bp, Homo sapiens
attgaaaatgtccaggaaagtg

SEQ ID NO: 2429099 - DNA, 14 bp, Homo sapiens
attgaacacaaact

SEQ ID NO: 2429100 - DNA, 15 bp, Homo sapiens
attgaacacaaactg

SEQ ID NO: 2429101 - DNA, 17 bp, Homo sapiens
attgaacacaaactgta

SEQ ID NO: 2429102 - DNA, 20 bp, Homo sapiens
attgaacacaaactgtaaat

SEQ ID NO: 2429103 - DNA, 14 bp, Homo sapiens
attgaatactttga

SEQ ID NO: 2429104 - DNA, 22 bp, Homo sapiens
attgaatggctatgtttttaat

SEQ ID NO: 2429105 - DNA, 23 bp, Homo sapiens
attgaattcttggttgaggaaac

SEQ ID NO: 2429106 - DNA, 17 bp, Homo sapiens
attgaccgcgactaatt

SEQ ID NO: 2429107 - DNA, 23 bp, Homo sapiens
attgaccgcgactaatttcaaaa

SEQ ID NO: 2429108 - DNA, 14 bp, Homo sapiens
attgacctggatgg

SEQ ID NO: 2429109 - DNA, 22 bp, Homo sapiens
attgactttccccaccagatgc

SEQ ID NO: 2429110 - DNA, 13 bp, Homo sapiens
attgactttgaca

SEQ ID NO: 2429111 - DNA, 21 bp, Homo sapiens
attgaggcttggttccttccc

SEQ ID NO: 2429112 - DNA, 20 bp, Homo sapiens
attgagtaatggtgtagaac

SEQ ID NO: 2429113 - DNA, 22 bp, Homo sapiens
attgagtaatggtgtagaacac

SEQ ID NO: 2429114 - DNA, 17 bp, Homo sapiens
attgataagatctttta

SEQ ID NO: 2429115 - DNA, 13 bp, Homo sapiens
attgatttgcatt

SEQ ID NO: 2429116 - DNA, 20 bp, Homo sapiens
attgatttgcattgaacaca

SEQ ID NO: 2429117 - DNA, 12 bp, Homo sapiens
attgatttttgg

SEQ ID NO: 2429118 - DNA, 12 bp, Homo sapiens
attgcaaatctt

SEQ ID NO: 2429119 - DNA, 16 bp, Homo sapiens
attgcaaatcttgaaa

SEQ ID NO: 2429120 - DNA, 16 bp, Homo sapiens
attgcaatatctgaag

SEQ ID NO: 2429121 - DNA, 23 bp, Homo sapiens
attgcacgtggcctcttgagcag

SEQ ID NO: 2429122 - DNA, 18 bp, Homo sapiens
attgcagaaaattctgtg

SEQ ID NO: 2429123 - DNA, 15 bp, Homo sapiens
attgcatctcccaga

SEQ ID NO: 2429124 - DNA, 21 bp, Homo sapiens
attgccacctctaacagcacc

SEQ ID NO: 2429125 - DNA, 17 bp, Homo sapiens
attgccttttttctgta

SEQ ID NO: 2429126 - DNA, 18 bp, Homo sapiens
attgccttttttctgtat

SEQ ID NO: 2429127 - DNA, 14 bp, Homo sapiens
attgcgagagatgt

SEQ ID NO: 2429128 - DNA, 15 bp, Homo sapiens
attgcgagagatgtg

SEQ ID NO: 2429129 - DNA, 17 bp, Homo sapiens
attgcgagagatgtgtg

SEQ ID NO: 2429130 - DNA, 20 bp, Homo sapiens
attgcgagagatgtgtgttg

SEQ ID NO: 2429131 - DNA, 20 bp, Homo sapiens
attgcgtttgaccttttatg

SEQ ID NO: 2429132 - DNA, 21 bp, Homo sapiens
attgcgtttgaccttttatgt

SEQ ID NO: 2429133 - DNA, 21 bp, Homo sapiens
attgctgccccatcagtgctc

SEQ ID NO: 2429134 - DNA, 12 bp, Homo sapiens
atttcacttgtc

SEQ ID NO: 2429135 - DNA, 17 bp, Homo sapiens
atttcagttctaggaaa

SEQ ID NO: 2429136 - DNA, 19 bp, Homo sapiens
atttcagttctaggaaaat

SEQ ID NO: 2429137 - DNA, 23 bp, Homo sapiens
atttcatactgtaacattcagga

SEQ ID NO: 2429138 - DNA, 14 bp, Homo sapiens
atttcatagttcag

SEQ ID NO: 2429139 - DNA, 17 bp, Homo sapiens
atttcatagttcagaat

SEQ ID NO: 2429140 - DNA, 16 bp, Homo sapiens
atttcatgtttttgat

SEQ ID NO: 2429141 - DNA, 18 bp, Homo sapiens
atttcatttcaactgttt

SEQ ID NO: 2429142 - DNA, 20 bp, Homo sapiens
atttccaactcgaatctgtg

SEQ ID NO: 2429143 - DNA, 17 bp, Homo sapiens
atttcctaatactgtca

SEQ ID NO: 2429144 - DNA, 16 bp, Homo sapiens
atttcctccacaaatt

SEQ ID NO: 2429145 - DNA, 14 bp, Homo sapiens
atttccttgaatgt

SEQ ID NO: 2429146 - DNA, 14 bp, Homo sapiens
atttctaaaatctt

SEQ ID NO: 2429147 - DNA, 22 bp, Homo sapiens
atttctaattatgtagctcttt

SEQ ID NO: 2429148 - DNA, 15 bp, Homo sapiens
atttctatttctcct

SEQ ID NO: 2429149 - DNA, 12 bp, Homo sapiens
atttctcaggct

SEQ ID NO: 2429150 - DNA, 13 bp, Homo sapiens
atttctgcatatg

SEQ ID NO: 2429151 - DNA, 18 bp, Homo sapiens
atttctgcatatgttgaa

SEQ ID NO: 2429152 - DNA, 15 bp, Homo sapiens
atttctgtgttgcca

SEQ ID NO: 2429153 - DNA, 19 bp, Homo sapiens
atttcttcctaccaagtca

SEQ ID NO: 2429154 - DNA, 14 bp, Homo sapiens
atttcttcttacca

SEQ ID NO: 2429155 - DNA, 16 bp, Homo sapiens
atttgaagaacatgtg

SEQ ID NO: 2429156 - DNA, 20 bp, Homo sapiens
atttgaatgatttttcttta

SEQ ID NO: 2429157 - DNA, 22 bp, Homo sapiens
atttgacttttctgtaattcag

SEQ ID NO: 2429158 - DNA, 17 bp, Homo sapiens
atttgatgtaatacttc

SEQ ID NO: 2429159 - DNA, 13 bp, Homo sapiens
atttgattgattt

SEQ ID NO: 2429160 - DNA, 11 bp, Homo sapiens
atttgcacagt

SEQ ID NO: 2429161 - DNA, 14 bp, Homo sapiens
atttgcagggtcct

SEQ ID NO: 2429162 - DNA, 21 bp, Homo sapiens
atttgcatttgtttatgtaat

SEQ ID NO: 2429163 - DNA, 13 bp, Homo sapiens
atttgctaatttt

SEQ ID NO: 2429164 - DNA, 13 bp, Homo sapiens
atttgctttggaa

SEQ ID NO: 2429165 - DNA, 17 bp, Homo sapiens
atttgctttttgtgata

SEQ ID NO: 2429166 - DNA, 22 bp, Homo sapiens
atttggaaataaagtcagatgg

SEQ ID NO: 2429167 - DNA, 17 bp, Homo sapiens
atttggaaccttgtttt

SEQ ID NO: 2429168 - DNA, 13 bp, Homo sapiens
atttggaatactt

SEQ ID NO: 2429169 - DNA, 23 bp, Homo sapiens
atttggatttaaaagcctgctca

SEQ ID NO: 2429170 - DNA, 19 bp, Homo sapiens
atttggcaatgccatcatc

SEQ ID NO: 2429171 - DNA, 14 bp, Homo sapiens
atttggcatccctg

SEQ ID NO: 2429172 - DNA, 20 bp, Homo sapiens
atttggcatccctgggcctt

SEQ ID NO: 2429173 - DNA, 19 bp, Homo sapiens
atttggcttgacaaaggca

SEQ ID NO: 2429174 - DNA, 14 bp, Homo sapiens
atttgggaagtgaa

SEQ ID NO: 2429175 - DNA, 23 bp, Homo sapiens
atttgggcctgctccagacctga

SEQ ID NO: 2429176 - DNA, 15 bp, Homo sapiens
atttggggcttccaa

SEQ ID NO: 2429177 - DNA, 15 bp, Homo sapiens
atttgggtccaggag

SEQ ID NO: 2429178 - DNA, 14 bp, Homo sapiens
atttgggtgggagt

SEQ ID NO: 2429179 - DNA, 16 bp, Homo sapiens
atttggttcattaatt

SEQ ID NO: 2429180 - DNA, 21 bp, Homo sapiens
atttggttcattaattctata

SEQ ID NO: 2429181 - DNA, 16 bp, Homo sapiens
atttgtaaaatgacaa

SEQ ID NO: 2429182 - DNA, 17 bp, Homo sapiens
atttgtaatagatgttt

SEQ ID NO: 2429183 - DNA, 20 bp, Homo sapiens
atttgtaatgtcttgagctc

SEQ ID NO: 2429184 - DNA, 13 bp, Homo sapiens
atttgtaattaaa

SEQ ID NO: 2429185 - DNA, 21 bp, Homo sapiens
atttgtaattaaaagcaaatc

SEQ ID NO: 2429186 - DNA, 19 bp, Homo sapiens
atttgtactatttaactga

SEQ ID NO: 2429187 - DNA, 22 bp, Homo sapiens
atttgtactatttaactgacta

SEQ ID NO: 2429188 - DNA, 16 bp, Homo sapiens
atttgtagggtttcta

SEQ ID NO: 2429189 - DNA, 19 bp, Homo sapiens
atttgtcagtatttttgcc

SEQ ID NO: 2429190 - DNA, 19 bp, Homo sapiens
atttgtcatgctgggattt

SEQ ID NO: 2429191 - DNA, 13 bp, Homo sapiens
atttgtgttttaa

SEQ ID NO: 2429192 - DNA, 16 bp, Homo sapiens
atttgttattttgcaa

SEQ ID NO: 2429193 - DNA, 17 bp, Homo sapiens
atttgttcccaagagca

SEQ ID NO: 2429194 - DNA, 17 bp, Homo sapiens
atttgttcttgtattta

SEQ ID NO: 2429195 - DNA, 22 bp, Homo sapiens
atttgtttatggtaaaaaattt

SEQ ID NO: 2429196 - DNA, 18 bp, Homo sapiens
atttgtttatgtaatttc

SEQ ID NO: 2429197 - DNA, 15 bp, Homo sapiens
atttgttttggatat

SEQ ID NO: 2429198 - DNA, 16 bp, Homo sapiens
atttgttttgtttaca

SEQ ID NO: 2429199 - DNA, 16 bp, Homo sapiens
atttgtttttaaactg

SEQ ID NO: 2429200 - DNA, 18 bp, Homo sapiens
atttgtttttaaactgta

SEQ ID NO: 2429201 - DNA, 21 bp, Homo sapiens
atttgtttttaaactgtacag

SEQ ID NO: 2429202 - DNA, 20 bp, Homo sapiens
attttaaaatagcgttcttg

SEQ ID NO: 2429203 - DNA, 15 bp, Homo sapiens
attttaaacagagga

SEQ ID NO: 2429204 - DNA, 14 bp, Homo sapiens
attttaatcaaatt

SEQ ID NO: 2429205 - DNA, 13 bp, Homo sapiens
attttaattatta

SEQ ID NO: 2429206 - DNA, 23 bp, Homo sapiens
attttaattattattcttcataa

SEQ ID NO: 2429207 - DNA, 14 bp, Homo sapiens
attttaattctctc

SEQ ID NO: 2429208 - DNA, 13 bp, Homo sapiens
attttacatgaag

SEQ ID NO: 2429209 - DNA, 13 bp, Homo sapiens
attttagcagaga

SEQ ID NO: 2429210 - DNA, 12 bp, Homo sapiens
attttagcattt

SEQ ID NO: 2429211 - DNA, 21 bp, Homo sapiens
attttaggagctaaggctcta

SEQ ID NO: 2429212 - DNA, 19 bp, Homo sapiens
attttagtttttcattaaa

SEQ ID NO: 2429213 - DNA, 18 bp, Homo sapiens
attttatattacactaca

SEQ ID NO: 2429214 - DNA, 12 bp, Homo sapiens
attttatgttat

SEQ ID NO: 2429215 - DNA, 18 bp, Homo sapiens
attttatgttatatataa

SEQ ID NO: 2429216 - DNA, 14 bp, Homo sapiens
attttattatgaag

SEQ ID NO: 2429217 - DNA, 16 bp, Homo sapiens
attttattatgaagaa

SEQ ID NO: 2429218 - DNA, 17 bp, Homo sapiens
attttcaatagccacta

SEQ ID NO: 2429219 - DNA, 20 bp, Homo sapiens
attttcaatagccactaacc

SEQ ID NO: 2429220 - DNA, 16 bp, Homo sapiens
attttcaccccaccct

SEQ ID NO: 2429221 - DNA, 21 bp, Homo sapiens
attttcataagtatttcaaat

SEQ ID NO: 2429222 - DNA, 17 bp, Homo sapiens
attttcatccttgtctt

SEQ ID NO: 2429223 - DNA, 21 bp, Homo sapiens
attttccaggcttctgctggg

SEQ ID NO: 2429224 - DNA, 22 bp, Homo sapiens
attttcctgtcctctttcagct

SEQ ID NO: 2429225 - DNA, 19 bp, Homo sapiens
attttcctgttgtcaagaa

SEQ ID NO: 2429226 - DNA, 16 bp, Homo sapiens
attttctaagaaacat

SEQ ID NO: 2429227 - DNA, 22 bp, Homo sapiens
attttctaagaaacatttatat

SEQ ID NO: 2429228 - DNA, 16 bp, Homo sapiens
attttctctcaggtga

SEQ ID NO: 2429229 - DNA, 22 bp, Homo sapiens
attttctggattccccatctca

SEQ ID NO: 2429230 - DNA, 18 bp, Homo sapiens
attttgaatcaataatat

SEQ ID NO: 2429231 - DNA, 17 bp, Homo sapiens
attttgacataaagttg

SEQ ID NO: 2429232 - DNA, 24 bp, Homo sapiens
attttgacataaagttgataaaga

SEQ ID NO: 2429233 - DNA, 14 bp, Homo sapiens
attttgagttgcca

SEQ ID NO: 2429234 - DNA, 16 bp, Homo sapiens
attttgcaaagattta

SEQ ID NO: 2429235 - DNA, 21 bp, Homo sapiens
attttgcaatcccttaatatc

SEQ ID NO: 2429236 - DNA, 20 bp, Homo sapiens
attttgccaagggcataaat

SEQ ID NO: 2429237 - DNA, 11 bp, Homo sapiens
attttggaatt

SEQ ID NO: 2429238 - DNA, 21 bp, Homo sapiens
cacagcttgacctgaggctgt

SEQ ID NO: 2429239 - DNA, 22 bp, Homo sapiens
cacagcttgacctgaggctgtg

SEQ ID NO: 2429240 - DNA, 20 bp, Homo sapiens
cacagcttgtctcttgcctg

SEQ ID NO: 2429241 - DNA, 22 bp, Homo sapiens
cacagcttgtctcttgcctgcc

SEQ ID NO: 2429242 - DNA, 13 bp, Homo sapiens
cacagcttttgca

SEQ ID NO: 2429243 - DNA, 16 bp, Homo sapiens
cacaggagctacctgt

SEQ ID NO: 2429244 - DNA, 19 bp, Homo sapiens
cacaggagggcggcctcct

SEQ ID NO: 2429245 - DNA, 22 bp, Homo sapiens
cacaggagggggtcgtggagag

SEQ ID NO: 2429246 - DNA, 16 bp, Homo sapiens
cacaggagtgtcctct

SEQ ID NO: 2429247 - DNA, 11 bp, Homo sapiens
cacaggcagcc

SEQ ID NO: 2429248 - DNA, 15 bp, Homo sapiens
cacaggcatttcctg

SEQ ID NO: 2429249 - DNA, 18 bp, Homo sapiens
cacaggcatttcctgggt

SEQ ID NO: 2429250 - DNA, 19 bp, Homo sapiens
cacaggcatttcctgggtg

SEQ ID NO: 2429251 - DNA, 12 bp, Homo sapiens
cacaggccccct

SEQ ID NO: 2429252 - DNA, 14 bp, Homo sapiens
cacaggcctgtgta

SEQ ID NO: 2429253 - DNA, 21 bp, Homo sapiens
cacaggcctgtgtagctgtga

SEQ ID NO: 2429254 - DNA, 14 bp, Homo sapiens
cacaggctcaggca

SEQ ID NO: 2429255 - DNA, 16 bp, Homo sapiens
cacaggctcaggcagg

SEQ ID NO: 2429256 - DNA, 23 bp, Homo sapiens
cacagggcggtaccttgtgccca

SEQ ID NO: 2429257 - DNA, 22 bp, Homo sapiens
cacagggtccccgagtgcctag

SEQ ID NO: 2429258 - DNA, 17 bp, Homo sapiens
cacagggtctgctcttt

SEQ ID NO: 2429259 - DNA, 13 bp, Homo sapiens
cacaggtctagac

SEQ ID NO: 2429260 - DNA, 15 bp, Homo sapiens
cacagtatttgtaat

SEQ ID NO: 2429261 - DNA, 15 bp, Homo sapiens
cacagtgacttctga

SEQ ID NO: 2429262 - DNA, 16 bp, Homo sapiens
cacagtgacttctgag

SEQ ID NO: 2429263 - DNA, 16 bp, Homo sapiens
cacagtgctcttttct

SEQ ID NO: 2429264 - DNA, 14 bp, Homo sapiens
cacagtgttgccca

SEQ ID NO: 2429265 - DNA, 16 bp, Homo sapiens
cacagtgttggaggtt

SEQ ID NO: 2429266 - DNA, 18 bp, Homo sapiens
cacagttctttgggccag

SEQ ID NO: 2429267 - DNA, 20 bp, Homo sapiens
cacagttctttgggccagac

SEQ ID NO: 2429268 - DNA, 23 bp, Homo sapiens
cacagttctttgggccagacatg

SEQ ID NO: 2429269 - DNA, 18 bp, Homo sapiens
cacagttgaagggagggg

SEQ ID NO: 2429270 - DNA, 15 bp, Homo sapiens
cacagtttgaaataa

SEQ ID NO: 2429271 - DNA, 12 bp, Homo sapiens
cacataaaactt

SEQ ID NO: 2429272 - DNA, 15 bp, Homo sapiens
cacatattttaaaat

SEQ ID NO: 2429273 - DNA, 13 bp, Homo sapiens
cacatccctgggc

SEQ ID NO: 2429274 - DNA, 14 bp, Homo sapiens
cacatccctgggcc

SEQ ID NO: 2429275 - DNA, 18 bp, Homo sapiens
cacatccctgggcctgct

SEQ ID NO: 2429276 - DNA, 19 bp, Homo sapiens
cacatcgcagattctccct

SEQ ID NO: 2429277 - DNA, 13 bp, Homo sapiens
cacatctcaacag

SEQ ID NO: 2429278 - DNA, 17 bp, Homo sapiens
cacatctgtgtcttgtt

SEQ ID NO: 2429279 - DNA, 15 bp, Homo sapiens
cacatgaacttagat

SEQ ID NO: 2429280 - DNA, 22 bp, Homo sapiens
cacatgtgagcatgtcacttcc

SEQ ID NO: 2429281 - DNA, 12 bp, Homo sapiens
cacattaaagaa

SEQ ID NO: 2429282 - DNA, 20 bp, Homo sapiens
cacattaaagaagacctgag

SEQ ID NO: 2429283 - DNA, 19 bp, Homo sapiens
cacatttgctttttgtgat

SEQ ID NO: 2429284 - DNA, 15 bp, Homo sapiens
caccaaaagaagtaa

SEQ ID NO: 2429285 - DNA, 13 bp, Homo sapiens
caccaaagttcta

SEQ ID NO: 2429286 - DNA, 13 bp, Homo sapiens
caccaaatgtgct

SEQ ID NO: 2429287 - DNA, 14 bp, Homo sapiens
caccaaccctcagg

SEQ ID NO: 2429288 - DNA, 15 bp, Homo sapiens
caccaaccctcaggg

SEQ ID NO: 2429289 - DNA, 16 bp, Homo sapiens
caccaagcacagcagc

SEQ ID NO: 2429290 - DNA, 19 bp, Homo sapiens
caccaagcacagcagcctg

SEQ ID NO: 2429291 - DNA, 14 bp, Homo sapiens
caccaagccaaggg

SEQ ID NO: 2429292 - DNA, 22 bp, Homo sapiens
caccaagtgcgggtccggcagc

SEQ ID NO: 2429293 - DNA, 22 bp, Homo sapiens
caccaatgtacccaccgggcca

SEQ ID NO: 2429294 - DNA, 19 bp, Homo sapiens
caccacagccagcacctgg

SEQ ID NO: 2429295 - DNA, 20 bp, Homo sapiens
caccaccctgctcatccact

SEQ ID NO: 2429296 - DNA, 22 bp, Homo sapiens
caccacggaccaaagggagtct

SEQ ID NO: 2429297 - DNA, 15 bp, Homo sapiens
caccacgtccagctg

SEQ ID NO: 2429298 - DNA, 13 bp, Homo sapiens
caccactctggca

SEQ ID NO: 2429299 - DNA, 14 bp, Homo sapiens
caccactctggcag

SEQ ID NO: 2429300 - DNA, 15 bp, Homo sapiens
caccactctggcagc

SEQ ID NO: 2429301 - DNA, 17 bp, Homo sapiens
caccactctggcagcca

SEQ ID NO: 2429302 - DNA, 18 bp, Homo sapiens
caccactctggcagccac

SEQ ID NO: 2429303 - DNA, 19 bp, Homo sapiens
caccactctggcagccaca

SEQ ID NO: 2429304 - DNA, 14 bp, Homo sapiens
caccagacacccag

SEQ ID NO: 2429305 - DNA, 16 bp, Homo sapiens
caccagacacccagga

SEQ ID NO: 2429306 - DNA, 13 bp, Homo sapiens
caccagatctgat

SEQ ID NO: 2429307 - DNA, 15 bp, Homo sapiens
caccaggccacctcc

SEQ ID NO: 2429308 - DNA, 22 bp, Homo sapiens
caccaggccacctccccagcat

SEQ ID NO: 2429309 - DNA, 23 bp, Homo sapiens
caccaggcgctaattcaaggaat

SEQ ID NO: 2429310 - DNA, 21 bp, Homo sapiens
caccaggctgaggtcctgatc

SEQ ID NO: 2429311 - DNA, 18 bp, Homo sapiens
caccagggcatctctggg

SEQ ID NO: 2429312 - DNA, 23 bp, Homo sapiens
caccagggcatctctgggctgga

SEQ ID NO: 2429313 - DNA, 15 bp, Homo sapiens
caccatgattccttt

SEQ ID NO: 2429314 - DNA, 19 bp, Homo sapiens
caccatgattcctttaaca

SEQ ID NO: 2429315 - DNA, 17 bp, Homo sapiens
caccatgctgctgggga

SEQ ID NO: 2429316 - DNA, 19 bp, Homo sapiens
caccatgctgctggggaag

SEQ ID NO: 2429317 - DNA, 22 bp, Homo sapiens
caccatgctgctggggaagaca

SEQ ID NO: 2429318 - DNA, 20 bp, Homo sapiens
caccatgttgcccaggctgg

SEQ ID NO: 2429319 - DNA, 17 bp, Homo sapiens
caccattataatgaatt

SEQ ID NO: 2429320 - DNA, 22 bp, Homo sapiens
caccattataatgaatttagtg

SEQ ID NO: 2429321 - DNA, 14 bp, Homo sapiens
caccattctgactc

SEQ ID NO: 2429322 - DNA, 17 bp, Homo sapiens
caccatttggatcctgt

SEQ ID NO: 2429323 - DNA, 20 bp, Homo sapiens
caccatttggcatccctggg

SEQ ID NO: 2429324 - DNA, 21 bp, Homo sapiens
caccatttggcatccctgggc

SEQ ID NO: 2429325 - DNA, 14 bp, Homo sapiens
cacccaacgctcca

SEQ ID NO: 2429326 - DNA, 17 bp, Homo sapiens
cacccaccaaccctcag

SEQ ID NO: 2429327 - DNA, 15 bp, Homo sapiens
cacccacttctgcac

SEQ ID NO: 2429328 - DNA, 20 bp, Homo sapiens
cacccagatgcccctttctg

SEQ ID NO: 2429329 - DNA, 20 bp, Homo sapiens
cacccaggctggagtgcagt

SEQ ID NO: 2429330 - DNA, 16 bp, Homo sapiens
cacccatccctgtggt

SEQ ID NO: 2429331 - DNA, 18 bp, Homo sapiens
cacccatttttccttttg

SEQ ID NO: 2429332 - DNA, 18 bp, Homo sapiens
caccccaaagctttcctg

SEQ ID NO: 2429333 - DNA, 21 bp, Homo sapiens
caccccacccacttctgcact

SEQ ID NO: 2429334 - DNA, 18 bp, Homo sapiens
caccccacgccttatccc

SEQ ID NO: 2429335 - DNA, 16 bp, Homo sapiens
caccccagggcagcca

SEQ ID NO: 2429336 - DNA, 12 bp, Homo sapiens
caccccatccca

SEQ ID NO: 2429337 - DNA, 15 bp, Homo sapiens
caccccatcccacac

SEQ ID NO: 2429338 - DNA, 12 bp, Homo sapiens
cacccccaaggt

SEQ ID NO: 2429339 - DNA, 14 bp, Homo sapiens
cacccccaccccca

SEQ ID NO: 2429340 - DNA, 12 bp, Homo sapiens
cacccccagcct

SEQ ID NO: 2429341 - DNA, 17 bp, Homo sapiens
cacccccatctctccct

SEQ ID NO: 2429342 - DNA, 18 bp, Homo sapiens
cagagaagccagcttgtt

SEQ ID NO: 2429343 - DNA, 12 bp, Homo sapiens
cagagaagccat

SEQ ID NO: 2429344 - DNA, 21 bp, Homo sapiens
cagagaagccatcacctcaga

SEQ ID NO: 2429345 - DNA, 17 bp, Homo sapiens
cagagaagccttcaagc

SEQ ID NO: 2429346 - DNA, 18 bp, Homo sapiens
cagagaagccttcaagct

SEQ ID NO: 2429347 - DNA, 19 bp, Homo sapiens
cagagaagccttcaagctc

SEQ ID NO: 2429348 - DNA, 22 bp, Homo sapiens
cagagaagccttcaagctctga

SEQ ID NO: 2429349 - DNA, 16 bp, Homo sapiens
cagagaagtcacaggg

SEQ ID NO: 2429350 - DNA, 18 bp, Homo sapiens
cagagaagtcacagggca

SEQ ID NO: 2429351 - DNA, 20 bp, Homo sapiens
cagagaagtcacagggcagt

SEQ ID NO: 2429352 - DNA, 15 bp, Homo sapiens
cagagacatacttga

SEQ ID NO: 2429353 - DNA, 16 bp, Homo sapiens
cagagacatacttgaa

SEQ ID NO: 2429354 - DNA, 23 bp, Homo sapiens
cagagaccaagatggcccatcct

SEQ ID NO: 2429355 - DNA, 12 bp, Homo sapiens
cagagaccaggg

SEQ ID NO: 2429356 - DNA, 21 bp, Homo sapiens
cagagaccagggctccagccc

SEQ ID NO: 2429357 - DNA, 13 bp, Homo sapiens
cagagacccagcg

SEQ ID NO: 2429358 - DNA, 15 bp, Homo sapiens
cagagacccagcgga

SEQ ID NO: 2429359 - DNA, 14 bp, Homo sapiens
cagagagcagtgct

SEQ ID NO: 2429360 - DNA, 16 bp, Homo sapiens
cagagatgcctccctg

SEQ ID NO: 2429361 - DNA, 23 bp, Homo sapiens
cagagatgcctccctgagctaga

SEQ ID NO: 2429362 - DNA, 19 bp, Homo sapiens
cagagcacctgctgtctgg

SEQ ID NO: 2429363 - DNA, 12 bp, Homo sapiens
cagagccaggag

SEQ ID NO: 2429364 - DNA, 16 bp, Homo sapiens
cagagccaggagaagc

SEQ ID NO: 2429365 - DNA, 20 bp, Homo sapiens
cagagccaggagaagctcag

SEQ ID NO: 2429366 - DNA, 23 bp, Homo sapiens
cagagccaggggggtgaggagct

SEQ ID NO: 2429367 - DNA, 13 bp, Homo sapiens
cagagcccaggct

SEQ ID NO: 2429368 - DNA, 12 bp, Homo sapiens
cagagcctgggg

SEQ ID NO: 2429369 - DNA, 13 bp, Homo sapiens
cagagcctggggc

SEQ ID NO: 2429370 - DNA, 15 bp, Homo sapiens
cagagcgtgagctga

SEQ ID NO: 2429371 - DNA, 17 bp, Homo sapiens
cagagctggctctgagc

SEQ ID NO: 2429372 - DNA, 11 bp, Homo sapiens
cagagctggtg

SEQ ID NO: 2429373 - DNA, 12 bp, Homo sapiens
cagagctggtgc

SEQ ID NO: 2429374 - DNA, 18 bp, Homo sapiens
cagagctggtgcggctgg

SEQ ID NO: 2429375 - DNA, 16 bp, Homo sapiens
cagaggaaggggccag

SEQ ID NO: 2429376 - DNA, 20 bp, Homo sapiens
cagaggaaggggccagaggc

SEQ ID NO: 2429377 - DNA, 15 bp, Homo sapiens
cagaggacacagaga

SEQ ID NO: 2429378 - DNA, 17 bp, Homo sapiens
cagaggacacagagaag

SEQ ID NO: 2429379 - DNA, 15 bp, Homo sapiens
cagaggcccaggctg

SEQ ID NO: 2429380 - DNA, 18 bp, Homo sapiens
cagaggcccaggctgccg

SEQ ID NO: 2429381 - DNA, 19 bp, Homo sapiens
cagaggcccaggctgccgt

SEQ ID NO: 2429382 - DNA, 22 bp, Homo sapiens
cagaggcccccagcccagggct

SEQ ID NO: 2429383 - DNA, 14 bp, Homo sapiens
cagaggcctgcagg

SEQ ID NO: 2429384 - DNA, 17 bp, Homo sapiens
cagaggcctgcagggcc

SEQ ID NO: 2429385 - DNA, 16 bp, Homo sapiens
cagaggcctgggctgg

SEQ ID NO: 2429386 - DNA, 10 bp, Homo sapiens
cagagggctg

SEQ ID NO: 2429387 - DNA, 17 bp, Homo sapiens
cagagggctggaggccc

SEQ ID NO: 2429388 - DNA, 22 bp, Homo sapiens
cagaggggcctgccacctggac

SEQ ID NO: 2429389 - DNA, 15 bp, Homo sapiens
cagagtgagacccag

SEQ ID NO: 2429390 - DNA, 17 bp, Homo sapiens
cagagtgagacccagcc

SEQ ID NO: 2429391 - DNA, 20 bp, Homo sapiens
cagagtgagacccagccctc

SEQ ID NO: 2429392 - DNA, 13 bp, Homo sapiens
cagagttacagtt

SEQ ID NO: 2429393 - DNA, 13 bp, Homo sapiens
cagataacttttt

SEQ ID NO: 2429394 - DNA, 20 bp, Homo sapiens
cagataacttttttttttct

SEQ ID NO: 2429395 - DNA, 14 bp, Homo sapiens
cagataatgtgaaa

SEQ ID NO: 2429396 - DNA, 22 bp, Homo sapiens
cagatacggacagagaccaaga

SEQ ID NO: 2429397 - DNA, 20 bp, Homo sapiens
cagatagtgtagctgaggag

SEQ ID NO: 2429398 - DNA, 18 bp, Homo sapiens
cagatcatcttggaactg

SEQ ID NO: 2429399 - DNA, 13 bp, Homo sapiens
cagatccaggact

SEQ ID NO: 2429400 - DNA, 14 bp, Homo sapiens
cagatccaggagct

SEQ ID NO: 2429401 - DNA, 17 bp, Homo sapiens
cagatccaggagctcca

SEQ ID NO: 2429402 - DNA, 18 bp, Homo sapiens
cagatccaggagctccag

SEQ ID NO: 2429403 - DNA, 19 bp, Homo sapiens
cagatccaggagctccagt

SEQ ID NO: 2429404 - DNA, 15 bp, Homo sapiens
cagatctggaacctc

SEQ ID NO: 2429405 - DNA, 18 bp, Homo sapiens
cagatctggaacctcagc

SEQ ID NO: 2429406 - DNA, 20 bp, Homo sapiens
cagatctggaacctcagcct

SEQ ID NO: 2429407 - DNA, 22 bp, Homo sapiens
cagatctggaacctcagcctgg

SEQ ID NO: 2429408 - DNA, 13 bp, Homo sapiens
cagatgcagggca

SEQ ID NO: 2429409 - DNA, 15 bp, Homo sapiens
cagatgcccctttct

SEQ ID NO: 2429410 - DNA, 14 bp, Homo sapiens
cagatgcctccttc

SEQ ID NO: 2429411 - DNA, 15 bp, Homo sapiens
cagatgctccaagat

SEQ ID NO: 2429412 - DNA, 19 bp, Homo sapiens
cagatgctccaagattcta

SEQ ID NO: 2429413 - DNA, 21 bp, Homo sapiens
cagatgctccaagattctaga

SEQ ID NO: 2429414 - DNA, 22 bp, Homo sapiens
cagatgctccaagattctagat

SEQ ID NO: 2429415 - DNA, 23 bp, Homo sapiens
cagatgctccaagattctagatg

SEQ ID NO: 2429416 - DNA, 14 bp, Homo sapiens
cagatgctttcctg

SEQ ID NO: 2429417 - DNA, 19 bp, Homo sapiens
cagatggaaaattcatttt

SEQ ID NO: 2429418 - DNA, 21 bp, Homo sapiens
cagatggaaaattcatttttt

SEQ ID NO: 2429419 - DNA, 15 bp, Homo sapiens
cagatggcagctttt

SEQ ID NO: 2429420 - DNA, 24 bp, Homo sapiens
cagatgtaggagggactgtcgctg

SEQ ID NO: 2429421 - DNA, 17 bp, Homo sapiens
cagatgtgaaccattaa

SEQ ID NO: 2429422 - DNA, 23 bp, Homo sapiens
cagattttgttggcatagctctg

SEQ ID NO: 2429423 - DNA, 14 bp, Homo sapiens
cagcaaagtggttc

SEQ ID NO: 2429424 - DNA, 12 bp, Homo sapiens
cagcaaccccag

SEQ ID NO: 2429425 - DNA, 21 bp, Homo sapiens
cagcaactatcagactaagcc

SEQ ID NO: 2429426 - DNA, 14 bp, Homo sapiens
cagcaaggcccgag

SEQ ID NO: 2429427 - DNA, 16 bp, Homo sapiens
cagcaaggcccgagca

SEQ ID NO: 2429428 - DNA, 20 bp, Homo sapiens
cagcaaggcccgagcagctg

SEQ ID NO: 2429429 - DNA, 13 bp, Homo sapiens
cagcacaaggcca

SEQ ID NO: 2429430 - DNA, 16 bp, Homo sapiens
cagcacaaggccatct

SEQ ID NO: 2429431 - DNA, 15 bp, Homo sapiens
cagcacacagggcag

SEQ ID NO: 2429432 - DNA, 18 bp, Homo sapiens
cagcacacagggcagtga

SEQ ID NO: 2429433 - DNA, 17 bp, Homo sapiens
cagcacagcttgacctg

SEQ ID NO: 2429434 - DNA, 22 bp, Homo sapiens
cagcacagcttgacctgaggct

SEQ ID NO: 2429435 - DNA, 15 bp, Homo sapiens
cagcaccggaccagc

SEQ ID NO: 2429436 - DNA, 17 bp, Homo sapiens
cagcaccggaccagcct

SEQ ID NO: 2429437 - DNA, 14 bp, Homo sapiens
cagcacctcctcag

SEQ ID NO: 2429438 - DNA, 15 bp, Homo sapiens
cagcacctcctcagc

SEQ ID NO: 2429439 - DNA, 16 bp, Homo sapiens
cagcacctcctcagcc

SEQ ID NO: 2429440 - DNA, 18 bp, Homo sapiens
cagcacctcctcagcctg

SEQ ID NO: 2429441 - DNA, 13 bp, Homo sapiens
cagcacctgccct

SEQ ID NO: 2429442 - DNA, 17 bp, Homo sapiens
cagcactagccaaacct

SEQ ID NO: 2429443 - DNA, 19 bp, Homo sapiens
cagcactgcttgaggaaaa

SEQ ID NO: 2429444 - DNA, 13 bp, Homo sapiens
cagcactgtccct

SEQ ID NO: 2429445 - DNA, 16 bp, Homo sapiens
cagcactgtcccttgc

SEQ ID NO: 2429446 - DNA, 18 bp, Homo sapiens
cagcactgtcccttgcct

SEQ ID NO: 2429447 - DNA, 22 bp, Homo sapiens
caggcccagccgaccccctctc

SEQ ID NO: 2429448 - DNA, 20 bp, Homo sapiens
caggcccccgccttggcctg

SEQ ID NO: 2429449 - DNA, 20 bp, Homo sapiens
caggcccggatgcagaggcc

SEQ ID NO: 2429450 - DNA, 14 bp, Homo sapiens
caggccctggcctc

SEQ ID NO: 2429451 - DNA, 17 bp, Homo sapiens
caggccctggcctcccc

SEQ ID NO: 2429452 - DNA, 20 bp, Homo sapiens
caggccctggcctcccctgc

SEQ ID NO: 2429453 - DNA, 13 bp, Homo sapiens
caggccgggaaaa

SEQ ID NO: 2429454 - DNA, 20 bp, Homo sapiens
caggccgtgacgtctgggtg

SEQ ID NO: 2429455 - DNA, 14 bp, Homo sapiens
caggcctcagggct

SEQ ID NO: 2429456 - DNA, 22 bp, Homo sapiens
caggcctgtgtagctgtgacct

SEQ ID NO: 2429457 - DNA, 13 bp, Homo sapiens
caggctaattttt

SEQ ID NO: 2429458 - DNA, 17 bp, Homo sapiens
caggctaggccagcagg

SEQ ID NO: 2429459 - DNA, 20 bp, Homo sapiens
caggctaggccagcaggggc

SEQ ID NO: 2429460 - DNA, 18 bp, Homo sapiens
caggctcaaacaatgaca

SEQ ID NO: 2429461 - DNA, 15 bp, Homo sapiens
caggctcggcctgcc

SEQ ID NO: 2429462 - DNA, 16 bp, Homo sapiens
caggctcggcctgccc

SEQ ID NO: 2429463 - DNA, 12 bp, Homo sapiens
caggctctcttt

SEQ ID NO: 2429464 - DNA, 12 bp, Homo sapiens
caggctcttagc

SEQ ID NO: 2429465 - DNA, 15 bp, Homo sapiens
caggctcttagcagc

SEQ ID NO: 2429466 - DNA, 21 bp, Homo sapiens
caggctcttagcagcttccag

SEQ ID NO: 2429467 - DNA, 18 bp, Homo sapiens
caggctgaagcaggttcc

SEQ ID NO: 2429468 - DNA, 15 bp, Homo sapiens
caggctgaccacagc

SEQ ID NO: 2429469 - DNA, 22 bp, Homo sapiens
caggctgaggtcctgatcagct

SEQ ID NO: 2429470 - DNA, 16 bp, Homo sapiens
caggctgcctcccttg

SEQ ID NO: 2429471 - DNA, 12 bp, Homo sapiens
caggctgcctga

SEQ ID NO: 2429472 - DNA, 13 bp, Homo sapiens
caggctgcctgag

SEQ ID NO: 2429473 - DNA, 18 bp, Homo sapiens
caggctggccagtccagg

SEQ ID NO: 2429474 - DNA, 16 bp, Homo sapiens
caggctggctccagat

SEQ ID NO: 2429475 - DNA, 17 bp, Homo sapiens
caggctggctccagatg

SEQ ID NO: 2429476 - DNA, 12 bp, Homo sapiens
caggctgggaac

SEQ ID NO: 2429477 - DNA, 10 bp, Homo sapiens
caggctgggc

SEQ ID NO: 2429478 - DNA, 11 bp, Homo sapiens
caggctgggcc

SEQ ID NO: 2429479 - DNA, 12 bp, Homo sapiens
caggctgggcca

SEQ ID NO: 2429480 - DNA, 22 bp, Homo sapiens
caggctgggccatgtccaaaga

SEQ ID NO: 2429481 - DNA, 14 bp, Homo sapiens
caggcttctgctgg

SEQ ID NO: 2429482 - DNA, 14 bp, Homo sapiens
caggcttttgtttc

SEQ ID NO: 2429483 - DNA, 20 bp, Homo sapiens
cagggaacatggggaggagg

SEQ ID NO: 2429484 - DNA, 14 bp, Homo sapiens
cagggaaggaggag

SEQ ID NO: 2429485 - DNA, 20 bp, Homo sapiens
cagggaaggaggagcctgtc

SEQ ID NO: 2429486 - DNA, 23 bp, Homo sapiens
cagggaaggaggagcctgtcctg

SEQ ID NO: 2429487 - DNA, 12 bp, Homo sapiens
cagggaaggcag

SEQ ID NO: 2429488 - DNA, 22 bp, Homo sapiens
cagggaaggcaggcagggctct

SEQ ID NO: 2429489 - DNA, 17 bp, Homo sapiens
cagggacacctgggaga

SEQ ID NO: 2429490 - DNA, 19 bp, Homo sapiens
cagggacagaggccccagc

SEQ ID NO: 2429491 - DNA, 22 bp, Homo sapiens
cagggaccacaccctgtactgt

SEQ ID NO: 2429492 - DNA, 21 bp, Homo sapiens
cagggacttcaggatcaagtc

SEQ ID NO: 2429493 - DNA, 19 bp, Homo sapiens
cagggagagcccaggagct

SEQ ID NO: 2429494 - DNA, 20 bp, Homo sapiens
cagggagagcccaggagctc

SEQ ID NO: 2429495 - DNA, 15 bp, Homo sapiens
cagggagcggccggc

SEQ ID NO: 2429496 - DNA, 19 bp, Homo sapiens
cagggagcggccggccagc

SEQ ID NO: 2429497 - DNA, 23 bp, Homo sapiens
cagggagcggccggccagcccct

SEQ ID NO: 2429498 - DNA, 17 bp, Homo sapiens
cagggaggccctgtgcc

SEQ ID NO: 2429499 - DNA, 22 bp, Homo sapiens
cagggaggctggtcctatggcc

SEQ ID NO: 2429500 - DNA, 19 bp, Homo sapiens
cagggattaacctctgcac

SEQ ID NO: 2429501 - DNA, 18 bp, Homo sapiens
cagggcacaggagctacc

SEQ ID NO: 2429502 - DNA, 12 bp, Homo sapiens
cagggcagccag

SEQ ID NO: 2429503 - DNA, 22 bp, Homo sapiens
cagggcagccagggagagccca

SEQ ID NO: 2429504 - DNA, 17 bp, Homo sapiens
cagggcagcgccaggct

SEQ ID NO: 2429505 - DNA, 18 bp, Homo sapiens
cagggcagcgccaggctg

SEQ ID NO: 2429506 - DNA, 13 bp, Homo sapiens
cagggcagggccc

SEQ ID NO: 2429507 - DNA, 17 bp, Homo sapiens
cagggcatctctgggct

SEQ ID NO: 2429508 - DNA, 24 bp, Homo sapiens
cagggcatctctgggctggatgag

SEQ ID NO: 2429509 - DNA, 17 bp, Homo sapiens
cagggccacgctccagc

SEQ ID NO: 2429510 - DNA, 20 bp, Homo sapiens
cagggccacgctccagctgc

SEQ ID NO: 2429511 - DNA, 16 bp, Homo sapiens
cagggccatgctgagg

SEQ ID NO: 2429512 - DNA, 15 bp, Homo sapiens
cagggcccccatctc

SEQ ID NO: 2429513 - DNA, 21 bp, Homo sapiens
cagggcccccatctcatgccc

SEQ ID NO: 2429514 - DNA, 20 bp, Homo sapiens
cagggccggggaactggcca

SEQ ID NO: 2429515 - DNA, 20 bp, Homo sapiens
cagggcgggcagagggctgg

SEQ ID NO: 2429516 - DNA, 23 bp, Homo sapiens
cagggcggtaccttgtgcccagg

SEQ ID NO: 2429517 - DNA, 22 bp, Homo sapiens
cagggctccagcccctcttgga

SEQ ID NO: 2429518 - DNA, 15 bp, Homo sapiens
cagggctctgtaagt

SEQ ID NO: 2429519 - DNA, 13 bp, Homo sapiens
cagggctgggagg

SEQ ID NO: 2429520 - DNA, 14 bp, Homo sapiens
cagggctgggagga

SEQ ID NO: 2429521 - DNA, 19 bp, Homo sapiens
cagggctgggaggaaggac

SEQ ID NO: 2429522 - DNA, 16 bp, Homo sapiens
caggggacaggagtcc

SEQ ID NO: 2429523 - DNA, 16 bp, Homo sapiens
caggggagcagagggg

SEQ ID NO: 2429524 - DNA, 13 bp, Homo sapiens
caggggcctggag

SEQ ID NO: 2429525 - DNA, 14 bp, Homo sapiens
caggggcctggaga

SEQ ID NO: 2429526 - DNA, 21 bp, Homo sapiens
caggggctccctccgccccca

SEQ ID NO: 2429527 - DNA, 16 bp, Homo sapiens
caggggctgcttcctc

SEQ ID NO: 2429528 - DNA, 18 bp, Homo sapiens
caggggctgtcccggagg

SEQ ID NO: 2429529 - DNA, 13 bp, Homo sapiens
caggggcttgact

SEQ ID NO: 2429530 - DNA, 19 bp, Homo sapiens
cagggggaaggtggggtcc

SEQ ID NO: 2429531 - DNA, 15 bp, Homo sapiens
cagggggctgctgct

SEQ ID NO: 2429532 - DNA, 18 bp, Homo sapiens
caggggggtgaggagctg

SEQ ID NO: 2429533 - DNA, 14 bp, Homo sapiens
cagggggtctggct

SEQ ID NO: 2429534 - DNA, 18 bp, Homo sapiens
cagggggtctggctggtg

SEQ ID NO: 2429535 - DNA, 23 bp, Homo sapiens
caggggtctgagctccagctcct

SEQ ID NO: 2429536 - DNA, 13 bp, Homo sapiens
caggggtttctcg

SEQ ID NO: 2429537 - DNA, 16 bp, Homo sapiens
cagggtaggctggagt

SEQ ID NO: 2429538 - DNA, 23 bp, Homo sapiens
cagggtatggactatctgtctgg

SEQ ID NO: 2429539 - DNA, 19 bp, Homo sapiens
cagggtccccgagtgccta

SEQ ID NO: 2429540 - DNA, 20 bp, Homo sapiens
cagggtccccgagtgcctag

SEQ ID NO: 2429541 - DNA, 13 bp, Homo sapiens
cagggtctgctct

SEQ ID NO: 2429542 - DNA, 20 bp, Homo sapiens
cagggtctgctctttctctg

SEQ ID NO: 2429543 - DNA, 22 bp, Homo sapiens
cagggtctgctctttctctgcc

SEQ ID NO: 2429544 - DNA, 23 bp, Homo sapiens
cagggtctgctctttctctgcca

SEQ ID NO: 2429545 - DNA, 15 bp, Homo sapiens
cagggttaagaagac

SEQ ID NO: 2429546 - DNA, 15 bp, Homo sapiens
cagggttttaacttt

SEQ ID NO: 2429547 - DNA, 21 bp, Homo sapiens
caggtacttgtaaattattaa

SEQ ID NO: 2429548 - DNA, 22 bp, Homo sapiens
caggtaggggcccctctcagcc

SEQ ID NO: 2429549 - DNA, 19 bp, Homo sapiens
caggtccaatgagctttct

SEQ ID NO: 2429550 - DNA, 16 bp, Homo sapiens
caggtccagctctgga

SEQ ID NO: 2429551 - DNA, 16 bp, Homo sapiens
catgcggtagccagca

SEQ ID NO: 2429552 - DNA, 21 bp, Homo sapiens
catgcggtagccagcacacag

SEQ ID NO: 2429553 - DNA, 16 bp, Homo sapiens
catgctaagagaagta

SEQ ID NO: 2429554 - DNA, 19 bp, Homo sapiens
catgctcatctgctggtcc

SEQ ID NO: 2429555 - DNA, 15 bp, Homo sapiens
catgctgaggcctgg

SEQ ID NO: 2429556 - DNA, 16 bp, Homo sapiens
catgctgaggcctggg

SEQ ID NO: 2429557 - DNA, 19 bp, Homo sapiens
catgctgaggcctgggccg

SEQ ID NO: 2429558 - DNA, 22 bp, Homo sapiens
catgctgccttattcagggaag

SEQ ID NO: 2429559 - DNA, 14 bp, Homo sapiens
catgctgctgggga

SEQ ID NO: 2429560 - DNA, 23 bp, Homo sapiens
catgcttagcagtccccttccct

SEQ ID NO: 2429561 - DNA, 19 bp, Homo sapiens
catgcttattccatgactg

SEQ ID NO: 2429562 - DNA, 19 bp, Homo sapiens
catggaaatttaaagcagg

SEQ ID NO: 2429563 - DNA, 20 bp, Homo sapiens
catggacaatggaccggaga

SEQ ID NO: 2429564 - DNA, 17 bp, Homo sapiens
catggactctgtcctga

SEQ ID NO: 2429565 - DNA, 23 bp, Homo sapiens
catggagaaagctgacttggctg

SEQ ID NO: 2429566 - DNA, 16 bp, Homo sapiens
catggaggttctaagg

SEQ ID NO: 2429567 - DNA, 15 bp, Homo sapiens
catggagtggcagcc

SEQ ID NO: 2429568 - DNA, 19 bp, Homo sapiens
catggagtggcagcccagc

SEQ ID NO: 2429569 - DNA, 20 bp, Homo sapiens
catggagtggcagcccagcc

SEQ ID NO: 2429570 - DNA, 22 bp, Homo sapiens
catggagtggcagcccagccag

SEQ ID NO: 2429571 - DNA, 13 bp, Homo sapiens
catggatttcttt

SEQ ID NO: 2429572 - DNA, 13 bp, Homo sapiens
catggcagaaggc

SEQ ID NO: 2429573 - DNA, 21 bp, Homo sapiens
catggcagatgtaggagggac

SEQ ID NO: 2429574 - DNA, 17 bp, Homo sapiens
catggcagggggctgct

SEQ ID NO: 2429575 - DNA, 14 bp, Homo sapiens
catggcatcctcca

SEQ ID NO: 2429576 - DNA, 15 bp, Homo sapiens
catggcatcctccag

SEQ ID NO: 2429577 - DNA, 19 bp, Homo sapiens
catggcatcctccagcccc

SEQ ID NO: 2429578 - DNA, 22 bp, Homo sapiens
catggcatcctccagcccctgt

SEQ ID NO: 2429579 - DNA, 14 bp, Homo sapiens
catggccagcagca

SEQ ID NO: 2429580 - DNA, 13 bp, Homo sapiens
catggcccctctg

SEQ ID NO: 2429581 - DNA, 17 bp, Homo sapiens
catggcccctctgacct

SEQ ID NO: 2429582 - DNA, 18 bp, Homo sapiens
catggcccctctgacctg

SEQ ID NO: 2429583 - DNA, 19 bp, Homo sapiens
catggcctgcaaactggga

SEQ ID NO: 2429584 - DNA, 17 bp, Homo sapiens
catgggaccacaactat

SEQ ID NO: 2429585 - DNA, 13 bp, Homo sapiens
catgggagccggg

SEQ ID NO: 2429586 - DNA, 13 bp, Homo sapiens
catgggccagagc

SEQ ID NO: 2429587 - DNA, 16 bp, Homo sapiens
catgggccagagcctc

SEQ ID NO: 2429588 - DNA, 15 bp, Homo sapiens
catggggaggaggag

SEQ ID NO: 2429589 - DNA, 18 bp, Homo sapiens
catggggaggaggagggt

SEQ ID NO: 2429590 - DNA, 19 bp, Homo sapiens
catggggaggaggagggtc

SEQ ID NO: 2429591 - DNA, 16 bp, Homo sapiens
catggtcacacactga

SEQ ID NO: 2429592 - DNA, 19 bp, Homo sapiens
catggtcagccctagggtg

SEQ ID NO: 2429593 - DNA, 16 bp, Homo sapiens
catggtcccacatccc

SEQ ID NO: 2429594 - DNA, 20 bp, Homo sapiens
catggtcccacatccctggg

SEQ ID NO: 2429595 - DNA, 15 bp, Homo sapiens
catggtctgccctct

SEQ ID NO: 2429596 - DNA, 17 bp, Homo sapiens
catggtgccccaggacc

SEQ ID NO: 2429597 - DNA, 22 bp, Homo sapiens
catggtgccccaggaccagctc

SEQ ID NO: 2429598 - DNA, 17 bp, Homo sapiens
catggtgctaggaagag

SEQ ID NO: 2429599 - DNA, 22 bp, Homo sapiens
catggtgctaggaagaggagtg

SEQ ID NO: 2429600 - DNA, 22 bp, Homo sapiens
catggtgggtccatgggcagag

SEQ ID NO: 2429601 - DNA, 16 bp, Homo sapiens
catggtgtccagacag

SEQ ID NO: 2429602 - DNA, 19 bp, Homo sapiens
catggtgttctcctgctgc

SEQ ID NO: 2429603 - DNA, 19 bp, Homo sapiens
catggttaccatgtctttc

SEQ ID NO: 2429604 - DNA, 16 bp, Homo sapiens
catgtaaactgtgcac

SEQ ID NO: 2429605 - DNA, 15 bp, Homo sapiens
catgtaactgcctag

SEQ ID NO: 2429606 - DNA, 16 bp, Homo sapiens
catgtaactgcctaga

SEQ ID NO: 2429607 - DNA, 14 bp, Homo sapiens
catgtaatcctcaa

SEQ ID NO: 2429608 - DNA, 15 bp, Homo sapiens
catgtacatgaagaa

SEQ ID NO: 2429609 - DNA, 20 bp, Homo sapiens
catgtagaaaatttgttatt

SEQ ID NO: 2429610 - DNA, 18 bp, Homo sapiens
catgtattgcacattgta

SEQ ID NO: 2429611 - DNA, 15 bp, Homo sapiens
catgtcaacagcgtt

SEQ ID NO: 2429612 - DNA, 16 bp, Homo sapiens
catgtccaaagaggct

SEQ ID NO: 2429613 - DNA, 18 bp, Homo sapiens
catgtgaccactctgtct

SEQ ID NO: 2429614 - DNA, 14 bp, Homo sapiens
catgtgcccagtta

SEQ ID NO: 2429615 - DNA, 12 bp, Homo sapiens
catgtggctgga

SEQ ID NO: 2429616 - DNA, 18 bp, Homo sapiens
catgtggggccaggtcac

SEQ ID NO: 2429617 - DNA, 13 bp, Homo sapiens
catgtgtataaaa

SEQ ID NO: 2429618 - DNA, 21 bp, Homo sapiens
catgtgtcccagaagatgact

SEQ ID NO: 2429619 - DNA, 13 bp, Homo sapiens
catgtgtggaagt

SEQ ID NO: 2429620 - DNA, 21 bp, Homo sapiens
catgtgtggtacatggtgttt

SEQ ID NO: 2429621 - DNA, 21 bp, Homo sapiens
catgtgtgtccacgactgtct

SEQ ID NO: 2429622 - DNA, 22 bp, Homo sapiens
catgtgtgttaacccagtgctt

SEQ ID NO: 2429623 - DNA, 16 bp, Homo sapiens
catgttagcccttcct

SEQ ID NO: 2429624 - DNA, 14 bp, Homo sapiens
catgttatttgtaa

SEQ ID NO: 2429625 - DNA, 18 bp, Homo sapiens
catgttctgtcccttgcc

SEQ ID NO: 2429626 - DNA, 22 bp, Homo sapiens
catgtttggaaggggtctgtag

SEQ ID NO: 2429627 - DNA, 14 bp, Homo sapiens
cattaaaatataat

SEQ ID NO: 2429628 - DNA, 23 bp, Homo sapiens
cattaaaccatctccctggtgct

SEQ ID NO: 2429629 - DNA, 13 bp, Homo sapiens
cattaaataaatt

SEQ ID NO: 2429630 - DNA, 12 bp, Homo sapiens
cattaatctgcc

SEQ ID NO: 2429631 - DNA, 17 bp, Homo sapiens
cattagggatgcctcct

SEQ ID NO: 2429632 - DNA, 13 bp, Homo sapiens
cattataatgaat

SEQ ID NO: 2429633 - DNA, 17 bp, Homo sapiens
cattatgtggttttaga

SEQ ID NO: 2429634 - DNA, 12 bp, Homo sapiens
cattattacttt

SEQ ID NO: 2429635 - DNA, 15 bp, Homo sapiens
cattatttatgtatt

SEQ ID NO: 2429636 - DNA, 16 bp, Homo sapiens
cattatttatgtattg

SEQ ID NO: 2429637 - DNA, 23 bp, Homo sapiens
cattcaaaatagggtatattttc

SEQ ID NO: 2429638 - DNA, 12 bp, Homo sapiens
cattcaacaaga

SEQ ID NO: 2429639 - DNA, 18 bp, Homo sapiens
cattcaagtgtaaaatat

SEQ ID NO: 2429640 - DNA, 20 bp, Homo sapiens
cattcaagtgtaaaatattt

SEQ ID NO: 2429641 - DNA, 21 bp, Homo sapiens
cattcaagtgtaaaatatttt

SEQ ID NO: 2429642 - DNA, 22 bp, Homo sapiens
cattcaagtgtaaaatattttg

SEQ ID NO: 2429643 - DNA, 23 bp, Homo sapiens
cattcaagtgtaaaatattttga

SEQ ID NO: 2429644 - DNA, 23 bp, Homo sapiens
cattcacagttctttgggccaga

SEQ ID NO: 2429645 - DNA, 17 bp, Homo sapiens
cattcacatcgcagatt

SEQ ID NO: 2429646 - DNA, 15 bp, Homo sapiens
cattcacctgcccca

SEQ ID NO: 2429647 - DNA, 19 bp, Homo sapiens
cattcaggaattcttggag

SEQ ID NO: 2429648 - DNA, 21 bp, Homo sapiens
cattccaactcgtatagcatg

SEQ ID NO: 2429649 - DNA, 14 bp, Homo sapiens
cattccaagactct

SEQ ID NO: 2429650 - DNA, 11 bp, Homo sapiens
cattcccaggt

SEQ ID NO: 2429651 - DNA, 22 bp, Homo sapiens
cattcccgcagtgggagcaaac

SEQ ID NO: 2429652 - DNA, 18 bp, Homo sapiens
cattcctcatgaatgtaa

SEQ ID NO: 2429653 - DNA, 15 bp, Homo sapiens
cattccttcccagag

SEQ ID NO: 2429654 - DNA, 16 bp, Homo sapiens
cattcgacctataaga

SEQ ID NO: 2429655 - DNA, 15 bp, Homo sapiens
ccaaatttgattgat

SEQ ID NO: 2429656 - DNA, 20 bp, Homo sapiens
ccaaatttgattgatttgaa

SEQ ID NO: 2429657 - DNA, 12 bp, Homo sapiens
ccaacagctgga

SEQ ID NO: 2429658 - DNA, 22 bp, Homo sapiens
ccaacagtttaatgaagatcta

SEQ ID NO: 2429659 - DNA, 18 bp, Homo sapiens
ccaacatcacagcccagc

SEQ ID NO: 2429660 - DNA, 23 bp, Homo sapiens
ccaacatgcactgatgttgtgtt

SEQ ID NO: 2429661 - DNA, 18 bp, Homo sapiens
ccaacccgtggaggctgc

SEQ ID NO: 2429662 - DNA, 13 bp, Homo sapiens
ccaaccctcaggg

SEQ ID NO: 2429663 - DNA, 16 bp, Homo sapiens
ccaaccctgtcctccc

SEQ ID NO: 2429664 - DNA, 13 bp, Homo sapiens
ccaacctgctctc

SEQ ID NO: 2429665 - DNA, 15 bp, Homo sapiens
ccaacctgctctcct

SEQ ID NO: 2429666 - DNA, 23 bp, Homo sapiens
ccaaccttagatgttctaagtct

SEQ ID NO: 2429667 - DNA, 14 bp, Homo sapiens
ccaactactaatag

SEQ ID NO: 2429668 - DNA, 23 bp, Homo sapiens
ccaactcctagttctagaaaaac

SEQ ID NO: 2429669 - DNA, 12 bp, Homo sapiens
ccaactccttcc

SEQ ID NO: 2429670 - DNA, 14 bp, Homo sapiens
ccaactccttccag

SEQ ID NO: 2429671 - DNA, 11 bp, Homo sapiens
ccaacttttct

SEQ ID NO: 2429672 - DNA, 14 bp, Homo sapiens
ccaagaaacgtctt

SEQ ID NO: 2429673 - DNA, 14 bp, Homo sapiens
ccaagaagcagtgg

SEQ ID NO: 2429674 - DNA, 19 bp, Homo sapiens
ccaagaatccacatttcta

SEQ ID NO: 2429675 - DNA, 14 bp, Homo sapiens
ccaagactctagag

SEQ ID NO: 2429676 - DNA, 22 bp, Homo sapiens
ccaagactctagagtccaaggt

SEQ ID NO: 2429677 - DNA, 21 bp, Homo sapiens
ccaagactgctgtggccagga

SEQ ID NO: 2429678 - DNA, 23 bp, Homo sapiens
ccaagactgctgtggccaggagg

SEQ ID NO: 2429679 - DNA, 21 bp, Homo sapiens
ccaagagcatcatgcctctga

SEQ ID NO: 2429680 - DNA, 22 bp, Homo sapiens
ccaagagctacgtatttaatag

SEQ ID NO: 2429681 - DNA, 15 bp, Homo sapiens
ccaagatggcccatc

SEQ ID NO: 2429682 - DNA, 13 bp, Homo sapiens
ccaagattctaga

SEQ ID NO: 2429683 - DNA, 15 bp, Homo sapiens
ccaagattctagatg

SEQ ID NO: 2429684 - DNA, 15 bp, Homo sapiens
ccaagcacagcagcc

SEQ ID NO: 2429685 - DNA, 20 bp, Homo sapiens
ccaagcagttgggactacag

SEQ ID NO: 2429686 - DNA, 22 bp, Homo sapiens
ccaagcagttgggactacaggc

SEQ ID NO: 2429687 - DNA, 20 bp, Homo sapiens
ccaagccaagggaacctgtg

SEQ ID NO: 2429688 - DNA, 15 bp, Homo sapiens
ccaagcggtgtctct

SEQ ID NO: 2429689 - DNA, 17 bp, Homo sapiens
ccaagcggtgtctctcc

SEQ ID NO: 2429690 - DNA, 17 bp, Homo sapiens
ccaagctaagcactgcc

SEQ ID NO: 2429691 - DNA, 13 bp, Homo sapiens
ccaagctccaagc

SEQ ID NO: 2429692 - DNA, 14 bp, Homo sapiens
ccaagctctgcagt

SEQ ID NO: 2429693 - DNA, 17 bp, Homo sapiens
ccaagctgaggtgccca

SEQ ID NO: 2429694 - DNA, 19 bp, Homo sapiens
ccaagctgaggtgcccagg

SEQ ID NO: 2429695 - DNA, 20 bp, Homo sapiens
ccaagctgaggtgcccagga

SEQ ID NO: 2429696 - DNA, 19 bp, Homo sapiens
ccaagctgagtttcctatg

SEQ ID NO: 2429697 - DNA, 13 bp, Homo sapiens
ccaaggaggcagc

SEQ ID NO: 2429698 - DNA, 15 bp, Homo sapiens
ccaaggaggcagcct

SEQ ID NO: 2429699 - DNA, 20 bp, Homo sapiens
ccaaggcagaggcctgggct

SEQ ID NO: 2429700 - DNA, 15 bp, Homo sapiens
ccaagggaggctgct

SEQ ID NO: 2429701 - DNA, 18 bp, Homo sapiens
ccaagggaggctgctgct

SEQ ID NO: 2429702 - DNA, 22 bp, Homo sapiens
ccaagggaggctgctgctgctc

SEQ ID NO: 2429703 - DNA, 18 bp, Homo sapiens
ccaagggccgactaagag

SEQ ID NO: 2429704 - DNA, 13 bp, Homo sapiens
ccaagggctgccg

SEQ ID NO: 2429705 - DNA, 17 bp, Homo sapiens
ccaaggggcctgagcag

SEQ ID NO: 2429706 - DNA, 22 bp, Homo sapiens
ccaaggggcctgagcagtcctt

SEQ ID NO: 2429707 - DNA, 16 bp, Homo sapiens
ccaaggggcttcaggt

SEQ ID NO: 2429708 - DNA, 15 bp, Homo sapiens
ccaaggtgtcctaca

SEQ ID NO: 2429709 - DNA, 20 bp, Homo sapiens
ccaaggtgtcctacagaaaa

SEQ ID NO: 2429710 - DNA, 16 bp, Homo sapiens
ccaaggttctccaaca

SEQ ID NO: 2429711 - DNA, 23 bp, Homo sapiens
ccaaggtttaaagagtctagatt

SEQ ID NO: 2429712 - DNA, 19 bp, Homo sapiens
ccaaggttttataaggctg

SEQ ID NO: 2429713 - DNA, 20 bp, Homo sapiens
ccaaggttttataaggctga

SEQ ID NO: 2429714 - DNA, 21 bp, Homo sapiens
ccaaggttttataaggctgat

SEQ ID NO: 2429715 - DNA, 20 bp, Homo sapiens
ccaagtagctgggattacag

SEQ ID NO: 2429716 - DNA, 15 bp, Homo sapiens
ccaagtgaggcagcc

SEQ ID NO: 2429717 - DNA, 20 bp, Homo sapiens
ccaagtgagtctctctgggc

SEQ ID NO: 2429718 - DNA, 11 bp, Homo sapiens
ccaagttcctc

SEQ ID NO: 2429719 - DNA, 15 bp, Homo sapiens
ccaatattaaatctg

SEQ ID NO: 2429720 - DNA, 16 bp, Homo sapiens
ccaatcaatcttgcat

SEQ ID NO: 2429721 - DNA, 12 bp, Homo sapiens
ccaatcatttta

SEQ ID NO: 2429722 - DNA, 22 bp, Homo sapiens
ccaatcattttaattattattc

SEQ ID NO: 2429723 - DNA, 15 bp, Homo sapiens
ccaatgaaaaaatgt

SEQ ID NO: 2429724 - DNA, 15 bp, Homo sapiens
ccaatgagctttctg

SEQ ID NO: 2429725 - DNA, 16 bp, Homo sapiens
ccaatgagctttctga

SEQ ID NO: 2429726 - DNA, 21 bp, Homo sapiens
ccaatgagctttctgaacagc

SEQ ID NO: 2429727 - DNA, 20 bp, Homo sapiens
ccaatggaatgtgatgttca

SEQ ID NO: 2429728 - DNA, 22 bp, Homo sapiens
ccaatggaatgtgatgttcatg

SEQ ID NO: 2429729 - DNA, 22 bp, Homo sapiens
ccaatgtctggagaccaccagg

SEQ ID NO: 2429730 - DNA, 23 bp, Homo sapiens
ccaatgtttcaagaggagccccc

SEQ ID NO: 2429731 - DNA, 20 bp, Homo sapiens
ccaattagtttcctttttaa

SEQ ID NO: 2429732 - DNA, 14 bp, Homo sapiens
ccaattcagacagg

SEQ ID NO: 2429733 - DNA, 23 bp, Homo sapiens
ccaatttcggattttttccaaaa

SEQ ID NO: 2429734 - DNA, 23 bp, Homo sapiens
ccaattttttaagtgaaaatata

SEQ ID NO: 2429735 - DNA, 22 bp, Homo sapiens
ccacaaaaacaggtatatactt

SEQ ID NO: 2429736 - DNA, 17 bp, Homo sapiens
ccacaacatgaggccac

SEQ ID NO: 2429737 - DNA, 17 bp, Homo sapiens
ccacaactattttcaga

SEQ ID NO: 2429738 - DNA, 22 bp, Homo sapiens
ccacaagcttctgtcctgcccc

SEQ ID NO: 2429739 - DNA, 20 bp, Homo sapiens
ccacacaaggatagatgctg

SEQ ID NO: 2429740 - DNA, 16 bp, Homo sapiens
ccacacagctgccggt

SEQ ID NO: 2429741 - DNA, 16 bp, Homo sapiens
ccacaccctgtactgt

SEQ ID NO: 2429742 - DNA, 13 bp, Homo sapiens
ccacacctgcggc

SEQ ID NO: 2429743 - DNA, 11 bp, Homo sapiens
ccacactcaga

SEQ ID NO: 2429744 - DNA, 18 bp, Homo sapiens
ccacactcagatcctcct

SEQ ID NO: 2429745 - DNA, 12 bp, Homo sapiens
ccacactgcaca

SEQ ID NO: 2429746 - DNA, 14 bp, Homo sapiens
ccacactgcacaat

SEQ ID NO: 2429747 - DNA, 17 bp, Homo sapiens
ccacacttcaaactact

SEQ ID NO: 2429748 - DNA, 15 bp, Homo sapiens
ccacacttctcagga

SEQ ID NO: 2429749 - DNA, 21 bp, Homo sapiens
ccacagacggaagggtaaaca

SEQ ID NO: 2429750 - DNA, 18 bp, Homo sapiens
ccacagataactgaaaat

SEQ ID NO: 2429751 - DNA, 18 bp, Homo sapiens
ccacagccagcacctggc

SEQ ID NO: 2429752 - DNA, 19 bp, Homo sapiens
ccacagccctgtcagcatg

SEQ ID NO: 2429753 - DNA, 22 bp, Homo sapiens
ccacaggaagcctgcagtcctg

SEQ ID NO: 2429754 - DNA, 21 bp, Homo sapiens
ccacaggacatttctctaaga

SEQ ID NO: 2429755 - DNA, 19 bp, Homo sapiens
ccacaggctcaggcagggg

SEQ ID NO: 2429756 - DNA, 20 bp, Homo sapiens
ccacaggctcaggcaggggc

SEQ ID NO: 2429757 - DNA, 19 bp, Homo sapiens
ccacagtcccatctgcttc

SEQ ID NO: 2429758 - DNA, 14 bp, Homo sapiens
ccacagtgtcaggc

SEQ ID NO: 2429759 - DNA, 22 bp, Homo sapiens
cctgccattgtagcgtctttct

SEQ ID NO: 2429760 - DNA, 22 bp, Homo sapiens
cctgcccagttgcactcaggtg

SEQ ID NO: 2429761 - DNA, 21 bp, Homo sapiens
cctgccccaactctcccctga

SEQ ID NO: 2429762 - DNA, 14 bp, Homo sapiens
cctgccccaggcct

SEQ ID NO: 2429763 - DNA, 18 bp, Homo sapiens
cctgccccaggcctgaaa

SEQ ID NO: 2429764 - DNA, 15 bp, Homo sapiens
cctgcccccaatcca

SEQ ID NO: 2429765 - DNA, 18 bp, Homo sapiens
cctgcccccaccccattc

SEQ ID NO: 2429766 - DNA, 15 bp, Homo sapiens
cctgccccccagcct

SEQ ID NO: 2429767 - DNA, 15 bp, Homo sapiens
cctgccccctgcagg

SEQ ID NO: 2429768 - DNA, 22 bp, Homo sapiens
cctgcccttgtttggggcagga

SEQ ID NO: 2429769 - DNA, 11 bp, Homo sapiens
cctgcctcctg

SEQ ID NO: 2429770 - DNA, 21 bp, Homo sapiens
cctgcctctactgggaaggct

SEQ ID NO: 2429771 - DNA, 15 bp, Homo sapiens
cctgcctctcccagg

SEQ ID NO: 2429772 - DNA, 18 bp, Homo sapiens
cctgcctctcccaggcag

SEQ ID NO: 2429773 - DNA, 11 bp, Homo sapiens
cctgcctggag

SEQ ID NO: 2429774 - DNA, 17 bp, Homo sapiens
cctgcctggaggacctg

SEQ ID NO: 2429775 - DNA, 14 bp, Homo sapiens
cctgccttcctcct

SEQ ID NO: 2429776 - DNA, 16 bp, Homo sapiens
cctgccttcctcctgg

SEQ ID NO: 2429777 - DNA, 20 bp, Homo sapiens
cctgcgggtggggcttgggg

SEQ ID NO: 2429778 - DNA, 18 bp, Homo sapiens
cctgctaacggtgctcag

SEQ ID NO: 2429779 - DNA, 13 bp, Homo sapiens
cctgctaggccag

SEQ ID NO: 2429780 - DNA, 18 bp, Homo sapiens
cctgctaggccagagccc

SEQ ID NO: 2429781 - DNA, 19 bp, Homo sapiens
cctgctaggccagagccca

SEQ ID NO: 2429782 - DNA, 21 bp, Homo sapiens
cctgctaggccagagcccact

SEQ ID NO: 2429783 - DNA, 19 bp, Homo sapiens
cctgctcaatccctgagga

SEQ ID NO: 2429784 - DNA, 16 bp, Homo sapiens
cctgctcagccctgca

SEQ ID NO: 2429785 - DNA, 13 bp, Homo sapiens
cctgctcatccac

SEQ ID NO: 2429786 - DNA, 15 bp, Homo sapiens
cctgctcgctccctg

SEQ ID NO: 2429787 - DNA, 13 bp, Homo sapiens
cctgctgacctgt

SEQ ID NO: 2429788 - DNA, 12 bp, Homo sapiens
cctgctgagctc

SEQ ID NO: 2429789 - DNA, 14 bp, Homo sapiens
cctgctgagctctg

SEQ ID NO: 2429790 - DNA, 15 bp, Homo sapiens
cctgctgagctctga

SEQ ID NO: 2429791 - DNA, 17 bp, Homo sapiens
cctgctgagctctgaga

SEQ ID NO: 2429792 - DNA, 12 bp, Homo sapiens
cctgctgccagc

SEQ ID NO: 2429793 - DNA, 14 bp, Homo sapiens
cctgctgctgagaa

SEQ ID NO: 2429794 - DNA, 17 bp, Homo sapiens
cctgctgctgagaacct

SEQ ID NO: 2429795 - DNA, 19 bp, Homo sapiens
cctgctgctgagaacctgg

SEQ ID NO: 2429796 - DNA, 20 bp, Homo sapiens
cctgctgctgagaacctggc

SEQ ID NO: 2429797 - DNA, 21 bp, Homo sapiens
cctgctgctgagaacctggcc

SEQ ID NO: 2429798 - DNA, 23 bp, Homo sapiens
cctgctgctgagaacctggcctt

SEQ ID NO: 2429799 - DNA, 17 bp, Homo sapiens
cctgctgctgtctgggt

SEQ ID NO: 2429800 - DNA, 20 bp, Homo sapiens
cctgctgctgtctgggtgct

SEQ ID NO: 2429801 - DNA, 15 bp, Homo sapiens
cctgcttgccaaggc

SEQ ID NO: 2429802 - DNA, 23 bp, Homo sapiens
cctgcttgccaaggcagaggcct

SEQ ID NO: 2429803 - DNA, 18 bp, Homo sapiens
cctgctttgggcttgggc

SEQ ID NO: 2429804 - DNA, 17 bp, Homo sapiens
cctggaacttggggagt

SEQ ID NO: 2429805 - DNA, 20 bp, Homo sapiens
cctggaatgagttgaggcca

SEQ ID NO: 2429806 - DNA, 16 bp, Homo sapiens
cctggacactcagacc

SEQ ID NO: 2429807 - DNA, 17 bp, Homo sapiens
cctggacagctgtgcct

SEQ ID NO: 2429808 - DNA, 18 bp, Homo sapiens
cctggacagctgtgcctc

SEQ ID NO: 2429809 - DNA, 21 bp, Homo sapiens
cctggacatgaagattctttc

SEQ ID NO: 2429810 - DNA, 22 bp, Homo sapiens
cctggacccgttcatgggggag

SEQ ID NO: 2429811 - DNA, 17 bp, Homo sapiens
cctggacctctgacagc

SEQ ID NO: 2429812 - DNA, 14 bp, Homo sapiens
cctggactgttttc

SEQ ID NO: 2429813 - DNA, 24 bp, Homo sapiens
cctggacttaagcatctggctcta

SEQ ID NO: 2429814 - DNA, 17 bp, Homo sapiens
cctggactttcctgcaa

SEQ ID NO: 2429815 - DNA, 19 bp, Homo sapiens
cctggactttcctgcaact

SEQ ID NO: 2429816 - DNA, 19 bp, Homo sapiens
cctggagacttagggcacc

SEQ ID NO: 2429817 - DNA, 15 bp, Homo sapiens
cctggagatcctcct

SEQ ID NO: 2429818 - DNA, 17 bp, Homo sapiens
cctggagatcctcctgc

SEQ ID NO: 2429819 - DNA, 19 bp, Homo sapiens
cctggagatcctcctgcag

SEQ ID NO: 2429820 - DNA, 18 bp, Homo sapiens
cctggagcagaccacccc

SEQ ID NO: 2429821 - DNA, 12 bp, Homo sapiens
cctggaggacct

SEQ ID NO: 2429822 - DNA, 13 bp, Homo sapiens
cctggaggacctg

SEQ ID NO: 2429823 - DNA, 21 bp, Homo sapiens
cctggaggacctgagcctgcc

SEQ ID NO: 2429824 - DNA, 14 bp, Homo sapiens
cctggaggcccagt

SEQ ID NO: 2429825 - DNA, 14 bp, Homo sapiens
cctggatcagcgtg

SEQ ID NO: 2429826 - DNA, 16 bp, Homo sapiens
cctggatcagcgtggc

SEQ ID NO: 2429827 - DNA, 18 bp, Homo sapiens
cctggatcagcgtggcct

SEQ ID NO: 2429828 - DNA, 18 bp, Homo sapiens
cctggatggggcaggcca

SEQ ID NO: 2429829 - DNA, 23 bp, Homo sapiens
cctggcactaacgttgagcccct

SEQ ID NO: 2429830 - DNA, 20 bp, Homo sapiens
cctggcagctctggacagcc

SEQ ID NO: 2429831 - DNA, 23 bp, Homo sapiens
cctggcatcgcaccattctgact

SEQ ID NO: 2429832 - DNA, 15 bp, Homo sapiens
cctggccagacacag

SEQ ID NO: 2429833 - DNA, 19 bp, Homo sapiens
cctggccagacacaggccc

SEQ ID NO: 2429834 - DNA, 16 bp, Homo sapiens
cctggcccagcctttg

SEQ ID NO: 2429835 - DNA, 12 bp, Homo sapiens
cctggccccagg

SEQ ID NO: 2429836 - DNA, 13 bp, Homo sapiens
cctggccccctcc

SEQ ID NO: 2429837 - DNA, 20 bp, Homo sapiens
cctggcccctctcccttggg

SEQ ID NO: 2429838 - DNA, 19 bp, Homo sapiens
cctggccgagtccaagctg

SEQ ID NO: 2429839 - DNA, 16 bp, Homo sapiens
cctggcctagaccagc

SEQ ID NO: 2429840 - DNA, 18 bp, Homo sapiens
cctggcctcccctgccac

SEQ ID NO: 2429841 - DNA, 19 bp, Homo sapiens
cctggcctcccctgccacc

SEQ ID NO: 2429842 - DNA, 13 bp, Homo sapiens
cctggcctcctgc

SEQ ID NO: 2429843 - DNA, 17 bp, Homo sapiens
cctggcctcctgcctct

SEQ ID NO: 2429844 - DNA, 15 bp, Homo sapiens
cctggcgcctggcag

SEQ ID NO: 2429845 - DNA, 20 bp, Homo sapiens
cctggctccttgtgccagag

SEQ ID NO: 2429846 - DNA, 21 bp, Homo sapiens
cctggctccttgtgccagaga

SEQ ID NO: 2429847 - DNA, 22 bp, Homo sapiens
cctggctccttgtgccagagaa

SEQ ID NO: 2429848 - DNA, 24 bp, Homo sapiens
cctggctgggacgtggctcagcca

SEQ ID NO: 2429849 - DNA, 21 bp, Homo sapiens
cctggctttcattttctctca

SEQ ID NO: 2429850 - DNA, 18 bp, Homo sapiens
cctgggaaagcccctgcc

SEQ ID NO: 2429851 - DNA, 18 bp, Homo sapiens
cctgggaaatattcccta

SEQ ID NO: 2429852 - DNA, 15 bp, Homo sapiens
cctgggacaactgct

SEQ ID NO: 2429853 - DNA, 18 bp, Homo sapiens
cctgggacaactgctccc

SEQ ID NO: 2429854 - DNA, 19 bp, Homo sapiens
cctgggacaactgctccca

SEQ ID NO: 2429855 - DNA, 17 bp, Homo sapiens
cctgggaggagagacac

SEQ ID NO: 2429856 - DNA, 22 bp, Homo sapiens
cctgggagggacatgcttagca

SEQ ID NO: 2429857 - DNA, 11 bp, Homo sapiens
cctgggccctc

SEQ ID NO: 2429858 - DNA, 14 bp, Homo sapiens
cctgggccctctct

SEQ ID NO: 2429859 - DNA, 15 bp, Homo sapiens
cctgggccctggggc

SEQ ID NO: 2429860 - DNA, 16 bp, Homo sapiens
cctgggccctggggcc

SEQ ID NO: 2429861 - DNA, 17 bp, Homo sapiens
cctgggccctggggcct

SEQ ID NO: 2429862 - DNA, 21 bp, Homo sapiens
cctgggccctggggcctgtac

SEQ ID NO: 2429863 - DNA, 23 bp, Homo sapiens
cggacagttccagaagtgtgact

SEQ ID NO: 2429864 - DNA, 23 bp, Homo sapiens
cggaccaaagggagtctgccagg

SEQ ID NO: 2429865 - DNA, 12 bp, Homo sapiens
cggaccagcctg

SEQ ID NO: 2429866 - DNA, 21 bp, Homo sapiens
cggacttagaaaaccagctca

SEQ ID NO: 2429867 - DNA, 13 bp, Homo sapiens
cggagagccagct

SEQ ID NO: 2429868 - DNA, 14 bp, Homo sapiens
cggagcactgcacc

SEQ ID NO: 2429869 - DNA, 14 bp, Homo sapiens
cggaggactcacca

SEQ ID NO: 2429870 - DNA, 14 bp, Homo sapiens
cggaggcggtgggc

SEQ ID NO: 2429871 - DNA, 23 bp, Homo sapiens
cggagtcctgtgtttgtgagtcg

SEQ ID NO: 2429872 - DNA, 18 bp, Homo sapiens
cggatccagggaggctgg

SEQ ID NO: 2429873 - DNA, 14 bp, Homo sapiens
cggatcctaagcat

SEQ ID NO: 2429874 - DNA, 17 bp, Homo sapiens
cggatcctaagcatcta

SEQ ID NO: 2429875 - DNA, 15 bp, Homo sapiens
cggcaccccctgcag

SEQ ID NO: 2429876 - DNA, 16 bp, Homo sapiens
cggcaccccctgcagc

SEQ ID NO: 2429877 - DNA, 17 bp, Homo sapiens
cggcaccccctgcagct

SEQ ID NO: 2429878 - DNA, 16 bp, Homo sapiens
cggcacctcccttggg

SEQ ID NO: 2429879 - DNA, 22 bp, Homo sapiens
cggcagcttctgccccctgcag

SEQ ID NO: 2429880 - DNA, 11 bp, Homo sapiens
cggcaggacac

SEQ ID NO: 2429881 - DNA, 20 bp, Homo sapiens
cggcagggcgggcagagggc

SEQ ID NO: 2429882 - DNA, 14 bp, Homo sapiens
cggcaggggcctgg

SEQ ID NO: 2429883 - DNA, 15 bp, Homo sapiens
cggcaggggcctgga

SEQ ID NO: 2429884 - DNA, 18 bp, Homo sapiens
cggcaggggcctggagat

SEQ ID NO: 2429885 - DNA, 13 bp, Homo sapiens
cggcatttgtttc

SEQ ID NO: 2429886 - DNA, 21 bp, Homo sapiens
cggccacagggcggtaccttg

SEQ ID NO: 2429887 - DNA, 12 bp, Homo sapiens
cggccaggcaga

SEQ ID NO: 2429888 - DNA, 15 bp, Homo sapiens
cggcccaatccaagg

SEQ ID NO: 2429889 - DNA, 16 bp, Homo sapiens
cggccggccagcccct

SEQ ID NO: 2429890 - DNA, 22 bp, Homo sapiens
cggcctccttctgagctcctgt

SEQ ID NO: 2429891 - DNA, 15 bp, Homo sapiens
cggcctgccaggagg

SEQ ID NO: 2429892 - DNA, 15 bp, Homo sapiens
cggcctgtcctccaa

SEQ ID NO: 2429893 - DNA, 21 bp, Homo sapiens
cggcctgtcctccaacaccaa

SEQ ID NO: 2429894 - DNA, 20 bp, Homo sapiens
cggctccccatgtgtcctgg

SEQ ID NO: 2429895 - DNA, 20 bp, Homo sapiens
cggctcctcagggactcagg

SEQ ID NO: 2429896 - DNA, 16 bp, Homo sapiens
cggctcggaggaagcc

SEQ ID NO: 2429897 - DNA, 16 bp, Homo sapiens
cggctctcacctggcc

SEQ ID NO: 2429898 - DNA, 19 bp, Homo sapiens
cggctctgtccccagcctg

SEQ ID NO: 2429899 - DNA, 14 bp, Homo sapiens
cggctgaccatgct

SEQ ID NO: 2429900 - DNA, 16 bp, Homo sapiens
cggctgaccatgctca

SEQ ID NO: 2429901 - DNA, 20 bp, Homo sapiens
cggctggccatggagaaagc

SEQ ID NO: 2429902 - DNA, 15 bp, Homo sapiens
cggcttcatgccagc

SEQ ID NO: 2429903 - DNA, 19 bp, Homo sapiens
cggcttcatgccagctact

SEQ ID NO: 2429904 - DNA, 16 bp, Homo sapiens
cgggatggttctggct

SEQ ID NO: 2429905 - DNA, 21 bp, Homo sapiens
cgggcacgggtgtcacggcca

SEQ ID NO: 2429906 - DNA, 16 bp, Homo sapiens
cgggcagagggctgga

SEQ ID NO: 2429907 - DNA, 19 bp, Homo sapiens
cgggcagagggctggaggc

SEQ ID NO: 2429908 - DNA, 15 bp, Homo sapiens
cgggcctgtccacag

SEQ ID NO: 2429909 - DNA, 12 bp, Homo sapiens
cgggctgtgccc

SEQ ID NO: 2429910 - DNA, 15 bp, Homo sapiens
cggggaactggccaa

SEQ ID NO: 2429911 - DNA, 19 bp, Homo sapiens
cggggcagccccctcacag

SEQ ID NO: 2429912 - DNA, 15 bp, Homo sapiens
cggggcatctggcct

SEQ ID NO: 2429913 - DNA, 15 bp, Homo sapiens
cggggcttgccttct

SEQ ID NO: 2429914 - DNA, 19 bp, Homo sapiens
cgggggagggtaggcagga

SEQ ID NO: 2429915 - DNA, 17 bp, Homo sapiens
cgggggtggcggcggcc

SEQ ID NO: 2429916 - DNA, 20 bp, Homo sapiens
cgggggttccgtgtccaccc

SEQ ID NO: 2429917 - DNA, 22 bp, Homo sapiens
cgggggttccgtgtccaccccc

SEQ ID NO: 2429918 - DNA, 22 bp, Homo sapiens
cggggtgagggggggctccctg

SEQ ID NO: 2429919 - DNA, 16 bp, Homo sapiens
cggggtgcccacaggc

SEQ ID NO: 2429920 - DNA, 13 bp, Homo sapiens
cgggtctgctccc

SEQ ID NO: 2429921 - DNA, 14 bp, Homo sapiens
cgggtctgctccca

SEQ ID NO: 2429922 - DNA, 20 bp, Homo sapiens
cgggtggggcttggggctca

SEQ ID NO: 2429923 - DNA, 21 bp, Homo sapiens
cgggtgtcacggccaggcaga

SEQ ID NO: 2429924 - DNA, 14 bp, Homo sapiens
cggtgcccaagcca

SEQ ID NO: 2429925 - DNA, 15 bp, Homo sapiens
cggtgcccaagccag

SEQ ID NO: 2429926 - DNA, 21 bp, Homo sapiens
cggtgcctttatttccactgt

SEQ ID NO: 2429927 - DNA, 23 bp, Homo sapiens
cggtgcctttatttccactgtgc

SEQ ID NO: 2429928 - DNA, 13 bp, Homo sapiens
cggtgctcagggg

SEQ ID NO: 2429929 - DNA, 13 bp, Homo sapiens
cggtgggcctggt

SEQ ID NO: 2429930 - DNA, 15 bp, Homo sapiens
cggtgtgcaccaggg

SEQ ID NO: 2429931 - DNA, 18 bp, Homo sapiens
cgtaagtacagagaagcc

SEQ ID NO: 2429932 - DNA, 21 bp, Homo sapiens
cgtaagtacagagaagccatc

SEQ ID NO: 2429933 - DNA, 13 bp, Homo sapiens
cgtactcaggagc

SEQ ID NO: 2429934 - DNA, 23 bp, Homo sapiens
cgtagatattggacaaagaacct

SEQ ID NO: 2429935 - DNA, 19 bp, Homo sapiens
cgtaggctacagagaagcc

SEQ ID NO: 2429936 - DNA, 23 bp, Homo sapiens
cgtatttaatagcaaagaattga

SEQ ID NO: 2429937 - DNA, 20 bp, Homo sapiens
cgtcatgcacagtatttgta

SEQ ID NO: 2429938 - DNA, 14 bp, Homo sapiens
cgtcctcctctgtg

SEQ ID NO: 2429939 - DNA, 13 bp, Homo sapiens
cgtcctgagaaag

SEQ ID NO: 2429940 - DNA, 13 bp, Homo sapiens
cgtcctgcctgtg

SEQ ID NO: 2429941 - DNA, 15 bp, Homo sapiens
cgtccttactcctgt

SEQ ID NO: 2429942 - DNA, 16 bp, Homo sapiens
cgtccttactcctgtg

SEQ ID NO: 2429943 - DNA, 17 bp, Homo sapiens
cgtccttactcctgtgg

SEQ ID NO: 2429944 - DNA, 21 bp, Homo sapiens
cgtccttactcctgtgggagc

SEQ ID NO: 2429945 - DNA, 15 bp, Homo sapiens
cgtctaccctgggat

SEQ ID NO: 2429946 - DNA, 11 bp, Homo sapiens
cgtctcagtgt

SEQ ID NO: 2429947 - DNA, 21 bp, Homo sapiens
cgtctccaggggctgcttcct

SEQ ID NO: 2429948 - DNA, 20 bp, Homo sapiens
cgtctcttttaccctggccc

SEQ ID NO: 2429949 - DNA, 12 bp, Homo sapiens
cgtctgggtggc

SEQ ID NO: 2429950 - DNA, 18 bp, Homo sapiens
cgtcttttcctgtttcct

SEQ ID NO: 2429951 - DNA, 18 bp, Homo sapiens
cgtgaatgggtgcccaca

SEQ ID NO: 2429952 - DNA, 17 bp, Homo sapiens
cgtgacaataaaacatt

SEQ ID NO: 2429953 - DNA, 20 bp, Homo sapiens
cgtgagcatgtttggaaggg

SEQ ID NO: 2429954 - DNA, 17 bp, Homo sapiens
cgtgagctgagcaggcc

SEQ ID NO: 2429955 - DNA, 13 bp, Homo sapiens
cgtgatcttggct

SEQ ID NO: 2429956 - DNA, 14 bp, Homo sapiens
cgtgcctgtgtcca

SEQ ID NO: 2429957 - DNA, 19 bp, Homo sapiens
cgtgctcgccccagcaggt

SEQ ID NO: 2429958 - DNA, 22 bp, Homo sapiens
cgtggaatgcccttcactgtca

SEQ ID NO: 2429959 - DNA, 15 bp, Homo sapiens
cgtggactgagtggg

SEQ ID NO: 2429960 - DNA, 19 bp, Homo sapiens
cgtggactgagtgggaagc

SEQ ID NO: 2429961 - DNA, 18 bp, Homo sapiens
cgtggagagctaggagca

SEQ ID NO: 2429962 - DNA, 13 bp, Homo sapiens
cgtggaggctgct

SEQ ID NO: 2429963 - DNA, 18 bp, Homo sapiens
cgtggaggggtaggggct

SEQ ID NO: 2429964 - DNA, 21 bp, Homo sapiens
cgtggaggggtaggggctggg

SEQ ID NO: 2429965 - DNA, 15 bp, Homo sapiens
cgtggcccttcctgg

SEQ ID NO: 2429966 - DNA, 16 bp, Homo sapiens
cgtggcccttcctgga

SEQ ID NO: 2429967 - DNA, 22 bp, Homo sapiens
ctatgtaacatgtaggaagtag

SEQ ID NO: 2429968 - DNA, 11 bp, Homo sapiens
ctattaaaaga

SEQ ID NO: 2429969 - DNA, 19 bp, Homo sapiens
ctattaaaagactcatccg

SEQ ID NO: 2429970 - DNA, 21 bp, Homo sapiens
ctattaaagtgctaaggttct

SEQ ID NO: 2429971 - DNA, 21 bp, Homo sapiens
ctattaggtgcaatttcaagg

SEQ ID NO: 2429972 - DNA, 23 bp, Homo sapiens
ctattatgaatgtgaagccttcc

SEQ ID NO: 2429973 - DNA, 16 bp, Homo sapiens
ctattccagctgtccc

SEQ ID NO: 2429974 - DNA, 15 bp, Homo sapiens
ctattctgtccctag

SEQ ID NO: 2429975 - DNA, 16 bp, Homo sapiens
ctattctgtccctagg

SEQ ID NO: 2429976 - DNA, 18 bp, Homo sapiens
ctattcttgatgtaaaat

SEQ ID NO: 2429977 - DNA, 19 bp, Homo sapiens
ctattcttgatgtaaaatc

SEQ ID NO: 2429978 - DNA, 20 bp, Homo sapiens
ctattcttgatgtaaaatct

SEQ ID NO: 2429979 - DNA, 17 bp, Homo sapiens
ctattgctagagctcct

SEQ ID NO: 2429980 - DNA, 15 bp, Homo sapiens
ctatttaaagcctcc

SEQ ID NO: 2429981 - DNA, 13 bp, Homo sapiens
ctatttaactgac

SEQ ID NO: 2429982 - DNA, 14 bp, Homo sapiens
ctatttattgactt

SEQ ID NO: 2429983 - DNA, 16 bp, Homo sapiens
ctatttattgactttg

SEQ ID NO: 2429984 - DNA, 18 bp, Homo sapiens
ctatttcttaaacacttg

SEQ ID NO: 2429985 - DNA, 16 bp, Homo sapiens
ctatttgatgtaatac

SEQ ID NO: 2429986 - DNA, 18 bp, Homo sapiens
ctattttcagatgtgaac

SEQ ID NO: 2429987 - DNA, 21 bp, Homo sapiens
ctattttccaggcttctgctg

SEQ ID NO: 2429988 - DNA, 15 bp, Homo sapiens
ctatttttctaacta

SEQ ID NO: 2429989 - DNA, 20 bp, Homo sapiens
ctatttttggaggtttatta

SEQ ID NO: 2429990 - DNA, 15 bp, Homo sapiens
ctcaaacaatgacaa

SEQ ID NO: 2429991 - DNA, 19 bp, Homo sapiens
ctcaaagcaagcattcaga

SEQ ID NO: 2429992 - DNA, 18 bp, Homo sapiens
ctcaaaggtttggaagga

SEQ ID NO: 2429993 - DNA, 19 bp, Homo sapiens
ctcaaatcgtccagcgacc

SEQ ID NO: 2429994 - DNA, 16 bp, Homo sapiens
ctcaaatgagtaacat

SEQ ID NO: 2429995 - DNA, 21 bp, Homo sapiens
ctcaaatgagtaacatttgct

SEQ ID NO: 2429996 - DNA, 17 bp, Homo sapiens
ctcaaatgttctaagtt

SEQ ID NO: 2429997 - DNA, 19 bp, Homo sapiens
ctcaacaccatgattcctt

SEQ ID NO: 2429998 - DNA, 14 bp, Homo sapiens
ctcaacacccagtt

SEQ ID NO: 2429999 - DNA, 14 bp, Homo sapiens
ctcaacaggcctca

SEQ ID NO: 2430000 - DNA, 17 bp, Homo sapiens
ctcaacaggcctcaggg

SEQ ID NO: 2430001 - DNA, 18 bp, Homo sapiens
ctcaacaggcctcagggc

SEQ ID NO: 2430002 - DNA, 14 bp, Homo sapiens
ctcaacctctacag

SEQ ID NO: 2430003 - DNA, 16 bp, Homo sapiens
ctcaaccttaagacct

SEQ ID NO: 2430004 - DNA, 16 bp, Homo sapiens
ctcaacgtattgtttc

SEQ ID NO: 2430005 - DNA, 21 bp, Homo sapiens
ctcaagaaataaaaggaagcc

SEQ ID NO: 2430006 - DNA, 23 bp, Homo sapiens
ctcaagacccttttgggtttctg

SEQ ID NO: 2430007 - DNA, 16 bp, Homo sapiens
ctcaagatgaaggcaa

SEQ ID NO: 2430008 - DNA, 22 bp, Homo sapiens
ctcaagcagcgaccgccccctc

SEQ ID NO: 2430009 - DNA, 17 bp, Homo sapiens
ctcaagcgattctcctg

SEQ ID NO: 2430010 - DNA, 20 bp, Homo sapiens
ctcaagctcttccttactcc

SEQ ID NO: 2430011 - DNA, 23 bp, Homo sapiens
ctcaaggcggtgcttgatagaaa

SEQ ID NO: 2430012 - DNA, 14 bp, Homo sapiens
ctcaaggttttagg

SEQ ID NO: 2430013 - DNA, 20 bp, Homo sapiens
ctcaaggttttaggttctaa

SEQ ID NO: 2430014 - DNA, 16 bp, Homo sapiens
ctcaagtctttctctt

SEQ ID NO: 2430015 - DNA, 14 bp, Homo sapiens
ctcaagttctaaga

SEQ ID NO: 2430016 - DNA, 18 bp, Homo sapiens
ctcaagttctaagattct

SEQ ID NO: 2430017 - DNA, 19 bp, Homo sapiens
ctcaagttctaagattcta

SEQ ID NO: 2430018 - DNA, 22 bp, Homo sapiens
ctcaagttgattagaaagacca

SEQ ID NO: 2430019 - DNA, 16 bp, Homo sapiens
ctcaataaatgattct

SEQ ID NO: 2430020 - DNA, 19 bp, Homo sapiens
ctcaatgagcatgtttaga

SEQ ID NO: 2430021 - DNA, 13 bp, Homo sapiens
ctcaatggactgg

SEQ ID NO: 2430022 - DNA, 13 bp, Homo sapiens
ctcacaaggcagc

SEQ ID NO: 2430023 - DNA, 15 bp, Homo sapiens
ctcacaaggcagcaa

SEQ ID NO: 2430024 - DNA, 20 bp, Homo sapiens
ctcacaaggcagcaaggccc

SEQ ID NO: 2430025 - DNA, 19 bp, Homo sapiens
ctcacaagtgggtaccccc

SEQ ID NO: 2430026 - DNA, 13 bp, Homo sapiens
ctcacacaggcat

SEQ ID NO: 2430027 - DNA, 21 bp, Homo sapiens
ctcacacaggcatttcctggg

SEQ ID NO: 2430028 - DNA, 23 bp, Homo sapiens
ctcacacaggcatttcctgggtg

SEQ ID NO: 2430029 - DNA, 17 bp, Homo sapiens
ctcacaccactagcctc

SEQ ID NO: 2430030 - DNA, 20 bp, Homo sapiens
ctcacaccactagcctcagg

SEQ ID NO: 2430031 - DNA, 21 bp, Homo sapiens
ctcacagtgttgcccaggctg

SEQ ID NO: 2430032 - DNA, 16 bp, Homo sapiens
ctcaccacggaccaaa

SEQ ID NO: 2430033 - DNA, 17 bp, Homo sapiens
ctcaccactgccccctg

SEQ ID NO: 2430034 - DNA, 20 bp, Homo sapiens
ctcaccattccaagtctcca

SEQ ID NO: 2430035 - DNA, 17 bp, Homo sapiens
ctcacccccttctccat

SEQ ID NO: 2430036 - DNA, 20 bp, Homo sapiens
ctcacccccttctccatcca

SEQ ID NO: 2430037 - DNA, 21 bp, Homo sapiens
ctcacccgccccactccctcc

SEQ ID NO: 2430038 - DNA, 13 bp, Homo sapiens
ctcaccctgcctt

SEQ ID NO: 2430039 - DNA, 14 bp, Homo sapiens
ctcaccctgcctta

SEQ ID NO: 2430040 - DNA, 15 bp, Homo sapiens
ctcaccctgccttat

SEQ ID NO: 2430041 - DNA, 21 bp, Homo sapiens
ctcaccctgccttatcttgca

SEQ ID NO: 2430042 - DNA, 13 bp, Homo sapiens
ctcacctggactt

SEQ ID NO: 2430043 - DNA, 16 bp, Homo sapiens
ctcaccttggcaccag

SEQ ID NO: 2430044 - DNA, 21 bp, Homo sapiens
ctcacggccacacagctgccg

SEQ ID NO: 2430045 - DNA, 15 bp, Homo sapiens
ctcacgtcctgagaa

SEQ ID NO: 2430046 - DNA, 15 bp, Homo sapiens
ctcactaggccccca

SEQ ID NO: 2430047 - DNA, 22 bp, Homo sapiens
ctcactaggcccccacttgcct

SEQ ID NO: 2430048 - DNA, 14 bp, Homo sapiens
ctcactcagcactt

SEQ ID NO: 2430049 - DNA, 15 bp, Homo sapiens
ctcactccttttaaa

SEQ ID NO: 2430050 - DNA, 19 bp, Homo sapiens
ctcactccttttaaagaaa

SEQ ID NO: 2430051 - DNA, 18 bp, Homo sapiens
ctcactgcaaccttcacc

SEQ ID NO: 2430052 - DNA, 18 bp, Homo sapiens
ctcactggctctcctggc

SEQ ID NO: 2430053 - DNA, 15 bp, Homo sapiens
ctcacttttcccact

SEQ ID NO: 2430054 - DNA, 16 bp, Homo sapiens
ctcacttttcccactc

SEQ ID NO: 2430055 - DNA, 18 bp, Homo sapiens
ctcagaaagtgcctgaca

SEQ ID NO: 2430056 - DNA, 17 bp, Homo sapiens
ctcagaagcctgggggc

SEQ ID NO: 2430057 - DNA, 21 bp, Homo sapiens
ctcagaagcctgggggcctgg

SEQ ID NO: 2430058 - DNA, 22 bp, Homo sapiens
ctcagaagtgcatctggagaga

SEQ ID NO: 2430059 - DNA, 18 bp, Homo sapiens
ctcagactctaagaaaga

SEQ ID NO: 2430060 - DNA, 17 bp, Homo sapiens
ctcagaggcgcactgtg

SEQ ID NO: 2430061 - DNA, 19 bp, Homo sapiens
ctcagaggcgcactgtgac

SEQ ID NO: 2430062 - DNA, 21 bp, Homo sapiens
ctcagatcagtgtaccatttg

SEQ ID NO: 2430063 - DNA, 10 bp, Homo sapiens
ctcagatcca

SEQ ID NO: 2430064 - DNA, 15 bp, Homo sapiens
ctcagatccagggac

SEQ ID NO: 2430065 - DNA, 20 bp, Homo sapiens
ctcagatccagggacagagg

SEQ ID NO: 2430066 - DNA, 22 bp, Homo sapiens
ctcagatccagggacagaggcc

SEQ ID NO: 2430067 - DNA, 17 bp, Homo sapiens
ctcagatggcagctttt

SEQ ID NO: 2430068 - DNA, 14 bp, Homo sapiens
ctcagattccttcc

SEQ ID NO: 2430069 - DNA, 21 bp, Homo sapiens
ctcagattccttcccatggag

SEQ ID NO: 2430070 - DNA, 24 bp, Homo sapiens
ctcagattccttcccatggaggga

SEQ ID NO: 2430071 - DNA, 18 bp, Homo sapiens
ctgaataaagtgtaacaa

SEQ ID NO: 2430072 - DNA, 17 bp, Homo sapiens
ctgaataccactctgta

SEQ ID NO: 2430073 - DNA, 19 bp, Homo sapiens
ctgaataccactctgtaat

SEQ ID NO: 2430074 - DNA, 21 bp, Homo sapiens
ctgaataccactctgtaattg

SEQ ID NO: 2430075 - DNA, 23 bp, Homo sapiens
ctgaataccactctgtaattgca

SEQ ID NO: 2430076 - DNA, 17 bp, Homo sapiens
ctgaatacccttttctg

SEQ ID NO: 2430077 - DNA, 17 bp, Homo sapiens
ctgaatctgctaccaaa

SEQ ID NO: 2430078 - DNA, 15 bp, Homo sapiens
ctgaatgtttttcta

SEQ ID NO: 2430079 - DNA, 16 bp, Homo sapiens
ctgaatgtttttctaa

SEQ ID NO: 2430080 - DNA, 22 bp, Homo sapiens
ctgacaacatttctatagccaa

SEQ ID NO: 2430081 - DNA, 14 bp, Homo sapiens
ctgacaagccatct

SEQ ID NO: 2430082 - DNA, 19 bp, Homo sapiens
ctgacacaccaggcgctaa

SEQ ID NO: 2430083 - DNA, 20 bp, Homo sapiens
ctgacacactaaccaagctg

SEQ ID NO: 2430084 - DNA, 22 bp, Homo sapiens
ctgacacactaaccaagctgag

SEQ ID NO: 2430085 - DNA, 21 bp, Homo sapiens
ctgacacccttctcccactct

SEQ ID NO: 2430086 - DNA, 15 bp, Homo sapiens
ctgacactgctggag

SEQ ID NO: 2430087 - DNA, 15 bp, Homo sapiens
ctgacagcagcatct

SEQ ID NO: 2430088 - DNA, 16 bp, Homo sapiens
ctgacagcagcatctc

SEQ ID NO: 2430089 - DNA, 14 bp, Homo sapiens
ctgacagcctccca

SEQ ID NO: 2430090 - DNA, 19 bp, Homo sapiens
ctgacagtttacagacgct

SEQ ID NO: 2430091 - DNA, 14 bp, Homo sapiens
ctgacatgtggggc

SEQ ID NO: 2430092 - DNA, 16 bp, Homo sapiens
ctgacattcacctgcc

SEQ ID NO: 2430093 - DNA, 18 bp, Homo sapiens
ctgacatttggagtgttc

SEQ ID NO: 2430094 - DNA, 15 bp, Homo sapiens
ctgaccacacgcggg

SEQ ID NO: 2430095 - DNA, 17 bp, Homo sapiens
ctgaccactcagagaca

SEQ ID NO: 2430096 - DNA, 13 bp, Homo sapiens
ctgaccagaacta

SEQ ID NO: 2430097 - DNA, 23 bp, Homo sapiens
ctgaccagccgtgagcatgtttg

SEQ ID NO: 2430098 - DNA, 14 bp, Homo sapiens
ctgaccagctcccc

SEQ ID NO: 2430099 - DNA, 21 bp, Homo sapiens
ctgaccagctccccctccctc

SEQ ID NO: 2430100 - DNA, 22 bp, Homo sapiens
ctgaccagctccccctccctcc

SEQ ID NO: 2430101 - DNA, 18 bp, Homo sapiens
ctgacccagtgcccccac

SEQ ID NO: 2430102 - DNA, 21 bp, Homo sapiens
ctgaccccaaacaccttccag

SEQ ID NO: 2430103 - DNA, 17 bp, Homo sapiens
ctgacctcaagtgatct

SEQ ID NO: 2430104 - DNA, 19 bp, Homo sapiens
ctgacctgctgacctgtgc

SEQ ID NO: 2430105 - DNA, 20 bp, Homo sapiens
ctgacctgctgacctgtgca

SEQ ID NO: 2430106 - DNA, 17 bp, Homo sapiens
ctgacctgtgagcccag

SEQ ID NO: 2430107 - DNA, 18 bp, Homo sapiens
ctgactagggagccatgt

SEQ ID NO: 2430108 - DNA, 15 bp, Homo sapiens
ctgactcagggctcc

SEQ ID NO: 2430109 - DNA, 16 bp, Homo sapiens
ctgactcagggctcct

SEQ ID NO: 2430110 - DNA, 19 bp, Homo sapiens
ctgactcagggctcctggg

SEQ ID NO: 2430111 - DNA, 21 bp, Homo sapiens
ctgactcagggctcctgggtt

SEQ ID NO: 2430112 - DNA, 17 bp, Homo sapiens
ctgactcggtttctcca

SEQ ID NO: 2430113 - DNA, 17 bp, Homo sapiens
ctgacttcatctcccac

SEQ ID NO: 2430114 - DNA, 14 bp, Homo sapiens
ctgacttctgcctg

SEQ ID NO: 2430115 - DNA, 15 bp, Homo sapiens
ctgacttggctggtg

SEQ ID NO: 2430116 - DNA, 20 bp, Homo sapiens
ctgacttggctggtgtggta

SEQ ID NO: 2430117 - DNA, 19 bp, Homo sapiens
ctgactttgcttgctttga

SEQ ID NO: 2430118 - DNA, 14 bp, Homo sapiens
ctgagaacctggcc

SEQ ID NO: 2430119 - DNA, 18 bp, Homo sapiens
ctgagaacctggccttca

SEQ ID NO: 2430120 - DNA, 20 bp, Homo sapiens
ctgagaacctggccttcagt

SEQ ID NO: 2430121 - DNA, 17 bp, Homo sapiens
ctgagaggacagagaga

SEQ ID NO: 2430122 - DNA, 21 bp, Homo sapiens
ctgagaggacagagagaaata

SEQ ID NO: 2430123 - DNA, 14 bp, Homo sapiens
ctgagaggctgtct

SEQ ID NO: 2430124 - DNA, 15 bp, Homo sapiens
ctgagatttattaaa

SEQ ID NO: 2430125 - DNA, 17 bp, Homo sapiens
ctgagatttattaaaga

SEQ ID NO: 2430126 - DNA, 18 bp, Homo sapiens
ctgagatttattaaagaa

SEQ ID NO: 2430127 - DNA, 18 bp, Homo sapiens
ctgagcactgccaggagg

SEQ ID NO: 2430128 - DNA, 12 bp, Homo sapiens
ctgagcactgtt

SEQ ID NO: 2430129 - DNA, 12 bp, Homo sapiens
ctgagcaggcca

SEQ ID NO: 2430130 - DNA, 15 bp, Homo sapiens
ctgagcaggccacac

SEQ ID NO: 2430131 - DNA, 12 bp, Homo sapiens
ctgagcagggcc

SEQ ID NO: 2430132 - DNA, 13 bp, Homo sapiens
ctgagcagggccg

SEQ ID NO: 2430133 - DNA, 17 bp, Homo sapiens
ctgagcccagggaggcc

SEQ ID NO: 2430134 - DNA, 13 bp, Homo sapiens
ctgagccccaggg

SEQ ID NO: 2430135 - DNA, 15 bp, Homo sapiens
ctgagccccagggag

SEQ ID NO: 2430136 - DNA, 16 bp, Homo sapiens
ctgagccggccccagg

SEQ ID NO: 2430137 - DNA, 18 bp, Homo sapiens
ctgagccggccccaggct

SEQ ID NO: 2430138 - DNA, 15 bp, Homo sapiens
ctgagcctgccgagc

SEQ ID NO: 2430139 - DNA, 16 bp, Homo sapiens
ctgagccttgtaattc

SEQ ID NO: 2430140 - DNA, 15 bp, Homo sapiens
ctgagcgccaggatg

SEQ ID NO: 2430141 - DNA, 16 bp, Homo sapiens
ctgagctctgagaggc

SEQ ID NO: 2430142 - DNA, 17 bp, Homo sapiens
ctgagctctgagaggcc

SEQ ID NO: 2430143 - DNA, 16 bp, Homo sapiens
ctgaggaactgtctcg

SEQ ID NO: 2430144 - DNA, 23 bp, Homo sapiens
ctgaggacaagagaaaaaagcca

SEQ ID NO: 2430145 - DNA, 16 bp, Homo sapiens
ctgaggagtctgaggt

SEQ ID NO: 2430146 - DNA, 18 bp, Homo sapiens
ctgaggagtctgaggtcc

SEQ ID NO: 2430147 - DNA, 17 bp, Homo sapiens
ctgaggcagcagtgtga

SEQ ID NO: 2430148 - DNA, 22 bp, Homo sapiens
ctgaggcagcagtgtgaggcca

SEQ ID NO: 2430149 - DNA, 14 bp, Homo sapiens
ctgaggccacactc

SEQ ID NO: 2430150 - DNA, 13 bp, Homo sapiens
ctgaggccagcct

SEQ ID NO: 2430151 - DNA, 15 bp, Homo sapiens
ctgaggcctgggccg

SEQ ID NO: 2430152 - DNA, 19 bp, Homo sapiens
ctgaggcctgggccgctgc

SEQ ID NO: 2430153 - DNA, 22 bp, Homo sapiens
ctgaggcgagaagggctgcttc

SEQ ID NO: 2430154 - DNA, 23 bp, Homo sapiens
ctgaggcgccccaacccgtggag

SEQ ID NO: 2430155 - DNA, 14 bp, Homo sapiens
ctgaggctgtggtc

SEQ ID NO: 2430156 - DNA, 21 bp, Homo sapiens
ctgaggctttggatttgacat

SEQ ID NO: 2430157 - DNA, 12 bp, Homo sapiens
ctgagggcagtt

SEQ ID NO: 2430158 - DNA, 12 bp, Homo sapiens
ctgagggtctgt

SEQ ID NO: 2430159 - DNA, 14 bp, Homo sapiens
ctgagggtctgtag

SEQ ID NO: 2430160 - DNA, 18 bp, Homo sapiens
ctgaggtcctgagcactg

SEQ ID NO: 2430161 - DNA, 20 bp, Homo sapiens
ctgaggtcctgagcactgcc

SEQ ID NO: 2430162 - DNA, 21 bp, Homo sapiens
ctgaggtcctgagcactgcca

SEQ ID NO: 2430163 - DNA, 16 bp, Homo sapiens
ctgaggtgcactggga

SEQ ID NO: 2430164 - DNA, 17 bp, Homo sapiens
ctgaggtgcactgggag

SEQ ID NO: 2430165 - DNA, 16 bp, Homo sapiens
ctgaggtgcccaggag

SEQ ID NO: 2430166 - DNA, 19 bp, Homo sapiens
ctgaggtgcccaggagaag

SEQ ID NO: 2430167 - DNA, 20 bp, Homo sapiens
ctgaggtgcccaggagaaga

SEQ ID NO: 2430168 - DNA, 19 bp, Homo sapiens
ctgaggtgcctgtcccacc

SEQ ID NO: 2430169 - DNA, 22 bp, Homo sapiens
ctgaggtgcctgtcccaccccc

SEQ ID NO: 2430170 - DNA, 21 bp, Homo sapiens
ctgaggttactggaaattagg

SEQ ID NO: 2430171 - DNA, 16 bp, Homo sapiens
ctgagtactccacact

SEQ ID NO: 2430172 - DNA, 19 bp, Homo sapiens
ctgagtactccacactgca

SEQ ID NO: 2430173 - DNA, 21 bp, Homo sapiens
ctgagtattaaaatgtatgca

SEQ ID NO: 2430174 - DNA, 17 bp, Homo sapiens
ctgagtgcttgcttttc

SEQ ID NO: 2430175 - DNA, 20 bp, Homo sapiens
ctggagagcatagggtctgg

SEQ ID NO: 2430176 - DNA, 14 bp, Homo sapiens
ctggagatcctcct

SEQ ID NO: 2430177 - DNA, 18 bp, Homo sapiens
ctggagatcctcctgcag

SEQ ID NO: 2430178 - DNA, 13 bp, Homo sapiens
ctggagcacaaag

SEQ ID NO: 2430179 - DNA, 23 bp, Homo sapiens
ctggagcacaataaatggctgta

SEQ ID NO: 2430180 - DNA, 17 bp, Homo sapiens
ctggagcagaagcagca

SEQ ID NO: 2430181 - DNA, 13 bp, Homo sapiens
ctggagcagacca

SEQ ID NO: 2430182 - DNA, 22 bp, Homo sapiens
ctggagcagaccaccccgcctg

SEQ ID NO: 2430183 - DNA, 16 bp, Homo sapiens
ctggaggacctgagcc

SEQ ID NO: 2430184 - DNA, 13 bp, Homo sapiens
ctggaggagccca

SEQ ID NO: 2430185 - DNA, 14 bp, Homo sapiens
ctggaggagcccag

SEQ ID NO: 2430186 - DNA, 16 bp, Homo sapiens
ctggaggagcccaggc

SEQ ID NO: 2430187 - DNA, 21 bp, Homo sapiens
ctggaggagcccaggccagga

SEQ ID NO: 2430188 - DNA, 15 bp, Homo sapiens
ctggaggcagggaac

SEQ ID NO: 2430189 - DNA, 18 bp, Homo sapiens
ctggaggcaggggcttcc

SEQ ID NO: 2430190 - DNA, 14 bp, Homo sapiens
ctggaggcccaggc

SEQ ID NO: 2430191 - DNA, 13 bp, Homo sapiens
ctggaggcccagt

SEQ ID NO: 2430192 - DNA, 14 bp, Homo sapiens
ctggaggcccagtt

SEQ ID NO: 2430193 - DNA, 14 bp, Homo sapiens
ctggaggccccaac

SEQ ID NO: 2430194 - DNA, 15 bp, Homo sapiens
ctggagggggaatgg

SEQ ID NO: 2430195 - DNA, 19 bp, Homo sapiens
ctggagggggaatggcagc

SEQ ID NO: 2430196 - DNA, 20 bp, Homo sapiens
ctggaggggtgtggctcctt

SEQ ID NO: 2430197 - DNA, 15 bp, Homo sapiens
ctggagtcaaaacac

SEQ ID NO: 2430198 - DNA, 18 bp, Homo sapiens
ctggagttgatctggaac

SEQ ID NO: 2430199 - DNA, 14 bp, Homo sapiens
ctggatcagcgtgg

SEQ ID NO: 2430200 - DNA, 18 bp, Homo sapiens
ctggatcagcgtggcctt

SEQ ID NO: 2430201 - DNA, 14 bp, Homo sapiens
ctggatgatactaa

SEQ ID NO: 2430202 - DNA, 15 bp, Homo sapiens
ctggatgatactaat

SEQ ID NO: 2430203 - DNA, 16 bp, Homo sapiens
ctggatgatactaata

SEQ ID NO: 2430204 - DNA, 23 bp, Homo sapiens
ctggatgatactaataaactaat

SEQ ID NO: 2430205 - DNA, 17 bp, Homo sapiens
ctggatggggcaggcca

SEQ ID NO: 2430206 - DNA, 21 bp, Homo sapiens
ctggattccccatctcaggcc

SEQ ID NO: 2430207 - DNA, 16 bp, Homo sapiens
ctggcaacacagaggc

SEQ ID NO: 2430208 - DNA, 19 bp, Homo sapiens
ctggcaaggactttgtaca

SEQ ID NO: 2430209 - DNA, 12 bp, Homo sapiens
ctggcaatgcca

SEQ ID NO: 2430210 - DNA, 14 bp, Homo sapiens
ctggcagccacact

SEQ ID NO: 2430211 - DNA, 15 bp, Homo sapiens
ctggcagccacactt

SEQ ID NO: 2430212 - DNA, 22 bp, Homo sapiens
ctggcagccacacttctcagga

SEQ ID NO: 2430213 - DNA, 14 bp, Homo sapiens
ctggcagcctccca

SEQ ID NO: 2430214 - DNA, 15 bp, Homo sapiens
ctggcagcctcccat

SEQ ID NO: 2430215 - DNA, 20 bp, Homo sapiens
ctggcagctctggacagccc

SEQ ID NO: 2430216 - DNA, 19 bp, Homo sapiens
ctggcagtccgtgggacgg

SEQ ID NO: 2430217 - DNA, 20 bp, Homo sapiens
ctggcagtttatatttaact

SEQ ID NO: 2430218 - DNA, 22 bp, Homo sapiens
ctggcagtttatatttaactct

SEQ ID NO: 2430219 - DNA, 18 bp, Homo sapiens
ctggcatcgcaccattct

SEQ ID NO: 2430220 - DNA, 20 bp, Homo sapiens
ctggcatcgcaccattctga

SEQ ID NO: 2430221 - DNA, 18 bp, Homo sapiens
ctggcatgtcaacagcgt

SEQ ID NO: 2430222 - DNA, 21 bp, Homo sapiens
ctggccaagctgaggtgccca

SEQ ID NO: 2430223 - DNA, 22 bp, Homo sapiens
ctggccaagctgaggtgcccag

SEQ ID NO: 2430224 - DNA, 21 bp, Homo sapiens
ctggccagacacaggccctcc

SEQ ID NO: 2430225 - DNA, 15 bp, Homo sapiens
ctggccagtccaggc

SEQ ID NO: 2430226 - DNA, 19 bp, Homo sapiens
ctggccagtccaggctgcc

SEQ ID NO: 2430227 - DNA, 12 bp, Homo sapiens
ctggccatggag

SEQ ID NO: 2430228 - DNA, 17 bp, Homo sapiens
ctggccatggagaaagc

SEQ ID NO: 2430229 - DNA, 21 bp, Homo sapiens
ctggccatggagaaagctgac

SEQ ID NO: 2430230 - DNA, 14 bp, Homo sapiens
ctggccatggcctg

SEQ ID NO: 2430231 - DNA, 15 bp, Homo sapiens
ctggccatggcctgc

SEQ ID NO: 2430232 - DNA, 13 bp, Homo sapiens
ctggcccagccaa

SEQ ID NO: 2430233 - DNA, 15 bp, Homo sapiens
ctggcccagcctttg

SEQ ID NO: 2430234 - DNA, 12 bp, Homo sapiens
ctggcccagggc

SEQ ID NO: 2430235 - DNA, 13 bp, Homo sapiens
ctggcccagggcc

SEQ ID NO: 2430236 - DNA, 15 bp, Homo sapiens
ctggcccagggccca

SEQ ID NO: 2430237 - DNA, 17 bp, Homo sapiens
ctggcccagggcccaga

SEQ ID NO: 2430238 - DNA, 18 bp, Homo sapiens
ctggcccagggcccagag

SEQ ID NO: 2430239 - DNA, 20 bp, Homo sapiens
ctggcccagggcccagagcc

SEQ ID NO: 2430240 - DNA, 22 bp, Homo sapiens
ctggcccagggcccagagccca

SEQ ID NO: 2430241 - DNA, 13 bp, Homo sapiens
ctggccccaggac

SEQ ID NO: 2430242 - DNA, 20 bp, Homo sapiens
ctggccccaggacctggctg

SEQ ID NO: 2430243 - DNA, 13 bp, Homo sapiens
ctggccccctccc

SEQ ID NO: 2430244 - DNA, 16 bp, Homo sapiens
ctggccccctccctgg

SEQ ID NO: 2430245 - DNA, 17 bp, Homo sapiens
ctggccccctccctgga

SEQ ID NO: 2430246 - DNA, 24 bp, Homo sapiens
ctggcccctctcccttgggctctg

SEQ ID NO: 2430247 - DNA, 22 bp, Homo sapiens
ctggccctgcttcctgcttgcc

SEQ ID NO: 2430248 - DNA, 21 bp, Homo sapiens
ctggccctgggagaatcgctc

SEQ ID NO: 2430249 - DNA, 14 bp, Homo sapiens
ctggccgccccctg

SEQ ID NO: 2430250 - DNA, 18 bp, Homo sapiens
ctggccgctgtgccaggc

SEQ ID NO: 2430251 - DNA, 19 bp, Homo sapiens
ctggcctagaccagcagac

SEQ ID NO: 2430252 - DNA, 20 bp, Homo sapiens
ctggcctagaccagcagaca

SEQ ID NO: 2430253 - DNA, 16 bp, Homo sapiens
ctggcctcaaagcaag

SEQ ID NO: 2430254 - DNA, 21 bp, Homo sapiens
ctggcctcaaagcaagcattc

SEQ ID NO: 2430255 - DNA, 22 bp, Homo sapiens
ctggcctcacccacccctgcac

SEQ ID NO: 2430256 - DNA, 15 bp, Homo sapiens
ctggcctcccccact

SEQ ID NO: 2430257 - DNA, 18 bp, Homo sapiens
ctggcctcccctgccacc

SEQ ID NO: 2430258 - DNA, 13 bp, Homo sapiens
ctggcctcctgcc

SEQ ID NO: 2430259 - DNA, 14 bp, Homo sapiens
ctggcctctgcttt

SEQ ID NO: 2430260 - DNA, 15 bp, Homo sapiens
ctggcctctgctttc

SEQ ID NO: 2430261 - DNA, 18 bp, Homo sapiens
ctggcctggactgttttc

SEQ ID NO: 2430262 - DNA, 14 bp, Homo sapiens
ctggcctggccagt

SEQ ID NO: 2430263 - DNA, 15 bp, Homo sapiens
ctggcctggccagtg

SEQ ID NO: 2430264 - DNA, 19 bp, Homo sapiens
ctggcctggccagtgccct

SEQ ID NO: 2430265 - DNA, 17 bp, Homo sapiens
ctggcctttttcattta

SEQ ID NO: 2430266 - DNA, 20 bp, Homo sapiens
ctggcctttttcatttatct

SEQ ID NO: 2430267 - DNA, 19 bp, Homo sapiens
ctggctatagatgtctttt

SEQ ID NO: 2430268 - DNA, 23 bp, Homo sapiens
ctggctatagatgtcttttccca

SEQ ID NO: 2430269 - DNA, 19 bp, Homo sapiens
ctggctctaattcacagtg

SEQ ID NO: 2430270 - DNA, 20 bp, Homo sapiens
ctggctctaattcacagtgc

SEQ ID NO: 2430271 - DNA, 13 bp, Homo sapiens
ctggctctcacct

SEQ ID NO: 2430272 - DNA, 14 bp, Homo sapiens
ctggctctcacctc

SEQ ID NO: 2430273 - DNA, 13 bp, Homo sapiens
ctggctctgagcg

SEQ ID NO: 2430274 - DNA, 24 bp, Homo sapiens
ctggctctgagcgcctccatccaa

SEQ ID NO: 2430275 - DNA, 13 bp, Homo sapiens
ctggctggcctca

SEQ ID NO: 2430276 - DNA, 23 bp, Homo sapiens
ctggctgggacgtggctcagcca

SEQ ID NO: 2430277 - DNA, 16 bp, Homo sapiens
ctggctgtaaggctct

SEQ ID NO: 2430278 - DNA, 12 bp, Homo sapiens
ctggcttctggc

SEQ ID NO: 2430279 - DNA, 15 bp, Homo sapiens
cttcggggctgggaa

SEQ ID NO: 2430280 - DNA, 19 bp, Homo sapiens
cttctaaacccaatccaaa

SEQ ID NO: 2430281 - DNA, 18 bp, Homo sapiens
cttctactcacttttccc

SEQ ID NO: 2430282 - DNA, 13 bp, Homo sapiens
cttctacttttaa

SEQ ID NO: 2430283 - DNA, 19 bp, Homo sapiens
cttctataattttgccttt

SEQ ID NO: 2430284 - DNA, 23 bp, Homo sapiens
cttctatttggggcttgatgact

SEQ ID NO: 2430285 - DNA, 16 bp, Homo sapiens
cttctcaagttctaag

SEQ ID NO: 2430286 - DNA, 19 bp, Homo sapiens
cttctcaggacacaggcct

SEQ ID NO: 2430287 - DNA, 20 bp, Homo sapiens
cttctcaggacacaggcctg

SEQ ID NO: 2430288 - DNA, 21 bp, Homo sapiens
cttctcaggacacaggcctgt

SEQ ID NO: 2430289 - DNA, 22 bp, Homo sapiens
cttctcaggacacaggcctgtg

SEQ ID NO: 2430290 - DNA, 20 bp, Homo sapiens
cttctcattttttaaaaaag

SEQ ID NO: 2430291 - DNA, 13 bp, Homo sapiens
cttctcccactct

SEQ ID NO: 2430292 - DNA, 16 bp, Homo sapiens
cttctcccactctcct

SEQ ID NO: 2430293 - DNA, 15 bp, Homo sapiens
cttctcccaggcaag

SEQ ID NO: 2430294 - DNA, 16 bp, Homo sapiens
cttctcccctgcactg

SEQ ID NO: 2430295 - DNA, 17 bp, Homo sapiens
cttctcccctgcactgt

SEQ ID NO: 2430296 - DNA, 23 bp, Homo sapiens
cttctcccctgcactgtaaaatg

SEQ ID NO: 2430297 - DNA, 13 bp, Homo sapiens
cttctccctggaa

SEQ ID NO: 2430298 - DNA, 21 bp, Homo sapiens
cttctcgtcctcgtttgtgtt

SEQ ID NO: 2430299 - DNA, 19 bp, Homo sapiens
cttctctccagctgactaa

SEQ ID NO: 2430300 - DNA, 13 bp, Homo sapiens
cttctctctccct

SEQ ID NO: 2430301 - DNA, 12 bp, Homo sapiens
cttctctgactt

SEQ ID NO: 2430302 - DNA, 14 bp, Homo sapiens
cttctctgacttct

SEQ ID NO: 2430303 - DNA, 22 bp, Homo sapiens
cttctcttccttttatcagtag

SEQ ID NO: 2430304 - DNA, 14 bp, Homo sapiens
cttctgacagcctc

SEQ ID NO: 2430305 - DNA, 15 bp, Homo sapiens
cttctgacagcctca

SEQ ID NO: 2430306 - DNA, 22 bp, Homo sapiens
cttctgagacgtcatgaggaga

SEQ ID NO: 2430307 - DNA, 12 bp, Homo sapiens
cttctgagctcc

SEQ ID NO: 2430308 - DNA, 16 bp, Homo sapiens
cttctgagctcctgtc

SEQ ID NO: 2430309 - DNA, 23 bp, Homo sapiens
cttctgagctcctgtcccctgct

SEQ ID NO: 2430310 - DNA, 15 bp, Homo sapiens
cttctgccccctgca

SEQ ID NO: 2430311 - DNA, 21 bp, Homo sapiens
cttctgccttagtctcagttt

SEQ ID NO: 2430312 - DNA, 21 bp, Homo sapiens
cttctgctggggcctgggaca

SEQ ID NO: 2430313 - DNA, 15 bp, Homo sapiens
cttctggactggttt

SEQ ID NO: 2430314 - DNA, 15 bp, Homo sapiens
cttctggccaggaag

SEQ ID NO: 2430315 - DNA, 22 bp, Homo sapiens
cttctgggagggcagcagggct

SEQ ID NO: 2430316 - DNA, 15 bp, Homo sapiens
cttctgtaattgtgt

SEQ ID NO: 2430317 - DNA, 14 bp, Homo sapiens
cttctgtcctgccc

SEQ ID NO: 2430318 - DNA, 21 bp, Homo sapiens
cttcttacttggaactgaagg

SEQ ID NO: 2430319 - DNA, 22 bp, Homo sapiens
cttcttatggaattgatttgca

SEQ ID NO: 2430320 - DNA, 23 bp, Homo sapiens
cttcttatggaattgatttgcat

SEQ ID NO: 2430321 - DNA, 15 bp, Homo sapiens
cttcttgcctctgtg

SEQ ID NO: 2430322 - DNA, 16 bp, Homo sapiens
cttcttgtgtgtatgc

SEQ ID NO: 2430323 - DNA, 13 bp, Homo sapiens
cttcttgttcccc

SEQ ID NO: 2430324 - DNA, 17 bp, Homo sapiens
cttctttcatttcttct

SEQ ID NO: 2430325 - DNA, 15 bp, Homo sapiens
cttgaaaaagacatt

SEQ ID NO: 2430326 - DNA, 16 bp, Homo sapiens
cttgaaaataagaata

SEQ ID NO: 2430327 - DNA, 18 bp, Homo sapiens
cttgaaatatcctgcttg

SEQ ID NO: 2430328 - DNA, 23 bp, Homo sapiens
cttgaacccaggtctccctggat

SEQ ID NO: 2430329 - DNA, 18 bp, Homo sapiens
cttgaacgttttctaatt

SEQ ID NO: 2430330 - DNA, 17 bp, Homo sapiens
cttgaagaactgcaggc

SEQ ID NO: 2430331 - DNA, 18 bp, Homo sapiens
cttgaagaactgcaggcc

SEQ ID NO: 2430332 - DNA, 22 bp, Homo sapiens
cttgaagaactgcaggccctgg

SEQ ID NO: 2430333 - DNA, 19 bp, Homo sapiens
cttgaatgtggcttgagaa

SEQ ID NO: 2430334 - DNA, 20 bp, Homo sapiens
cttgaatgtggcttgagaaa

SEQ ID NO: 2430335 - DNA, 20 bp, Homo sapiens
cttgaattgtaactgttctt

SEQ ID NO: 2430336 - DNA, 21 bp, Homo sapiens
cttgaattgtaactgttcttg

SEQ ID NO: 2430337 - DNA, 13 bp, Homo sapiens
cttgacacctgct

SEQ ID NO: 2430338 - DNA, 21 bp, Homo sapiens
cttgaccaggctgcctccctt

SEQ ID NO: 2430339 - DNA, 18 bp, Homo sapiens
cttgagatggtgaggctg

SEQ ID NO: 2430340 - DNA, 13 bp, Homo sapiens
cttgagcagtggc

SEQ ID NO: 2430341 - DNA, 14 bp, Homo sapiens
cttgagcagtggct

SEQ ID NO: 2430342 - DNA, 17 bp, Homo sapiens
cttgaggggaccaggag

SEQ ID NO: 2430343 - DNA, 14 bp, Homo sapiens
cttgaggtctcagc

SEQ ID NO: 2430344 - DNA, 15 bp, Homo sapiens
cttgaggtctcagcc

SEQ ID NO: 2430345 - DNA, 12 bp, Homo sapiens
cttgagtttgtc

SEQ ID NO: 2430346 - DNA, 13 bp, Homo sapiens
cttgagtttgtcg

SEQ ID NO: 2430347 - DNA, 18 bp, Homo sapiens
cttgatacccccctctgt

SEQ ID NO: 2430348 - DNA, 19 bp, Homo sapiens
cttgatacccccctctgtc

SEQ ID NO: 2430349 - DNA, 20 bp, Homo sapiens
cttgatacccccctctgtct

SEQ ID NO: 2430350 - DNA, 22 bp, Homo sapiens
cttgatagaaatgccaagcact

SEQ ID NO: 2430351 - DNA, 23 bp, Homo sapiens
cttgatcagccccaccctggcct

SEQ ID NO: 2430352 - DNA, 18 bp, Homo sapiens
cttgatcagttaagaaat

SEQ ID NO: 2430353 - DNA, 19 bp, Homo sapiens
cttgatccatttctaatta

SEQ ID NO: 2430354 - DNA, 20 bp, Homo sapiens
cttgatccatttctaattat

SEQ ID NO: 2430355 - DNA, 21 bp, Homo sapiens
cttgatgaccaaagtcctttt

SEQ ID NO: 2430356 - DNA, 17 bp, Homo sapiens
cttgatgggattctgga

SEQ ID NO: 2430357 - DNA, 22 bp, Homo sapiens
cttgatgtaaaatcttgtcatg

SEQ ID NO: 2430358 - DNA, 20 bp, Homo sapiens
cttgatgtctttgttaagac

SEQ ID NO: 2430359 - DNA, 16 bp, Homo sapiens
cttgattatccatatt

SEQ ID NO: 2430360 - DNA, 17 bp, Homo sapiens
cttgattctgcagtaaa

SEQ ID NO: 2430361 - DNA, 15 bp, Homo sapiens
cttgcacagtcactg

SEQ ID NO: 2430362 - DNA, 19 bp, Homo sapiens
cttgcacagtcactgctct

SEQ ID NO: 2430363 - DNA, 11 bp, Homo sapiens
cttgccagaga

SEQ ID NO: 2430364 - DNA, 17 bp, Homo sapiens
cttgcctcaatgccagt

SEQ ID NO: 2430365 - DNA, 16 bp, Homo sapiens
cttgcctcttccttga

SEQ ID NO: 2430366 - DNA, 13 bp, Homo sapiens
cttgcctgccttt

SEQ ID NO: 2430367 - DNA, 15 bp, Homo sapiens
cttgcctgcctttcc

SEQ ID NO: 2430368 - DNA, 11 bp, Homo sapiens
cttgcctgtgc

SEQ ID NO: 2430369 - DNA, 16 bp, Homo sapiens
cttgcctgtgccaggt

SEQ ID NO: 2430370 - DNA, 13 bp, Homo sapiens
cttgctaccagta

SEQ ID NO: 2430371 - DNA, 17 bp, Homo sapiens
cttgctaccagtattta

SEQ ID NO: 2430372 - DNA, 18 bp, Homo sapiens
cttgctaccagtatttag

SEQ ID NO: 2430373 - DNA, 20 bp, Homo sapiens
cttgctattctgtccctagg

SEQ ID NO: 2430374 - DNA, 21 bp, Homo sapiens
cttgctgcaagcacagccctt

SEQ ID NO: 2430375 - DNA, 15 bp, Homo sapiens
cttgctgctttagtc

SEQ ID NO: 2430376 - DNA, 13 bp, Homo sapiens
cttgcttccctaa

SEQ ID NO: 2430377 - DNA, 21 bp, Homo sapiens
cttgctttctttgtttggctg

SEQ ID NO: 2430378 - DNA, 14 bp, Homo sapiens
cttgcttttcatgc

SEQ ID NO: 2430379 - DNA, 19 bp, Homo sapiens
cttggaacttgcctgcctt

SEQ ID NO: 2430380 - DNA, 23 bp, Homo sapiens
cttggaacttgcctgcctttcca

SEQ ID NO: 2430381 - DNA, 19 bp, Homo sapiens
cttggacatcctcctccca

SEQ ID NO: 2430382 - DNA, 19 bp, Homo sapiens
cttggagaagtctcagcta

SEQ ID NO: 2430383 - DNA, 21 bp, Homo sapiens
gaagctcccccagcaaagccc

SEQ ID NO: 2430384 - DNA, 17 bp, Homo sapiens
gaagctcctctccccag

SEQ ID NO: 2430385 - DNA, 21 bp, Homo sapiens
gaagctcctctccccagccca

SEQ ID NO: 2430386 - DNA, 14 bp, Homo sapiens
gaagctttggtgag

SEQ ID NO: 2430387 - DNA, 19 bp, Homo sapiens
gaaggactaatagaaaagt

SEQ ID NO: 2430388 - DNA, 20 bp, Homo sapiens
gaaggactaatagaaaagta

SEQ ID NO: 2430389 - DNA, 14 bp, Homo sapiens
gaaggagctgcctg

SEQ ID NO: 2430390 - DNA, 16 bp, Homo sapiens
gaaggagctgcctgga

SEQ ID NO: 2430391 - DNA, 17 bp, Homo sapiens
gaaggagctgcctggac

SEQ ID NO: 2430392 - DNA, 15 bp, Homo sapiens
gaaggaggagcctgt

SEQ ID NO: 2430393 - DNA, 14 bp, Homo sapiens
gaaggcaggcaggg

SEQ ID NO: 2430394 - DNA, 21 bp, Homo sapiens
gaaggcaggcagggctctcct

SEQ ID NO: 2430395 - DNA, 22 bp, Homo sapiens
gaaggcaggcagggctctcctg

SEQ ID NO: 2430396 - DNA, 16 bp, Homo sapiens
gaaggcttgggatttg

SEQ ID NO: 2430397 - DNA, 17 bp, Homo sapiens
gaaggcttgttgtgctt

SEQ ID NO: 2430398 - DNA, 20 bp, Homo sapiens
gaagggagccaagggatgga

SEQ ID NO: 2430399 - DNA, 23 bp, Homo sapiens
gaagggagggcagagctggtgcg

SEQ ID NO: 2430400 - DNA, 15 bp, Homo sapiens
gaagggccagagcca

SEQ ID NO: 2430401 - DNA, 17 bp, Homo sapiens
gaagggccagagccagg

SEQ ID NO: 2430402 - DNA, 14 bp, Homo sapiens
gaaggggccagagg

SEQ ID NO: 2430403 - DNA, 22 bp, Homo sapiens
gaaggggcctcaccgagtgggg

SEQ ID NO: 2430404 - DNA, 22 bp, Homo sapiens
gaaggtaaataaaaagaaaggc

SEQ ID NO: 2430405 - DNA, 12 bp, Homo sapiens
gaaggtgaatag

SEQ ID NO: 2430406 - DNA, 22 bp, Homo sapiens
gaaggtggatggccccagcaca

SEQ ID NO: 2430407 - DNA, 20 bp, Homo sapiens
gaaggttatcagtgcttccc

SEQ ID NO: 2430408 - DNA, 16 bp, Homo sapiens
gaagtaaactttttgt

SEQ ID NO: 2430409 - DNA, 13 bp, Homo sapiens
gaagtaggaagta

SEQ ID NO: 2430410 - DNA, 21 bp, Homo sapiens
gaagtattttttcagtattat

SEQ ID NO: 2430411 - DNA, 16 bp, Homo sapiens
gaagtcaaagcaagga

SEQ ID NO: 2430412 - DNA, 17 bp, Homo sapiens
gaagtccaatgtggcaa

SEQ ID NO: 2430413 - DNA, 15 bp, Homo sapiens
gaagtccggccccag

SEQ ID NO: 2430414 - DNA, 24 bp, Homo sapiens
gaagtctcatctggggagcaggca

SEQ ID NO: 2430415 - DNA, 15 bp, Homo sapiens
gaagtgaagaatgca

SEQ ID NO: 2430416 - DNA, 16 bp, Homo sapiens
gaagtgaatgctggga

SEQ ID NO: 2430417 - DNA, 17 bp, Homo sapiens
gaagtgaatgctgggac

SEQ ID NO: 2430418 - DNA, 22 bp, Homo sapiens
gaagtgagggctcactcagcca

SEQ ID NO: 2430419 - DNA, 21 bp, Homo sapiens
gaagtgctgccgcgcagtgtg

SEQ ID NO: 2430420 - DNA, 16 bp, Homo sapiens
gaagttagtttgtata

SEQ ID NO: 2430421 - DNA, 14 bp, Homo sapiens
gaagttgctgcttc

SEQ ID NO: 2430422 - DNA, 21 bp, Homo sapiens
gaagttgctgcttctcccagg

SEQ ID NO: 2430423 - DNA, 17 bp, Homo sapiens
gaagtttagctctgaga

SEQ ID NO: 2430424 - DNA, 15 bp, Homo sapiens
gaataaaggcagttt

SEQ ID NO: 2430425 - DNA, 15 bp, Homo sapiens
gaataaatgtcactt

SEQ ID NO: 2430426 - DNA, 16 bp, Homo sapiens
gaataaattgattttt

SEQ ID NO: 2430427 - DNA, 18 bp, Homo sapiens
gaataagctcccagggcc

SEQ ID NO: 2430428 - DNA, 15 bp, Homo sapiens
gaataccactctgta

SEQ ID NO: 2430429 - DNA, 13 bp, Homo sapiens
gaatactgaacat

SEQ ID NO: 2430430 - DNA, 16 bp, Homo sapiens
gaatactttgaatgtg

SEQ ID NO: 2430431 - DNA, 20 bp, Homo sapiens
gaatactttgaatgtgtttc

SEQ ID NO: 2430432 - DNA, 14 bp, Homo sapiens
gaatactttttaca

SEQ ID NO: 2430433 - DNA, 23 bp, Homo sapiens
gaatagccatatttgtaaaatga

SEQ ID NO: 2430434 - DNA, 14 bp, Homo sapiens
gaatatgaaacata

SEQ ID NO: 2430435 - DNA, 19 bp, Homo sapiens
gaatattgccattatgctt

SEQ ID NO: 2430436 - DNA, 13 bp, Homo sapiens
gaatattgtccat

SEQ ID NO: 2430437 - DNA, 19 bp, Homo sapiens
gaatcaagggtcaggcctt

SEQ ID NO: 2430438 - DNA, 11 bp, Homo sapiens
gaatcaataat

SEQ ID NO: 2430439 - DNA, 21 bp, Homo sapiens
gaatcaataatatattttctg

SEQ ID NO: 2430440 - DNA, 24 bp, Homo sapiens
gaatcatttagcatgttgttgaaa

SEQ ID NO: 2430441 - DNA, 21 bp, Homo sapiens
gaatcccttaacagttgtatt

SEQ ID NO: 2430442 - DNA, 20 bp, Homo sapiens
gaatcgctcctgcagcccca

SEQ ID NO: 2430443 - DNA, 22 bp, Homo sapiens
gaatcggcgacggagcactgca

SEQ ID NO: 2430444 - DNA, 18 bp, Homo sapiens
gaatctacccccagatcc

SEQ ID NO: 2430445 - DNA, 15 bp, Homo sapiens
gaatctctgtgcctt

SEQ ID NO: 2430446 - DNA, 19 bp, Homo sapiens
gaatctgtgggtctgggag

SEQ ID NO: 2430447 - DNA, 20 bp, Homo sapiens
gaatctgtgggtctgggagt

SEQ ID NO: 2430448 - DNA, 14 bp, Homo sapiens
gaatctgtgtgaaa

SEQ ID NO: 2430449 - DNA, 21 bp, Homo sapiens
gaatcttaaggtgtagccaca

SEQ ID NO: 2430450 - DNA, 22 bp, Homo sapiens
gaatcttaaggtgtagccacac

SEQ ID NO: 2430451 - DNA, 20 bp, Homo sapiens
gaatcttggtttgccttcca

SEQ ID NO: 2430452 - DNA, 22 bp, Homo sapiens
gaatctttagagaagtatacat

SEQ ID NO: 2430453 - DNA, 23 bp, Homo sapiens
gaatctttagagaagtatacata

SEQ ID NO: 2430454 - DNA, 18 bp, Homo sapiens
gaatgcacaagaatggat

SEQ ID NO: 2430455 - DNA, 21 bp, Homo sapiens
gaatgccactgccttcgcttc

SEQ ID NO: 2430456 - DNA, 13 bp, Homo sapiens
gaatgctgtacat

SEQ ID NO: 2430457 - DNA, 14 bp, Homo sapiens
gaatgctgtacatc

SEQ ID NO: 2430458 - DNA, 23 bp, Homo sapiens
gaatgcttctaagtaaatacaat

SEQ ID NO: 2430459 - DNA, 14 bp, Homo sapiens
gaatggatcacaag

SEQ ID NO: 2430460 - DNA, 19 bp, Homo sapiens
gaatgtaatcaatgtttct

SEQ ID NO: 2430461 - DNA, 14 bp, Homo sapiens
gaatgtgaagcctt

SEQ ID NO: 2430462 - DNA, 16 bp, Homo sapiens
gaatgtgaagccttcc

SEQ ID NO: 2430463 - DNA, 18 bp, Homo sapiens
gaatgtggcttgagaaat

SEQ ID NO: 2430464 - DNA, 13 bp, Homo sapiens
gaatgtgtcttta

SEQ ID NO: 2430465 - DNA, 13 bp, Homo sapiens
gaatgtgtttcac

SEQ ID NO: 2430466 - DNA, 20 bp, Homo sapiens
gaatgtttacactctttgta

SEQ ID NO: 2430467 - DNA, 20 bp, Homo sapiens
gaattaaacttttaattcat

SEQ ID NO: 2430468 - DNA, 14 bp, Homo sapiens
gaattaaagtactt

SEQ ID NO: 2430469 - DNA, 21 bp, Homo sapiens
gaattaatatccctacatgta

SEQ ID NO: 2430470 - DNA, 15 bp, Homo sapiens
gaattaggctgtaac

SEQ ID NO: 2430471 - DNA, 18 bp, Homo sapiens
gaattaggctgtaactac

SEQ ID NO: 2430472 - DNA, 23 bp, Homo sapiens
gaattaggctgtaactactttat

SEQ ID NO: 2430473 - DNA, 20 bp, Homo sapiens
gaattataactggaaagaag

SEQ ID NO: 2430474 - DNA, 19 bp, Homo sapiens
gaattattacagtgtttat

SEQ ID NO: 2430475 - DNA, 12 bp, Homo sapiens
gaattattttgt

SEQ ID NO: 2430476 - DNA, 13 bp, Homo sapiens
gaattccctcact

SEQ ID NO: 2430477 - DNA, 14 bp, Homo sapiens
gaattccctcactc

SEQ ID NO: 2430478 - DNA, 20 bp, Homo sapiens
gaattccctcactcgtctcc

SEQ ID NO: 2430479 - DNA, 21 bp, Homo sapiens
gaattccctcactcgtctccc

SEQ ID NO: 2430480 - DNA, 16 bp, Homo sapiens
gaattgagtaatggtg

SEQ ID NO: 2430481 - DNA, 15 bp, Homo sapiens
gaattgagtgtttaa

SEQ ID NO: 2430482 - DNA, 22 bp, Homo sapiens
gaattgatttgcattgaacaca

SEQ ID NO: 2430483 - DNA, 16 bp, Homo sapiens
gaattgtggtttatat

SEQ ID NO: 2430484 - DNA, 22 bp, Homo sapiens
gaattgttgagatactttacta

SEQ ID NO: 2430485 - DNA, 16 bp, Homo sapiens
gaatttaataatctgt

SEQ ID NO: 2430486 - DNA, 21 bp, Homo sapiens
gaggaggtgtctcaggctgcc

SEQ ID NO: 2430487 - DNA, 23 bp, Homo sapiens
gaggaggtgtctcaggctgcctg

SEQ ID NO: 2430488 - DNA, 12 bp, Homo sapiens
gaggagtaacaa

SEQ ID NO: 2430489 - DNA, 21 bp, Homo sapiens
gaggagtctgaggtcctgagc

SEQ ID NO: 2430490 - DNA, 22 bp, Homo sapiens
gaggagtctgaggtcctgagca

SEQ ID NO: 2430491 - DNA, 21 bp, Homo sapiens
gaggcaattagacactttgga

SEQ ID NO: 2430492 - DNA, 20 bp, Homo sapiens
gaggcacctggtggccatgc

SEQ ID NO: 2430493 - DNA, 18 bp, Homo sapiens
gaggcactgaagtgctta

SEQ ID NO: 2430494 - DNA, 12 bp, Homo sapiens
gaggcagcccag

SEQ ID NO: 2430495 - DNA, 18 bp, Homo sapiens
gaggcaggggcttcctgg

SEQ ID NO: 2430496 - DNA, 16 bp, Homo sapiens
gaggccagcctggcct

SEQ ID NO: 2430497 - DNA, 19 bp, Homo sapiens
gaggccagcctggcctcct

SEQ ID NO: 2430498 - DNA, 13 bp, Homo sapiens
gaggccagggcag

SEQ ID NO: 2430499 - DNA, 15 bp, Homo sapiens
gaggccagggcagag

SEQ ID NO: 2430500 - DNA, 19 bp, Homo sapiens
gaggccagggcagagtgag

SEQ ID NO: 2430501 - DNA, 22 bp, Homo sapiens
gaggccatggactctgtcctga

SEQ ID NO: 2430502 - DNA, 14 bp, Homo sapiens
gaggcccaggctgc

SEQ ID NO: 2430503 - DNA, 15 bp, Homo sapiens
gaggcccaggctgcc

SEQ ID NO: 2430504 - DNA, 16 bp, Homo sapiens
gaggcccaggctgccg

SEQ ID NO: 2430505 - DNA, 18 bp, Homo sapiens
gaggcccaggctgccgtc

SEQ ID NO: 2430506 - DNA, 16 bp, Homo sapiens
gaggcccaggctggga

SEQ ID NO: 2430507 - DNA, 17 bp, Homo sapiens
gaggcccaggctgggaa

SEQ ID NO: 2430508 - DNA, 15 bp, Homo sapiens
gaggccccaaccctg

SEQ ID NO: 2430509 - DNA, 19 bp, Homo sapiens
gaggccccagcctccctga

SEQ ID NO: 2430510 - DNA, 22 bp, Homo sapiens
gaggccccagcctccctgaagc

SEQ ID NO: 2430511 - DNA, 17 bp, Homo sapiens
gaggccctcgctgccag

SEQ ID NO: 2430512 - DNA, 12 bp, Homo sapiens
gaggccctggat

SEQ ID NO: 2430513 - DNA, 13 bp, Homo sapiens
gaggccctggatc

SEQ ID NO: 2430514 - DNA, 22 bp, Homo sapiens
gaggccctggatcagcgtggcc

SEQ ID NO: 2430515 - DNA, 23 bp, Homo sapiens
gaggccctggatcagcgtggcct

SEQ ID NO: 2430516 - DNA, 19 bp, Homo sapiens
gaggccgggcggtcacagc

SEQ ID NO: 2430517 - DNA, 21 bp, Homo sapiens
gaggccgtggctgctgtggga

SEQ ID NO: 2430518 - DNA, 15 bp, Homo sapiens
gaggcctaggagggt

SEQ ID NO: 2430519 - DNA, 13 bp, Homo sapiens
gaggcctggactt

SEQ ID NO: 2430520 - DNA, 18 bp, Homo sapiens
gaggcctgggctgggaaa

SEQ ID NO: 2430521 - DNA, 22 bp, Homo sapiens
gaggcgccccaacccgtggagg

SEQ ID NO: 2430522 - DNA, 13 bp, Homo sapiens
gaggcgctgctgg

SEQ ID NO: 2430523 - DNA, 16 bp, Homo sapiens
gaggctgaggcctgga

SEQ ID NO: 2430524 - DNA, 18 bp, Homo sapiens
gaggctgaggcctggact

SEQ ID NO: 2430525 - DNA, 18 bp, Homo sapiens
gaggctgcccctctcacc

SEQ ID NO: 2430526 - DNA, 14 bp, Homo sapiens
gaggctgccctcct

SEQ ID NO: 2430527 - DNA, 22 bp, Homo sapiens
gaggctgctcggggtgcacagg

SEQ ID NO: 2430528 - DNA, 23 bp, Homo sapiens
gaggctgctcggggtgcacagga

SEQ ID NO: 2430529 - DNA, 16 bp, Homo sapiens
gaggctggtcctatgg

SEQ ID NO: 2430530 - DNA, 14 bp, Homo sapiens
gaggctgtcctgta

SEQ ID NO: 2430531 - DNA, 23 bp, Homo sapiens
gaggctgtggtcacagcggaggt

SEQ ID NO: 2430532 - DNA, 14 bp, Homo sapiens
gaggcttggttcct

SEQ ID NO: 2430533 - DNA, 14 bp, Homo sapiens
gaggctttccatgg

SEQ ID NO: 2430534 - DNA, 16 bp, Homo sapiens
gaggctttggatttga

SEQ ID NO: 2430535 - DNA, 16 bp, Homo sapiens
gagggaaaggccagca

SEQ ID NO: 2430536 - DNA, 15 bp, Homo sapiens
gagggaagggagcca

SEQ ID NO: 2430537 - DNA, 16 bp, Homo sapiens
gagggaagggagccaa

SEQ ID NO: 2430538 - DNA, 17 bp, Homo sapiens
gagggaagggagccaag

SEQ ID NO: 2430539 - DNA, 19 bp, Homo sapiens
gagggaagggagccaaggg

SEQ ID NO: 2430540 - DNA, 17 bp, Homo sapiens
gagggacaaaggagcct

SEQ ID NO: 2430541 - DNA, 18 bp, Homo sapiens
gagggacaaaggagcctg

SEQ ID NO: 2430542 - DNA, 21 bp, Homo sapiens
gagggagacactggcccctca

SEQ ID NO: 2430543 - DNA, 14 bp, Homo sapiens
gagggcagcagcca

SEQ ID NO: 2430544 - DNA, 16 bp, Homo sapiens
gagggcagcagccagc

SEQ ID NO: 2430545 - DNA, 14 bp, Homo sapiens
gagggcagcagggc

SEQ ID NO: 2430546 - DNA, 19 bp, Homo sapiens
gagggcagttcgcagccac

SEQ ID NO: 2430547 - DNA, 16 bp, Homo sapiens
gagggcccgtgtaaat

SEQ ID NO: 2430548 - DNA, 19 bp, Homo sapiens
gagggcggcaggggcctgg

SEQ ID NO: 2430549 - DNA, 12 bp, Homo sapiens
gagggcgtgtct

SEQ ID NO: 2430550 - DNA, 14 bp, Homo sapiens
gagggctctgaggc

SEQ ID NO: 2430551 - DNA, 10 bp, Homo sapiens
gagggctgga

SEQ ID NO: 2430552 - DNA, 17 bp, Homo sapiens
gagggctggaggcccag

SEQ ID NO: 2430553 - DNA, 14 bp, Homo sapiens
gagggctggctggc

SEQ ID NO: 2430554 - DNA, 12 bp, Homo sapiens
gaggggaagagg

SEQ ID NO: 2430555 - DNA, 15 bp, Homo sapiens
gaggggaagaggcct

SEQ ID NO: 2430556 - DNA, 13 bp, Homo sapiens
gaggggaccagga

SEQ ID NO: 2430557 - DNA, 15 bp, Homo sapiens
gaggggcctgccacc

SEQ ID NO: 2430558 - DNA, 19 bp, Homo sapiens
gaggggcctgccacctgga

SEQ ID NO: 2430559 - DNA, 19 bp, Homo sapiens
gagggggtcgtggagagct

SEQ ID NO: 2430560 - DNA, 22 bp, Homo sapiens
gaggggttcctcccctccagct

SEQ ID NO: 2430561 - DNA, 18 bp, Homo sapiens
gagggtaggcaggattgg

SEQ ID NO: 2430562 - DNA, 22 bp, Homo sapiens
gagggtaggcaggattggggaa

SEQ ID NO: 2430563 - DNA, 20 bp, Homo sapiens
gagggtgaaggaggtcaggc

SEQ ID NO: 2430564 - DNA, 13 bp, Homo sapiens
gagggtgggaagg

SEQ ID NO: 2430565 - DNA, 13 bp, Homo sapiens
gaggtcctgagca

SEQ ID NO: 2430566 - DNA, 17 bp, Homo sapiens
gaggtcctgagcactgc

SEQ ID NO: 2430567 - DNA, 23 bp, Homo sapiens
gaggtcctgagcactgccaggag

SEQ ID NO: 2430568 - DNA, 18 bp, Homo sapiens
gaggtgaccccagggcac

SEQ ID NO: 2430569 - DNA, 21 bp, Homo sapiens
gaggtgaccccagggcacagg

SEQ ID NO: 2430570 - DNA, 23 bp, Homo sapiens
gaggtgaccccagggcacaggag

SEQ ID NO: 2430571 - DNA, 14 bp, Homo sapiens
gaggtgcactggga

SEQ ID NO: 2430572 - DNA, 16 bp, Homo sapiens
gaggtgcactgggagg

SEQ ID NO: 2430573 - DNA, 13 bp, Homo sapiens
gaggtgcccagga

SEQ ID NO: 2430574 - DNA, 14 bp, Homo sapiens
gaggtgcccaggag

SEQ ID NO: 2430575 - DNA, 19 bp, Homo sapiens
gaggtgggccgtggccctt

SEQ ID NO: 2430576 - DNA, 13 bp, Homo sapiens
gaggtgtctcagg

SEQ ID NO: 2430577 - DNA, 16 bp, Homo sapiens
gaggtgtctcaggctg

SEQ ID NO: 2430578 - DNA, 14 bp, Homo sapiens
gaggttgggtgggc

SEQ ID NO: 2430579 - DNA, 19 bp, Homo sapiens
gaggtttgcagtcccaagc

SEQ ID NO: 2430580 - DNA, 15 bp, Homo sapiens
gagtaacaatacaaa

SEQ ID NO: 2430581 - DNA, 15 bp, Homo sapiens
gagtaacatttgctg

SEQ ID NO: 2430582 - DNA, 16 bp, Homo sapiens
gagtaacatttgctgt

SEQ ID NO: 2430583 - DNA, 16 bp, Homo sapiens
gagtactccacactgc

SEQ ID NO: 2430584 - DNA, 17 bp, Homo sapiens
gagtcaaaacacttgta

SEQ ID NO: 2430585 - DNA, 22 bp, Homo sapiens
gagtcagacattttaagatggt

SEQ ID NO: 2430586 - DNA, 14 bp, Homo sapiens
gagtccaagctggg

SEQ ID NO: 2430587 - DNA, 19 bp, Homo sapiens
gagtcccctcacctcctct

SEQ ID NO: 2430588 - DNA, 14 bp, Homo sapiens
gagtccttaaaatg

SEQ ID NO: 2430589 - DNA, 19 bp, Homo sapiens
gagtcgtggggtgtgctgg

SEQ ID NO: 2430590 - DNA, 20 bp, Homo sapiens
gcacaagactgacgccaggg

SEQ ID NO: 2430591 - DNA, 18 bp, Homo sapiens
gcacaataactcctccca

SEQ ID NO: 2430592 - DNA, 21 bp, Homo sapiens
gcacaataactcctcccaggg

SEQ ID NO: 2430593 - DNA, 13 bp, Homo sapiens
gcacactttgcca

SEQ ID NO: 2430594 - DNA, 17 bp, Homo sapiens
gcacagccaaatttaaa

SEQ ID NO: 2430595 - DNA, 22 bp, Homo sapiens
gcacagccaacacgcacctgcc

SEQ ID NO: 2430596 - DNA, 19 bp, Homo sapiens
gcacagcttagatttcata

SEQ ID NO: 2430597 - DNA, 20 bp, Homo sapiens
gcacagcttgacctgaggct

SEQ ID NO: 2430598 - DNA, 14 bp, Homo sapiens
gcacaggacatgcg

SEQ ID NO: 2430599 - DNA, 21 bp, Homo sapiens
gcacaggacatgcggtagcca

SEQ ID NO: 2430600 - DNA, 16 bp, Homo sapiens
gcacaggagctacctg

SEQ ID NO: 2430601 - DNA, 20 bp, Homo sapiens
gcacaggagtgtcctcttcc

SEQ ID NO: 2430602 - DNA, 14 bp, Homo sapiens
gcacaggccccctt

SEQ ID NO: 2430603 - DNA, 17 bp, Homo sapiens
gcacagggtctgctctt

SEQ ID NO: 2430604 - DNA, 23 bp, Homo sapiens
gcacagggtctgctctttctctg

SEQ ID NO: 2430605 - DNA, 18 bp, Homo sapiens
gcacagtgacttctgaga

SEQ ID NO: 2430606 - DNA, 21 bp, Homo sapiens
gcacagttgaagggaggggct

SEQ ID NO: 2430607 - DNA, 23 bp, Homo sapiens
gcacatatggaattttgcaaaga

SEQ ID NO: 2430608 - DNA, 18 bp, Homo sapiens
gcaccaaaagaagtaaaa

SEQ ID NO: 2430609 - DNA, 22 bp, Homo sapiens
gcaccaagtgcgggtccggcag

SEQ ID NO: 2430610 - DNA, 14 bp, Homo sapiens
gcaccaccaagcca

SEQ ID NO: 2430611 - DNA, 16 bp, Homo sapiens
gcaccagacacccagg

SEQ ID NO: 2430612 - DNA, 16 bp, Homo sapiens
gcaccaggggtttctc

SEQ ID NO: 2430613 - DNA, 23 bp, Homo sapiens
gcaccatgctgctggggaagaca

SEQ ID NO: 2430614 - DNA, 17 bp, Homo sapiens
gcaccccaaagctttcc

SEQ ID NO: 2430615 - DNA, 18 bp, Homo sapiens
gcacccccagcctgggcc

SEQ ID NO: 2430616 - DNA, 23 bp, Homo sapiens
gcacccccagcctgggcctatgg

SEQ ID NO: 2430617 - DNA, 14 bp, Homo sapiens
gcaccccctgcagc

SEQ ID NO: 2430618 - DNA, 15 bp, Homo sapiens
gcaccccctgcagct

SEQ ID NO: 2430619 - DNA, 15 bp, Homo sapiens
gcaccggaccagcct

SEQ ID NO: 2430620 - DNA, 14 bp, Homo sapiens
gcacctaaagaaaa

SEQ ID NO: 2430621 - DNA, 17 bp, Homo sapiens
gcacctaaagaaaaaca

SEQ ID NO: 2430622 - DNA, 17 bp, Homo sapiens
gcacctaatccaggcag

SEQ ID NO: 2430623 - DNA, 18 bp, Homo sapiens
gcacctaatccaggcaga

SEQ ID NO: 2430624 - DNA, 18 bp, Homo sapiens
gcacctccacatcctcca

SEQ ID NO: 2430625 - DNA, 14 bp, Homo sapiens
gcacctgcctccag

SEQ ID NO: 2430626 - DNA, 18 bp, Homo sapiens
gcacctgcctccagccgc

SEQ ID NO: 2430627 - DNA, 15 bp, Homo sapiens
gcacctgctgtctgg

SEQ ID NO: 2430628 - DNA, 18 bp, Homo sapiens
gcacctggcatcgcacca

SEQ ID NO: 2430629 - DNA, 15 bp, Homo sapiens
gcacctgggccctgg

SEQ ID NO: 2430630 - DNA, 19 bp, Homo sapiens
gcacctgggccctggggcc

SEQ ID NO: 2430631 - DNA, 18 bp, Homo sapiens
gcacctgtaatgtgcgag

SEQ ID NO: 2430632 - DNA, 13 bp, Homo sapiens
gcacgacagtgga

SEQ ID NO: 2430633 - DNA, 15 bp, Homo sapiens
gcacgcgtgtgcagg

SEQ ID NO: 2430634 - DNA, 20 bp, Homo sapiens
gcacggctctgtccccagcc

SEQ ID NO: 2430635 - DNA, 17 bp, Homo sapiens
gcacgtaaagtacttgt

SEQ ID NO: 2430636 - DNA, 15 bp, Homo sapiens
gcacgtggcctcttg

SEQ ID NO: 2430637 - DNA, 16 bp, Homo sapiens
gcacgtgtgtttttct

SEQ ID NO: 2430638 - DNA, 12 bp, Homo sapiens
gcactacattca

SEQ ID NO: 2430639 - DNA, 16 bp, Homo sapiens
gcactacattcattta

SEQ ID NO: 2430640 - DNA, 18 bp, Homo sapiens
gcactactgacatgtggg

SEQ ID NO: 2430641 - DNA, 15 bp, Homo sapiens
gcactagccaaacct

SEQ ID NO: 2430642 - DNA, 20 bp, Homo sapiens
gcactagccaaacctcacca

SEQ ID NO: 2430643 - DNA, 21 bp, Homo sapiens
gcactagccaaacctcaccaa

SEQ ID NO: 2430644 - DNA, 17 bp, Homo sapiens
gcactcccacctgacac

SEQ ID NO: 2430645 - DNA, 20 bp, Homo sapiens
gcactcgctagcagtggcag

SEQ ID NO: 2430646 - DNA, 13 bp, Homo sapiens
gcactctagattc

SEQ ID NO: 2430647 - DNA, 22 bp, Homo sapiens
gcactgaataaattgtacagcc

SEQ ID NO: 2430648 - DNA, 21 bp, Homo sapiens
gcactgagataccagcgagga

SEQ ID NO: 2430649 - DNA, 13 bp, Homo sapiens
gcactgatgctgc

SEQ ID NO: 2430650 - DNA, 19 bp, Homo sapiens
gcactgatgctgcccctca

SEQ ID NO: 2430651 - DNA, 18 bp, Homo sapiens
gcactgatgttgtgtttt

SEQ ID NO: 2430652 - DNA, 12 bp, Homo sapiens
gcactgcacctg

SEQ ID NO: 2430653 - DNA, 22 bp, Homo sapiens
gcactgcacctgcctccagccg

SEQ ID NO: 2430654 - DNA, 18 bp, Homo sapiens
gcactgccaggagggaca

SEQ ID NO: 2430655 - DNA, 19 bp, Homo sapiens
gcactgcctgctcccatcc

SEQ ID NO: 2430656 - DNA, 21 bp, Homo sapiens
gcactgcctgctcccatcctg

SEQ ID NO: 2430657 - DNA, 16 bp, Homo sapiens
gcactgcttgaggaaa

SEQ ID NO: 2430658 - DNA, 17 bp, Homo sapiens
gcactgcttgaggaaaa

SEQ ID NO: 2430659 - DNA, 13 bp, Homo sapiens
gcactgggcatga

SEQ ID NO: 2430660 - DNA, 15 bp, Homo sapiens
gcactgggctccgga

SEQ ID NO: 2430661 - DNA, 15 bp, Homo sapiens
gcactggggagcccg

SEQ ID NO: 2430662 - DNA, 18 bp, Homo sapiens
gcactggggagcccgtct

SEQ ID NO: 2430663 - DNA, 23 bp, Homo sapiens
gcactggggagcccgtctcagtg

SEQ ID NO: 2430664 - DNA, 9 bp, Homo sapiens
gcactgtaa

SEQ ID NO: 2430665 - DNA, 23 bp, Homo sapiens
gcactgtaaaatgtgggattatg

SEQ ID NO: 2430666 - DNA, 18 bp, Homo sapiens
gcactgtagttctaagac

SEQ ID NO: 2430667 - DNA, 16 bp, Homo sapiens
gcactgtcttaaggca

SEQ ID NO: 2430668 - DNA, 11 bp, Homo sapiens
gcactgtgaag

SEQ ID NO: 2430669 - DNA, 16 bp, Homo sapiens
gcactgtgaaggaccc

SEQ ID NO: 2430670 - DNA, 18 bp, Homo sapiens
gcactgtgaaggaccctt

SEQ ID NO: 2430671 - DNA, 19 bp, Homo sapiens
gcactgtgacccccagctc

SEQ ID NO: 2430672 - DNA, 18 bp, Homo sapiens
gcactgttccccctgtgc

SEQ ID NO: 2430673 - DNA, 18 bp, Homo sapiens
gcacttaaagctttcaga

SEQ ID NO: 2430674 - DNA, 18 bp, Homo sapiens
gcacttatttaatgccga

SEQ ID NO: 2430675 - DNA, 20 bp, Homo sapiens
gcactttctatcctctgtaa

SEQ ID NO: 2430676 - DNA, 16 bp, Homo sapiens
gcactttggcttataa

SEQ ID NO: 2430677 - DNA, 16 bp, Homo sapiens
gcagaaaacccttggg

SEQ ID NO: 2430678 - DNA, 16 bp, Homo sapiens
gcagaaatccaagcac

SEQ ID NO: 2430679 - DNA, 20 bp, Homo sapiens
gcagaaccggagagccagct

SEQ ID NO: 2430680 - DNA, 14 bp, Homo sapiens
gcagaatagtattt

SEQ ID NO: 2430681 - DNA, 15 bp, Homo sapiens
gcagacagagccagg

SEQ ID NO: 2430682 - DNA, 17 bp, Homo sapiens
gcagacagagccaggag

SEQ ID NO: 2430683 - DNA, 23 bp, Homo sapiens
gcagacagagccaggagaagctc

SEQ ID NO: 2430684 - DNA, 15 bp, Homo sapiens
gcagacagctccacc

SEQ ID NO: 2430685 - DNA, 13 bp, Homo sapiens
gcagaccaccccg

SEQ ID NO: 2430686 - DNA, 20 bp, Homo sapiens
gcagactctttatgcttgca

SEQ ID NO: 2430687 - DNA, 11 bp, Homo sapiens
gcagactggcg

SEQ ID NO: 2430688 - DNA, 16 bp, Homo sapiens
gcagagatgcctccct

SEQ ID NO: 2430689 - DNA, 12 bp, Homo sapiens
gcagagctggct

SEQ ID NO: 2430690 - DNA, 14 bp, Homo sapiens
gcagagctggtgcg

SEQ ID NO: 2430691 - DNA, 14 bp, Homo sapiens
gcagaggcccacat

SEQ ID NO: 2430692 - DNA, 21 bp, Homo sapiens
gcagaggcccacattggaaga

SEQ ID NO: 2430693 - DNA, 11 bp, Homo sapiens
gcagaggcctg

SEQ ID NO: 2430694 - DNA, 22 bp, Homo sapiens
gccaggaggacccagggctctg

SEQ ID NO: 2430695 - DNA, 21 bp, Homo sapiens
gccaggagggacaaaggagcc

SEQ ID NO: 2430696 - DNA, 22 bp, Homo sapiens
gccaggagggacaaaggagcct

SEQ ID NO: 2430697 - DNA, 23 bp, Homo sapiens
gccaggcctctccctcctccagg

SEQ ID NO: 2430698 - DNA, 13 bp, Homo sapiens
gccaggctctctt

SEQ ID NO: 2430699 - DNA, 17 bp, Homo sapiens
gccaggctgaccacagc

SEQ ID NO: 2430700 - DNA, 15 bp, Homo sapiens
gccagggagaagctc

SEQ ID NO: 2430701 - DNA, 15 bp, Homo sapiens
gccagggagagccca

SEQ ID NO: 2430702 - DNA, 16 bp, Homo sapiens
gccagggagagcccag

SEQ ID NO: 2430703 - DNA, 22 bp, Homo sapiens
gccagggagagcccaggagctc

SEQ ID NO: 2430704 - DNA, 22 bp, Homo sapiens
gccagggcccctcaccctgcct

SEQ ID NO: 2430705 - DNA, 17 bp, Homo sapiens
gccagggcccctctccc

SEQ ID NO: 2430706 - DNA, 21 bp, Homo sapiens
gccaggggggtgaggagctgg

SEQ ID NO: 2430707 - DNA, 22 bp, Homo sapiens
gccaggggggtgaggagctggg

SEQ ID NO: 2430708 - DNA, 22 bp, Homo sapiens
gccagtaacgcgtcttcctgag

SEQ ID NO: 2430709 - DNA, 12 bp, Homo sapiens
gccagtctgtgg

SEQ ID NO: 2430710 - DNA, 13 bp, Homo sapiens
gccagtgacagac

SEQ ID NO: 2430711 - DNA, 15 bp, Homo sapiens
gccagtgccctgagc

SEQ ID NO: 2430712 - DNA, 16 bp, Homo sapiens
gccagtgtcctgagcc

SEQ ID NO: 2430713 - DNA, 17 bp, Homo sapiens
gccagtgtttaaaactt

SEQ ID NO: 2430714 - DNA, 17 bp, Homo sapiens
gccatatgatttacatt

SEQ ID NO: 2430715 - DNA, 19 bp, Homo sapiens
gccatatttacctcagcct

SEQ ID NO: 2430716 - DNA, 21 bp, Homo sapiens
gccatatttacctcagcctgg

SEQ ID NO: 2430717 - DNA, 22 bp, Homo sapiens
gccatatttacctcagcctggg

SEQ ID NO: 2430718 - DNA, 17 bp, Homo sapiens
gccatattttcaccatt

SEQ ID NO: 2430719 - DNA, 14 bp, Homo sapiens
gccatcaaaatgct

SEQ ID NO: 2430720 - DNA, 15 bp, Homo sapiens
gccatcaaaatgctt

SEQ ID NO: 2430721 - DNA, 19 bp, Homo sapiens
gccatcaaaatgcttttta

SEQ ID NO: 2430722 - DNA, 23 bp, Homo sapiens
gccatcacctcagatggcagctt

SEQ ID NO: 2430723 - DNA, 21 bp, Homo sapiens
gccatctgcgtgacaataaaa

SEQ ID NO: 2430724 - DNA, 12 bp, Homo sapiens
gccatctgctcc

SEQ ID NO: 2430725 - DNA, 17 bp, Homo sapiens
gccatgaccctgcctct

SEQ ID NO: 2430726 - DNA, 21 bp, Homo sapiens
gccatgaccctgcctctccca

SEQ ID NO: 2430727 - DNA, 19 bp, Homo sapiens
gccatgatgcctctgtctt

SEQ ID NO: 2430728 - DNA, 20 bp, Homo sapiens
gccatgctcctcttccccag

SEQ ID NO: 2430729 - DNA, 21 bp, Homo sapiens
gccatgctcctcttccccaga

SEQ ID NO: 2430730 - DNA, 14 bp, Homo sapiens
gccatgctgaggcc

SEQ ID NO: 2430731 - DNA, 20 bp, Homo sapiens
gccatggactctgtcctgaa

SEQ ID NO: 2430732 - DNA, 21 bp, Homo sapiens
gccatggactctgtcctgaag

SEQ ID NO: 2430733 - DNA, 15 bp, Homo sapiens
gccatggagaaagct

SEQ ID NO: 2430734 - DNA, 21 bp, Homo sapiens
gccatggagaaagctgacttg

SEQ ID NO: 2430735 - DNA, 22 bp, Homo sapiens
gccatggagaaagctgacttgg

SEQ ID NO: 2430736 - DNA, 14 bp, Homo sapiens
gccatgtcttctcc

SEQ ID NO: 2430737 - DNA, 20 bp, Homo sapiens
gccattggctatttaaaact

SEQ ID NO: 2430738 - DNA, 11 bp, Homo sapiens
gccatttgaga

SEQ ID NO: 2430739 - DNA, 16 bp, Homo sapiens
gcccaaaggacgcact

SEQ ID NO: 2430740 - DNA, 16 bp, Homo sapiens
gcccaacccttccctc

SEQ ID NO: 2430741 - DNA, 16 bp, Homo sapiens
gcccaagccagaggct

SEQ ID NO: 2430742 - DNA, 23 bp, Homo sapiens
gcccaagccagaggctgggttca

SEQ ID NO: 2430743 - DNA, 18 bp, Homo sapiens
gcccaagtgaggcagccg

SEQ ID NO: 2430744 - DNA, 16 bp, Homo sapiens
gcccacagtgtcaggc

SEQ ID NO: 2430745 - DNA, 15 bp, Homo sapiens
gcccacattggaaga

SEQ ID NO: 2430746 - DNA, 20 bp, Homo sapiens
gcccacccccggcagcagcc

SEQ ID NO: 2430747 - DNA, 15 bp, Homo sapiens
gcccacgacactgca

SEQ ID NO: 2430748 - DNA, 20 bp, Homo sapiens
gcccacgtacccaggtctgg

SEQ ID NO: 2430749 - DNA, 16 bp, Homo sapiens
gcccactgtgcctcag

SEQ ID NO: 2430750 - DNA, 23 bp, Homo sapiens
gcccactgtgcctcagagaccag

SEQ ID NO: 2430751 - DNA, 20 bp, Homo sapiens
gcccagaataagttattgca

SEQ ID NO: 2430752 - DNA, 19 bp, Homo sapiens
gcccagagacccaagctgc

SEQ ID NO: 2430753 - DNA, 14 bp, Homo sapiens
gcccagagcccagc

SEQ ID NO: 2430754 - DNA, 15 bp, Homo sapiens
gcccagagcccagct

SEQ ID NO: 2430755 - DNA, 14 bp, Homo sapiens
gcccagagggtctg

SEQ ID NO: 2430756 - DNA, 20 bp, Homo sapiens
gcccagcactgcttgaggaa

SEQ ID NO: 2430757 - DNA, 17 bp, Homo sapiens
gcccagccaaaccctgt

SEQ ID NO: 2430758 - DNA, 20 bp, Homo sapiens
gcccagccaaaccctgtctg

SEQ ID NO: 2430759 - DNA, 12 bp, Homo sapiens
gcccagccagcg

SEQ ID NO: 2430760 - DNA, 13 bp, Homo sapiens
gcccagccagcgt

SEQ ID NO: 2430761 - DNA, 22 bp, Homo sapiens
gcccagccagcgtcggtctgtg

SEQ ID NO: 2430762 - DNA, 16 bp, Homo sapiens
gcccagcccatggaga

SEQ ID NO: 2430763 - DNA, 18 bp, Homo sapiens
gcccagccccactcctct

SEQ ID NO: 2430764 - DNA, 17 bp, Homo sapiens
gcccagcctttgttccc

SEQ ID NO: 2430765 - DNA, 12 bp, Homo sapiens
gcccagctccaa

SEQ ID NO: 2430766 - DNA, 15 bp, Homo sapiens
gcccagctccaaggg

SEQ ID NO: 2430767 - DNA, 15 bp, Homo sapiens
gcccagctgggtcag

SEQ ID NO: 2430768 - DNA, 18 bp, Homo sapiens
gcccagctgggtcaggca

SEQ ID NO: 2430769 - DNA, 11 bp, Homo sapiens
gcccaggaagt

SEQ ID NO: 2430770 - DNA, 17 bp, Homo sapiens
gcccaggagctcccctc

SEQ ID NO: 2430771 - DNA, 20 bp, Homo sapiens
gcccaggagctcccctcccc

SEQ ID NO: 2430772 - DNA, 21 bp, Homo sapiens
gcccaggagctcccctcccca

SEQ ID NO: 2430773 - DNA, 24 bp, Homo sapiens
gcccaggccaggactctgcagcct

SEQ ID NO: 2430774 - DNA, 12 bp, Homo sapiens
gcccaggctgcc

SEQ ID NO: 2430775 - DNA, 13 bp, Homo sapiens
gcccaggctgccg

SEQ ID NO: 2430776 - DNA, 20 bp, Homo sapiens
gcccaggctggagtgcagtg

SEQ ID NO: 2430777 - DNA, 13 bp, Homo sapiens
gcccaggctggga

SEQ ID NO: 2430778 - DNA, 16 bp, Homo sapiens
gcccaggctggtttcg

SEQ ID NO: 2430779 - DNA, 12 bp, Homo sapiens
gcccagggaggc

SEQ ID NO: 2430780 - DNA, 16 bp, Homo sapiens
gcccagggcccagagc

SEQ ID NO: 2430781 - DNA, 18 bp, Homo sapiens
gcccagggcccagagccc

SEQ ID NO: 2430782 - DNA, 20 bp, Homo sapiens
gcccagggcccagagcccag

SEQ ID NO: 2430783 - DNA, 12 bp, Homo sapiens
gcccagggctcc

SEQ ID NO: 2430784 - DNA, 14 bp, Homo sapiens
gcccagggctcctg

SEQ ID NO: 2430785 - DNA, 21 bp, Homo sapiens
gcccagggctgggaggaagga

SEQ ID NO: 2430786 - DNA, 15 bp, Homo sapiens
gcccagtgcactgaa

SEQ ID NO: 2430787 - DNA, 15 bp, Homo sapiens
gcccagttaatcttg

SEQ ID NO: 2430788 - DNA, 21 bp, Homo sapiens
gcccatatgctaccaccagct

SEQ ID NO: 2430789 - DNA, 22 bp, Homo sapiens
gcccatatgctaccaccagctg

SEQ ID NO: 2430790 - DNA, 22 bp, Homo sapiens
gcccatccccttgaggtctcag

SEQ ID NO: 2430791 - DNA, 21 bp, Homo sapiens
gcccatggagattgacctgga

SEQ ID NO: 2430792 - DNA, 23 bp, Homo sapiens
gccccaacccgtggaggctgctc

SEQ ID NO: 2430793 - DNA, 14 bp, Homo sapiens
gccccaactccttc

SEQ ID NO: 2430794 - DNA, 17 bp, Homo sapiens
gccccaactccttccag

SEQ ID NO: 2430795 - DNA, 18 bp, Homo sapiens
gccccaactccttccagc

SEQ ID NO: 2430796 - DNA, 21 bp, Homo sapiens
gccccacaccagggccagcct

SEQ ID NO: 2430797 - DNA, 17 bp, Homo sapiens
gccccaccccagggcag

SEQ ID NO: 2430798 - DNA, 20 bp, Homo sapiens
gccttgcggctcctcaggga

SEQ ID NO: 2430799 - DNA, 15 bp, Homo sapiens
gccttggcctcccaa

SEQ ID NO: 2430800 - DNA, 11 bp, Homo sapiens
gccttggcctg

SEQ ID NO: 2430801 - DNA, 16 bp, Homo sapiens
gccttggcctggagca

SEQ ID NO: 2430802 - DNA, 15 bp, Homo sapiens
gccttggcctgtgtt

SEQ ID NO: 2430803 - DNA, 20 bp, Homo sapiens
gccttggctgacatgaagct

SEQ ID NO: 2430804 - DNA, 17 bp, Homo sapiens
gccttgggctccgtgtg

SEQ ID NO: 2430805 - DNA, 18 bp, Homo sapiens
gccttgggctccgtgtgg

SEQ ID NO: 2430806 - DNA, 21 bp, Homo sapiens
gccttgtgatgtcatacagag

SEQ ID NO: 2430807 - DNA, 22 bp, Homo sapiens
gccttgtgatgtcatacagaga

SEQ ID NO: 2430808 - DNA, 12 bp, Homo sapiens
gccttgttctgt

SEQ ID NO: 2430809 - DNA, 20 bp, Homo sapiens
gcctttatttccactgtgca

SEQ ID NO: 2430810 - DNA, 14 bp, Homo sapiens
gcctttatttgtta

SEQ ID NO: 2430811 - DNA, 14 bp, Homo sapiens
gcctttgagctcag

SEQ ID NO: 2430812 - DNA, 14 bp, Homo sapiens
gcctttgccaggtg

SEQ ID NO: 2430813 - DNA, 16 bp, Homo sapiens
gcctttgcgctcctgg

SEQ ID NO: 2430814 - DNA, 21 bp, Homo sapiens
gcctttgcgctcctggcccag

SEQ ID NO: 2430815 - DNA, 23 bp, Homo sapiens
gcctttgcgctcctggcccagcc

SEQ ID NO: 2430816 - DNA, 20 bp, Homo sapiens
gcctttgttccccactggag

SEQ ID NO: 2430817 - DNA, 22 bp, Homo sapiens
gccttttatcccaaagttgttg

SEQ ID NO: 2430818 - DNA, 20 bp, Homo sapiens
gccttttccctctttggctc

SEQ ID NO: 2430819 - DNA, 17 bp, Homo sapiens
gcctttttcatttatct

SEQ ID NO: 2430820 - DNA, 19 bp, Homo sapiens
gcctttttcatttatctat

SEQ ID NO: 2430821 - DNA, 17 bp, Homo sapiens
gcctttttgtttcaatg

SEQ ID NO: 2430822 - DNA, 20 bp, Homo sapiens
gccttttttccccagacttg

SEQ ID NO: 2430823 - DNA, 13 bp, Homo sapiens
gcgaccgccccct

SEQ ID NO: 2430824 - DNA, 22 bp, Homo sapiens
gcgaccttcctcatccacccca

SEQ ID NO: 2430825 - DNA, 13 bp, Homo sapiens
gcgactaatttca

SEQ ID NO: 2430826 - DNA, 20 bp, Homo sapiens
gcgactccgttggccactcc

SEQ ID NO: 2430827 - DNA, 19 bp, Homo sapiens
gcgagagatcaaagatgaa

SEQ ID NO: 2430828 - DNA, 13 bp, Homo sapiens
gcgagagatgtgt

SEQ ID NO: 2430829 - DNA, 12 bp, Homo sapiens
gcgagcctgcta

SEQ ID NO: 2430830 - DNA, 16 bp, Homo sapiens
gcgaggaggctccaga

SEQ ID NO: 2430831 - DNA, 18 bp, Homo sapiens
gcgaggaggctccagagg

SEQ ID NO: 2430832 - DNA, 17 bp, Homo sapiens
gcgatgacacttgtaca

SEQ ID NO: 2430833 - DNA, 20 bp, Homo sapiens
gcgatgacacttgtacaatt

SEQ ID NO: 2430834 - DNA, 13 bp, Homo sapiens
gcgatgccagcca

SEQ ID NO: 2430835 - DNA, 19 bp, Homo sapiens
gcgcaggccgtgacgtctg

SEQ ID NO: 2430836 - DNA, 21 bp, Homo sapiens
gcgccaccgagtgccttcaac

SEQ ID NO: 2430837 - DNA, 21 bp, Homo sapiens
gcgccaggatggaacacggcc

SEQ ID NO: 2430838 - DNA, 20 bp, Homo sapiens
gcgccaggctgaccacagca

SEQ ID NO: 2430839 - DNA, 22 bp, Homo sapiens
gcgccaggctgaccacagcaca

SEQ ID NO: 2430840 - DNA, 19 bp, Homo sapiens
gcgcccagggctgggagga

SEQ ID NO: 2430841 - DNA, 21 bp, Homo sapiens
gcgccccaacccgtggaggct

SEQ ID NO: 2430842 - DNA, 12 bp, Homo sapiens
gcgccctgcaga

SEQ ID NO: 2430843 - DNA, 13 bp, Homo sapiens
gcgccctgcagac

SEQ ID NO: 2430844 - DNA, 16 bp, Homo sapiens
gcgccctgcagaccct

SEQ ID NO: 2430845 - DNA, 19 bp, Homo sapiens
gcgcctccatccaaggcca

SEQ ID NO: 2430846 - DNA, 15 bp, Homo sapiens
gcgcctgtggttctg

SEQ ID NO: 2430847 - DNA, 20 bp, Homo sapiens
gcgctatctccctgcctcct

SEQ ID NO: 2430848 - DNA, 22 bp, Homo sapiens
gcgctcagggccatgctgaggc

SEQ ID NO: 2430849 - DNA, 19 bp, Homo sapiens
gcgctcctggcccagcctt

SEQ ID NO: 2430850 - DNA, 20 bp, Homo sapiens
gcgctcctggcccagccttt

SEQ ID NO: 2430851 - DNA, 16 bp, Homo sapiens
gcggcagatggggaga

SEQ ID NO: 2430852 - DNA, 13 bp, Homo sapiens
gcggcatcaggct

SEQ ID NO: 2430853 - DNA, 16 bp, Homo sapiens
gcggcccaatccaagg

SEQ ID NO: 2430854 - DNA, 13 bp, Homo sapiens
gcggccctcagta

SEQ ID NO: 2430855 - DNA, 15 bp, Homo sapiens
gcggcctccttctga

SEQ ID NO: 2430856 - DNA, 12 bp, Homo sapiens
gcggctcctcag

SEQ ID NO: 2430857 - DNA, 18 bp, Homo sapiens
gcggctggccatggagaa

SEQ ID NO: 2430858 - DNA, 19 bp, Homo sapiens
gcggctggggtcccagcag

SEQ ID NO: 2430859 - DNA, 20 bp, Homo sapiens
gcggctggggtcccagcagc

SEQ ID NO: 2430860 - DNA, 12 bp, Homo sapiens
gcggctgtgtgt

SEQ ID NO: 2430861 - DNA, 21 bp, Homo sapiens
gcgggagccatgcgccccctc

SEQ ID NO: 2430862 - DNA, 14 bp, Homo sapiens
gcggtcacagcatg

SEQ ID NO: 2430863 - DNA, 17 bp, Homo sapiens
gcggtgcttgatagaaa

SEQ ID NO: 2430864 - DNA, 23 bp, Homo sapiens
gcggttatgaaattcaccccctt

SEQ ID NO: 2430865 - DNA, 20 bp, Homo sapiens
gcgtaggctacagagaagcc

SEQ ID NO: 2430866 - DNA, 19 bp, Homo sapiens
gcgtattataccaaaatgt

SEQ ID NO: 2430867 - DNA, 13 bp, Homo sapiens
gcgtcttcctgag

SEQ ID NO: 2430868 - DNA, 21 bp, Homo sapiens
gcgtcttcctgagtggtgcca

SEQ ID NO: 2430869 - DNA, 14 bp, Homo sapiens
gcgtgagctgagca

SEQ ID NO: 2430870 - DNA, 11 bp, Homo sapiens
gcgttcttgta

SEQ ID NO: 2430871 - DNA, 22 bp, Homo sapiens
gcgttcttgtaattttacacgc

SEQ ID NO: 2430872 - DNA, 22 bp, Homo sapiens
gcgtttgaccttttatgtagta

SEQ ID NO: 2430873 - DNA, 18 bp, Homo sapiens
gctaacagggaaggcagg

SEQ ID NO: 2430874 - DNA, 20 bp, Homo sapiens
gctaacagggaaggcaggca

SEQ ID NO: 2430875 - DNA, 16 bp, Homo sapiens
gctaagaacctggaac

SEQ ID NO: 2430876 - DNA, 11 bp, Homo sapiens
gctaaggctct

SEQ ID NO: 2430877 - DNA, 15 bp, Homo sapiens
gctaaggggtggggc

SEQ ID NO: 2430878 - DNA, 17 bp, Homo sapiens
gctaaggttctaaggcc

SEQ ID NO: 2430879 - DNA, 12 bp, Homo sapiens
gctaatttttat

SEQ ID NO: 2430880 - DNA, 15 bp, Homo sapiens
gctaatttttgtaat

SEQ ID NO: 2430881 - DNA, 16 bp, Homo sapiens
gctaatttttgtaatt

SEQ ID NO: 2430882 - DNA, 17 bp, Homo sapiens
gctaatttttgtaattt

SEQ ID NO: 2430883 - DNA, 20 bp, Homo sapiens
gctaattttttgttgtttct

SEQ ID NO: 2430884 - DNA, 19 bp, Homo sapiens
gctaatttttttgtatttt

SEQ ID NO: 2430885 - DNA, 17 bp, Homo sapiens
gctacaccactctggca

SEQ ID NO: 2430886 - DNA, 19 bp, Homo sapiens
gctacaccactctggcagc

SEQ ID NO: 2430887 - DNA, 15 bp, Homo sapiens
gctacagagaaacca

SEQ ID NO: 2430888 - DNA, 16 bp, Homo sapiens
gctacagagaaaccag

SEQ ID NO: 2430889 - DNA, 23 bp, Homo sapiens
gctacagagaagccttcaagctc

SEQ ID NO: 2430890 - DNA, 19 bp, Homo sapiens
gctacagcaatttctaatt

SEQ ID NO: 2430891 - DNA, 15 bp, Homo sapiens
gctaccaccagctgt

SEQ ID NO: 2430892 - DNA, 21 bp, Homo sapiens
gctaccaccagctgtgtccaa

SEQ ID NO: 2430893 - DNA, 13 bp, Homo sapiens
gctaccagtattt

SEQ ID NO: 2430894 - DNA, 15 bp, Homo sapiens
gctaccagtatttag

SEQ ID NO: 2430895 - DNA, 22 bp, Homo sapiens
gctaccagtatttagaagccaa

SEQ ID NO: 2430896 - DNA, 14 bp, Homo sapiens
gctaccctgagctg

SEQ ID NO: 2430897 - DNA, 19 bp, Homo sapiens
gctaccctttttctccagc

SEQ ID NO: 2430898 - DNA, 19 bp, Homo sapiens
gctacctgctcagccctgc

SEQ ID NO: 2430899 - DNA, 14 bp, Homo sapiens
gctacctgtgtgga

SEQ ID NO: 2430900 - DNA, 20 bp, Homo sapiens
gctacctgtgtggacaggac

SEQ ID NO: 2430901 - DNA, 20 bp, Homo sapiens
gctactatgatttaatttga

SEQ ID NO: 2430902 - DNA, 16 bp, Homo sapiens
ggaaagcaagaatcag

SEQ ID NO: 2430903 - DNA, 20 bp, Homo sapiens
ggaaagggccctccttccta

SEQ ID NO: 2430904 - DNA, 20 bp, Homo sapiens
ggaaaggggtcggctgacca

SEQ ID NO: 2430905 - DNA, 16 bp, Homo sapiens
ggaaaggtggtgtttc

SEQ ID NO: 2430906 - DNA, 14 bp, Homo sapiens
ggaaatttagcatt

SEQ ID NO: 2430907 - DNA, 13 bp, Homo sapiens
ggaacatggggag

SEQ ID NO: 2430908 - DNA, 17 bp, Homo sapiens
ggaacatggggaggagg

SEQ ID NO: 2430909 - DNA, 24 bp, Homo sapiens
ggaacccttacagtaggagcccag

SEQ ID NO: 2430910 - DNA, 12 bp, Homo sapiens
ggaacctcagcc

SEQ ID NO: 2430911 - DNA, 14 bp, Homo sapiens
ggaacctcagcctg

SEQ ID NO: 2430912 - DNA, 22 bp, Homo sapiens
ggaacctcagcctggccagaca

SEQ ID NO: 2430913 - DNA, 19 bp, Homo sapiens
ggaactcagatccagggac

SEQ ID NO: 2430914 - DNA, 21 bp, Homo sapiens
ggaactgaagggggcggccta

SEQ ID NO: 2430915 - DNA, 13 bp, Homo sapiens
ggaactgctgcca

SEQ ID NO: 2430916 - DNA, 12 bp, Homo sapiens
ggaactggaggc

SEQ ID NO: 2430917 - DNA, 22 bp, Homo sapiens
ggaactggccaagctgaggtgc

SEQ ID NO: 2430918 - DNA, 17 bp, Homo sapiens
ggaagagcagcacctcc

SEQ ID NO: 2430919 - DNA, 23 bp, Homo sapiens
ggaagagcaggactccaggccca

SEQ ID NO: 2430920 - DNA, 13 bp, Homo sapiens
ggaagaggcctgt

SEQ ID NO: 2430921 - DNA, 23 bp, Homo sapiens
ggaagaggcctgtttggcctctc

SEQ ID NO: 2430922 - DNA, 22 bp, Homo sapiens
ggaagagtttttgtgatggggg

SEQ ID NO: 2430923 - DNA, 14 bp, Homo sapiens
ggaagatagctgtg

SEQ ID NO: 2430924 - DNA, 12 bp, Homo sapiens
ggaagatcctgc

SEQ ID NO: 2430925 - DNA, 22 bp, Homo sapiens
ggaagcattgtaaaataattct

SEQ ID NO: 2430926 - DNA, 18 bp, Homo sapiens
ggaagcccatcctgacca

SEQ ID NO: 2430927 - DNA, 13 bp, Homo sapiens
ggaagcctcagat

SEQ ID NO: 2430928 - DNA, 22 bp, Homo sapiens
ggaagcctcagattccttccca

SEQ ID NO: 2430929 - DNA, 16 bp, Homo sapiens
ggaagctaatttgcat

SEQ ID NO: 2430930 - DNA, 22 bp, Homo sapiens
ggaagctagacacatgaaggta

SEQ ID NO: 2430931 - DNA, 16 bp, Homo sapiens
ggaagctagtcttttg

SEQ ID NO: 2430932 - DNA, 23 bp, Homo sapiens
ggaagctagtcttttgcttttgc

SEQ ID NO: 2430933 - DNA, 20 bp, Homo sapiens
ggaagctcttggagctgtga

SEQ ID NO: 2430934 - DNA, 20 bp, Homo sapiens
ggaagctttggtgagaacct

SEQ ID NO: 2430935 - DNA, 21 bp, Homo sapiens
ggaagctttggtgagaacctg

SEQ ID NO: 2430936 - DNA, 15 bp, Homo sapiens
ggaaggagctgcctg

SEQ ID NO: 2430937 - DNA, 17 bp, Homo sapiens
ggaaggagctgcctgga

SEQ ID NO: 2430938 - DNA, 16 bp, Homo sapiens
ggaaggaggagcctgt

SEQ ID NO: 2430939 - DNA, 20 bp, Homo sapiens
ggaaggattctgctggcctc

SEQ ID NO: 2430940 - DNA, 22 bp, Homo sapiens
ggaaggattctgctggcctctg

SEQ ID NO: 2430941 - DNA, 17 bp, Homo sapiens
ggaagggagccaaggga

SEQ ID NO: 2430942 - DNA, 14 bp, Homo sapiens
ggaaggggaccctc

SEQ ID NO: 2430943 - DNA, 15 bp, Homo sapiens
ggaaggggccagagg

SEQ ID NO: 2430944 - DNA, 14 bp, Homo sapiens
ggaagtagaaacaa

SEQ ID NO: 2430945 - DNA, 15 bp, Homo sapiens
ggaagtccaatgtgg

SEQ ID NO: 2430946 - DNA, 17 bp, Homo sapiens
ggaagtccaatgtggca

SEQ ID NO: 2430947 - DNA, 21 bp, Homo sapiens
ggaagtcgtccttactcctgt

SEQ ID NO: 2430948 - DNA, 22 bp, Homo sapiens
ggaagtcgtccttactcctgtg

SEQ ID NO: 2430949 - DNA, 18 bp, Homo sapiens
ggaataagctcccagggc

SEQ ID NO: 2430950 - DNA, 19 bp, Homo sapiens
ggaataaggtacaagaagc

SEQ ID NO: 2430951 - DNA, 19 bp, Homo sapiens
ggaatactgaacatctgag

SEQ ID NO: 2430952 - DNA, 14 bp, Homo sapiens
ggaatagcatgtca

SEQ ID NO: 2430953 - DNA, 19 bp, Homo sapiens
ggaatgcccttcactgtca

SEQ ID NO: 2430954 - DNA, 12 bp, Homo sapiens
ggaatggcagca

SEQ ID NO: 2430955 - DNA, 18 bp, Homo sapiens
ggaatttcccaggaccct

SEQ ID NO: 2430956 - DNA, 22 bp, Homo sapiens
ggaatttcttaacttcttgctt

SEQ ID NO: 2430957 - DNA, 19 bp, Homo sapiens
ggaattttcatctaggatt

SEQ ID NO: 2430958 - DNA, 16 bp, Homo sapiens
ggacaaaggagcctgt

SEQ ID NO: 2430959 - DNA, 18 bp, Homo sapiens
ggacaaatcacatatttt

SEQ ID NO: 2430960 - DNA, 16 bp, Homo sapiens
ggacaagacccccagc

SEQ ID NO: 2430961 - DNA, 20 bp, Homo sapiens
ggacaagtggactcagggca

SEQ ID NO: 2430962 - DNA, 11 bp, Homo sapiens
ggacacaggcc

SEQ ID NO: 2430963 - DNA, 15 bp, Homo sapiens
ggacagatgcctcct

SEQ ID NO: 2430964 - DNA, 20 bp, Homo sapiens
ggacagatgcctccttcctc

SEQ ID NO: 2430965 - DNA, 15 bp, Homo sapiens
ggacagccccaccct

SEQ ID NO: 2430966 - DNA, 11 bp, Homo sapiens
ggacagctgtg

SEQ ID NO: 2430967 - DNA, 14 bp, Homo sapiens
ggacagctgtgcct

SEQ ID NO: 2430968 - DNA, 23 bp, Homo sapiens
ggacaggctggctccagatgcag

SEQ ID NO: 2430969 - DNA, 20 bp, Homo sapiens
ggacagtttaccagttgcct

SEQ ID NO: 2430970 - DNA, 19 bp, Homo sapiens
ggacatgcggtagccagca

SEQ ID NO: 2430971 - DNA, 16 bp, Homo sapiens
ggaccaagcatcttgg

SEQ ID NO: 2430972 - DNA, 20 bp, Homo sapiens
ggaccacaactattttcaga

SEQ ID NO: 2430973 - DNA, 14 bp, Homo sapiens
ggaccacaggctca

SEQ ID NO: 2430974 - DNA, 22 bp, Homo sapiens
ggaccaccctcactggctctcc

SEQ ID NO: 2430975 - DNA, 18 bp, Homo sapiens
ggaccaccctgagccggc

SEQ ID NO: 2430976 - DNA, 20 bp, Homo sapiens
ggaccaggagtgggtgggga

SEQ ID NO: 2430977 - DNA, 16 bp, Homo sapiens
ggaccagtcccagagc

SEQ ID NO: 2430978 - DNA, 18 bp, Homo sapiens
ggaccagtcccagagcag

SEQ ID NO: 2430979 - DNA, 13 bp, Homo sapiens
ggacccagggctc

SEQ ID NO: 2430980 - DNA, 17 bp, Homo sapiens
ggacccgttcatggggg

SEQ ID NO: 2430981 - DNA, 11 bp, Homo sapiens
ggaccctgacc

SEQ ID NO: 2430982 - DNA, 13 bp, Homo sapiens
ggaccctgtgagc

SEQ ID NO: 2430983 - DNA, 20 bp, Homo sapiens
ggaccgctacaccactctgg

SEQ ID NO: 2430984 - DNA, 17 bp, Homo sapiens
ggacctaaatggcctca

SEQ ID NO: 2430985 - DNA, 22 bp, Homo sapiens
ggacctaaatggcctcatgtgg

SEQ ID NO: 2430986 - DNA, 14 bp, Homo sapiens
ggacctgagcctgc

SEQ ID NO: 2430987 - DNA, 15 bp, Homo sapiens
ggacctgagcctgcc

SEQ ID NO: 2430988 - DNA, 20 bp, Homo sapiens
ggacctgagcctgccgagca

SEQ ID NO: 2430989 - DNA, 14 bp, Homo sapiens
ggacctggaaggga

SEQ ID NO: 2430990 - DNA, 18 bp, Homo sapiens
ggaccttcgggctgtgcc

SEQ ID NO: 2430991 - DNA, 20 bp, Homo sapiens
ggaccttcgggctgtgcccg

SEQ ID NO: 2430992 - DNA, 14 bp, Homo sapiens
ggacgcctgggggt

SEQ ID NO: 2430993 - DNA, 20 bp, Homo sapiens
ggacgcctgggggtgccagg

SEQ ID NO: 2430994 - DNA, 18 bp, Homo sapiens
ggactaacactcagaagc

SEQ ID NO: 2430995 - DNA, 21 bp, Homo sapiens
ggactaacactcagaagcctg

SEQ ID NO: 2430996 - DNA, 17 bp, Homo sapiens
ggactcagccttcagac

SEQ ID NO: 2430997 - DNA, 22 bp, Homo sapiens
ggactcagggcagcgccaggct

SEQ ID NO: 2430998 - DNA, 23 bp, Homo sapiens
ggactccaggcccaaggctcccg

SEQ ID NO: 2430999 - DNA, 20 bp, Homo sapiens
ggactctcagtctctgagca

SEQ ID NO: 2431000 - DNA, 14 bp, Homo sapiens
ggactctgcagcct

SEQ ID NO: 2431001 - DNA, 15 bp, Homo sapiens
ggactctgcagcctc

SEQ ID NO: 2431002 - DNA, 12 bp, Homo sapiens
ggactctgtcct

SEQ ID NO: 2431003 - DNA, 14 bp, Homo sapiens
ggactctgtcctga

SEQ ID NO: 2431004 - DNA, 21 bp, Homo sapiens
ggactctgtcctgaaggcctg

SEQ ID NO: 2431005 - DNA, 17 bp, Homo sapiens
ggactgagtgggaagcc

SEQ ID NO: 2431006 - DNA, 15 bp, Homo sapiens
ggcaggcagggctct

SEQ ID NO: 2431007 - DNA, 23 bp, Homo sapiens
ggcaggcagggctctcctggctt

SEQ ID NO: 2431008 - DNA, 15 bp, Homo sapiens
ggcaggccagctgtg

SEQ ID NO: 2431009 - DNA, 11 bp, Homo sapiens
ggcaggctggc

SEQ ID NO: 2431010 - DNA, 12 bp, Homo sapiens
ggcaggctggcc

SEQ ID NO: 2431011 - DNA, 20 bp, Homo sapiens
ggcaggctggccagtccagg

SEQ ID NO: 2431012 - DNA, 15 bp, Homo sapiens
ggcaggctgggccat

SEQ ID NO: 2431013 - DNA, 17 bp, Homo sapiens
ggcagggaacatgggga

SEQ ID NO: 2431014 - DNA, 20 bp, Homo sapiens
ggcagggaacatggggagga

SEQ ID NO: 2431015 - DNA, 22 bp, Homo sapiens
ggcagggcgggcagagggctgg

SEQ ID NO: 2431016 - DNA, 13 bp, Homo sapiens
ggcagggctctcc

SEQ ID NO: 2431017 - DNA, 16 bp, Homo sapiens
ggcaggggcctggaga

SEQ ID NO: 2431018 - DNA, 17 bp, Homo sapiens
ggcaggggcctggagat

SEQ ID NO: 2431019 - DNA, 13 bp, Homo sapiens
ggcaggggcttcc

SEQ ID NO: 2431020 - DNA, 14 bp, Homo sapiens
ggcaggggcttcct

SEQ ID NO: 2431021 - DNA, 12 bp, Homo sapiens
ggcagggggctg

SEQ ID NO: 2431022 - DNA, 13 bp, Homo sapiens
ggcagggggctgc

SEQ ID NO: 2431023 - DNA, 17 bp, Homo sapiens
ggcagggggctgctgct

SEQ ID NO: 2431024 - DNA, 14 bp, Homo sapiens
ggcagggtgaccct

SEQ ID NO: 2431025 - DNA, 21 bp, Homo sapiens
ggcaggtatgatcggcaggac

SEQ ID NO: 2431026 - DNA, 23 bp, Homo sapiens
ggcaggtatgatcggcaggacac

SEQ ID NO: 2431027 - DNA, 13 bp, Homo sapiens
ggcagtacctgag

SEQ ID NO: 2431028 - DNA, 16 bp, Homo sapiens
ggcagtacctgagggt

SEQ ID NO: 2431029 - DNA, 20 bp, Homo sapiens
ggcagtacctgagggtctgt

SEQ ID NO: 2431030 - DNA, 23 bp, Homo sapiens
ggcagtacctgggcaagctggcg

SEQ ID NO: 2431031 - DNA, 16 bp, Homo sapiens
ggcagttaccattaaa

SEQ ID NO: 2431032 - DNA, 22 bp, Homo sapiens
ggcagttaccattaaaccatct

SEQ ID NO: 2431033 - DNA, 19 bp, Homo sapiens
ggcagttcgcagccaccct

SEQ ID NO: 2431034 - DNA, 17 bp, Homo sapiens
ggcatactatgtggatg

SEQ ID NO: 2431035 - DNA, 15 bp, Homo sapiens
ggcatagctctgggg

SEQ ID NO: 2431036 - DNA, 12 bp, Homo sapiens
ggcatccctggg

SEQ ID NO: 2431037 - DNA, 14 bp, Homo sapiens
ggcatccctgggcc

SEQ ID NO: 2431038 - DNA, 18 bp, Homo sapiens
ggcatcgcaccattctga

SEQ ID NO: 2431039 - DNA, 16 bp, Homo sapiens
ggcatctggcctggcc

SEQ ID NO: 2431040 - DNA, 17 bp, Homo sapiens
ggcatcttttgtattaa

SEQ ID NO: 2431041 - DNA, 21 bp, Homo sapiens
ggcatcttttgtattaagaaa

SEQ ID NO: 2431042 - DNA, 19 bp, Homo sapiens
ggcattagaattatttaaa

SEQ ID NO: 2431043 - DNA, 15 bp, Homo sapiens
ggcatttttatttta

SEQ ID NO: 2431044 - DNA, 14 bp, Homo sapiens
ggccaacaaagaac

SEQ ID NO: 2431045 - DNA, 15 bp, Homo sapiens
ggccaagaagcagtg

SEQ ID NO: 2431046 - DNA, 15 bp, Homo sapiens
ggccaagttcctcta

SEQ ID NO: 2431047 - DNA, 12 bp, Homo sapiens
ggccacacagct

SEQ ID NO: 2431048 - DNA, 15 bp, Homo sapiens
ggccacacagctgcc

SEQ ID NO: 2431049 - DNA, 17 bp, Homo sapiens
ggccacacttcaaacta

SEQ ID NO: 2431050 - DNA, 18 bp, Homo sapiens
ggccacgctccagctgcc

SEQ ID NO: 2431051 - DNA, 16 bp, Homo sapiens
ggccagacacaggccc

SEQ ID NO: 2431052 - DNA, 18 bp, Homo sapiens
ggccagacacaggccctc

SEQ ID NO: 2431053 - DNA, 15 bp, Homo sapiens
ggccagacatgccac

SEQ ID NO: 2431054 - DNA, 18 bp, Homo sapiens
ggccagacatgccacaag

SEQ ID NO: 2431055 - DNA, 11 bp, Homo sapiens
ggccagagcca

SEQ ID NO: 2431056 - DNA, 21 bp, Homo sapiens
ggccagaggcccccagcccag

SEQ ID NO: 2431057 - DNA, 22 bp, Homo sapiens
ggccagaggcccccagcccagg

SEQ ID NO: 2431058 - DNA, 18 bp, Homo sapiens
ggccagcagcacctgccc

SEQ ID NO: 2431059 - DNA, 19 bp, Homo sapiens
ggccagcagcacctgccct

SEQ ID NO: 2431060 - DNA, 15 bp, Homo sapiens
ggccagccccttaga

SEQ ID NO: 2431061 - DNA, 19 bp, Homo sapiens
ggccagccccttagacaga

SEQ ID NO: 2431062 - DNA, 20 bp, Homo sapiens
ggccagccccttagacagag

SEQ ID NO: 2431063 - DNA, 17 bp, Homo sapiens
ggccagcctggcctcct

SEQ ID NO: 2431064 - DNA, 19 bp, Homo sapiens
ggccagcctggcctcctgc

SEQ ID NO: 2431065 - DNA, 22 bp, Homo sapiens
ggccagcgagcgcccagctcct

SEQ ID NO: 2431066 - DNA, 14 bp, Homo sapiens
ggccaggcctctcc

SEQ ID NO: 2431067 - DNA, 18 bp, Homo sapiens
ggccagggagaagctcct

SEQ ID NO: 2431068 - DNA, 14 bp, Homo sapiens
ggccagtccaggct

SEQ ID NO: 2431069 - DNA, 18 bp, Homo sapiens
ggccagtctgtggatcag

SEQ ID NO: 2431070 - DNA, 19 bp, Homo sapiens
ggccatatttacctcagcc

SEQ ID NO: 2431071 - DNA, 17 bp, Homo sapiens
ggccatctgctcctgga

SEQ ID NO: 2431072 - DNA, 16 bp, Homo sapiens
ggccatgaccctgcct

SEQ ID NO: 2431073 - DNA, 18 bp, Homo sapiens
ggccatgctcctcttccc

SEQ ID NO: 2431074 - DNA, 13 bp, Homo sapiens
ggccatgctgagg

SEQ ID NO: 2431075 - DNA, 22 bp, Homo sapiens
ggccatgctgaggcctgggccg

SEQ ID NO: 2431076 - DNA, 14 bp, Homo sapiens
ggccatggactctg

SEQ ID NO: 2431077 - DNA, 22 bp, Homo sapiens
ggccatggactctgtcctgaag

SEQ ID NO: 2431078 - DNA, 15 bp, Homo sapiens
ggccatggagaaagc

SEQ ID NO: 2431079 - DNA, 16 bp, Homo sapiens
ggccatggagaaagct

SEQ ID NO: 2431080 - DNA, 15 bp, Homo sapiens
ggccatggcctgcaa

SEQ ID NO: 2431081 - DNA, 21 bp, Homo sapiens
ggcccaatccaaggtggggtg

SEQ ID NO: 2431082 - DNA, 18 bp, Homo sapiens
ggcccacattggaagagc

SEQ ID NO: 2431083 - DNA, 23 bp, Homo sapiens
ggcccaccccacccacttctgca

SEQ ID NO: 2431084 - DNA, 17 bp, Homo sapiens
ggcccactgtgcctcag

SEQ ID NO: 2431085 - DNA, 16 bp, Homo sapiens
ggcccagccgaccccc

SEQ ID NO: 2431086 - DNA, 19 bp, Homo sapiens
ggcccagccgaccccctct

SEQ ID NO: 2431087 - DNA, 23 bp, Homo sapiens
ggcccagcctttgttccccactg

SEQ ID NO: 2431088 - DNA, 15 bp, Homo sapiens
ggcccagggcccaga

SEQ ID NO: 2431089 - DNA, 18 bp, Homo sapiens
ggcccaggtcagccactg

SEQ ID NO: 2431090 - DNA, 21 bp, Homo sapiens
ggcccatcagggtaggctgga

SEQ ID NO: 2431091 - DNA, 17 bp, Homo sapiens
ggccccaccctcgggga

SEQ ID NO: 2431092 - DNA, 15 bp, Homo sapiens
ggccccagcacagct

SEQ ID NO: 2431093 - DNA, 18 bp, Homo sapiens
ggccccaggaaaggccca

SEQ ID NO: 2431094 - DNA, 21 bp, Homo sapiens
ggccccaggacctggctgcca

SEQ ID NO: 2431095 - DNA, 22 bp, Homo sapiens
ggccccaggcattgccaagggc

SEQ ID NO: 2431096 - DNA, 18 bp, Homo sapiens
ggccccatgacctccagc

SEQ ID NO: 2431097 - DNA, 14 bp, Homo sapiens
ggcccccatctcat

SEQ ID NO: 2431098 - DNA, 15 bp, Homo sapiens
ggcccccatctcatg

SEQ ID NO: 2431099 - DNA, 17 bp, Homo sapiens
ggccccctccctggatg

SEQ ID NO: 2431100 - DNA, 13 bp, Homo sapiens
ggcccctctcagc

SEQ ID NO: 2431101 - DNA, 14 bp, Homo sapiens
ggcccctctgacct

SEQ ID NO: 2431102 - DNA, 13 bp, Homo sapiens
ggcccgagcagct

SEQ ID NO: 2431103 - DNA, 14 bp, Homo sapiens
ggcccgagcagctg

SEQ ID NO: 2431104 - DNA, 15 bp, Homo sapiens
ggcccgagcagctga

SEQ ID NO: 2431105 - DNA, 16 bp, Homo sapiens
ggcccgagcagctgag

SEQ ID NO: 2431106 - DNA, 20 bp, Homo sapiens
ggcccgagcagctgagcagg

SEQ ID NO: 2431107 - DNA, 13 bp, Homo sapiens
ggcccggcagggc

SEQ ID NO: 2431108 - DNA, 19 bp, Homo sapiens
ggccctcaagtctttctct

SEQ ID NO: 2431109 - DNA, 15 bp, Homo sapiens
ggccctcgctgccag

SEQ ID NO: 2431110 - DNA, 12 bp, Homo sapiens
ggccctctcccc

SEQ ID NO: 2431111 - DNA, 11 bp, Homo sapiens
gggcccagagc

SEQ ID NO: 2431112 - DNA, 13 bp, Homo sapiens
gggcccagagccc

SEQ ID NO: 2431113 - DNA, 20 bp, Homo sapiens
gggcccagagcccagctcca

SEQ ID NO: 2431114 - DNA, 17 bp, Homo sapiens
gggcccctcaccctgcc

SEQ ID NO: 2431115 - DNA, 14 bp, Homo sapiens
gggcccctctcagc

SEQ ID NO: 2431116 - DNA, 15 bp, Homo sapiens
gggcccctctcagcc

SEQ ID NO: 2431117 - DNA, 17 bp, Homo sapiens
gggccctgggcctgcct

SEQ ID NO: 2431118 - DNA, 18 bp, Homo sapiens
gggccctgggcctgcctc

SEQ ID NO: 2431119 - DNA, 18 bp, Homo sapiens
gggccctggggcctgtac

SEQ ID NO: 2431120 - DNA, 14 bp, Homo sapiens
gggccgactaagag

SEQ ID NO: 2431121 - DNA, 15 bp, Homo sapiens
gggccgatgcccaga

SEQ ID NO: 2431122 - DNA, 17 bp, Homo sapiens
gggccgccgcctctttc

SEQ ID NO: 2431123 - DNA, 23 bp, Homo sapiens
gggccggggaactggccaagctg

SEQ ID NO: 2431124 - DNA, 20 bp, Homo sapiens
gggcctcaccgagtgggggc

SEQ ID NO: 2431125 - DNA, 16 bp, Homo sapiens
gggcctgccacctgga

SEQ ID NO: 2431126 - DNA, 19 bp, Homo sapiens
gggcctgccacctggaccc

SEQ ID NO: 2431127 - DNA, 12 bp, Homo sapiens
gggcctgcctca

SEQ ID NO: 2431128 - DNA, 17 bp, Homo sapiens
gggcctgctccagacct

SEQ ID NO: 2431129 - DNA, 23 bp, Homo sapiens
gggcctgctgctgagaacctggc

SEQ ID NO: 2431130 - DNA, 21 bp, Homo sapiens
gggcctggagatcctcctgca

SEQ ID NO: 2431131 - DNA, 14 bp, Homo sapiens
gggcctggctggct

SEQ ID NO: 2431132 - DNA, 18 bp, Homo sapiens
gggcctggctggctgagg

SEQ ID NO: 2431133 - DNA, 22 bp, Homo sapiens
gggcctggctggctgagggcag

SEQ ID NO: 2431134 - DNA, 12 bp, Homo sapiens
gggcctgggagg

SEQ ID NO: 2431135 - DNA, 12 bp, Homo sapiens
gggcctgggctc

SEQ ID NO: 2431136 - DNA, 19 bp, Homo sapiens
gggcctggtctcaccctgg

SEQ ID NO: 2431137 - DNA, 17 bp, Homo sapiens
gggcctgtactgcctgc

SEQ ID NO: 2431138 - DNA, 16 bp, Homo sapiens
gggcctgtccacaggc

SEQ ID NO: 2431139 - DNA, 15 bp, Homo sapiens
gggccttggcctgga

SEQ ID NO: 2431140 - DNA, 16 bp, Homo sapiens
gggccttggcctggag

SEQ ID NO: 2431141 - DNA, 24 bp, Homo sapiens
gggccttgggctccgtgtgggaga

SEQ ID NO: 2431142 - DNA, 12 bp, Homo sapiens
gggcgcaggccg

SEQ ID NO: 2431143 - DNA, 17 bp, Homo sapiens
gggcggcaggggcctgg

SEQ ID NO: 2431144 - DNA, 22 bp, Homo sapiens
gggcggcctatgacttgggcac

SEQ ID NO: 2431145 - DNA, 22 bp, Homo sapiens
gggcggtcacagcatggaggag

SEQ ID NO: 2431146 - DNA, 13 bp, Homo sapiens
gggctaccctgag

SEQ ID NO: 2431147 - DNA, 23 bp, Homo sapiens
gggctccagcccctcttggagaa

SEQ ID NO: 2431148 - DNA, 14 bp, Homo sapiens
gggctccctgactg

SEQ ID NO: 2431149 - DNA, 21 bp, Homo sapiens
gggctccctgtaacctcttca

SEQ ID NO: 2431150 - DNA, 12 bp, Homo sapiens
gggctcctttcc

SEQ ID NO: 2431151 - DNA, 15 bp, Homo sapiens
gggctctaacgcctg

SEQ ID NO: 2431152 - DNA, 18 bp, Homo sapiens
gggctctaacgcctgagc

SEQ ID NO: 2431153 - DNA, 19 bp, Homo sapiens
gggctctaacgcctgagcc

SEQ ID NO: 2431154 - DNA, 22 bp, Homo sapiens
gggctctaacgcctgagcccag

SEQ ID NO: 2431155 - DNA, 12 bp, Homo sapiens
gggctctcctgg

SEQ ID NO: 2431156 - DNA, 22 bp, Homo sapiens
gggctctcctggcttcccatcc

SEQ ID NO: 2431157 - DNA, 15 bp, Homo sapiens
gggctctgaggcgcc

SEQ ID NO: 2431158 - DNA, 11 bp, Homo sapiens
gggctctgagt

SEQ ID NO: 2431159 - DNA, 16 bp, Homo sapiens
gggctctgagtacccc

SEQ ID NO: 2431160 - DNA, 12 bp, Homo sapiens
gggctgagggag

SEQ ID NO: 2431161 - DNA, 17 bp, Homo sapiens
gggctgctgctgggctc

SEQ ID NO: 2431162 - DNA, 14 bp, Homo sapiens
gggctggaggagcc

SEQ ID NO: 2431163 - DNA, 17 bp, Homo sapiens
gggctggaggagcccag

SEQ ID NO: 2431164 - DNA, 18 bp, Homo sapiens
gggctggaggagcccagg

SEQ ID NO: 2431165 - DNA, 22 bp, Homo sapiens
gggctggaggagcccaggccag

SEQ ID NO: 2431166 - DNA, 15 bp, Homo sapiens
gggctggccgctgtg

SEQ ID NO: 2431167 - DNA, 11 bp, Homo sapiens
gggctggctgg

SEQ ID NO: 2431168 - DNA, 17 bp, Homo sapiens
gggctgtaactgccagg

SEQ ID NO: 2431169 - DNA, 19 bp, Homo sapiens
gggctgtaactgccaggct

SEQ ID NO: 2431170 - DNA, 19 bp, Homo sapiens
gggcttatatctggcctct

SEQ ID NO: 2431171 - DNA, 17 bp, Homo sapiens
gggcttcaggtccaggc

SEQ ID NO: 2431172 - DNA, 15 bp, Homo sapiens
gggcttcctggtgct

SEQ ID NO: 2431173 - DNA, 13 bp, Homo sapiens
gggcttgccttct

SEQ ID NO: 2431174 - DNA, 20 bp, Homo sapiens
gggcttgggcctaggctgca

SEQ ID NO: 2431175 - DNA, 22 bp, Homo sapiens
gggctttgatgttccttccagt

SEQ ID NO: 2431176 - DNA, 18 bp, Homo sapiens
ggggaactcagatccagg

SEQ ID NO: 2431177 - DNA, 12 bp, Homo sapiens
ggggaccaggag

SEQ ID NO: 2431178 - DNA, 21 bp, Homo sapiens
ggggactgtaagttgggcttg

SEQ ID NO: 2431179 - DNA, 17 bp, Homo sapiens
ggggagactgggctgag

SEQ ID NO: 2431180 - DNA, 14 bp, Homo sapiens
ggggagcaggcagc

SEQ ID NO: 2431181 - DNA, 22 bp, Homo sapiens
ggggagccccttctgctcagct

SEQ ID NO: 2431182 - DNA, 19 bp, Homo sapiens
ggggagcgggtctgctccc

SEQ ID NO: 2431183 - DNA, 13 bp, Homo sapiens
ggggaggaggagg

SEQ ID NO: 2431184 - DNA, 14 bp, Homo sapiens
ggggagggattctg

SEQ ID NO: 2431185 - DNA, 13 bp, Homo sapiens
ggggatgtgtcct

SEQ ID NO: 2431186 - DNA, 17 bp, Homo sapiens
ggggcagaggcagtacc

SEQ ID NO: 2431187 - DNA, 11 bp, Homo sapiens
ggggcaggagt

SEQ ID NO: 2431188 - DNA, 21 bp, Homo sapiens
ggggcaggagtagctgagctc

SEQ ID NO: 2431189 - DNA, 16 bp, Homo sapiens
ggggcatctggcctgg

SEQ ID NO: 2431190 - DNA, 19 bp, Homo sapiens
ggggcccctctcagccctc

SEQ ID NO: 2431191 - DNA, 20 bp, Homo sapiens
ggggcctgccacctggaccc

SEQ ID NO: 2431192 - DNA, 19 bp, Homo sapiens
ggggcctggagatcctcct

SEQ ID NO: 2431193 - DNA, 11 bp, Homo sapiens
ggggcctggct

SEQ ID NO: 2431194 - DNA, 19 bp, Homo sapiens
ggggcctggctggctgagg

SEQ ID NO: 2431195 - DNA, 14 bp, Homo sapiens
ggggcctgtactgc

SEQ ID NO: 2431196 - DNA, 15 bp, Homo sapiens
ggggcctgtactgcc

SEQ ID NO: 2431197 - DNA, 16 bp, Homo sapiens
ggggctccctccgccc

SEQ ID NO: 2431198 - DNA, 22 bp, Homo sapiens
ggggctctaacgcctgagccca

SEQ ID NO: 2431199 - DNA, 12 bp, Homo sapiens
ggggctgctgct

SEQ ID NO: 2431200 - DNA, 23 bp, Homo sapiens
ggggctgtcctgccacccagccc

SEQ ID NO: 2431201 - DNA, 12 bp, Homo sapiens
gggggcagaagt

SEQ ID NO: 2431202 - DNA, 14 bp, Homo sapiens
gggggcctggctgg

SEQ ID NO: 2431203 - DNA, 15 bp, Homo sapiens
gggggcctggctggc

SEQ ID NO: 2431204 - DNA, 20 bp, Homo sapiens
gggggcctggctggctgagg

SEQ ID NO: 2431205 - DNA, 18 bp, Homo sapiens
gggggtcctcctccaggg

SEQ ID NO: 2431206 - DNA, 18 bp, Homo sapiens
gggggtgatgagggcagc

SEQ ID NO: 2431207 - DNA, 22 bp, Homo sapiens
gggggtgatgagggcagcagcc

SEQ ID NO: 2431208 - DNA, 14 bp, Homo sapiens
ggggtcccagcagc

SEQ ID NO: 2431209 - DNA, 18 bp, Homo sapiens
ggggtcccagcagctgcc

SEQ ID NO: 2431210 - DNA, 18 bp, Homo sapiens
ggggtcgtggagagctag

SEQ ID NO: 2431211 - DNA, 20 bp, Homo sapiens
ggggtctggagttgatctgg

SEQ ID NO: 2431212 - DNA, 13 bp, Homo sapiens
ggggtctggctgg

SEQ ID NO: 2431213 - DNA, 23 bp, Homo sapiens
ggggtgacccggcaccccctgca

SEQ ID NO: 2431214 - DNA, 13 bp, Homo sapiens
ggggtgcagggat

SEQ ID NO: 2431215 - DNA, 18 bp, Homo sapiens
ggggtgcagggatgtggg

SEQ ID NO: 2431216 - DNA, 20 bp, Homo sapiens
gtagaccttgttacttctga

SEQ ID NO: 2431217 - DNA, 22 bp, Homo sapiens
gtagaccttgttacttctgagg

SEQ ID NO: 2431218 - DNA, 14 bp, Homo sapiens
gtagagttgctgag

SEQ ID NO: 2431219 - DNA, 22 bp, Homo sapiens
gtagatattggacaaagaacct

SEQ ID NO: 2431220 - DNA, 14 bp, Homo sapiens
gtagattcaggtaa

SEQ ID NO: 2431221 - DNA, 13 bp, Homo sapiens
gtagattgcagaa

SEQ ID NO: 2431222 - DNA, 14 bp, Homo sapiens
gtagattttccaaa

SEQ ID NO: 2431223 - DNA, 13 bp, Homo sapiens
gtagccacaccag

SEQ ID NO: 2431224 - DNA, 23 bp, Homo sapiens
gtagcgggggagggtaggcagga

SEQ ID NO: 2431225 - DNA, 18 bp, Homo sapiens
gtagcgtctttctttttt

SEQ ID NO: 2431226 - DNA, 16 bp, Homo sapiens
gtagctacagagaaac

SEQ ID NO: 2431227 - DNA, 18 bp, Homo sapiens
gtagctacagagaaacca

SEQ ID NO: 2431228 - DNA, 12 bp, Homo sapiens
gtagctcctccc

SEQ ID NO: 2431229 - DNA, 19 bp, Homo sapiens
gtagctcctcccctggagg

SEQ ID NO: 2431230 - DNA, 22 bp, Homo sapiens
gtagctgagctcacaaggcagc

SEQ ID NO: 2431231 - DNA, 13 bp, Homo sapiens
gtagctgtgacct

SEQ ID NO: 2431232 - DNA, 14 bp, Homo sapiens
gtagctgtgacctg

SEQ ID NO: 2431233 - DNA, 15 bp, Homo sapiens
gtaggaagtaggaag

SEQ ID NO: 2431234 - DNA, 15 bp, Homo sapiens
gtaggctacagagaa

SEQ ID NO: 2431235 - DNA, 17 bp, Homo sapiens
gtaggctacagagaagc

SEQ ID NO: 2431236 - DNA, 20 bp, Homo sapiens
gtaggctacagagaagcctt

SEQ ID NO: 2431237 - DNA, 13 bp, Homo sapiens
gtaggggcccctc

SEQ ID NO: 2431238 - DNA, 13 bp, Homo sapiens
gtaggggctggga

SEQ ID NO: 2431239 - DNA, 17 bp, Homo sapiens
gtaggggctgggaacag

SEQ ID NO: 2431240 - DNA, 22 bp, Homo sapiens
gtagggtaattagtaacatgtg

SEQ ID NO: 2431241 - DNA, 16 bp, Homo sapiens
gtaggttcagccaagg

SEQ ID NO: 2431242 - DNA, 18 bp, Homo sapiens
gtaggttgcacactttgg

SEQ ID NO: 2431243 - DNA, 17 bp, Homo sapiens
gtagtaaataatgcttt

SEQ ID NO: 2431244 - DNA, 22 bp, Homo sapiens
gtagtatgataggttattttga

SEQ ID NO: 2431245 - DNA, 17 bp, Homo sapiens
gtagtatggcctgtgtc

SEQ ID NO: 2431246 - DNA, 15 bp, Homo sapiens
gtagtattttttgta

SEQ ID NO: 2431247 - DNA, 23 bp, Homo sapiens
gtagtgctacagggtccaacata

SEQ ID NO: 2431248 - DNA, 20 bp, Homo sapiens
gtagttctgctccagacagg

SEQ ID NO: 2431249 - DNA, 16 bp, Homo sapiens
gtataaaaataaaaaa

SEQ ID NO: 2431250 - DNA, 23 bp, Homo sapiens
gtataaaaataaaaaagatccca

SEQ ID NO: 2431251 - DNA, 16 bp, Homo sapiens
gtataaaactttcctc

SEQ ID NO: 2431252 - DNA, 21 bp, Homo sapiens
gtataaaactttcctcgcctg

SEQ ID NO: 2431253 - DNA, 17 bp, Homo sapiens
gtataaacaagaaaaat

SEQ ID NO: 2431254 - DNA, 22 bp, Homo sapiens
gtataaacaagaaaaataaaga

SEQ ID NO: 2431255 - DNA, 14 bp, Homo sapiens
gtataagatcctag

SEQ ID NO: 2431256 - DNA, 13 bp, Homo sapiens
gtatacctcactt

SEQ ID NO: 2431257 - DNA, 20 bp, Homo sapiens
gtatagcatgcatctgttta

SEQ ID NO: 2431258 - DNA, 18 bp, Homo sapiens
gtatagctgcttccagtg

SEQ ID NO: 2431259 - DNA, 20 bp, Homo sapiens
gtataggtctcatctcttca

SEQ ID NO: 2431260 - DNA, 14 bp, Homo sapiens
gtatagttaacaca

SEQ ID NO: 2431261 - DNA, 23 bp, Homo sapiens
gtatatacacccaagatgggcat

SEQ ID NO: 2431262 - DNA, 14 bp, Homo sapiens
gtatattttcctat

SEQ ID NO: 2431263 - DNA, 17 bp, Homo sapiens
gtatcatgccctgtgca

SEQ ID NO: 2431264 - DNA, 13 bp, Homo sapiens
gtatctcagaaag

SEQ ID NO: 2431265 - DNA, 13 bp, Homo sapiens
gtatcttttgata

SEQ ID NO: 2431266 - DNA, 16 bp, Homo sapiens
gtatgcatgttgtcta

SEQ ID NO: 2431267 - DNA, 18 bp, Homo sapiens
gtatggactatctgtctg

SEQ ID NO: 2431268 - DNA, 19 bp, Homo sapiens
gtatggcgtaagtacagag

SEQ ID NO: 2431269 - DNA, 21 bp, Homo sapiens
gtatggcgtaagtacagagaa

SEQ ID NO: 2431270 - DNA, 22 bp, Homo sapiens
gtatggcgtaagtacagagaag

SEQ ID NO: 2431271 - DNA, 23 bp, Homo sapiens
gtatggcgtaagtacagagaagc

SEQ ID NO: 2431272 - DNA, 19 bp, Homo sapiens
gtatgggtagggtaaatca

SEQ ID NO: 2431273 - DNA, 16 bp, Homo sapiens
gtatggttttgtggat

SEQ ID NO: 2431274 - DNA, 17 bp, Homo sapiens
gtattaaaatgtatgca

SEQ ID NO: 2431275 - DNA, 13 bp, Homo sapiens
gtattatatgtac

SEQ ID NO: 2431276 - DNA, 11 bp, Homo sapiens
gtattctctga

SEQ ID NO: 2431277 - DNA, 22 bp, Homo sapiens
gtattcttctcttccttttatc

SEQ ID NO: 2431278 - DNA, 13 bp, Homo sapiens
gtattgcacattg

SEQ ID NO: 2431279 - DNA, 19 bp, Homo sapiens
gtattgtgcaatgtgtata

SEQ ID NO: 2431280 - DNA, 15 bp, Homo sapiens
gtattgttgtccttt

SEQ ID NO: 2431281 - DNA, 18 bp, Homo sapiens
gtattgttgtccttttca

SEQ ID NO: 2431282 - DNA, 20 bp, Homo sapiens
gtattgttgtccttttcata

SEQ ID NO: 2431283 - DNA, 22 bp, Homo sapiens
gtatttgttaatttagaaaact

SEQ ID NO: 2431284 - DNA, 23 bp, Homo sapiens
gtatttgttaatttagaaaactt

SEQ ID NO: 2431285 - DNA, 16 bp, Homo sapiens
gtatttgttcccaaga

SEQ ID NO: 2431286 - DNA, 13 bp, Homo sapiens
gtatttttcttga

SEQ ID NO: 2431287 - DNA, 14 bp, Homo sapiens
gtcaaaaagaacca

SEQ ID NO: 2431288 - DNA, 14 bp, Homo sapiens
gtcaaaacacttgt

SEQ ID NO: 2431289 - DNA, 21 bp, Homo sapiens
gtcaacgagacgtttcctacc

SEQ ID NO: 2431290 - DNA, 17 bp, Homo sapiens
gtcaacttgagcatgtt

SEQ ID NO: 2431291 - DNA, 21 bp, Homo sapiens
gtcaagtctctgctggcccag

SEQ ID NO: 2431292 - DNA, 17 bp, Homo sapiens
gtcaagtgcgtccacga

SEQ ID NO: 2431293 - DNA, 16 bp, Homo sapiens
gtcaatgacatgaatt

SEQ ID NO: 2431294 - DNA, 23 bp, Homo sapiens
gtcaatgacatgaattttagctt

SEQ ID NO: 2431295 - DNA, 22 bp, Homo sapiens
gtcaatttctgtgttgccaagc

SEQ ID NO: 2431296 - DNA, 14 bp, Homo sapiens
gtcacaaccaagaa

SEQ ID NO: 2431297 - DNA, 19 bp, Homo sapiens
gtcacacagtgttggaggt

SEQ ID NO: 2431298 - DNA, 17 bp, Homo sapiens
gtcacagcatggaggag

SEQ ID NO: 2431299 - DNA, 12 bp, Homo sapiens
gtcacagccacc

SEQ ID NO: 2431300 - DNA, 12 bp, Homo sapiens
gtcacagctgta

SEQ ID NO: 2431301 - DNA, 12 bp, Homo sapiens
gtcacagggcag

SEQ ID NO: 2431302 - DNA, 19 bp, Homo sapiens
gtcaccaatgtacccaccg

SEQ ID NO: 2431303 - DNA, 20 bp, Homo sapiens
gtcacctaggaagcctcaga

SEQ ID NO: 2431304 - DNA, 16 bp, Homo sapiens
gtcacggccaggcaga

SEQ ID NO: 2431305 - DNA, 19 bp, Homo sapiens
gtcactctagtcaatgaca

SEQ ID NO: 2431306 - DNA, 15 bp, Homo sapiens
gtcagaccctggagg

SEQ ID NO: 2431307 - DNA, 16 bp, Homo sapiens
gtcagaccctggaggc

SEQ ID NO: 2431308 - DNA, 18 bp, Homo sapiens
gtcagacgcctgaggaac

SEQ ID NO: 2431309 - DNA, 20 bp, Homo sapiens
gtcagagccatgtcttctcc

SEQ ID NO: 2431310 - DNA, 21 bp, Homo sapiens
gtcagagccatgtcttctccc

SEQ ID NO: 2431311 - DNA, 22 bp, Homo sapiens
gtcagagccatgtcttctccct

SEQ ID NO: 2431312 - DNA, 20 bp, Homo sapiens
gtcagcatgaatttgtaatg

SEQ ID NO: 2431313 - DNA, 13 bp, Homo sapiens
gtcagccactgtt

SEQ ID NO: 2431314 - DNA, 22 bp, Homo sapiens
gtcagccctagggtggagagcc

SEQ ID NO: 2431315 - DNA, 18 bp, Homo sapiens
gtcaggagtgtgtgtgag

SEQ ID NO: 2431316 - DNA, 20 bp, Homo sapiens
gtcaggagtgtgtgtgagtg

SEQ ID NO: 2431317 - DNA, 19 bp, Homo sapiens
gtcaggattgcgagagatg

SEQ ID NO: 2431318 - DNA, 16 bp, Homo sapiens
gtcaggcactgggcat

SEQ ID NO: 2431319 - DNA, 16 bp, Homo sapiens
gtcagtcacagccacc

SEQ ID NO: 2431320 - DNA, 19 bp, Homo sapiens
gtgctgttttgttatataa

SEQ ID NO: 2431321 - DNA, 16 bp, Homo sapiens
gtgcttatggtaccag

SEQ ID NO: 2431322 - DNA, 20 bp, Homo sapiens
gtgctttccattcgtgaaaa

SEQ ID NO: 2431323 - DNA, 16 bp, Homo sapiens
gtgctttttttgtgtg

SEQ ID NO: 2431324 - DNA, 14 bp, Homo sapiens
gtggaactgctgcc

SEQ ID NO: 2431325 - DNA, 16 bp, Homo sapiens
gtggaagcttggggaa

SEQ ID NO: 2431326 - DNA, 19 bp, Homo sapiens
gtggaagcttggggaagac

SEQ ID NO: 2431327 - DNA, 16 bp, Homo sapiens
gtggacacacacagac

SEQ ID NO: 2431328 - DNA, 21 bp, Homo sapiens
gtggaccatggagtggcagcc

SEQ ID NO: 2431329 - DNA, 15 bp, Homo sapiens
gtggactcagggcag

SEQ ID NO: 2431330 - DNA, 21 bp, Homo sapiens
gtggactcagggcagcgccag

SEQ ID NO: 2431331 - DNA, 12 bp, Homo sapiens
gtggagagggaa

SEQ ID NO: 2431332 - DNA, 17 bp, Homo sapiens
gtggaggaggagggagg

SEQ ID NO: 2431333 - DNA, 12 bp, Homo sapiens
gtggaggctgct

SEQ ID NO: 2431334 - DNA, 23 bp, Homo sapiens
gtggagggacaagtggactcagg

SEQ ID NO: 2431335 - DNA, 16 bp, Homo sapiens
gtggagtctgccaccc

SEQ ID NO: 2431336 - DNA, 19 bp, Homo sapiens
gtggatctatttcatgttt

SEQ ID NO: 2431337 - DNA, 22 bp, Homo sapiens
gtggatggccccagcacagctt

SEQ ID NO: 2431338 - DNA, 13 bp, Homo sapiens
gtggattctttaa

SEQ ID NO: 2431339 - DNA, 16 bp, Homo sapiens
gtggcacaggccccct

SEQ ID NO: 2431340 - DNA, 15 bp, Homo sapiens
gtggcagagttacag

SEQ ID NO: 2431341 - DNA, 17 bp, Homo sapiens
gtggcagcccagccagc

SEQ ID NO: 2431342 - DNA, 13 bp, Homo sapiens
gtggcaggcagag

SEQ ID NO: 2431343 - DNA, 15 bp, Homo sapiens
gtggcaggcagaggc

SEQ ID NO: 2431344 - DNA, 18 bp, Homo sapiens
gtggcaggggacaggagt

SEQ ID NO: 2431345 - DNA, 20 bp, Homo sapiens
gtggcaggggacaggagtcc

SEQ ID NO: 2431346 - DNA, 15 bp, Homo sapiens
gtggccaagaagcag

SEQ ID NO: 2431347 - DNA, 21 bp, Homo sapiens
gtggccagcgagggcgtgtct

SEQ ID NO: 2431348 - DNA, 13 bp, Homo sapiens
gtggccaggaggt

SEQ ID NO: 2431349 - DNA, 13 bp, Homo sapiens
gtggccatgctcc

SEQ ID NO: 2431350 - DNA, 18 bp, Homo sapiens
gtggccccaccctgggcc

SEQ ID NO: 2431351 - DNA, 19 bp, Homo sapiens
gtggccccaccctgggccc

SEQ ID NO: 2431352 - DNA, 23 bp, Homo sapiens
gtggccccaccctgggccctggg

SEQ ID NO: 2431353 - DNA, 17 bp, Homo sapiens
gtggccccgtttctggt

SEQ ID NO: 2431354 - DNA, 15 bp, Homo sapiens
gtggccctctcccct

SEQ ID NO: 2431355 - DNA, 18 bp, Homo sapiens
gtggccctctcccctgcc

SEQ ID NO: 2431356 - DNA, 15 bp, Homo sapiens
gtggcccttcctgga

SEQ ID NO: 2431357 - DNA, 16 bp, Homo sapiens
gtggcccttcctggac

SEQ ID NO: 2431358 - DNA, 18 bp, Homo sapiens
gtggcccttcctggacag

SEQ ID NO: 2431359 - DNA, 18 bp, Homo sapiens
gtggccgaaccagaacca

SEQ ID NO: 2431360 - DNA, 20 bp, Homo sapiens
gtggcctcttgagcagtggc

SEQ ID NO: 2431361 - DNA, 19 bp, Homo sapiens
gtggcctttgcgctcctgg

SEQ ID NO: 2431362 - DNA, 17 bp, Homo sapiens
gtggcgccgtctccagg

SEQ ID NO: 2431363 - DNA, 22 bp, Homo sapiens
gtggcgccgtctccaggggctg

SEQ ID NO: 2431364 - DNA, 15 bp, Homo sapiens
gtggctactctgtgc

SEQ ID NO: 2431365 - DNA, 20 bp, Homo sapiens
gtggctactctgtgccagag

SEQ ID NO: 2431366 - DNA, 22 bp, Homo sapiens
gtggctactctgtgccagagcc

SEQ ID NO: 2431367 - DNA, 23 bp, Homo sapiens
gtggctactctgtgccagagcct

SEQ ID NO: 2431368 - DNA, 17 bp, Homo sapiens
gtggctgaggccaccca

SEQ ID NO: 2431369 - DNA, 14 bp, Homo sapiens
gtggctgcagcctc

SEQ ID NO: 2431370 - DNA, 15 bp, Homo sapiens
gtggctgctgtggga

SEQ ID NO: 2431371 - DNA, 12 bp, Homo sapiens
gtggctggaaga

SEQ ID NO: 2431372 - DNA, 20 bp, Homo sapiens
gtgggaagcccatcctgacc

SEQ ID NO: 2431373 - DNA, 20 bp, Homo sapiens
gtgggacggtgcccaagcca

SEQ ID NO: 2431374 - DNA, 21 bp, Homo sapiens
gtgggagaccggcctgccagg

SEQ ID NO: 2431375 - DNA, 22 bp, Homo sapiens
gtgggagaccggcctgccagga

SEQ ID NO: 2431376 - DNA, 23 bp, Homo sapiens
gtgggagaccggcctgccaggag

SEQ ID NO: 2431377 - DNA, 14 bp, Homo sapiens
gtgggagtgtgtgc

SEQ ID NO: 2431378 - DNA, 15 bp, Homo sapiens
gtgggccagtctgtg

SEQ ID NO: 2431379 - DNA, 18 bp, Homo sapiens
gtgggccagtctgtggat

SEQ ID NO: 2431380 - DNA, 17 bp, Homo sapiens
gtgggcctgggctcctg

SEQ ID NO: 2431381 - DNA, 20 bp, Homo sapiens
gtgggcctgggctcctggac

SEQ ID NO: 2431382 - DNA, 14 bp, Homo sapiens
gtgggctccctgac

SEQ ID NO: 2431383 - DNA, 22 bp, Homo sapiens
gtgggcttgtggggcctgggag

SEQ ID NO: 2431384 - DNA, 19 bp, Homo sapiens
gtggggggtcccaaagagt

SEQ ID NO: 2431385 - DNA, 20 bp, Homo sapiens
gtgggtacccccaggaccag

SEQ ID NO: 2431386 - DNA, 13 bp, Homo sapiens
gtgggtgcctagg

SEQ ID NO: 2431387 - DNA, 15 bp, Homo sapiens
gtgggttccacagac

SEQ ID NO: 2431388 - DNA, 15 bp, Homo sapiens
gtggtacagagaagc

SEQ ID NO: 2431389 - DNA, 18 bp, Homo sapiens
gtggtacagagaagccag

SEQ ID NO: 2431390 - DNA, 21 bp, Homo sapiens
gtggtattttcaatagccact

SEQ ID NO: 2431391 - DNA, 19 bp, Homo sapiens
gtggtccacaagcttctgt

SEQ ID NO: 2431392 - DNA, 19 bp, Homo sapiens
gtggtctgttggcaggctg

SEQ ID NO: 2431393 - DNA, 23 bp, Homo sapiens
gtggtctgttggcaggctggcca

SEQ ID NO: 2431394 - DNA, 13 bp, Homo sapiens
gtggtggcctggt

SEQ ID NO: 2431395 - DNA, 16 bp, Homo sapiens
gtggtggtccctgggt

SEQ ID NO: 2431396 - DNA, 23 bp, Homo sapiens
gtggtgtgtccccctctgtccag

SEQ ID NO: 2431397 - DNA, 20 bp, Homo sapiens
gtggttctgagatggctccc

SEQ ID NO: 2431398 - DNA, 19 bp, Homo sapiens
gtggttttcttttgccatg

SEQ ID NO: 2431399 - DNA, 17 bp, Homo sapiens
gtgtaaaatattttgaa

SEQ ID NO: 2431400 - DNA, 19 bp, Homo sapiens
gtgtaaaatattttgaatc

SEQ ID NO: 2431401 - DNA, 16 bp, Homo sapiens
gtgtaaatatgtacat

SEQ ID NO: 2431402 - DNA, 17 bp, Homo sapiens
gtgtaacaattgtgtag

SEQ ID NO: 2431403 - DNA, 21 bp, Homo sapiens
gtgtaagatttgtttttaaac

SEQ ID NO: 2431404 - DNA, 15 bp, Homo sapiens
gtgtacatatgtgct

SEQ ID NO: 2431405 - DNA, 14 bp, Homo sapiens
gtgtagaacactaa

SEQ ID NO: 2431406 - DNA, 16 bp, Homo sapiens
gtgtagcaactacagt

SEQ ID NO: 2431407 - DNA, 15 bp, Homo sapiens
gtgtagctacagaga

SEQ ID NO: 2431408 - DNA, 16 bp, Homo sapiens
gtgtagctacagagaa

SEQ ID NO: 2431409 - DNA, 15 bp, Homo sapiens
gtgtagctgtgacct

SEQ ID NO: 2431410 - DNA, 18 bp, Homo sapiens
gtgtagctgtgacctgct

SEQ ID NO: 2431411 - DNA, 20 bp, Homo sapiens
gtgtagctgtgacctgctga

SEQ ID NO: 2431412 - DNA, 22 bp, Homo sapiens
gtgtagctgtgacctgctgagc

SEQ ID NO: 2431413 - DNA, 23 bp, Homo sapiens
gtgtagctgtgacctgctgagct

SEQ ID NO: 2431414 - DNA, 15 bp, Homo sapiens
gtgtagttcatgtaa

SEQ ID NO: 2431415 - DNA, 13 bp, Homo sapiens
gtgtatatggaca

SEQ ID NO: 2431416 - DNA, 21 bp, Homo sapiens
gtgtatttggaaataaagtca

SEQ ID NO: 2431417 - DNA, 14 bp, Homo sapiens
gtgtcacggccagg

SEQ ID NO: 2431418 - DNA, 16 bp, Homo sapiens
gtgtcacggccaggca

SEQ ID NO: 2431419 - DNA, 21 bp, Homo sapiens
gtgtcactcaaggcggtgctt

SEQ ID NO: 2431420 - DNA, 20 bp, Homo sapiens
gtgtcagaccctggaggccc

SEQ ID NO: 2431421 - DNA, 19 bp, Homo sapiens
gtgtcaggcactgggcatg

SEQ ID NO: 2431422 - DNA, 20 bp, Homo sapiens
gtgtcatcctcacagtgaac

SEQ ID NO: 2431423 - DNA, 16 bp, Homo sapiens
gtgtcatttctcatcc

SEQ ID NO: 2431424 - DNA, 17 bp, Homo sapiens
taaaaataaaaaagatc

SEQ ID NO: 2431425 - DNA, 19 bp, Homo sapiens
taaaaataagtcaacagta

SEQ ID NO: 2431426 - DNA, 17 bp, Homo sapiens
taaaaattgtgatcaga

SEQ ID NO: 2431427 - DNA, 14 bp, Homo sapiens
taaaacacacaggt

SEQ ID NO: 2431428 - DNA, 18 bp, Homo sapiens
taaaacccgttgattact

SEQ ID NO: 2431429 - DNA, 12 bp, Homo sapiens
taaaagaaaatt

SEQ ID NO: 2431430 - DNA, 13 bp, Homo sapiens
taaaagaaacttt

SEQ ID NO: 2431431 - DNA, 17 bp, Homo sapiens
taaaagaaactttcttt

SEQ ID NO: 2431432 - DNA, 12 bp, Homo sapiens
taaaagactcat

SEQ ID NO: 2431433 - DNA, 13 bp, Homo sapiens
taaaagactcatc

SEQ ID NO: 2431434 - DNA, 14 bp, Homo sapiens
taaaagatgctttt

SEQ ID NO: 2431435 - DNA, 22 bp, Homo sapiens
taaaagcaaaaaagaaaacctt

SEQ ID NO: 2431436 - DNA, 21 bp, Homo sapiens
taaaagcaaatcatttgttta

SEQ ID NO: 2431437 - DNA, 21 bp, Homo sapiens
taaaaggaaatctcaccccat

SEQ ID NO: 2431438 - DNA, 21 bp, Homo sapiens
taaaagttttttattatgcat

SEQ ID NO: 2431439 - DNA, 16 bp, Homo sapiens
taaaataagcaggtgg

SEQ ID NO: 2431440 - DNA, 20 bp, Homo sapiens
taaaataattatataactgt

SEQ ID NO: 2431441 - DNA, 21 bp, Homo sapiens
taaaatacttttactctgcct

SEQ ID NO: 2431442 - DNA, 13 bp, Homo sapiens
taaaatagcaaaa

SEQ ID NO: 2431443 - DNA, 22 bp, Homo sapiens
taaaatagcaaaagaagaagtt

SEQ ID NO: 2431444 - DNA, 19 bp, Homo sapiens
taaaatagcgttcttgtaa

SEQ ID NO: 2431445 - DNA, 14 bp, Homo sapiens
taaaatatctacat

SEQ ID NO: 2431446 - DNA, 20 bp, Homo sapiens
taaaatatgaagacataaac

SEQ ID NO: 2431447 - DNA, 20 bp, Homo sapiens
taaaatattttgaatcaata

SEQ ID NO: 2431448 - DNA, 17 bp, Homo sapiens
taaaatcttatagttct

SEQ ID NO: 2431449 - DNA, 19 bp, Homo sapiens
taaaatcttatagttctag

SEQ ID NO: 2431450 - DNA, 11 bp, Homo sapiens
taaaatcttgt

SEQ ID NO: 2431451 - DNA, 18 bp, Homo sapiens
taaaatcttgtcatgtgt

SEQ ID NO: 2431452 - DNA, 19 bp, Homo sapiens
taaaatcttgtcatgtgta

SEQ ID NO: 2431453 - DNA, 22 bp, Homo sapiens
taaaatcttgtcatgtgtataa

SEQ ID NO: 2431454 - DNA, 21 bp, Homo sapiens
taaaatgacaatcatgtgtgt

SEQ ID NO: 2431455 - DNA, 16 bp, Homo sapiens
taaaatgctaggttct

SEQ ID NO: 2431456 - DNA, 15 bp, Homo sapiens
taaaatgtaaagcca

SEQ ID NO: 2431457 - DNA, 16 bp, Homo sapiens
taaaatgtatgcatgt

SEQ ID NO: 2431458 - DNA, 19 bp, Homo sapiens
taaaatgtgatgttctaag

SEQ ID NO: 2431459 - DNA, 13 bp, Homo sapiens
taaaattatttca

SEQ ID NO: 2431460 - DNA, 13 bp, Homo sapiens
taaaattgatttt

SEQ ID NO: 2431461 - DNA, 18 bp, Homo sapiens
taaacaagaaaaataaag

SEQ ID NO: 2431462 - DNA, 19 bp, Homo sapiens
taaacaagaaaaataaaga

SEQ ID NO: 2431463 - DNA, 18 bp, Homo sapiens
taaacaagtatttgttaa

SEQ ID NO: 2431464 - DNA, 13 bp, Homo sapiens
taaaccactgaaa

SEQ ID NO: 2431465 - DNA, 20 bp, Homo sapiens
taaaccactgaaaaaatata

SEQ ID NO: 2431466 - DNA, 13 bp, Homo sapiens
taaaccttttttg

SEQ ID NO: 2431467 - DNA, 16 bp, Homo sapiens
taaacgatttttaaaa

SEQ ID NO: 2431468 - DNA, 18 bp, Homo sapiens
taaacgatttttaaaatg

SEQ ID NO: 2431469 - DNA, 19 bp, Homo sapiens
taaacgatttttaaaatgt

SEQ ID NO: 2431470 - DNA, 15 bp, Homo sapiens
taaacggattccaaa

SEQ ID NO: 2431471 - DNA, 15 bp, Homo sapiens
taaactctgttgcaa

SEQ ID NO: 2431472 - DNA, 12 bp, Homo sapiens
taaactggagac

SEQ ID NO: 2431473 - DNA, 16 bp, Homo sapiens
taaactggagactgtg

SEQ ID NO: 2431474 - DNA, 13 bp, Homo sapiens
taaactgtacagt

SEQ ID NO: 2431475 - DNA, 17 bp, Homo sapiens
taaactgtacagtgtct

SEQ ID NO: 2431476 - DNA, 14 bp, Homo sapiens
taaactgtgcacca

SEQ ID NO: 2431477 - DNA, 15 bp, Homo sapiens
taaacttttaattca

SEQ ID NO: 2431478 - DNA, 18 bp, Homo sapiens
taaactttttttctgtac

SEQ ID NO: 2431479 - DNA, 9 bp, Homo sapiens
taaagaaaa

SEQ ID NO: 2431480 - DNA, 23 bp, Homo sapiens
taaagaaaaaaatgtattttatg

SEQ ID NO: 2431481 - DNA, 16 bp, Homo sapiens
taaagaaaaaaattga

SEQ ID NO: 2431482 - DNA, 22 bp, Homo sapiens
taaagaaaaaaattgaaatgta

SEQ ID NO: 2431483 - DNA, 23 bp, Homo sapiens
taaagaaaaaaattgaaatgtaa

SEQ ID NO: 2431484 - DNA, 15 bp, Homo sapiens
taaagaaaaacaaac

SEQ ID NO: 2431485 - DNA, 15 bp, Homo sapiens
taaagaaaagatgca

SEQ ID NO: 2431486 - DNA, 18 bp, Homo sapiens
taaagaaaagatgcactt

SEQ ID NO: 2431487 - DNA, 16 bp, Homo sapiens
taaagaaagtgtattt

SEQ ID NO: 2431488 - DNA, 20 bp, Homo sapiens
taaagaaagtgtatttggaa

SEQ ID NO: 2431489 - DNA, 21 bp, Homo sapiens
taaagaagacctgagaatgta

SEQ ID NO: 2431490 - DNA, 17 bp, Homo sapiens
taaagaatatgaaacat

SEQ ID NO: 2431491 - DNA, 15 bp, Homo sapiens
taaagaattattttg

SEQ ID NO: 2431492 - DNA, 20 bp, Homo sapiens
taaagaattgtggtttatat

SEQ ID NO: 2431493 - DNA, 16 bp, Homo sapiens
taaagacgttttataa

SEQ ID NO: 2431494 - DNA, 14 bp, Homo sapiens
taaagactggcttt

SEQ ID NO: 2431495 - DNA, 13 bp, Homo sapiens
taaagagtctaga

SEQ ID NO: 2431496 - DNA, 18 bp, Homo sapiens
taaagagtctagattcaa

SEQ ID NO: 2431497 - DNA, 23 bp, Homo sapiens
taaagagtctagattcaaaggtt

SEQ ID NO: 2431498 - DNA, 18 bp, Homo sapiens
taaagatggagtttctaa

SEQ ID NO: 2431499 - DNA, 21 bp, Homo sapiens
taaagatggagtttctaaggt

SEQ ID NO: 2431500 - DNA, 22 bp, Homo sapiens
taaagatggagtttctaaggtc

SEQ ID NO: 2431501 - DNA, 20 bp, Homo sapiens
taaagattctatagttctag

SEQ ID NO: 2431502 - DNA, 13 bp, Homo sapiens
taaagatttgggt

SEQ ID NO: 2431503 - DNA, 10 bp, Homo sapiens
taaagcaaat

SEQ ID NO: 2431504 - DNA, 15 bp, Homo sapiens
taaagcaatatgcat

SEQ ID NO: 2431505 - DNA, 17 bp, Homo sapiens
taaagcaggttcttgtt

SEQ ID NO: 2431506 - DNA, 13 bp, Homo sapiens
taaagcagtattt

SEQ ID NO: 2431507 - DNA, 15 bp, Homo sapiens
taaagccatgctgga

SEQ ID NO: 2431508 - DNA, 21 bp, Homo sapiens
taaagcctcaaggttttaggt

SEQ ID NO: 2431509 - DNA, 19 bp, Homo sapiens
taaagctggtttaatgttt

SEQ ID NO: 2431510 - DNA, 19 bp, Homo sapiens
taaagcttgcaacaaaatt

SEQ ID NO: 2431511 - DNA, 11 bp, Homo sapiens
taaaggaaaag

SEQ ID NO: 2431512 - DNA, 17 bp, Homo sapiens
taaaggaaaagacacat

SEQ ID NO: 2431513 - DNA, 17 bp, Homo sapiens
taaaggcagttttctaa

SEQ ID NO: 2431514 - DNA, 22 bp, Homo sapiens
taaaggggagacctcagaagta

SEQ ID NO: 2431515 - DNA, 20 bp, Homo sapiens
taaaggtccacaggtctaga

SEQ ID NO: 2431516 - DNA, 22 bp, Homo sapiens
taaaggtccacaggtctagact

SEQ ID NO: 2431517 - DNA, 21 bp, Homo sapiens
taaaggtgacatcggaaaaat

SEQ ID NO: 2431518 - DNA, 16 bp, Homo sapiens
taaagtacttgtagtt

SEQ ID NO: 2431519 - DNA, 14 bp, Homo sapiens
taaagtattcttct

SEQ ID NO: 2431520 - DNA, 18 bp, Homo sapiens
taaagtgctaaggttcta

SEQ ID NO: 2431521 - DNA, 20 bp, Homo sapiens
taaagttagtatcttttgat

SEQ ID NO: 2431522 - DNA, 15 bp, Homo sapiens
taaagttcaacatgt

SEQ ID NO: 2431523 - DNA, 12 bp, Homo sapiens
taaagttctaag

SEQ ID NO: 2431524 - DNA, 17 bp, Homo sapiens
taaagttctaagattct

SEQ ID NO: 2431525 - DNA, 23 bp, Homo sapiens
taaagttctgtactcaaatgtag

SEQ ID NO: 2431526 - DNA, 14 bp, Homo sapiens
taaagttttatata

SEQ ID NO: 2431527 - DNA, 17 bp, Homo sapiens
taaagttttatatatta

SEQ ID NO: 2431528 - DNA, 18 bp, Homo sapiens
taacttcttatggaattg

SEQ ID NO: 2431529 - DNA, 19 bp, Homo sapiens
taacttcttatggaattga

SEQ ID NO: 2431530 - DNA, 12 bp, Homo sapiens
taacttcttgct

SEQ ID NO: 2431531 - DNA, 14 bp, Homo sapiens
taactttgttttat

SEQ ID NO: 2431532 - DNA, 12 bp, Homo sapiens
taacttttgtga

SEQ ID NO: 2431533 - DNA, 16 bp, Homo sapiens
taacttttttttttct

SEQ ID NO: 2431534 - DNA, 17 bp, Homo sapiens
taagaaagcctgagtac

SEQ ID NO: 2431535 - DNA, 23 bp, Homo sapiens
taagaaaggaagcattgtaaaat

SEQ ID NO: 2431536 - DNA, 18 bp, Homo sapiens
taagaaattgaatacttt

SEQ ID NO: 2431537 - DNA, 21 bp, Homo sapiens
taagaagaatgcttaatcaga

SEQ ID NO: 2431538 - DNA, 19 bp, Homo sapiens
taagaatatctgtaatggt

SEQ ID NO: 2431539 - DNA, 14 bp, Homo sapiens
taagaatctttaga

SEQ ID NO: 2431540 - DNA, 21 bp, Homo sapiens
taagaattgagtaatggtgta

SEQ ID NO: 2431541 - DNA, 22 bp, Homo sapiens
taagaattgagtaatggtgtag

SEQ ID NO: 2431542 - DNA, 23 bp, Homo sapiens
taagacactgaaaaatctaagtg

SEQ ID NO: 2431543 - DNA, 16 bp, Homo sapiens
taagacatgatttcct

SEQ ID NO: 2431544 - DNA, 21 bp, Homo sapiens
taagacatgatttccttgaat

SEQ ID NO: 2431545 - DNA, 11 bp, Homo sapiens
taagacctggc

SEQ ID NO: 2431546 - DNA, 13 bp, Homo sapiens
taagacctggcag

SEQ ID NO: 2431547 - DNA, 19 bp, Homo sapiens
taagactcaaatgttctaa

SEQ ID NO: 2431548 - DNA, 22 bp, Homo sapiens
taagactcaaatgttctaagtt

SEQ ID NO: 2431549 - DNA, 17 bp, Homo sapiens
taagacttactctaaga

SEQ ID NO: 2431550 - DNA, 18 bp, Homo sapiens
taagacttactctaagat

SEQ ID NO: 2431551 - DNA, 14 bp, Homo sapiens
taagagaagtagaa

SEQ ID NO: 2431552 - DNA, 12 bp, Homo sapiens
taagagctcagg

SEQ ID NO: 2431553 - DNA, 14 bp, Homo sapiens
taagagctcaggat

SEQ ID NO: 2431554 - DNA, 21 bp, Homo sapiens
taagagtagaaactgcaggga

SEQ ID NO: 2431555 - DNA, 12 bp, Homo sapiens
taagataattat

SEQ ID NO: 2431556 - DNA, 13 bp, Homo sapiens
taagataattata

SEQ ID NO: 2431557 - DNA, 23 bp, Homo sapiens
taagatcctagatcctaagggtc

SEQ ID NO: 2431558 - DNA, 17 bp, Homo sapiens
taagatcttagattctc

SEQ ID NO: 2431559 - DNA, 14 bp, Homo sapiens
taagatgtgatatt

SEQ ID NO: 2431560 - DNA, 19 bp, Homo sapiens
taagatgtgatattctaag

SEQ ID NO: 2431561 - DNA, 19 bp, Homo sapiens
taagattacaaatcagaag

SEQ ID NO: 2431562 - DNA, 22 bp, Homo sapiens
taagattacaaatcagaagtca

SEQ ID NO: 2431563 - DNA, 15 bp, Homo sapiens
taagattatagattc

SEQ ID NO: 2431564 - DNA, 17 bp, Homo sapiens
taagattatagattcta

SEQ ID NO: 2431565 - DNA, 20 bp, Homo sapiens
taagattatagattctaaag

SEQ ID NO: 2431566 - DNA, 21 bp, Homo sapiens
taagattatagattctaaaga

SEQ ID NO: 2431567 - DNA, 11 bp, Homo sapiens
taagattctaa

SEQ ID NO: 2431568 - DNA, 17 bp, Homo sapiens
taagattctaaaggtcc

SEQ ID NO: 2431569 - DNA, 17 bp, Homo sapiens
taagattctaacggtct

SEQ ID NO: 2431570 - DNA, 12 bp, Homo sapiens
taagattctaat

SEQ ID NO: 2431571 - DNA, 14 bp, Homo sapiens
taagattctaatga

SEQ ID NO: 2431572 - DNA, 15 bp, Homo sapiens
taagattctaatgat

SEQ ID NO: 2431573 - DNA, 13 bp, Homo sapiens
taagattctagat

SEQ ID NO: 2431574 - DNA, 14 bp, Homo sapiens
taagattctagatc

SEQ ID NO: 2431575 - DNA, 21 bp, Homo sapiens
taagattctagatcagatgct

SEQ ID NO: 2431576 - DNA, 15 bp, Homo sapiens
taagatttccttctt

SEQ ID NO: 2431577 - DNA, 16 bp, Homo sapiens
taagatttccttcttt

SEQ ID NO: 2431578 - DNA, 12 bp, Homo sapiens
taagatttgttt

SEQ ID NO: 2431579 - DNA, 15 bp, Homo sapiens
taagatttgttttta

SEQ ID NO: 2431580 - DNA, 20 bp, Homo sapiens
taagatttgtttttaaactg

SEQ ID NO: 2431581 - DNA, 14 bp, Homo sapiens
taagcaacatggct

SEQ ID NO: 2431582 - DNA, 17 bp, Homo sapiens
taagcaacatggctttg

SEQ ID NO: 2431583 - DNA, 14 bp, Homo sapiens
taagcaagaaggca

SEQ ID NO: 2431584 - DNA, 21 bp, Homo sapiens
taagcagaaagtgcctttcag

SEQ ID NO: 2431585 - DNA, 21 bp, Homo sapiens
taagcatcattatttatgtat

SEQ ID NO: 2431586 - DNA, 14 bp, Homo sapiens
taagcatctaagtt

SEQ ID NO: 2431587 - DNA, 22 bp, Homo sapiens
taagccagcaccggaccagcct

SEQ ID NO: 2431588 - DNA, 16 bp, Homo sapiens
taagcctaaaagtggg

SEQ ID NO: 2431589 - DNA, 14 bp, Homo sapiens
taagctatttgatg

SEQ ID NO: 2431590 - DNA, 15 bp, Homo sapiens
taagctatttgatgt

SEQ ID NO: 2431591 - DNA, 19 bp, Homo sapiens
taagctatttgatgtaata

SEQ ID NO: 2431592 - DNA, 17 bp, Homo sapiens
taagctatttttctaac

SEQ ID NO: 2431593 - DNA, 19 bp, Homo sapiens
taagctcacgtcctgagaa

SEQ ID NO: 2431594 - DNA, 22 bp, Homo sapiens
taagctcacgtcctgagaaagc

SEQ ID NO: 2431595 - DNA, 12 bp, Homo sapiens
taagctctgagc

SEQ ID NO: 2431596 - DNA, 16 bp, Homo sapiens
taagctctgagctgtc

SEQ ID NO: 2431597 - DNA, 20 bp, Homo sapiens
taaggaaatcaacttgctta

SEQ ID NO: 2431598 - DNA, 15 bp, Homo sapiens
taaggacctgaaatt

SEQ ID NO: 2431599 - DNA, 19 bp, Homo sapiens
taaggagaaatctatagaa

SEQ ID NO: 2431600 - DNA, 17 bp, Homo sapiens
taaggatccggaaagaa

SEQ ID NO: 2431601 - DNA, 22 bp, Homo sapiens
taaggctctatgagtctagatg

SEQ ID NO: 2431602 - DNA, 14 bp, Homo sapiens
taaggctctgagag

SEQ ID NO: 2431603 - DNA, 16 bp, Homo sapiens
taaggctgtgtaagat

SEQ ID NO: 2431604 - DNA, 13 bp, Homo sapiens
taaggggtggggc

SEQ ID NO: 2431605 - DNA, 20 bp, Homo sapiens
taagggttagtttacaatca

SEQ ID NO: 2431606 - DNA, 18 bp, Homo sapiens
taaggtacaagaagcatt

SEQ ID NO: 2431607 - DNA, 21 bp, Homo sapiens
taaggtgctctctttctgtct

SEQ ID NO: 2431608 - DNA, 16 bp, Homo sapiens
taagtaaatacaattt

SEQ ID NO: 2431609 - DNA, 16 bp, Homo sapiens
taagtacagagaagcc

SEQ ID NO: 2431610 - DNA, 17 bp, Homo sapiens
taagtacagagaagcca

SEQ ID NO: 2431611 - DNA, 21 bp, Homo sapiens
taagtacagagaagccatcac

SEQ ID NO: 2431612 - DNA, 20 bp, Homo sapiens
taagtattttcctgttgtca

SEQ ID NO: 2431613 - DNA, 16 bp, Homo sapiens
taagtcaacagtaaac

SEQ ID NO: 2431614 - DNA, 22 bp, Homo sapiens
taagtccagtccagtcctatct

SEQ ID NO: 2431615 - DNA, 15 bp, Homo sapiens
taagtgaaaatatag

SEQ ID NO: 2431616 - DNA, 14 bp, Homo sapiens
taagtgtacatatg

SEQ ID NO: 2431617 - DNA, 18 bp, Homo sapiens
taagtgtacatatgtgct

SEQ ID NO: 2431618 - DNA, 19 bp, Homo sapiens
taagttagttccactgaga

SEQ ID NO: 2431619 - DNA, 20 bp, Homo sapiens
taagttagttccactgagac

SEQ ID NO: 2431620 - DNA, 14 bp, Homo sapiens
taagttataagact

SEQ ID NO: 2431621 - DNA, 14 bp, Homo sapiens
taagttattgcagt

SEQ ID NO: 2431622 - DNA, 15 bp, Homo sapiens
taagttattgcagtt

SEQ ID NO: 2431623 - DNA, 12 bp, Homo sapiens
taagtttctaag

SEQ ID NO: 2431624 - DNA, 14 bp, Homo sapiens
taagtttctaagat

SEQ ID NO: 2431625 - DNA, 16 bp, Homo sapiens
taagtttctaagattc

SEQ ID NO: 2431626 - DNA, 19 bp, Homo sapiens
taagtttctaagattctaa

SEQ ID NO: 2431627 - DNA, 20 bp, Homo sapiens
taagtttctaagattctaaa

SEQ ID NO: 2431628 - DNA, 21 bp, Homo sapiens
taagtttctaagattctaaag

SEQ ID NO: 2431629 - DNA, 15 bp, Homo sapiens
taataaaaataattt

SEQ ID NO: 2431630 - DNA, 19 bp, Homo sapiens
taataaactaataattgca

SEQ ID NO: 2431631 - DNA, 17 bp, Homo sapiens
taataaactttaatata

SEQ ID NO: 2431632 - DNA, 22 bp, Homo sapiens
tactttgaatgtgtttcacagt

SEQ ID NO: 2431633 - DNA, 15 bp, Homo sapiens
tactttgtgcattct

SEQ ID NO: 2431634 - DNA, 15 bp, Homo sapiens
tacttttgccctttg

SEQ ID NO: 2431635 - DNA, 13 bp, Homo sapiens
tactttttatata

SEQ ID NO: 2431636 - DNA, 16 bp, Homo sapiens
tagaaaactttaaagc

SEQ ID NO: 2431637 - DNA, 16 bp, Homo sapiens
tagaaaagtatgttct

SEQ ID NO: 2431638 - DNA, 18 bp, Homo sapiens
tagaaaagtatgttctaa

SEQ ID NO: 2431639 - DNA, 23 bp, Homo sapiens
tagaaaatttgttattttgcaac

SEQ ID NO: 2431640 - DNA, 13 bp, Homo sapiens
tagaaacaaaata

SEQ ID NO: 2431641 - DNA, 13 bp, Homo sapiens
tagaaacaacact

SEQ ID NO: 2431642 - DNA, 18 bp, Homo sapiens
tagaaacaacactgtagt

SEQ ID NO: 2431643 - DNA, 20 bp, Homo sapiens
tagaaacaacactgtagtaa

SEQ ID NO: 2431644 - DNA, 15 bp, Homo sapiens
tagaaacttccaaat

SEQ ID NO: 2431645 - DNA, 16 bp, Homo sapiens
tagaaagagaaacagt

SEQ ID NO: 2431646 - DNA, 20 bp, Homo sapiens
tagaacactaattcataatc

SEQ ID NO: 2431647 - DNA, 15 bp, Homo sapiens
tagaacctaattcaa

SEQ ID NO: 2431648 - DNA, 23 bp, Homo sapiens
tagaacctaattcaattcaaagc

SEQ ID NO: 2431649 - DNA, 22 bp, Homo sapiens
tagaacttggatgtacctgccc

SEQ ID NO: 2431650 - DNA, 17 bp, Homo sapiens
tagaagggaaagcccat

SEQ ID NO: 2431651 - DNA, 22 bp, Homo sapiens
tagaataaaggcagttttctaa

SEQ ID NO: 2431652 - DNA, 22 bp, Homo sapiens
tagaatcaaacattttgaaagt

SEQ ID NO: 2431653 - DNA, 21 bp, Homo sapiens
tagaattataactggaaagaa

SEQ ID NO: 2431654 - DNA, 15 bp, Homo sapiens
tagaattatctaatt

SEQ ID NO: 2431655 - DNA, 19 bp, Homo sapiens
tagaattatctaatttata

SEQ ID NO: 2431656 - DNA, 22 bp, Homo sapiens
tagaattatctaatttataaaa

SEQ ID NO: 2431657 - DNA, 23 bp, Homo sapiens
tagaattatctaatttataaaaa

SEQ ID NO: 2431658 - DNA, 16 bp, Homo sapiens
tagaattatttaaaca

SEQ ID NO: 2431659 - DNA, 15 bp, Homo sapiens
tagaattgcattgac

SEQ ID NO: 2431660 - DNA, 15 bp, Homo sapiens
tagaattgtatatag

SEQ ID NO: 2431661 - DNA, 13 bp, Homo sapiens
tagaatttgatta

SEQ ID NO: 2431662 - DNA, 13 bp, Homo sapiens
tagacaagccaga

SEQ ID NO: 2431663 - DNA, 19 bp, Homo sapiens
tagacaagccagaacttga

SEQ ID NO: 2431664 - DNA, 17 bp, Homo sapiens
tagaccttgttacttct

SEQ ID NO: 2431665 - DNA, 21 bp, Homo sapiens
tagactcttttccttcccttt

SEQ ID NO: 2431666 - DNA, 18 bp, Homo sapiens
tagactgtgattcagaaa

SEQ ID NO: 2431667 - DNA, 22 bp, Homo sapiens
tagacttcaagcatggctattt

SEQ ID NO: 2431668 - DNA, 14 bp, Homo sapiens
tagactttaacata

SEQ ID NO: 2431669 - DNA, 17 bp, Homo sapiens
tagagattacctcctga

SEQ ID NO: 2431670 - DNA, 18 bp, Homo sapiens
tagagattacctcctgag

SEQ ID NO: 2431671 - DNA, 21 bp, Homo sapiens
tagagattacctcctgagaaa

SEQ ID NO: 2431672 - DNA, 11 bp, Homo sapiens
tagagcactgc

SEQ ID NO: 2431673 - DNA, 17 bp, Homo sapiens
tagagcctgtaaacttt

SEQ ID NO: 2431674 - DNA, 10 bp, Homo sapiens
tagagctcct

SEQ ID NO: 2431675 - DNA, 14 bp, Homo sapiens
tagagctcctccct

SEQ ID NO: 2431676 - DNA, 20 bp, Homo sapiens
tagagctgtattaagccact

SEQ ID NO: 2431677 - DNA, 22 bp, Homo sapiens
tagagtcccaggttggctctgc

SEQ ID NO: 2431678 - DNA, 12 bp, Homo sapiens
tagagttgctga

SEQ ID NO: 2431679 - DNA, 14 bp, Homo sapiens
tagagttggccata

SEQ ID NO: 2431680 - DNA, 20 bp, Homo sapiens
tagataaaacatctttgaaa

SEQ ID NO: 2431681 - DNA, 22 bp, Homo sapiens
tagataccctacgctgtccaga

SEQ ID NO: 2431682 - DNA, 23 bp, Homo sapiens
tagataccctacgctgtccagaa

SEQ ID NO: 2431683 - DNA, 19 bp, Homo sapiens
tagatagccctgtcctggt

SEQ ID NO: 2431684 - DNA, 15 bp, Homo sapiens
tagatatgaaagctg

SEQ ID NO: 2431685 - DNA, 18 bp, Homo sapiens
tagatcagatgctccaag

SEQ ID NO: 2431686 - DNA, 15 bp, Homo sapiens
tagatcataaggctt

SEQ ID NO: 2431687 - DNA, 16 bp, Homo sapiens
tagatctggcatgtta

SEQ ID NO: 2431688 - DNA, 15 bp, Homo sapiens
tagatgaactcaact

SEQ ID NO: 2431689 - DNA, 12 bp, Homo sapiens
tagatgataaag

SEQ ID NO: 2431690 - DNA, 19 bp, Homo sapiens
tagatgattaaataagatt

SEQ ID NO: 2431691 - DNA, 20 bp, Homo sapiens
tagatgattaaataagattc

SEQ ID NO: 2431692 - DNA, 22 bp, Homo sapiens
tagatgatttcagttctaggaa

SEQ ID NO: 2431693 - DNA, 15 bp, Homo sapiens
tagatgcatttgggt

SEQ ID NO: 2431694 - DNA, 23 bp, Homo sapiens
tagatgcatttgggtccaggagg

SEQ ID NO: 2431695 - DNA, 21 bp, Homo sapiens
tagatgctggcccagggccca

SEQ ID NO: 2431696 - DNA, 22 bp, Homo sapiens
tagatgggggaaagcaaagcac

SEQ ID NO: 2431697 - DNA, 15 bp, Homo sapiens
tagatgtagtatttt

SEQ ID NO: 2431698 - DNA, 20 bp, Homo sapiens
tagatgtttattcttctaga

SEQ ID NO: 2431699 - DNA, 16 bp, Homo sapiens
tagattcaaaggttct

SEQ ID NO: 2431700 - DNA, 17 bp, Homo sapiens
tagattcaggtaataca

SEQ ID NO: 2431701 - DNA, 19 bp, Homo sapiens
tagattcaggtaatacaaa

SEQ ID NO: 2431702 - DNA, 21 bp, Homo sapiens
tagattccattggtccaagat

SEQ ID NO: 2431703 - DNA, 11 bp, Homo sapiens
tagattctaaa

SEQ ID NO: 2431704 - DNA, 17 bp, Homo sapiens
tagattctaaagattct

SEQ ID NO: 2431705 - DNA, 23 bp, Homo sapiens
tagattgattgtattgttgaaaa

SEQ ID NO: 2431706 - DNA, 20 bp, Homo sapiens
tagattgtccttttgcaaag

SEQ ID NO: 2431707 - DNA, 22 bp, Homo sapiens
tagatttcatagttcagaattt

SEQ ID NO: 2431708 - DNA, 20 bp, Homo sapiens
tagatttgtgtgcatcaggc

SEQ ID NO: 2431709 - DNA, 16 bp, Homo sapiens
tagattttaatcaaat

SEQ ID NO: 2431710 - DNA, 18 bp, Homo sapiens
tagattttaatcaaattt

SEQ ID NO: 2431711 - DNA, 16 bp, Homo sapiens
tagattttacatgaag

SEQ ID NO: 2431712 - DNA, 21 bp, Homo sapiens
tagattttacatgaagtattt

SEQ ID NO: 2431713 - DNA, 12 bp, Homo sapiens
tagattttccaa

SEQ ID NO: 2431714 - DNA, 23 bp, Homo sapiens
tagcagaaggttgcacctccccc

SEQ ID NO: 2431715 - DNA, 13 bp, Homo sapiens
tagcagcctttct

SEQ ID NO: 2431716 - DNA, 16 bp, Homo sapiens
tagcagcctttctctc

SEQ ID NO: 2431717 - DNA, 14 bp, Homo sapiens
tagcagcttccaga

SEQ ID NO: 2431718 - DNA, 15 bp, Homo sapiens
tagcagcttccagat

SEQ ID NO: 2431719 - DNA, 15 bp, Homo sapiens
tagcagtggcaggca

SEQ ID NO: 2431720 - DNA, 17 bp, Homo sapiens
tagcatgcttgttgcaa

SEQ ID NO: 2431721 - DNA, 24 bp, Homo sapiens
tagcattgtaaaattatttcatga

SEQ ID NO: 2431722 - DNA, 14 bp, Homo sapiens
tagccacaccagga

SEQ ID NO: 2431723 - DNA, 16 bp, Homo sapiens
tagccacatttggaat

SEQ ID NO: 2431724 - DNA, 21 bp, Homo sapiens
tagcccacttacatttacaaa

SEQ ID NO: 2431725 - DNA, 13 bp, Homo sapiens
tagccctgtcctg

SEQ ID NO: 2431726 - DNA, 15 bp, Homo sapiens
tagccctgtcctggt

SEQ ID NO: 2431727 - DNA, 20 bp, Homo sapiens
tagcctaaggctcctgtttt

SEQ ID NO: 2431728 - DNA, 13 bp, Homo sapiens
tagcctgtcctgt

SEQ ID NO: 2431729 - DNA, 12 bp, Homo sapiens
tagccttgcttg

SEQ ID NO: 2431730 - DNA, 14 bp, Homo sapiens
tagccttgcttgtt

SEQ ID NO: 2431731 - DNA, 15 bp, Homo sapiens
tagccttgcttgtta

SEQ ID NO: 2431732 - DNA, 22 bp, Homo sapiens
tagcctttttgtataaaataga

SEQ ID NO: 2431733 - DNA, 20 bp, Homo sapiens
tagccttttttccccagact

SEQ ID NO: 2431734 - DNA, 13 bp, Homo sapiens
tagcgttcttgta

SEQ ID NO: 2431735 - DNA, 14 bp, Homo sapiens
tagcgttcttgtaa

SEQ ID NO: 2431736 - DNA, 23 bp, Homo sapiens
tcaacccctcccctccatccctg

SEQ ID NO: 2431737 - DNA, 17 bp, Homo sapiens
tcaacctgggcaaagcc

SEQ ID NO: 2431738 - DNA, 15 bp, Homo sapiens
tcaaccttaagacct

SEQ ID NO: 2431739 - DNA, 21 bp, Homo sapiens
tcaacggaaagtgctgtctta

SEQ ID NO: 2431740 - DNA, 15 bp, Homo sapiens
tcaacgtattgtttc

SEQ ID NO: 2431741 - DNA, 20 bp, Homo sapiens
tcaactctcttattgcctca

SEQ ID NO: 2431742 - DNA, 24 bp, Homo sapiens
tcaactctcttattgcctcacttc

SEQ ID NO: 2431743 - DNA, 14 bp, Homo sapiens
tcaactctttgtta

SEQ ID NO: 2431744 - DNA, 16 bp, Homo sapiens
tcaactctttgttatt

SEQ ID NO: 2431745 - DNA, 22 bp, Homo sapiens
tcaactctttgttatttgaaaa

SEQ ID NO: 2431746 - DNA, 16 bp, Homo sapiens
tcaacttgagcatgtt

SEQ ID NO: 2431747 - DNA, 20 bp, Homo sapiens
tcaacttgagcatgttactg

SEQ ID NO: 2431748 - DNA, 15 bp, Homo sapiens
tcaagaaaacaggca

SEQ ID NO: 2431749 - DNA, 22 bp, Homo sapiens
tcaagaaaacaggcactgccct

SEQ ID NO: 2431750 - DNA, 21 bp, Homo sapiens
tcaagaaataaaaggaagcca

SEQ ID NO: 2431751 - DNA, 22 bp, Homo sapiens
tcaagaaataaaaggaagccaa

SEQ ID NO: 2431752 - DNA, 14 bp, Homo sapiens
tcaagaaataagtt

SEQ ID NO: 2431753 - DNA, 22 bp, Homo sapiens
tcaagaagtgaagaatgcacaa

SEQ ID NO: 2431754 - DNA, 16 bp, Homo sapiens
tcaagattgttcctgc

SEQ ID NO: 2431755 - DNA, 19 bp, Homo sapiens
tcaagattgttcctgcttt

SEQ ID NO: 2431756 - DNA, 18 bp, Homo sapiens
tcaagctctgagggaaag

SEQ ID NO: 2431757 - DNA, 19 bp, Homo sapiens
tcaaggaatttcttaactt

SEQ ID NO: 2431758 - DNA, 23 bp, Homo sapiens
tcaaggaatttcttaacttcttg

SEQ ID NO: 2431759 - DNA, 15 bp, Homo sapiens
tcaaggtcgtttttt

SEQ ID NO: 2431760 - DNA, 21 bp, Homo sapiens
tcaaggtcgtttttttcattc

SEQ ID NO: 2431761 - DNA, 13 bp, Homo sapiens
tcaaggttttagg

SEQ ID NO: 2431762 - DNA, 12 bp, Homo sapiens
tcaagtatttgg

SEQ ID NO: 2431763 - DNA, 19 bp, Homo sapiens
tcaagtctgtttactgcaa

SEQ ID NO: 2431764 - DNA, 15 bp, Homo sapiens
tcaagtctttctctt

SEQ ID NO: 2431765 - DNA, 15 bp, Homo sapiens
tcaagttctaagatt

SEQ ID NO: 2431766 - DNA, 15 bp, Homo sapiens
tcaagttgaggggct

SEQ ID NO: 2431767 - DNA, 18 bp, Homo sapiens
tcaataatatattttctg

SEQ ID NO: 2431768 - DNA, 14 bp, Homo sapiens
tcaatacagatata

SEQ ID NO: 2431769 - DNA, 16 bp, Homo sapiens
tcaatacagatatatt

SEQ ID NO: 2431770 - DNA, 17 bp, Homo sapiens
tcaatattttcttttcc

SEQ ID NO: 2431771 - DNA, 14 bp, Homo sapiens
tcaatcaactttac

SEQ ID NO: 2431772 - DNA, 22 bp, Homo sapiens
tcaatcagtctcagaatgtcat

SEQ ID NO: 2431773 - DNA, 13 bp, Homo sapiens
tcaatcatttcta

SEQ ID NO: 2431774 - DNA, 15 bp, Homo sapiens
tcaatcttgcatgta

SEQ ID NO: 2431775 - DNA, 16 bp, Homo sapiens
tcaatcttgcatgtaa

SEQ ID NO: 2431776 - DNA, 20 bp, Homo sapiens
tcaatcttgcatgtaacgca

SEQ ID NO: 2431777 - DNA, 21 bp, Homo sapiens
tcaatgacatgaattttagct

SEQ ID NO: 2431778 - DNA, 17 bp, Homo sapiens
tcaatgagcatgtttag

SEQ ID NO: 2431779 - DNA, 17 bp, Homo sapiens
tcaatgcagttgtctct

SEQ ID NO: 2431780 - DNA, 18 bp, Homo sapiens
tcaatgcagttgtctctg

SEQ ID NO: 2431781 - DNA, 15 bp, Homo sapiens
tcaattatagtttct

SEQ ID NO: 2431782 - DNA, 16 bp, Homo sapiens
tcaattatagtttctg

SEQ ID NO: 2431783 - DNA, 17 bp, Homo sapiens
tcaattatagtttctga

SEQ ID NO: 2431784 - DNA, 19 bp, Homo sapiens
tcaattatagtttctgagg

SEQ ID NO: 2431785 - DNA, 17 bp, Homo sapiens
tcaattcaaagctgtgt

SEQ ID NO: 2431786 - DNA, 14 bp, Homo sapiens
tcaattccacctgc

SEQ ID NO: 2431787 - DNA, 16 bp, Homo sapiens
tcaatttatttgaatg

SEQ ID NO: 2431788 - DNA, 22 bp, Homo sapiens
tcaattttatccctcacctgta

SEQ ID NO: 2431789 - DNA, 21 bp, Homo sapiens
tcacaaacttttatactcttt

SEQ ID NO: 2431790 - DNA, 12 bp, Homo sapiens
tcacaaggcagc

SEQ ID NO: 2431791 - DNA, 22 bp, Homo sapiens
tcacaagtgggtacccccagga

SEQ ID NO: 2431792 - DNA, 19 bp, Homo sapiens
tcacacaggcatttcctgg

SEQ ID NO: 2431793 - DNA, 23 bp, Homo sapiens
tcacacaggcatttcctgggtgg

SEQ ID NO: 2431794 - DNA, 21 bp, Homo sapiens
tcacactcagttgtgactaac

SEQ ID NO: 2431795 - DNA, 21 bp, Homo sapiens
tcacactgggtggtggcctgg

SEQ ID NO: 2431796 - DNA, 21 bp, Homo sapiens
tcacagcatggaggaggaggg

SEQ ID NO: 2431797 - DNA, 13 bp, Homo sapiens
tcacagcggaggt

SEQ ID NO: 2431798 - DNA, 22 bp, Homo sapiens
tcacaggcagccagtgccctga

SEQ ID NO: 2431799 - DNA, 19 bp, Homo sapiens
tcacaggccccaggaaagg

SEQ ID NO: 2431800 - DNA, 20 bp, Homo sapiens
tcacagggcagtacctgagg

SEQ ID NO: 2431801 - DNA, 17 bp, Homo sapiens
tcacagtgctcttttct

SEQ ID NO: 2431802 - DNA, 20 bp, Homo sapiens
tcacagtgctcttttctcct

SEQ ID NO: 2431803 - DNA, 18 bp, Homo sapiens
tcacatgaattattacag

SEQ ID NO: 2431804 - DNA, 15 bp, Homo sapiens
tcaccaatgtaccca

SEQ ID NO: 2431805 - DNA, 12 bp, Homo sapiens
tcaccacaaact

SEQ ID NO: 2431806 - DNA, 22 bp, Homo sapiens
tcaccacaaactgtaatacaat

SEQ ID NO: 2431807 - DNA, 21 bp, Homo sapiens
tcaccatgttagccaggctgg

SEQ ID NO: 2431808 - DNA, 20 bp, Homo sapiens
tcaccattataatgaattta

SEQ ID NO: 2431809 - DNA, 23 bp, Homo sapiens
tcaccattataatgaatttagtg

SEQ ID NO: 2431810 - DNA, 17 bp, Homo sapiens
tcaccatttgattatgt

SEQ ID NO: 2431811 - DNA, 16 bp, Homo sapiens
tcaccatttggatcct

SEQ ID NO: 2431812 - DNA, 23 bp, Homo sapiens
tcaccatttggcaatgccatcat

SEQ ID NO: 2431813 - DNA, 15 bp, Homo sapiens
tcacccagacataaa

SEQ ID NO: 2431814 - DNA, 20 bp, Homo sapiens
tcacccagacataaaggaaa

SEQ ID NO: 2431815 - DNA, 19 bp, Homo sapiens
tcaccccatcccacaccct

SEQ ID NO: 2431816 - DNA, 13 bp, Homo sapiens
tcaccctttgctg

SEQ ID NO: 2431817 - DNA, 15 bp, Homo sapiens
tcaccctttgctgtg

SEQ ID NO: 2431818 - DNA, 22 bp, Homo sapiens
tcaccggctctcacctggccct

SEQ ID NO: 2431819 - DNA, 15 bp, Homo sapiens
tcaccgtgggctccc

SEQ ID NO: 2431820 - DNA, 16 bp, Homo sapiens
tcaccgtgggctccct

SEQ ID NO: 2431821 - DNA, 17 bp, Homo sapiens
tcaccgtgggctccctg

SEQ ID NO: 2431822 - DNA, 19 bp, Homo sapiens
tcaccgtgggctccctgac

SEQ ID NO: 2431823 - DNA, 19 bp, Homo sapiens
tcacctactcacacaggca

SEQ ID NO: 2431824 - DNA, 16 bp, Homo sapiens
tcacctagctgaatgt

SEQ ID NO: 2431825 - DNA, 20 bp, Homo sapiens
tcacctagctgaatgttttt

SEQ ID NO: 2431826 - DNA, 19 bp, Homo sapiens
tcacctaggaagcctcaga

SEQ ID NO: 2431827 - DNA, 20 bp, Homo sapiens
tcacctaggaagcctcagat

SEQ ID NO: 2431828 - DNA, 12 bp, Homo sapiens
tcacctcctcta

SEQ ID NO: 2431829 - DNA, 23 bp, Homo sapiens
tcacctctaggtccccatactcc

SEQ ID NO: 2431830 - DNA, 13 bp, Homo sapiens
tcacctgcactaa

SEQ ID NO: 2431831 - DNA, 16 bp, Homo sapiens
tcacctggccctgctt

SEQ ID NO: 2431832 - DNA, 21 bp, Homo sapiens
tcacctgtgcttcgggccctt

SEQ ID NO: 2431833 - DNA, 16 bp, Homo sapiens
tcacgctttttgaaaa

SEQ ID NO: 2431834 - DNA, 15 bp, Homo sapiens
tcacggccaggcaga

SEQ ID NO: 2431835 - DNA, 18 bp, Homo sapiens
tcacggctgcgcactgtg

SEQ ID NO: 2431836 - DNA, 17 bp, Homo sapiens
tcacgggactatttcca

SEQ ID NO: 2431837 - DNA, 15 bp, Homo sapiens
tcactaattcattaa

SEQ ID NO: 2431838 - DNA, 18 bp, Homo sapiens
tcactaattcattaatct

SEQ ID NO: 2431839 - DNA, 13 bp, Homo sapiens
tccactttcagct

SEQ ID NO: 2431840 - DNA, 15 bp, Homo sapiens
tccactttcagctgt

SEQ ID NO: 2431841 - DNA, 18 bp, Homo sapiens
tccactttgtttcgtggg

SEQ ID NO: 2431842 - DNA, 23 bp, Homo sapiens
tccagaaagccccacccaggcca

SEQ ID NO: 2431843 - DNA, 19 bp, Homo sapiens
tccagaagtgtgactggct

SEQ ID NO: 2431844 - DNA, 13 bp, Homo sapiens
tccagaatgctgt

SEQ ID NO: 2431845 - DNA, 15 bp, Homo sapiens
tccagaatgctgtac

SEQ ID NO: 2431846 - DNA, 16 bp, Homo sapiens
tccagaatgctgtaca

SEQ ID NO: 2431847 - DNA, 17 bp, Homo sapiens
tccagaatgctgtacat

SEQ ID NO: 2431848 - DNA, 18 bp, Homo sapiens
tccagacctgatcctgga

SEQ ID NO: 2431849 - DNA, 15 bp, Homo sapiens
tccagatagtgtagc

SEQ ID NO: 2431850 - DNA, 17 bp, Homo sapiens
tccagattgacgacaag

SEQ ID NO: 2431851 - DNA, 15 bp, Homo sapiens
tccagcattcccagg

SEQ ID NO: 2431852 - DNA, 17 bp, Homo sapiens
tccagcattcccaggta

SEQ ID NO: 2431853 - DNA, 15 bp, Homo sapiens
tccagcccctctggt

SEQ ID NO: 2431854 - DNA, 18 bp, Homo sapiens
tccagcccctcttggaga

SEQ ID NO: 2431855 - DNA, 20 bp, Homo sapiens
tccagcccctcttggagaag

SEQ ID NO: 2431856 - DNA, 21 bp, Homo sapiens
tccagcccctcttggagaagt

SEQ ID NO: 2431857 - DNA, 13 bp, Homo sapiens
tccagcctgacat

SEQ ID NO: 2431858 - DNA, 21 bp, Homo sapiens
tccagcctgacatcaaaaaag

SEQ ID NO: 2431859 - DNA, 11 bp, Homo sapiens
tccagcctggg

SEQ ID NO: 2431860 - DNA, 15 bp, Homo sapiens
tccagctagtgaccc

SEQ ID NO: 2431861 - DNA, 19 bp, Homo sapiens
tccagctccaacctgcaaa

SEQ ID NO: 2431862 - DNA, 20 bp, Homo sapiens
tccagctccctgtgccccca

SEQ ID NO: 2431863 - DNA, 15 bp, Homo sapiens
tccagctcctttggg

SEQ ID NO: 2431864 - DNA, 20 bp, Homo sapiens
tccagctctggaggggaggg

SEQ ID NO: 2431865 - DNA, 13 bp, Homo sapiens
tccagctgccccg

SEQ ID NO: 2431866 - DNA, 22 bp, Homo sapiens
tccaggaaagtggccaagaagc

SEQ ID NO: 2431867 - DNA, 20 bp, Homo sapiens
tccaggactatatttgggcc

SEQ ID NO: 2431868 - DNA, 16 bp, Homo sapiens
tccaggagaaggccaa

SEQ ID NO: 2431869 - DNA, 13 bp, Homo sapiens
tccaggagctcca

SEQ ID NO: 2431870 - DNA, 18 bp, Homo sapiens
tccaggcagatccaggac

SEQ ID NO: 2431871 - DNA, 17 bp, Homo sapiens
tccaggcttctgctggg

SEQ ID NO: 2431872 - DNA, 21 bp, Homo sapiens
tccagggacagaggccccagc

SEQ ID NO: 2431873 - DNA, 23 bp, Homo sapiens
tccagggacagaggccccagcct

SEQ ID NO: 2431874 - DNA, 18 bp, Homo sapiens
tccagggaggctggtcct

SEQ ID NO: 2431875 - DNA, 21 bp, Homo sapiens
tccaggggctgcttcctcctg

SEQ ID NO: 2431876 - DNA, 22 bp, Homo sapiens
tccaggggctgcttcctcctgg

SEQ ID NO: 2431877 - DNA, 17 bp, Homo sapiens
tccagggtccctctgtg

SEQ ID NO: 2431878 - DNA, 17 bp, Homo sapiens
tccagggtgtgtgctcg

SEQ ID NO: 2431879 - DNA, 18 bp, Homo sapiens
tccaggtgttactgtaat

SEQ ID NO: 2431880 - DNA, 18 bp, Homo sapiens
tccaggttccctcccaga

SEQ ID NO: 2431881 - DNA, 21 bp, Homo sapiens
tccagtataagactactgaat

SEQ ID NO: 2431882 - DNA, 13 bp, Homo sapiens
tccagtctattca

SEQ ID NO: 2431883 - DNA, 23 bp, Homo sapiens
tccagtggacttcgcagtccact

SEQ ID NO: 2431884 - DNA, 23 bp, Homo sapiens
tccagttggagttttttgtacca

SEQ ID NO: 2431885 - DNA, 19 bp, Homo sapiens
tccatcacgttagctgtcc

SEQ ID NO: 2431886 - DNA, 22 bp, Homo sapiens
tccatccctggccccctccctg

SEQ ID NO: 2431887 - DNA, 24 bp, Homo sapiens
tccatccctggccccctccctgga

SEQ ID NO: 2431888 - DNA, 21 bp, Homo sapiens
tccatcttgagatggtgaggc

SEQ ID NO: 2431889 - DNA, 15 bp, Homo sapiens
tccatgacatcaaga

SEQ ID NO: 2431890 - DNA, 15 bp, Homo sapiens
tccatgcgctcaggg

SEQ ID NO: 2431891 - DNA, 18 bp, Homo sapiens
tccatggcaggaaggctt

SEQ ID NO: 2431892 - DNA, 20 bp, Homo sapiens
tccatggccctgcaaaagga

SEQ ID NO: 2431893 - DNA, 16 bp, Homo sapiens
tccatgggcagagccc

SEQ ID NO: 2431894 - DNA, 14 bp, Homo sapiens
tccatgtaactgcc

SEQ ID NO: 2431895 - DNA, 24 bp, Homo sapiens
tccatgtaactgcctagaaacaac

SEQ ID NO: 2431896 - DNA, 22 bp, Homo sapiens
tccattcacagttctttgggcc

SEQ ID NO: 2431897 - DNA, 18 bp, Homo sapiens
tccattctcacaggtccc

SEQ ID NO: 2431898 - DNA, 18 bp, Homo sapiens
tccatttcccctccttcc

SEQ ID NO: 2431899 - DNA, 14 bp, Homo sapiens
tccatttctaatta

SEQ ID NO: 2431900 - DNA, 15 bp, Homo sapiens
tccatttgcaaggga

SEQ ID NO: 2431901 - DNA, 19 bp, Homo sapiens
tcccaaagtgctgagatta

SEQ ID NO: 2431902 - DNA, 22 bp, Homo sapiens
tcccaagagcatcatgcctctg

SEQ ID NO: 2431903 - DNA, 20 bp, Homo sapiens
tcccaagtagctgggattac

SEQ ID NO: 2431904 - DNA, 17 bp, Homo sapiens
tcccaagtgagtctctc

SEQ ID NO: 2431905 - DNA, 18 bp, Homo sapiens
tcccaatttcagactccc

SEQ ID NO: 2431906 - DNA, 23 bp, Homo sapiens
tcccaatttcagactcccattcc

SEQ ID NO: 2431907 - DNA, 13 bp, Homo sapiens
tcccacaccctgg

SEQ ID NO: 2431908 - DNA, 18 bp, Homo sapiens
tcccacaggttcaggcga

SEQ ID NO: 2431909 - DNA, 13 bp, Homo sapiens
tcccacatccctg

SEQ ID NO: 2431910 - DNA, 14 bp, Homo sapiens
tcccacatccctgg

SEQ ID NO: 2431911 - DNA, 16 bp, Homo sapiens
tcccacatccctgggc

SEQ ID NO: 2431912 - DNA, 19 bp, Homo sapiens
tcccacatgggcccaggcc

SEQ ID NO: 2431913 - DNA, 21 bp, Homo sapiens
tcccaccccaacctgctctcc

SEQ ID NO: 2431914 - DNA, 23 bp, Homo sapiens
tcccacccccacccccagctcaa

SEQ ID NO: 2431915 - DNA, 16 bp, Homo sapiens
tcccacctagcagcac

SEQ ID NO: 2431916 - DNA, 17 bp, Homo sapiens
tcccacctccatcccag

SEQ ID NO: 2431917 - DNA, 15 bp, Homo sapiens
tcccacctccccttg

SEQ ID NO: 2431918 - DNA, 21 bp, Homo sapiens
tcccacctcctgacacccttc

SEQ ID NO: 2431919 - DNA, 13 bp, Homo sapiens
tcccactccaagc

SEQ ID NO: 2431920 - DNA, 22 bp, Homo sapiens
tcccactccaagcccagcccat

SEQ ID NO: 2431921 - DNA, 13 bp, Homo sapiens
tcccagaagatga

SEQ ID NO: 2431922 - DNA, 20 bp, Homo sapiens
tcccagaagatgactgaggg

SEQ ID NO: 2431923 - DNA, 14 bp, Homo sapiens
tcccagagagcccg

SEQ ID NO: 2431924 - DNA, 13 bp, Homo sapiens
tcccagagcacct

SEQ ID NO: 2431925 - DNA, 19 bp, Homo sapiens
tcccagaggggcctgccac

SEQ ID NO: 2431926 - DNA, 22 bp, Homo sapiens
tcccagaggggcctgccacctg

SEQ ID NO: 2431927 - DNA, 16 bp, Homo sapiens
tcccagataatgtgaa

SEQ ID NO: 2431928 - DNA, 17 bp, Homo sapiens
tcccagccccctgacca

SEQ ID NO: 2431929 - DNA, 23 bp, Homo sapiens
tcccagctaggaagagcaggact

SEQ ID NO: 2431930 - DNA, 14 bp, Homo sapiens
tcccagctgcctag

SEQ ID NO: 2431931 - DNA, 18 bp, Homo sapiens
tcccaggaccacaggctc

SEQ ID NO: 2431932 - DNA, 23 bp, Homo sapiens
tcccaggaccacaggctcaggca

SEQ ID NO: 2431933 - DNA, 24 bp, Homo sapiens
tcccaggaccacaggctcaggcag

SEQ ID NO: 2431934 - DNA, 15 bp, Homo sapiens
tcccaggcaaggctg

SEQ ID NO: 2431935 - DNA, 16 bp, Homo sapiens
tcccaggcaaggctgt

SEQ ID NO: 2431936 - DNA, 17 bp, Homo sapiens
tcccaggcaaggctgtg

SEQ ID NO: 2431937 - DNA, 19 bp, Homo sapiens
tcccaggcaaggctgtgga

SEQ ID NO: 2431938 - DNA, 18 bp, Homo sapiens
tcccagggttttaacttt

SEQ ID NO: 2431939 - DNA, 17 bp, Homo sapiens
tcccaggttggctctgc

SEQ ID NO: 2431940 - DNA, 19 bp, Homo sapiens
tcccaggttggctctgcca

SEQ ID NO: 2431941 - DNA, 23 bp, Homo sapiens
tcccaggttggctctgccagtcc

SEQ ID NO: 2431942 - DNA, 18 bp, Homo sapiens
tcctggacagctgtgcct

SEQ ID NO: 2431943 - DNA, 21 bp, Homo sapiens
tcctggacatgaagattcttt

SEQ ID NO: 2431944 - DNA, 16 bp, Homo sapiens
tcctggagcagaagca

SEQ ID NO: 2431945 - DNA, 18 bp, Homo sapiens
tcctggagcagaagcagc

SEQ ID NO: 2431946 - DNA, 19 bp, Homo sapiens
tcctggagcagaagcagca

SEQ ID NO: 2431947 - DNA, 18 bp, Homo sapiens
tcctggagcagaccaccc

SEQ ID NO: 2431948 - DNA, 13 bp, Homo sapiens
tcctggcccagcc

SEQ ID NO: 2431949 - DNA, 15 bp, Homo sapiens
tcctggcccagcctt

SEQ ID NO: 2431950 - DNA, 12 bp, Homo sapiens
tcctggcgcctg

SEQ ID NO: 2431951 - DNA, 23 bp, Homo sapiens
tcctggctcttgatacccccctc

SEQ ID NO: 2431952 - DNA, 16 bp, Homo sapiens
tcctgggcctgcagaa

SEQ ID NO: 2431953 - DNA, 12 bp, Homo sapiens
tcctgggctcag

SEQ ID NO: 2431954 - DNA, 13 bp, Homo sapiens
tcctgggctcagg

SEQ ID NO: 2431955 - DNA, 15 bp, Homo sapiens
tcctgggtcctcctt

SEQ ID NO: 2431956 - DNA, 23 bp, Homo sapiens
tcctgggtggctactctgtgcca

SEQ ID NO: 2431957 - DNA, 24 bp, Homo sapiens
tcctgggtggctactctgtgccag

SEQ ID NO: 2431958 - DNA, 17 bp, Homo sapiens
tcctgggttttgtattc

SEQ ID NO: 2431959 - DNA, 17 bp, Homo sapiens
tcctggtggggcagctc

SEQ ID NO: 2431960 - DNA, 19 bp, Homo sapiens
tcctggtggggcagctcct

SEQ ID NO: 2431961 - DNA, 21 bp, Homo sapiens
tcctggttcccgtttctccac

SEQ ID NO: 2431962 - DNA, 20 bp, Homo sapiens
tcctgtacattgtgggatgt

SEQ ID NO: 2431963 - DNA, 13 bp, Homo sapiens
tcctgtccagctc

SEQ ID NO: 2431964 - DNA, 15 bp, Homo sapiens
tcctgtccagctcca

SEQ ID NO: 2431965 - DNA, 17 bp, Homo sapiens
tcctgtcctctttcagc

SEQ ID NO: 2431966 - DNA, 20 bp, Homo sapiens
tcctgtcctctttcagctcc

SEQ ID NO: 2431967 - DNA, 21 bp, Homo sapiens
tcctgtcctctttcagctcct

SEQ ID NO: 2431968 - DNA, 16 bp, Homo sapiens
tcctgtgctcagccct

SEQ ID NO: 2431969 - DNA, 22 bp, Homo sapiens
tcctgtggccccaccctgggcc

SEQ ID NO: 2431970 - DNA, 23 bp, Homo sapiens
tcctgtggccccaccctgggccc

SEQ ID NO: 2431971 - DNA, 13 bp, Homo sapiens
tcctgtgggagcc

SEQ ID NO: 2431972 - DNA, 15 bp, Homo sapiens
tcctgtgggagcctc

SEQ ID NO: 2431973 - DNA, 20 bp, Homo sapiens
tcctgtgtgttaagctctgc

SEQ ID NO: 2431974 - DNA, 14 bp, Homo sapiens
tcctgttgggagag

SEQ ID NO: 2431975 - DNA, 17 bp, Homo sapiens
tcctgttttgcacagcc

SEQ ID NO: 2431976 - DNA, 16 bp, Homo sapiens
tccttactcccaggca

SEQ ID NO: 2431977 - DNA, 16 bp, Homo sapiens
tccttactcctgtggg

SEQ ID NO: 2431978 - DNA, 18 bp, Homo sapiens
tccttagatctggcatgt

SEQ ID NO: 2431979 - DNA, 20 bp, Homo sapiens
tccttcaacaattctaaaat

SEQ ID NO: 2431980 - DNA, 24 bp, Homo sapiens
tccttccagtgtcatttctcatcc

SEQ ID NO: 2431981 - DNA, 23 bp, Homo sapiens
tccttcccagaggggcctgccac

SEQ ID NO: 2431982 - DNA, 14 bp, Homo sapiens
tccttcccatggag

SEQ ID NO: 2431983 - DNA, 17 bp, Homo sapiens
tccttcccttttctgtt

SEQ ID NO: 2431984 - DNA, 12 bp, Homo sapiens
tccttcctgccc

SEQ ID NO: 2431985 - DNA, 23 bp, Homo sapiens
tccttggcctgctaaggtcttgg

SEQ ID NO: 2431986 - DNA, 20 bp, Homo sapiens
tccttgtgatgtgcacgtaa

SEQ ID NO: 2431987 - DNA, 16 bp, Homo sapiens
tccttgtgccagagaa

SEQ ID NO: 2431988 - DNA, 11 bp, Homo sapiens
tcctttaacaa

SEQ ID NO: 2431989 - DNA, 15 bp, Homo sapiens
tcctttaattgtaaa

SEQ ID NO: 2431990 - DNA, 20 bp, Homo sapiens
tccttttcataggtctgaaa

SEQ ID NO: 2431991 - DNA, 21 bp, Homo sapiens
tccttttcataggtctgaaat

SEQ ID NO: 2431992 - DNA, 13 bp, Homo sapiens
tccttttgacact

SEQ ID NO: 2431993 - DNA, 16 bp, Homo sapiens
tccttttgacactgct

SEQ ID NO: 2431994 - DNA, 18 bp, Homo sapiens
tccttttgacactgctct

SEQ ID NO: 2431995 - DNA, 22 bp, Homo sapiens
tccttttgacactgctctaaca

SEQ ID NO: 2431996 - DNA, 14 bp, Homo sapiens
tcctttttttgtac

SEQ ID NO: 2431997 - DNA, 14 bp, Homo sapiens
tcgaaaatcaaatg

SEQ ID NO: 2431998 - DNA, 13 bp, Homo sapiens
tcgaaacacagaa

SEQ ID NO: 2431999 - DNA, 17 bp, Homo sapiens
tcgaatctctgtgcctt

SEQ ID NO: 2432000 - DNA, 22 bp, Homo sapiens
tcgacactgttcttagctcaat

SEQ ID NO: 2432001 - DNA, 23 bp, Homo sapiens
tcgagaggggccgatgcccagag

SEQ ID NO: 2432002 - DNA, 20 bp, Homo sapiens
tcgagattatcgttttctta

SEQ ID NO: 2432003 - DNA, 15 bp, Homo sapiens
tcgagcgccctgcag

SEQ ID NO: 2432004 - DNA, 17 bp, Homo sapiens
tcgagcgccctgcagac

SEQ ID NO: 2432005 - DNA, 19 bp, Homo sapiens
tcgagcgccctgcagaccc

SEQ ID NO: 2432006 - DNA, 20 bp, Homo sapiens
tcgaggggtgggctggtatc

SEQ ID NO: 2432007 - DNA, 13 bp, Homo sapiens
tcgcagccaccct

SEQ ID NO: 2432008 - DNA, 19 bp, Homo sapiens
tcgcagccaccctgaggag

SEQ ID NO: 2432009 - DNA, 23 bp, Homo sapiens
tcgcagccaccctgaggagtctg

SEQ ID NO: 2432010 - DNA, 20 bp, Homo sapiens
tcgcatggtcacacactgat

SEQ ID NO: 2432011 - DNA, 16 bp, Homo sapiens
tcgcccatccccttga

SEQ ID NO: 2432012 - DNA, 19 bp, Homo sapiens
tcgcccatgctggagtgca

SEQ ID NO: 2432013 - DNA, 20 bp, Homo sapiens
tcgccccagcaggtgctgac

SEQ ID NO: 2432014 - DNA, 12 bp, Homo sapiens
tcgcctgtaatc

SEQ ID NO: 2432015 - DNA, 16 bp, Homo sapiens
tcgcctgtaatctcac

SEQ ID NO: 2432016 - DNA, 23 bp, Homo sapiens
tcgctagcatttcccaacacaaa

SEQ ID NO: 2432017 - DNA, 19 bp, Homo sapiens
tcgctgccagctctgtatc

SEQ ID NO: 2432018 - DNA, 20 bp, Homo sapiens
tcgctgccagctctgtatca

SEQ ID NO: 2432019 - DNA, 16 bp, Homo sapiens
tcgcttcttgcctctg

SEQ ID NO: 2432020 - DNA, 17 bp, Homo sapiens
tcgcttcttgcctctgt

SEQ ID NO: 2432021 - DNA, 19 bp, Homo sapiens
tcgcttcttgcctctgtgc

SEQ ID NO: 2432022 - DNA, 12 bp, Homo sapiens
tcggaggaagcc

SEQ ID NO: 2432023 - DNA, 18 bp, Homo sapiens
tcggatccagggaggctg

SEQ ID NO: 2432024 - DNA, 16 bp, Homo sapiens
tcggattttttccaaa

SEQ ID NO: 2432025 - DNA, 16 bp, Homo sapiens
tcggcctgcccccacc

SEQ ID NO: 2432026 - DNA, 19 bp, Homo sapiens
tcggctccccatgtgtcct

SEQ ID NO: 2432027 - DNA, 16 bp, Homo sapiens
tcggctgaccatgctc

SEQ ID NO: 2432028 - DNA, 21 bp, Homo sapiens
tcgggaaaaggtagaggagtc

SEQ ID NO: 2432029 - DNA, 21 bp, Homo sapiens
tcgggagacagcatcagggtt

SEQ ID NO: 2432030 - DNA, 15 bp, Homo sapiens
tcggggtgcacagga

SEQ ID NO: 2432031 - DNA, 17 bp, Homo sapiens
tcggggtgcacaggagg

SEQ ID NO: 2432032 - DNA, 22 bp, Homo sapiens
tcggggtgcacaggagggggtc

SEQ ID NO: 2432033 - DNA, 16 bp, Homo sapiens
tcggtaggttcagcca

SEQ ID NO: 2432034 - DNA, 20 bp, Homo sapiens
tcggtatccccccatcttgc

SEQ ID NO: 2432035 - DNA, 13 bp, Homo sapiens
tcgtaaagatttg

SEQ ID NO: 2432036 - DNA, 18 bp, Homo sapiens
tcgtatgatacttcgaca

SEQ ID NO: 2432037 - DNA, 14 bp, Homo sapiens
tcgtccccaagtga

SEQ ID NO: 2432038 - DNA, 15 bp, Homo sapiens
tcgtccttactcctg

SEQ ID NO: 2432039 - DNA, 22 bp, Homo sapiens
tcgtggacacacacagactatt

SEQ ID NO: 2432040 - DNA, 16 bp, Homo sapiens
tcgtggagagctagga

SEQ ID NO: 2432041 - DNA, 24 bp, Homo sapiens
tcgtggagagctaggagcaaagcc

SEQ ID NO: 2432042 - DNA, 15 bp, Homo sapiens
tcgtggggtgtgctg

SEQ ID NO: 2432043 - DNA, 13 bp, Homo sapiens
tcgtttgtttgtt

SEQ ID NO: 2432044 - DNA, 15 bp, Homo sapiens
tctaaaatcttatag

SEQ ID NO: 2432045 - DNA, 22 bp, Homo sapiens
tctaaaatcttatagttctagg

SEQ ID NO: 2432046 - DNA, 16 bp, Homo sapiens
tgaaattccaaagtct

SEQ ID NO: 2432047 - DNA, 17 bp, Homo sapiens
tgaaattccaaagtctc

SEQ ID NO: 2432048 - DNA, 13 bp, Homo sapiens
tgaaattgaacct

SEQ ID NO: 2432049 - DNA, 19 bp, Homo sapiens
tgaaattgaacctttgtgc

SEQ ID NO: 2432050 - DNA, 15 bp, Homo sapiens
tgaaatttttcttct

SEQ ID NO: 2432051 - DNA, 16 bp, Homo sapiens
tgaacaagagaagcat

SEQ ID NO: 2432052 - DNA, 18 bp, Homo sapiens
tgaacacaaactgtaaat

SEQ ID NO: 2432053 - DNA, 19 bp, Homo sapiens
tgaacacaaactgtaaata

SEQ ID NO: 2432054 - DNA, 17 bp, Homo sapiens
tgaacaccattgaaggc

SEQ ID NO: 2432055 - DNA, 15 bp, Homo sapiens
tgaacagctggtgta

SEQ ID NO: 2432056 - DNA, 23 bp, Homo sapiens
tgaacagctggtgtagctacaga

SEQ ID NO: 2432057 - DNA, 17 bp, Homo sapiens
tgaaccattaaccagat

SEQ ID NO: 2432058 - DNA, 13 bp, Homo sapiens
tgaacccaggaca

SEQ ID NO: 2432059 - DNA, 17 bp, Homo sapiens
tgaacgttttctaattg

SEQ ID NO: 2432060 - DNA, 14 bp, Homo sapiens
tgaactcctgccat

SEQ ID NO: 2432061 - DNA, 21 bp, Homo sapiens
tgaactcttaatcaaatagca

SEQ ID NO: 2432062 - DNA, 22 bp, Homo sapiens
tgaactgaacaccattgaaggc

SEQ ID NO: 2432063 - DNA, 17 bp, Homo sapiens
tgaacttgcattgtgat

SEQ ID NO: 2432064 - DNA, 13 bp, Homo sapiens
tgaagaacatgtg

SEQ ID NO: 2432065 - DNA, 14 bp, Homo sapiens
tgaagaactgcagg

SEQ ID NO: 2432066 - DNA, 15 bp, Homo sapiens
tgaagaactgcaggc

SEQ ID NO: 2432067 - DNA, 20 bp, Homo sapiens
tgaagaactgcaggccctgg

SEQ ID NO: 2432068 - DNA, 15 bp, Homo sapiens
tgaagaaggtgaata

SEQ ID NO: 2432069 - DNA, 19 bp, Homo sapiens
tgaagaatacttctcattt

SEQ ID NO: 2432070 - DNA, 14 bp, Homo sapiens
tgaagacagaacca

SEQ ID NO: 2432071 - DNA, 23 bp, Homo sapiens
tgaagagtaagtcaacctgcctg

SEQ ID NO: 2432072 - DNA, 14 bp, Homo sapiens
tgaagatctaaata

SEQ ID NO: 2432073 - DNA, 21 bp, Homo sapiens
tgaagattctttcccaattca

SEQ ID NO: 2432074 - DNA, 20 bp, Homo sapiens
tgaagcaaatcgaatgaaat

SEQ ID NO: 2432075 - DNA, 22 bp, Homo sapiens
tgaagcaaatgtcatgctgcct

SEQ ID NO: 2432076 - DNA, 22 bp, Homo sapiens
tgaagctactgtgtgtgtgaat

SEQ ID NO: 2432077 - DNA, 17 bp, Homo sapiens
tgaaggactaatagaaa

SEQ ID NO: 2432078 - DNA, 22 bp, Homo sapiens
tgaaggactaatagaaaagtat

SEQ ID NO: 2432079 - DNA, 11 bp, Homo sapiens
tgaaggagccc

SEQ ID NO: 2432080 - DNA, 22 bp, Homo sapiens
tgaaggagccccattcctggga

SEQ ID NO: 2432081 - DNA, 23 bp, Homo sapiens
tgaaggagccccattcctgggaa

SEQ ID NO: 2432082 - DNA, 12 bp, Homo sapiens
tgaaggcctgag

SEQ ID NO: 2432083 - DNA, 20 bp, Homo sapiens
tgaaggccttcaacccgaga

SEQ ID NO: 2432084 - DNA, 15 bp, Homo sapiens
tgaaggcttctctct

SEQ ID NO: 2432085 - DNA, 12 bp, Homo sapiens
tgaagggccaga

SEQ ID NO: 2432086 - DNA, 16 bp, Homo sapiens
tgaagggccagagcca

SEQ ID NO: 2432087 - DNA, 20 bp, Homo sapiens
tgaaggtgctgacggccagg

SEQ ID NO: 2432088 - DNA, 18 bp, Homo sapiens
tgaagttagctttaactt

SEQ ID NO: 2432089 - DNA, 22 bp, Homo sapiens
tgaagttgctgcttctcccagg

SEQ ID NO: 2432090 - DNA, 15 bp, Homo sapiens
tgaagttttacattg

SEQ ID NO: 2432091 - DNA, 15 bp, Homo sapiens
tgaataaatgtcact

SEQ ID NO: 2432092 - DNA, 19 bp, Homo sapiens
tgaataccactctgtaatt

SEQ ID NO: 2432093 - DNA, 20 bp, Homo sapiens
tgaataccactctgtaattg

SEQ ID NO: 2432094 - DNA, 14 bp, Homo sapiens
tgaatacctgctca

SEQ ID NO: 2432095 - DNA, 15 bp, Homo sapiens
tgaatactttgaatg

SEQ ID NO: 2432096 - DNA, 18 bp, Homo sapiens
tgaatactttgaatgtgt

SEQ ID NO: 2432097 - DNA, 16 bp, Homo sapiens
tgaatactttttacaa

SEQ ID NO: 2432098 - DNA, 16 bp, Homo sapiens
tgaatagccatatttg

SEQ ID NO: 2432099 - DNA, 21 bp, Homo sapiens
tgaatatacagcaggtgctca

SEQ ID NO: 2432100 - DNA, 20 bp, Homo sapiens
tgaatcaagggtcaggcctt

SEQ ID NO: 2432101 - DNA, 16 bp, Homo sapiens
tgaatcaataatatat

SEQ ID NO: 2432102 - DNA, 20 bp, Homo sapiens
tgaatcaataatatattttc

SEQ ID NO: 2432103 - DNA, 22 bp, Homo sapiens
tgaatcaataatatattttctg

SEQ ID NO: 2432104 - DNA, 24 bp, Homo sapiens
tgaatgaagcaaatgtcatgctgc

SEQ ID NO: 2432105 - DNA, 19 bp, Homo sapiens
tgaatgcaaaccatagcac

SEQ ID NO: 2432106 - DNA, 22 bp, Homo sapiens
tgaatgccactgccttcgcttc

SEQ ID NO: 2432107 - DNA, 20 bp, Homo sapiens
tgaatggctatgtttttaat

SEQ ID NO: 2432108 - DNA, 16 bp, Homo sapiens
tgaatgtaaatttgta

SEQ ID NO: 2432109 - DNA, 22 bp, Homo sapiens
tgaatgtaaatttgtactattt

SEQ ID NO: 2432110 - DNA, 17 bp, Homo sapiens
tgaatgtgtttcacagt

SEQ ID NO: 2432111 - DNA, 21 bp, Homo sapiens
tgaatgtgtttcacagtttga

SEQ ID NO: 2432112 - DNA, 15 bp, Homo sapiens
tgaatgtttttctaa

SEQ ID NO: 2432113 - DNA, 18 bp, Homo sapiens
tgaatgtttttctaaagg

SEQ ID NO: 2432114 - DNA, 22 bp, Homo sapiens
tgaattaatatccctacatgta

SEQ ID NO: 2432115 - DNA, 16 bp, Homo sapiens
tgaattattacagtgt

SEQ ID NO: 2432116 - DNA, 18 bp, Homo sapiens
tgaattattacagtgttt

SEQ ID NO: 2432117 - DNA, 20 bp, Homo sapiens
tgaattcttggttgaggaaa

SEQ ID NO: 2432118 - DNA, 18 bp, Homo sapiens
tgaattgtaactgttctt

SEQ ID NO: 2432119 - DNA, 19 bp, Homo sapiens
tgaattgtaactgttcttg

SEQ ID NO: 2432120 - DNA, 19 bp, Homo sapiens
tgaatttaataatctgtag

SEQ ID NO: 2432121 - DNA, 13 bp, Homo sapiens
tgaattttagctt

SEQ ID NO: 2432122 - DNA, 14 bp, Homo sapiens
tgaattttagcttt

SEQ ID NO: 2432123 - DNA, 16 bp, Homo sapiens
tgaattttttttaaca

SEQ ID NO: 2432124 - DNA, 20 bp, Homo sapiens
tgaattttttttaacattcc

SEQ ID NO: 2432125 - DNA, 17 bp, Homo sapiens
tgacaaaggcaagcact

SEQ ID NO: 2432126 - DNA, 13 bp, Homo sapiens
tgacaactggcag

SEQ ID NO: 2432127 - DNA, 17 bp, Homo sapiens
tgacaactggcaggcag

SEQ ID NO: 2432128 - DNA, 15 bp, Homo sapiens
tgacaacttctaatt

SEQ ID NO: 2432129 - DNA, 13 bp, Homo sapiens
tgacaataaaaca

SEQ ID NO: 2432130 - DNA, 20 bp, Homo sapiens
tgacacactaaccaagctga

SEQ ID NO: 2432131 - DNA, 14 bp, Homo sapiens
tgacacccttctcc

SEQ ID NO: 2432132 - DNA, 16 bp, Homo sapiens
tgacacccttctccca

SEQ ID NO: 2432133 - DNA, 19 bp, Homo sapiens
tgacacccttctcccactc

SEQ ID NO: 2432134 - DNA, 23 bp, Homo sapiens
tgacacccttctcccactctcct

SEQ ID NO: 2432135 - DNA, 18 bp, Homo sapiens
tgacacctaactcttctt

SEQ ID NO: 2432136 - DNA, 16 bp, Homo sapiens
tgacactcatataatt

SEQ ID NO: 2432137 - DNA, 17 bp, Homo sapiens
tgacactgcaattggca

SEQ ID NO: 2432138 - DNA, 13 bp, Homo sapiens
tgacactgctcta

SEQ ID NO: 2432139 - DNA, 21 bp, Homo sapiens
tgacactgctctaacagccct

SEQ ID NO: 2432140 - DNA, 14 bp, Homo sapiens
tgacacttgtacaa

SEQ ID NO: 2432141 - DNA, 16 bp, Homo sapiens
tgacagcagcatctct

SEQ ID NO: 2432142 - DNA, 18 bp, Homo sapiens
tgacagcctcagtgaccc

SEQ ID NO: 2432143 - DNA, 17 bp, Homo sapiens
tgacagcctcccacccc

SEQ ID NO: 2432144 - DNA, 14 bp, Homo sapiens
tgacataaagttga

SEQ ID NO: 2432145 - DNA, 14 bp, Homo sapiens
tgacatcaaaaaag

SEQ ID NO: 2432146 - DNA, 19 bp, Homo sapiens
tgacatgtggggccaggtc

SEQ ID NO: 2432147 - DNA, 20 bp, Homo sapiens
tgacattatgtggttttaga

SEQ ID NO: 2432148 - DNA, 15 bp, Homo sapiens
tgacattcacctgcc

SEQ ID NO: 2432149 - DNA, 16 bp, Homo sapiens
tgacattctgaatgct

SEQ ID NO: 2432150 - DNA, 19 bp, Homo sapiens
tgcaatttcaaggttctaa

SEQ ID NO: 2432151 - DNA, 20 bp, Homo sapiens
tgcaatttcaaggttctaac

SEQ ID NO: 2432152 - DNA, 23 bp, Homo sapiens
tgcacaagaatggatcacaagat

SEQ ID NO: 2432153 - DNA, 18 bp, Homo sapiens
tgcacaataactcctccc

SEQ ID NO: 2432154 - DNA, 22 bp, Homo sapiens
tgcacactttgccatattttca

SEQ ID NO: 2432155 - DNA, 22 bp, Homo sapiens
tgcacactttggtaccagataa

SEQ ID NO: 2432156 - DNA, 16 bp, Homo sapiens
tgcacagcacaaatta

SEQ ID NO: 2432157 - DNA, 18 bp, Homo sapiens
tgcacagcacaaattagt

SEQ ID NO: 2432158 - DNA, 15 bp, Homo sapiens
tgcacaggagggggt

SEQ ID NO: 2432159 - DNA, 19 bp, Homo sapiens
tgcacagggtccccgagtg

SEQ ID NO: 2432160 - DNA, 17 bp, Homo sapiens
tgcacagtatttgtaat

SEQ ID NO: 2432161 - DNA, 20 bp, Homo sapiens
tgcacagtatttgtaattaa

SEQ ID NO: 2432162 - DNA, 23 bp, Homo sapiens
tgcacagtatttgtaattaaaag

SEQ ID NO: 2432163 - DNA, 17 bp, Homo sapiens
tgcacagtgacttctga

SEQ ID NO: 2432164 - DNA, 22 bp, Homo sapiens
tgcacatctgtaaatctacaca

SEQ ID NO: 2432165 - DNA, 15 bp, Homo sapiens
tgcacatctgtgtct

SEQ ID NO: 2432166 - DNA, 16 bp, Homo sapiens
tgcacatctgtgtctt

SEQ ID NO: 2432167 - DNA, 14 bp, Homo sapiens
tgcaccaagcagga

SEQ ID NO: 2432168 - DNA, 16 bp, Homo sapiens
tgcaccaccaagccaa

SEQ ID NO: 2432169 - DNA, 18 bp, Homo sapiens
tgcaccaccaagccaagg

SEQ ID NO: 2432170 - DNA, 23 bp, Homo sapiens
tgcaccagggttgaccccagagg

SEQ ID NO: 2432171 - DNA, 18 bp, Homo sapiens
tgcaccccaaagctttcc

SEQ ID NO: 2432172 - DNA, 19 bp, Homo sapiens
tgcaccccaaagctttcct

SEQ ID NO: 2432173 - DNA, 21 bp, Homo sapiens
tgcaccccaaagctttcctgc

SEQ ID NO: 2432174 - DNA, 22 bp, Homo sapiens
tgcaccccaaagctttcctgcc

SEQ ID NO: 2432175 - DNA, 14 bp, Homo sapiens
tgcacctaaagaaa

SEQ ID NO: 2432176 - DNA, 15 bp, Homo sapiens
tgcacctaaagaaaa

SEQ ID NO: 2432177 - DNA, 22 bp, Homo sapiens
tgcacctttttgcatgatatct

SEQ ID NO: 2432178 - DNA, 22 bp, Homo sapiens
tgcacgtggcctcttgagcagt

SEQ ID NO: 2432179 - DNA, 15 bp, Homo sapiens
tgcactactgacatg

SEQ ID NO: 2432180 - DNA, 16 bp, Homo sapiens
tgcactactgacatgt

SEQ ID NO: 2432181 - DNA, 16 bp, Homo sapiens
tgcactgatgctgccc

SEQ ID NO: 2432182 - DNA, 21 bp, Homo sapiens
tgcactgatgctgcccctcat

SEQ ID NO: 2432183 - DNA, 21 bp, Homo sapiens
tgcactgatgttgtgttttta

SEQ ID NO: 2432184 - DNA, 19 bp, Homo sapiens
tgcactgcccatggacagg

SEQ ID NO: 2432185 - DNA, 21 bp, Homo sapiens
tgcactgcccatggacaggct

SEQ ID NO: 2432186 - DNA, 12 bp, Homo sapiens
tgcactgggagg

SEQ ID NO: 2432187 - DNA, 14 bp, Homo sapiens
tgcactgtaaaatg

SEQ ID NO: 2432188 - DNA, 15 bp, Homo sapiens
tgcactgtaaaatgt

SEQ ID NO: 2432189 - DNA, 18 bp, Homo sapiens
tgcactgtgaaggaccct

SEQ ID NO: 2432190 - DNA, 14 bp, Homo sapiens
tgcactgttccccc

SEQ ID NO: 2432191 - DNA, 20 bp, Homo sapiens
tgcactgttccccctgtgca

SEQ ID NO: 2432192 - DNA, 15 bp, Homo sapiens
tgcacttacttgctt

SEQ ID NO: 2432193 - DNA, 16 bp, Homo sapiens
tgcacttacttgctta

SEQ ID NO: 2432194 - DNA, 20 bp, Homo sapiens
tgcactttctatcctctgta

SEQ ID NO: 2432195 - DNA, 21 bp, Homo sapiens
tgcactttgctttaatataaa

SEQ ID NO: 2432196 - DNA, 16 bp, Homo sapiens
tgcagaagaaggcatc

SEQ ID NO: 2432197 - DNA, 17 bp, Homo sapiens
tgcagaagaaggcatcg

SEQ ID NO: 2432198 - DNA, 13 bp, Homo sapiens
tgcagacaggaat

SEQ ID NO: 2432199 - DNA, 16 bp, Homo sapiens
tgcagacaggaatctt

SEQ ID NO: 2432200 - DNA, 23 bp, Homo sapiens
tgcagaccacgcccgtcctgcct

SEQ ID NO: 2432201 - DNA, 14 bp, Homo sapiens
tgcagaggccagag

SEQ ID NO: 2432202 - DNA, 15 bp, Homo sapiens
tgcagaggccagagg

SEQ ID NO: 2432203 - DNA, 17 bp, Homo sapiens
tgcagaggccagaggcc

SEQ ID NO: 2432204 - DNA, 14 bp, Homo sapiens
tgcagaggcctgca

SEQ ID NO: 2432205 - DNA, 15 bp, Homo sapiens
tgcagaggcctgcag

SEQ ID NO: 2432206 - DNA, 18 bp, Homo sapiens
tgcagaggcctgcagggc

SEQ ID NO: 2432207 - DNA, 18 bp, Homo sapiens
tgcagatggtgagagata

SEQ ID NO: 2432208 - DNA, 23 bp, Homo sapiens
tgcagcacagctgagaggctgtc

SEQ ID NO: 2432209 - DNA, 18 bp, Homo sapiens
tgcagccggcacagggtc

SEQ ID NO: 2432210 - DNA, 19 bp, Homo sapiens
tgcagccggcacagggtct

SEQ ID NO: 2432211 - DNA, 23 bp, Homo sapiens
tgcagcctttgcctccccggctc

SEQ ID NO: 2432212 - DNA, 17 bp, Homo sapiens
tgcagcgactggcatac

SEQ ID NO: 2432213 - DNA, 20 bp, Homo sapiens
tgcagctcaagagatcccaa

SEQ ID NO: 2432214 - DNA, 16 bp, Homo sapiens
tgcagcttgtagccag

SEQ ID NO: 2432215 - DNA, 17 bp, Homo sapiens
tgcagcttgtagccagc

SEQ ID NO: 2432216 - DNA, 21 bp, Homo sapiens
tgcagcttgtagccagccggg

SEQ ID NO: 2432217 - DNA, 15 bp, Homo sapiens
tgcaggaaggagctg

SEQ ID NO: 2432218 - DNA, 19 bp, Homo sapiens
tgcaggaaggagctgcctg

SEQ ID NO: 2432219 - DNA, 20 bp, Homo sapiens
tgcaggaaggagctgcctgg

SEQ ID NO: 2432220 - DNA, 19 bp, Homo sapiens
tgcaggaatctttaaaaga

SEQ ID NO: 2432221 - DNA, 17 bp, Homo sapiens
tgcaggatctcaccagg

SEQ ID NO: 2432222 - DNA, 22 bp, Homo sapiens
tgcaggatctcaccaggcagcc

SEQ ID NO: 2432223 - DNA, 12 bp, Homo sapiens
tgcaggccctgg

SEQ ID NO: 2432224 - DNA, 16 bp, Homo sapiens
tgcaggccctggcctc

SEQ ID NO: 2432225 - DNA, 20 bp, Homo sapiens
tgcagggaaaattatttgca

SEQ ID NO: 2432226 - DNA, 14 bp, Homo sapiens
tgcagggatgtggg

SEQ ID NO: 2432227 - DNA, 13 bp, Homo sapiens
tgcagggcctctg

SEQ ID NO: 2432228 - DNA, 14 bp, Homo sapiens
tgcagggcctctgt

SEQ ID NO: 2432229 - DNA, 15 bp, Homo sapiens
tgcagggcctctgtc

SEQ ID NO: 2432230 - DNA, 13 bp, Homo sapiens
tgcaggtggggag

SEQ ID NO: 2432231 - DNA, 12 bp, Homo sapiens
tgcaggttccca

SEQ ID NO: 2432232 - DNA, 21 bp, Homo sapiens
tgcagtaactgttttttaagt

SEQ ID NO: 2432233 - DNA, 17 bp, Homo sapiens
tgcagtactttgtgcat

SEQ ID NO: 2432234 - DNA, 18 bp, Homo sapiens
tgcagtactttgtgcatt

SEQ ID NO: 2432235 - DNA, 14 bp, Homo sapiens
tgcagtcccaagcg

SEQ ID NO: 2432236 - DNA, 21 bp, Homo sapiens
tgcagtcccaagcggtgtctc

SEQ ID NO: 2432237 - DNA, 22 bp, Homo sapiens
tgcagtcccaagcggtgtctct

SEQ ID NO: 2432238 - DNA, 23 bp, Homo sapiens
tgcagtcccaagcggtgtctctc

SEQ ID NO: 2432239 - DNA, 13 bp, Homo sapiens
tgcagtcctgggt

SEQ ID NO: 2432240 - DNA, 15 bp, Homo sapiens
tgcagtcctgggtcc

SEQ ID NO: 2432241 - DNA, 13 bp, Homo sapiens
tgcagttgtctct

SEQ ID NO: 2432242 - DNA, 10 bp, Homo sapiens
tgcagtttat

SEQ ID NO: 2432243 - DNA, 19 bp, Homo sapiens
tgcagtttatcattcaagt

SEQ ID NO: 2432244 - DNA, 18 bp, Homo sapiens
tgcataacaattcctcta

SEQ ID NO: 2432245 - DNA, 22 bp, Homo sapiens
tgcatacactttttctctttcc

SEQ ID NO: 2432246 - DNA, 20 bp, Homo sapiens
tgcataggagtttggaggaa

SEQ ID NO: 2432247 - DNA, 21 bp, Homo sapiens
tgcatagtaccaatcatttta

SEQ ID NO: 2432248 - DNA, 20 bp, Homo sapiens
tgcatcagaaagggagggct

SEQ ID NO: 2432249 - DNA, 18 bp, Homo sapiens
tgcatccattctcctgag

SEQ ID NO: 2432250 - DNA, 21 bp, Homo sapiens
tgcatctggagagaacaggtt

SEQ ID NO: 2432251 - DNA, 21 bp, Homo sapiens
tgcatgatatcttcaagcctg

SEQ ID NO: 2432252 - DNA, 16 bp, Homo sapiens
tgcatggatttctttg

SEQ ID NO: 2432253 - DNA, 13 bp, Homo sapiens
tgcttcgggccct

SEQ ID NO: 2432254 - DNA, 18 bp, Homo sapiens
tgcttcgggcccttccca

SEQ ID NO: 2432255 - DNA, 19 bp, Homo sapiens
tgcttctataattttgcct

SEQ ID NO: 2432256 - DNA, 17 bp, Homo sapiens
tgcttctcccaggcaag

SEQ ID NO: 2432257 - DNA, 20 bp, Homo sapiens
tgcttctcccaggcaaggct

SEQ ID NO: 2432258 - DNA, 22 bp, Homo sapiens
tgcttctcccaggcaaggctgt

SEQ ID NO: 2432259 - DNA, 13 bp, Homo sapiens
tgcttctctgact

SEQ ID NO: 2432260 - DNA, 23 bp, Homo sapiens
tgcttctctgacttctgcctgga

SEQ ID NO: 2432261 - DNA, 15 bp, Homo sapiens
tgcttctttctagaa

SEQ ID NO: 2432262 - DNA, 12 bp, Homo sapiens
tgcttgaggaaa

SEQ ID NO: 2432263 - DNA, 18 bp, Homo sapiens
tgcttgccctaagcagaa

SEQ ID NO: 2432264 - DNA, 20 bp, Homo sapiens
tgcttgccctaagcagaaag

SEQ ID NO: 2432265 - DNA, 15 bp, Homo sapiens
tgcttgtaactaaaa

SEQ ID NO: 2432266 - DNA, 16 bp, Homo sapiens
tgcttgttccctctcc

SEQ ID NO: 2432267 - DNA, 14 bp, Homo sapiens
tgctttaatataaa

SEQ ID NO: 2432268 - DNA, 19 bp, Homo sapiens
tgctttccattcgtgaaaa

SEQ ID NO: 2432269 - DNA, 16 bp, Homo sapiens
tgctttctgttccaaa

SEQ ID NO: 2432270 - DNA, 22 bp, Homo sapiens
tgctttctgttccaaattcagt

SEQ ID NO: 2432271 - DNA, 18 bp, Homo sapiens
tgctttctttgtttggct

SEQ ID NO: 2432272 - DNA, 21 bp, Homo sapiens
tgctttgaaacagaaaaatat

SEQ ID NO: 2432273 - DNA, 23 bp, Homo sapiens
tgctttgaaattgaacctttgtg

SEQ ID NO: 2432274 - DNA, 22 bp, Homo sapiens
tgctttggacctaaatggcctc

SEQ ID NO: 2432275 - DNA, 21 bp, Homo sapiens
tgcttttggcaaaactctact

SEQ ID NO: 2432276 - DNA, 16 bp, Homo sapiens
tggaaaaacagcatgt

SEQ ID NO: 2432277 - DNA, 17 bp, Homo sapiens
tggaaaacaaggaagtc

SEQ ID NO: 2432278 - DNA, 17 bp, Homo sapiens
tggaaaacagaacactt

SEQ ID NO: 2432279 - DNA, 18 bp, Homo sapiens
tggaaagataactaggaa

SEQ ID NO: 2432280 - DNA, 12 bp, Homo sapiens
tggaaagcaggt

SEQ ID NO: 2432281 - DNA, 19 bp, Homo sapiens
tggaaaggtgtgagactgg

SEQ ID NO: 2432282 - DNA, 22 bp, Homo sapiens
tggaaaggtgtgagactgggaa

SEQ ID NO: 2432283 - DNA, 19 bp, Homo sapiens
tggaaatatatattatact

SEQ ID NO: 2432284 - DNA, 16 bp, Homo sapiens
tggaaattgacgaggg

SEQ ID NO: 2432285 - DNA, 12 bp, Homo sapiens
tggaaatttaaa

SEQ ID NO: 2432286 - DNA, 13 bp, Homo sapiens
tggaaatttaaag

SEQ ID NO: 2432287 - DNA, 22 bp, Homo sapiens
tggaacactagacaagccagaa

SEQ ID NO: 2432288 - DNA, 13 bp, Homo sapiens
tggaacacttcga

SEQ ID NO: 2432289 - DNA, 13 bp, Homo sapiens
tggaacattggaa

SEQ ID NO: 2432290 - DNA, 19 bp, Homo sapiens
tggaacctcagcctggcca

SEQ ID NO: 2432291 - DNA, 22 bp, Homo sapiens
tggaactgaagggggcggccta

SEQ ID NO: 2432292 - DNA, 15 bp, Homo sapiens
tggaactgctgccac

SEQ ID NO: 2432293 - DNA, 19 bp, Homo sapiens
tggaactgctgccactgag

SEQ ID NO: 2432294 - DNA, 20 bp, Homo sapiens
tggaactgctgccactgagg

SEQ ID NO: 2432295 - DNA, 13 bp, Homo sapiens
tggaactggaggc

SEQ ID NO: 2432296 - DNA, 16 bp, Homo sapiens
tggaagaaggggcagg

SEQ ID NO: 2432297 - DNA, 16 bp, Homo sapiens
tggaagagcagcacct

SEQ ID NO: 2432298 - DNA, 18 bp, Homo sapiens
tggaagatagctgtgact

SEQ ID NO: 2432299 - DNA, 13 bp, Homo sapiens
tggaagatcctgc

SEQ ID NO: 2432300 - DNA, 23 bp, Homo sapiens
tggaagatggggaccagcagccc

SEQ ID NO: 2432301 - DNA, 16 bp, Homo sapiens
tggaagcttggggaag

SEQ ID NO: 2432302 - DNA, 18 bp, Homo sapiens
tggaagtttagctctgag

SEQ ID NO: 2432303 - DNA, 15 bp, Homo sapiens
tggaatattgtccat

SEQ ID NO: 2432304 - DNA, 21 bp, Homo sapiens
tggaatcaggaatattttcca

SEQ ID NO: 2432305 - DNA, 22 bp, Homo sapiens
tggaatcaggaatattttccaa

SEQ ID NO: 2432306 - DNA, 15 bp, Homo sapiens
tggaatggatttttc

SEQ ID NO: 2432307 - DNA, 15 bp, Homo sapiens
tggaattgatttgca

SEQ ID NO: 2432308 - DNA, 17 bp, Homo sapiens
tggaatttgcctgctgg

SEQ ID NO: 2432309 - DNA, 15 bp, Homo sapiens
tggacaaatcacata

SEQ ID NO: 2432310 - DNA, 23 bp, Homo sapiens
tggacaaatcacatattttaaaa

SEQ ID NO: 2432311 - DNA, 16 bp, Homo sapiens
tggacacacacagact

SEQ ID NO: 2432312 - DNA, 23 bp, Homo sapiens
tggacacttaatactaccttgaa

SEQ ID NO: 2432313 - DNA, 23 bp, Homo sapiens
tggacatcctcctcccacccggc

SEQ ID NO: 2432314 - DNA, 21 bp, Homo sapiens
tggacatgaagattctttccc

SEQ ID NO: 2432315 - DNA, 15 bp, Homo sapiens
tggaccactcctcat

SEQ ID NO: 2432316 - DNA, 18 bp, Homo sapiens
tggaccactcctcatagc

SEQ ID NO: 2432317 - DNA, 19 bp, Homo sapiens
tggaccatggagtggcagc

SEQ ID NO: 2432318 - DNA, 21 bp, Homo sapiens
tggacccagccaggcccagcc

SEQ ID NO: 2432319 - DNA, 23 bp, Homo sapiens
tggacccccctttcacaggcagc

SEQ ID NO: 2432320 - DNA, 16 bp, Homo sapiens
tggacccctgcattgg

SEQ ID NO: 2432321 - DNA, 20 bp, Homo sapiens
tggacccgttcatgggggag

SEQ ID NO: 2432322 - DNA, 15 bp, Homo sapiens
tggaccctgaccagc

SEQ ID NO: 2432323 - DNA, 18 bp, Homo sapiens
tggaccctgaccagctcc

SEQ ID NO: 2432324 - DNA, 19 bp, Homo sapiens
tggaccctgaccagctccc

SEQ ID NO: 2432325 - DNA, 22 bp, Homo sapiens
tggaccggagagtgggggtggg

SEQ ID NO: 2432326 - DNA, 18 bp, Homo sapiens
tggacctaaatggcctca

SEQ ID NO: 2432327 - DNA, 13 bp, Homo sapiens
tggacctctgaca

SEQ ID NO: 2432328 - DNA, 15 bp, Homo sapiens
tggacctgcctgcat

SEQ ID NO: 2432329 - DNA, 14 bp, Homo sapiens
tggactatctgtct

SEQ ID NO: 2432330 - DNA, 15 bp, Homo sapiens
tggactatctgtctg

SEQ ID NO: 2432331 - DNA, 20 bp, Homo sapiens
tggactcagggcagcgccag

SEQ ID NO: 2432332 - DNA, 20 bp, Homo sapiens
tggactctcagtctctgagc

SEQ ID NO: 2432333 - DNA, 21 bp, Homo sapiens
tggactctggtgcctccagag

SEQ ID NO: 2432334 - DNA, 22 bp, Homo sapiens
tggactctggtgcctccagagg

SEQ ID NO: 2432335 - DNA, 22 bp, Homo sapiens
tggactctgtcctgaaggcctg

SEQ ID NO: 2432336 - DNA, 14 bp, Homo sapiens
tggactggttttca

SEQ ID NO: 2432337 - DNA, 22 bp, Homo sapiens
tggactgttttctctcggctcc

SEQ ID NO: 2432338 - DNA, 13 bp, Homo sapiens
tggactttcctgc

SEQ ID NO: 2432339 - DNA, 13 bp, Homo sapiens
tggagaaaatggg

SEQ ID NO: 2432340 - DNA, 22 bp, Homo sapiens
tggagaaaatgggtttattcac

SEQ ID NO: 2432341 - DNA, 13 bp, Homo sapiens
tggagaaagctga

SEQ ID NO: 2432342 - DNA, 18 bp, Homo sapiens
tggagaaagctgacttgg

SEQ ID NO: 2432343 - DNA, 23 bp, Homo sapiens
tggagaaagctgacttggctggt

SEQ ID NO: 2432344 - DNA, 21 bp, Homo sapiens
tggagaaagggccctgggcct

SEQ ID NO: 2432345 - DNA, 17 bp, Homo sapiens
tggagaagtctcagcta

SEQ ID NO: 2432346 - DNA, 13 bp, Homo sapiens
tggagaccaccag

SEQ ID NO: 2432347 - DNA, 21 bp, Homo sapiens
tggagactgtgtgtgccctct

SEQ ID NO: 2432348 - DNA, 19 bp, Homo sapiens
tggagagagcagactggcg

SEQ ID NO: 2432349 - DNA, 16 bp, Homo sapiens
tggagagccctgggac

SEQ ID NO: 2432350 - DNA, 18 bp, Homo sapiens
tggagagccctgggaccg

SEQ ID NO: 2432351 - DNA, 17 bp, Homo sapiens
tggagagctaggagcaa

SEQ ID NO: 2432352 - DNA, 23 bp, Homo sapiens
tggagagctaggagcaaagcctg

SEQ ID NO: 2432353 - DNA, 15 bp, Homo sapiens
tggagagggaatgtg

SEQ ID NO: 2432354 - DNA, 16 bp, Homo sapiens
tggagagggaatgtga

SEQ ID NO: 2432355 - DNA, 17 bp, Homo sapiens
tggagagggaatgtgaa

SEQ ID NO: 2432356 - DNA, 22 bp, Homo sapiens
tggggtgacccggcaccccctg

SEQ ID NO: 2432357 - DNA, 14 bp, Homo sapiens
tggggtggctgcag

SEQ ID NO: 2432358 - DNA, 16 bp, Homo sapiens
tggggtggctgcagcc

SEQ ID NO: 2432359 - DNA, 18 bp, Homo sapiens
tggggttatctctgtgtt

SEQ ID NO: 2432360 - DNA, 16 bp, Homo sapiens
tgggtaaaatactttt

SEQ ID NO: 2432361 - DNA, 15 bp, Homo sapiens
tgggtacccccagga

SEQ ID NO: 2432362 - DNA, 16 bp, Homo sapiens
tgggtacttcttgaag

SEQ ID NO: 2432363 - DNA, 12 bp, Homo sapiens
tgggtcacagga

SEQ ID NO: 2432364 - DNA, 13 bp, Homo sapiens
tgggtcccaggac

SEQ ID NO: 2432365 - DNA, 20 bp, Homo sapiens
tgggtcctcctttctgaggg

SEQ ID NO: 2432366 - DNA, 12 bp, Homo sapiens
tgggtgacattt

SEQ ID NO: 2432367 - DNA, 16 bp, Homo sapiens
tgggtgcctaggcctg

SEQ ID NO: 2432368 - DNA, 21 bp, Homo sapiens
tgggtgcctaggcctgggcag

SEQ ID NO: 2432369 - DNA, 23 bp, Homo sapiens
tgggtgcctaggcctgggcagtg

SEQ ID NO: 2432370 - DNA, 14 bp, Homo sapiens
tgggtggctactct

SEQ ID NO: 2432371 - DNA, 20 bp, Homo sapiens
tgggtggctactctgtgcca

SEQ ID NO: 2432372 - DNA, 18 bp, Homo sapiens
tgggtggtaccctctgga

SEQ ID NO: 2432373 - DNA, 13 bp, Homo sapiens
tgggttccacaga

SEQ ID NO: 2432374 - DNA, 14 bp, Homo sapiens
tgggttccacagac

SEQ ID NO: 2432375 - DNA, 19 bp, Homo sapiens
tgggttctgcctgccagct

SEQ ID NO: 2432376 - DNA, 15 bp, Homo sapiens
tgggttgggatcagg

SEQ ID NO: 2432377 - DNA, 14 bp, Homo sapiens
tgggtttttccctg

SEQ ID NO: 2432378 - DNA, 16 bp, Homo sapiens
tggtaacttttgtgaa

SEQ ID NO: 2432379 - DNA, 19 bp, Homo sapiens
tggtacagagaagccagct

SEQ ID NO: 2432380 - DNA, 21 bp, Homo sapiens
tggtacagagaagccagcttg

SEQ ID NO: 2432381 - DNA, 18 bp, Homo sapiens
tggtacatggtgtttgtg

SEQ ID NO: 2432382 - DNA, 14 bp, Homo sapiens
tggtaccagataac

SEQ ID NO: 2432383 - DNA, 16 bp, Homo sapiens
tggtaccctcctggct

SEQ ID NO: 2432384 - DNA, 17 bp, Homo sapiens
tggtagaccactgccat

SEQ ID NO: 2432385 - DNA, 17 bp, Homo sapiens
tggtaggaatagcatgt

SEQ ID NO: 2432386 - DNA, 13 bp, Homo sapiens
tggtagggtggga

SEQ ID NO: 2432387 - DNA, 22 bp, Homo sapiens
tggtattttcaatagccactaa

SEQ ID NO: 2432388 - DNA, 16 bp, Homo sapiens
tggtcacacactgatg

SEQ ID NO: 2432389 - DNA, 15 bp, Homo sapiens
tggtcacagcggagg

SEQ ID NO: 2432390 - DNA, 15 bp, Homo sapiens
tggtcagccctaggg

SEQ ID NO: 2432391 - DNA, 19 bp, Homo sapiens
tggtcagccctagggtgga

SEQ ID NO: 2432392 - DNA, 18 bp, Homo sapiens
tggtccaattagtttcct

SEQ ID NO: 2432393 - DNA, 21 bp, Homo sapiens
tggtccaattagtttcctttt

SEQ ID NO: 2432394 - DNA, 12 bp, Homo sapiens
tggtccaggaga

SEQ ID NO: 2432395 - DNA, 16 bp, Homo sapiens
tggtccaggagaaggc

SEQ ID NO: 2432396 - DNA, 13 bp, Homo sapiens
tggtcccacatcc

SEQ ID NO: 2432397 - DNA, 19 bp, Homo sapiens
tggtcccacatccctgggc

SEQ ID NO: 2432398 - DNA, 20 bp, Homo sapiens
tggtcccacatccctgggcc

SEQ ID NO: 2432399 - DNA, 22 bp, Homo sapiens
tggtcccctccttcccaagtga

SEQ ID NO: 2432400 - DNA, 12 bp, Homo sapiens
tggtccctgggt

SEQ ID NO: 2432401 - DNA, 22 bp, Homo sapiens
tggtcccttgtatcccctgcag

SEQ ID NO: 2432402 - DNA, 23 bp, Homo sapiens
tggtcccttgtatcccctgcagg

SEQ ID NO: 2432403 - DNA, 17 bp, Homo sapiens
tggtcgaggagtaacaa

SEQ ID NO: 2432404 - DNA, 15 bp, Homo sapiens
tggtcgctcctgccc

SEQ ID NO: 2432405 - DNA, 22 bp, Homo sapiens
tggtcgttttttttttgtttgt

SEQ ID NO: 2432406 - DNA, 14 bp, Homo sapiens
tggtctcaccctgg

SEQ ID NO: 2432407 - DNA, 23 bp, Homo sapiens
tggtctcaccctggaggcacctg

SEQ ID NO: 2432408 - DNA, 13 bp, Homo sapiens
tggtctcttgctt

SEQ ID NO: 2432409 - DNA, 18 bp, Homo sapiens
tggtctgccctctgcatc

SEQ ID NO: 2432410 - DNA, 14 bp, Homo sapiens
tggtctgttggcag

SEQ ID NO: 2432411 - DNA, 23 bp, Homo sapiens
tggtgcacagcacaaattagtta

SEQ ID NO: 2432412 - DNA, 10 bp, Homo sapiens
tggtgccacc

SEQ ID NO: 2432413 - DNA, 14 bp, Homo sapiens
tggtgccccaggac

SEQ ID NO: 2432414 - DNA, 16 bp, Homo sapiens
tggtgccccaggacca

SEQ ID NO: 2432415 - DNA, 14 bp, Homo sapiens
tggtgcggctggcc

SEQ ID NO: 2432416 - DNA, 17 bp, Homo sapiens
tggtgcggctggccatg

SEQ ID NO: 2432417 - DNA, 20 bp, Homo sapiens
tggtggccatgctcctcttc

SEQ ID NO: 2432418 - DNA, 21 bp, Homo sapiens
tggtggccatgctcctcttcc

SEQ ID NO: 2432419 - DNA, 14 bp, Homo sapiens
tggtggccctctcc

SEQ ID NO: 2432420 - DNA, 23 bp, Homo sapiens
tggtggccctctcccctgccccc

SEQ ID NO: 2432421 - DNA, 16 bp, Homo sapiens
tggtgggtccatgggc

SEQ ID NO: 2432422 - DNA, 17 bp, Homo sapiens
tggtgggtccatgggca

SEQ ID NO: 2432423 - DNA, 16 bp, Homo sapiens
tggtggtattttcaat

SEQ ID NO: 2432424 - DNA, 16 bp, Homo sapiens
tggtgtagctacagag

SEQ ID NO: 2432425 - DNA, 20 bp, Homo sapiens
tggtgtagctacagagaaac

SEQ ID NO: 2432426 - DNA, 22 bp, Homo sapiens
tggtgtagctacagagaaacca

SEQ ID NO: 2432427 - DNA, 18 bp, Homo sapiens
tggtgtccagacagagcc

SEQ ID NO: 2432428 - DNA, 17 bp, Homo sapiens
tggtgtctcttctttag

SEQ ID NO: 2432429 - DNA, 16 bp, Homo sapiens
tggtgtgatcgtctga

SEQ ID NO: 2432430 - DNA, 15 bp, Homo sapiens
tggtgtggtacagag

SEQ ID NO: 2432431 - DNA, 17 bp, Homo sapiens
tggtgtggtacagagaa

SEQ ID NO: 2432432 - DNA, 18 bp, Homo sapiens
tggtgtggtacagagaag

SEQ ID NO: 2432433 - DNA, 23 bp, Homo sapiens
tggtgtggtacagagaagccagc

SEQ ID NO: 2432434 - DNA, 19 bp, Homo sapiens
tggtgtgtccccctctgtc

SEQ ID NO: 2432435 - DNA, 20 bp, Homo sapiens
tggtgttaacagaagggagg

SEQ ID NO: 2432436 - DNA, 23 bp, Homo sapiens
tggtgttctcctgctgctccctc

SEQ ID NO: 2432437 - DNA, 20 bp, Homo sapiens
tggtgttggacaagcttctg

SEQ ID NO: 2432438 - DNA, 22 bp, Homo sapiens
tggtgtttttttctatgggtgt

SEQ ID NO: 2432439 - DNA, 16 bp, Homo sapiens
tggttaagagtccaag

SEQ ID NO: 2432440 - DNA, 15 bp, Homo sapiens
tggttaccatgtctt

SEQ ID NO: 2432441 - DNA, 21 bp, Homo sapiens
tggttcagaattaaactttta

SEQ ID NO: 2432442 - DNA, 16 bp, Homo sapiens
tggttcattaattcta

SEQ ID NO: 2432443 - DNA, 20 bp, Homo sapiens
tggttcccgtttctccacct

SEQ ID NO: 2432444 - DNA, 22 bp, Homo sapiens
tggttctaaggacctgaaattc

SEQ ID NO: 2432445 - DNA, 16 bp, Homo sapiens
tggttctcaattccaa

SEQ ID NO: 2432446 - DNA, 23 bp, Homo sapiens
tggttctcaattccaacagttta

SEQ ID NO: 2432447 - DNA, 22 bp, Homo sapiens
tggttctgagatggctcccagg

SEQ ID NO: 2432448 - DNA, 23 bp, Homo sapiens
tggttcttgaggggaccaggagt

SEQ ID NO: 2432449 - DNA, 23 bp, Homo sapiens
tggttgaactctggtggcacagg

SEQ ID NO: 2432450 - DNA, 18 bp, Homo sapiens
tggttgatgccaaaaaaa

SEQ ID NO: 2432451 - DNA, 17 bp, Homo sapiens
tggttggttttcttctt

SEQ ID NO: 2432452 - DNA, 17 bp, Homo sapiens
tggttgtttctgttcca

SEQ ID NO: 2432453 - DNA, 19 bp, Homo sapiens
tggtttaaagaaagtgtat

SEQ ID NO: 2432454 - DNA, 12 bp, Homo sapiens
tggtttcatgtt

SEQ ID NO: 2432455 - DNA, 22 bp, Homo sapiens
tggtttcttgtgcactggcacc

SEQ ID NO: 2432456 - DNA, 16 bp, Homo sapiens
tggtttgccttccaga

SEQ ID NO: 2432457 - DNA, 13 bp, Homo sapiens
tggttttagattt

SEQ ID NO: 2432458 - DNA, 14 bp, Homo sapiens
tggttttagatttt

SEQ ID NO: 2432459 - DNA, 19 bp, Homo sapiens
tggttttctccaagagcta

SEQ ID NO: 2432460 - DNA, 15 bp, Homo sapiens
tgtgtatttacgctt

SEQ ID NO: 2432461 - DNA, 11 bp, Homo sapiens
tgtgtatttgc

SEQ ID NO: 2432462 - DNA, 13 bp, Homo sapiens
tgtgtatttgcta

SEQ ID NO: 2432463 - DNA, 19 bp, Homo sapiens
tgtgtccaaaaccgccagc

SEQ ID NO: 2432464 - DNA, 21 bp, Homo sapiens
tgtgtccaaaaccgccagctc

SEQ ID NO: 2432465 - DNA, 16 bp, Homo sapiens
tgtgtccaaaactgcc

SEQ ID NO: 2432466 - DNA, 17 bp, Homo sapiens
tgtgtcctgacactgca

SEQ ID NO: 2432467 - DNA, 16 bp, Homo sapiens
tgtgtctaagattcta

SEQ ID NO: 2432468 - DNA, 16 bp, Homo sapiens
tgtgtcttaattatta

SEQ ID NO: 2432469 - DNA, 18 bp, Homo sapiens
tgtgtctttcacagctcc

SEQ ID NO: 2432470 - DNA, 18 bp, Homo sapiens
tgtgtgaatgaacactct

SEQ ID NO: 2432471 - DNA, 16 bp, Homo sapiens
tgtgtgacttacagaa

SEQ ID NO: 2432472 - DNA, 21 bp, Homo sapiens
tgtgtgagtggagttgaggtg

SEQ ID NO: 2432473 - DNA, 14 bp, Homo sapiens
tgtgtgccctctgg

SEQ ID NO: 2432474 - DNA, 20 bp, Homo sapiens
tgtgtgctttttttgtgtgt

SEQ ID NO: 2432475 - DNA, 14 bp, Homo sapiens
tgtgtggacaggac

SEQ ID NO: 2432476 - DNA, 12 bp, Homo sapiens
tgtgtgtatgca

SEQ ID NO: 2432477 - DNA, 14 bp, Homo sapiens
tgtgtgtatttgct

SEQ ID NO: 2432478 - DNA, 19 bp, Homo sapiens
tgtgtgtccaaaactgcct

SEQ ID NO: 2432479 - DNA, 22 bp, Homo sapiens
tgtgtgtgccctctgggctctg

SEQ ID NO: 2432480 - DNA, 16 bp, Homo sapiens
tgtgtgttgatactgt

SEQ ID NO: 2432481 - DNA, 19 bp, Homo sapiens
tgtgttatgcaaaagcaag

SEQ ID NO: 2432482 - DNA, 22 bp, Homo sapiens
tgtgttgatactgttgcacgtg

SEQ ID NO: 2432483 - DNA, 23 bp, Homo sapiens
tgtgttgatactgttgcacgtgt

SEQ ID NO: 2432484 - DNA, 18 bp, Homo sapiens
tgtgtttcacagtttgaa

SEQ ID NO: 2432485 - DNA, 21 bp, Homo sapiens
tgtgtttcacagtttgaaata

SEQ ID NO: 2432486 - DNA, 12 bp, Homo sapiens
tgtgtttccaca

SEQ ID NO: 2432487 - DNA, 16 bp, Homo sapiens
tgtgtttggctttcag

SEQ ID NO: 2432488 - DNA, 22 bp, Homo sapiens
tgtgtttttctattaaaagact

SEQ ID NO: 2432489 - DNA, 22 bp, Homo sapiens
tgttaaaaaaataagaagaatg

SEQ ID NO: 2432490 - DNA, 22 bp, Homo sapiens
tgttaacagaagggagggcaga

SEQ ID NO: 2432491 - DNA, 15 bp, Homo sapiens
tgttaacattccaag

SEQ ID NO: 2432492 - DNA, 20 bp, Homo sapiens
tgttaacattccaagactct

SEQ ID NO: 2432493 - DNA, 12 bp, Homo sapiens
tgttaactgaat

SEQ ID NO: 2432494 - DNA, 15 bp, Homo sapiens
tgttaactgaatacc

SEQ ID NO: 2432495 - DNA, 17 bp, Homo sapiens
tgttaactgaataccac

SEQ ID NO: 2432496 - DNA, 19 bp, Homo sapiens
tgttaatattgatttatta

SEQ ID NO: 2432497 - DNA, 16 bp, Homo sapiens
tgttaatttttgatac

SEQ ID NO: 2432498 - DNA, 15 bp, Homo sapiens
tgttacattattatc

SEQ ID NO: 2432499 - DNA, 23 bp, Homo sapiens
tgttaccaaaaataaatatatct

SEQ ID NO: 2432500 - DNA, 23 bp, Homo sapiens
tgttacctgaaaacactgtgcac

SEQ ID NO: 2432501 - DNA, 20 bp, Homo sapiens
tgttagccttttttccccag

SEQ ID NO: 2432502 - DNA, 20 bp, Homo sapiens
tgttagttaccttatagtta

SEQ ID NO: 2432503 - DNA, 16 bp, Homo sapiens
tgttatacaatacaga

SEQ ID NO: 2432504 - DNA, 13 bp, Homo sapiens
tgttatatataaa

SEQ ID NO: 2432505 - DNA, 15 bp, Homo sapiens
tgttatatataaata

SEQ ID NO: 2432506 - DNA, 17 bp, Homo sapiens
tgttatatataaatata

SEQ ID NO: 2432507 - DNA, 22 bp, Homo sapiens
tgttatcaaacaccaacataaa

SEQ ID NO: 2432508 - DNA, 22 bp, Homo sapiens
tgttatcttctcaagttctaag

SEQ ID NO: 2432509 - DNA, 20 bp, Homo sapiens
tgttatgttttcgaaaatca

SEQ ID NO: 2432510 - DNA, 21 bp, Homo sapiens
tgttatgttttcgaaaatcaa

SEQ ID NO: 2432511 - DNA, 21 bp, Homo sapiens
tgttattagagattacctcct

SEQ ID NO: 2432512 - DNA, 16 bp, Homo sapiens
tgttattatctgggct

SEQ ID NO: 2432513 - DNA, 18 bp, Homo sapiens
tgttattttttaattatt

SEQ ID NO: 2432514 - DNA, 15 bp, Homo sapiens
tgttcaaagctgcct

SEQ ID NO: 2432515 - DNA, 15 bp, Homo sapiens
tgttcaccattataa

SEQ ID NO: 2432516 - DNA, 17 bp, Homo sapiens
tgttcacttttgacaaa

SEQ ID NO: 2432517 - DNA, 20 bp, Homo sapiens
tgttcatagcccagtagacc

SEQ ID NO: 2432518 - DNA, 13 bp, Homo sapiens
tgttcatggcaga

SEQ ID NO: 2432519 - DNA, 19 bp, Homo sapiens
tgttccaaattcagtttca

SEQ ID NO: 2432520 - DNA, 21 bp, Homo sapiens
tgttccaaattcagtttcata

SEQ ID NO: 2432521 - DNA, 16 bp, Homo sapiens
tgttcccaagagcatc

SEQ ID NO: 2432522 - DNA, 16 bp, Homo sapiens
tgttccctatccaatc

SEQ ID NO: 2432523 - DNA, 18 bp, Homo sapiens
tgttccctctccctgttg

SEQ ID NO: 2432524 - DNA, 22 bp, Homo sapiens
tgttccttccagtgtcatttct

SEQ ID NO: 2432525 - DNA, 19 bp, Homo sapiens
tgttccttccgcttggagc

SEQ ID NO: 2432526 - DNA, 22 bp, Homo sapiens
tgttcgcatggtcacacactga

SEQ ID NO: 2432527 - DNA, 16 bp, Homo sapiens
tgttctaaagctctga

SEQ ID NO: 2432528 - DNA, 18 bp, Homo sapiens
tgttctaaagctctgaca

SEQ ID NO: 2432529 - DNA, 19 bp, Homo sapiens
tgttctaaagctctgacat

SEQ ID NO: 2432530 - DNA, 16 bp, Homo sapiens
tgttctaagatgtgat

SEQ ID NO: 2432531 - DNA, 17 bp, Homo sapiens
tgttctaagtctttcca

SEQ ID NO: 2432532 - DNA, 16 bp, Homo sapiens
tgttctaagtttctaa

SEQ ID NO: 2432533 - DNA, 22 bp, Homo sapiens
tgttctaagtttctaagattct

SEQ ID NO: 2432534 - DNA, 23 bp, Homo sapiens
tgttctcacactggtctgctgtc

SEQ ID NO: 2432535 - DNA, 12 bp, Homo sapiens
tgttctcagatt

SEQ ID NO: 2432536 - DNA, 11 bp, Homo sapiens
tgttctcctgc

SEQ ID NO: 2432537 - DNA, 21 bp, Homo sapiens
tgttctgttaactgaatacca

SEQ ID NO: 2432538 - DNA, 14 bp, Homo sapiens
tgttctgtttcaag

SEQ ID NO: 2432539 - DNA, 20 bp, Homo sapiens
tgttcttagctcaatgagca

SEQ ID NO: 2432540 - DNA, 15 bp, Homo sapiens
tgttcttcctcagcc

SEQ ID NO: 2432541 - DNA, 16 bp, Homo sapiens
tgttcttcctcagcca

SEQ ID NO: 2432542 - DNA, 17 bp, Homo sapiens
tgttcttcctcagccag

SEQ ID NO: 2432543 - DNA, 21 bp, Homo sapiens
tgttcttcctcagccagcctc

SEQ ID NO: 2432544 - DNA, 13 bp, Homo sapiens
tgttcttgaattt

SEQ ID NO: 2432545 - DNA, 13 bp, Homo sapiens
tgttcttgtattt

SEQ ID NO: 2432546 - DNA, 18 bp, Homo sapiens
tgttctttggaaagtaca

SEQ ID NO: 2432547 - DNA, 13 bp, Homo sapiens
tgttctttttaga

SEQ ID NO: 2432548 - DNA, 18 bp, Homo sapiens
tgttgaaaaagtttgttt

SEQ ID NO: 2432549 - DNA, 23 bp, Homo sapiens
tgttgaaaggttttttttcagtt

SEQ ID NO: 2432550 - DNA, 17 bp, Homo sapiens
tgttgacattctgaatg

SEQ ID NO: 2432551 - DNA, 18 bp, Homo sapiens
tgttgacattctgaatgc

SEQ ID NO: 2432552 - DNA, 23 bp, Homo sapiens
tgttgacattctgaatgcttcta

SEQ ID NO: 2432553 - DNA, 23 bp, Homo sapiens
tgttgagaatcccaaatttgatt

SEQ ID NO: 2432554 - DNA, 16 bp, Homo sapiens
tgttgagcatcacaga

SEQ ID NO: 2432555 - DNA, 20 bp, Homo sapiens
tgttgagcatcacagaatgt

SEQ ID NO: 2432556 - DNA, 19 bp, Homo sapiens
tgttgatactgttgcacgt

SEQ ID NO: 2432557 - DNA, 21 bp, Homo sapiens
tgttgatactgttgcacgtgt

SEQ ID NO: 2432558 - DNA, 15 bp, Homo sapiens
tgttgatcaaccatt

SEQ ID NO: 2432559 - DNA, 14 bp, Homo sapiens
tgttgcgttccttt

SEQ ID NO: 2432560 - DNA, 21 bp, Homo sapiens
tgttggcaggctggccagtcc

SEQ ID NO: 2432561 - DNA, 22 bp, Homo sapiens
tgttggcgtaggctacagagaa

SEQ ID NO: 2432562 - DNA, 24 bp, Homo sapiens
tgttggcgtaggctacagagaagc

SEQ ID NO: 2432563 - DNA, 21 bp, Homo sapiens
ttattataatcttataattgt

SEQ ID NO: 2432564 - DNA, 16 bp, Homo sapiens
ttattattatttttta

SEQ ID NO: 2432565 - DNA, 22 bp, Homo sapiens
ttattatttgtgttttaattta

SEQ ID NO: 2432566 - DNA, 22 bp, Homo sapiens
ttattccagaatgctgtacatc

SEQ ID NO: 2432567 - DNA, 16 bp, Homo sapiens
ttattccatgactgct

SEQ ID NO: 2432568 - DNA, 13 bp, Homo sapiens
ttattcccttcct

SEQ ID NO: 2432569 - DNA, 18 bp, Homo sapiens
ttattcccttcctgccag

SEQ ID NO: 2432570 - DNA, 19 bp, Homo sapiens
ttattcgtagatattggac

SEQ ID NO: 2432571 - DNA, 13 bp, Homo sapiens
ttattcttctaga

SEQ ID NO: 2432572 - DNA, 14 bp, Homo sapiens
ttattcttctagag

SEQ ID NO: 2432573 - DNA, 13 bp, Homo sapiens
ttattgtattctg

SEQ ID NO: 2432574 - DNA, 23 bp, Homo sapiens
ttatttaaaccgctaaaagaaac

SEQ ID NO: 2432575 - DNA, 20 bp, Homo sapiens
ttatttaaactctgttgcaa

SEQ ID NO: 2432576 - DNA, 19 bp, Homo sapiens
ttatttcatgattagaaat

SEQ ID NO: 2432577 - DNA, 13 bp, Homo sapiens
ttatttctgcata

SEQ ID NO: 2432578 - DNA, 15 bp, Homo sapiens
ttatttctgcatatg

SEQ ID NO: 2432579 - DNA, 20 bp, Homo sapiens
ttatttctgcatatgttgaa

SEQ ID NO: 2432580 - DNA, 17 bp, Homo sapiens
ttatttgtaatagatgt

SEQ ID NO: 2432581 - DNA, 22 bp, Homo sapiens
ttatttgtgttttaatttaaac

SEQ ID NO: 2432582 - DNA, 11 bp, Homo sapiens
ttattttgatg

SEQ ID NO: 2432583 - DNA, 13 bp, Homo sapiens
ttattttgatgta

SEQ ID NO: 2432584 - DNA, 22 bp, Homo sapiens
ttattttgtgatgcaaataaat

SEQ ID NO: 2432585 - DNA, 14 bp, Homo sapiens
ttatttttcttgtc

SEQ ID NO: 2432586 - DNA, 17 bp, Homo sapiens
ttcaaaaccttttgaaa

SEQ ID NO: 2432587 - DNA, 13 bp, Homo sapiens
ttcaaaagggaag

SEQ ID NO: 2432588 - DNA, 15 bp, Homo sapiens
ttcaaaagttccaag

SEQ ID NO: 2432589 - DNA, 19 bp, Homo sapiens
ttcaaaatagggtatattt

SEQ ID NO: 2432590 - DNA, 17 bp, Homo sapiens
ttcaaaatgctttttat

SEQ ID NO: 2432591 - DNA, 23 bp, Homo sapiens
ttcaaaatgttatcttctcaagt

SEQ ID NO: 2432592 - DNA, 12 bp, Homo sapiens
ttcaaagatgct

SEQ ID NO: 2432593 - DNA, 21 bp, Homo sapiens
ttcaaagccagcgtcctcctc

SEQ ID NO: 2432594 - DNA, 20 bp, Homo sapiens
ttcaaagctgtgtgtttgga

SEQ ID NO: 2432595 - DNA, 21 bp, Homo sapiens
ttcaaaggttctaggtttcaa

SEQ ID NO: 2432596 - DNA, 13 bp, Homo sapiens
ttcaaagtgttat

SEQ ID NO: 2432597 - DNA, 19 bp, Homo sapiens
ttcaaagtttaataaattt

SEQ ID NO: 2432598 - DNA, 14 bp, Homo sapiens
ttcaacacagcttg

SEQ ID NO: 2432599 - DNA, 19 bp, Homo sapiens
ttcaacagtgaagacagaa

SEQ ID NO: 2432600 - DNA, 15 bp, Homo sapiens
ttcaagaggagcccc

SEQ ID NO: 2432601 - DNA, 22 bp, Homo sapiens
ttcaagcagtcgtgcctgtgtc

SEQ ID NO: 2432602 - DNA, 20 bp, Homo sapiens
ttcaagcctgtgcaatgcat

SEQ ID NO: 2432603 - DNA, 14 bp, Homo sapiens
ttcaagctctgagg

SEQ ID NO: 2432604 - DNA, 19 bp, Homo sapiens
ttcaaggcactctagattc

SEQ ID NO: 2432605 - DNA, 22 bp, Homo sapiens
ttcaaggcactctagattccat

SEQ ID NO: 2432606 - DNA, 17 bp, Homo sapiens
ttcaatacagatatatt

SEQ ID NO: 2432607 - DNA, 18 bp, Homo sapiens
ttcaatacagatatattt

SEQ ID NO: 2432608 - DNA, 16 bp, Homo sapiens
ttcaatattttctttt

SEQ ID NO: 2432609 - DNA, 18 bp, Homo sapiens
ttcaatcaactttactgt

SEQ ID NO: 2432610 - DNA, 19 bp, Homo sapiens
ttcaattgcatctcccaga

SEQ ID NO: 2432611 - DNA, 22 bp, Homo sapiens
ttcacaaacttttatactcttt

SEQ ID NO: 2432612 - DNA, 22 bp, Homo sapiens
ttcacaacagcctgacaacatt

SEQ ID NO: 2432613 - DNA, 13 bp, Homo sapiens
ttcacagaaaata

SEQ ID NO: 2432614 - DNA, 12 bp, Homo sapiens
ttcacagctcct

SEQ ID NO: 2432615 - DNA, 12 bp, Homo sapiens
ttcacaggcagc

SEQ ID NO: 2432616 - DNA, 19 bp, Homo sapiens
ttcacagtacccaaactgc

SEQ ID NO: 2432617 - DNA, 14 bp, Homo sapiens
ttcacagtttgaaa

SEQ ID NO: 2432618 - DNA, 23 bp, Homo sapiens
ttcacagtttgaaataagctatt

SEQ ID NO: 2432619 - DNA, 21 bp, Homo sapiens
ttcacatcgcagattctccct

SEQ ID NO: 2432620 - DNA, 20 bp, Homo sapiens
ttcacatctaacctcatctt

SEQ ID NO: 2432621 - DNA, 15 bp, Homo sapiens
ttcaccattataatg

SEQ ID NO: 2432622 - DNA, 13 bp, Homo sapiens
ttcaccccaccct

SEQ ID NO: 2432623 - DNA, 19 bp, Homo sapiens
ttcacgcctgaggcaatta

SEQ ID NO: 2432624 - DNA, 20 bp, Homo sapiens
ttcactgtcaccaccctgct

SEQ ID NO: 2432625 - DNA, 19 bp, Homo sapiens
ttcactgtctttaattctg

SEQ ID NO: 2432626 - DNA, 15 bp, Homo sapiens
ttcagaaaatgttct

SEQ ID NO: 2432627 - DNA, 16 bp, Homo sapiens
ttcagaaagacttggt

SEQ ID NO: 2432628 - DNA, 22 bp, Homo sapiens
ttcagaaccccaactactgtgt

SEQ ID NO: 2432629 - DNA, 20 bp, Homo sapiens
ttcagactcccattcctgaa

SEQ ID NO: 2432630 - DNA, 13 bp, Homo sapiens
ttcagagagcagt

SEQ ID NO: 2432631 - DNA, 21 bp, Homo sapiens
ttcagagagcagtgcttttgg

SEQ ID NO: 2432632 - DNA, 22 bp, Homo sapiens
ttcagagagcagtgcttttggc

SEQ ID NO: 2432633 - DNA, 23 bp, Homo sapiens
ttcagaggccctcgctgccagct

SEQ ID NO: 2432634 - DNA, 13 bp, Homo sapiens
ttcagaggctcag

SEQ ID NO: 2432635 - DNA, 23 bp, Homo sapiens
ttcagagttctttttgaagtatt

SEQ ID NO: 2432636 - DNA, 22 bp, Homo sapiens
ttcagatatcttggacaaatca

SEQ ID NO: 2432637 - DNA, 12 bp, Homo sapiens
ttcagatttggc

SEQ ID NO: 2432638 - DNA, 18 bp, Homo sapiens
ttcagcaagacttctctt

SEQ ID NO: 2432639 - DNA, 20 bp, Homo sapiens
ttcagcactgtcccttgcct

SEQ ID NO: 2432640 - DNA, 21 bp, Homo sapiens
ttcagcactgtcccttgcctc

SEQ ID NO: 2432641 - DNA, 19 bp, Homo sapiens
ttcagcatccgcaggtgct

SEQ ID NO: 2432642 - DNA, 11 bp, Homo sapiens
ttcagcatttg

SEQ ID NO: 2432643 - DNA, 13 bp, Homo sapiens
ttcagcccatctc

SEQ ID NO: 2432644 - DNA, 10 bp, Homo sapiens
ttcagctcct

SEQ ID NO: 2432645 - DNA, 16 bp, Homo sapiens
ttcagctgtcttttgg

SEQ ID NO: 2432646 - DNA, 13 bp, Homo sapiens
ttcaggaaaattg

SEQ ID NO: 2432647 - DNA, 22 bp, Homo sapiens
ttcaggatctatttttggaggt

SEQ ID NO: 2432648 - DNA, 23 bp, Homo sapiens
ttcagggaaggaggagcctgtcc

SEQ ID NO: 2432649 - DNA, 14 bp, Homo sapiens
ttcaggtccaggct

SEQ ID NO: 2432650 - DNA, 21 bp, Homo sapiens
ttcagtaccctctcagctcca

SEQ ID NO: 2432651 - DNA, 18 bp, Homo sapiens
ttcagtgttaaatgtgat

SEQ ID NO: 2432652 - DNA, 22 bp, Homo sapiens
ttcagtgttaaatgtgatgaat

SEQ ID NO: 2432653 - DNA, 16 bp, Homo sapiens
ttcagttctaggaaaa

SEQ ID NO: 2432654 - DNA, 13 bp, Homo sapiens
ttcagtttcataa

SEQ ID NO: 2432655 - DNA, 21 bp, Homo sapiens
ttcagttttcatttggttcat

SEQ ID NO: 2432656 - DNA, 17 bp, Homo sapiens
ttcataggtctgaaatt

SEQ ID NO: 2432657 - DNA, 17 bp, Homo sapiens
ttcatattttaaacaga

SEQ ID NO: 2432658 - DNA, 22 bp, Homo sapiens
ttcatattttaaacagaggata

SEQ ID NO: 2432659 - DNA, 22 bp, Homo sapiens
ttcatctcccacctagcagcac

SEQ ID NO: 2432660 - DNA, 17 bp, Homo sapiens
ttcatcttcagttgtct

SEQ ID NO: 2432661 - DNA, 15 bp, Homo sapiens
ttcatgataatgaac

SEQ ID NO: 2432662 - DNA, 17 bp, Homo sapiens
ttcatgatttcatttca

SEQ ID NO: 2432663 - DNA, 15 bp, Homo sapiens
ttcatgcaaactctt

SEQ ID NO: 2432664 - DNA, 20 bp, Homo sapiens
ttcatgcaaactctttggtc

SEQ ID NO: 2432665 - DNA, 19 bp, Homo sapiens
ttcatgccaccatggccag

SEQ ID NO: 2432666 - DNA, 19 bp, Homo sapiens
ttcatgtaaactgtgcacc

SEQ ID NO: 2432667 - DNA, 16 bp, Homo sapiens
ttgacactgctctaac

SEQ ID NO: 2432668 - DNA, 14 bp, Homo sapiens
ttgacagtgttttt

SEQ ID NO: 2432669 - DNA, 13 bp, Homo sapiens
ttgacattctgaa

SEQ ID NO: 2432670 - DNA, 20 bp, Homo sapiens
ttgaccgcgactaatttcaa

SEQ ID NO: 2432671 - DNA, 13 bp, Homo sapiens
ttgacctgaggct

SEQ ID NO: 2432672 - DNA, 23 bp, Homo sapiens
ttgactagatgatggatgccaat

SEQ ID NO: 2432673 - DNA, 20 bp, Homo sapiens
ttgactcaggagcctgtgac

SEQ ID NO: 2432674 - DNA, 21 bp, Homo sapiens
ttgactcttttgccattaaac

SEQ ID NO: 2432675 - DNA, 19 bp, Homo sapiens
ttgactttccccaccagat

SEQ ID NO: 2432676 - DNA, 18 bp, Homo sapiens
ttgacttttctgtaattc

SEQ ID NO: 2432677 - DNA, 21 bp, Homo sapiens
ttgagaaatatggacacttaa

SEQ ID NO: 2432678 - DNA, 23 bp, Homo sapiens
ttgagaatcccaaatttgattga

SEQ ID NO: 2432679 - DNA, 21 bp, Homo sapiens
ttgagatggagtcttgctctg

SEQ ID NO: 2432680 - DNA, 17 bp, Homo sapiens
ttgagatggtgaggctg

SEQ ID NO: 2432681 - DNA, 15 bp, Homo sapiens
ttgagcatctgtccc

SEQ ID NO: 2432682 - DNA, 18 bp, Homo sapiens
ttgagctctctcattgtc

SEQ ID NO: 2432683 - DNA, 15 bp, Homo sapiens
ttgaggaaagcaaga

SEQ ID NO: 2432684 - DNA, 13 bp, Homo sapiens
ttgaggacttctt

SEQ ID NO: 2432685 - DNA, 17 bp, Homo sapiens
ttgaggggaccaggagt

SEQ ID NO: 2432686 - DNA, 12 bp, Homo sapiens
ttgagtaatggt

SEQ ID NO: 2432687 - DNA, 23 bp, Homo sapiens
ttgagtttgtcgctcatgtgtgc

SEQ ID NO: 2432688 - DNA, 14 bp, Homo sapiens
ttgagttttcagtg

SEQ ID NO: 2432689 - DNA, 14 bp, Homo sapiens
ttgataaagatttt

SEQ ID NO: 2432690 - DNA, 17 bp, Homo sapiens
ttgataaagatttttta

SEQ ID NO: 2432691 - DNA, 18 bp, Homo sapiens
ttgataagatcttttatt

SEQ ID NO: 2432692 - DNA, 15 bp, Homo sapiens
ttgatacccccctct

SEQ ID NO: 2432693 - DNA, 15 bp, Homo sapiens
ttgatactaagcatt

SEQ ID NO: 2432694 - DNA, 17 bp, Homo sapiens
ttgatactgttgcacgt

SEQ ID NO: 2432695 - DNA, 15 bp, Homo sapiens
ttgatagaaatgcca

SEQ ID NO: 2432696 - DNA, 13 bp, Homo sapiens
ttgatagaaccat

SEQ ID NO: 2432697 - DNA, 20 bp, Homo sapiens
ttgatcagccccaccctggc

SEQ ID NO: 2432698 - DNA, 18 bp, Homo sapiens
ttgatcagttaagaaatt

SEQ ID NO: 2432699 - DNA, 16 bp, Homo sapiens
ttgatgtaaaatcttg

SEQ ID NO: 2432700 - DNA, 18 bp, Homo sapiens
ttgatgtaaaatcttgtc

SEQ ID NO: 2432701 - DNA, 14 bp, Homo sapiens
ttgatgtaaagatg

SEQ ID NO: 2432702 - DNA, 17 bp, Homo sapiens
ttgattacagtgcagtg

SEQ ID NO: 2432703 - DNA, 21 bp, Homo sapiens
ttgattatccatattgagtca

SEQ ID NO: 2432704 - DNA, 15 bp, Homo sapiens
ttgattattcagtgt

SEQ ID NO: 2432705 - DNA, 23 bp, Homo sapiens
ttgattcggtatccccccatctt

SEQ ID NO: 2432706 - DNA, 12 bp, Homo sapiens
ttgattctgcag

SEQ ID NO: 2432707 - DNA, 19 bp, Homo sapiens
ttgatttgcattgaacaca

SEQ ID NO: 2432708 - DNA, 14 bp, Homo sapiens
ttgatttttctctt

SEQ ID NO: 2432709 - DNA, 16 bp, Homo sapiens
ttgatttttctcttca

SEQ ID NO: 2432710 - DNA, 19 bp, Homo sapiens
ttgcaaaaactacaaccaa

SEQ ID NO: 2432711 - DNA, 15 bp, Homo sapiens
ttgcaaagaaagaaa

SEQ ID NO: 2432712 - DNA, 15 bp, Homo sapiens
ttgcaaatcttgaaa

SEQ ID NO: 2432713 - DNA, 16 bp, Homo sapiens
ttgcaaatcttgaaat

SEQ ID NO: 2432714 - DNA, 22 bp, Homo sapiens
ttgcaaatgtagtatggcctgt

SEQ ID NO: 2432715 - DNA, 22 bp, Homo sapiens
ttgcaatatctgaagccctccc

SEQ ID NO: 2432716 - DNA, 21 bp, Homo sapiens
ttgcacagtcactgctcttca

SEQ ID NO: 2432717 - DNA, 21 bp, Homo sapiens
ttgcaccccaaagctttcctg

SEQ ID NO: 2432718 - DNA, 22 bp, Homo sapiens
ttgcaccccaaagctttcctgc

SEQ ID NO: 2432719 - DNA, 15 bp, Homo sapiens
ttgcactatctttca

SEQ ID NO: 2432720 - DNA, 19 bp, Homo sapiens
ttgcagaaaattctgtgcc

SEQ ID NO: 2432721 - DNA, 16 bp, Homo sapiens
ttgcagacaggaatct

SEQ ID NO: 2432722 - DNA, 17 bp, Homo sapiens
ttgcagcacagctgaga

SEQ ID NO: 2432723 - DNA, 15 bp, Homo sapiens
ttgcagcgactggca

SEQ ID NO: 2432724 - DNA, 12 bp, Homo sapiens
ttgcagctgttt

SEQ ID NO: 2432725 - DNA, 18 bp, Homo sapiens
ttgcagctgttttgttga

SEQ ID NO: 2432726 - DNA, 20 bp, Homo sapiens
ttgcagctgttttgttgaca

SEQ ID NO: 2432727 - DNA, 17 bp, Homo sapiens
ttgcagggtcctcttct

SEQ ID NO: 2432728 - DNA, 23 bp, Homo sapiens
ttgcaggtggccaagttcctcta

SEQ ID NO: 2432729 - DNA, 23 bp, Homo sapiens
ttgcagtcccaagcggtgtctct

SEQ ID NO: 2432730 - DNA, 20 bp, Homo sapiens
ttgcagtttatcattcaagt

SEQ ID NO: 2432731 - DNA, 23 bp, Homo sapiens
ttgcagtttatcattcaagtgta

SEQ ID NO: 2432732 - DNA, 19 bp, Homo sapiens
ttgcataacaattcctcta

SEQ ID NO: 2432733 - DNA, 13 bp, Homo sapiens
ttgcatgatatct

SEQ ID NO: 2432734 - DNA, 17 bp, Homo sapiens
ttgcatgatatcttcaa

SEQ ID NO: 2432735 - DNA, 19 bp, Homo sapiens
ttgcatgtagtaacactaa

SEQ ID NO: 2432736 - DNA, 21 bp, Homo sapiens
ttgcatgtagtaacactaata

SEQ ID NO: 2432737 - DNA, 13 bp, Homo sapiens
ttgcattaaatta

SEQ ID NO: 2432738 - DNA, 20 bp, Homo sapiens
ttgcattaaattcacaaact

SEQ ID NO: 2432739 - DNA, 13 bp, Homo sapiens
ttgcattgacttt

SEQ ID NO: 2432740 - DNA, 19 bp, Homo sapiens
ttgccaaaaagtgaaataa

SEQ ID NO: 2432741 - DNA, 23 bp, Homo sapiens
ttgccaaaaagtgaaataatgtg

SEQ ID NO: 2432742 - DNA, 18 bp, Homo sapiens
ttgccaaatatgtcctgg

SEQ ID NO: 2432743 - DNA, 16 bp, Homo sapiens
ttgccaaggcagaggc

SEQ ID NO: 2432744 - DNA, 18 bp, Homo sapiens
ttgccacctctaacagca

SEQ ID NO: 2432745 - DNA, 19 bp, Homo sapiens
ttgccatattttcaccatt

SEQ ID NO: 2432746 - DNA, 20 bp, Homo sapiens
ttgccatgacaacttctaat

SEQ ID NO: 2432747 - DNA, 21 bp, Homo sapiens
ttgcccacgtacccaggtctg

SEQ ID NO: 2432748 - DNA, 18 bp, Homo sapiens
ttgcccaggctggtctca

SEQ ID NO: 2432749 - DNA, 14 bp, Homo sapiens
ttgccccaagtcct

SEQ ID NO: 2432750 - DNA, 21 bp, Homo sapiens
ttgcccccgtgagccaatccc

SEQ ID NO: 2432751 - DNA, 16 bp, Homo sapiens
ttgccctaagcagaaa

SEQ ID NO: 2432752 - DNA, 12 bp, Homo sapiens
ttgcctctgtgc

SEQ ID NO: 2432753 - DNA, 13 bp, Homo sapiens
ttgcctctgtgct

SEQ ID NO: 2432754 - DNA, 14 bp, Homo sapiens
ttgcctctgtgctg

SEQ ID NO: 2432755 - DNA, 19 bp, Homo sapiens
ttgcctctgtgctgtgtgt

SEQ ID NO: 2432756 - DNA, 19 bp, Homo sapiens
ttgcctgaactcctgccat

SEQ ID NO: 2432757 - DNA, 18 bp, Homo sapiens
ttgcctgccactgtgtga

SEQ ID NO: 2432758 - DNA, 12 bp, Homo sapiens
ttgcctgccttt

SEQ ID NO: 2432759 - DNA, 23 bp, Homo sapiens
ttgcctgcctttccatccatggc

SEQ ID NO: 2432760 - DNA, 12 bp, Homo sapiens
ttgcctggtaca

SEQ ID NO: 2432761 - DNA, 13 bp, Homo sapiens
ttgcctggtacag

SEQ ID NO: 2432762 - DNA, 13 bp, Homo sapiens
ttgcctttaacag

SEQ ID NO: 2432763 - DNA, 16 bp, Homo sapiens
ttgcgagagatgtgtg

SEQ ID NO: 2432764 - DNA, 17 bp, Homo sapiens
ttgcgagagatgtgtgt

SEQ ID NO: 2432765 - DNA, 14 bp, Homo sapiens
ttgcggctcctcag

SEQ ID NO: 2432766 - DNA, 14 bp, Homo sapiens
ttgcggttcaggaa

SEQ ID NO: 2432767 - DNA, 22 bp, Homo sapiens
ttgctaaaggaaaaaaccatcc

SEQ ID NO: 2432768 - DNA, 12 bp, Homo sapiens
ttgctaccagta

SEQ ID NO: 2432769 - DNA, 20 bp, Homo sapiens
ttgctaccagtatttagaag

SEQ ID NO: 2432770 - DNA, 22 bp, Homo sapiens
ttgctaccagtatttagaagcc

SEQ ID NO: 2432771 - DNA, 16 bp, Homo sapiens
tttcatccataactga

SEQ ID NO: 2432772 - DNA, 16 bp, Homo sapiens
tttcatctcttgtata

SEQ ID NO: 2432773 - DNA, 22 bp, Homo sapiens
tttcatcttcagttgtctctga

SEQ ID NO: 2432774 - DNA, 18 bp, Homo sapiens
tttcatgcaaactctttg

SEQ ID NO: 2432775 - DNA, 12 bp, Homo sapiens
tttcatgtacaa

SEQ ID NO: 2432776 - DNA, 19 bp, Homo sapiens
tttcatgttagttacctta

SEQ ID NO: 2432777 - DNA, 22 bp, Homo sapiens
tttcattaaataaatttgactt

SEQ ID NO: 2432778 - DNA, 13 bp, Homo sapiens
tttcattccttca

SEQ ID NO: 2432779 - DNA, 23 bp, Homo sapiens
tttcatttcttctacaactcata

SEQ ID NO: 2432780 - DNA, 23 bp, Homo sapiens
tttccaccacagccagcacctgg

SEQ ID NO: 2432781 - DNA, 23 bp, Homo sapiens
tttccacggagccactcctctga

SEQ ID NO: 2432782 - DNA, 18 bp, Homo sapiens
tttccagcattcccaggt

SEQ ID NO: 2432783 - DNA, 18 bp, Homo sapiens
tttccaggcttctgctgg

SEQ ID NO: 2432784 - DNA, 19 bp, Homo sapiens
tttccatccatggccagca

SEQ ID NO: 2432785 - DNA, 21 bp, Homo sapiens
tttccatggcaggaaggcttg

SEQ ID NO: 2432786 - DNA, 22 bp, Homo sapiens
tttccatgggaccacaactatt

SEQ ID NO: 2432787 - DNA, 18 bp, Homo sapiens
tttccattacaagtattt

SEQ ID NO: 2432788 - DNA, 18 bp, Homo sapiens
tttcccaggaccctgaag

SEQ ID NO: 2432789 - DNA, 19 bp, Homo sapiens
tttcccggacttagaaaac

SEQ ID NO: 2432790 - DNA, 17 bp, Homo sapiens
tttccctactgaagccc

SEQ ID NO: 2432791 - DNA, 23 bp, Homo sapiens
tttccctactgaagcccttgtga

SEQ ID NO: 2432792 - DNA, 15 bp, Homo sapiens
tttccctttgccttc

SEQ ID NO: 2432793 - DNA, 21 bp, Homo sapiens
tttcctaataaagttctgtac

SEQ ID NO: 2432794 - DNA, 17 bp, Homo sapiens
tttcctatgggaacaat

SEQ ID NO: 2432795 - DNA, 18 bp, Homo sapiens
tttcctcctcaggcacac

SEQ ID NO: 2432796 - DNA, 14 bp, Homo sapiens
tttcctctccacac

SEQ ID NO: 2432797 - DNA, 16 bp, Homo sapiens
tttcctggacactcag

SEQ ID NO: 2432798 - DNA, 22 bp, Homo sapiens
tttcctgggtggctactctgtg

SEQ ID NO: 2432799 - DNA, 14 bp, Homo sapiens
tttcgaaaatcaaa

SEQ ID NO: 2432800 - DNA, 17 bp, Homo sapiens
tttcggattttttccaa

SEQ ID NO: 2432801 - DNA, 14 bp, Homo sapiens
tttcgtttgtttgt

SEQ ID NO: 2432802 - DNA, 14 bp, Homo sapiens
tttctaaactggag

SEQ ID NO: 2432803 - DNA, 21 bp, Homo sapiens
tttctaaaggagtttatgttc

SEQ ID NO: 2432804 - DNA, 20 bp, Homo sapiens
tttctaactacaaaggttta

SEQ ID NO: 2432805 - DNA, 18 bp, Homo sapiens
tttctaagattctaaagg

SEQ ID NO: 2432806 - DNA, 20 bp, Homo sapiens
tttctaagcataaaagatga

SEQ ID NO: 2432807 - DNA, 14 bp, Homo sapiens
tttctaattatgta

SEQ ID NO: 2432808 - DNA, 17 bp, Homo sapiens
tttctaattatgtagct

SEQ ID NO: 2432809 - DNA, 23 bp, Homo sapiens
tttctaattgcttatttattgta

SEQ ID NO: 2432810 - DNA, 18 bp, Homo sapiens
tttctactttgaagtcat

SEQ ID NO: 2432811 - DNA, 23 bp, Homo sapiens
tttctatgggtgttatcacctag

SEQ ID NO: 2432812 - DNA, 17 bp, Homo sapiens
tttctattaaaagactc

SEQ ID NO: 2432813 - DNA, 19 bp, Homo sapiens
tttctattaaaagactcat

SEQ ID NO: 2432814 - DNA, 23 bp, Homo sapiens
tttctattaaaagactcatccgt

SEQ ID NO: 2432815 - DNA, 16 bp, Homo sapiens
tttctatttcactgga

SEQ ID NO: 2432816 - DNA, 19 bp, Homo sapiens
tttctatttcactggagca

SEQ ID NO: 2432817 - DNA, 17 bp, Homo sapiens
tttctatttctcctcca

SEQ ID NO: 2432818 - DNA, 20 bp, Homo sapiens
tttctcatccacataccctg

SEQ ID NO: 2432819 - DNA, 21 bp, Homo sapiens
tttctccaagagctacataat

SEQ ID NO: 2432820 - DNA, 12 bp, Homo sapiens
tttctccagctg

SEQ ID NO: 2432821 - DNA, 22 bp, Homo sapiens
tttctcctttaattgtaaagta

SEQ ID NO: 2432822 - DNA, 22 bp, Homo sapiens
tttctctaacttcaaggcccat

SEQ ID NO: 2432823 - DNA, 14 bp, Homo sapiens
tttctctcaacacc

SEQ ID NO: 2432824 - DNA, 21 bp, Homo sapiens
tttctctctttatacagctgt

SEQ ID NO: 2432825 - DNA, 13 bp, Homo sapiens
tttctctgcagaa

SEQ ID NO: 2432826 - DNA, 13 bp, Homo sapiens
tttctgaacagct

SEQ ID NO: 2432827 - DNA, 15 bp, Homo sapiens
tttctgaacagctgg

SEQ ID NO: 2432828 - DNA, 17 bp, Homo sapiens
tttctgaacagctggtg

SEQ ID NO: 2432829 - DNA, 15 bp, Homo sapiens
tttctgatcaaggcc

SEQ ID NO: 2432830 - DNA, 15 bp, Homo sapiens
tttctggatttcata

SEQ ID NO: 2432831 - DNA, 15 bp, Homo sapiens
tttctggttctaaca

SEQ ID NO: 2432832 - DNA, 15 bp, Homo sapiens
tttctgtaccagtta

SEQ ID NO: 2432833 - DNA, 17 bp, Homo sapiens
tttctgtataaatgtct

SEQ ID NO: 2432834 - DNA, 16 bp, Homo sapiens
tttctgttccaaattc

SEQ ID NO: 2432835 - DNA, 22 bp, Homo sapiens
tttctgttccaaattcagtttc

SEQ ID NO: 2432836 - DNA, 14 bp, Homo sapiens
tttctgttctagtt

SEQ ID NO: 2432837 - DNA, 21 bp, Homo sapiens
tttcttaaataagaaactttt

SEQ ID NO: 2432838 - DNA, 13 bp, Homo sapiens
tttcttaacttct

SEQ ID NO: 2432839 - DNA, 21 bp, Homo sapiens
tttcttaacttcttgcttctt

SEQ ID NO: 2432840 - DNA, 18 bp, Homo sapiens
tttcttcaccaaatcttg

SEQ ID NO: 2432841 - DNA, 16 bp, Homo sapiens
tttcttcactgcaaca

SEQ ID NO: 2432842 - DNA, 19 bp, Homo sapiens
tttcttcactgcaacatga

SEQ ID NO: 2432843 - DNA, 22 bp, Homo sapiens
tttcttcactgcaacatgatga

SEQ ID NO: 2432844 - DNA, 20 bp, Homo sapiens
tttcttgtctataaagcatt

SEQ ID NO: 2432845 - DNA, 19 bp, Homo sapiens
tttcttgtgcactggcacc

SEQ ID NO: 2432846 - DNA, 15 bp, Homo sapiens
tttctttacaaaaca

SEQ ID NO: 2432847 - DNA, 13 bp, Homo sapiens
tttctttctttct

SEQ ID NO: 2432848 - DNA, 20 bp, Homo sapiens
tttctttgaaaaaaaataaa

SEQ ID NO: 2432849 - DNA, 13 bp, Homo sapiens
tttctttgaataa

SEQ ID NO: 2432850 - DNA, 16 bp, Homo sapiens
tttcttttctctggta

SEQ ID NO: 2432851 - DNA, 23 bp, Homo sapiens
tttcttttggtaaagactggctt

SEQ ID NO: 2432852 - DNA, 11 bp, Homo sapiens
tttgaaaatgg

SEQ ID NO: 2432853 - DNA, 21 bp, Homo sapiens
tttgaaagaatagaacacagt

SEQ ID NO: 2432854 - DNA, 19 bp, Homo sapiens
tttgaaataagctatttga

SEQ ID NO: 2432855 - DNA, 18 bp, Homo sapiens
tttgaaattaacctctca

SEQ ID NO: 2432856 - DNA, 17 bp, Homo sapiens
tttgaaattatgtaaat

SEQ ID NO: 2432857 - DNA, 21 bp, Homo sapiens
tttgaaattatgtaaattatg

SEQ ID NO: 2432858 - DNA, 18 bp, Homo sapiens
tttgaagaacatgtgaga

SEQ ID NO: 2432859 - DNA, 16 bp, Homo sapiens
tttgaagctactgtgt

SEQ ID NO: 2432860 - DNA, 12 bp, Homo sapiens
tttgaaggcaaa

SEQ ID NO: 2432861 - DNA, 16 bp, Homo sapiens
tttgaagtgctgttta

SEQ ID NO: 2432862 - DNA, 23 bp, Homo sapiens
tttgaagttagctttaacttaaa

SEQ ID NO: 2432863 - DNA, 18 bp, Homo sapiens
tttgaatcacatgaatta

SEQ ID NO: 2432864 - DNA, 20 bp, Homo sapiens
tttgacattgcgtttgacct

SEQ ID NO: 2432865 - DNA, 19 bp, Homo sapiens
tttgaccttttatgtagta

SEQ ID NO: 2432866 - DNA, 13 bp, Homo sapiens
tttgacttttctg

SEQ ID NO: 2432867 - DNA, 17 bp, Homo sapiens
tttgagaaaaaggaaaa

SEQ ID NO: 2432868 - DNA, 21 bp, Homo sapiens
tttgagaaacaacaatttcta

SEQ ID NO: 2432869 - DNA, 13 bp, Homo sapiens
tttgagtgctctg

SEQ ID NO: 2432870 - DNA, 14 bp, Homo sapiens
tttgatacattttt

SEQ ID NO: 2432871 - DNA, 16 bp, Homo sapiens
tttgatactaagcatt

SEQ ID NO: 2432872 - DNA, 21 bp, Homo sapiens
tttgatactaagcattgaatg

SEQ ID NO: 2432873 - DNA, 23 bp, Homo sapiens
tttgatatagaagtataaagaat

SEQ ID NO: 2432874 - DNA, 23 bp, Homo sapiens
aaaccgctaaaagaaactttctt

SEQ ID NO: 2432875 - DNA, 21 bp, Homo sapiens
aaacctgagatttattaaaga

SEQ ID NO: 2432876 - DNA, 22 bp, Homo sapiens
aaacctgagatttattaaagaa

SEQ ID NO: 2432877 - DNA, 13 bp, Homo sapiens
aaaccttttgaaa

SEQ ID NO: 2432878 - DNA, 17 bp, Homo sapiens
aaactaaaaaattaaac

SEQ ID NO: 2432879 - DNA, 21 bp, Homo sapiens
aaactacaaccaatggaatgt

SEQ ID NO: 2432880 - DNA, 20 bp, Homo sapiens
aaactactttgctgctaata

SEQ ID NO: 2432881 - DNA, 18 bp, Homo sapiens
aaactagggccaagccca

SEQ ID NO: 2432882 - DNA, 22 bp, Homo sapiens
aaactataagcaagaaggcaaa

SEQ ID NO: 2432883 - DNA, 22 bp, Homo sapiens
aaactctgttacactttttgga

SEQ ID NO: 2432884 - DNA, 19 bp, Homo sapiens
aaactctgttgcaagtgca

SEQ ID NO: 2432885 - DNA, 18 bp, Homo sapiens
aaactgaagcagcctctc

SEQ ID NO: 2432886 - DNA, 22 bp, Homo sapiens
aaactgaagcagcctctcccca

SEQ ID NO: 2432887 - DNA, 16 bp, Homo sapiens
aaactgcatgaaaaat

SEQ ID NO: 2432888 - DNA, 12 bp, Homo sapiens
aaactggagact

SEQ ID NO: 2432889 - DNA, 21 bp, Homo sapiens
aaactggagactgtgtgtgcc

SEQ ID NO: 2432890 - DNA, 11 bp, Homo sapiens
aaactgtacag

SEQ ID NO: 2432891 - DNA, 17 bp, Homo sapiens
aaacttaaatgttatta

SEQ ID NO: 2432892 - DNA, 21 bp, Homo sapiens
aaacttaaatgttattatctg

SEQ ID NO: 2432893 - DNA, 20 bp, Homo sapiens
aaacttatgctgatttattt

SEQ ID NO: 2432894 - DNA, 20 bp, Homo sapiens
aaacttcagtttcacagaaa

SEQ ID NO: 2432895 - DNA, 19 bp, Homo sapiens
aaacttgcatcacttaacg

SEQ ID NO: 2432896 - DNA, 20 bp, Homo sapiens
aaacttggatacttggattt

SEQ ID NO: 2432897 - DNA, 24 bp, Homo sapiens
aaacttggctcgaatctctgtgcc

SEQ ID NO: 2432898 - DNA, 20 bp, Homo sapiens
aaactttcattccttcagat

SEQ ID NO: 2432899 - DNA, 19 bp, Homo sapiens
aaactttggaaccagactc

SEQ ID NO: 2432900 - DNA, 22 bp, Homo sapiens
aaactttttttctgtaccagtt

SEQ ID NO: 2432901 - DNA, 10 bp, Homo sapiens
aaagaaaaaa

SEQ ID NO: 2432902 - DNA, 23 bp, Homo sapiens
aaagaaaaaaaaccatcaagttg

SEQ ID NO: 2432903 - DNA, 13 bp, Homo sapiens
aaagaaaaaaatt

SEQ ID NO: 2432904 - DNA, 19 bp, Homo sapiens
aaagaaaaaaattgaaatg

SEQ ID NO: 2432905 - DNA, 22 bp, Homo sapiens
aaagaaaaaaattgaaatgtaa

SEQ ID NO: 2432906 - DNA, 13 bp, Homo sapiens
aaagaaccacttg

SEQ ID NO: 2432907 - DNA, 23 bp, Homo sapiens
aaagaacgtggtcagagtagaac

SEQ ID NO: 2432908 - DNA, 16 bp, Homo sapiens
aaagaagcccccagct

SEQ ID NO: 2432909 - DNA, 19 bp, Homo sapiens
aaagaattgtggtttatat

SEQ ID NO: 2432910 - DNA, 20 bp, Homo sapiens
aaagaattgttgggggtttt

SEQ ID NO: 2432911 - DNA, 22 bp, Homo sapiens
aaagacacattttttaggaaat

SEQ ID NO: 2432912 - DNA, 15 bp, Homo sapiens
aaagacgttttataa

SEQ ID NO: 2432913 - DNA, 18 bp, Homo sapiens
aaagacgttttataagca

SEQ ID NO: 2432914 - DNA, 20 bp, Homo sapiens
aaagacgttttataagcatc

SEQ ID NO: 2432915 - DNA, 12 bp, Homo sapiens
aaagactggctt

SEQ ID NO: 2432916 - DNA, 19 bp, Homo sapiens
aaagagaaacagttggtaa

SEQ ID NO: 2432917 - DNA, 22 bp, Homo sapiens
aaagagaaacagttggtaactt

SEQ ID NO: 2432918 - DNA, 13 bp, Homo sapiens
aaagagacagtga

SEQ ID NO: 2432919 - DNA, 15 bp, Homo sapiens
aaagagacagtgata

SEQ ID NO: 2432920 - DNA, 21 bp, Homo sapiens
aaagagacagtgatattggaa

SEQ ID NO: 2432921 - DNA, 16 bp, Homo sapiens
aaagagttcaagaaat

SEQ ID NO: 2432922 - DNA, 20 bp, Homo sapiens
aaagagttcaagaaataagt

SEQ ID NO: 2432923 - DNA, 13 bp, Homo sapiens
aaagatcccaaat

SEQ ID NO: 2432924 - DNA, 18 bp, Homo sapiens
aaagatctgtcctcagcc

SEQ ID NO: 2432925 - DNA, 20 bp, Homo sapiens
aaagatgagctttgtctact

SEQ ID NO: 2432926 - DNA, 12 bp, Homo sapiens
aaagatgcactt

SEQ ID NO: 2432927 - DNA, 22 bp, Homo sapiens
aaagatgcactttgctttaata

SEQ ID NO: 2432928 - DNA, 19 bp, Homo sapiens
aaagatggagtttctaagg

SEQ ID NO: 2432929 - DNA, 12 bp, Homo sapiens
aaagattctata

SEQ ID NO: 2432930 - DNA, 20 bp, Homo sapiens
aaagattctatagttctaga

SEQ ID NO: 2432931 - DNA, 21 bp, Homo sapiens
aaagattctatagttctagac

SEQ ID NO: 2432932 - DNA, 15 bp, Homo sapiens
aaagattgagagaat

SEQ ID NO: 2432933 - DNA, 14 bp, Homo sapiens
aaagattttttaat

SEQ ID NO: 2432934 - DNA, 19 bp, Homo sapiens
aaagattttttaataattt

SEQ ID NO: 2432935 - DNA, 23 bp, Homo sapiens
aaagattttttttttttctctca

SEQ ID NO: 2432936 - DNA, 14 bp, Homo sapiens
aaagcaaaaaagaa

SEQ ID NO: 2432937 - DNA, 20 bp, Homo sapiens
aaagcaagcattcagaagaa

SEQ ID NO: 2432938 - DNA, 14 bp, Homo sapiens
aaagcaatatgcat

SEQ ID NO: 2432939 - DNA, 19 bp, Homo sapiens
aaagcagaatagtattttt

SEQ ID NO: 2432940 - DNA, 15 bp, Homo sapiens
aaagcagccacgagg

SEQ ID NO: 2432941 - DNA, 15 bp, Homo sapiens
aaagcaggttcttgt

SEQ ID NO: 2432942 - DNA, 23 bp, Homo sapiens
aaagcatttaacccccctgtaca

SEQ ID NO: 2432943 - DNA, 14 bp, Homo sapiens
aaagcattttgtaa

SEQ ID NO: 2432944 - DNA, 14 bp, Homo sapiens
aaagccaagggcaa

SEQ ID NO: 2432945 - DNA, 21 bp, Homo sapiens
aaagccagcgtcctcctctgt

SEQ ID NO: 2432946 - DNA, 19 bp, Homo sapiens
aaagcctgagtactccaca

SEQ ID NO: 2432947 - DNA, 18 bp, Homo sapiens
aaagcctgttcatggcag

SEQ ID NO: 2432948 - DNA, 18 bp, Homo sapiens
aaagccttcttttggggg

SEQ ID NO: 2432949 - DNA, 12 bp, Homo sapiens
aaagcgaaaaaa

SEQ ID NO: 2432950 - DNA, 21 bp, Homo sapiens
aaagcgtgagcttaaaataca

SEQ ID NO: 2432951 - DNA, 22 bp, Homo sapiens
aaagcgtgagcttaaaatacaa

SEQ ID NO: 2432952 - DNA, 13 bp, Homo sapiens
aaagctagaattg

SEQ ID NO: 2432953 - DNA, 14 bp, Homo sapiens
aaagctagaattga

SEQ ID NO: 2432954 - DNA, 20 bp, Homo sapiens
aaagctataaagcagtattt

SEQ ID NO: 2432955 - DNA, 17 bp, Homo sapiens
aaagctcaaaggtttgg

SEQ ID NO: 2432956 - DNA, 18 bp, Homo sapiens
aaagctgacttggctggt

SEQ ID NO: 2432957 - DNA, 10 bp, Homo sapiens
aaagctgcct

SEQ ID NO: 2432958 - DNA, 15 bp, Homo sapiens
aaagctggtttaatg

SEQ ID NO: 2432959 - DNA, 14 bp, Homo sapiens
aaagcttaaaactt

SEQ ID NO: 2432960 - DNA, 15 bp, Homo sapiens
aaagcttaaaacttt

SEQ ID NO: 2432961 - DNA, 17 bp, Homo sapiens
aaagcttccatgattct

SEQ ID NO: 2432962 - DNA, 12 bp, Homo sapiens
aaaggaaaagac

SEQ ID NO: 2432963 - DNA, 17 bp, Homo sapiens
aaaggaaatcaaatgaa

SEQ ID NO: 2432964 - DNA, 17 bp, Homo sapiens
aaaggaagcattgtaaa

SEQ ID NO: 2432965 - DNA, 20 bp, Homo sapiens
aaaggaagcattgtaaaata

SEQ ID NO: 2432966 - DNA, 14 bp, Homo sapiens
aaaggaagccaaag

SEQ ID NO: 2432967 - DNA, 21 bp, Homo sapiens
aaaggactcctgaaaaaaaac

SEQ ID NO: 2432968 - DNA, 11 bp, Homo sapiens
aaaggagcctg

SEQ ID NO: 2432969 - DNA, 16 bp, Homo sapiens
aaaggagtcaaaacta

SEQ ID NO: 2432970 - DNA, 11 bp, Homo sapiens
aaaggagttta

SEQ ID NO: 2432971 - DNA, 15 bp, Homo sapiens
aaaggagtttatgtt

SEQ ID NO: 2432972 - DNA, 12 bp, Homo sapiens
aaaggatgtgat

SEQ ID NO: 2432973 - DNA, 21 bp, Homo sapiens
aaaggcacccccgtcaagagt

SEQ ID NO: 2432974 - DNA, 13 bp, Homo sapiens
aaaggcagttttc

SEQ ID NO: 2432975 - DNA, 14 bp, Homo sapiens
aaaggcagttttct

SEQ ID NO: 2432976 - DNA, 16 bp, Homo sapiens
aaaggcagttttctaa

SEQ ID NO: 2432977 - DNA, 21 bp, Homo sapiens
aaaggcctaattctatgcctg

SEQ ID NO: 2432978 - DNA, 13 bp, Homo sapiens
aactacaaatcaa

SEQ ID NO: 2432979 - DNA, 22 bp, Homo sapiens
aactacatgagaacaaacagat

SEQ ID NO: 2432980 - DNA, 14 bp, Homo sapiens
aactactgtgttat

SEQ ID NO: 2432981 - DNA, 17 bp, Homo sapiens
aactagggccaagccca

SEQ ID NO: 2432982 - DNA, 12 bp, Homo sapiens
aactattttcag

SEQ ID NO: 2432983 - DNA, 13 bp, Homo sapiens
aactattttcaga

SEQ ID NO: 2432984 - DNA, 14 bp, Homo sapiens
aactattttcagat

SEQ ID NO: 2432985 - DNA, 21 bp, Homo sapiens
aactcaaatggggccagatcc

SEQ ID NO: 2432986 - DNA, 23 bp, Homo sapiens
aactcaaatggggccagatccag

SEQ ID NO: 2432987 - DNA, 21 bp, Homo sapiens
aactcaaatgtgagtgttttt

SEQ ID NO: 2432988 - DNA, 12 bp, Homo sapiens
aactcagatcca

SEQ ID NO: 2432989 - DNA, 23 bp, Homo sapiens
aactcatacactcgtatgatact

SEQ ID NO: 2432990 - DNA, 15 bp, Homo sapiens
aactcccattaccat

SEQ ID NO: 2432991 - DNA, 21 bp, Homo sapiens
aactcccattaccatgtaatg

SEQ ID NO: 2432992 - DNA, 14 bp, Homo sapiens
aactcctagttcta

SEQ ID NO: 2432993 - DNA, 13 bp, Homo sapiens
aactcctgtgacc

SEQ ID NO: 2432994 - DNA, 15 bp, Homo sapiens
aactcgtatagcatg

SEQ ID NO: 2432995 - DNA, 21 bp, Homo sapiens
aactctcttattgcctcactt

SEQ ID NO: 2432996 - DNA, 19 bp, Homo sapiens
aactctgttgcaagtgcaa

SEQ ID NO: 2432997 - DNA, 22 bp, Homo sapiens
aactctgttgcaagtgcaataa

SEQ ID NO: 2432998 - DNA, 12 bp, Homo sapiens
aactctttcaaa

SEQ ID NO: 2432999 - DNA, 14 bp, Homo sapiens
aactctttgagaaa

SEQ ID NO: 2433000 - DNA, 15 bp, Homo sapiens
aactctttgttattt

SEQ ID NO: 2433001 - DNA, 12 bp, Homo sapiens
aactgaaaatta

SEQ ID NO: 2433002 - DNA, 23 bp, Homo sapiens
aactgaacaccattgaaggctta

SEQ ID NO: 2433003 - DNA, 18 bp, Homo sapiens
aactgaagagtaatcaat

SEQ ID NO: 2433004 - DNA, 20 bp, Homo sapiens
aactgaagcagcctctcccc

SEQ ID NO: 2433005 - DNA, 13 bp, Homo sapiens
aactgaataccac

SEQ ID NO: 2433006 - DNA, 21 bp, Homo sapiens
aactgaataccactctgtaat

SEQ ID NO: 2433007 - DNA, 16 bp, Homo sapiens
aactgacaagccatct

SEQ ID NO: 2433008 - DNA, 17 bp, Homo sapiens
aactgacaagccatctt

SEQ ID NO: 2433009 - DNA, 23 bp, Homo sapiens
aactgactattcttgatgtaaaa

SEQ ID NO: 2433010 - DNA, 14 bp, Homo sapiens
aactgcaggccctg

SEQ ID NO: 2433011 - DNA, 18 bp, Homo sapiens
aactgcaggccctggcct

SEQ ID NO: 2433012 - DNA, 23 bp, Homo sapiens
aactgcaggccctggcctcccct

SEQ ID NO: 2433013 - DNA, 23 bp, Homo sapiens
aactgcagggaaaattatttgca

SEQ ID NO: 2433014 - DNA, 18 bp, Homo sapiens
aactgcatgcccagagac

SEQ ID NO: 2433015 - DNA, 22 bp, Homo sapiens
aactgcatgcccagagacccag

SEQ ID NO: 2433016 - DNA, 14 bp, Homo sapiens
aactgcccaaagca

SEQ ID NO: 2433017 - DNA, 17 bp, Homo sapiens
aactgccgtaatttaac

SEQ ID NO: 2433018 - DNA, 17 bp, Homo sapiens
aactgcctagaaacaac

SEQ ID NO: 2433019 - DNA, 17 bp, Homo sapiens
aactgctcccacctcct

SEQ ID NO: 2433020 - DNA, 13 bp, Homo sapiens
aactgctgccact

SEQ ID NO: 2433021 - DNA, 14 bp, Homo sapiens
aactgctttctgtt

SEQ ID NO: 2433022 - DNA, 20 bp, Homo sapiens
aactgctttctgttccaaat

SEQ ID NO: 2433023 - DNA, 17 bp, Homo sapiens
aactggccaagctgagg

SEQ ID NO: 2433024 - DNA, 21 bp, Homo sapiens
aactggccaagctgaggtgcc

SEQ ID NO: 2433025 - DNA, 18 bp, Homo sapiens
aactggccatggcctgca

SEQ ID NO: 2433026 - DNA, 22 bp, Homo sapiens
aactggccctatttagatgata

SEQ ID NO: 2433027 - DNA, 20 bp, Homo sapiens
aactgggaacccctttccca

SEQ ID NO: 2433028 - DNA, 18 bp, Homo sapiens
aactgggtaatgaaacaa

SEQ ID NO: 2433029 - DNA, 10 bp, Homo sapiens
aactgtacag

SEQ ID NO: 2433030 - DNA, 16 bp, Homo sapiens
aactgtacagtgtctt

SEQ ID NO: 2433031 - DNA, 17 bp, Homo sapiens
aactgtacagtgtcttt

SEQ ID NO: 2433032 - DNA, 13 bp, Homo sapiens
aactgtatttgaa

SEQ ID NO: 2433033 - DNA, 23 bp, Homo sapiens
aactgtctcgatgcaatgaacac

SEQ ID NO: 2433034 - DNA, 11 bp, Homo sapiens
aactgtggata

SEQ ID NO: 2433035 - DNA, 19 bp, Homo sapiens
aactgttggaatggatttt

SEQ ID NO: 2433036 - DNA, 15 bp, Homo sapiens
aactgttttttaagt

SEQ ID NO: 2433037 - DNA, 16 bp, Homo sapiens
aacttagattttacat

SEQ ID NO: 2433038 - DNA, 19 bp, Homo sapiens
aacttccaggtgttactgt

SEQ ID NO: 2433039 - DNA, 18 bp, Homo sapiens
aacttccccatcttctaa

SEQ ID NO: 2433040 - DNA, 17 bp, Homo sapiens
aacttcttatggaattg

SEQ ID NO: 2433041 - DNA, 12 bp, Homo sapiens
aacttcttgctt

SEQ ID NO: 2433042 - DNA, 19 bp, Homo sapiens
aacttcttgcttctttcta

SEQ ID NO: 2433043 - DNA, 20 bp, Homo sapiens
aacttcttgcttctttctag

SEQ ID NO: 2433044 - DNA, 15 bp, Homo sapiens
aacttgaccctgagc

SEQ ID NO: 2433045 - DNA, 15 bp, Homo sapiens
aacttgagcatgtta

SEQ ID NO: 2433046 - DNA, 14 bp, Homo sapiens
aacttgcatcactt

SEQ ID NO: 2433047 - DNA, 18 bp, Homo sapiens
aacttgcttatcaacttc

SEQ ID NO: 2433048 - DNA, 22 bp, Homo sapiens
aacttggggagttaagacctgg

SEQ ID NO: 2433049 - DNA, 23 bp, Homo sapiens
aacttggggagttaagacctggc

SEQ ID NO: 2433050 - DNA, 19 bp, Homo sapiens
aacttgtgtccctaatgtg

SEQ ID NO: 2433051 - DNA, 19 bp, Homo sapiens
aactttcattccttcagat

SEQ ID NO: 2433052 - DNA, 14 bp, Homo sapiens
aactttcctcgcct

SEQ ID NO: 2433053 - DNA, 15 bp, Homo sapiens
aactttggaaccaga

SEQ ID NO: 2433054 - DNA, 19 bp, Homo sapiens
aactttggaaccagactct

SEQ ID NO: 2433055 - DNA, 19 bp, Homo sapiens
aacttttgtgaattaggct

SEQ ID NO: 2433056 - DNA, 20 bp, Homo sapiens
aactttttattgatttttgg

SEQ ID NO: 2433057 - DNA, 21 bp, Homo sapiens
aactttttttctgtaccagtt

SEQ ID NO: 2433058 - DNA, 15 bp, Homo sapiens
aagaaaaaaatgtat

SEQ ID NO: 2433059 - DNA, 21 bp, Homo sapiens
aagaaaaaaatgtattttatg

SEQ ID NO: 2433060 - DNA, 22 bp, Homo sapiens
aagaaaaaaatgtattttatgt

SEQ ID NO: 2433061 - DNA, 23 bp, Homo sapiens
aagaaaaaaatgtattttatgtt

SEQ ID NO: 2433062 - DNA, 18 bp, Homo sapiens
aagaaaaaaattgaaatg

SEQ ID NO: 2433063 - DNA, 23 bp, Homo sapiens
aagaaaagatgcactttgcttta

SEQ ID NO: 2433064 - DNA, 22 bp, Homo sapiens
aagaaaaggttcttactgcttg

SEQ ID NO: 2433065 - DNA, 20 bp, Homo sapiens
aagaaaataagagctcagga

SEQ ID NO: 2433066 - DNA, 16 bp, Homo sapiens
aagaaaattacaaaaa

SEQ ID NO: 2433067 - DNA, 19 bp, Homo sapiens
aagaaacaactctttgaga

SEQ ID NO: 2433068 - DNA, 16 bp, Homo sapiens
aagaaacaaggttttc

SEQ ID NO: 2433069 - DNA, 14 bp, Homo sapiens
aagaaacatttata

SEQ ID NO: 2433070 - DNA, 20 bp, Homo sapiens
aagaaagacgcactttggct

SEQ ID NO: 2433071 - DNA, 22 bp, Homo sapiens
aagaaagcctgagtactccaca

SEQ ID NO: 2433072 - DNA, 12 bp, Homo sapiens
aagaaagtgtat

SEQ ID NO: 2433073 - DNA, 12 bp, Homo sapiens
aagaaatagaat

SEQ ID NO: 2433074 - DNA, 15 bp, Homo sapiens
aagaaatttcacata

SEQ ID NO: 2433075 - DNA, 11 bp, Homo sapiens
aagaacatgtg

SEQ ID NO: 2433076 - DNA, 13 bp, Homo sapiens
aagaaccacttgt

SEQ ID NO: 2433077 - DNA, 18 bp, Homo sapiens
aagaactgcaggccctgg

SEQ ID NO: 2433078 - DNA, 23 bp, Homo sapiens
aagaactgcaggccctggcctcc

SEQ ID NO: 2433079 - DNA, 13 bp, Homo sapiens
aagaagacttttt

SEQ ID NO: 2433080 - DNA, 22 bp, Homo sapiens
aagaagcattttgtaagttgaa

SEQ ID NO: 2433081 - DNA, 19 bp, Homo sapiens
aagaagccacagacctagg

SEQ ID NO: 2433082 - DNA, 12 bp, Homo sapiens
aatcaataatat

SEQ ID NO: 2433083 - DNA, 16 bp, Homo sapiens
aatcaatcttgcatgt

SEQ ID NO: 2433084 - DNA, 22 bp, Homo sapiens
aatcacatattttaaaatttgt

SEQ ID NO: 2433085 - DNA, 18 bp, Homo sapiens
aatcaccacaaactgtaa

SEQ ID NO: 2433086 - DNA, 14 bp, Homo sapiens
aatcacgctttttg

SEQ ID NO: 2433087 - DNA, 17 bp, Homo sapiens
aatcacgctttttgaaa

SEQ ID NO: 2433088 - DNA, 18 bp, Homo sapiens
aatcacgctttttgaaaa

SEQ ID NO: 2433089 - DNA, 20 bp, Homo sapiens
aatcacgctttttgaaaaag

SEQ ID NO: 2433090 - DNA, 18 bp, Homo sapiens
aatcactctaattaattg

SEQ ID NO: 2433091 - DNA, 13 bp, Homo sapiens
aatcagaattaga

SEQ ID NO: 2433092 - DNA, 20 bp, Homo sapiens
aatcagagaccttccagaaa

SEQ ID NO: 2433093 - DNA, 14 bp, Homo sapiens
aatcagatagatat

SEQ ID NO: 2433094 - DNA, 21 bp, Homo sapiens
aatcagatagatattcctatt

SEQ ID NO: 2433095 - DNA, 17 bp, Homo sapiens
aatcagctattttgtga

SEQ ID NO: 2433096 - DNA, 15 bp, Homo sapiens
aatcaggcttttgtt

SEQ ID NO: 2433097 - DNA, 19 bp, Homo sapiens
aatcagggaggtcattttg

SEQ ID NO: 2433098 - DNA, 22 bp, Homo sapiens
aatcagtaagaggtgttatttg

SEQ ID NO: 2433099 - DNA, 17 bp, Homo sapiens
aatcagtctcagaatgt

SEQ ID NO: 2433100 - DNA, 18 bp, Homo sapiens
aatcagttcattagaaat

SEQ ID NO: 2433101 - DNA, 20 bp, Homo sapiens
aatcagttcattagaaatat

SEQ ID NO: 2433102 - DNA, 15 bp, Homo sapiens
aatcatcaagagaat

SEQ ID NO: 2433103 - DNA, 14 bp, Homo sapiens
aatcattgtatgtg

SEQ ID NO: 2433104 - DNA, 12 bp, Homo sapiens
aatcatttctat

SEQ ID NO: 2433105 - DNA, 15 bp, Homo sapiens
aatcatttgtttaaa

SEQ ID NO: 2433106 - DNA, 17 bp, Homo sapiens
aatcattttaattatta

SEQ ID NO: 2433107 - DNA, 22 bp, Homo sapiens
aatcattttaattattattctt

SEQ ID NO: 2433108 - DNA, 13 bp, Homo sapiens
aatcattttgcaa

SEQ ID NO: 2433109 - DNA, 15 bp, Homo sapiens
aatccacatttctaa

SEQ ID NO: 2433110 - DNA, 17 bp, Homo sapiens
aatccaggcagatccag

SEQ ID NO: 2433111 - DNA, 20 bp, Homo sapiens
aatccaggcagatccaggac

SEQ ID NO: 2433112 - DNA, 22 bp, Homo sapiens
aatccaggcagatccaggacta

SEQ ID NO: 2433113 - DNA, 16 bp, Homo sapiens
aatcccaaatttgatt

SEQ ID NO: 2433114 - DNA, 14 bp, Homo sapiens
aatccccttctccc

SEQ ID NO: 2433115 - DNA, 16 bp, Homo sapiens
aatccccttctcccct

SEQ ID NO: 2433116 - DNA, 19 bp, Homo sapiens
aatccctcaccttctgagt

SEQ ID NO: 2433117 - DNA, 21 bp, Homo sapiens
aatcccttaatatcctaaaca

SEQ ID NO: 2433118 - DNA, 18 bp, Homo sapiens
aatcccttcatacttgaa

SEQ ID NO: 2433119 - DNA, 21 bp, Homo sapiens
aatcctatgcatggtttcagc

SEQ ID NO: 2433120 - DNA, 16 bp, Homo sapiens
aatcggcgacggagca

SEQ ID NO: 2433121 - DNA, 15 bp, Homo sapiens
aatctaagtgatata

SEQ ID NO: 2433122 - DNA, 17 bp, Homo sapiens
aatctaagtgatataaa

SEQ ID NO: 2433123 - DNA, 22 bp, Homo sapiens
aatctagatatcgacttgtttt

SEQ ID NO: 2433124 - DNA, 13 bp, Homo sapiens
aatctcaccccat

SEQ ID NO: 2433125 - DNA, 16 bp, Homo sapiens
aatctctccactttca

SEQ ID NO: 2433126 - DNA, 18 bp, Homo sapiens
aatctctccactttcagc

SEQ ID NO: 2433127 - DNA, 13 bp, Homo sapiens
aatctgacccagt

SEQ ID NO: 2433128 - DNA, 17 bp, Homo sapiens
aatctgacccagtgccc

SEQ ID NO: 2433129 - DNA, 21 bp, Homo sapiens
aatctggcttctggccaggaa

SEQ ID NO: 2433130 - DNA, 23 bp, Homo sapiens
aatctggcttctggccaggaagc

SEQ ID NO: 2433131 - DNA, 18 bp, Homo sapiens
aatcttagtgtatgatta

SEQ ID NO: 2433132 - DNA, 21 bp, Homo sapiens
aatcttagtgtatgattactg

SEQ ID NO: 2433133 - DNA, 18 bp, Homo sapiens
aatcttatagttctaggc

SEQ ID NO: 2433134 - DNA, 17 bp, Homo sapiens
aatcttgaaattaagaa

SEQ ID NO: 2433135 - DNA, 15 bp, Homo sapiens
aatcttgtcatgtgt

SEQ ID NO: 2433136 - DNA, 17 bp, Homo sapiens
aatcttgtcatgtgtat

SEQ ID NO: 2433137 - DNA, 19 bp, Homo sapiens
aatcttgtcatgtgtataa

SEQ ID NO: 2433138 - DNA, 15 bp, Homo sapiens
aatctttaaaccaat

SEQ ID NO: 2433139 - DNA, 22 bp, Homo sapiens
aatctttagagaagtatacata

SEQ ID NO: 2433140 - DNA, 12 bp, Homo sapiens
aatcttttacaa

SEQ ID NO: 2433141 - DNA, 14 bp, Homo sapiens
aatgaaaaaatgta

SEQ ID NO: 2433142 - DNA, 18 bp, Homo sapiens
aatgaaaactctttgctg

SEQ ID NO: 2433143 - DNA, 18 bp, Homo sapiens
aatgaaagctactcatag

SEQ ID NO: 2433144 - DNA, 16 bp, Homo sapiens
aatgaacaagagaagc

SEQ ID NO: 2433145 - DNA, 15 bp, Homo sapiens
aatgaacactctttt

SEQ ID NO: 2433146 - DNA, 12 bp, Homo sapiens
aatgaacagaac

SEQ ID NO: 2433147 - DNA, 21 bp, Homo sapiens
aatgaacatccctttttcaat

SEQ ID NO: 2433148 - DNA, 12 bp, Homo sapiens
aatgaagatcta

SEQ ID NO: 2433149 - DNA, 21 bp, Homo sapiens
aatgaatggaggaactttcca

SEQ ID NO: 2433150 - DNA, 17 bp, Homo sapiens
aatgacactcatataat

SEQ ID NO: 2433151 - DNA, 15 bp, Homo sapiens
aatgacaggcctgtc

SEQ ID NO: 2433152 - DNA, 18 bp, Homo sapiens
aatgacatttatatcaca

SEQ ID NO: 2433153 - DNA, 17 bp, Homo sapiens
aatgagaggttcctaag

SEQ ID NO: 2433154 - DNA, 16 bp, Homo sapiens
aatgagcatgtttaga

SEQ ID NO: 2433155 - DNA, 13 bp, Homo sapiens
aatgagctttctg

SEQ ID NO: 2433156 - DNA, 20 bp, Homo sapiens
aatgagctttctgaacagct

SEQ ID NO: 2433157 - DNA, 21 bp, Homo sapiens
aatgagctttctgaacagctg

SEQ ID NO: 2433158 - DNA, 12 bp, Homo sapiens
aatgagtaacat

SEQ ID NO: 2433159 - DNA, 17 bp, Homo sapiens
aatgagtaacatttgct

SEQ ID NO: 2433160 - DNA, 19 bp, Homo sapiens
aatgagtaacatttgctgt

SEQ ID NO: 2433161 - DNA, 23 bp, Homo sapiens
aatgattcagtgttaaatgtgat

SEQ ID NO: 2433162 - DNA, 15 bp, Homo sapiens
aatgatttttcttta

SEQ ID NO: 2433163 - DNA, 15 bp, Homo sapiens
aatgcactttctatc

SEQ ID NO: 2433164 - DNA, 16 bp, Homo sapiens
aatgcagttgtctctg

SEQ ID NO: 2433165 - DNA, 15 bp, Homo sapiens
aatgccaaattaaaa

SEQ ID NO: 2433166 - DNA, 14 bp, Homo sapiens
aatgccacagccct

SEQ ID NO: 2433167 - DNA, 16 bp, Homo sapiens
aatgccacagccctgt

SEQ ID NO: 2433168 - DNA, 19 bp, Homo sapiens
aatgccacagccctgtcag

SEQ ID NO: 2433169 - DNA, 22 bp, Homo sapiens
aatgccacagccctgtcagcat

SEQ ID NO: 2433170 - DNA, 23 bp, Homo sapiens
aatgccacagccctgtcagcatg

SEQ ID NO: 2433171 - DNA, 23 bp, Homo sapiens
aatgccagtaacgcgtcttcctg

SEQ ID NO: 2433172 - DNA, 22 bp, Homo sapiens
aatgcggttataaaaaatggtt

SEQ ID NO: 2433173 - DNA, 23 bp, Homo sapiens
aatgcggttataaaaaatggttc

SEQ ID NO: 2433174 - DNA, 13 bp, Homo sapiens
aatgctaggttct

SEQ ID NO: 2433175 - DNA, 14 bp, Homo sapiens
aatgctaggttcta

SEQ ID NO: 2433176 - DNA, 17 bp, Homo sapiens
aatgctaggttctacct

SEQ ID NO: 2433177 - DNA, 22 bp, Homo sapiens
aatgctggctatagatgtcttt

SEQ ID NO: 2433178 - DNA, 12 bp, Homo sapiens
aatgctgtacat

SEQ ID NO: 2433179 - DNA, 13 bp, Homo sapiens
aatgctgtacatc

SEQ ID NO: 2433180 - DNA, 15 bp, Homo sapiens
aatgctgtacatcta

SEQ ID NO: 2433181 - DNA, 17 bp, Homo sapiens
aatgctgtacatctatt

SEQ ID NO: 2433182 - DNA, 18 bp, Homo sapiens
aatgcttctaagtaaata

SEQ ID NO: 2433183 - DNA, 23 bp, Homo sapiens
aatgcttctaagtaaatacaatt

SEQ ID NO: 2433184 - DNA, 14 bp, Homo sapiens
aatgctttgaaatt

SEQ ID NO: 2433185 - DNA, 22 bp, Homo sapiens
aatgctttgaaattgaaccttt

SEQ ID NO: 2433186 - DNA, 13 bp, Homo sapiens
acacttgcaacct

SEQ ID NO: 2433187 - DNA, 14 bp, Homo sapiens
acacttggtaattg

SEQ ID NO: 2433188 - DNA, 12 bp, Homo sapiens
acacttgtacaa

SEQ ID NO: 2433189 - DNA, 13 bp, Homo sapiens
acacttgtacaat

SEQ ID NO: 2433190 - DNA, 17 bp, Homo sapiens
acactttgcactgatat

SEQ ID NO: 2433191 - DNA, 22 bp, Homo sapiens
acactttgcactgatatatcat

SEQ ID NO: 2433192 - DNA, 21 bp, Homo sapiens
acagaaaaaccttgggttaga

SEQ ID NO: 2433193 - DNA, 15 bp, Homo sapiens
acagaaattgtatat

SEQ ID NO: 2433194 - DNA, 16 bp, Homo sapiens
acagaaattgtatatt

SEQ ID NO: 2433195 - DNA, 19 bp, Homo sapiens
acagaaattgtatattgta

SEQ ID NO: 2433196 - DNA, 23 bp, Homo sapiens
acagaaattgtatattgtaattt

SEQ ID NO: 2433197 - DNA, 12 bp, Homo sapiens
acagaacactta

SEQ ID NO: 2433198 - DNA, 20 bp, Homo sapiens
acagaactctttcaaaacct

SEQ ID NO: 2433199 - DNA, 21 bp, Homo sapiens
acagaagggagggcagagctg

SEQ ID NO: 2433200 - DNA, 23 bp, Homo sapiens
acagaagggagggcagagctggt

SEQ ID NO: 2433201 - DNA, 18 bp, Homo sapiens
acagaatgtgataaggaa

SEQ ID NO: 2433202 - DNA, 13 bp, Homo sapiens
acagacaggctct

SEQ ID NO: 2433203 - DNA, 23 bp, Homo sapiens
acagacggaagggtaaacaatat

SEQ ID NO: 2433204 - DNA, 20 bp, Homo sapiens
acagactggatgtaccacca

SEQ ID NO: 2433205 - DNA, 18 bp, Homo sapiens
acagagaaaccagcttcc

SEQ ID NO: 2433206 - DNA, 19 bp, Homo sapiens
acagagaaaccagcttcct

SEQ ID NO: 2433207 - DNA, 10 bp, Homo sapiens
acagagaagc

SEQ ID NO: 2433208 - DNA, 12 bp, Homo sapiens
acagagaagcca

SEQ ID NO: 2433209 - DNA, 17 bp, Homo sapiens
acagagaagccagcttg

SEQ ID NO: 2433210 - DNA, 18 bp, Homo sapiens
acagagaagccagcttgt

SEQ ID NO: 2433211 - DNA, 13 bp, Homo sapiens
acagagaagccat

SEQ ID NO: 2433212 - DNA, 14 bp, Homo sapiens
acagagaagccatc

SEQ ID NO: 2433213 - DNA, 21 bp, Homo sapiens
acagagaagccatcacctcag

SEQ ID NO: 2433214 - DNA, 14 bp, Homo sapiens
acagagaagtcaca

SEQ ID NO: 2433215 - DNA, 18 bp, Homo sapiens
acagagaagtcacagggc

SEQ ID NO: 2433216 - DNA, 19 bp, Homo sapiens
acagagaagtcacagggca

SEQ ID NO: 2433217 - DNA, 14 bp, Homo sapiens
acagagaccaagat

SEQ ID NO: 2433218 - DNA, 19 bp, Homo sapiens
acagagcacatttgtcagt

SEQ ID NO: 2433219 - DNA, 13 bp, Homo sapiens
acagagccaggag

SEQ ID NO: 2433220 - DNA, 16 bp, Homo sapiens
acagagcttccctgac

SEQ ID NO: 2433221 - DNA, 18 bp, Homo sapiens
acagataactgaaaatta

SEQ ID NO: 2433222 - DNA, 12 bp, Homo sapiens
acagatatattt

SEQ ID NO: 2433223 - DNA, 14 bp, Homo sapiens
acagatctggaacc

SEQ ID NO: 2433224 - DNA, 22 bp, Homo sapiens
acagatgcctccttcctctttt

SEQ ID NO: 2433225 - DNA, 14 bp, Homo sapiens
acagatttggaaag

SEQ ID NO: 2433226 - DNA, 14 bp, Homo sapiens
acagcaatttctaa

SEQ ID NO: 2433227 - DNA, 12 bp, Homo sapiens
acagcacagcca

SEQ ID NO: 2433228 - DNA, 13 bp, Homo sapiens
acagcagcatctc

SEQ ID NO: 2433229 - DNA, 13 bp, Homo sapiens
acagcatcagggt

SEQ ID NO: 2433230 - DNA, 15 bp, Homo sapiens
acagccaaatttaaa

SEQ ID NO: 2433231 - DNA, 19 bp, Homo sapiens
acagccaactagcccctgg

SEQ ID NO: 2433232 - DNA, 15 bp, Homo sapiens
acagccccaccctgg

SEQ ID NO: 2433233 - DNA, 17 bp, Homo sapiens
acagccctgtcagcatg

SEQ ID NO: 2433234 - DNA, 19 bp, Homo sapiens
acagccctgtcagcatgaa

SEQ ID NO: 2433235 - DNA, 23 bp, Homo sapiens
acagcccttatgcggttaatttt

SEQ ID NO: 2433236 - DNA, 15 bp, Homo sapiens
acagcctcccacccc

SEQ ID NO: 2433237 - DNA, 16 bp, Homo sapiens
acagcctcccaccccc

SEQ ID NO: 2433238 - DNA, 22 bp, Homo sapiens
acagcctcccctgccagggcag

SEQ ID NO: 2433239 - DNA, 15 bp, Homo sapiens
acagcgcggaggagg

SEQ ID NO: 2433240 - DNA, 13 bp, Homo sapiens
acagcgttcctag

SEQ ID NO: 2433241 - DNA, 22 bp, Homo sapiens
acagctactctccccacgaggg

SEQ ID NO: 2433242 - DNA, 17 bp, Homo sapiens
acagctccaccctggcc

SEQ ID NO: 2433243 - DNA, 14 bp, Homo sapiens
acagctcctcccac

SEQ ID NO: 2433244 - DNA, 16 bp, Homo sapiens
acagctggctctactt

SEQ ID NO: 2433245 - DNA, 16 bp, Homo sapiens
acagctggggtgcagg

SEQ ID NO: 2433246 - DNA, 11 bp, Homo sapiens
acagctggtgt

SEQ ID NO: 2433247 - DNA, 20 bp, Homo sapiens
acagctggtgtagctacaga

SEQ ID NO: 2433248 - DNA, 16 bp, Homo sapiens
acagctgtgcctcgct

SEQ ID NO: 2433249 - DNA, 14 bp, Homo sapiens
acagcttagatttc

SEQ ID NO: 2433250 - DNA, 16 bp, Homo sapiens
acagcttagatttcat

SEQ ID NO: 2433251 - DNA, 17 bp, Homo sapiens
acagcttagatttcata

SEQ ID NO: 2433252 - DNA, 21 bp, Homo sapiens
acagcttgacctgaggctgtg

SEQ ID NO: 2433253 - DNA, 17 bp, Homo sapiens
acagcttgtaggggagg

SEQ ID NO: 2433254 - DNA, 13 bp, Homo sapiens
acagcttgtctct

SEQ ID NO: 2433255 - DNA, 22 bp, Homo sapiens
acagcttttgcaacttaatact

SEQ ID NO: 2433256 - DNA, 12 bp, Homo sapiens
acaggaaaaagt

SEQ ID NO: 2433257 - DNA, 20 bp, Homo sapiens
acaggactaacactcagaag

SEQ ID NO: 2433258 - DNA, 21 bp, Homo sapiens
acaggactaacactcagaagc

SEQ ID NO: 2433259 - DNA, 19 bp, Homo sapiens
acaggatgtgtttgctttc

SEQ ID NO: 2433260 - DNA, 21 bp, Homo sapiens
acaggatgtgtttgctttctg

SEQ ID NO: 2433261 - DNA, 23 bp, Homo sapiens
acaggcactgccctggtggccct

SEQ ID NO: 2433262 - DNA, 22 bp, Homo sapiens
acaggcagccagtgccctgagc

SEQ ID NO: 2433263 - DNA, 17 bp, Homo sapiens
acaggcatttcctgggt

SEQ ID NO: 2433264 - DNA, 23 bp, Homo sapiens
acaggccctccctgttccccaga

SEQ ID NO: 2433265 - DNA, 14 bp, Homo sapiens
acaggcctcagggc

SEQ ID NO: 2433266 - DNA, 15 bp, Homo sapiens
acaggcctcagggct

SEQ ID NO: 2433267 - DNA, 18 bp, Homo sapiens
acaggcctcagggctcct

SEQ ID NO: 2433268 - DNA, 23 bp, Homo sapiens
acaggcctgtgtagctgtgacct

SEQ ID NO: 2433269 - DNA, 20 bp, Homo sapiens
acaggctcaaacaatgacaa

SEQ ID NO: 2433270 - DNA, 15 bp, Homo sapiens
acaggctcaggcagg

SEQ ID NO: 2433271 - DNA, 17 bp, Homo sapiens
acaggcttctgagcagc

SEQ ID NO: 2433272 - DNA, 12 bp, Homo sapiens
acagggaaggca

SEQ ID NO: 2433273 - DNA, 14 bp, Homo sapiens
acagggaaggcagg

SEQ ID NO: 2433274 - DNA, 15 bp, Homo sapiens
acagggaaggcaggc

SEQ ID NO: 2433275 - DNA, 17 bp, Homo sapiens
acagggaaggcaggcag

SEQ ID NO: 2433276 - DNA, 19 bp, Homo sapiens
acagggaaggcaggcaggg

SEQ ID NO: 2433277 - DNA, 23 bp, Homo sapiens
acagggaaggcaggcagggctct

SEQ ID NO: 2433278 - DNA, 13 bp, Homo sapiens
acagggggtctgg

SEQ ID NO: 2433279 - DNA, 18 bp, Homo sapiens
acagggggtctggctggt

SEQ ID NO: 2433280 - DNA, 18 bp, Homo sapiens
acagggtcccacagccac

SEQ ID NO: 2433281 - DNA, 24 bp, Homo sapiens
acagggtctgctctttctctgcca

SEQ ID NO: 2433282 - DNA, 15 bp, Homo sapiens
acagggtttcaccat

SEQ ID NO: 2433283 - DNA, 13 bp, Homo sapiens
acaggtccctccc

SEQ ID NO: 2433284 - DNA, 16 bp, Homo sapiens
acaggtcttcatcgaa

SEQ ID NO: 2433285 - DNA, 21 bp, Homo sapiens
acagtaaaccactgaaaaaat

SEQ ID NO: 2433286 - DNA, 22 bp, Homo sapiens
acagtaaaccactgaaaaaata

SEQ ID NO: 2433287 - DNA, 14 bp, Homo sapiens
acagtagtcttgat

SEQ ID NO: 2433288 - DNA, 23 bp, Homo sapiens
acagtatgggggttgtaaattgg

SEQ ID NO: 2433289 - DNA, 18 bp, Homo sapiens
acagtcaaaaccaagtca

SEQ ID NO: 2433290 - DNA, 23 bp, Homo sapiens
acctagcagcaccgttctgtgca

SEQ ID NO: 2433291 - DNA, 21 bp, Homo sapiens
acctagcgggatggggctccc

SEQ ID NO: 2433292 - DNA, 19 bp, Homo sapiens
acctagctgaatgtttttc

SEQ ID NO: 2433293 - DNA, 18 bp, Homo sapiens
acctaggaagcctcagat

SEQ ID NO: 2433294 - DNA, 22 bp, Homo sapiens
acctaggaagcctcagattcct

SEQ ID NO: 2433295 - DNA, 17 bp, Homo sapiens
acctataagaagcctta

SEQ ID NO: 2433296 - DNA, 15 bp, Homo sapiens
acctatacctgtgtt

SEQ ID NO: 2433297 - DNA, 16 bp, Homo sapiens
acctattatcccagct

SEQ ID NO: 2433298 - DNA, 12 bp, Homo sapiens
acctatttccat

SEQ ID NO: 2433299 - DNA, 18 bp, Homo sapiens
acctatttcttaaacact

SEQ ID NO: 2433300 - DNA, 23 bp, Homo sapiens
acctatttcttaaacacttgcaa

SEQ ID NO: 2433301 - DNA, 21 bp, Homo sapiens
acctcaatcagtctcagaatg

SEQ ID NO: 2433302 - DNA, 15 bp, Homo sapiens
acctcaccaactcct

SEQ ID NO: 2433303 - DNA, 16 bp, Homo sapiens
acctcaccaactccta

SEQ ID NO: 2433304 - DNA, 17 bp, Homo sapiens
acctcaccaactcctag

SEQ ID NO: 2433305 - DNA, 11 bp, Homo sapiens
acctcagcctg

SEQ ID NO: 2433306 - DNA, 14 bp, Homo sapiens
acctcagcctggcc

SEQ ID NO: 2433307 - DNA, 16 bp, Homo sapiens
acctcagcctggccag

SEQ ID NO: 2433308 - DNA, 17 bp, Homo sapiens
acctcagcctggccaga

SEQ ID NO: 2433309 - DNA, 19 bp, Homo sapiens
acctcagcctggccagaca

SEQ ID NO: 2433310 - DNA, 21 bp, Homo sapiens
acctcagcctggccagacaca

SEQ ID NO: 2433311 - DNA, 13 bp, Homo sapiens
acctcagcctggg

SEQ ID NO: 2433312 - DNA, 15 bp, Homo sapiens
acctcaggtgatcca

SEQ ID NO: 2433313 - DNA, 17 bp, Homo sapiens
acctcagtaatttagaa

SEQ ID NO: 2433314 - DNA, 18 bp, Homo sapiens
acctcagttttatcattt

SEQ ID NO: 2433315 - DNA, 22 bp, Homo sapiens
acctccaaccaaataagacttc

SEQ ID NO: 2433316 - DNA, 16 bp, Homo sapiens
acctccacatcctcca

SEQ ID NO: 2433317 - DNA, 15 bp, Homo sapiens
acctccacctcctgg

SEQ ID NO: 2433318 - DNA, 12 bp, Homo sapiens
acctcccttggg

SEQ ID NO: 2433319 - DNA, 13 bp, Homo sapiens
acctcctcagcct

SEQ ID NO: 2433320 - DNA, 14 bp, Homo sapiens
acctcctcagcctg

SEQ ID NO: 2433321 - DNA, 21 bp, Homo sapiens
acctcctgacacccttctccc

SEQ ID NO: 2433322 - DNA, 14 bp, Homo sapiens
acctccttccctct

SEQ ID NO: 2433323 - DNA, 19 bp, Homo sapiens
acctccttccctctctgga

SEQ ID NO: 2433324 - DNA, 21 bp, Homo sapiens
acctccttccctctctggaga

SEQ ID NO: 2433325 - DNA, 15 bp, Homo sapiens
acctcgggcctgctg

SEQ ID NO: 2433326 - DNA, 13 bp, Homo sapiens
acctctgacagca

SEQ ID NO: 2433327 - DNA, 14 bp, Homo sapiens
acctctgacagcag

SEQ ID NO: 2433328 - DNA, 20 bp, Homo sapiens
acctctgacagcagcatctc

SEQ ID NO: 2433329 - DNA, 21 bp, Homo sapiens
acctctgacagcagcatctct

SEQ ID NO: 2433330 - DNA, 17 bp, Homo sapiens
acctcttcagaggccct

SEQ ID NO: 2433331 - DNA, 14 bp, Homo sapiens
acctgaaattccaa

SEQ ID NO: 2433332 - DNA, 15 bp, Homo sapiens
acctgaaattccaaa

SEQ ID NO: 2433333 - DNA, 19 bp, Homo sapiens
acctgaaattccaaagtct

SEQ ID NO: 2433334 - DNA, 20 bp, Homo sapiens
acctgaaattccaaagtctc

SEQ ID NO: 2433335 - DNA, 16 bp, Homo sapiens
acctgaactgaacacc

SEQ ID NO: 2433336 - DNA, 17 bp, Homo sapiens
acctgacactcccttgg

SEQ ID NO: 2433337 - DNA, 15 bp, Homo sapiens
acctgagacctgaag

SEQ ID NO: 2433338 - DNA, 15 bp, Homo sapiens
acctgagatttatta

SEQ ID NO: 2433339 - DNA, 12 bp, Homo sapiens
acctgagcctgc

SEQ ID NO: 2433340 - DNA, 17 bp, Homo sapiens
acctgaggaactgtctc

SEQ ID NO: 2433341 - DNA, 18 bp, Homo sapiens
acctgagggtctgtaggt

SEQ ID NO: 2433342 - DNA, 20 bp, Homo sapiens
acctgatcctggaggcccag

SEQ ID NO: 2433343 - DNA, 16 bp, Homo sapiens
acctgcaaagatctgt

SEQ ID NO: 2433344 - DNA, 18 bp, Homo sapiens
acctgcactaacagagtg

SEQ ID NO: 2433345 - DNA, 17 bp, Homo sapiens
acctgccccacttgtcc

SEQ ID NO: 2433346 - DNA, 23 bp, Homo sapiens
acctgccccacttgtccttagcc

SEQ ID NO: 2433347 - DNA, 13 bp, Homo sapiens
acctgcctcagga

SEQ ID NO: 2433348 - DNA, 16 bp, Homo sapiens
acctgcggcccaatcc

SEQ ID NO: 2433349 - DNA, 16 bp, Homo sapiens
acctgctcacgtcaaa

SEQ ID NO: 2433350 - DNA, 15 bp, Homo sapiens
acctgctctcctctt

SEQ ID NO: 2433351 - DNA, 17 bp, Homo sapiens
acctgctctcctcttct

SEQ ID NO: 2433352 - DNA, 16 bp, Homo sapiens
acctgctgacctgtgc

SEQ ID NO: 2433353 - DNA, 17 bp, Homo sapiens
acctgctgacctgtgca

SEQ ID NO: 2433354 - DNA, 11 bp, Homo sapiens
acctgctgagc

SEQ ID NO: 2433355 - DNA, 17 bp, Homo sapiens
acctgctgagctctgag

SEQ ID NO: 2433356 - DNA, 18 bp, Homo sapiens
acctggaacttggggagt

SEQ ID NO: 2433357 - DNA, 20 bp, Homo sapiens
acctggacccctgcattgga

SEQ ID NO: 2433358 - DNA, 21 bp, Homo sapiens
acctggcatcgcaccattctg

SEQ ID NO: 2433359 - DNA, 17 bp, Homo sapiens
acctggcccatcagggt

SEQ ID NO: 2433360 - DNA, 19 bp, Homo sapiens
acctggccctgcttcctgc

SEQ ID NO: 2433361 - DNA, 15 bp, Homo sapiens
acctggctctcacct

SEQ ID NO: 2433362 - DNA, 21 bp, Homo sapiens
acctgggccctggggcctgta

SEQ ID NO: 2433363 - DNA, 16 bp, Homo sapiens
acctgggttgcagaca

SEQ ID NO: 2433364 - DNA, 18 bp, Homo sapiens
acctgggttgcagacagg

SEQ ID NO: 2433365 - DNA, 16 bp, Homo sapiens
acctggtaccctcctg

SEQ ID NO: 2433366 - DNA, 17 bp, Homo sapiens
acctggtactccctctc

SEQ ID NO: 2433367 - DNA, 15 bp, Homo sapiens
acctgtaatgacagg

SEQ ID NO: 2433368 - DNA, 18 bp, Homo sapiens
acctgtctcacctggact

SEQ ID NO: 2433369 - DNA, 15 bp, Homo sapiens
acctgtgagcccagc

SEQ ID NO: 2433370 - DNA, 17 bp, Homo sapiens
acctgtgagcccagctg

SEQ ID NO: 2433371 - DNA, 18 bp, Homo sapiens
acctgtgagcccagctgg

SEQ ID NO: 2433372 - DNA, 19 bp, Homo sapiens
acctgtgcacaccccactc

SEQ ID NO: 2433373 - DNA, 14 bp, Homo sapiens
acctgtggatattt

SEQ ID NO: 2433374 - DNA, 17 bp, Homo sapiens
acctgtgtttcttgcct

SEQ ID NO: 2433375 - DNA, 19 bp, Homo sapiens
acctgtgtttcttgcctca

SEQ ID NO: 2433376 - DNA, 20 bp, Homo sapiens
acctgttgagcatcacagaa

SEQ ID NO: 2433377 - DNA, 21 bp, Homo sapiens
acctgttgagcatcacagaat

SEQ ID NO: 2433378 - DNA, 12 bp, Homo sapiens
accttaagacct

SEQ ID NO: 2433379 - DNA, 22 bp, Homo sapiens
accttaagacctactgttctaa

SEQ ID NO: 2433380 - DNA, 22 bp, Homo sapiens
accttagatgttctaagtcttt

SEQ ID NO: 2433381 - DNA, 15 bp, Homo sapiens
accttccagaaatac

SEQ ID NO: 2433382 - DNA, 23 bp, Homo sapiens
accttccagaaatactactgtgt

SEQ ID NO: 2433383 - DNA, 15 bp, Homo sapiens
accttctccccagct

SEQ ID NO: 2433384 - DNA, 19 bp, Homo sapiens
accttctccccagctccca

SEQ ID NO: 2433385 - DNA, 21 bp, Homo sapiens
accttctccccagctcccagg

SEQ ID NO: 2433386 - DNA, 23 bp, Homo sapiens
accttctccccagctcccaggac

SEQ ID NO: 2433387 - DNA, 22 bp, Homo sapiens
accttctctatggggcatcctc

SEQ ID NO: 2433388 - DNA, 16 bp, Homo sapiens
accttgaaaaaaaaca

SEQ ID NO: 2433389 - DNA, 16 bp, Homo sapiens
accttggcaccagaca

SEQ ID NO: 2433390 - DNA, 17 bp, Homo sapiens
accttggcaccagacac

SEQ ID NO: 2433391 - DNA, 17 bp, Homo sapiens
accttgggttagaccta

SEQ ID NO: 2433392 - DNA, 13 bp, Homo sapiens
accttgtgcccag

SEQ ID NO: 2433393 - DNA, 18 bp, Homo sapiens
accttgtgcccagggttt

SEQ ID NO: 2433394 - DNA, 19 bp, Homo sapiens
actttgcactgatatatca

SEQ ID NO: 2433395 - DNA, 21 bp, Homo sapiens
actttgcactgatatatcatg

SEQ ID NO: 2433396 - DNA, 16 bp, Homo sapiens
actttgcatctcagta

SEQ ID NO: 2433397 - DNA, 17 bp, Homo sapiens
actttgctaaagacatg

SEQ ID NO: 2433398 - DNA, 14 bp, Homo sapiens
actttgcttgcttt

SEQ ID NO: 2433399 - DNA, 20 bp, Homo sapiens
actttgcttgctttgaagta

SEQ ID NO: 2433400 - DNA, 19 bp, Homo sapiens
actttgctttaatataaat

SEQ ID NO: 2433401 - DNA, 21 bp, Homo sapiens
actttgctttaatataaatgc

SEQ ID NO: 2433402 - DNA, 15 bp, Homo sapiens
actttggaaccagac

SEQ ID NO: 2433403 - DNA, 17 bp, Homo sapiens
actttggaaccagactc

SEQ ID NO: 2433404 - DNA, 18 bp, Homo sapiens
actttggagtcccctcac

SEQ ID NO: 2433405 - DNA, 22 bp, Homo sapiens
actttggcttataattctttca

SEQ ID NO: 2433406 - DNA, 17 bp, Homo sapiens
actttgtacatttggga

SEQ ID NO: 2433407 - DNA, 14 bp, Homo sapiens
actttgtgaataga

SEQ ID NO: 2433408 - DNA, 20 bp, Homo sapiens
actttgtttcgtggggaggt

SEQ ID NO: 2433409 - DNA, 17 bp, Homo sapiens
actttgttttattttca

SEQ ID NO: 2433410 - DNA, 16 bp, Homo sapiens
acttttactctgccta

SEQ ID NO: 2433411 - DNA, 23 bp, Homo sapiens
acttttatactctttctgtatat

SEQ ID NO: 2433412 - DNA, 17 bp, Homo sapiens
acttttctgtaattcag

SEQ ID NO: 2433413 - DNA, 22 bp, Homo sapiens
acttttgctgtaatgttaatat

SEQ ID NO: 2433414 - DNA, 15 bp, Homo sapiens
actttttgaggcaaa

SEQ ID NO: 2433415 - DNA, 16 bp, Homo sapiens
actttttgaggcaaaa

SEQ ID NO: 2433416 - DNA, 19 bp, Homo sapiens
actttttgaggcaaaagaa

SEQ ID NO: 2433417 - DNA, 23 bp, Homo sapiens
actttttgttctggtcctttttg

SEQ ID NO: 2433418 - DNA, 15 bp, Homo sapiens
acttttttatttaaa

SEQ ID NO: 2433419 - DNA, 23 bp, Homo sapiens
acttttttatttaaaaaactaaa

SEQ ID NO: 2433420 - DNA, 21 bp, Homo sapiens
actttttttctgtaccagtta

SEQ ID NO: 2433421 - DNA, 16 bp, Homo sapiens
agaaaaaaattgaaat

SEQ ID NO: 2433422 - DNA, 18 bp, Homo sapiens
agaaaaaaattgaaatgt

SEQ ID NO: 2433423 - DNA, 23 bp, Homo sapiens
agaaaaacaaactcgttttttac

SEQ ID NO: 2433424 - DNA, 14 bp, Homo sapiens
agaaaaacaggcac

SEQ ID NO: 2433425 - DNA, 20 bp, Homo sapiens
agaaaaataaagaaaagatg

SEQ ID NO: 2433426 - DNA, 22 bp, Homo sapiens
agaaaacccttgggccagaagt

SEQ ID NO: 2433427 - DNA, 19 bp, Homo sapiens
agaaaatgaattttttcca

SEQ ID NO: 2433428 - DNA, 14 bp, Homo sapiens
agaaaatgttctgt

SEQ ID NO: 2433429 - DNA, 18 bp, Homo sapiens
agaaacaacaatttctac

SEQ ID NO: 2433430 - DNA, 20 bp, Homo sapiens
agaaacaactctttgagaaa

SEQ ID NO: 2433431 - DNA, 17 bp, Homo sapiens
agaaacagttggtaact

SEQ ID NO: 2433432 - DNA, 14 bp, Homo sapiens
agaaaccagcttcc

SEQ ID NO: 2433433 - DNA, 16 bp, Homo sapiens
agaaaccagcttcctt

SEQ ID NO: 2433434 - DNA, 19 bp, Homo sapiens
agaaaccagcttccttcag

SEQ ID NO: 2433435 - DNA, 18 bp, Homo sapiens
agaaacgtcttctaaact

SEQ ID NO: 2433436 - DNA, 22 bp, Homo sapiens
agaaagaagacaaactttgcat

SEQ ID NO: 2433437 - DNA, 20 bp, Homo sapiens
agaaagcctgggtgacattt

SEQ ID NO: 2433438 - DNA, 13 bp, Homo sapiens
agaaagccttctt

SEQ ID NO: 2433439 - DNA, 15 bp, Homo sapiens
agaaagccttctttt

SEQ ID NO: 2433440 - DNA, 15 bp, Homo sapiens
agaaagctgacttgg

SEQ ID NO: 2433441 - DNA, 23 bp, Homo sapiens
agaaagctgacttggctggtgtg

SEQ ID NO: 2433442 - DNA, 19 bp, Homo sapiens
agaaaggactcctgaaaaa

SEQ ID NO: 2433443 - DNA, 21 bp, Homo sapiens
agaaaggctgttaaatacagg

SEQ ID NO: 2433444 - DNA, 14 bp, Homo sapiens
agaaagggagggct

SEQ ID NO: 2433445 - DNA, 20 bp, Homo sapiens
agaaagggagggctctgagg

SEQ ID NO: 2433446 - DNA, 14 bp, Homo sapiens
agaaaggggagccc

SEQ ID NO: 2433447 - DNA, 17 bp, Homo sapiens
agaaaggggagcccact

SEQ ID NO: 2433448 - DNA, 19 bp, Homo sapiens
agaaagtgcctgacacact

SEQ ID NO: 2433449 - DNA, 22 bp, Homo sapiens
agaaagtgcctgacacactaac

SEQ ID NO: 2433450 - DNA, 20 bp, Homo sapiens
agaaagtggaaaacaaggaa

SEQ ID NO: 2433451 - DNA, 13 bp, Homo sapiens
agaaagtgtattt

SEQ ID NO: 2433452 - DNA, 23 bp, Homo sapiens
agaaatactactgtgtaagggcc

SEQ ID NO: 2433453 - DNA, 20 bp, Homo sapiens
agaaatagcttatgaaaaga

SEQ ID NO: 2433454 - DNA, 13 bp, Homo sapiens
agaaatatcttca

SEQ ID NO: 2433455 - DNA, 17 bp, Homo sapiens
agaaatatggacactta

SEQ ID NO: 2433456 - DNA, 17 bp, Homo sapiens
agaaatattttaaaatc

SEQ ID NO: 2433457 - DNA, 21 bp, Homo sapiens
agaaatattttaaaatcagct

SEQ ID NO: 2433458 - DNA, 14 bp, Homo sapiens
agaaatcatagctg

SEQ ID NO: 2433459 - DNA, 17 bp, Homo sapiens
agaaatctggcttctgg

SEQ ID NO: 2433460 - DNA, 11 bp, Homo sapiens
agaaatgccaa

SEQ ID NO: 2433461 - DNA, 19 bp, Homo sapiens
agaaattcaatttggattt

SEQ ID NO: 2433462 - DNA, 22 bp, Homo sapiens
agaaattcaatttggatttaaa

SEQ ID NO: 2433463 - DNA, 21 bp, Homo sapiens
agaaattgaatactttgaatg

SEQ ID NO: 2433464 - DNA, 13 bp, Homo sapiens
agaaatttaaact

SEQ ID NO: 2433465 - DNA, 17 bp, Homo sapiens
agaacacctatgcaaag

SEQ ID NO: 2433466 - DNA, 14 bp, Homo sapiens
agaacactaattca

SEQ ID NO: 2433467 - DNA, 15 bp, Homo sapiens
agaacactaattcat

SEQ ID NO: 2433468 - DNA, 16 bp, Homo sapiens
agaacactaattcata

SEQ ID NO: 2433469 - DNA, 19 bp, Homo sapiens
agaacactaattcataatc

SEQ ID NO: 2433470 - DNA, 19 bp, Homo sapiens
agaacagggaaaataggca

SEQ ID NO: 2433471 - DNA, 18 bp, Homo sapiens
agaacatggcctaagggc

SEQ ID NO: 2433472 - DNA, 13 bp, Homo sapiens
agaacatgtgaga

SEQ ID NO: 2433473 - DNA, 22 bp, Homo sapiens
agaaccacagggctattttgtt

SEQ ID NO: 2433474 - DNA, 16 bp, Homo sapiens
agaaccaggctacaag

SEQ ID NO: 2433475 - DNA, 16 bp, Homo sapiens
agaaccagtcccccca

SEQ ID NO: 2433476 - DNA, 20 bp, Homo sapiens
agaaccagtccccccaccct

SEQ ID NO: 2433477 - DNA, 15 bp, Homo sapiens
agaacctaattcaat

SEQ ID NO: 2433478 - DNA, 12 bp, Homo sapiens
agaacctggcct

SEQ ID NO: 2433479 - DNA, 14 bp, Homo sapiens
agaacctggccttc

SEQ ID NO: 2433480 - DNA, 22 bp, Homo sapiens
agaacctggccttcagtgtacc

SEQ ID NO: 2433481 - DNA, 14 bp, Homo sapiens
agaaccttctctat

SEQ ID NO: 2433482 - DNA, 13 bp, Homo sapiens
agaacgtggtcag

SEQ ID NO: 2433483 - DNA, 15 bp, Homo sapiens
agaactgcaggccct

SEQ ID NO: 2433484 - DNA, 14 bp, Homo sapiens
agaacttcagaaag

SEQ ID NO: 2433485 - DNA, 13 bp, Homo sapiens
agaagaaaaagaa

SEQ ID NO: 2433486 - DNA, 19 bp, Homo sapiens
agaagaaaaggttcttact

SEQ ID NO: 2433487 - DNA, 22 bp, Homo sapiens
agaagaagtttcatcatttttt

SEQ ID NO: 2433488 - DNA, 15 bp, Homo sapiens
agaagacaattgaca

SEQ ID NO: 2433489 - DNA, 18 bp, Homo sapiens
agaagacaggctggaaga

SEQ ID NO: 2433490 - DNA, 15 bp, Homo sapiens
agaagcagtggcctt

SEQ ID NO: 2433491 - DNA, 14 bp, Homo sapiens
agaagccagcttgt

SEQ ID NO: 2433492 - DNA, 21 bp, Homo sapiens
agaagccagcttgtttacatg

SEQ ID NO: 2433493 - DNA, 12 bp, Homo sapiens
agaagccaggaa

SEQ ID NO: 2433494 - DNA, 22 bp, Homo sapiens
agaagccaggaatttcccagga

SEQ ID NO: 2433495 - DNA, 22 bp, Homo sapiens
agaagccatcacctcagatggc

SEQ ID NO: 2433496 - DNA, 24 bp, Homo sapiens
agaagcccccagctaagaacctgg

SEQ ID NO: 2433497 - DNA, 14 bp, Homo sapiens
agaagcccggctcc

SEQ ID NO: 2433498 - DNA, 15 bp, Homo sapiens
agattcaaaggttct

SEQ ID NO: 2433499 - DNA, 17 bp, Homo sapiens
agattcaaaggttctag

SEQ ID NO: 2433500 - DNA, 19 bp, Homo sapiens
agattcaaaggttctaggt

SEQ ID NO: 2433501 - DNA, 19 bp, Homo sapiens
agattccattggtccaaga

SEQ ID NO: 2433502 - DNA, 20 bp, Homo sapiens
agattccattggtccaagat

SEQ ID NO: 2433503 - DNA, 21 bp, Homo sapiens
agattccattggtccaagatt

SEQ ID NO: 2433504 - DNA, 23 bp, Homo sapiens
agattccggatcctaagcatcta

SEQ ID NO: 2433505 - DNA, 24 bp, Homo sapiens
agattccggatcctaagcatctaa

SEQ ID NO: 2433506 - DNA, 15 bp, Homo sapiens
agattctaaagattc

SEQ ID NO: 2433507 - DNA, 18 bp, Homo sapiens
agattctaaagattctat

SEQ ID NO: 2433508 - DNA, 12 bp, Homo sapiens
agattctaaagg

SEQ ID NO: 2433509 - DNA, 10 bp, Homo sapiens
agattctaac

SEQ ID NO: 2433510 - DNA, 19 bp, Homo sapiens
agattctatagttctagac

SEQ ID NO: 2433511 - DNA, 23 bp, Homo sapiens
agattgacctggatggggcaggc

SEQ ID NO: 2433512 - DNA, 15 bp, Homo sapiens
agattgacgacaagt

SEQ ID NO: 2433513 - DNA, 18 bp, Homo sapiens
agattgcagaaaattctg

SEQ ID NO: 2433514 - DNA, 20 bp, Homo sapiens
agattgcagaaaattctgtg

SEQ ID NO: 2433515 - DNA, 23 bp, Homo sapiens
agatttaatataaagttttatat

SEQ ID NO: 2433516 - DNA, 20 bp, Homo sapiens
agatttaatctgccaagggc

SEQ ID NO: 2433517 - DNA, 18 bp, Homo sapiens
agatttcatagttcagaa

SEQ ID NO: 2433518 - DNA, 19 bp, Homo sapiens
agatttgtgtgcatcaggc

SEQ ID NO: 2433519 - DNA, 20 bp, Homo sapiens
agatttgtttttaaactgta

SEQ ID NO: 2433520 - DNA, 16 bp, Homo sapiens
agattttacatgaagt

SEQ ID NO: 2433521 - DNA, 19 bp, Homo sapiens
agattttacatgaagtatt

SEQ ID NO: 2433522 - DNA, 16 bp, Homo sapiens
agattttctgctactt

SEQ ID NO: 2433523 - DNA, 22 bp, Homo sapiens
agattttcttttgccttttgca

SEQ ID NO: 2433524 - DNA, 13 bp, Homo sapiens
agattttttaata

SEQ ID NO: 2433525 - DNA, 15 bp, Homo sapiens
agcaaaatctaccag

SEQ ID NO: 2433526 - DNA, 14 bp, Homo sapiens
agcaaagcacagag

SEQ ID NO: 2433527 - DNA, 12 bp, Homo sapiens
agcaaagcctgt

SEQ ID NO: 2433528 - DNA, 22 bp, Homo sapiens
agcaaagcctgttcatggcaga

SEQ ID NO: 2433529 - DNA, 23 bp, Homo sapiens
agcaaatcaccacaaactgtaat

SEQ ID NO: 2433530 - DNA, 14 bp, Homo sapiens
agcaaatgcaaaaa

SEQ ID NO: 2433531 - DNA, 22 bp, Homo sapiens
agcaaatgcaaaaactctttga

SEQ ID NO: 2433532 - DNA, 20 bp, Homo sapiens
agcaaatgtcatgctgcctt

SEQ ID NO: 2433533 - DNA, 14 bp, Homo sapiens
agcaacatggcttt

SEQ ID NO: 2433534 - DNA, 15 bp, Homo sapiens
agcaacattcatagt

SEQ ID NO: 2433535 - DNA, 16 bp, Homo sapiens
agcaaccgtggccctt

SEQ ID NO: 2433536 - DNA, 21 bp, Homo sapiens
agcaaccgtggcccttcctgg

SEQ ID NO: 2433537 - DNA, 23 bp, Homo sapiens
agcaacgctattccagctgtccc

SEQ ID NO: 2433538 - DNA, 21 bp, Homo sapiens
agcaagacttctctttgcctc

SEQ ID NO: 2433539 - DNA, 22 bp, Homo sapiens
agcaagacttctctttgcctca

SEQ ID NO: 2433540 - DNA, 23 bp, Homo sapiens
agcaagacttctctttgcctcaa

SEQ ID NO: 2433541 - DNA, 19 bp, Homo sapiens
agcaagaggccgtggctgc

SEQ ID NO: 2433542 - DNA, 21 bp, Homo sapiens
agcaagaggccgtggctgctg

SEQ ID NO: 2433543 - DNA, 21 bp, Homo sapiens
agcaaggcccgagcagctgag

SEQ ID NO: 2433544 - DNA, 18 bp, Homo sapiens
agcaagttcgtctgttgt

SEQ ID NO: 2433545 - DNA, 18 bp, Homo sapiens
agcacaaagaccctggct

SEQ ID NO: 2433546 - DNA, 19 bp, Homo sapiens
agcacaaagaccctggctt

SEQ ID NO: 2433547 - DNA, 13 bp, Homo sapiens
agcacaaattagt

SEQ ID NO: 2433548 - DNA, 18 bp, Homo sapiens
agcacaataaatggctgt

SEQ ID NO: 2433549 - DNA, 12 bp, Homo sapiens
agcacagagagt

SEQ ID NO: 2433550 - DNA, 17 bp, Homo sapiens
agcacagagagtctgga

SEQ ID NO: 2433551 - DNA, 17 bp, Homo sapiens
agcacagatggccagcc

SEQ ID NO: 2433552 - DNA, 13 bp, Homo sapiens
agcacagcagcct

SEQ ID NO: 2433553 - DNA, 12 bp, Homo sapiens
agcacagccaac

SEQ ID NO: 2433554 - DNA, 12 bp, Homo sapiens
agcacagccctt

SEQ ID NO: 2433555 - DNA, 12 bp, Homo sapiens
agcacagcctag

SEQ ID NO: 2433556 - DNA, 18 bp, Homo sapiens
agcacagcttagatttca

SEQ ID NO: 2433557 - DNA, 18 bp, Homo sapiens
agcacagcttgacctgag

SEQ ID NO: 2433558 - DNA, 12 bp, Homo sapiens
agcacaggctaa

SEQ ID NO: 2433559 - DNA, 16 bp, Homo sapiens
agcacatatggaattt

SEQ ID NO: 2433560 - DNA, 17 bp, Homo sapiens
agcacatttgtcagtat

SEQ ID NO: 2433561 - DNA, 17 bp, Homo sapiens
agcaccaaatcaaaatc

SEQ ID NO: 2433562 - DNA, 18 bp, Homo sapiens
agcaccaaatcaaaatct

SEQ ID NO: 2433563 - DNA, 16 bp, Homo sapiens
agcaccggaccagcct

SEQ ID NO: 2433564 - DNA, 23 bp, Homo sapiens
agcaccggaccagcctggcccac

SEQ ID NO: 2433565 - DNA, 16 bp, Homo sapiens
agcaccgttctgtgca

SEQ ID NO: 2433566 - DNA, 18 bp, Homo sapiens
agcaccgttctgtgcaca

SEQ ID NO: 2433567 - DNA, 16 bp, Homo sapiens
agcacctcctcagcct

SEQ ID NO: 2433568 - DNA, 22 bp, Homo sapiens
agcacctgccctacctgcccca

SEQ ID NO: 2433569 - DNA, 14 bp, Homo sapiens
agcacctgctgtct

SEQ ID NO: 2433570 - DNA, 17 bp, Homo sapiens
agcacgaaatgttattt

SEQ ID NO: 2433571 - DNA, 16 bp, Homo sapiens
agcactagccaaacct

SEQ ID NO: 2433572 - DNA, 20 bp, Homo sapiens
agcactcgctagcagtggca

SEQ ID NO: 2433573 - DNA, 24 bp, Homo sapiens
agcactcgctagcagtggcaggca

SEQ ID NO: 2433574 - DNA, 19 bp, Homo sapiens
agcactgcacctgcctcca

SEQ ID NO: 2433575 - DNA, 13 bp, Homo sapiens
agcactgcctgct

SEQ ID NO: 2433576 - DNA, 15 bp, Homo sapiens
agcactgtcccttgc

SEQ ID NO: 2433577 - DNA, 19 bp, Homo sapiens
agcactgtcccttgcctca

SEQ ID NO: 2433578 - DNA, 22 bp, Homo sapiens
agcagaaaacccttgggccaga

SEQ ID NO: 2433579 - DNA, 19 bp, Homo sapiens
agcagaaagtgcctttcag

SEQ ID NO: 2433580 - DNA, 18 bp, Homo sapiens
agcagaaatccaagcacc

SEQ ID NO: 2433581 - DNA, 17 bp, Homo sapiens
agcagacagagccagga

SEQ ID NO: 2433582 - DNA, 21 bp, Homo sapiens
agcagacagtgttttctggga

SEQ ID NO: 2433583 - DNA, 20 bp, Homo sapiens
agcagaggggcagaggccca

SEQ ID NO: 2433584 - DNA, 14 bp, Homo sapiens
agcagaggggctga

SEQ ID NO: 2433585 - DNA, 13 bp, Homo sapiens
agcagaggtctcc

SEQ ID NO: 2433586 - DNA, 24 bp, Homo sapiens
agcagattcagaaatgaggccatg

SEQ ID NO: 2433587 - DNA, 20 bp, Homo sapiens
agcagcaccgttctgtgcac

SEQ ID NO: 2433588 - DNA, 20 bp, Homo sapiens
agcagcacctcctcagcctg

SEQ ID NO: 2433589 - DNA, 14 bp, Homo sapiens
agcagcacctgccc

SEQ ID NO: 2433590 - DNA, 19 bp, Homo sapiens
agcagcacctgccctacct

SEQ ID NO: 2433591 - DNA, 17 bp, Homo sapiens
agcagcaggagggggga

SEQ ID NO: 2433592 - DNA, 12 bp, Homo sapiens
agcagccagccc

SEQ ID NO: 2433593 - DNA, 16 bp, Homo sapiens
agcagccagccctgcc

SEQ ID NO: 2433594 - DNA, 18 bp, Homo sapiens
agcagccagccctgcctg

SEQ ID NO: 2433595 - DNA, 22 bp, Homo sapiens
agcagcctcgcccctggcagag

SEQ ID NO: 2433596 - DNA, 23 bp, Homo sapiens
agcagcctgagcaactcttgatt

SEQ ID NO: 2433597 - DNA, 11 bp, Homo sapiens
agcagcctttc

SEQ ID NO: 2433598 - DNA, 18 bp, Homo sapiens
agcagcgaccgccccctc

SEQ ID NO: 2433599 - DNA, 12 bp, Homo sapiens
agcagctgagca

SEQ ID NO: 2433600 - DNA, 19 bp, Homo sapiens
agcagctgagcagggccgg

SEQ ID NO: 2433601 - DNA, 23 bp, Homo sapiens
aggaatttcttaacttcttgctt

SEQ ID NO: 2433602 - DNA, 13 bp, Homo sapiens
aggacacaggcct

SEQ ID NO: 2433603 - DNA, 14 bp, Homo sapiens
aggacacaggcctg

SEQ ID NO: 2433604 - DNA, 17 bp, Homo sapiens
aggacagatgcctcctt

SEQ ID NO: 2433605 - DNA, 21 bp, Homo sapiens
aggacagatgcctccttcctc

SEQ ID NO: 2433606 - DNA, 22 bp, Homo sapiens
aggacatgcggtagccagcaca

SEQ ID NO: 2433607 - DNA, 17 bp, Homo sapiens
aggaccaagcatcttgg

SEQ ID NO: 2433608 - DNA, 22 bp, Homo sapiens
aggaccagaagctcccccagca

SEQ ID NO: 2433609 - DNA, 19 bp, Homo sapiens
aggaccagtcaacctgggc

SEQ ID NO: 2433610 - DNA, 20 bp, Homo sapiens
aggaccagtcaacctgggca

SEQ ID NO: 2433611 - DNA, 19 bp, Homo sapiens
aggaccctgaaggggccat

SEQ ID NO: 2433612 - DNA, 20 bp, Homo sapiens
aggacctgaaattccaaagt

SEQ ID NO: 2433613 - DNA, 12 bp, Homo sapiens
aggacctgagcc

SEQ ID NO: 2433614 - DNA, 14 bp, Homo sapiens
aggacctgagcctg

SEQ ID NO: 2433615 - DNA, 17 bp, Homo sapiens
aggacctggctgccata

SEQ ID NO: 2433616 - DNA, 18 bp, Homo sapiens
aggaccttcgggctgtgc

SEQ ID NO: 2433617 - DNA, 14 bp, Homo sapiens
aggacgcactgagc

SEQ ID NO: 2433618 - DNA, 22 bp, Homo sapiens
aggactaacactcagaagcctg

SEQ ID NO: 2433619 - DNA, 17 bp, Homo sapiens
aggactcctgaaaaaaa

SEQ ID NO: 2433620 - DNA, 17 bp, Homo sapiens
aggactgatgtctccta

SEQ ID NO: 2433621 - DNA, 18 bp, Homo sapiens
aggactgatttcagagtg

SEQ ID NO: 2433622 - DNA, 16 bp, Homo sapiens
aggactgggagccccc

SEQ ID NO: 2433623 - DNA, 20 bp, Homo sapiens
aggactgggagcccccagcc

SEQ ID NO: 2433624 - DNA, 21 bp, Homo sapiens
aggactgggagcccccagcct

SEQ ID NO: 2433625 - DNA, 22 bp, Homo sapiens
aggactgggagcccccagcctg

SEQ ID NO: 2433626 - DNA, 23 bp, Homo sapiens
aggactgggagcccccagcctgt

SEQ ID NO: 2433627 - DNA, 21 bp, Homo sapiens
aggacttcctgtccagctcca

SEQ ID NO: 2433628 - DNA, 22 bp, Homo sapiens
aggacttcctgtccagctccaa

SEQ ID NO: 2433629 - DNA, 13 bp, Homo sapiens
aggacttgaaaga

SEQ ID NO: 2433630 - DNA, 11 bp, Homo sapiens
aggactttgca

SEQ ID NO: 2433631 - DNA, 14 bp, Homo sapiens
aggagaagccagga

SEQ ID NO: 2433632 - DNA, 15 bp, Homo sapiens
aggagaagccaggaa

SEQ ID NO: 2433633 - DNA, 22 bp, Homo sapiens
aggagatgctccttgggccctt

SEQ ID NO: 2433634 - DNA, 17 bp, Homo sapiens
aggagatggggacaggg

SEQ ID NO: 2433635 - DNA, 16 bp, Homo sapiens
aggagattctgccttt

SEQ ID NO: 2433636 - DNA, 13 bp, Homo sapiens
aggagcaaagcct

SEQ ID NO: 2433637 - DNA, 15 bp, Homo sapiens
aggagcaaagcctgt

SEQ ID NO: 2433638 - DNA, 15 bp, Homo sapiens
aggagcacggctctg

SEQ ID NO: 2433639 - DNA, 15 bp, Homo sapiens
aggagccaccagttc

SEQ ID NO: 2433640 - DNA, 17 bp, Homo sapiens
aggagccaccagttctc

SEQ ID NO: 2433641 - DNA, 17 bp, Homo sapiens
aggagcccaggccagga

SEQ ID NO: 2433642 - DNA, 16 bp, Homo sapiens
aggagccccattcctg

SEQ ID NO: 2433643 - DNA, 19 bp, Homo sapiens
aggagccccattcctggga

SEQ ID NO: 2433644 - DNA, 21 bp, Homo sapiens
aggagccccattcctgggaaa

SEQ ID NO: 2433645 - DNA, 12 bp, Homo sapiens
aggagcctgtcc

SEQ ID NO: 2433646 - DNA, 17 bp, Homo sapiens
aggagcctgtcctgcct

SEQ ID NO: 2433647 - DNA, 11 bp, Homo sapiens
aggagcctgtg

SEQ ID NO: 2433648 - DNA, 22 bp, Homo sapiens
aggagcctgtgaacccaggaca

SEQ ID NO: 2433649 - DNA, 15 bp, Homo sapiens
aggagcgagcatgtc

SEQ ID NO: 2433650 - DNA, 16 bp, Homo sapiens
aggagctaaggctcta

SEQ ID NO: 2433651 - DNA, 18 bp, Homo sapiens
aggagctacctgtgtgga

SEQ ID NO: 2433652 - DNA, 22 bp, Homo sapiens
aggagctccagtgtcctgagct

SEQ ID NO: 2433653 - DNA, 12 bp, Homo sapiens
aggagctcccct

SEQ ID NO: 2433654 - DNA, 22 bp, Homo sapiens
aggagctgactcacacctgaac

SEQ ID NO: 2433655 - DNA, 12 bp, Homo sapiens
aggagctgcctg

SEQ ID NO: 2433656 - DNA, 17 bp, Homo sapiens
aggagctgcctggaccc

SEQ ID NO: 2433657 - DNA, 18 bp, Homo sapiens
aggagctgcctggacccg

SEQ ID NO: 2433658 - DNA, 12 bp, Homo sapiens
aggagctgggga

SEQ ID NO: 2433659 - DNA, 20 bp, Homo sapiens
aggagctggggatccctccc

SEQ ID NO: 2433660 - DNA, 21 bp, Homo sapiens
aggagctggggatccctcccc

SEQ ID NO: 2433661 - DNA, 19 bp, Homo sapiens
aggagctttgactcaggag

SEQ ID NO: 2433662 - DNA, 23 bp, Homo sapiens
aggagctttgactcaggagcctg

SEQ ID NO: 2433663 - DNA, 15 bp, Homo sapiens
aggaggaatactgaa

SEQ ID NO: 2433664 - DNA, 18 bp, Homo sapiens
aggaggacccagggctct

SEQ ID NO: 2433665 - DNA, 14 bp, Homo sapiens
aggaggagcctgtc

SEQ ID NO: 2433666 - DNA, 21 bp, Homo sapiens
aggaggagcctgtcctgcctg

SEQ ID NO: 2433667 - DNA, 22 bp, Homo sapiens
aggaggagcctgtcctgcctgt

SEQ ID NO: 2433668 - DNA, 16 bp, Homo sapiens
aggaggagggaggccg

SEQ ID NO: 2433669 - DNA, 11 bp, Homo sapiens
aggaggcagcc

SEQ ID NO: 2433670 - DNA, 21 bp, Homo sapiens
aggagggacaaaggagcctgt

SEQ ID NO: 2433671 - DNA, 23 bp, Homo sapiens
aggagggagacactggcccctca

SEQ ID NO: 2433672 - DNA, 18 bp, Homo sapiens
tgagtaatggtgtagaac

SEQ ID NO: 2433673 - DNA, 19 bp, Homo sapiens
tgagtacccctgctttggg

SEQ ID NO: 2433674 - DNA, 21 bp, Homo sapiens
tgagtacccctgctttgggct

SEQ ID NO: 2433675 - DNA, 22 bp, Homo sapiens
tgagtccccattgaggcttggt

SEQ ID NO: 2433676 - DNA, 17 bp, Homo sapiens
tgagtcctggatgatac

SEQ ID NO: 2433677 - DNA, 17 bp, Homo sapiens
tgagtcgtgacctgcta

SEQ ID NO: 2433678 - DNA, 15 bp, Homo sapiens
tgagtctctctgggc

SEQ ID NO: 2433679 - DNA, 17 bp, Homo sapiens
tgagtctttggttctaa

SEQ ID NO: 2433680 - DNA, 20 bp, Homo sapiens
tgagtctttggttctaagga

SEQ ID NO: 2433681 - DNA, 15 bp, Homo sapiens
tgagtgaataaatgt

SEQ ID NO: 2433682 - DNA, 11 bp, Homo sapiens
tgagtttccta

SEQ ID NO: 2433683 - DNA, 19 bp, Homo sapiens
tgagttttccatggcagga

SEQ ID NO: 2433684 - DNA, 15 bp, Homo sapiens
tgataagatctttta

SEQ ID NO: 2433685 - DNA, 15 bp, Homo sapiens
tgataatagattctc

SEQ ID NO: 2433686 - DNA, 13 bp, Homo sapiens
tgataattttaaa

SEQ ID NO: 2433687 - DNA, 22 bp, Homo sapiens
tgatacatccaaagcagacagc

SEQ ID NO: 2433688 - DNA, 14 bp, Homo sapiens
tgatacatttttgt

SEQ ID NO: 2433689 - DNA, 19 bp, Homo sapiens
tgataccacctttactgtg

SEQ ID NO: 2433690 - DNA, 22 bp, Homo sapiens
tgataccacctttactgtgctt

SEQ ID NO: 2433691 - DNA, 19 bp, Homo sapiens
tgatacccccctctgtctt

SEQ ID NO: 2433692 - DNA, 13 bp, Homo sapiens
tgatactaataaa

SEQ ID NO: 2433693 - DNA, 15 bp, Homo sapiens
tgatactaataaact

SEQ ID NO: 2433694 - DNA, 14 bp, Homo sapiens
tgatactgttgcac

SEQ ID NO: 2433695 - DNA, 19 bp, Homo sapiens
tgatactgttgcacgtgtg

SEQ ID NO: 2433696 - DNA, 20 bp, Homo sapiens
tgatactgttgcacgtgtgt

SEQ ID NO: 2433697 - DNA, 22 bp, Homo sapiens
tgataggttattttgatgtaaa

SEQ ID NO: 2433698 - DNA, 19 bp, Homo sapiens
tgatatataagtgtacata

SEQ ID NO: 2433699 - DNA, 22 bp, Homo sapiens
tgatatataagtgtacatatgt

SEQ ID NO: 2433700 - DNA, 19 bp, Homo sapiens
tgatatgcatatttgttta

SEQ ID NO: 2433701 - DNA, 15 bp, Homo sapiens
tgatattctaagact

SEQ ID NO: 2433702 - DNA, 11 bp, Homo sapiens
tgatcaaggcc

SEQ ID NO: 2433703 - DNA, 12 bp, Homo sapiens
tgatcaaggcct

SEQ ID NO: 2433704 - DNA, 20 bp, Homo sapiens
tgatcaattatagtttctga

SEQ ID NO: 2433705 - DNA, 21 bp, Homo sapiens
tgatcaattatagtttctgag

SEQ ID NO: 2433706 - DNA, 21 bp, Homo sapiens
tgatcagagccgtggtccttt

SEQ ID NO: 2433707 - DNA, 13 bp, Homo sapiens
tgatccatgtaac

SEQ ID NO: 2433708 - DNA, 17 bp, Homo sapiens
tgatccatgtaactgcc

SEQ ID NO: 2433709 - DNA, 16 bp, Homo sapiens
tgatcctggaggccca

SEQ ID NO: 2433710 - DNA, 20 bp, Homo sapiens
tgatcctgtattcagacaga

SEQ ID NO: 2433711 - DNA, 20 bp, Homo sapiens
tgatctacttctgtaattgt

SEQ ID NO: 2433712 - DNA, 21 bp, Homo sapiens
tgatctacttctgtaattgtg

SEQ ID NO: 2433713 - DNA, 18 bp, Homo sapiens
tgatctccgtggctttgg

SEQ ID NO: 2433714 - DNA, 17 bp, Homo sapiens
tgatctggaacccagac

SEQ ID NO: 2433715 - DNA, 18 bp, Homo sapiens
tgatctggaacccagact

SEQ ID NO: 2433716 - DNA, 19 bp, Homo sapiens
tgatctggaacccagactc

SEQ ID NO: 2433717 - DNA, 19 bp, Homo sapiens
tgatgaaaaattgctgact

SEQ ID NO: 2433718 - DNA, 14 bp, Homo sapiens
tgatgaggccctcc

SEQ ID NO: 2433719 - DNA, 15 bp, Homo sapiens
tgatgaggccctcca

SEQ ID NO: 2433720 - DNA, 17 bp, Homo sapiens
tgatgaggccctccaca

SEQ ID NO: 2433721 - DNA, 16 bp, Homo sapiens
tgatgagggcagcagc

SEQ ID NO: 2433722 - DNA, 17 bp, Homo sapiens
tgatgagggcagcagcc

SEQ ID NO: 2433723 - DNA, 19 bp, Homo sapiens
tgatgagggcagcagccag

SEQ ID NO: 2433724 - DNA, 22 bp, Homo sapiens
tgatgcatcagaaagggagggc

SEQ ID NO: 2433725 - DNA, 23 bp, Homo sapiens
tgatgcatgcactgttccccctg

SEQ ID NO: 2433726 - DNA, 14 bp, Homo sapiens
tgatgccaaaaaaa

SEQ ID NO: 2433727 - DNA, 18 bp, Homo sapiens
tgatgccaaaaaaaaata

SEQ ID NO: 2433728 - DNA, 19 bp, Homo sapiens
tgatgtaaaatcttgtcat

SEQ ID NO: 2433729 - DNA, 17 bp, Homo sapiens
tgatgtcaatttctgtg

SEQ ID NO: 2433730 - DNA, 23 bp, Homo sapiens
tgatgtcaatttctgtgttgcca

SEQ ID NO: 2433731 - DNA, 14 bp, Homo sapiens
tgatgtcatacaga

SEQ ID NO: 2433732 - DNA, 15 bp, Homo sapiens
tgatgtcatacagag

SEQ ID NO: 2433733 - DNA, 18 bp, Homo sapiens
tgatgtcatacagagaag

SEQ ID NO: 2433734 - DNA, 19 bp, Homo sapiens
tgatgtcatacagagaagt

SEQ ID NO: 2433735 - DNA, 14 bp, Homo sapiens
tgatgtgaagccaa

SEQ ID NO: 2433736 - DNA, 19 bp, Homo sapiens
tgatgtgcacgtaaagtac

SEQ ID NO: 2433737 - DNA, 12 bp, Homo sapiens
tgatgttaaaaa

SEQ ID NO: 2433738 - DNA, 13 bp, Homo sapiens
tgatgttaaaaaa

SEQ ID NO: 2433739 - DNA, 14 bp, Homo sapiens
tgatgttaaaaaaa

SEQ ID NO: 2433740 - DNA, 15 bp, Homo sapiens
tgatgttctaaggct

SEQ ID NO: 2433741 - DNA, 22 bp, Homo sapiens
tgatgttctaaggctctgagag

SEQ ID NO: 2433742 - DNA, 22 bp, Homo sapiens
tgattaaagatgagctttgtct

SEQ ID NO: 2433743 - DNA, 17 bp, Homo sapiens
tgattaaataagattct

SEQ ID NO: 2433744 - DNA, 14 bp, Homo sapiens
tgattaaatgacac

SEQ ID NO: 2433745 - DNA, 21 bp, Homo sapiens
tgattactggcctttttcatt

SEQ ID NO: 2433746 - DNA, 21 bp, Homo sapiens
tgattcagaaaatgttctgtt

SEQ ID NO: 2433747 - DNA, 14 bp, Homo sapiens
tgattcctttaaca

SEQ ID NO: 2433748 - DNA, 16 bp, Homo sapiens
tgattctgcagtaaat

SEQ ID NO: 2433749 - DNA, 15 bp, Homo sapiens
tgattgatgaccctt

SEQ ID NO: 2433750 - DNA, 12 bp, Homo sapiens
tgattgatttga

SEQ ID NO: 2433751 - DNA, 18 bp, Homo sapiens
tgattgtcttaatattgt

SEQ ID NO: 2433752 - DNA, 13 bp, Homo sapiens
tgattgtttacag

SEQ ID NO: 2433753 - DNA, 21 bp, Homo sapiens
tgatttaggagaagccaggaa

SEQ ID NO: 2433754 - DNA, 16 bp, Homo sapiens
tgatttatcacacaaa

SEQ ID NO: 2433755 - DNA, 15 bp, Homo sapiens
tgatttcattaatac

SEQ ID NO: 2433756 - DNA, 17 bp, Homo sapiens
tgatttcatttcaactg

SEQ ID NO: 2433757 - DNA, 14 bp, Homo sapiens
tgatttccttgaat

SEQ ID NO: 2433758 - DNA, 13 bp, Homo sapiens
tgatttgcattga

SEQ ID NO: 2433759 - DNA, 18 bp, Homo sapiens
tgatttgcattgaacaca

SEQ ID NO: 2433760 - DNA, 20 bp, Homo sapiens
tgatttgtaacccactgaga

SEQ ID NO: 2433761 - DNA, 22 bp, Homo sapiens
tgattttaagtttctctgcaga

SEQ ID NO: 2433762 - DNA, 15 bp, Homo sapiens
tgatttttctcttca

SEQ ID NO: 2433763 - DNA, 15 bp, Homo sapiens
tgatttttctttaca

SEQ ID NO: 2433764 - DNA, 22 bp, Homo sapiens
tgcaaactgggaacccctttcc

SEQ ID NO: 2433765 - DNA, 16 bp, Homo sapiens
tgcaaagaaagaaaaa

SEQ ID NO: 2433766 - DNA, 13 bp, Homo sapiens
tgcaacaaaattc

SEQ ID NO: 2433767 - DNA, 12 bp, Homo sapiens
tgcaacactggt

SEQ ID NO: 2433768 - DNA, 24 bp, Homo sapiens
tgcaacagggtatggactatctgt

SEQ ID NO: 2433769 - DNA, 16 bp, Homo sapiens
tgcaaccatttgaaac

SEQ ID NO: 2433770 - DNA, 20 bp, Homo sapiens
tgcaacctccacctcctggg

SEQ ID NO: 2433771 - DNA, 22 bp, Homo sapiens
tgcaacctcgctggactctcag

SEQ ID NO: 2433772 - DNA, 15 bp, Homo sapiens
tgcaagcacagccct

SEQ ID NO: 2433773 - DNA, 23 bp, Homo sapiens
tgcaagtcagtccaggatgctaa

SEQ ID NO: 2433774 - DNA, 18 bp, Homo sapiens
tgcaagttgaggacttct

SEQ ID NO: 2433775 - DNA, 14 bp, Homo sapiens
tgcaatatctgaag

SEQ ID NO: 2433776 - DNA, 17 bp, Homo sapiens
ttatctataatttacct

SEQ ID NO: 2433777 - DNA, 12 bp, Homo sapiens
ttatctctgtgt

SEQ ID NO: 2433778 - DNA, 17 bp, Homo sapiens
ttatctgaatttttaaa

SEQ ID NO: 2433779 - DNA, 21 bp, Homo sapiens
ttatctgaatttttaaacaag

SEQ ID NO: 2433780 - DNA, 18 bp, Homo sapiens
ttatcttctcaagttcta

SEQ ID NO: 2433781 - DNA, 14 bp, Homo sapiens
ttatgaaaaagaag

SEQ ID NO: 2433782 - DNA, 17 bp, Homo sapiens
ttatgaaaaagaagaat

SEQ ID NO: 2433783 - DNA, 15 bp, Homo sapiens
ttatgagaaagcctt

SEQ ID NO: 2433784 - DNA, 17 bp, Homo sapiens
ttatgataatagattct

SEQ ID NO: 2433785 - DNA, 21 bp, Homo sapiens
ttatgcaaaagcaagctgatt

SEQ ID NO: 2433786 - DNA, 14 bp, Homo sapiens
ttatgctcagggtc

SEQ ID NO: 2433787 - DNA, 15 bp, Homo sapiens
ttatgctgatttatt

SEQ ID NO: 2433788 - DNA, 20 bp, Homo sapiens
ttatggaattgatttgcatt

SEQ ID NO: 2433789 - DNA, 11 bp, Homo sapiens
ttatgggtcac

SEQ ID NO: 2433790 - DNA, 22 bp, Homo sapiens
ttatggtaactgctttctgttc

SEQ ID NO: 2433791 - DNA, 11 bp, Homo sapiens
ttatgtaattt

SEQ ID NO: 2433792 - DNA, 16 bp, Homo sapiens
ttatgtagctctttgt

SEQ ID NO: 2433793 - DNA, 16 bp, Homo sapiens
ttatgtagtaattgac

SEQ ID NO: 2433794 - DNA, 19 bp, Homo sapiens
ttatgtagtaattgacatg

SEQ ID NO: 2433795 - DNA, 11 bp, Homo sapiens
ttatgtagttt

SEQ ID NO: 2433796 - DNA, 20 bp, Homo sapiens
ttatgtattgtgcaatgtgt

SEQ ID NO: 2433797 - DNA, 11 bp, Homo sapiens
ttatgtctggg

SEQ ID NO: 2433798 - DNA, 20 bp, Homo sapiens
ttatgtggttttagattttc

SEQ ID NO: 2433799 - DNA, 16 bp, Homo sapiens
ttatgttatatataaa

SEQ ID NO: 2433800 - DNA, 12 bp, Homo sapiens
ttattaaagaaa

SEQ ID NO: 2433801 - DNA, 23 bp, Homo sapiens
ttattaaagaaaaaaatgtattt

SEQ ID NO: 2433802 - DNA, 21 bp, Homo sapiens
ttattaacgatgtccaacccg

SEQ ID NO: 2433803 - DNA, 15 bp, Homo sapiens
ttattaactttaatg

SEQ ID NO: 2433804 - DNA, 17 bp, Homo sapiens
ttattaatcttagtgta

SEQ ID NO: 2433805 - DNA, 20 bp, Homo sapiens
ttattaattttagtttttca

SEQ ID NO: 2433806 - DNA, 13 bp, Homo sapiens
ttattacagtgtt

SEQ ID NO: 2433807 - DNA, 19 bp, Homo sapiens
ttattacagtgtttatcct

SEQ ID NO: 2433808 - DNA, 16 bp, Homo sapiens
ttattacttgtaaata

SEQ ID NO: 2433809 - DNA, 18 bp, Homo sapiens
ttattacttgtaaatata

SEQ ID NO: 2433810 - DNA, 16 bp, Homo sapiens
ttattagtattgttgt

SEQ ID NO: 2433811 - DNA, 17 bp, Homo sapiens
ttattcaatttatttga

SEQ ID NO: 2433812 - DNA, 18 bp, Homo sapiens
ttattcaatttatttgaa

SEQ ID NO: 2433813 - DNA, 15 bp, Homo sapiens
ttattcagggaagga

SEQ ID NO: 2433814 - DNA, 20 bp, Homo sapiens
ttattccagaatgctgtaca

SEQ ID NO: 2433815 - DNA, 23 bp, Homo sapiens
ttattccatgactgcttgcccta

SEQ ID NO: 2433816 - DNA, 19 bp, Homo sapiens
ttattgacacagaaaatgt

SEQ ID NO: 2433817 - DNA, 14 bp, Homo sapiens
ttattgcagtttat

SEQ ID NO: 2433818 - DNA, 18 bp, Homo sapiens
ttattgcagtttatcatt

SEQ ID NO: 2433819 - DNA, 18 bp, Homo sapiens
ttattggttttgcagaag

SEQ ID NO: 2433820 - DNA, 16 bp, Homo sapiens
ttatttaaaatagcaa

SEQ ID NO: 2433821 - DNA, 17 bp, Homo sapiens
ttatttacccctcccct

SEQ ID NO: 2433822 - DNA, 14 bp, Homo sapiens
ttatttatgtattg

SEQ ID NO: 2433823 - DNA, 12 bp, Homo sapiens
ttatttctgcat

SEQ ID NO: 2433824 - DNA, 15 bp, Homo sapiens
ttattttgacataaa

SEQ ID NO: 2433825 - DNA, 17 bp, Homo sapiens
ttattttgacataaagt

SEQ ID NO: 2433826 - DNA, 16 bp, Homo sapiens
ttattttgatgtaaag

SEQ ID NO: 2433827 - DNA, 12 bp, Homo sapiens
ttattttgcaac

SEQ ID NO: 2433828 - DNA, 23 bp, Homo sapiens
ttatttttggcgtggctgactta

SEQ ID NO: 2433829 - DNA, 14 bp, Homo sapiens
ttattttttaatta

SEQ ID NO: 2433830 - DNA, 16 bp, Homo sapiens
ttattttttaattatt

SEQ ID NO: 2433831 - DNA, 12 bp, Homo sapiens
ttcaaaagttcc

SEQ ID NO: 2433832 - DNA, 20 bp, Homo sapiens
ttcaaaatagggtatatttt

SEQ ID NO: 2433833 - DNA, 12 bp, Homo sapiens
ttcaaactactt

SEQ ID NO: 2433834 - DNA, 23 bp, Homo sapiens
ttcaaagctgtgtgtttggaaga

SEQ ID NO: 2433835 - DNA, 12 bp, Homo sapiens
ttcaaaggttct

SEQ ID NO: 2433836 - DNA, 21 bp, Homo sapiens
ttcaacaaagaaacaaagatg

SEQ ID NO: 2433837 - DNA, 22 bp, Homo sapiens
ttcaacaaagaaacaaagatgt

SEQ ID NO: 2433838 - DNA, 15 bp, Homo sapiens
ttcaacaattctaaa

SEQ ID NO: 2433839 - DNA, 15 bp, Homo sapiens
ttcaacaatttcaat

SEQ ID NO: 2433840 - DNA, 22 bp, Homo sapiens
ttcaacacagcttgtctcttgc

SEQ ID NO: 2433841 - DNA, 16 bp, Homo sapiens
ttcaacagtgaagaca

SEQ ID NO: 2433842 - DNA, 19 bp, Homo sapiens
ttcaacttattaacaatta

SEQ ID NO: 2433843 - DNA, 23 bp, Homo sapiens
ttcaagaggagcccccaccctgt

SEQ ID NO: 2433844 - DNA, 18 bp, Homo sapiens
ttcaagcagtcgtgcctg

SEQ ID NO: 2433845 - DNA, 19 bp, Homo sapiens
ttcaaggagtatgcaggga

SEQ ID NO: 2433846 - DNA, 14 bp, Homo sapiens
ttcaaggcactcta

SEQ ID NO: 2433847 - DNA, 16 bp, Homo sapiens
ttcaaggcactctaga

SEQ ID NO: 2433848 - DNA, 17 bp, Homo sapiens
ttcaaggcactctagat

SEQ ID NO: 2433849 - DNA, 18 bp, Homo sapiens
ttcaaggcactctagatt

SEQ ID NO: 2433850 - DNA, 21 bp, Homo sapiens
ttcaaggcactctagattcca

SEQ ID NO: 2433851 - DNA, 15 bp, Homo sapiens
ttcaaggttctaacc

SEQ ID NO: 2433852 - DNA, 14 bp, Homo sapiens
ttcaatacagatat

SEQ ID NO: 2433853 - DNA, 17 bp, Homo sapiens
ttcaatagcacatatgg

SEQ ID NO: 2433854 - DNA, 15 bp, Homo sapiens
ttcaatagccactaa

SEQ ID NO: 2433855 - DNA, 17 bp, Homo sapiens
ttcaatagccactaacc

SEQ ID NO: 2433856 - DNA, 23 bp, Homo sapiens
ttcaatagccactaaccttgcct

SEQ ID NO: 2433857 - DNA, 18 bp, Homo sapiens
ttcaatataagcttttct

SEQ ID NO: 2433858 - DNA, 21 bp, Homo sapiens
ttcaatcaactttactgtaat

SEQ ID NO: 2433859 - DNA, 15 bp, Homo sapiens
ttcacaaacttttat

SEQ ID NO: 2433860 - DNA, 16 bp, Homo sapiens
ttcacaaacttttata

SEQ ID NO: 2433861 - DNA, 14 bp, Homo sapiens
ttcacaggcagcca

SEQ ID NO: 2433862 - DNA, 23 bp, Homo sapiens
ttcacagtacccaaactgctttt

SEQ ID NO: 2433863 - DNA, 21 bp, Homo sapiens
ttcacagttctttgggccaga

SEQ ID NO: 2433864 - DNA, 18 bp, Homo sapiens
ttcacatctaacctcatc

SEQ ID NO: 2433865 - DNA, 19 bp, Homo sapiens
ttcacatctaacctcatct

SEQ ID NO: 2433866 - DNA, 16 bp, Homo sapiens
ttcacattagaagaca

SEQ ID NO: 2433867 - DNA, 18 bp, Homo sapiens
ttcacctaccgagttcaa

SEQ ID NO: 2433868 - DNA, 22 bp, Homo sapiens
ttcagaaatgaggccatggact

SEQ ID NO: 2433869 - DNA, 21 bp, Homo sapiens
ttcagaatatgtcagtgctga

SEQ ID NO: 2433870 - DNA, 17 bp, Homo sapiens
ttcagaattaaactttt

SEQ ID NO: 2433871 - DNA, 21 bp, Homo sapiens
ttcagaatttagtgtatccat

SEQ ID NO: 2433872 - DNA, 20 bp, Homo sapiens
ttcagacatctgaggtttta

SEQ ID NO: 2433873 - DNA, 22 bp, Homo sapiens
ttcagaggccctcgctgccagc

SEQ ID NO: 2433874 - DNA, 21 bp, Homo sapiens
ttcagagttctttttgaagta

SEQ ID NO: 2433875 - DNA, 22 bp, Homo sapiens
ttcagagttctttttgaagtat

SEQ ID NO: 2433876 - DNA, 16 bp, Homo sapiens
ttcagcactagccaaa

SEQ ID NO: 2433877 - DNA, 19 bp, Homo sapiens
ttcagcactagccaaacct

SEQ ID NO: 2433878 - DNA, 21 bp, Homo sapiens
ttcagcactagccaaacctca

SEQ ID NO: 2433879 - DNA, 14 bp, Homo sapiens
ttcagcactgtccc

SEQ ID NO: 2433880 - DNA, 14 bp, Homo sapiens
ttctcagatttctg

SEQ ID NO: 2433881 - DNA, 16 bp, Homo sapiens
ttctcaggacacaggc

SEQ ID NO: 2433882 - DNA, 12 bp, Homo sapiens
ttctcatcagta

SEQ ID NO: 2433883 - DNA, 20 bp, Homo sapiens
ttctccaaactgaagcagcc

SEQ ID NO: 2433884 - DNA, 15 bp, Homo sapiens
ttctccacagcaacc

SEQ ID NO: 2433885 - DNA, 12 bp, Homo sapiens
ttctcccactct

SEQ ID NO: 2433886 - DNA, 16 bp, Homo sapiens
ttctcccctgcactgt

SEQ ID NO: 2433887 - DNA, 19 bp, Homo sapiens
ttctcccctgcactgtaaa

SEQ ID NO: 2433888 - DNA, 21 bp, Homo sapiens
ttctcccctgcactgtaaaat

SEQ ID NO: 2433889 - DNA, 17 bp, Homo sapiens
ttctccgttagctcctg

SEQ ID NO: 2433890 - DNA, 18 bp, Homo sapiens
ttctcctcactgtatcca

SEQ ID NO: 2433891 - DNA, 20 bp, Homo sapiens
ttctcctgctgctccctcag

SEQ ID NO: 2433892 - DNA, 23 bp, Homo sapiens
ttctcctgctgctccctcagact

SEQ ID NO: 2433893 - DNA, 13 bp, Homo sapiens
ttctccttttcct

SEQ ID NO: 2433894 - DNA, 21 bp, Homo sapiens
ttctctaacttcaaggcccat

SEQ ID NO: 2433895 - DNA, 24 bp, Homo sapiens
ttctctaagagaacaatgtgctat

SEQ ID NO: 2433896 - DNA, 20 bp, Homo sapiens
ttctctccccctatttattg

SEQ ID NO: 2433897 - DNA, 17 bp, Homo sapiens
ttctctctttatacagc

SEQ ID NO: 2433898 - DNA, 16 bp, Homo sapiens
ttctctgagctgtgca

SEQ ID NO: 2433899 - DNA, 20 bp, Homo sapiens
ttctctgaggacaagagaaa

SEQ ID NO: 2433900 - DNA, 12 bp, Homo sapiens
ttctctgtctca

SEQ ID NO: 2433901 - DNA, 18 bp, Homo sapiens
ttctctgtgtctaagatt

SEQ ID NO: 2433902 - DNA, 22 bp, Homo sapiens
ttctctgtgtctaagattctag

SEQ ID NO: 2433903 - DNA, 23 bp, Homo sapiens
ttctctgtgtctaagattctaga

SEQ ID NO: 2433904 - DNA, 22 bp, Homo sapiens
ttctctgttgtcgtaaagattt

SEQ ID NO: 2433905 - DNA, 23 bp, Homo sapiens
ttctctgttgtcgtaaagatttg

SEQ ID NO: 2433906 - DNA, 19 bp, Homo sapiens
ttctcttgtataagatcct

SEQ ID NO: 2433907 - DNA, 14 bp, Homo sapiens
ttctctttgcctca

SEQ ID NO: 2433908 - DNA, 22 bp, Homo sapiens
ttctcttttgctttctgtttct

SEQ ID NO: 2433909 - DNA, 12 bp, Homo sapiens
ttctgaacagct

SEQ ID NO: 2433910 - DNA, 15 bp, Homo sapiens
ttctgaatgcttcta

SEQ ID NO: 2433911 - DNA, 20 bp, Homo sapiens
ttctgagcagcgagcctgct

SEQ ID NO: 2433912 - DNA, 22 bp, Homo sapiens
ttctgagcagcgagcctgctag

SEQ ID NO: 2433913 - DNA, 19 bp, Homo sapiens
ttctgagctcctgtcccct

SEQ ID NO: 2433914 - DNA, 23 bp, Homo sapiens
ttctgagttttgtgtttgttgta

SEQ ID NO: 2433915 - DNA, 14 bp, Homo sapiens
ttctgatcaaggcc

SEQ ID NO: 2433916 - DNA, 18 bp, Homo sapiens
ttctgcagtaaatctttt

SEQ ID NO: 2433917 - DNA, 22 bp, Homo sapiens
ttctgcatatgttgaatacttt

SEQ ID NO: 2433918 - DNA, 15 bp, Homo sapiens
ttctgccctgcccac

SEQ ID NO: 2433919 - DNA, 19 bp, Homo sapiens
ttctgcctgccagctgcac

SEQ ID NO: 2433920 - DNA, 21 bp, Homo sapiens
ttctgcctttgccaggtgact

SEQ ID NO: 2433921 - DNA, 21 bp, Homo sapiens
ttctgctactttgctgctatg

SEQ ID NO: 2433922 - DNA, 14 bp, Homo sapiens
ttctgctcagctct

SEQ ID NO: 2433923 - DNA, 14 bp, Homo sapiens
ttctgctcatcatt

SEQ ID NO: 2433924 - DNA, 16 bp, Homo sapiens
ttctgctccagacagg

SEQ ID NO: 2433925 - DNA, 16 bp, Homo sapiens
ttctgctccttcccca

SEQ ID NO: 2433926 - DNA, 15 bp, Homo sapiens
ttctgctggcctctg

SEQ ID NO: 2433927 - DNA, 20 bp, Homo sapiens
ttctggaatgtaatcaatgt

SEQ ID NO: 2433928 - DNA, 15 bp, Homo sapiens
ttctggacctctggg

SEQ ID NO: 2433929 - DNA, 15 bp, Homo sapiens
ttctggctgtttgag

SEQ ID NO: 2433930 - DNA, 21 bp, Homo sapiens
ttctggggcaggctgggccat

SEQ ID NO: 2433931 - DNA, 20 bp, Homo sapiens
ttctggtaggaatagcatgt

SEQ ID NO: 2433932 - DNA, 18 bp, Homo sapiens
ttctggtgttggacaagc

SEQ ID NO: 2433933 - DNA, 17 bp, Homo sapiens
ttctggttccagggtcc

SEQ ID NO: 2433934 - DNA, 14 bp, Homo sapiens
ttctggttctaaca

SEQ ID NO: 2433935 - DNA, 22 bp, Homo sapiens
ttctgtaaataatgtgcactga

SEQ ID NO: 2433936 - DNA, 16 bp, Homo sapiens
ttctgtatatactttt

SEQ ID NO: 2433937 - DNA, 17 bp, Homo sapiens
ttctgtatatacttttt

SEQ ID NO: 2433938 - DNA, 12 bp, Homo sapiens
ttctgtgtcttt

SEQ ID NO: 2433939 - DNA, 23 bp, Homo sapiens
ttctgtgtctttcacagctcctc

SEQ ID NO: 2433940 - DNA, 17 bp, Homo sapiens
ttctgttaactgaatac

SEQ ID NO: 2433941 - DNA, 21 bp, Homo sapiens
ttctgttaactgaataccact

SEQ ID NO: 2433942 - DNA, 13 bp, Homo sapiens
ttctgttccaaat

SEQ ID NO: 2433943 - DNA, 19 bp, Homo sapiens
ttctgttccaaattcagtt

SEQ ID NO: 2433944 - DNA, 12 bp, Homo sapiens
ttctgtttcaag

SEQ ID NO: 2433945 - DNA, 13 bp, Homo sapiens
ttctgtttgctgt

SEQ ID NO: 2433946 - DNA, 16 bp, Homo sapiens
ttcttaaacacttgca

SEQ ID NO: 2433947 - DNA, 15 bp, Homo sapiens
ttcttaaagtgccag

SEQ ID NO: 2433948 - DNA, 11 bp, Homo sapiens
ttcttaaataa

SEQ ID NO: 2433949 - DNA, 19 bp, Homo sapiens
ttcttaaataagaaacttt

SEQ ID NO: 2433950 - DNA, 16 bp, Homo sapiens
ttcttaacttcttgct

SEQ ID NO: 2433951 - DNA, 17 bp, Homo sapiens
ttcttaagggcacacac

SEQ ID NO: 2433952 - DNA, 14 bp, Homo sapiens
ttcttactgcttgg

SEQ ID NO: 2433953 - DNA, 12 bp, Homo sapiens
ttcttagctcaa

SEQ ID NO: 2433954 - DNA, 17 bp, Homo sapiens
ttcttatggaattgatt

SEQ ID NO: 2433955 - DNA, 18 bp, Homo sapiens
ttcttatggaattgattt

SEQ ID NO: 2433956 - DNA, 13 bp, Homo sapiens
ttcttcactgcaa

SEQ ID NO: 2433957 - DNA, 20 bp, Homo sapiens
ttcttcctcagccagcctcg

SEQ ID NO: 2433958 - DNA, 22 bp, Homo sapiens
ttcttctacaactcatacactc

SEQ ID NO: 2433959 - DNA, 15 bp, Homo sapiens
ttcttctagagttca

SEQ ID NO: 2433960 - DNA, 16 bp, Homo sapiens
ttcttcttgaggggaa

SEQ ID NO: 2433961 - DNA, 20 bp, Homo sapiens
ttcttgaggggaccaggagt

SEQ ID NO: 2433962 - DNA, 22 bp, Homo sapiens
ttcttgcctctgtgctgtgtgt

SEQ ID NO: 2433963 - DNA, 19 bp, Homo sapiens
ttcttgcttctttctagaa

SEQ ID NO: 2433964 - DNA, 16 bp, Homo sapiens
ttcttggttgaggaaa

SEQ ID NO: 2433965 - DNA, 22 bp, Homo sapiens
ttcttggttgaggaaacaaaca

SEQ ID NO: 2433966 - DNA, 13 bp, Homo sapiens
ttcttgtaatttt

SEQ ID NO: 2433967 - DNA, 17 bp, Homo sapiens
ttcttgtctataaagca

SEQ ID NO: 2433968 - DNA, 18 bp, Homo sapiens
ttcttgtctataaagcat

SEQ ID NO: 2433969 - DNA, 14 bp, Homo sapiens
ttcttgttggtgca

SEQ ID NO: 2433970 - DNA, 20 bp, Homo sapiens
ttctttaaagttcttctaag

SEQ ID NO: 2433971 - DNA, 19 bp, Homo sapiens
ttctttaactgccgtaatt

SEQ ID NO: 2433972 - DNA, 22 bp, Homo sapiens
ttctttacaaaacaaactcatt

SEQ ID NO: 2433973 - DNA, 19 bp, Homo sapiens
ttctttgaaaaaaaataaa

SEQ ID NO: 2433974 - DNA, 13 bp, Homo sapiens
ttctttgaataaa

SEQ ID NO: 2433975 - DNA, 19 bp, Homo sapiens
ttctttgaataaatgtcac

SEQ ID NO: 2433976 - DNA, 16 bp, Homo sapiens
ttctttggaaagtaca

SEQ ID NO: 2433977 - DNA, 13 bp, Homo sapiens
ttcttttggtaaa

SEQ ID NO: 2433978 - DNA, 22 bp, Homo sapiens
ttcttttttgatatagaagtat

SEQ ID NO: 2433979 - DNA, 14 bp, Homo sapiens
ttgaaaaagacatt

SEQ ID NO: 2433980 - DNA, 12 bp, Homo sapiens
ttgaaataagct

SEQ ID NO: 2433981 - DNA, 21 bp, Homo sapiens
ttgaaatatggtcttttggtt

SEQ ID NO: 2433982 - DNA, 11 bp, Homo sapiens
ttgaaatgtaa

SEQ ID NO: 2433983 - DNA, 21 bp, Homo sapiens
ttgaaatgtaaggctgtgtaa

SEQ ID NO: 2433984 - DNA, 13 bp, Homo sapiens
ttgctgaaaaatg

SEQ ID NO: 2433985 - DNA, 20 bp, Homo sapiens
ttgctgcaagcacagccctt

SEQ ID NO: 2433986 - DNA, 15 bp, Homo sapiens
ttgctgcatggcagg

SEQ ID NO: 2433987 - DNA, 16 bp, Homo sapiens
ttgctgctaatatttt

SEQ ID NO: 2433988 - DNA, 20 bp, Homo sapiens
ttgctgctaatattttcctc

SEQ ID NO: 2433989 - DNA, 17 bp, Homo sapiens
ttgctgtgaggctgtcc

SEQ ID NO: 2433990 - DNA, 18 bp, Homo sapiens
ttgctgtgaggctgtcct

SEQ ID NO: 2433991 - DNA, 20 bp, Homo sapiens
ttgcttatttattgtattct

SEQ ID NO: 2433992 - DNA, 19 bp, Homo sapiens
ttgcttcatgtgtcccaga

SEQ ID NO: 2433993 - DNA, 20 bp, Homo sapiens
ttgcttctttctagaaagag

SEQ ID NO: 2433994 - DNA, 21 bp, Homo sapiens
ttgctttaatataaatgcaaa

SEQ ID NO: 2433995 - DNA, 22 bp, Homo sapiens
ttgctttaatataaatgcaaat

SEQ ID NO: 2433996 - DNA, 17 bp, Homo sapiens
ttgctttggaagtttta

SEQ ID NO: 2433997 - DNA, 16 bp, Homo sapiens
ttgcttttcatgcaaa

SEQ ID NO: 2433998 - DNA, 17 bp, Homo sapiens
ttgcttttcatgcaaac

SEQ ID NO: 2433999 - DNA, 15 bp, Homo sapiens
ttgctttttgtgata

SEQ ID NO: 2434000 - DNA, 17 bp, Homo sapiens
ttggaaagtacactctg

SEQ ID NO: 2434001 - DNA, 21 bp, Homo sapiens
ttggaaagtacactctgctgt

SEQ ID NO: 2434002 - DNA, 22 bp, Homo sapiens
ttggaaagtacactctgctgtt

SEQ ID NO: 2434003 - DNA, 13 bp, Homo sapiens
ttggaaataaagt

SEQ ID NO: 2434004 - DNA, 13 bp, Homo sapiens
ttggaactggagg

SEQ ID NO: 2434005 - DNA, 16 bp, Homo sapiens
ttggaagagcagcacc

SEQ ID NO: 2434006 - DNA, 13 bp, Homo sapiens
ttggaatactttt

SEQ ID NO: 2434007 - DNA, 15 bp, Homo sapiens
ttggacagtttacca

SEQ ID NO: 2434008 - DNA, 23 bp, Homo sapiens
ttggacctaaatggcctcatgtg

SEQ ID NO: 2434009 - DNA, 22 bp, Homo sapiens
ttggagactgtctggcccccct

SEQ ID NO: 2434010 - DNA, 15 bp, Homo sapiens
ttggagagtttcctg

SEQ ID NO: 2434011 - DNA, 14 bp, Homo sapiens
ttggagcttcatgg

SEQ ID NO: 2434012 - DNA, 19 bp, Homo sapiens
ttggatacttggatttagt

SEQ ID NO: 2434013 - DNA, 19 bp, Homo sapiens
ttggatatgtaaaacattt

SEQ ID NO: 2434014 - DNA, 20 bp, Homo sapiens
ttggattctttccatttgca

SEQ ID NO: 2434015 - DNA, 19 bp, Homo sapiens
ttggatttaaaagcctgct

SEQ ID NO: 2434016 - DNA, 12 bp, Homo sapiens
ttggatttccta

SEQ ID NO: 2434017 - DNA, 17 bp, Homo sapiens
ttggcaatgccatcatc

SEQ ID NO: 2434018 - DNA, 12 bp, Homo sapiens
ttggcaattttg

SEQ ID NO: 2434019 - DNA, 14 bp, Homo sapiens
ttggcaattttgtg

SEQ ID NO: 2434020 - DNA, 14 bp, Homo sapiens
ttggcagccttgtg

SEQ ID NO: 2434021 - DNA, 12 bp, Homo sapiens
ttggcaggctgg

SEQ ID NO: 2434022 - DNA, 14 bp, Homo sapiens
ttggcaggctggcc

SEQ ID NO: 2434023 - DNA, 15 bp, Homo sapiens
ttggcatccctgggc

SEQ ID NO: 2434024 - DNA, 17 bp, Homo sapiens
ttggcatccctgggcct

SEQ ID NO: 2434025 - DNA, 22 bp, Homo sapiens
ttggccaatgcacctaaagaaa

SEQ ID NO: 2434026 - DNA, 18 bp, Homo sapiens
ttggccatatttacctca

SEQ ID NO: 2434027 - DNA, 21 bp, Homo sapiens
ttggccatatttacctcagcc

SEQ ID NO: 2434028 - DNA, 22 bp, Homo sapiens
ttggccatatttacctcagcct

SEQ ID NO: 2434029 - DNA, 17 bp, Homo sapiens
ttggcctgatcagacca

SEQ ID NO: 2434030 - DNA, 19 bp, Homo sapiens
ttggcctgatcagaccacg

SEQ ID NO: 2434031 - DNA, 17 bp, Homo sapiens
ttggcgtaggctacaga

SEQ ID NO: 2434032 - DNA, 21 bp, Homo sapiens
ttggcgtaggctacagagaag

SEQ ID NO: 2434033 - DNA, 23 bp, Homo sapiens
ttggcgtaggctacagagaagcc

SEQ ID NO: 2434034 - DNA, 20 bp, Homo sapiens
ttggctcgaatctctgtgcc

SEQ ID NO: 2434035 - DNA, 22 bp, Homo sapiens
ttggctcgaatctctgtgcctt

SEQ ID NO: 2434036 - DNA, 12 bp, Homo sapiens
ttggctctgcca

SEQ ID NO: 2434037 - DNA, 16 bp, Homo sapiens
ttggctctgccagtcc

SEQ ID NO: 2434038 - DNA, 23 bp, Homo sapiens
ttggctctgccagtcctgtcctt

SEQ ID NO: 2434039 - DNA, 17 bp, Homo sapiens
ttggctggacccagcca

SEQ ID NO: 2434040 - DNA, 16 bp, Homo sapiens
ttgggaaacttggctc

SEQ ID NO: 2434041 - DNA, 17 bp, Homo sapiens
ttgggagacatgtgaca

SEQ ID NO: 2434042 - DNA, 13 bp, Homo sapiens
ttgggagagactt

SEQ ID NO: 2434043 - DNA, 14 bp, Homo sapiens
ttgggatttgctgt

SEQ ID NO: 2434044 - DNA, 19 bp, Homo sapiens
ttgggcacccccagcctgg

SEQ ID NO: 2434045 - DNA, 20 bp, Homo sapiens
ttgggcacccccagcctggg

SEQ ID NO: 2434046 - DNA, 22 bp, Homo sapiens
ttgggcagagctggctctgagc

SEQ ID NO: 2434047 - DNA, 21 bp, Homo sapiens
ttgggccagaagtaccagact

SEQ ID NO: 2434048 - DNA, 14 bp, Homo sapiens
ttgggccagacatg

SEQ ID NO: 2434049 - DNA, 17 bp, Homo sapiens
ttgggccagacatgcca

SEQ ID NO: 2434050 - DNA, 19 bp, Homo sapiens
ttgggcccacacctccttc

SEQ ID NO: 2434051 - DNA, 20 bp, Homo sapiens
ttgggcctgctccagacctg

SEQ ID NO: 2434052 - DNA, 14 bp, Homo sapiens
ttgggctctgatga

SEQ ID NO: 2434053 - DNA, 23 bp, Homo sapiens
ttggggaaacagcatctccaagc

SEQ ID NO: 2434054 - DNA, 11 bp, Homo sapiens
ttggggaagag

SEQ ID NO: 2434055 - DNA, 19 bp, Homo sapiens
ttggggagttaagacctgg

SEQ ID NO: 2434056 - DNA, 21 bp, Homo sapiens
ttggggagttaagacctggca

SEQ ID NO: 2434057 - DNA, 22 bp, Homo sapiens
ttggggcaggagtagctgagct

SEQ ID NO: 2434058 - DNA, 14 bp, Homo sapiens
ttggggtctgaccc

SEQ ID NO: 2434059 - DNA, 17 bp, Homo sapiens
ttgggtaaaatactttt

SEQ ID NO: 2434060 - DNA, 13 bp, Homo sapiens
ttggtcgtttttt

SEQ ID NO: 2434061 - DNA, 14 bp, Homo sapiens
ttggtggccacata

SEQ ID NO: 2434062 - DNA, 12 bp, Homo sapiens
ttggtgtttttt

SEQ ID NO: 2434063 - DNA, 20 bp, Homo sapiens
ttggttcattaattctataa

SEQ ID NO: 2434064 - DNA, 15 bp, Homo sapiens
ttggttccttcccaa

SEQ ID NO: 2434065 - DNA, 18 bp, Homo sapiens
ttggttctaaggacctga

SEQ ID NO: 2434066 - DNA, 20 bp, Homo sapiens
ttggttctagcgcagttttt

SEQ ID NO: 2434067 - DNA, 15 bp, Homo sapiens
ttggttcttgagggg

SEQ ID NO: 2434068 - DNA, 22 bp, Homo sapiens
ttggttcttgaggggaccagga

SEQ ID NO: 2434069 - DNA, 17 bp, Homo sapiens
ttggtttaaagaaagtg

SEQ ID NO: 2434070 - DNA, 22 bp, Homo sapiens
ttggtttaaagaaagtgtattt

SEQ ID NO: 2434071 - DNA, 21 bp, Homo sapiens
ttggttttgctacataattat

SEQ ID NO: 2434072 - DNA, 14 bp, Homo sapiens
ttgtaaaacaggta

SEQ ID NO: 2434073 - DNA, 17 bp, Homo sapiens
ttgtaaaagcattttgt

SEQ ID NO: 2434074 - DNA, 18 bp, Homo sapiens
ttgtaaaagcattttgta

SEQ ID NO: 2434075 - DNA, 17 bp, Homo sapiens
ttgtaaaatgacaatca

SEQ ID NO: 2434076 - DNA, 19 bp, Homo sapiens
ttgtaaaatgacaatcatg

SEQ ID NO: 2434077 - DNA, 20 bp, Homo sapiens
ttgtaaaatgacaatcatgt

SEQ ID NO: 2434078 - DNA, 23 bp, Homo sapiens
ttgtaaacaaactgtgtaactgc

SEQ ID NO: 2434079 - DNA, 17 bp, Homo sapiens
ttgtaaagtatgtatta

SEQ ID NO: 2434080 - DNA, 11 bp, Homo sapiens
ttgtaaatata

SEQ ID NO: 2434081 - DNA, 12 bp, Homo sapiens
ttgtaaatataa

SEQ ID NO: 2434082 - DNA, 16 bp, Homo sapiens
ttgtaaatataaagac

SEQ ID NO: 2434083 - DNA, 16 bp, Homo sapiens
ttgtaaattattaatt

SEQ ID NO: 2434084 - DNA, 23 bp, Homo sapiens
ttgtaaattattaatttatgcag

SEQ ID NO: 2434085 - DNA, 13 bp, Homo sapiens
ttgtaaattggca

SEQ ID NO: 2434086 - DNA, 17 bp, Homo sapiens
ttgtaatctgaataaag

SEQ ID NO: 2434087 - DNA, 11 bp, Homo sapiens
ttgtaattatg

SEQ ID NO: 2434088 - DNA, 23 bp, Homo sapiens
tttcacaacagcctgacaacatt

SEQ ID NO: 2434089 - DNA, 14 bp, Homo sapiens
tttcacagaaaata

SEQ ID NO: 2434090 - DNA, 13 bp, Homo sapiens
tttcacagctcct

SEQ ID NO: 2434091 - DNA, 16 bp, Homo sapiens
tttcacagtttgaaat

SEQ ID NO: 2434092 - DNA, 17 bp, Homo sapiens
tttcacagtttgaaata

SEQ ID NO: 2434093 - DNA, 16 bp, Homo sapiens
tttcactggagcacaa

SEQ ID NO: 2434094 - DNA, 23 bp, Homo sapiens
tttcagaagttagtttgtatata

SEQ ID NO: 2434095 - DNA, 23 bp, Homo sapiens
tttcagagttctttttgaagtat

SEQ ID NO: 2434096 - DNA, 11 bp, Homo sapiens
tttcagatgtg

SEQ ID NO: 2434097 - DNA, 22 bp, Homo sapiens
tttcagcactagccaaacctca

SEQ ID NO: 2434098 - DNA, 20 bp, Homo sapiens
tttcagctcctgaccagttg

SEQ ID NO: 2434099 - DNA, 15 bp, Homo sapiens
tttcagctgtctttt

SEQ ID NO: 2434100 - DNA, 12 bp, Homo sapiens
tttcaggaggaa

SEQ ID NO: 2434101 - DNA, 16 bp, Homo sapiens
tttcagtattatatgt

SEQ ID NO: 2434102 - DNA, 18 bp, Homo sapiens
tttcagtccccacagata

SEQ ID NO: 2434103 - DNA, 15 bp, Homo sapiens
tttcataaaaggaga

SEQ ID NO: 2434104 - DNA, 14 bp, Homo sapiens
tttcataagtattt

SEQ ID NO: 2434105 - DNA, 18 bp, Homo sapiens
tttcataagtatttcaaa

SEQ ID NO: 2434106 - DNA, 19 bp, Homo sapiens
tttcataagtatttcaaat

SEQ ID NO: 2434107 - DNA, 16 bp, Homo sapiens
tttcataggtctgaaa

SEQ ID NO: 2434108 - DNA, 13 bp, Homo sapiens
tttcatataaagt

SEQ ID NO: 2434109 - DNA, 15 bp, Homo sapiens
tttcatcttcagttg

SEQ ID NO: 2434110 - DNA, 16 bp, Homo sapiens
tttcatcttcagttgt

SEQ ID NO: 2434111 - DNA, 16 bp, Homo sapiens
tttcatgattagaaat

SEQ ID NO: 2434112 - DNA, 13 bp, Homo sapiens
tttcatgcaaact

SEQ ID NO: 2434113 - DNA, 21 bp, Homo sapiens
tttcatgcaaactctttggtc

SEQ ID NO: 2434114 - DNA, 15 bp, Homo sapiens
tttcatgtttttgat

SEQ ID NO: 2434115 - DNA, 17 bp, Homo sapiens
tttcattaaataaattt

SEQ ID NO: 2434116 - DNA, 14 bp, Homo sapiens
tttcatttatctat

SEQ ID NO: 2434117 - DNA, 17 bp, Homo sapiens
tttcatttatctataat

SEQ ID NO: 2434118 - DNA, 20 bp, Homo sapiens
tttcatttatctataattta

SEQ ID NO: 2434119 - DNA, 17 bp, Homo sapiens
tttcattttctctcagg

SEQ ID NO: 2434120 - DNA, 18 bp, Homo sapiens
tttcattttctctcaggt

SEQ ID NO: 2434121 - DNA, 19 bp, Homo sapiens
tttccaaaatctcccattt

SEQ ID NO: 2434122 - DNA, 19 bp, Homo sapiens
tttccaggcttctgctggg

SEQ ID NO: 2434123 - DNA, 23 bp, Homo sapiens
tttccaggcttctgctggggcct

SEQ ID NO: 2434124 - DNA, 20 bp, Homo sapiens
tttccatggcaggaaggctt

SEQ ID NO: 2434125 - DNA, 15 bp, Homo sapiens
tttccattacaagta

SEQ ID NO: 2434126 - DNA, 22 bp, Homo sapiens
tttccattcgtgaaaacacatt

SEQ ID NO: 2434127 - DNA, 15 bp, Homo sapiens
tttcccaattcacat

SEQ ID NO: 2434128 - DNA, 22 bp, Homo sapiens
tttcccaccccaacctgctctc

SEQ ID NO: 2434129 - DNA, 12 bp, Homo sapiens
tttcccactcca

SEQ ID NO: 2434130 - DNA, 16 bp, Homo sapiens
tttcccactccaagcc

SEQ ID NO: 2434131 - DNA, 14 bp, Homo sapiens
tttcccaggaccct

SEQ ID NO: 2434132 - DNA, 16 bp, Homo sapiens
tttcccatggggaggg

SEQ ID NO: 2434133 - DNA, 18 bp, Homo sapiens
tttcccttgtagctcctc

SEQ ID NO: 2434134 - DNA, 23 bp, Homo sapiens
tttcctaataaagttctgtactc

SEQ ID NO: 2434135 - DNA, 15 bp, Homo sapiens
tttcctatgctttga

SEQ ID NO: 2434136 - DNA, 18 bp, Homo sapiens
tttccttcaaagtttaat

SEQ ID NO: 2434137 - DNA, 21 bp, Homo sapiens
tttccttccaatgtctggaga

SEQ ID NO: 2434138 - DNA, 20 bp, Homo sapiens
tttccttcccttttctgttc

SEQ ID NO: 2434139 - DNA, 18 bp, Homo sapiens
tttctaactacaaaggtt

SEQ ID NO: 2434140 - DNA, 15 bp, Homo sapiens
tttctaagattctaa

SEQ ID NO: 2434141 - DNA, 19 bp, Homo sapiens
tttctaagcataaaagatg

SEQ ID NO: 2434142 - DNA, 14 bp, Homo sapiens
tttctaattgctta

SEQ ID NO: 2434143 - DNA, 16 bp, Homo sapiens
tttctaattgcttatt

SEQ ID NO: 2434144 - DNA, 22 bp, Homo sapiens
tttctactttgaagtcatacca

SEQ ID NO: 2434145 - DNA, 13 bp, Homo sapiens
tttctagaaagag

SEQ ID NO: 2434146 - DNA, 15 bp, Homo sapiens
tttctatcctctgta

SEQ ID NO: 2434147 - DNA, 17 bp, Homo sapiens
tttctatttcactggag

SEQ ID NO: 2434148 - DNA, 16 bp, Homo sapiens
tttctcactaaatctt

SEQ ID NO: 2434149 - DNA, 21 bp, Homo sapiens
tttctcccccatgttctgtcc

SEQ ID NO: 2434150 - DNA, 18 bp, Homo sapiens
tttctcctttaattgtaa

SEQ ID NO: 2434151 - DNA, 20 bp, Homo sapiens
tttctctctttatacagctg

SEQ ID NO: 2434152 - DNA, 21 bp, Homo sapiens
tttctctgcagaaactactga

SEQ ID NO: 2434153 - DNA, 20 bp, Homo sapiens
tttctctttccctggtccct

SEQ ID NO: 2434154 - DNA, 13 bp, Homo sapiens
tttctcttttgct

SEQ ID NO: 2434155 - DNA, 19 bp, Homo sapiens
tttctcttttgctttctgt

SEQ ID NO: 2434156 - DNA, 17 bp, Homo sapiens
tttctgaggctttatga

SEQ ID NO: 2434157 - DNA, 17 bp, Homo sapiens
tttctgatcaaggcctt

SEQ ID NO: 2434158 - DNA, 22 bp, Homo sapiens
tttctgcctggagtgtatgact

SEQ ID NO: 2434159 - DNA, 18 bp, Homo sapiens
tttctggaatgtaatcaa

SEQ ID NO: 2434160 - DNA, 11 bp, Homo sapiens
tttctggccag

SEQ ID NO: 2434161 - DNA, 23 bp, Homo sapiens
tttctgggagacagaaaacatgt

SEQ ID NO: 2434162 - DNA, 23 bp, Homo sapiens
tttctgtaattcaggtttttcct

SEQ ID NO: 2434163 - DNA, 14 bp, Homo sapiens
tttctgtaccagtt

SEQ ID NO: 2434164 - DNA, 9 bp, Homo sapiens
tttctgttc

SEQ ID NO: 2434165 - DNA, 12 bp, Homo sapiens
tttctgttccaa

SEQ ID NO: 2434166 - DNA, 14 bp, Homo sapiens
tttctgttccaaat

SEQ ID NO: 2434167 - DNA, 20 bp, Homo sapiens
tttctgttccaaattcagtt

SEQ ID NO: 2434168 - DNA, 17 bp, Homo sapiens
tttcttaaaaagttata

SEQ ID NO: 2434169 - DNA, 13 bp, Homo sapiens
tttcttaaagtgc

SEQ ID NO: 2434170 - DNA, 20 bp, Homo sapiens
tttcttaaataagaaacttt

SEQ ID NO: 2434171 - DNA, 18 bp, Homo sapiens
tttcttgtctataaagca

SEQ ID NO: 2434172 - DNA, 9 bp, Homo sapiens
tttcttttc

SEQ ID NO: 2434173 - DNA, 15 bp, Homo sapiens
tttcttttttgatat

SEQ ID NO: 2434174 - DNA, 16 bp, Homo sapiens
tttgaaaaaaaataaa

SEQ ID NO: 2434175 - DNA, 15 bp, Homo sapiens
tttgaaaaagcgaaa

SEQ ID NO: 2434176 - DNA, 17 bp, Homo sapiens
tttgaaaacatgtttat

SEQ ID NO: 2434177 - DNA, 19 bp, Homo sapiens
tttgaaaacatgtttattt

SEQ ID NO: 2434178 - DNA, 22 bp, Homo sapiens
tttgaaacccctgtaggcctca

SEQ ID NO: 2434179 - DNA, 21 bp, Homo sapiens
tttgaaaggagatgtcttgga

SEQ ID NO: 2434180 - DNA, 16 bp, Homo sapiens
tttgaaagtctgtcct

SEQ ID NO: 2434181 - DNA, 17 bp, Homo sapiens
tttgaaagtctgtcctt

SEQ ID NO: 2434182 - DNA, 21 bp, Homo sapiens
tttgaaattgaacctttgtgc

SEQ ID NO: 2434183 - DNA, 16 bp, Homo sapiens
tttgaagttagcttta

SEQ ID NO: 2434184 - DNA, 15 bp, Homo sapiens
tttgaataaatgtca

SEQ ID NO: 2434185 - DNA, 20 bp, Homo sapiens
tttgaataaatgtcactttt

SEQ ID NO: 2434186 - DNA, 17 bp, Homo sapiens
tttgaatgtgtttcaca

SEQ ID NO: 2434187 - DNA, 15 bp, Homo sapiens
tttgacactgctcta

SEQ ID NO: 2434188 - DNA, 16 bp, Homo sapiens
tttgaccccgatatat

SEQ ID NO: 2434189 - DNA, 14 bp, Homo sapiens
tttgagtgctctga

SEQ ID NO: 2434190 - DNA, 17 bp, Homo sapiens
tttgatactaagcattg

SEQ ID NO: 2434191 - DNA, 20 bp, Homo sapiens
tttgatatgcatatttgttt

SEQ ID NO: 2434192 - DNA, 21 bp, Homo sapiens
tttttctcgctgtcctttcta

SEQ ID NO: 2434193 - DNA, 13 bp, Homo sapiens
tttttctgataaa

SEQ ID NO: 2434194 - DNA, 21 bp, Homo sapiens
tttttcttttcggaaatctta

SEQ ID NO: 2434195 - DNA, 15 bp, Homo sapiens
tttttgatactaagc

SEQ ID NO: 2434196 - DNA, 16 bp, Homo sapiens
tttttgatcaaaaact

SEQ ID NO: 2434197 - DNA, 14 bp, Homo sapiens
tttttgcagtaact

SEQ ID NO: 2434198 - DNA, 21 bp, Homo sapiens
tttttgcatgatatcttcaag

SEQ ID NO: 2434199 - DNA, 22 bp, Homo sapiens
tttttggggggttttcttgcct

SEQ ID NO: 2434200 - DNA, 22 bp, Homo sapiens
tttttggtcgaggagtaacaat

SEQ ID NO: 2434201 - DNA, 12 bp, Homo sapiens
tttttgtaccaa

SEQ ID NO: 2434202 - DNA, 23 bp, Homo sapiens
tttttgtaccattttaaagttag

SEQ ID NO: 2434203 - DNA, 15 bp, Homo sapiens
tttttgtgtgtattt

SEQ ID NO: 2434204 - DNA, 12 bp, Homo sapiens
tttttgttgaca

SEQ ID NO: 2434205 - DNA, 13 bp, Homo sapiens
ttttttaaaaaag

SEQ ID NO: 2434206 - DNA, 12 bp, Homo sapiens
ttttttaggaaa

SEQ ID NO: 2434207 - DNA, 13 bp, Homo sapiens
ttttttagttgaa

SEQ ID NO: 2434208 - DNA, 12 bp, Homo sapiens
ttttttccaaaa

SEQ ID NO: 2434209 - DNA, 17 bp, Homo sapiens
ttttttgcagtaactgt

SEQ ID NO: 2434210 - DNA, 13 bp, Homo sapiens
ttttttgtaccaa

SEQ ID NO: 2434211 - DNA, 11 bp, Homo sapiens
tttttttgcag

SEQ ID NO: 2434212 - DNA, 12 bp, Homo sapiens
tttttttgtgtg

SEQ ID NO: 2434213 - DNA, 11 bp, Homo sapiens
ttttttttgca

SEQ ID NO: 2434214 - DNA, 20 bp, Homo sapiens
tcccttgcctcaatgccagt

SEQ ID NO: 2434215 - DNA, 16 bp, Homo sapiens
tcccttgggcacgtgt

SEQ ID NO: 2434216 - DNA, 14 bp, Homo sapiens
tcccttgggctccc

SEQ ID NO: 2434217 - DNA, 16 bp, Homo sapiens
tcccttgggctctgat

SEQ ID NO: 2434218 - DNA, 15 bp, Homo sapiens
tcccttgtagctcct

SEQ ID NO: 2434219 - DNA, 15 bp, Homo sapiens
tcccttgtatcccct

SEQ ID NO: 2434220 - DNA, 14 bp, Homo sapiens
tcccttttccatga

SEQ ID NO: 2434221 - DNA, 16 bp, Homo sapiens
tcccttttctgttcta

SEQ ID NO: 2434222 - DNA, 20 bp, Homo sapiens
tcccttttctgttctagttt

SEQ ID NO: 2434223 - DNA, 20 bp, Homo sapiens
tccctttttatatcccattt

SEQ ID NO: 2434224 - DNA, 16 bp, Homo sapiens
tccgactcacaccact

SEQ ID NO: 2434225 - DNA, 23 bp, Homo sapiens
tccgcagcccccacccccaaggt

SEQ ID NO: 2434226 - DNA, 15 bp, Homo sapiens
tccgcaggtgctggt

SEQ ID NO: 2434227 - DNA, 18 bp, Homo sapiens
tccgcaggtgctggtccc

SEQ ID NO: 2434228 - DNA, 19 bp, Homo sapiens
tccgccactggggctcaga

SEQ ID NO: 2434229 - DNA, 14 bp, Homo sapiens
tccgcccccaggta

SEQ ID NO: 2434230 - DNA, 14 bp, Homo sapiens
tccgccctgccact

SEQ ID NO: 2434231 - DNA, 15 bp, Homo sapiens
tccgccctgccactc

SEQ ID NO: 2434232 - DNA, 12 bp, Homo sapiens
tccggaaagaag

SEQ ID NO: 2434233 - DNA, 15 bp, Homo sapiens
tccggtgttctaaga

SEQ ID NO: 2434234 - DNA, 18 bp, Homo sapiens
tccgtcccctgcccatgc

SEQ ID NO: 2434235 - DNA, 16 bp, Homo sapiens
tccgtgtccaccccca

SEQ ID NO: 2434236 - DNA, 16 bp, Homo sapiens
tccgtgtgggagaccg

SEQ ID NO: 2434237 - DNA, 16 bp, Homo sapiens
tccgttagctcctgtg

SEQ ID NO: 2434238 - DNA, 17 bp, Homo sapiens
tccgttagctcctgtgg

SEQ ID NO: 2434239 - DNA, 18 bp, Homo sapiens
tcctaaattttcctgtcc

SEQ ID NO: 2434240 - DNA, 16 bp, Homo sapiens
tcctaagagtgctggg

SEQ ID NO: 2434241 - DNA, 19 bp, Homo sapiens
tcctaagagtgctgggcat

SEQ ID NO: 2434242 - DNA, 13 bp, Homo sapiens
tcctaagcatcta

SEQ ID NO: 2434243 - DNA, 15 bp, Homo sapiens
tcctaagcatctaag

SEQ ID NO: 2434244 - DNA, 18 bp, Homo sapiens
tcctaagggtcgaaagct

SEQ ID NO: 2434245 - DNA, 14 bp, Homo sapiens
tcctaatactgtca

SEQ ID NO: 2434246 - DNA, 13 bp, Homo sapiens
tcctacagaaaaa

SEQ ID NO: 2434247 - DNA, 14 bp, Homo sapiens
tcctaccaagtcaa

SEQ ID NO: 2434248 - DNA, 15 bp, Homo sapiens
tcctacctcaaaatt

SEQ ID NO: 2434249 - DNA, 13 bp, Homo sapiens
tcctagatcctaa

SEQ ID NO: 2434250 - DNA, 14 bp, Homo sapiens
tcctagatcctaag

SEQ ID NO: 2434251 - DNA, 12 bp, Homo sapiens
tcctagcacaga

SEQ ID NO: 2434252 - DNA, 19 bp, Homo sapiens
tcctatctccagcggccct

SEQ ID NO: 2434253 - DNA, 12 bp, Homo sapiens
tcctatgcatgg

SEQ ID NO: 2434254 - DNA, 20 bp, Homo sapiens
tcctatgcatggtttcagca

SEQ ID NO: 2434255 - DNA, 13 bp, Homo sapiens
tcctatgctttga

SEQ ID NO: 2434256 - DNA, 18 bp, Homo sapiens
tcctcaaagaaagtgtat

SEQ ID NO: 2434257 - DNA, 19 bp, Homo sapiens
tcctcaacccctcccctcc

SEQ ID NO: 2434258 - DNA, 23 bp, Homo sapiens
tcctcaagaaataaaaggaagcc

SEQ ID NO: 2434259 - DNA, 14 bp, Homo sapiens
tcctcaatccagct

SEQ ID NO: 2434260 - DNA, 21 bp, Homo sapiens
tcctcagactctaagaaagaa

SEQ ID NO: 2434261 - DNA, 10 bp, Homo sapiens
tcctcagcca

SEQ ID NO: 2434262 - DNA, 18 bp, Homo sapiens
tcctcagccttgccagag

SEQ ID NO: 2434263 - DNA, 17 bp, Homo sapiens
tcctcaggcacacagct

SEQ ID NO: 2434264 - DNA, 22 bp, Homo sapiens
tcctcaggcacacagctactct

SEQ ID NO: 2434265 - DNA, 14 bp, Homo sapiens
tcctcatgaatgta

SEQ ID NO: 2434266 - DNA, 19 bp, Homo sapiens
tcctcattgtaaacaaact

SEQ ID NO: 2434267 - DNA, 12 bp, Homo sapiens
tcctccacgcct

SEQ ID NO: 2434268 - DNA, 19 bp, Homo sapiens
tcctccacgttctgctcat

SEQ ID NO: 2434269 - DNA, 23 bp, Homo sapiens
tcctccacgttctgctcatcatt

SEQ ID NO: 2434270 - DNA, 17 bp, Homo sapiens
tcctccagcccctgtag

SEQ ID NO: 2434271 - DNA, 15 bp, Homo sapiens
tcctccaggaagcct

SEQ ID NO: 2434272 - DNA, 14 bp, Homo sapiens
tcctccagggacag

SEQ ID NO: 2434273 - DNA, 12 bp, Homo sapiens
tcctccatggga

SEQ ID NO: 2434274 - DNA, 21 bp, Homo sapiens
tcctcccaatttcagactccc

SEQ ID NO: 2434275 - DNA, 21 bp, Homo sapiens
tcctcccacccggctgcagag

SEQ ID NO: 2434276 - DNA, 12 bp, Homo sapiens
tcctcccagaaa

SEQ ID NO: 2434277 - DNA, 22 bp, Homo sapiens
tcctcccagggttttaactttg

SEQ ID NO: 2434278 - DNA, 21 bp, Homo sapiens
tcctccccacttgtccgctgg

SEQ ID NO: 2434279 - DNA, 15 bp, Homo sapiens
tcctcccctggaggg

SEQ ID NO: 2434280 - DNA, 15 bp, Homo sapiens
tcctccctgtaactt

SEQ ID NO: 2434281 - DNA, 20 bp, Homo sapiens
tcctcctcccacccggctgc

SEQ ID NO: 2434282 - DNA, 20 bp, Homo sapiens
tcctcctgcagaccacgccc

SEQ ID NO: 2434283 - DNA, 11 bp, Homo sapiens
tcctcctggaa

SEQ ID NO: 2434284 - DNA, 13 bp, Homo sapiens
tcctcgtttgtgt

SEQ ID NO: 2434285 - DNA, 17 bp, Homo sapiens
tcctctactaacaatca

SEQ ID NO: 2434286 - DNA, 21 bp, Homo sapiens
tcctctagctgtgggggtgag

SEQ ID NO: 2434287 - DNA, 17 bp, Homo sapiens
tcctctccccagcccag

SEQ ID NO: 2434288 - DNA, 20 bp, Homo sapiens
tcctctccccagcccagaga

SEQ ID NO: 2434289 - DNA, 23 bp, Homo sapiens
tcctctccccagcccagagacat

SEQ ID NO: 2434290 - DNA, 19 bp, Homo sapiens
tcctctcgcggccctcagt

SEQ ID NO: 2434291 - DNA, 17 bp, Homo sapiens
tcctctgactcagggct

SEQ ID NO: 2434292 - DNA, 18 bp, Homo sapiens
tcctctgactcagggctc

SEQ ID NO: 2434293 - DNA, 12 bp, Homo sapiens
tcctctgcactc

SEQ ID NO: 2434294 - DNA, 16 bp, Homo sapiens
tcctctgcactcccac

SEQ ID NO: 2434295 - DNA, 13 bp, Homo sapiens
tcctctggagcca

SEQ ID NO: 2434296 - DNA, 17 bp, Homo sapiens
tcctctggagccagccg

SEQ ID NO: 2434297 - DNA, 23 bp, Homo sapiens
tcctctgtctcgagcgccctgca

SEQ ID NO: 2434298 - DNA, 20 bp, Homo sapiens
tcctctgtgaccaatgtctt

SEQ ID NO: 2434299 - DNA, 15 bp, Homo sapiens
tcctcttccatgctg

SEQ ID NO: 2434300 - DNA, 13 bp, Homo sapiens
tcctctttcagct

SEQ ID NO: 2434301 - DNA, 18 bp, Homo sapiens
tcctcttttccttcccaa

SEQ ID NO: 2434302 - DNA, 17 bp, Homo sapiens
tcctgaaacaacttgga

SEQ ID NO: 2434303 - DNA, 18 bp, Homo sapiens
tcctgaagaaccagtccc

SEQ ID NO: 2434304 - DNA, 20 bp, Homo sapiens
tcctgacacccttctcccac

SEQ ID NO: 2434305 - DNA, 21 bp, Homo sapiens
tcctgacacccttctcccact

SEQ ID NO: 2434306 - DNA, 13 bp, Homo sapiens
tcctgacactgca

SEQ ID NO: 2434307 - DNA, 21 bp, Homo sapiens
tcctgaccagttgcagtcact

SEQ ID NO: 2434308 - DNA, 15 bp, Homo sapiens
tcctgacctccgcca

SEQ ID NO: 2434309 - DNA, 16 bp, Homo sapiens
tcctgacctccgccat

SEQ ID NO: 2434310 - DNA, 20 bp, Homo sapiens
tcctgacctccgccatccac

SEQ ID NO: 2434311 - DNA, 24 bp, Homo sapiens
tcctgagaaaaaaggttccgcttg

SEQ ID NO: 2434312 - DNA, 16 bp, Homo sapiens
tcctgagaaagctcaa

SEQ ID NO: 2434313 - DNA, 13 bp, Homo sapiens
tcctgagcactgc

SEQ ID NO: 2434314 - DNA, 18 bp, Homo sapiens
tcctgagcactgccagga

SEQ ID NO: 2434315 - DNA, 21 bp, Homo sapiens
tcctgagcactgccaggaggg

SEQ ID NO: 2434316 - DNA, 16 bp, Homo sapiens
tcctgagccccaggga

SEQ ID NO: 2434317 - DNA, 12 bp, Homo sapiens
tcctgagctcag

SEQ ID NO: 2434318 - DNA, 18 bp, Homo sapiens
tcctgagctcagcgtgga

SEQ ID NO: 2434319 - DNA, 15 bp, Homo sapiens
tcctgagtggtgcca

SEQ ID NO: 2434320 - DNA, 18 bp, Homo sapiens
tcctgcaactcaaggact

SEQ ID NO: 2434321 - DNA, 12 bp, Homo sapiens
tcctgcagcccc

SEQ ID NO: 2434322 - DNA, 16 bp, Homo sapiens
tcctgccacccagccc

SEQ ID NO: 2434323 - DNA, 15 bp, Homo sapiens
tcctgccatgtttag

SEQ ID NO: 2434324 - DNA, 16 bp, Homo sapiens
tcctgcctctactggg

SEQ ID NO: 2434325 - DNA, 22 bp, Homo sapiens
tcctgcctctactgggaaggct

SEQ ID NO: 2434326 - DNA, 18 bp, Homo sapiens
tcctgcctgtggccatga

SEQ ID NO: 2434327 - DNA, 14 bp, Homo sapiens
tcctgcctgtggcg

SEQ ID NO: 2434328 - DNA, 22 bp, Homo sapiens
tcctgccttcctcctgggccct

SEQ ID NO: 2434329 - DNA, 23 bp, Homo sapiens
tcctgccttcctcctgggccctc

SEQ ID NO: 2434330 - DNA, 15 bp, Homo sapiens
tcctgctgctccctc

SEQ ID NO: 2434331 - DNA, 18 bp, Homo sapiens
tcctgctgctccctcaga

SEQ ID NO: 2434332 - DNA, 23 bp, Homo sapiens
tcctgcttgatgggattctggac

SEQ ID NO: 2434333 - DNA, 18 bp, Homo sapiens
tcctgctttgggaagccg

SEQ ID NO: 2434334 - DNA, 22 bp, Homo sapiens
tcctggaagcgcgagggcctca

SEQ ID NO: 2434335 - DNA, 11 bp, Homo sapiens
tcctggacagc

SEQ ID NO: 2434336 - DNA, 14 bp, Homo sapiens
tcctggacagctgt

SEQ ID NO: 2434337 - DNA, 15 bp, Homo sapiens
tcctggacagctgtg

SEQ ID NO: 2434338 - DNA, 14 bp, Homo sapiens
tcctggcttcccat

SEQ ID NO: 2434339 - DNA, 16 bp, Homo sapiens
tcctgggaaatattcc

SEQ ID NO: 2434340 - DNA, 21 bp, Homo sapiens
tcctgggaaatattccctaga

SEQ ID NO: 2434341 - DNA, 16 bp, Homo sapiens
tcctgggccctctctg

SEQ ID NO: 2434342 - DNA, 15 bp, Homo sapiens
tcctgggcctgcaga

SEQ ID NO: 2434343 - DNA, 13 bp, Homo sapiens
tcctgggtggcta

SEQ ID NO: 2434344 - DNA, 15 bp, Homo sapiens
tcctgggtggctact

SEQ ID NO: 2434345 - DNA, 22 bp, Homo sapiens
tcctgggtggctactctgtgcc

SEQ ID NO: 2434346 - DNA, 22 bp, Homo sapiens
tcctgggttttgtattctctga

SEQ ID NO: 2434347 - DNA, 21 bp, Homo sapiens
tcctggtcacctaggaagcct

SEQ ID NO: 2434348 - DNA, 13 bp, Homo sapiens
tcctggtgccacc

SEQ ID NO: 2434349 - DNA, 14 bp, Homo sapiens
tcctggtgccacct

SEQ ID NO: 2434350 - DNA, 15 bp, Homo sapiens
tcctggtgccacctc

SEQ ID NO: 2434351 - DNA, 12 bp, Homo sapiens
tcctggtgctgg

SEQ ID NO: 2434352 - DNA, 14 bp, Homo sapiens
tcctggtgctggag

SEQ ID NO: 2434353 - DNA, 21 bp, Homo sapiens
tcctggtggtattttcaatag

SEQ ID NO: 2434354 - DNA, 23 bp, Homo sapiens
tcctggttcccgtttctccacct

SEQ ID NO: 2434355 - DNA, 16 bp, Homo sapiens
tcctgtattcagacag

SEQ ID NO: 2434356 - DNA, 21 bp, Homo sapiens
tcctgtattcagacagatgag

SEQ ID NO: 2434357 - DNA, 17 bp, Homo sapiens
tcctgtatttgttccca

SEQ ID NO: 2434358 - DNA, 19 bp, Homo sapiens
tcctgtatttgttcccaag

SEQ ID NO: 2434359 - DNA, 20 bp, Homo sapiens
tcctgtatttgttcccaaga

SEQ ID NO: 2434360 - DNA, 14 bp, Homo sapiens
tcctgtccagctcc

SEQ ID NO: 2434361 - DNA, 17 bp, Homo sapiens
tcctgtccagctccaac

SEQ ID NO: 2434362 - DNA, 19 bp, Homo sapiens
tcctgtcctctttcagctc

SEQ ID NO: 2434363 - DNA, 14 bp, Homo sapiens
tcctgtcttatcct

SEQ ID NO: 2434364 - DNA, 21 bp, Homo sapiens
tcctgtcttatcctccaccgt

SEQ ID NO: 2434365 - DNA, 16 bp, Homo sapiens
tcctgtgaatgccact

SEQ ID NO: 2434366 - DNA, 20 bp, Homo sapiens
tcctgtgaatgccactgcct

SEQ ID NO: 2434367 - DNA, 22 bp, Homo sapiens
tcctgtgaatgccactgccttc

SEQ ID NO: 2434368 - DNA, 16 bp, Homo sapiens
tcctgtgggagcctcg

SEQ ID NO: 2434369 - DNA, 22 bp, Homo sapiens
tcctgtgtggagagggaatgtg

SEQ ID NO: 2434370 - DNA, 21 bp, Homo sapiens
tcctgtgtgttaagctctgct

SEQ ID NO: 2434371 - DNA, 14 bp, Homo sapiens
tcctgtgtttgtga

SEQ ID NO: 2434372 - DNA, 15 bp, Homo sapiens
tcctgttcacaccag

SEQ ID NO: 2434373 - DNA, 21 bp, Homo sapiens
tcctgttgggagagggcgcag

SEQ ID NO: 2434374 - DNA, 17 bp, Homo sapiens
tcctgtttgtctacata

SEQ ID NO: 2434375 - DNA, 17 bp, Homo sapiens
tccttactcctgtggga

SEQ ID NO: 2434376 - DNA, 20 bp, Homo sapiens
tccttactcctgtgggagcc

SEQ ID NO: 2434377 - DNA, 17 bp, Homo sapiens
tccttactttttatata

SEQ ID NO: 2434378 - DNA, 18 bp, Homo sapiens
tccttagactcttttcct

SEQ ID NO: 2434379 - DNA, 13 bp, Homo sapiens
tccttagcctgga

SEQ ID NO: 2434380 - DNA, 14 bp, Homo sapiens
tccttagcctggac

SEQ ID NO: 2434381 - DNA, 21 bp, Homo sapiens
tccttcaaagtttaataaatt

SEQ ID NO: 2434382 - DNA, 18 bp, Homo sapiens
tccttcaacaattctaaa

SEQ ID NO: 2434383 - DNA, 13 bp, Homo sapiens
tccttcagagagc

SEQ ID NO: 2434384 - DNA, 22 bp, Homo sapiens
tccttcagagagcagtgctttt

SEQ ID NO: 2434385 - DNA, 14 bp, Homo sapiens
tccttcagatttgg

SEQ ID NO: 2434386 - DNA, 18 bp, Homo sapiens
tccttccaatgtctggag

SEQ ID NO: 2434387 - DNA, 22 bp, Homo sapiens
tccttccagctagtgacccaca

SEQ ID NO: 2434388 - DNA, 10 bp, Homo sapiens
tccttcccaa

SEQ ID NO: 2434389 - DNA, 12 bp, Homo sapiens
tccttcccagag

SEQ ID NO: 2434390 - DNA, 22 bp, Homo sapiens
tccttcccagaggggcctgcca

SEQ ID NO: 2434391 - DNA, 16 bp, Homo sapiens
tccttcccttttctgt

SEQ ID NO: 2434392 - DNA, 23 bp, Homo sapiens
tccttcctaaattttcctgtcct

SEQ ID NO: 2434393 - DNA, 15 bp, Homo sapiens
tccttcctgattgtt

SEQ ID NO: 2434394 - DNA, 10 bp, Homo sapiens
tccttcctgc

SEQ ID NO: 2434395 - DNA, 12 bp, Homo sapiens
tccttctccctt

SEQ ID NO: 2434396 - DNA, 18 bp, Homo sapiens
tccttgaagaactgcagg

SEQ ID NO: 2434397 - DNA, 16 bp, Homo sapiens
tccttgggccctttga

SEQ ID NO: 2434398 - DNA, 16 bp, Homo sapiens
tcctttaggtaagaag

SEQ ID NO: 2434399 - DNA, 19 bp, Homo sapiens
tcctttcatatagttagct

SEQ ID NO: 2434400 - DNA, 19 bp, Homo sapiens
tcctttctagagcactgcc

SEQ ID NO: 2434401 - DNA, 23 bp, Homo sapiens
tcctttgggcttcagctgccagt

SEQ ID NO: 2434402 - DNA, 13 bp, Homo sapiens
tccttttaaagaa

SEQ ID NO: 2434403 - DNA, 14 bp, Homo sapiens
tccttttaaagaaa

SEQ ID NO: 2434404 - DNA, 14 bp, Homo sapiens
tccttttcataggt

SEQ ID NO: 2434405 - DNA, 15 bp, Homo sapiens
tccttttcctctctc

SEQ ID NO: 2434406 - DNA, 17 bp, Homo sapiens
tcctttttaatatgctt

SEQ ID NO: 2434407 - DNA, 23 bp, Homo sapiens
tcctttttggtcgaggagtaaca

SEQ ID NO: 2434408 - DNA, 12 bp, Homo sapiens
tcctttttttcc

SEQ ID NO: 2434409 - DNA, 18 bp, Homo sapiens
tcgaaacacagaaacctt

SEQ ID NO: 2434410 - DNA, 14 bp, Homo sapiens
tcgaaagctctaga

SEQ ID NO: 2434411 - DNA, 16 bp, Homo sapiens
tcgaaagctctagaat

SEQ ID NO: 2434412 - DNA, 15 bp, Homo sapiens
tcgaaccgttttgaa

SEQ ID NO: 2434413 - DNA, 22 bp, Homo sapiens
tcgaagaaacccttgctgcttt

SEQ ID NO: 2434414 - DNA, 16 bp, Homo sapiens
tcgaatctctgtgcct

SEQ ID NO: 2434415 - DNA, 22 bp, Homo sapiens
tcgaatctctgtgccttcgtct

SEQ ID NO: 2434416 - DNA, 20 bp, Homo sapiens
tcgagaaagaggcaccagga

SEQ ID NO: 2434417 - DNA, 21 bp, Homo sapiens
tcgagaaagaggcaccaggaa

SEQ ID NO: 2434418 - DNA, 22 bp, Homo sapiens
tcgagcagtcctgcctcagcct

SEQ ID NO: 2434419 - DNA, 16 bp, Homo sapiens
tcgagcgccctgcaga

SEQ ID NO: 2434420 - DNA, 14 bp, Homo sapiens
tcgaggagtaacaa

SEQ ID NO: 2434421 - DNA, 14 bp, Homo sapiens
tcgagtgagacaga

SEQ ID NO: 2434422 - DNA, 20 bp, Homo sapiens
tcgatactgcgactttctgc

SEQ ID NO: 2434423 - DNA, 22 bp, Homo sapiens
tcgatactgcgactttctgcct

SEQ ID NO: 2434424 - DNA, 20 bp, Homo sapiens
tcgcaacccgtgccaagtcc

SEQ ID NO: 2434425 - DNA, 17 bp, Homo sapiens
tcgcaccattctgactc

SEQ ID NO: 2434426 - DNA, 12 bp, Homo sapiens
tcgcagccaccc

SEQ ID NO: 2434427 - DNA, 16 bp, Homo sapiens
tcgcagccaccctgag

SEQ ID NO: 2434428 - DNA, 18 bp, Homo sapiens
tcgcagccaccctgagga

SEQ ID NO: 2434429 - DNA, 20 bp, Homo sapiens
tcgcagccaccctgaggagt

SEQ ID NO: 2434430 - DNA, 11 bp, Homo sapiens
tcgcctgacaa

SEQ ID NO: 2434431 - DNA, 20 bp, Homo sapiens
tcgcctgacaaccactggtc

SEQ ID NO: 2434432 - DNA, 21 bp, Homo sapiens
tcgcctgacaaccactggtct

SEQ ID NO: 2434433 - DNA, 22 bp, Homo sapiens
tcgcctgacaaccactggtctg

SEQ ID NO: 2434434 - DNA, 22 bp, Homo sapiens
tcgcggccctcagtagtccctg

SEQ ID NO: 2434435 - DNA, 14 bp, Homo sapiens
tcgctccccactct

SEQ ID NO: 2434436 - DNA, 15 bp, Homo sapiens
tcgctccccactctg

SEQ ID NO: 2434437 - DNA, 18 bp, Homo sapiens
tcgctccccactctgctc

SEQ ID NO: 2434438 - DNA, 19 bp, Homo sapiens
tcgctcctcaacccctccc

SEQ ID NO: 2434439 - DNA, 14 bp, Homo sapiens
tcgctcctgcccac

SEQ ID NO: 2434440 - DNA, 22 bp, Homo sapiens
tcgctggactctcagtctctga

SEQ ID NO: 2434441 - DNA, 14 bp, Homo sapiens
tcgcttcttgcctc

SEQ ID NO: 2434442 - DNA, 15 bp, Homo sapiens
tcgcttcttgcctct

SEQ ID NO: 2434443 - DNA, 13 bp, Homo sapiens
tcggaaaaataat

SEQ ID NO: 2434444 - DNA, 15 bp, Homo sapiens
tcggaaatcttaaac

SEQ ID NO: 2434445 - DNA, 21 bp, Homo sapiens
tcggacaagacccccagcact

SEQ ID NO: 2434446 - DNA, 13 bp, Homo sapiens
tcggaggaagccc

SEQ ID NO: 2434447 - DNA, 10 bp, Homo sapiens
tcggattaga

SEQ ID NO: 2434448 - DNA, 13 bp, Homo sapiens
tcggattttttcc

SEQ ID NO: 2434449 - DNA, 17 bp, Homo sapiens
tcggattttttccaaaa

SEQ ID NO: 2434450 - DNA, 13 bp, Homo sapiens
tcggccacagggc

SEQ ID NO: 2434451 - DNA, 14 bp, Homo sapiens
tcggcctgccccca

SEQ ID NO: 2434452 - DNA, 19 bp, Homo sapiens
tcggcctgcccccacccca

SEQ ID NO: 2434453 - DNA, 13 bp, Homo sapiens
tcgggcccttccc

SEQ ID NO: 2434454 - DNA, 14 bp, Homo sapiens
tcggggtgcacagg

SEQ ID NO: 2434455 - DNA, 19 bp, Homo sapiens
tcggggtgcacaggagggg

SEQ ID NO: 2434456 - DNA, 14 bp, Homo sapiens
tcggtctgtgcccc

SEQ ID NO: 2434457 - DNA, 15 bp, Homo sapiens
tcgtaaagatttggg

SEQ ID NO: 2434458 - DNA, 20 bp, Homo sapiens
tcgtaagatttccttctttt

SEQ ID NO: 2434459 - DNA, 16 bp, Homo sapiens
tcgtccttactcctgt

SEQ ID NO: 2434460 - DNA, 19 bp, Homo sapiens
tcgtccttactcctgtggg

SEQ ID NO: 2434461 - DNA, 21 bp, Homo sapiens
tcgtctcggccttcacaatct

SEQ ID NO: 2434462 - DNA, 23 bp, Homo sapiens
tcgtctcttttaccctggcccct

SEQ ID NO: 2434463 - DNA, 17 bp, Homo sapiens
tcgtgacctgctaggcc

SEQ ID NO: 2434464 - DNA, 12 bp, Homo sapiens
tcgtgcctgtgt

SEQ ID NO: 2434465 - DNA, 21 bp, Homo sapiens
tcgtgcctgtgtccatgcgct

SEQ ID NO: 2434466 - DNA, 20 bp, Homo sapiens
tcgtggactgagtgggaagc

SEQ ID NO: 2434467 - DNA, 12 bp, Homo sapiens
tcgtggggaggt

SEQ ID NO: 2434468 - DNA, 20 bp, Homo sapiens
tcgtttgtttgtttgtttaa

SEQ ID NO: 2434469 - DNA, 13 bp, Homo sapiens
tcgttttcttaaa

SEQ ID NO: 2434470 - DNA, 21 bp, Homo sapiens
tcgttttcttaaagtgccagt

SEQ ID NO: 2434471 - DNA, 14 bp, Homo sapiens
tcgttttttacaaa

SEQ ID NO: 2434472 - DNA, 17 bp, Homo sapiens
tcgtttttttcattcca

SEQ ID NO: 2434473 - DNA, 20 bp, Homo sapiens
tcgttttttttttgtttgtt

SEQ ID NO: 2434474 - DNA, 23 bp, Homo sapiens
tctaaaatcttatagttctaggc

SEQ ID NO: 2434475 - DNA, 20 bp, Homo sapiens
tctaaaatgtgatgttctaa

SEQ ID NO: 2434476 - DNA, 21 bp, Homo sapiens
tctaaaatgtgatgttctaag

SEQ ID NO: 2434477 - DNA, 19 bp, Homo sapiens
tctaaacccaatccaaatg

SEQ ID NO: 2434478 - DNA, 18 bp, Homo sapiens
tctaaagatggagtttct

SEQ ID NO: 2434479 - DNA, 21 bp, Homo sapiens
tctaaagatggagtttctaag

SEQ ID NO: 2434480 - DNA, 22 bp, Homo sapiens
tctaaagatggagtttctaagg

SEQ ID NO: 2434481 - DNA, 11 bp, Homo sapiens
tctaaagcaaa

SEQ ID NO: 2434482 - DNA, 19 bp, Homo sapiens
tctaaagctggtttaatgt

SEQ ID NO: 2434483 - DNA, 14 bp, Homo sapiens
tctaaaggtccaca

SEQ ID NO: 2434484 - DNA, 17 bp, Homo sapiens
tctaaaggtccacaggt

SEQ ID NO: 2434485 - DNA, 12 bp, Homo sapiens
tctaaagttcta

SEQ ID NO: 2434486 - DNA, 13 bp, Homo sapiens
tctaacagcacca

SEQ ID NO: 2434487 - DNA, 21 bp, Homo sapiens
tctaacagccctcctctgcac

SEQ ID NO: 2434488 - DNA, 20 bp, Homo sapiens
tctaacctcatcttcttcac

SEQ ID NO: 2434489 - DNA, 13 bp, Homo sapiens
tctaacgcctgag

SEQ ID NO: 2434490 - DNA, 14 bp, Homo sapiens
tctaacgcctgagc

SEQ ID NO: 2434491 - DNA, 21 bp, Homo sapiens
tctaacgcctgagcccaggga

SEQ ID NO: 2434492 - DNA, 17 bp, Homo sapiens
tctaacggtctgttctg

SEQ ID NO: 2434493 - DNA, 17 bp, Homo sapiens
tctaactacaaaggttt

SEQ ID NO: 2434494 - DNA, 19 bp, Homo sapiens
tctaacttggctcacactc

SEQ ID NO: 2434495 - DNA, 13 bp, Homo sapiens
tctaagaaacatt

SEQ ID NO: 2434496 - DNA, 17 bp, Homo sapiens
tctaagaaacatttata

SEQ ID NO: 2434497 - DNA, 22 bp, Homo sapiens
tctaagaaacatttatattgat

SEQ ID NO: 2434498 - DNA, 12 bp, Homo sapiens
tctaagaaagaa

SEQ ID NO: 2434499 - DNA, 16 bp, Homo sapiens
tctaagaaattgaata

SEQ ID NO: 2434500 - DNA, 19 bp, Homo sapiens
tctaagaaattgaatactt

SEQ ID NO: 2434501 - DNA, 16 bp, Homo sapiens
tctaagactcaaatgt

SEQ ID NO: 2434502 - DNA, 22 bp, Homo sapiens
tctaagactcaaatgttctaag

SEQ ID NO: 2434503 - DNA, 20 bp, Homo sapiens
tctaagagaacaatgtgcta

SEQ ID NO: 2434504 - DNA, 12 bp, Homo sapiens
tctaagatctta

SEQ ID NO: 2434505 - DNA, 17 bp, Homo sapiens
tctaagatcttagattc

SEQ ID NO: 2434506 - DNA, 20 bp, Homo sapiens
tctaagatgtgatattctaa

SEQ ID NO: 2434507 - DNA, 21 bp, Homo sapiens
tctaagatgtgatattctaag

SEQ ID NO: 2434508 - DNA, 16 bp, Homo sapiens
tctaagattctaaagg

SEQ ID NO: 2434509 - DNA, 19 bp, Homo sapiens
tctaagattctagatcaga

SEQ ID NO: 2434510 - DNA, 12 bp, Homo sapiens
tctaagattctg

SEQ ID NO: 2434511 - DNA, 19 bp, Homo sapiens
tctaagattctgattttag

SEQ ID NO: 2434512 - DNA, 16 bp, Homo sapiens
tctaaggctctgagag

SEQ ID NO: 2434513 - DNA, 22 bp, Homo sapiens
tctaaggctctgagagtctaga

SEQ ID NO: 2434514 - DNA, 23 bp, Homo sapiens
tctaaggctctgagagtctagat

SEQ ID NO: 2434515 - DNA, 22 bp, Homo sapiens
tctaagttataagactctcaca

SEQ ID NO: 2434516 - DNA, 12 bp, Homo sapiens
tctaagtttcta

SEQ ID NO: 2434517 - DNA, 14 bp, Homo sapiens
tctaagtttctaag

SEQ ID NO: 2434518 - DNA, 15 bp, Homo sapiens
tctaagtttctaaga

SEQ ID NO: 2434519 - DNA, 16 bp, Homo sapiens
tctaagtttctaagat

SEQ ID NO: 2434520 - DNA, 18 bp, Homo sapiens
tctaagtttctaagattc

SEQ ID NO: 2434521 - DNA, 20 bp, Homo sapiens
tctaagtttctaagattcta

SEQ ID NO: 2434522 - DNA, 16 bp, Homo sapiens
tctaataatttctaat

SEQ ID NO: 2434523 - DNA, 18 bp, Homo sapiens
tctaataatttctaatgt

SEQ ID NO: 2434524 - DNA, 19 bp, Homo sapiens
tctaatctagatatcgact

SEQ ID NO: 2434525 - DNA, 14 bp, Homo sapiens
tctaattgccatgt

SEQ ID NO: 2434526 - DNA, 12 bp, Homo sapiens
tctaattgctta

SEQ ID NO: 2434527 - DNA, 15 bp, Homo sapiens
tctaattgcttattt

SEQ ID NO: 2434528 - DNA, 14 bp, Homo sapiens
tctaatttataaaa

SEQ ID NO: 2434529 - DNA, 15 bp, Homo sapiens
tctaatttttaagaa

SEQ ID NO: 2434530 - DNA, 16 bp, Homo sapiens
tctacagagcttccct

SEQ ID NO: 2434531 - DNA, 17 bp, Homo sapiens
tctacagagcttccctg

SEQ ID NO: 2434532 - DNA, 18 bp, Homo sapiens
tctacagagcttccctga

SEQ ID NO: 2434533 - DNA, 16 bp, Homo sapiens
tctacatcttctgcct

SEQ ID NO: 2434534 - DNA, 23 bp, Homo sapiens
tctaccccagactagatgtagta

SEQ ID NO: 2434535 - DNA, 13 bp, Homo sapiens
tctaccctgggat

SEQ ID NO: 2434536 - DNA, 16 bp, Homo sapiens
tctacctagatttaat

SEQ ID NO: 2434537 - DNA, 22 bp, Homo sapiens
tctacctagatttaatataaag

SEQ ID NO: 2434538 - DNA, 15 bp, Homo sapiens
tctacctcaggcagc

SEQ ID NO: 2434539 - DNA, 19 bp, Homo sapiens
tctactaatgcctcttcat

SEQ ID NO: 2434540 - DNA, 21 bp, Homo sapiens
tctactcacttttcccactcc

SEQ ID NO: 2434541 - DNA, 17 bp, Homo sapiens
tctactttccctctggg

SEQ ID NO: 2434542 - DNA, 20 bp, Homo sapiens
tctactttgaagtcatacca

SEQ ID NO: 2434543 - DNA, 16 bp, Homo sapiens
tctagaaaaacaggca

SEQ ID NO: 2434544 - DNA, 19 bp, Homo sapiens
tctagacatggaggttcta

SEQ ID NO: 2434545 - DNA, 20 bp, Homo sapiens
tctagacatggaggttctaa

SEQ ID NO: 2434546 - DNA, 14 bp, Homo sapiens
tctagaccaataaa

SEQ ID NO: 2434547 - DNA, 15 bp, Homo sapiens
tctagagtccaaggt

SEQ ID NO: 2434548 - DNA, 15 bp, Homo sapiens
tctagatatcgactt

SEQ ID NO: 2434549 - DNA, 14 bp, Homo sapiens
tctagatcataagg

SEQ ID NO: 2434550 - DNA, 13 bp, Homo sapiens
tctagattcaaag

SEQ ID NO: 2434551 - DNA, 22 bp, Homo sapiens
tctagattcaaaggttctaggt

SEQ ID NO: 2434552 - DNA, 23 bp, Homo sapiens
tctagattccattggtccaagat

SEQ ID NO: 2434553 - DNA, 14 bp, Homo sapiens
tctagattctctgg

SEQ ID NO: 2434554 - DNA, 15 bp, Homo sapiens
tctaggcactgtagt

SEQ ID NO: 2434555 - DNA, 23 bp, Homo sapiens
tctaggttctaaaaattgtgatc

SEQ ID NO: 2434556 - DNA, 19 bp, Homo sapiens
tctaggtttcaaagatgct

SEQ ID NO: 2434557 - DNA, 14 bp, Homo sapiens
tctagtcaatgaca

SEQ ID NO: 2434558 - DNA, 14 bp, Homo sapiens
tctagttcattgaa

SEQ ID NO: 2434559 - DNA, 13 bp, Homo sapiens
tctagttctttgt

SEQ ID NO: 2434560 - DNA, 14 bp, Homo sapiens
tctataaagcattt

SEQ ID NO: 2434561 - DNA, 16 bp, Homo sapiens
tctataaagcatttaa

SEQ ID NO: 2434562 - DNA, 17 bp, Homo sapiens
tctataaagcatttaac

SEQ ID NO: 2434563 - DNA, 13 bp, Homo sapiens
tctataaggccat

SEQ ID NO: 2434564 - DNA, 22 bp, Homo sapiens
tctataaggccataaaacaggt

SEQ ID NO: 2434565 - DNA, 17 bp, Homo sapiens
tctatagccaaaaatag

SEQ ID NO: 2434566 - DNA, 14 bp, Homo sapiens
tctatagttctaga

SEQ ID NO: 2434567 - DNA, 15 bp, Homo sapiens
tctatagttctagac

SEQ ID NO: 2434568 - DNA, 16 bp, Homo sapiens
tctatgagtctagatg

SEQ ID NO: 2434569 - DNA, 12 bp, Homo sapiens
tctattaaaaga

SEQ ID NO: 2434570 - DNA, 16 bp, Homo sapiens
tctattaaaagactca

SEQ ID NO: 2434571 - DNA, 18 bp, Homo sapiens
tctattaaaagactcatc

SEQ ID NO: 2434572 - DNA, 21 bp, Homo sapiens
tctattaaaagactcatccgt

SEQ ID NO: 2434573 - DNA, 22 bp, Homo sapiens
tctattaaagtgctaaggttct

SEQ ID NO: 2434574 - DNA, 17 bp, Homo sapiens
tctattacattttcagt

SEQ ID NO: 2434575 - DNA, 16 bp, Homo sapiens
tctattctttaactcc

SEQ ID NO: 2434576 - DNA, 14 bp, Homo sapiens
tctatttctcctcc

SEQ ID NO: 2434577 - DNA, 18 bp, Homo sapiens
tctatttggggcttgatg

SEQ ID NO: 2434578 - DNA, 15 bp, Homo sapiens
tctattttggattgt

SEQ ID NO: 2434579 - DNA, 18 bp, Homo sapiens
tctattttggattgtata

SEQ ID NO: 2434580 - DNA, 18 bp, Homo sapiens
tctcaaaacagagggctg

SEQ ID NO: 2434581 - DNA, 21 bp, Homo sapiens
tctcaacaccatgattccttt

SEQ ID NO: 2434582 - DNA, 17 bp, Homo sapiens
tctcaacaggcctcagg

SEQ ID NO: 2434583 - DNA, 13 bp, Homo sapiens
tctcaagttctaa

SEQ ID NO: 2434584 - DNA, 15 bp, Homo sapiens
tctcaagttctaaga

SEQ ID NO: 2434585 - DNA, 17 bp, Homo sapiens
tctcaagttctaagatt

SEQ ID NO: 2434586 - DNA, 21 bp, Homo sapiens
tctcaagttctaagattctaa

SEQ ID NO: 2434587 - DNA, 13 bp, Homo sapiens
tctcaccaggcag

SEQ ID NO: 2434588 - DNA, 21 bp, Homo sapiens
tctcaccaggcagcctctggg

SEQ ID NO: 2434589 - DNA, 15 bp, Homo sapiens
tctcaccatttggat

SEQ ID NO: 2434590 - DNA, 14 bp, Homo sapiens
tctcaccctggagg

SEQ ID NO: 2434591 - DNA, 18 bp, Homo sapiens
tctcaccctggaggcacc

SEQ ID NO: 2434592 - DNA, 20 bp, Homo sapiens
tctcagcccctttcccttgt

SEQ ID NO: 2434593 - DNA, 12 bp, Homo sapiens
tctcagcctccc

SEQ ID NO: 2434594 - DNA, 13 bp, Homo sapiens
tctcagcctccca

SEQ ID NO: 2434595 - DNA, 16 bp, Homo sapiens
tctcagctccaggtgg

SEQ ID NO: 2434596 - DNA, 21 bp, Homo sapiens
tctcagctccaggtggctctg

SEQ ID NO: 2434597 - DNA, 21 bp, Homo sapiens
tctcaggacacaggcctgtgt

SEQ ID NO: 2434598 - DNA, 15 bp, Homo sapiens
tctcaggatccaagc

SEQ ID NO: 2434599 - DNA, 16 bp, Homo sapiens
tctcaggctaggccag

SEQ ID NO: 2434600 - DNA, 17 bp, Homo sapiens
tctcaggctaggccagc

SEQ ID NO: 2434601 - DNA, 20 bp, Homo sapiens
tctcaggctaggccagcagg

SEQ ID NO: 2434602 - DNA, 13 bp, Homo sapiens
tctcaggctgcct

SEQ ID NO: 2434603 - DNA, 15 bp, Homo sapiens
tctcaggctgcctga

SEQ ID NO: 2434604 - DNA, 14 bp, Homo sapiens
tctcagggccaggc

SEQ ID NO: 2434605 - DNA, 17 bp, Homo sapiens
tctcagggccaggcctc

SEQ ID NO: 2434606 - DNA, 13 bp, Homo sapiens
tctcagtctctga

SEQ ID NO: 2434607 - DNA, 15 bp, Homo sapiens
tctcagtctctgagc

SEQ ID NO: 2434608 - DNA, 17 bp, Homo sapiens
tctcagtctctgagcag

SEQ ID NO: 2434609 - DNA, 18 bp, Homo sapiens
tctcagtctctgagcagt

SEQ ID NO: 2434610 - DNA, 13 bp, Homo sapiens
tctcatccatcat

SEQ ID NO: 2434611 - DNA, 14 bp, Homo sapiens
tctcatccatcatc

SEQ ID NO: 2434612 - DNA, 13 bp, Homo sapiens
tctcatctcttca

SEQ ID NO: 2434613 - DNA, 18 bp, Homo sapiens
tctcatctcttcaggttc

SEQ ID NO: 2434614 - DNA, 12 bp, Homo sapiens
tctcatgccagt

SEQ ID NO: 2434615 - DNA, 18 bp, Homo sapiens
tctcatgcccctggctgg

SEQ ID NO: 2434616 - DNA, 16 bp, Homo sapiens
tctcattaaaagaata

SEQ ID NO: 2434617 - DNA, 19 bp, Homo sapiens
tctcattggaaatttagca

SEQ ID NO: 2434618 - DNA, 20 bp, Homo sapiens
tctcattggaaatttagcat

SEQ ID NO: 2434619 - DNA, 24 bp, Homo sapiens
tctcattggaaatttagcattgta

SEQ ID NO: 2434620 - DNA, 23 bp, Homo sapiens
tctccaaactgaagcagcctctc

SEQ ID NO: 2434621 - DNA, 19 bp, Homo sapiens
tctccaacatcacagccca

SEQ ID NO: 2434622 - DNA, 15 bp, Homo sapiens
tctccactttcagct

SEQ ID NO: 2434623 - DNA, 16 bp, Homo sapiens
tctccactttcagctg

SEQ ID NO: 2434624 - DNA, 15 bp, Homo sapiens
tctccagctgactaa

SEQ ID NO: 2434625 - DNA, 17 bp, Homo sapiens
tctccagctgggctctg

SEQ ID NO: 2434626 - DNA, 19 bp, Homo sapiens
tctccagctgggctctgca

SEQ ID NO: 2434627 - DNA, 23 bp, Homo sapiens
tctccaggggctgcttcctcctg

SEQ ID NO: 2434628 - DNA, 13 bp, Homo sapiens
tctccatccacat

SEQ ID NO: 2434629 - DNA, 19 bp, Homo sapiens
tctccatccacatgggagc

SEQ ID NO: 2434630 - DNA, 14 bp, Homo sapiens
tctccatggccctg

SEQ ID NO: 2434631 - DNA, 15 bp, Homo sapiens
tctccatggccctgc

SEQ ID NO: 2434632 - DNA, 18 bp, Homo sapiens
tctccatggccctgcaaa

SEQ ID NO: 2434633 - DNA, 17 bp, Homo sapiens
tctcccaccctcttcct

SEQ ID NO: 2434634 - DNA, 19 bp, Homo sapiens
tctcccaccctcttcctac

SEQ ID NO: 2434635 - DNA, 20 bp, Homo sapiens
tctcccaccctcttcctact

SEQ ID NO: 2434636 - DNA, 17 bp, Homo sapiens
tctcccaggccccatga

SEQ ID NO: 2434637 - DNA, 13 bp, Homo sapiens
tctcccagttgtc

SEQ ID NO: 2434638 - DNA, 17 bp, Homo sapiens
tctccccagcccagaga

SEQ ID NO: 2434639 - DNA, 19 bp, Homo sapiens
tctccccagcccagagaca

SEQ ID NO: 2434640 - DNA, 14 bp, Homo sapiens
tctccccagctccc

SEQ ID NO: 2434641 - DNA, 15 bp, Homo sapiens
tctccccaggtccag

SEQ ID NO: 2434642 - DNA, 12 bp, Homo sapiens
tctcccctgcac

SEQ ID NO: 2434643 - DNA, 12 bp, Homo sapiens
tctcccctgccc

SEQ ID NO: 2434644 - DNA, 18 bp, Homo sapiens
tctcccctgccccctgca

SEQ ID NO: 2434645 - DNA, 19 bp, Homo sapiens
tctccctgcatggcatcct

SEQ ID NO: 2434646 - DNA, 20 bp, Homo sapiens
tctccctggaatgagttgag

SEQ ID NO: 2434647 - DNA, 18 bp, Homo sapiens
tctccctgtacagtgtta

SEQ ID NO: 2434648 - DNA, 22 bp, Homo sapiens
tctcccttgggctctgatgaaa

SEQ ID NO: 2434649 - DNA, 18 bp, Homo sapiens
tctccgttagctcctgtg

SEQ ID NO: 2434650 - DNA, 21 bp, Homo sapiens
tctccgttagctcctgtggcc

SEQ ID NO: 2434651 - DNA, 19 bp, Homo sapiens
tctcctaggcattctggac

SEQ ID NO: 2434652 - DNA, 15 bp, Homo sapiens
tctcctcactgtatc

SEQ ID NO: 2434653 - DNA, 18 bp, Homo sapiens
tctcctgctgctccctca

SEQ ID NO: 2434654 - DNA, 20 bp, Homo sapiens
tctcctgctgctccctcaga

SEQ ID NO: 2434655 - DNA, 11 bp, Homo sapiens
tctcctggagg

SEQ ID NO: 2434656 - DNA, 13 bp, Homo sapiens
tctcctggcttcc

SEQ ID NO: 2434657 - DNA, 18 bp, Homo sapiens
tctcctggcttcccatcc

SEQ ID NO: 2434658 - DNA, 23 bp, Homo sapiens
tctcctggcttcccatccccagc

SEQ ID NO: 2434659 - DNA, 14 bp, Homo sapiens
tctccttcttagct

SEQ ID NO: 2434660 - DNA, 17 bp, Homo sapiens
tctcctttaattgtaaa

SEQ ID NO: 2434661 - DNA, 17 bp, Homo sapiens
tctccttttcctctctc

SEQ ID NO: 2434662 - DNA, 14 bp, Homo sapiens
tctcgcacacctct

SEQ ID NO: 2434663 - DNA, 21 bp, Homo sapiens
tctcggctccccatgtgtcct

SEQ ID NO: 2434664 - DNA, 14 bp, Homo sapiens
tctctaacagtgga

SEQ ID NO: 2434665 - DNA, 22 bp, Homo sapiens
tctctacagtctcgtctctttt

SEQ ID NO: 2434666 - DNA, 22 bp, Homo sapiens
tctctactgaatgtcattgaaa

SEQ ID NO: 2434667 - DNA, 22 bp, Homo sapiens
tctctcaacaccatgattcctt

SEQ ID NO: 2434668 - DNA, 16 bp, Homo sapiens
tctctcagggccaggc

SEQ ID NO: 2434669 - DNA, 13 bp, Homo sapiens
tctctcaggtgaa

SEQ ID NO: 2434670 - DNA, 17 bp, Homo sapiens
tctctccactttcagct

SEQ ID NO: 2434671 - DNA, 19 bp, Homo sapiens
tctctccactttcagctgt

SEQ ID NO: 2434672 - DNA, 20 bp, Homo sapiens
tctctccactttcagctgtc

SEQ ID NO: 2434673 - DNA, 18 bp, Homo sapiens
tctctccagctgactaaa

SEQ ID NO: 2434674 - DNA, 19 bp, Homo sapiens
tctctccagctgactaaac

SEQ ID NO: 2434675 - DNA, 14 bp, Homo sapiens
tctctccctcccct

SEQ ID NO: 2434676 - DNA, 15 bp, Homo sapiens
tctctcggctcccca

SEQ ID NO: 2434677 - DNA, 13 bp, Homo sapiens
tctctctatgcct

SEQ ID NO: 2434678 - DNA, 22 bp, Homo sapiens
tctctctcactccctccctttc

SEQ ID NO: 2434679 - DNA, 11 bp, Homo sapiens
tctctctgtgg

SEQ ID NO: 2434680 - DNA, 12 bp, Homo sapiens
tctctcttctct

SEQ ID NO: 2434681 - DNA, 13 bp, Homo sapiens
tctctgacttctg

SEQ ID NO: 2434682 - DNA, 14 bp, Homo sapiens
tctctgccagtgac

SEQ ID NO: 2434683 - DNA, 12 bp, Homo sapiens
tctctgcccaac

SEQ ID NO: 2434684 - DNA, 14 bp, Homo sapiens
tctctgctggccca

SEQ ID NO: 2434685 - DNA, 15 bp, Homo sapiens
tctctgctggcccag

SEQ ID NO: 2434686 - DNA, 19 bp, Homo sapiens
tctctgctggcccagccaa

SEQ ID NO: 2434687 - DNA, 15 bp, Homo sapiens
tctctgggctggatg

SEQ ID NO: 2434688 - DNA, 17 bp, Homo sapiens
tctctgggctggatgag

SEQ ID NO: 2434689 - DNA, 22 bp, Homo sapiens
tctctgggctggatgagctccc

SEQ ID NO: 2434690 - DNA, 16 bp, Homo sapiens
tctctgtctcatccat

SEQ ID NO: 2434691 - DNA, 17 bp, Homo sapiens
tctctgtgccttcgtct

SEQ ID NO: 2434692 - DNA, 21 bp, Homo sapiens
tctctgtgtctaagattctag

SEQ ID NO: 2434693 - DNA, 10 bp, Homo sapiens
tctctgtgtt

SEQ ID NO: 2434694 - DNA, 13 bp, Homo sapiens
tctctgttgtcgt

SEQ ID NO: 2434695 - DNA, 18 bp, Homo sapiens
tctctgttgtcgtaaaga

SEQ ID NO: 2434696 - DNA, 16 bp, Homo sapiens
tctcttatggatgtcc

SEQ ID NO: 2434697 - DNA, 20 bp, Homo sapiens
tctcttatggatgtccccag

SEQ ID NO: 2434698 - DNA, 16 bp, Homo sapiens
tctcttattgcctcac

SEQ ID NO: 2434699 - DNA, 22 bp, Homo sapiens
tctcttcctcttcccccaagat

SEQ ID NO: 2434700 - DNA, 14 bp, Homo sapiens
tctcttgagtttgt

SEQ ID NO: 2434701 - DNA, 12 bp, Homo sapiens
tctcttgcctgc

SEQ ID NO: 2434702 - DNA, 20 bp, Homo sapiens
tctcttgcctgccactgtgt

SEQ ID NO: 2434703 - DNA, 22 bp, Homo sapiens
tctcttgtataagatcctagat

SEQ ID NO: 2434704 - DNA, 13 bp, Homo sapiens
tctctttgcctca

SEQ ID NO: 2434705 - DNA, 18 bp, Homo sapiens
tctgaaaatataaccagc

SEQ ID NO: 2434706 - DNA, 15 bp, Homo sapiens
tctgaaaccagtgtt

SEQ ID NO: 2434707 - DNA, 20 bp, Homo sapiens
tctgaaatttttcttcttga

SEQ ID NO: 2434708 - DNA, 12 bp, Homo sapiens
tctgaacagctg

SEQ ID NO: 2434709 - DNA, 15 bp, Homo sapiens
tctgaacagctggtg

SEQ ID NO: 2434710 - DNA, 20 bp, Homo sapiens
tctgaacagctggtgtagct

SEQ ID NO: 2434711 - DNA, 18 bp, Homo sapiens
tctgaagccctcccaggt

SEQ ID NO: 2434712 - DNA, 17 bp, Homo sapiens
tctgaagctcaactctc

SEQ ID NO: 2434713 - DNA, 19 bp, Homo sapiens
tctgaatttttaaacaagt

SEQ ID NO: 2434714 - DNA, 22 bp, Homo sapiens
tctgacagcagcatctctacct

SEQ ID NO: 2434715 - DNA, 14 bp, Homo sapiens
tctgacagcctcag

SEQ ID NO: 2434716 - DNA, 22 bp, Homo sapiens
tctgacattatgtggttttaga

SEQ ID NO: 2434717 - DNA, 23 bp, Homo sapiens
tctgacattatgtggttttagat

SEQ ID NO: 2434718 - DNA, 13 bp, Homo sapiens
tctgacccagtgc

SEQ ID NO: 2434719 - DNA, 15 bp, Homo sapiens
tctgacccagtgccc

SEQ ID NO: 2434720 - DNA, 23 bp, Homo sapiens
tctgacccagtgcccccactgac

SEQ ID NO: 2434721 - DNA, 14 bp, Homo sapiens
tctgaccttaaatg

SEQ ID NO: 2434722 - DNA, 16 bp, Homo sapiens
tctgactcggtttctc

SEQ ID NO: 2434723 - DNA, 18 bp, Homo sapiens
tctgagaggccctggatc

SEQ ID NO: 2434724 - DNA, 14 bp, Homo sapiens
tctgagagtctaga

SEQ ID NO: 2434725 - DNA, 18 bp, Homo sapiens
tctgagagtctagattct

SEQ ID NO: 2434726 - DNA, 19 bp, Homo sapiens
tctgagcagtgaatgattc

SEQ ID NO: 2434727 - DNA, 18 bp, Homo sapiens
tctgaggacaagagaaaa

SEQ ID NO: 2434728 - DNA, 14 bp, Homo sapiens
tctgaggccagcct

SEQ ID NO: 2434729 - DNA, 16 bp, Homo sapiens
tctgaggccagcctgg

SEQ ID NO: 2434730 - DNA, 15 bp, Homo sapiens
tctgaggtcctgagc

SEQ ID NO: 2434731 - DNA, 17 bp, Homo sapiens
tctgaggtcctgagcac

SEQ ID NO: 2434732 - DNA, 19 bp, Homo sapiens
tctgaggtgcactgggagg

SEQ ID NO: 2434733 - DNA, 13 bp, Homo sapiens
tctgagtacagag

SEQ ID NO: 2434734 - DNA, 15 bp, Homo sapiens
tctgagtcagagcca

SEQ ID NO: 2434735 - DNA, 21 bp, Homo sapiens
tctgatccctctacagagctt

SEQ ID NO: 2434736 - DNA, 15 bp, Homo sapiens
tctgatgaaaaattg

SEQ ID NO: 2434737 - DNA, 22 bp, Homo sapiens
tctgatgaaaaattgctgactg

SEQ ID NO: 2434738 - DNA, 13 bp, Homo sapiens
tctgatgcagctt

SEQ ID NO: 2434739 - DNA, 19 bp, Homo sapiens
tctgattaaaatgcttcct

SEQ ID NO: 2434740 - DNA, 17 bp, Homo sapiens
tctgatttgtaacccac

SEQ ID NO: 2434741 - DNA, 19 bp, Homo sapiens
tctgcaattcaaaagttcc

SEQ ID NO: 2434742 - DNA, 21 bp, Homo sapiens
tctgcaattcaaaagttccaa

SEQ ID NO: 2434743 - DNA, 14 bp, Homo sapiens
tctgcagcctcaga

SEQ ID NO: 2434744 - DNA, 19 bp, Homo sapiens
tctgcatatgttgaatact

SEQ ID NO: 2434745 - DNA, 21 bp, Homo sapiens
tctgcatatgttgaatacttt

SEQ ID NO: 2434746 - DNA, 16 bp, Homo sapiens
tctgcattctagtact

SEQ ID NO: 2434747 - DNA, 17 bp, Homo sapiens
tctgcattttcacccca

SEQ ID NO: 2434748 - DNA, 14 bp, Homo sapiens
tctgccaacctaaa

SEQ ID NO: 2434749 - DNA, 13 bp, Homo sapiens
tctgccacccagg

SEQ ID NO: 2434750 - DNA, 24 bp, Homo sapiens
tctgccagggcccctctccccagg

SEQ ID NO: 2434751 - DNA, 14 bp, Homo sapiens
tctgccagtcctgt

SEQ ID NO: 2434752 - DNA, 14 bp, Homo sapiens
tctgcctcttctgg

SEQ ID NO: 2434753 - DNA, 15 bp, Homo sapiens
tctgcctcttctggg

SEQ ID NO: 2434754 - DNA, 18 bp, Homo sapiens
tctgcctcttctgggagg

SEQ ID NO: 2434755 - DNA, 16 bp, Homo sapiens
tctgcctgccagctgc

SEQ ID NO: 2434756 - DNA, 15 bp, Homo sapiens
tctgcctttgccagg

SEQ ID NO: 2434757 - DNA, 21 bp, Homo sapiens
tctgcctttgccaggtgactg

SEQ ID NO: 2434758 - DNA, 15 bp, Homo sapiens
tctgcgtgtcacctg

SEQ ID NO: 2434759 - DNA, 18 bp, Homo sapiens
tctgctcatcattctctg

SEQ ID NO: 2434760 - DNA, 22 bp, Homo sapiens
tctgctcatcattctctgtctc

SEQ ID NO: 2434761 - DNA, 23 bp, Homo sapiens
tctgctcatcattctctgtctca

SEQ ID NO: 2434762 - DNA, 15 bp, Homo sapiens
tctgctccagacagg

SEQ ID NO: 2434763 - DNA, 20 bp, Homo sapiens
tctgctcccaaggggcctga

SEQ ID NO: 2434764 - DNA, 16 bp, Homo sapiens
tctgctctgcgtgtca

SEQ ID NO: 2434765 - DNA, 18 bp, Homo sapiens
tctgctctggttgtttct

SEQ ID NO: 2434766 - DNA, 21 bp, Homo sapiens
tctgctctggttgtttctgtt

SEQ ID NO: 2434767 - DNA, 14 bp, Homo sapiens
tctgctctttctct

SEQ ID NO: 2434768 - DNA, 13 bp, Homo sapiens
tctgctggagttt

SEQ ID NO: 2434769 - DNA, 13 bp, Homo sapiens
tctgctggcctct

SEQ ID NO: 2434770 - DNA, 13 bp, Homo sapiens
tctgctgtagaaa

SEQ ID NO: 2434771 - DNA, 16 bp, Homo sapiens
tctgcttctctgactt

SEQ ID NO: 2434772 - DNA, 19 bp, Homo sapiens
tctgcttctctgacttctg

SEQ ID NO: 2434773 - DNA, 22 bp, Homo sapiens
tctgcttctctgacttctgcct

SEQ ID NO: 2434774 - DNA, 19 bp, Homo sapiens
tctgcttgttattagagat

SEQ ID NO: 2434775 - DNA, 17 bp, Homo sapiens
tctggaacctcagcctg

SEQ ID NO: 2434776 - DNA, 20 bp, Homo sapiens
tctggaacctcagcctggcc

SEQ ID NO: 2434777 - DNA, 19 bp, Homo sapiens
tctggacagccccaccctg

SEQ ID NO: 2434778 - DNA, 21 bp, Homo sapiens
tctggagaaagggccctgggc

SEQ ID NO: 2434779 - DNA, 15 bp, Homo sapiens
tctggagcatttctc

SEQ ID NO: 2434780 - DNA, 21 bp, Homo sapiens
tctggaggggagggggatccg

SEQ ID NO: 2434781 - DNA, 17 bp, Homo sapiens
tctggagtattctataa

SEQ ID NO: 2434782 - DNA, 21 bp, Homo sapiens
tctggagtctcacttgtctca

SEQ ID NO: 2434783 - DNA, 17 bp, Homo sapiens
tctggagttgatctgga

SEQ ID NO: 2434784 - DNA, 21 bp, Homo sapiens
tctggataacttccacagggt

SEQ ID NO: 2434785 - DNA, 18 bp, Homo sapiens
tctggcaaggactttgta

SEQ ID NO: 2434786 - DNA, 23 bp, Homo sapiens
tctggcaaggactttgtacattt

SEQ ID NO: 2434787 - DNA, 14 bp, Homo sapiens
tctggcaatgccac

SEQ ID NO: 2434788 - DNA, 17 bp, Homo sapiens
tctggcaatgccacagc

SEQ ID NO: 2434789 - DNA, 12 bp, Homo sapiens
tctggcagccac

SEQ ID NO: 2434790 - DNA, 13 bp, Homo sapiens
tctggcagccaca

SEQ ID NO: 2434791 - DNA, 16 bp, Homo sapiens
tctggcccaccagggt

SEQ ID NO: 2434792 - DNA, 12 bp, Homo sapiens
tctggcccccct

SEQ ID NO: 2434793 - DNA, 22 bp, Homo sapiens
tctggcccccctggtcccctcc

SEQ ID NO: 2434794 - DNA, 14 bp, Homo sapiens
tctggcctggccag

SEQ ID NO: 2434795 - DNA, 17 bp, Homo sapiens
tctggcctggccagtgc

SEQ ID NO: 2434796 - DNA, 20 bp, Homo sapiens
tctggctctaattcacagtg

SEQ ID NO: 2434797 - DNA, 13 bp, Homo sapiens
tctggctggtgtt

SEQ ID NO: 2434798 - DNA, 18 bp, Homo sapiens
tctggctggtgttaacag

SEQ ID NO: 2434799 - DNA, 15 bp, Homo sapiens
tctggcttctggcca

SEQ ID NO: 2434800 - DNA, 13 bp, Homo sapiens
tctgggagggcag

SEQ ID NO: 2434801 - DNA, 19 bp, Homo sapiens
tctgggagggcagcagggc

SEQ ID NO: 2434802 - DNA, 21 bp, Homo sapiens
tctgggccattctccacagca

SEQ ID NO: 2434803 - DNA, 20 bp, Homo sapiens
tctgggctggatgagctccc

SEQ ID NO: 2434804 - DNA, 14 bp, Homo sapiens
tctgggcttcctgg

SEQ ID NO: 2434805 - DNA, 19 bp, Homo sapiens
tctgggcttcctggagcag

SEQ ID NO: 2434806 - DNA, 19 bp, Homo sapiens
tctggggagcgggtctgct

SEQ ID NO: 2434807 - DNA, 23 bp, Homo sapiens
tctggggagcgggtctgctccca

SEQ ID NO: 2434808 - DNA, 21 bp, Homo sapiens
tctggggcaggctgggccatg

SEQ ID NO: 2434809 - DNA, 18 bp, Homo sapiens
tctgggggcacaagactg

SEQ ID NO: 2434810 - DNA, 15 bp, Homo sapiens
tctgggggctgagga

SEQ ID NO: 2434811 - DNA, 18 bp, Homo sapiens
tctggggggtggccaggc

SEQ ID NO: 2434812 - DNA, 17 bp, Homo sapiens
tctggggtgggcagttt

SEQ ID NO: 2434813 - DNA, 18 bp, Homo sapiens
tctgggtggggcccaggc

SEQ ID NO: 2434814 - DNA, 20 bp, Homo sapiens
tctgggtggggcccaggccc

SEQ ID NO: 2434815 - DNA, 15 bp, Homo sapiens
tctgggttgccttta

SEQ ID NO: 2434816 - DNA, 18 bp, Homo sapiens
tctggtagaagggaaagc

SEQ ID NO: 2434817 - DNA, 20 bp, Homo sapiens
tctggtgagtcaccacttca

SEQ ID NO: 2434818 - DNA, 16 bp, Homo sapiens
tctggtgcctccagag

SEQ ID NO: 2434819 - DNA, 14 bp, Homo sapiens
tctggtggccccgt

SEQ ID NO: 2434820 - DNA, 16 bp, Homo sapiens
tctggtggtctgttgg

SEQ ID NO: 2434821 - DNA, 23 bp, Homo sapiens
tctggttccagggtccctctgtg

SEQ ID NO: 2434822 - DNA, 15 bp, Homo sapiens
tctggttgtttctgt

SEQ ID NO: 2434823 - DNA, 16 bp, Homo sapiens
tctggttgtttctgtt

SEQ ID NO: 2434824 - DNA, 14 bp, Homo sapiens
tctgtaattgcaaa

SEQ ID NO: 2434825 - DNA, 13 bp, Homo sapiens
tctgtaccagtta

SEQ ID NO: 2434826 - DNA, 22 bp, Homo sapiens
tctgtaccagttaatttttcca

SEQ ID NO: 2434827 - DNA, 20 bp, Homo sapiens
tctgtagggtaattagtaac

SEQ ID NO: 2434828 - DNA, 16 bp, Homo sapiens
tctgtaggttgcacac

SEQ ID NO: 2434829 - DNA, 17 bp, Homo sapiens
tctgtaggttgcacact

SEQ ID NO: 2434830 - DNA, 18 bp, Homo sapiens
tctgtaggttgcacactt

SEQ ID NO: 2434831 - DNA, 22 bp, Homo sapiens
tctgtccccctttagatctctg

SEQ ID NO: 2434832 - DNA, 23 bp, Homo sapiens
tctgtccccctttagatctctga

SEQ ID NO: 2434833 - DNA, 19 bp, Homo sapiens
tctgtcccttgcccccctg

SEQ ID NO: 2434834 - DNA, 22 bp, Homo sapiens
tctgtcccttgcccccctggcc

SEQ ID NO: 2434835 - DNA, 20 bp, Homo sapiens
tctgtccgttcacatgtgtg

SEQ ID NO: 2434836 - DNA, 13 bp, Homo sapiens
tctgtcctcagcc

SEQ ID NO: 2434837 - DNA, 18 bp, Homo sapiens
tctgtcctgaaggcctga

SEQ ID NO: 2434838 - DNA, 15 bp, Homo sapiens
tctgtccttgaagga

SEQ ID NO: 2434839 - DNA, 18 bp, Homo sapiens
tctgtccttgaaggacta

SEQ ID NO: 2434840 - DNA, 21 bp, Homo sapiens
tctgtctgccaacctaaaact

SEQ ID NO: 2434841 - DNA, 19 bp, Homo sapiens
tctgtctggaagatgggga

SEQ ID NO: 2434842 - DNA, 14 bp, Homo sapiens
tctgtctggcaatg

SEQ ID NO: 2434843 - DNA, 18 bp, Homo sapiens
tctgtgaccaatgtcttg

SEQ ID NO: 2434844 - DNA, 16 bp, Homo sapiens
tctgtgccagagcctg

SEQ ID NO: 2434845 - DNA, 17 bp, Homo sapiens
tctgtgccagagcctgg

SEQ ID NO: 2434846 - DNA, 16 bp, Homo sapiens
tctgtgccttcgtctt

SEQ ID NO: 2434847 - DNA, 12 bp, Homo sapiens
tctgtgctgtgt

SEQ ID NO: 2434848 - DNA, 18 bp, Homo sapiens
tctgtgtctaagattcta

SEQ ID NO: 2434849 - DNA, 21 bp, Homo sapiens
tctgtgtgaaactttcattcc

SEQ ID NO: 2434850 - DNA, 14 bp, Homo sapiens
tctgtgttgccaag

SEQ ID NO: 2434851 - DNA, 18 bp, Homo sapiens
tctgtgttttgaaagaat

SEQ ID NO: 2434852 - DNA, 13 bp, Homo sapiens
tctgttaactgaa

SEQ ID NO: 2434853 - DNA, 17 bp, Homo sapiens
tctgttaactgaatacc

SEQ ID NO: 2434854 - DNA, 20 bp, Homo sapiens
tctgttctagttttttactt

SEQ ID NO: 2434855 - DNA, 15 bp, Homo sapiens
tctgttcttcctcag

SEQ ID NO: 2434856 - DNA, 19 bp, Homo sapiens
tctgttcttcctcagccag

SEQ ID NO: 2434857 - DNA, 16 bp, Homo sapiens
tctgttgtattcattg

SEQ ID NO: 2434858 - DNA, 18 bp, Homo sapiens
tctgtttgctgtggaact

SEQ ID NO: 2434859 - DNA, 19 bp, Homo sapiens
tctgttttgtttcgctctt

SEQ ID NO: 2434860 - DNA, 16 bp, Homo sapiens
tcttaaacacttgcaa

SEQ ID NO: 2434861 - DNA, 12 bp, Homo sapiens
tcttaaactaaa

SEQ ID NO: 2434862 - DNA, 21 bp, Homo sapiens
tcttaaagtgccagtatttta

SEQ ID NO: 2434863 - DNA, 23 bp, Homo sapiens
tcttaacttcttgcttctttcta

SEQ ID NO: 2434864 - DNA, 13 bp, Homo sapiens
tcttacagcaggc

SEQ ID NO: 2434865 - DNA, 22 bp, Homo sapiens
tcttaccagatgctttcctgtt

SEQ ID NO: 2434866 - DNA, 20 bp, Homo sapiens
tcttagctatcattgcttcc

SEQ ID NO: 2434867 - DNA, 19 bp, Homo sapiens
tcttagctcaatgagcatg

SEQ ID NO: 2434868 - DNA, 16 bp, Homo sapiens
tcttatagttctaggc

SEQ ID NO: 2434869 - DNA, 18 bp, Homo sapiens
tcttatgctgtacccagt

SEQ ID NO: 2434870 - DNA, 23 bp, Homo sapiens
tcttatgctgtacccagtttcta

SEQ ID NO: 2434871 - DNA, 17 bp, Homo sapiens
tcttatggaattgattt

SEQ ID NO: 2434872 - DNA, 18 bp, Homo sapiens
tcttatggaattgatttg

SEQ ID NO: 2434873 - DNA, 21 bp, Homo sapiens
tcttatggaattgatttgcat

SEQ ID NO: 2434874 - DNA, 22 bp, Homo sapiens
tcttatggaattgatttgcatt

SEQ ID NO: 2434875 - DNA, 17 bp, Homo sapiens
tcttcaccatttggcaa

SEQ ID NO: 2434876 - DNA, 16 bp, Homo sapiens
tcttcagttgtctctg

SEQ ID NO: 2434877 - DNA, 21 bp, Homo sapiens
tcttcagttgtctctgatgca

SEQ ID NO: 2434878 - DNA, 20 bp, Homo sapiens
tcttcataacaattttagga

SEQ ID NO: 2434879 - DNA, 15 bp, Homo sapiens
tcttcatcccactcc

SEQ ID NO: 2434880 - DNA, 21 bp, Homo sapiens
tcttcatttttttttcaatca

SEQ ID NO: 2434881 - DNA, 22 bp, Homo sapiens
tcttccagtttgctttgccctt

SEQ ID NO: 2434882 - DNA, 15 bp, Homo sapiens
tcttccatgctgtgc

SEQ ID NO: 2434883 - DNA, 21 bp, Homo sapiens
tcttccccagacgcctggctg

SEQ ID NO: 2434884 - DNA, 17 bp, Homo sapiens
tcttccccctctcccag

SEQ ID NO: 2434885 - DNA, 21 bp, Homo sapiens
tcttccccctctcccagttgt

SEQ ID NO: 2434886 - DNA, 20 bp, Homo sapiens
tcttcctactggtctctcta

SEQ ID NO: 2434887 - DNA, 20 bp, Homo sapiens
tcttccttactttttatata

SEQ ID NO: 2434888 - DNA, 23 bp, Homo sapiens
tcttccttactttttatatatat

SEQ ID NO: 2434889 - DNA, 21 bp, Homo sapiens
tcttccttgaagaactgcagg

SEQ ID NO: 2434890 - DNA, 14 bp, Homo sapiens
tcttctcaagttct

SEQ ID NO: 2434891 - DNA, 15 bp, Homo sapiens
tcttctcaagttcta

SEQ ID NO: 2434892 - DNA, 23 bp, Homo sapiens
tcttctcgtcctcgtttgtgttc

SEQ ID NO: 2434893 - DNA, 18 bp, Homo sapiens
tcttctctccagctgact

SEQ ID NO: 2434894 - DNA, 19 bp, Homo sapiens
tcttctcttccttttatca

SEQ ID NO: 2434895 - DNA, 16 bp, Homo sapiens
tcttctgagcactgtt

SEQ ID NO: 2434896 - DNA, 17 bp, Homo sapiens
tcttctgggagggcagc

SEQ ID NO: 2434897 - DNA, 21 bp, Homo sapiens
tcttctggggcaggctgggcc

SEQ ID NO: 2434898 - DNA, 13 bp, Homo sapiens
tcttcttcaccat

SEQ ID NO: 2434899 - DNA, 14 bp, Homo sapiens
tcttcttccaggta

SEQ ID NO: 2434900 - DNA, 22 bp, Homo sapiens
tcttcttctcgtcctcgtttgt

SEQ ID NO: 2434901 - DNA, 20 bp, Homo sapiens
tcttgaaattaagaaggcaa

SEQ ID NO: 2434902 - DNA, 14 bp, Homo sapiens
tcttgagctctatt

SEQ ID NO: 2434903 - DNA, 22 bp, Homo sapiens
tcttgaggggaagctagtcttt

SEQ ID NO: 2434904 - DNA, 20 bp, Homo sapiens
tcttgagtttgtcgctcatg

SEQ ID NO: 2434905 - DNA, 22 bp, Homo sapiens
tcttgagtttgtcgctcatgtg

SEQ ID NO: 2434906 - DNA, 20 bp, Homo sapiens
tcttgatacccccctctgtc

SEQ ID NO: 2434907 - DNA, 21 bp, Homo sapiens
tcttgatacccccctctgtct

SEQ ID NO: 2434908 - DNA, 23 bp, Homo sapiens
tcttgatcagttaagaaatttca

SEQ ID NO: 2434909 - DNA, 13 bp, Homo sapiens
tcttgatgcatgc

SEQ ID NO: 2434910 - DNA, 16 bp, Homo sapiens
tcttgatgtaaaatct

SEQ ID NO: 2434911 - DNA, 19 bp, Homo sapiens
tcttgatgtaaaatcttgt

SEQ ID NO: 2434912 - DNA, 21 bp, Homo sapiens
tcttgatgtaaggatgggcat

SEQ ID NO: 2434913 - DNA, 20 bp, Homo sapiens
tcttgcacagtcactgctct

SEQ ID NO: 2434914 - DNA, 23 bp, Homo sapiens
tcttgcaccccaaagctttcctg

SEQ ID NO: 2434915 - DNA, 12 bp, Homo sapiens
tcttgcctctgt

SEQ ID NO: 2434916 - DNA, 15 bp, Homo sapiens
tcttgcctctgtgct

SEQ ID NO: 2434917 - DNA, 19 bp, Homo sapiens
tcttgcctctgtgctgtgt

SEQ ID NO: 2434918 - DNA, 21 bp, Homo sapiens
tcttgcctgaactcctgccat

SEQ ID NO: 2434919 - DNA, 16 bp, Homo sapiens
tcttgcctgccactgt

SEQ ID NO: 2434920 - DNA, 19 bp, Homo sapiens
tcttgcctgccactgtgtg

SEQ ID NO: 2434921 - DNA, 13 bp, Homo sapiens
tcttgctaccagt

SEQ ID NO: 2434922 - DNA, 22 bp, Homo sapiens
tcttgcttccctaatctatggt

SEQ ID NO: 2434923 - DNA, 11 bp, Homo sapiens
tcttgcttctt

SEQ ID NO: 2434924 - DNA, 16 bp, Homo sapiens
tcttgcttctttctag

SEQ ID NO: 2434925 - DNA, 15 bp, Homo sapiens
tcttggaacttgcct

SEQ ID NO: 2434926 - DNA, 20 bp, Homo sapiens
tcttggaacttgcctgcctt

SEQ ID NO: 2434927 - DNA, 20 bp, Homo sapiens
tcttggagaagtctcagcta

SEQ ID NO: 2434928 - DNA, 14 bp, Homo sapiens
tcttggctggaccc

SEQ ID NO: 2434929 - DNA, 17 bp, Homo sapiens
tcttggctggacccagc

SEQ ID NO: 2434930 - DNA, 18 bp, Homo sapiens
tcttggctggacccagcc

SEQ ID NO: 2434931 - DNA, 19 bp, Homo sapiens
tcttggctggacccagcca

SEQ ID NO: 2434932 - DNA, 20 bp, Homo sapiens
tcttggctggacccagccag

SEQ ID NO: 2434933 - DNA, 14 bp, Homo sapiens
tcttgggaactgaa

SEQ ID NO: 2434934 - DNA, 20 bp, Homo sapiens
tcttgggcagagctggctct

SEQ ID NO: 2434935 - DNA, 23 bp, Homo sapiens
tcttgggcagagctggctctgag

SEQ ID NO: 2434936 - DNA, 13 bp, Homo sapiens
tcttggggaagat

SEQ ID NO: 2434937 - DNA, 11 bp, Homo sapiens
tcttgtaattt

SEQ ID NO: 2434938 - DNA, 15 bp, Homo sapiens
tcttgtaattttaca

SEQ ID NO: 2434939 - DNA, 11 bp, Homo sapiens
tcttgtcatgt

SEQ ID NO: 2434940 - DNA, 15 bp, Homo sapiens
tcttgtcatgtgtat

SEQ ID NO: 2434941 - DNA, 13 bp, Homo sapiens
tcttgtctataaa

SEQ ID NO: 2434942 - DNA, 15 bp, Homo sapiens
tcttgtctataaagc

SEQ ID NO: 2434943 - DNA, 15 bp, Homo sapiens
tcttgtgaaggcagg

SEQ ID NO: 2434944 - DNA, 17 bp, Homo sapiens
tcttgttggtgcacagc

SEQ ID NO: 2434945 - DNA, 14 bp, Homo sapiens
tcttgtttcaattc

SEQ ID NO: 2434946 - DNA, 23 bp, Homo sapiens
tctttaaagtgactaatggcatg

SEQ ID NO: 2434947 - DNA, 14 bp, Homo sapiens
tctttacaaaacaa

SEQ ID NO: 2434948 - DNA, 23 bp, Homo sapiens
tctttacaaaacaaactcattca

SEQ ID NO: 2434949 - DNA, 15 bp, Homo sapiens
tctttatacagctgt

SEQ ID NO: 2434950 - DNA, 14 bp, Homo sapiens
tctttatgcttgca

SEQ ID NO: 2434951 - DNA, 15 bp, Homo sapiens
tctttatgcttgcaa

SEQ ID NO: 2434952 - DNA, 12 bp, Homo sapiens
tctttattttga

SEQ ID NO: 2434953 - DNA, 20 bp, Homo sapiens
tctttcaagcagtcgtgcct

SEQ ID NO: 2434954 - DNA, 14 bp, Homo sapiens
tctttcacagctcc

SEQ ID NO: 2434955 - DNA, 11 bp, Homo sapiens
tctttcagctc

SEQ ID NO: 2434956 - DNA, 17 bp, Homo sapiens
tctttccatttgcattt

SEQ ID NO: 2434957 - DNA, 15 bp, Homo sapiens
tctttctctgaggac

SEQ ID NO: 2434958 - DNA, 11 bp, Homo sapiens
tctttctctgc

SEQ ID NO: 2434959 - DNA, 15 bp, Homo sapiens
tctttctctgccagt

SEQ ID NO: 2434960 - DNA, 13 bp, Homo sapiens
tctttctttattt

SEQ ID NO: 2434961 - DNA, 12 bp, Homo sapiens
tctttgaaatta

SEQ ID NO: 2434962 - DNA, 16 bp, Homo sapiens
tctttgaaattatgta

SEQ ID NO: 2434963 - DNA, 12 bp, Homo sapiens
tctttgaataaa

SEQ ID NO: 2434964 - DNA, 21 bp, Homo sapiens
tctttgaataaatgtcacttt

SEQ ID NO: 2434965 - DNA, 12 bp, Homo sapiens
tctttgagaggg

SEQ ID NO: 2434966 - DNA, 12 bp, Homo sapiens
tctttgcctcaa

SEQ ID NO: 2434967 - DNA, 19 bp, Homo sapiens
tctttggaaagtacactct

SEQ ID NO: 2434968 - DNA, 22 bp, Homo sapiens
tctttggagaaatgcttagaaa

SEQ ID NO: 2434969 - DNA, 16 bp, Homo sapiens
tctttggttctaagga

SEQ ID NO: 2434970 - DNA, 15 bp, Homo sapiens
tctttgtcagggagt

SEQ ID NO: 2434971 - DNA, 18 bp, Homo sapiens
tctttgttaagactgctg

SEQ ID NO: 2434972 - DNA, 16 bp, Homo sapiens
tctttgttttgtgtct

SEQ ID NO: 2434973 - DNA, 17 bp, Homo sapiens
tctttgttttgtgtctc

SEQ ID NO: 2434974 - DNA, 19 bp, Homo sapiens
tctttgttttgtgtctctt

SEQ ID NO: 2434975 - DNA, 20 bp, Homo sapiens
tctttgttttgtgtctctta

SEQ ID NO: 2434976 - DNA, 14 bp, Homo sapiens
tcttttacattctg

SEQ ID NO: 2434977 - DNA, 17 bp, Homo sapiens
tcttttaccctggcccc

SEQ ID NO: 2434978 - DNA, 22 bp, Homo sapiens
tcttttataattctcattaaaa

SEQ ID NO: 2434979 - DNA, 18 bp, Homo sapiens
tcttttcaaaggtacttg

SEQ ID NO: 2434980 - DNA, 13 bp, Homo sapiens
tcttttcatacat

SEQ ID NO: 2434981 - DNA, 14 bp, Homo sapiens
tcttttcatacatt

SEQ ID NO: 2434982 - DNA, 21 bp, Homo sapiens
tcttttcccatttatctaaat

SEQ ID NO: 2434983 - DNA, 19 bp, Homo sapiens
tcttttcccccattaatca

SEQ ID NO: 2434984 - DNA, 19 bp, Homo sapiens
tcttttctggaatgtaatc

SEQ ID NO: 2434985 - DNA, 13 bp, Homo sapiens
tcttttgccatga

SEQ ID NO: 2434986 - DNA, 21 bp, Homo sapiens
tcttttggaggacgtacgtaa

SEQ ID NO: 2434987 - DNA, 20 bp, Homo sapiens
tcttttggttatgaatactt

SEQ ID NO: 2434988 - DNA, 19 bp, Homo sapiens
tctttttacctttcataca

SEQ ID NO: 2434989 - DNA, 22 bp, Homo sapiens
tctttttgggagagacttgttt

SEQ ID NO: 2434990 - DNA, 17 bp, Homo sapiens
tctttttttgtatagtt

SEQ ID NO: 2434991 - DNA, 23 bp, Homo sapiens
tctttttttgtatagttaacaca

SEQ ID NO: 2434992 - DNA, 15 bp, Homo sapiens
tgaaaaagtttgttt

SEQ ID NO: 2434993 - DNA, 22 bp, Homo sapiens
tgaaaaattgctgactgtagct

SEQ ID NO: 2434994 - DNA, 13 bp, Homo sapiens
tgaaaactctttg

SEQ ID NO: 2434995 - DNA, 16 bp, Homo sapiens
tgaaaactttgtagta

SEQ ID NO: 2434996 - DNA, 12 bp, Homo sapiens
tgaaaagagctg

SEQ ID NO: 2434997 - DNA, 20 bp, Homo sapiens
tgaaaagggtgttgggaggg

SEQ ID NO: 2434998 - DNA, 19 bp, Homo sapiens
tgaaaaggtttatgaaaaa

SEQ ID NO: 2434999 - DNA, 21 bp, Homo sapiens
tgaaaaggtttatgaaaaaga

SEQ ID NO: 2435000 - DNA, 14 bp, Homo sapiens
tgaaaatataacca

SEQ ID NO: 2435001 - DNA, 16 bp, Homo sapiens
tgaaaatgggctcaac

SEQ ID NO: 2435002 - DNA, 13 bp, Homo sapiens
tgaaaattattta

SEQ ID NO: 2435003 - DNA, 16 bp, Homo sapiens
tgaaacaacttggaaa

SEQ ID NO: 2435004 - DNA, 15 bp, Homo sapiens
tgaaacagaaaaata

SEQ ID NO: 2435005 - DNA, 23 bp, Homo sapiens
tgaaacagaaaaatatgtaccaa

SEQ ID NO: 2435006 - DNA, 19 bp, Homo sapiens
tgaaactccagatgccaca

SEQ ID NO: 2435007 - DNA, 14 bp, Homo sapiens
tgaaactttcattc

SEQ ID NO: 2435008 - DNA, 20 bp, Homo sapiens
tgaaaggaaattaaggcaac

SEQ ID NO: 2435009 - DNA, 18 bp, Homo sapiens
tgaaaggttttttttcag

SEQ ID NO: 2435010 - DNA, 15 bp, Homo sapiens
tgaaagttaatccac

SEQ ID NO: 2435011 - DNA, 20 bp, Homo sapiens
tgaaataagaattcagacat

SEQ ID NO: 2435012 - DNA, 14 bp, Homo sapiens
tgaaataagctatt

SEQ ID NO: 2435013 - DNA, 23 bp, Homo sapiens
tgaaataatgtgtagttcatgta

SEQ ID NO: 2435014 - DNA, 17 bp, Homo sapiens
tgaaatatcctgcttga

SEQ ID NO: 2435015 - DNA, 20 bp, Homo sapiens
tgaaatatgatgttaaaaaa

SEQ ID NO: 2435016 - DNA, 14 bp, Homo sapiens
tgaaattaacctct

SEQ ID NO: 2435017 - DNA, 17 bp, Homo sapiens
tgaaattgaacctttgt

SEQ ID NO: 2435018 - DNA, 13 bp, Homo sapiens
tgaaatttttctt

SEQ ID NO: 2435019 - DNA, 15 bp, Homo sapiens
tgaacaaagcagcca

SEQ ID NO: 2435020 - DNA, 16 bp, Homo sapiens
tgaacaaagcagccac

SEQ ID NO: 2435021 - DNA, 23 bp, Homo sapiens
tgaacaaagtttaccagaaagca

SEQ ID NO: 2435022 - DNA, 17 bp, Homo sapiens
tgaacaagagaagcatt

SEQ ID NO: 2435023 - DNA, 23 bp, Homo sapiens
tgaacaagagaagcattctcatt

SEQ ID NO: 2435024 - DNA, 17 bp, Homo sapiens
tgaacaggaaactcctg

SEQ ID NO: 2435025 - DNA, 17 bp, Homo sapiens
tgaacatctgagtcctg

SEQ ID NO: 2435026 - DNA, 20 bp, Homo sapiens
tgaacattggttctttcatt

SEQ ID NO: 2435027 - DNA, 12 bp, Homo sapiens
tgaacccaggac

SEQ ID NO: 2435028 - DNA, 22 bp, Homo sapiens
tgaacccaggacaagcatggtc

SEQ ID NO: 2435029 - DNA, 18 bp, Homo sapiens
tgaacctttgtgccctat

SEQ ID NO: 2435030 - DNA, 19 bp, Homo sapiens
tgaacgttttctaattgct

SEQ ID NO: 2435031 - DNA, 17 bp, Homo sapiens
tgaactcaactttgaca

SEQ ID NO: 2435032 - DNA, 18 bp, Homo sapiens
tgaactcactttcctcct

SEQ ID NO: 2435033 - DNA, 15 bp, Homo sapiens
tgaactcttcactct

SEQ ID NO: 2435034 - DNA, 13 bp, Homo sapiens
tgaactgaacacc

SEQ ID NO: 2435035 - DNA, 17 bp, Homo sapiens
tgaagaactgcaggccc

SEQ ID NO: 2435036 - DNA, 23 bp, Homo sapiens
tgaagaactgcaggccctggcct

SEQ ID NO: 2435037 - DNA, 21 bp, Homo sapiens
tgaagaatacttctcattttt

SEQ ID NO: 2435038 - DNA, 17 bp, Homo sapiens
tgaagactatgaaaatg

SEQ ID NO: 2435039 - DNA, 17 bp, Homo sapiens
tgaagactggaagctaa

SEQ ID NO: 2435040 - DNA, 17 bp, Homo sapiens
tgaagaggaggggaaga

SEQ ID NO: 2435041 - DNA, 23 bp, Homo sapiens
tgaagaggaggggaagaggcctg

SEQ ID NO: 2435042 - DNA, 23 bp, Homo sapiens
tgaagagtgttattttcattcaa

SEQ ID NO: 2435043 - DNA, 16 bp, Homo sapiens
tgaagattctttccca

SEQ ID NO: 2435044 - DNA, 15 bp, Homo sapiens
tgaagcagcctctcc

SEQ ID NO: 2435045 - DNA, 20 bp, Homo sapiens
tgaagcagcctctccccagg

SEQ ID NO: 2435046 - DNA, 19 bp, Homo sapiens
tgaagcaggttcccaagct

SEQ ID NO: 2435047 - DNA, 20 bp, Homo sapiens
tgaaggactaatagaaaagt

SEQ ID NO: 2435048 - DNA, 22 bp, Homo sapiens
tgaaggagaggcaacatccaaa

SEQ ID NO: 2435049 - DNA, 17 bp, Homo sapiens
tgaaggaggtcaggccc

SEQ ID NO: 2435050 - DNA, 14 bp, Homo sapiens
tgaaggcaaaattg

SEQ ID NO: 2435051 - DNA, 16 bp, Homo sapiens
tgaaggcaaaattgca

SEQ ID NO: 2435052 - DNA, 14 bp, Homo sapiens
tgaaggcctgaggt

SEQ ID NO: 2435053 - DNA, 13 bp, Homo sapiens
tgaaggcttctct

SEQ ID NO: 2435054 - DNA, 19 bp, Homo sapiens
tgaaggcttctctctgtgg

SEQ ID NO: 2435055 - DNA, 14 bp, Homo sapiens
tgaagggccagagc

SEQ ID NO: 2435056 - DNA, 19 bp, Homo sapiens
tgaagggccagagccaggg

SEQ ID NO: 2435057 - DNA, 14 bp, Homo sapiens
tgaagggcccgaga

SEQ ID NO: 2435058 - DNA, 15 bp, Homo sapiens
tgaagggggcggcct

SEQ ID NO: 2435059 - DNA, 18 bp, Homo sapiens
tgaaggtaaataaaaaga

SEQ ID NO: 2435060 - DNA, 22 bp, Homo sapiens
tgaaggtgatttaagggcccag

SEQ ID NO: 2435061 - DNA, 15 bp, Homo sapiens
tgaaggttgtggcct

SEQ ID NO: 2435062 - DNA, 14 bp, Homo sapiens
tgaagtaaactttt

SEQ ID NO: 2435063 - DNA, 23 bp, Homo sapiens
tgaagtgagctgagattgcacca

SEQ ID NO: 2435064 - DNA, 22 bp, Homo sapiens
tgaagtgctgtttattaatctt

SEQ ID NO: 2435065 - DNA, 16 bp, Homo sapiens
tgaagttttacattgt

SEQ ID NO: 2435066 - DNA, 17 bp, Homo sapiens
tgaataaagtgtaacaa

SEQ ID NO: 2435067 - DNA, 13 bp, Homo sapiens
tgaataaatgtct

SEQ ID NO: 2435068 - DNA, 15 bp, Homo sapiens
tgaataaatgtcttg

SEQ ID NO: 2435069 - DNA, 17 bp, Homo sapiens
tgaataccactctgtaa

SEQ ID NO: 2435070 - DNA, 16 bp, Homo sapiens
tgaatacccttttctg

SEQ ID NO: 2435071 - DNA, 13 bp, Homo sapiens
tgaatactttgaa

SEQ ID NO: 2435072 - DNA, 17 bp, Homo sapiens
tgaatactttgaatgtg

SEQ ID NO: 2435073 - DNA, 19 bp, Homo sapiens
tgaatactttgaatgtgtt

SEQ ID NO: 2435074 - DNA, 21 bp, Homo sapiens
tgaatagatatgaaagctgat

SEQ ID NO: 2435075 - DNA, 18 bp, Homo sapiens
tgaatcaagggtcaggcc

SEQ ID NO: 2435076 - DNA, 15 bp, Homo sapiens
tgaatcaataatata

SEQ ID NO: 2435077 - DNA, 18 bp, Homo sapiens
tgaatcattgtatgtggt

SEQ ID NO: 2435078 - DNA, 12 bp, Homo sapiens
tgaatgaacact

SEQ ID NO: 2435079 - DNA, 14 bp, Homo sapiens
tgaatgagaatcta

SEQ ID NO: 2435080 - DNA, 15 bp, Homo sapiens
tgaatgatttttctt

SEQ ID NO: 2435081 - DNA, 19 bp, Homo sapiens
tgaatgatttttctttaca

SEQ ID NO: 2435082 - DNA, 15 bp, Homo sapiens
tgaatgcaaaccata

SEQ ID NO: 2435083 - DNA, 21 bp, Homo sapiens
tgaatgccactgccttcgctt

SEQ ID NO: 2435084 - DNA, 11 bp, Homo sapiens
tgaatgctggg

SEQ ID NO: 2435085 - DNA, 13 bp, Homo sapiens
tgaatgctgggac

SEQ ID NO: 2435086 - DNA, 14 bp, Homo sapiens
tgaatgctgggact

SEQ ID NO: 2435087 - DNA, 17 bp, Homo sapiens
tgaatgcttctaagtaa

SEQ ID NO: 2435088 - DNA, 23 bp, Homo sapiens
tgaatgcttctaagtaaatacaa

SEQ ID NO: 2435089 - DNA, 15 bp, Homo sapiens
tgaatgtaaatttgt

SEQ ID NO: 2435090 - DNA, 18 bp, Homo sapiens
tgaatgtaaatttgtact

SEQ ID NO: 2435091 - DNA, 21 bp, Homo sapiens
tgaatgtaaatttgtactatt

SEQ ID NO: 2435092 - DNA, 23 bp, Homo sapiens
tgaatgtgtttcacagtttgaaa

SEQ ID NO: 2435093 - DNA, 22 bp, Homo sapiens
tgaatgtttacactctttgtaa

SEQ ID NO: 2435094 - DNA, 20 bp, Homo sapiens
tgaatgtttttctaaaggag

SEQ ID NO: 2435095 - DNA, 23 bp, Homo sapiens
tgaattaatatccctacatgtat

SEQ ID NO: 2435096 - DNA, 21 bp, Homo sapiens
tgaattaggctgtaactactt

SEQ ID NO: 2435097 - DNA, 17 bp, Homo sapiens
tgaattattacagtgtt

SEQ ID NO: 2435098 - DNA, 22 bp, Homo sapiens
tgaattcttggttgaggaaaca

SEQ ID NO: 2435099 - DNA, 15 bp, Homo sapiens
tgaatttagtgagca

SEQ ID NO: 2435100 - DNA, 17 bp, Homo sapiens
tgaatttgtaatgtctt

SEQ ID NO: 2435101 - DNA, 21 bp, Homo sapiens
tgaatttttaaacaagtattt

SEQ ID NO: 2435102 - DNA, 23 bp, Homo sapiens
tgaatttttaaacaagtatttgt

SEQ ID NO: 2435103 - DNA, 23 bp, Homo sapiens
tgacaacatttctatagccaaaa

SEQ ID NO: 2435104 - DNA, 19 bp, Homo sapiens
tgacaacttctaattgcca

SEQ ID NO: 2435105 - DNA, 22 bp, Homo sapiens
tgacaacttctaattgccatgt

SEQ ID NO: 2435106 - DNA, 17 bp, Homo sapiens
tgacaataaaacattaa

SEQ ID NO: 2435107 - DNA, 16 bp, Homo sapiens
tgacaatcatgtgtgt

SEQ ID NO: 2435108 - DNA, 17 bp, Homo sapiens
tgacaatcatgtgtgtt

SEQ ID NO: 2435109 - DNA, 12 bp, Homo sapiens
tgacacaaacac

SEQ ID NO: 2435110 - DNA, 16 bp, Homo sapiens
tgacacaccaggcgct

SEQ ID NO: 2435111 - DNA, 23 bp, Homo sapiens
tgacacaccaggcgctaattcaa

SEQ ID NO: 2435112 - DNA, 18 bp, Homo sapiens
tgacacagaaaatgttga

SEQ ID NO: 2435113 - DNA, 19 bp, Homo sapiens
tgacactgctctaacagcc

SEQ ID NO: 2435114 - DNA, 20 bp, Homo sapiens
tgacactgctggagaggccc

SEQ ID NO: 2435115 - DNA, 17 bp, Homo sapiens
tgacacttgtacaatta

SEQ ID NO: 2435116 - DNA, 19 bp, Homo sapiens
tgacagacaggctcttagc

SEQ ID NO: 2435117 - DNA, 19 bp, Homo sapiens
tgacagcctcccaccccca

SEQ ID NO: 2435118 - DNA, 22 bp, Homo sapiens
tgacagcctcccacccccatct

SEQ ID NO: 2435119 - DNA, 14 bp, Homo sapiens
tgacaggcctgtcc

SEQ ID NO: 2435120 - DNA, 18 bp, Homo sapiens
tgacagtggcgtttgtaa

SEQ ID NO: 2435121 - DNA, 16 bp, Homo sapiens
tgacataaagttgata

SEQ ID NO: 2435122 - DNA, 15 bp, Homo sapiens
tgacataccccctcc

SEQ ID NO: 2435123 - DNA, 20 bp, Homo sapiens
tgacataccccctcccccac

SEQ ID NO: 2435124 - DNA, 19 bp, Homo sapiens
tgacatcggaaaaataatc

SEQ ID NO: 2435125 - DNA, 15 bp, Homo sapiens
tgacatgaagctgtt

SEQ ID NO: 2435126 - DNA, 21 bp, Homo sapiens
tgacatgaattttagcttttg

SEQ ID NO: 2435127 - DNA, 17 bp, Homo sapiens
tgacatgtggggccagg

SEQ ID NO: 2435128 - DNA, 19 bp, Homo sapiens
tgacattctgaatgcttct

SEQ ID NO: 2435129 - DNA, 19 bp, Homo sapiens
tgacatttatatattgaat

SEQ ID NO: 2435130 - DNA, 18 bp, Homo sapiens
tgacatttatttttcatt

SEQ ID NO: 2435131 - DNA, 15 bp, Homo sapiens
tgaccacagcacagc

SEQ ID NO: 2435132 - DNA, 18 bp, Homo sapiens
tgaccactcagagacatg

SEQ ID NO: 2435133 - DNA, 15 bp, Homo sapiens
tgaccactctgtctt

SEQ ID NO: 2435134 - DNA, 12 bp, Homo sapiens
tgaccagctccc

SEQ ID NO: 2435135 - DNA, 18 bp, Homo sapiens
tgaccagctccccctccc

SEQ ID NO: 2435136 - DNA, 20 bp, Homo sapiens
tgaccagctccccctccctc

SEQ ID NO: 2435137 - DNA, 16 bp, Homo sapiens
tgaccaggcatcctcc

SEQ ID NO: 2435138 - DNA, 12 bp, Homo sapiens
tgaccatgctca

SEQ ID NO: 2435139 - DNA, 16 bp, Homo sapiens
tgaccatgctcatctg

SEQ ID NO: 2435140 - DNA, 11 bp, Homo sapiens
tgaccccaggg

SEQ ID NO: 2435141 - DNA, 12 bp, Homo sapiens
tgaccccagggc

SEQ ID NO: 2435142 - DNA, 17 bp, Homo sapiens
tgaccccagggcacagg

SEQ ID NO: 2435143 - DNA, 18 bp, Homo sapiens
tgaccccagggcacagga

SEQ ID NO: 2435144 - DNA, 20 bp, Homo sapiens
tgaccccagggcacaggagc

SEQ ID NO: 2435145 - DNA, 19 bp, Homo sapiens
tgacccggcaccccctgca

SEQ ID NO: 2435146 - DNA, 21 bp, Homo sapiens
tgacccggcaccccctgcagc

SEQ ID NO: 2435147 - DNA, 18 bp, Homo sapiens
tgaccctgcctctcccag

SEQ ID NO: 2435148 - DNA, 16 bp, Homo sapiens
tgaccggacttttctg

SEQ ID NO: 2435149 - DNA, 17 bp, Homo sapiens
tgacctaaattatttac

SEQ ID NO: 2435150 - DNA, 20 bp, Homo sapiens
tgacctcaagtgatctgccc

SEQ ID NO: 2435151 - DNA, 19 bp, Homo sapiens
tgacctcgtactcaggagc

SEQ ID NO: 2435152 - DNA, 18 bp, Homo sapiens
tgacctcgtgatccaccc

SEQ ID NO: 2435153 - DNA, 12 bp, Homo sapiens
tgacctgaggct

SEQ ID NO: 2435154 - DNA, 14 bp, Homo sapiens
tgaccttaaatgca

SEQ ID NO: 2435155 - DNA, 17 bp, Homo sapiens
tgacgtgaccggacttt

SEQ ID NO: 2435156 - DNA, 23 bp, Homo sapiens
tgactaactagacaccaaagttc

SEQ ID NO: 2435157 - DNA, 14 bp, Homo sapiens
tgactaatggcatg

SEQ ID NO: 2435158 - DNA, 13 bp, Homo sapiens
tgactagggagcc

SEQ ID NO: 2435159 - DNA, 17 bp, Homo sapiens
tgactagggagccatgt

SEQ ID NO: 2435160 - DNA, 18 bp, Homo sapiens
tgactagggagccatgtt

SEQ ID NO: 2435161 - DNA, 17 bp, Homo sapiens
tgactattcttgatgta

SEQ ID NO: 2435162 - DNA, 12 bp, Homo sapiens
tgactcaggagc

SEQ ID NO: 2435163 - DNA, 18 bp, Homo sapiens
tgactcagggctcctggg

SEQ ID NO: 2435164 - DNA, 19 bp, Homo sapiens
tgactcagggctcctgggt

SEQ ID NO: 2435165 - DNA, 14 bp, Homo sapiens
tgactcggtttctc

SEQ ID NO: 2435166 - DNA, 15 bp, Homo sapiens
tgactcggtttctcc

SEQ ID NO: 2435167 - DNA, 23 bp, Homo sapiens
tgactggtgttatcaccgtgggc

SEQ ID NO: 2435168 - DNA, 13 bp, Homo sapiens
tgacttctgagat

SEQ ID NO: 2435169 - DNA, 13 bp, Homo sapiens
tgacttctgcctg

SEQ ID NO: 2435170 - DNA, 16 bp, Homo sapiens
tgacttctgcctggag

SEQ ID NO: 2435171 - DNA, 22 bp, Homo sapiens
tgacttgggcacccccagcctg

SEQ ID NO: 2435172 - DNA, 19 bp, Homo sapiens
tgacttgtatattttaaga

SEQ ID NO: 2435173 - DNA, 15 bp, Homo sapiens
tgacttgtgtcccat

SEQ ID NO: 2435174 - DNA, 18 bp, Homo sapiens
tgactttgacaattactc

SEQ ID NO: 2435175 - DNA, 15 bp, Homo sapiens
tgactttgcttgctt

SEQ ID NO: 2435176 - DNA, 16 bp, Homo sapiens
tgactttgcttgcttt

SEQ ID NO: 2435177 - DNA, 13 bp, Homo sapiens
tgacttttctgta

SEQ ID NO: 2435178 - DNA, 22 bp, Homo sapiens
tgacttttctgtaattcaggtt

SEQ ID NO: 2435179 - DNA, 14 bp, Homo sapiens
tgacttttgtgaaa

SEQ ID NO: 2435180 - DNA, 12 bp, Homo sapiens
tgagaaaacatg

SEQ ID NO: 2435181 - DNA, 14 bp, Homo sapiens
tgagaaagccttct

SEQ ID NO: 2435182 - DNA, 15 bp, Homo sapiens
tgagaaatttaaact

SEQ ID NO: 2435183 - DNA, 18 bp, Homo sapiens
tgagaaatttaaactata

SEQ ID NO: 2435184 - DNA, 16 bp, Homo sapiens
tgagaacctggccttc

SEQ ID NO: 2435185 - DNA, 21 bp, Homo sapiens
tgagaacctgggttgcagaca

SEQ ID NO: 2435186 - DNA, 23 bp, Homo sapiens
tgagaacctgggttgcagacagg

SEQ ID NO: 2435187 - DNA, 19 bp, Homo sapiens
tgagaagtgaatgctggga

SEQ ID NO: 2435188 - DNA, 14 bp, Homo sapiens
tgagaatcatttag

SEQ ID NO: 2435189 - DNA, 19 bp, Homo sapiens
tgagaatcatttagcatgt

SEQ ID NO: 2435190 - DNA, 22 bp, Homo sapiens
tgagaatcccaaatttgattga

SEQ ID NO: 2435191 - DNA, 12 bp, Homo sapiens
tgagaatctacc

SEQ ID NO: 2435192 - DNA, 21 bp, Homo sapiens
tgagaatctacccccagatcc

SEQ ID NO: 2435193 - DNA, 21 bp, Homo sapiens
tgagacaagaaaataagagct

SEQ ID NO: 2435194 - DNA, 23 bp, Homo sapiens
tgagacaagaaaataagagctca

SEQ ID NO: 2435195 - DNA, 13 bp, Homo sapiens
tgagaggccctgg

SEQ ID NO: 2435196 - DNA, 23 bp, Homo sapiens
tgagaggccctggatcagcgtgg

SEQ ID NO: 2435197 - DNA, 20 bp, Homo sapiens
tgagataccagcgaggaggc

SEQ ID NO: 2435198 - DNA, 17 bp, Homo sapiens
tgagatagttttcatcc

SEQ ID NO: 2435199 - DNA, 18 bp, Homo sapiens
tgagatagttttcatcca

SEQ ID NO: 2435200 - DNA, 12 bp, Homo sapiens
tgagatattaat

SEQ ID NO: 2435201 - DNA, 16 bp, Homo sapiens
tgagatggctcccagg

SEQ ID NO: 2435202 - DNA, 22 bp, Homo sapiens
tgagattctcaaaggagcgagc

SEQ ID NO: 2435203 - DNA, 15 bp, Homo sapiens
tgagcactgccagga

SEQ ID NO: 2435204 - DNA, 17 bp, Homo sapiens
tgagcactgccaggagg

SEQ ID NO: 2435205 - DNA, 15 bp, Homo sapiens
tgagcactgtttata

SEQ ID NO: 2435206 - DNA, 13 bp, Homo sapiens
tgagcagtggctg

SEQ ID NO: 2435207 - DNA, 15 bp, Homo sapiens
tgagcagtggctggt

SEQ ID NO: 2435208 - DNA, 18 bp, Homo sapiens
tgagcagtggctggtcca

SEQ ID NO: 2435209 - DNA, 23 bp, Homo sapiens
tgagcataggtgatccatgtaac

SEQ ID NO: 2435210 - DNA, 12 bp, Homo sapiens
tgagcatcacag

SEQ ID NO: 2435211 - DNA, 13 bp, Homo sapiens
tgagcatcacaga

SEQ ID NO: 2435212 - DNA, 15 bp, Homo sapiens
tgagcatcacagaat

SEQ ID NO: 2435213 - DNA, 24 bp, Homo sapiens
tgagcatgtttagactttaacata

SEQ ID NO: 2435214 - DNA, 11 bp, Homo sapiens
tgagccactgc

SEQ ID NO: 2435215 - DNA, 13 bp, Homo sapiens
tgagccagggtct

SEQ ID NO: 2435216 - DNA, 11 bp, Homo sapiens
tgagcccaggg

SEQ ID NO: 2435217 - DNA, 15 bp, Homo sapiens
tgagcccagggaggc

SEQ ID NO: 2435218 - DNA, 17 bp, Homo sapiens
tgagcccagggaggccg

SEQ ID NO: 2435219 - DNA, 13 bp, Homo sapiens
tgagccttgtaat

SEQ ID NO: 2435220 - DNA, 23 bp, Homo sapiens
tgagcgaggagatgctccttggg

SEQ ID NO: 2435221 - DNA, 20 bp, Homo sapiens
tgagctcacaaggcagcaag

SEQ ID NO: 2435222 - DNA, 14 bp, Homo sapiens
tgagctcagcgtgg

SEQ ID NO: 2435223 - DNA, 20 bp, Homo sapiens
tgagctcctgtcccctgcta

SEQ ID NO: 2435224 - DNA, 12 bp, Homo sapiens
tgagctctgaga

SEQ ID NO: 2435225 - DNA, 18 bp, Homo sapiens
tgagctctgagaggccct

SEQ ID NO: 2435226 - DNA, 19 bp, Homo sapiens
tgagctctgagaggccctg

SEQ ID NO: 2435227 - DNA, 23 bp, Homo sapiens
tgagctctgagaggccctggatc

SEQ ID NO: 2435228 - DNA, 24 bp, Homo sapiens
tgagctgaccagccgtgagcatgt

SEQ ID NO: 2435229 - DNA, 16 bp, Homo sapiens
tgagctgtcaacgaga

SEQ ID NO: 2435230 - DNA, 16 bp, Homo sapiens
tgagcttaaaatacaa

SEQ ID NO: 2435231 - DNA, 19 bp, Homo sapiens
tgagcttaaaatacaagac

SEQ ID NO: 2435232 - DNA, 14 bp, Homo sapiens
tgagctttctgaac

SEQ ID NO: 2435233 - DNA, 16 bp, Homo sapiens
tgagctttctgaacag

SEQ ID NO: 2435234 - DNA, 20 bp, Homo sapiens
tgagctttctgaacagctgg

SEQ ID NO: 2435235 - DNA, 23 bp, Homo sapiens
tgagctttctgaacagctggtgt

SEQ ID NO: 2435236 - DNA, 13 bp, Homo sapiens
tgaggacaagaga

SEQ ID NO: 2435237 - DNA, 22 bp, Homo sapiens
tgaggacaagagaaaaaagcca

SEQ ID NO: 2435238 - DNA, 19 bp, Homo sapiens
tgaggagcagcaggagggg

SEQ ID NO: 2435239 - DNA, 13 bp, Homo sapiens
tgaggagtctgag

SEQ ID NO: 2435240 - DNA, 16 bp, Homo sapiens
tgaggagtctgaggtc

SEQ ID NO: 2435241 - DNA, 17 bp, Homo sapiens
tgaggagtctgaggtcc

SEQ ID NO: 2435242 - DNA, 22 bp, Homo sapiens
tgaggagtctgaggtcctgagc

SEQ ID NO: 2435243 - DNA, 22 bp, Homo sapiens
tgaggcagccgaggtccctgct

SEQ ID NO: 2435244 - DNA, 13 bp, Homo sapiens
tgaggccacactc

SEQ ID NO: 2435245 - DNA, 21 bp, Homo sapiens
tgaggccactgtgttccttcc

SEQ ID NO: 2435246 - DNA, 14 bp, Homo sapiens
tgaggccagcctgg

SEQ ID NO: 2435247 - DNA, 15 bp, Homo sapiens
tgaggccagcctggc

SEQ ID NO: 2435248 - DNA, 12 bp, Homo sapiens
tgaggccctcca

SEQ ID NO: 2435249 - DNA, 17 bp, Homo sapiens
tgaggccctccacacct

SEQ ID NO: 2435250 - DNA, 18 bp, Homo sapiens
tgaggccctccacacctg

SEQ ID NO: 2435251 - DNA, 14 bp, Homo sapiens
tgaggcctggactt

SEQ ID NO: 2435252 - DNA, 17 bp, Homo sapiens
tgaggcctggactttcc

SEQ ID NO: 2435253 - DNA, 19 bp, Homo sapiens
tgaggcctggactttcctg

SEQ ID NO: 2435254 - DNA, 20 bp, Homo sapiens
tgaggcctggactttcctgc

SEQ ID NO: 2435255 - DNA, 15 bp, Homo sapiens
tgaggctggcacagg

SEQ ID NO: 2435256 - DNA, 18 bp, Homo sapiens
tgaggctgtcctgtacat

SEQ ID NO: 2435257 - DNA, 23 bp, Homo sapiens
tgaggctttggatttgacattgc

SEQ ID NO: 2435258 - DNA, 14 bp, Homo sapiens
tgagggagcctggc

SEQ ID NO: 2435259 - DNA, 14 bp, Homo sapiens
tgagggcagcagcc

SEQ ID NO: 2435260 - DNA, 20 bp, Homo sapiens
tgagggcagcagccagccct

SEQ ID NO: 2435261 - DNA, 22 bp, Homo sapiens
tgagggcagcagccagccctgc

SEQ ID NO: 2435262 - DNA, 18 bp, Homo sapiens
gcctgttctatgccttta

SEQ ID NO: 2435263 - DNA, 16 bp, Homo sapiens
gcctgtttggcctctc

SEQ ID NO: 2435264 - DNA, 19 bp, Homo sapiens
gccttaggaagagccttcc

SEQ ID NO: 2435265 - DNA, 22 bp, Homo sapiens
gccttagtctcagtttgtgtgt

SEQ ID NO: 2435266 - DNA, 19 bp, Homo sapiens
gccttattagagtgtcttt

SEQ ID NO: 2435267 - DNA, 18 bp, Homo sapiens
gccttattcagggaagga

SEQ ID NO: 2435268 - DNA, 17 bp, Homo sapiens
gccttcaacacagcttg

SEQ ID NO: 2435269 - DNA, 19 bp, Homo sapiens
gccttcaacacagcttgtc

SEQ ID NO: 2435270 - DNA, 14 bp, Homo sapiens
gccttcaagctctg

SEQ ID NO: 2435271 - DNA, 15 bp, Homo sapiens
gccttcaagctctga

SEQ ID NO: 2435272 - DNA, 16 bp, Homo sapiens
gccttcaagctctgag

SEQ ID NO: 2435273 - DNA, 17 bp, Homo sapiens
gccttcacaatctgtca

SEQ ID NO: 2435274 - DNA, 18 bp, Homo sapiens
gccttcatatcatccaca

SEQ ID NO: 2435275 - DNA, 13 bp, Homo sapiens
gccttcctcctgg

SEQ ID NO: 2435276 - DNA, 17 bp, Homo sapiens
gccttcgcttcttgcct

SEQ ID NO: 2435277 - DNA, 21 bp, Homo sapiens
gccttcgcttcttgcctctgt

SEQ ID NO: 2435278 - DNA, 19 bp, Homo sapiens
gccttcgtctttcccatgg

SEQ ID NO: 2435279 - DNA, 13 bp, Homo sapiens
gccttgccagaga

SEQ ID NO: 2435280 - DNA, 18 bp, Homo sapiens
gccttgcggctcctcagg

SEQ ID NO: 2435281 - DNA, 13 bp, Homo sapiens
gccttgcttgtta

SEQ ID NO: 2435282 - DNA, 14 bp, Homo sapiens
gccttggcctggag

SEQ ID NO: 2435283 - DNA, 15 bp, Homo sapiens
gccttggcctggagc

SEQ ID NO: 2435284 - DNA, 23 bp, Homo sapiens
gccttggcctgtgttcttcctgg

SEQ ID NO: 2435285 - DNA, 20 bp, Homo sapiens
gccttgggctccgtgtggga

SEQ ID NO: 2435286 - DNA, 21 bp, Homo sapiens
gccttgggctccgtgtgggag

SEQ ID NO: 2435287 - DNA, 22 bp, Homo sapiens
gccttgggctccgtgtgggaga

SEQ ID NO: 2435288 - DNA, 23 bp, Homo sapiens
gccttggtttttactgctctgag

SEQ ID NO: 2435289 - DNA, 17 bp, Homo sapiens
gccttgtaattctaaat

SEQ ID NO: 2435290 - DNA, 23 bp, Homo sapiens
gcctttatttttggcgtggctga

SEQ ID NO: 2435291 - DNA, 17 bp, Homo sapiens
gcctttcaggatctatt

SEQ ID NO: 2435292 - DNA, 19 bp, Homo sapiens
gcctttccatccatggcca

SEQ ID NO: 2435293 - DNA, 20 bp, Homo sapiens
gcctttccatccatggccag

SEQ ID NO: 2435294 - DNA, 15 bp, Homo sapiens
gcctttgcctccccg

SEQ ID NO: 2435295 - DNA, 15 bp, Homo sapiens
gcctttgcgctcctg

SEQ ID NO: 2435296 - DNA, 23 bp, Homo sapiens
gcctttgttccccactggagcag

SEQ ID NO: 2435297 - DNA, 13 bp, Homo sapiens
gccttttttcccc

SEQ ID NO: 2435298 - DNA, 23 bp, Homo sapiens
gccttttttccccagacttgttg

SEQ ID NO: 2435299 - DNA, 22 bp, Homo sapiens
gcgaaaaaatcaggtggctttt

SEQ ID NO: 2435300 - DNA, 10 bp, Homo sapiens
gcgacctcct

SEQ ID NO: 2435301 - DNA, 21 bp, Homo sapiens
gcgactaatttcaaaatgctt

SEQ ID NO: 2435302 - DNA, 23 bp, Homo sapiens
gcgactaatttcaaaatgctttt

SEQ ID NO: 2435303 - DNA, 19 bp, Homo sapiens
gcgactccgttggccactc

SEQ ID NO: 2435304 - DNA, 14 bp, Homo sapiens
gcgactttctgcct

SEQ ID NO: 2435305 - DNA, 17 bp, Homo sapiens
gcgactttctgcctgga

SEQ ID NO: 2435306 - DNA, 22 bp, Homo sapiens
gcgagagatgtgtgttgatact

SEQ ID NO: 2435307 - DNA, 16 bp, Homo sapiens
gcgatccacctgtctc

SEQ ID NO: 2435308 - DNA, 18 bp, Homo sapiens
gcgatgacacttgtacaa

SEQ ID NO: 2435309 - DNA, 14 bp, Homo sapiens
gcgatgccagccaa

SEQ ID NO: 2435310 - DNA, 20 bp, Homo sapiens
gcgatgtggaactgctgcca

SEQ ID NO: 2435311 - DNA, 22 bp, Homo sapiens
gcgatgtggaactgctgccact

SEQ ID NO: 2435312 - DNA, 22 bp, Homo sapiens
gcgattccctctcccaggcccc

SEQ ID NO: 2435313 - DNA, 22 bp, Homo sapiens
gcgcactgtgacccccagctcc

SEQ ID NO: 2435314 - DNA, 18 bp, Homo sapiens
gcgcagtgtggaggccac

SEQ ID NO: 2435315 - DNA, 13 bp, Homo sapiens
gcgcatcagactg

SEQ ID NO: 2435316 - DNA, 14 bp, Homo sapiens
gcgcccagctcctg

SEQ ID NO: 2435317 - DNA, 15 bp, Homo sapiens
gcgcccagctcctga

SEQ ID NO: 2435318 - DNA, 22 bp, Homo sapiens
gcgccccaacccgtggaggctg

SEQ ID NO: 2435319 - DNA, 20 bp, Homo sapiens
gcgcgagggcctcaaaggcc

SEQ ID NO: 2435320 - DNA, 23 bp, Homo sapiens
gctctgtatcaggacccagagga

SEQ ID NO: 2435321 - DNA, 13 bp, Homo sapiens
gctctgtccccag

SEQ ID NO: 2435322 - DNA, 19 bp, Homo sapiens
gctctgtctacttgctcag

SEQ ID NO: 2435323 - DNA, 21 bp, Homo sapiens
gctctgttcttcctcagccag

SEQ ID NO: 2435324 - DNA, 22 bp, Homo sapiens
gctctgttcttcctcagccagc

SEQ ID NO: 2435325 - DNA, 15 bp, Homo sapiens
gctcttccttactcc

SEQ ID NO: 2435326 - DNA, 12 bp, Homo sapiens
gctcttcttaaa

SEQ ID NO: 2435327 - DNA, 17 bp, Homo sapiens
gctcttgatacccccct

SEQ ID NO: 2435328 - DNA, 13 bp, Homo sapiens
gctcttggctgga

SEQ ID NO: 2435329 - DNA, 18 bp, Homo sapiens
gctcttggctggacccag

SEQ ID NO: 2435330 - DNA, 13 bp, Homo sapiens
gctctttgagaaa

SEQ ID NO: 2435331 - DNA, 21 bp, Homo sapiens
gctctttgttttgtgtctctt

SEQ ID NO: 2435332 - DNA, 17 bp, Homo sapiens
gctgaaattctcctgga

SEQ ID NO: 2435333 - DNA, 18 bp, Homo sapiens
gctgaaattctcctggag

SEQ ID NO: 2435334 - DNA, 18 bp, Homo sapiens
gctgaagaattatttttt

SEQ ID NO: 2435335 - DNA, 17 bp, Homo sapiens
gctgaaggttgtggcct

SEQ ID NO: 2435336 - DNA, 20 bp, Homo sapiens
gctgaaggttgtggcctttg

SEQ ID NO: 2435337 - DNA, 15 bp, Homo sapiens
gctgaatgtttttct

SEQ ID NO: 2435338 - DNA, 21 bp, Homo sapiens
gctgacatgaagctgttgtgt

SEQ ID NO: 2435339 - DNA, 22 bp, Homo sapiens
gctgaccatgctcatctgctgg

SEQ ID NO: 2435340 - DNA, 13 bp, Homo sapiens
gctgacctgctga

SEQ ID NO: 2435341 - DNA, 17 bp, Homo sapiens
gctgactcacacctgaa

SEQ ID NO: 2435342 - DNA, 19 bp, Homo sapiens
gctgacttcatctcccacc

SEQ ID NO: 2435343 - DNA, 18 bp, Homo sapiens
gctgacttggctggtgtg

SEQ ID NO: 2435344 - DNA, 22 bp, Homo sapiens
gctgacttggctggtgtggtac

SEQ ID NO: 2435345 - DNA, 21 bp, Homo sapiens
gctgagaacctggccttcagt

SEQ ID NO: 2435346 - DNA, 16 bp, Homo sapiens
gctgagcagggccggg

SEQ ID NO: 2435347 - DNA, 16 bp, Homo sapiens
gctgagctcacaaggc

SEQ ID NO: 2435348 - DNA, 19 bp, Homo sapiens
gctgagctcacaaggcagc

SEQ ID NO: 2435349 - DNA, 21 bp, Homo sapiens
gctgagctcacaaggcagcaa

SEQ ID NO: 2435350 - DNA, 15 bp, Homo sapiens
gctgagctctgagag

SEQ ID NO: 2435351 - DNA, 21 bp, Homo sapiens
gctgaggccacactcagcaca

SEQ ID NO: 2435352 - DNA, 14 bp, Homo sapiens
gctgaggcctggac

SEQ ID NO: 2435353 - DNA, 21 bp, Homo sapiens
gctgaggcctggactttcctg

SEQ ID NO: 2435354 - DNA, 15 bp, Homo sapiens
gctgaggcctgggcc

SEQ ID NO: 2435355 - DNA, 23 bp, Homo sapiens
gctgaggcctgggccgctgccac

SEQ ID NO: 2435356 - DNA, 15 bp, Homo sapiens
gctgaggctggcaca

SEQ ID NO: 2435357 - DNA, 12 bp, Homo sapiens
gctgagggcagt

SEQ ID NO: 2435358 - DNA, 21 bp, Homo sapiens
gctgagggcagttcgcagcca

SEQ ID NO: 2435359 - DNA, 22 bp, Homo sapiens
gctgagggcagttcgcagccac

SEQ ID NO: 2435360 - DNA, 16 bp, Homo sapiens
gctgagtattaaaatg

SEQ ID NO: 2435361 - DNA, 11 bp, Homo sapiens
gctgagtttcc

SEQ ID NO: 2435362 - DNA, 13 bp, Homo sapiens
gctgagtttccta

SEQ ID NO: 2435363 - DNA, 20 bp, Homo sapiens
gctgatgtcaatttctgtgt

SEQ ID NO: 2435364 - DNA, 18 bp, Homo sapiens
gctgcaagcacagccctt

SEQ ID NO: 2435365 - DNA, 20 bp, Homo sapiens
gctgcaaggtactctggtga

SEQ ID NO: 2435366 - DNA, 18 bp, Homo sapiens
gctgcagaggccagaggc

SEQ ID NO: 2435367 - DNA, 22 bp, Homo sapiens
gctgcagaggccagaggccccc

SEQ ID NO: 2435368 - DNA, 23 bp, Homo sapiens
gctgcagcctcaggactgggagc

SEQ ID NO: 2435369 - DNA, 21 bp, Homo sapiens
gctgcagcctgcgccaccgcc

SEQ ID NO: 2435370 - DNA, 17 bp, Homo sapiens
gctgcagttcgactctg

SEQ ID NO: 2435371 - DNA, 19 bp, Homo sapiens
gctgcattgaaaagagctg

SEQ ID NO: 2435372 - DNA, 20 bp, Homo sapiens
gctgcattgaaaagagctga

SEQ ID NO: 2435373 - DNA, 12 bp, Homo sapiens
gctgccactgag

SEQ ID NO: 2435374 - DNA, 13 bp, Homo sapiens
gctgccactgagg

SEQ ID NO: 2435375 - DNA, 18 bp, Homo sapiens
gctgccagtgtcctgagc

SEQ ID NO: 2435376 - DNA, 16 bp, Homo sapiens
gctgccccggcccctc

SEQ ID NO: 2435377 - DNA, 22 bp, Homo sapiens
gctgcccctcatctctctgccc

SEQ ID NO: 2435378 - DNA, 18 bp, Homo sapiens
gctgcccctctcaccaaa

SEQ ID NO: 2435379 - DNA, 12 bp, Homo sapiens
gctgccctcctg

SEQ ID NO: 2435380 - DNA, 21 bp, Homo sapiens
gctgccctcctgtgctcagcc

SEQ ID NO: 2435381 - DNA, 13 bp, Homo sapiens
gctgccgtggggc

SEQ ID NO: 2435382 - DNA, 22 bp, Homo sapiens
gctgccgtggggccgccgcctc

SEQ ID NO: 2435383 - DNA, 14 bp, Homo sapiens
gctgcctggacccg

SEQ ID NO: 2435384 - DNA, 19 bp, Homo sapiens
gctgccttattcagggaag

SEQ ID NO: 2435385 - DNA, 21 bp, Homo sapiens
gctgctaatattttcctcctg

SEQ ID NO: 2435386 - DNA, 23 bp, Homo sapiens
gctgctaatattttcctcctgag

SEQ ID NO: 2435387 - DNA, 24 bp, Homo sapiens
gctgctaatattttcctcctgagt

SEQ ID NO: 2435388 - DNA, 13 bp, Homo sapiens
gctgctagagtga

SEQ ID NO: 2435389 - DNA, 12 bp, Homo sapiens
gctgctccctca

SEQ ID NO: 2435390 - DNA, 15 bp, Homo sapiens
gctgctccctcagac

SEQ ID NO: 2435391 - DNA, 21 bp, Homo sapiens
gctgctccctcagactggggc

SEQ ID NO: 2435392 - DNA, 20 bp, Homo sapiens
gctgctccgaggacccagga

SEQ ID NO: 2435393 - DNA, 18 bp, Homo sapiens
gctgctcggggtgcacag

SEQ ID NO: 2435394 - DNA, 18 bp, Homo sapiens
gctgctcttggctggacc

SEQ ID NO: 2435395 - DNA, 21 bp, Homo sapiens
gctgctcttggctggacccag

SEQ ID NO: 2435396 - DNA, 22 bp, Homo sapiens
gctgctcttggctggacccagc

SEQ ID NO: 2435397 - DNA, 14 bp, Homo sapiens
gctgctgagaacct

SEQ ID NO: 2435398 - DNA, 17 bp, Homo sapiens
gctgctgagaacctggc

SEQ ID NO: 2435399 - DNA, 16 bp, Homo sapiens
gctgctgctgggctca

SEQ ID NO: 2435400 - DNA, 17 bp, Homo sapiens
gctgctgctgggctcag

SEQ ID NO: 2435401 - DNA, 16 bp, Homo sapiens
gctgctgtccctcccc

SEQ ID NO: 2435402 - DNA, 16 bp, Homo sapiens
gctgctgtctgggtgc

SEQ ID NO: 2435403 - DNA, 21 bp, Homo sapiens
gctgctgtgtgctttttttgt

SEQ ID NO: 2435404 - DNA, 13 bp, Homo sapiens
gctgcttccagtg

SEQ ID NO: 2435405 - DNA, 15 bp, Homo sapiens
gctgcttcctcctgg

SEQ ID NO: 2435406 - DNA, 18 bp, Homo sapiens
gctgcttctcccaggcaa

SEQ ID NO: 2435407 - DNA, 22 bp, Homo sapiens
gctggaaaataatactgctgag

SEQ ID NO: 2435408 - DNA, 14 bp, Homo sapiens
gctggaagatcctg

SEQ ID NO: 2435409 - DNA, 17 bp, Homo sapiens
gctggaagctgggaggt

SEQ ID NO: 2435410 - DNA, 13 bp, Homo sapiens
gctggaagggtca

SEQ ID NO: 2435411 - DNA, 15 bp, Homo sapiens
gctggacccagccag

SEQ ID NO: 2435412 - DNA, 20 bp, Homo sapiens
gctggacccagccaggccca

SEQ ID NO: 2435413 - DNA, 21 bp, Homo sapiens
gctggacccagccaggcccag

SEQ ID NO: 2435414 - DNA, 15 bp, Homo sapiens
gctggaccctgacca

SEQ ID NO: 2435415 - DNA, 21 bp, Homo sapiens
gctggactctcagtctctgag

SEQ ID NO: 2435416 - DNA, 22 bp, Homo sapiens
gctggactctcagtctctgagc

SEQ ID NO: 2435417 - DNA, 14 bp, Homo sapiens
gctggaggagccca

SEQ ID NO: 2435418 - DNA, 22 bp, Homo sapiens
gctggaggagcccaggccagga

SEQ ID NO: 2435419 - DNA, 21 bp, Homo sapiens
gctggaggcaggggcttcctg

SEQ ID NO: 2435420 - DNA, 22 bp, Homo sapiens
gctggaggcaggggcttcctgg

SEQ ID NO: 2435421 - DNA, 14 bp, Homo sapiens
gctggaggcccagg

SEQ ID NO: 2435422 - DNA, 15 bp, Homo sapiens
gctggagtgcagtgg

SEQ ID NO: 2435423 - DNA, 13 bp, Homo sapiens
gcttctctgactt

SEQ ID NO: 2435424 - DNA, 18 bp, Homo sapiens
gcttctctgacttctgcc

SEQ ID NO: 2435425 - DNA, 21 bp, Homo sapiens
gcttctgagcagcgagcctgc

SEQ ID NO: 2435426 - DNA, 19 bp, Homo sapiens
gcttctgccccctgcagaa

SEQ ID NO: 2435427 - DNA, 18 bp, Homo sapiens
gcttctggccaggaagct

SEQ ID NO: 2435428 - DNA, 12 bp, Homo sapiens
gcttcttgcctc

SEQ ID NO: 2435429 - DNA, 14 bp, Homo sapiens
gcttcttgcctctg

SEQ ID NO: 2435430 - DNA, 20 bp, Homo sapiens
gcttcttgcctctgtgctgt

SEQ ID NO: 2435431 - DNA, 12 bp, Homo sapiens
gcttctttctag

SEQ ID NO: 2435432 - DNA, 21 bp, Homo sapiens
gcttctttctagaaagagaaa

SEQ ID NO: 2435433 - DNA, 20 bp, Homo sapiens
gcttgatgggattctggaca

SEQ ID NO: 2435434 - DNA, 19 bp, Homo sapiens
gcttgccctaagcagaaag

SEQ ID NO: 2435435 - DNA, 20 bp, Homo sapiens
gcttgccctaagcagaaagt

SEQ ID NO: 2435436 - DNA, 21 bp, Homo sapiens
gcttgcttttcatgcaaactc

SEQ ID NO: 2435437 - DNA, 22 bp, Homo sapiens
gcttgggaaaggtggtgtttct

SEQ ID NO: 2435438 - DNA, 20 bp, Homo sapiens
gcttggggctcacacacctg

SEQ ID NO: 2435439 - DNA, 15 bp, Homo sapiens
gcttggttccttccc

SEQ ID NO: 2435440 - DNA, 17 bp, Homo sapiens
gcttgtaactaaaataa

SEQ ID NO: 2435441 - DNA, 23 bp, Homo sapiens
gcttgtaactaaaataattttgt

SEQ ID NO: 2435442 - DNA, 14 bp, Homo sapiens
gcttgtagccagcc

SEQ ID NO: 2435443 - DNA, 17 bp, Homo sapiens
gcttgtggggcctggga

SEQ ID NO: 2435444 - DNA, 14 bp, Homo sapiens
gcttgttaaatttt

SEQ ID NO: 2435445 - DNA, 12 bp, Homo sapiens
gctttaatataa

SEQ ID NO: 2435446 - DNA, 13 bp, Homo sapiens
gctttaatataaa

SEQ ID NO: 2435447 - DNA, 16 bp, Homo sapiens
gctttaatataaatgc

SEQ ID NO: 2435448 - DNA, 19 bp, Homo sapiens
gctttaatataaatgcaaa

SEQ ID NO: 2435449 - DNA, 21 bp, Homo sapiens
gctttaatataaatgcaaata

SEQ ID NO: 2435450 - DNA, 12 bp, Homo sapiens
gctttagaaaca

SEQ ID NO: 2435451 - DNA, 21 bp, Homo sapiens
gctttagaatcccagccccct

SEQ ID NO: 2435452 - DNA, 15 bp, Homo sapiens
gctttcagaatatgt

SEQ ID NO: 2435453 - DNA, 21 bp, Homo sapiens
gctttcatgtaaactgtgcac

SEQ ID NO: 2435454 - DNA, 21 bp, Homo sapiens
gctttcattttctctcaggtg

SEQ ID NO: 2435455 - DNA, 20 bp, Homo sapiens
gctttctgaacagctggtgt

SEQ ID NO: 2435456 - DNA, 12 bp, Homo sapiens
gctttctgttcc

SEQ ID NO: 2435457 - DNA, 13 bp, Homo sapiens
gctttctgttcca

SEQ ID NO: 2435458 - DNA, 15 bp, Homo sapiens
gctttctgttccaaa

SEQ ID NO: 2435459 - DNA, 24 bp, Homo sapiens
gctttgactcaggagcctgtgaca

SEQ ID NO: 2435460 - DNA, 16 bp, Homo sapiens
gctttgagagagaaag

SEQ ID NO: 2435461 - DNA, 19 bp, Homo sapiens
gctttgatgttccttccag

SEQ ID NO: 2435462 - DNA, 21 bp, Homo sapiens
gctttgatgttccttccagtg

SEQ ID NO: 2435463 - DNA, 17 bp, Homo sapiens
gctttggtctcttgctt

SEQ ID NO: 2435464 - DNA, 16 bp, Homo sapiens
gctttggtttaaaaga

SEQ ID NO: 2435465 - DNA, 14 bp, Homo sapiens
gctttgttttgcac

SEQ ID NO: 2435466 - DNA, 23 bp, Homo sapiens
gctttgttttgcacactttgcca

SEQ ID NO: 2435467 - DNA, 21 bp, Homo sapiens
gcttttgtgggggactgtaag

SEQ ID NO: 2435468 - DNA, 21 bp, Homo sapiens
gcttttgtttcctttttcaga

SEQ ID NO: 2435469 - DNA, 16 bp, Homo sapiens
gctttttgtgtttttt

SEQ ID NO: 2435470 - DNA, 22 bp, Homo sapiens
gctttttttgtgtgtatttgct

SEQ ID NO: 2435471 - DNA, 15 bp, Homo sapiens
gcttttttttccttc

SEQ ID NO: 2435472 - DNA, 17 bp, Homo sapiens
ggaaaaactttggaacc

SEQ ID NO: 2435473 - DNA, 19 bp, Homo sapiens
ggaaaaactttggaaccag

SEQ ID NO: 2435474 - DNA, 20 bp, Homo sapiens
ggaaaactccaccttcccac

SEQ ID NO: 2435475 - DNA, 17 bp, Homo sapiens
ggaaaagacacattttt

SEQ ID NO: 2435476 - DNA, 15 bp, Homo sapiens
ggaaaattcattttt

SEQ ID NO: 2435477 - DNA, 20 bp, Homo sapiens
ggaaagcccatatgctacca

SEQ ID NO: 2435478 - DNA, 16 bp, Homo sapiens
ggaaagcccctgcccc

SEQ ID NO: 2435479 - DNA, 19 bp, Homo sapiens
ggaaagtacactctgctgt

SEQ ID NO: 2435480 - DNA, 16 bp, Homo sapiens
ggaaatatatattata

SEQ ID NO: 2435481 - DNA, 15 bp, Homo sapiens
ggaaatcccttcata

SEQ ID NO: 2435482 - DNA, 13 bp, Homo sapiens
ggaaatcttaaac

SEQ ID NO: 2435483 - DNA, 18 bp, Homo sapiens
ggaacaaggagtcagaca

SEQ ID NO: 2435484 - DNA, 14 bp, Homo sapiens
ggaacacggccaca

SEQ ID NO: 2435485 - DNA, 20 bp, Homo sapiens
ggaacactagacaagccaga

SEQ ID NO: 2435486 - DNA, 21 bp, Homo sapiens
ggaacactggggacttggcct

SEQ ID NO: 2435487 - DNA, 18 bp, Homo sapiens
ggaacagtgtgcaaggca

SEQ ID NO: 2435488 - DNA, 19 bp, Homo sapiens
ggaacagtgtgcaaggcag

SEQ ID NO: 2435489 - DNA, 14 bp, Homo sapiens
ggaacatggggagg

SEQ ID NO: 2435490 - DNA, 13 bp, Homo sapiens
ggaaccagactct

SEQ ID NO: 2435491 - DNA, 11 bp, Homo sapiens
ggaacccagac

SEQ ID NO: 2435492 - DNA, 14 bp, Homo sapiens
ggaacccagactca

SEQ ID NO: 2435493 - DNA, 15 bp, Homo sapiens
ggaacccagactcag

SEQ ID NO: 2435494 - DNA, 17 bp, Homo sapiens
ggaacccctttcccacc

SEQ ID NO: 2435495 - DNA, 16 bp, Homo sapiens
ggaacctcagcctggc

SEQ ID NO: 2435496 - DNA, 21 bp, Homo sapiens
ggaacctcagcctggccagac

SEQ ID NO: 2435497 - DNA, 23 bp, Homo sapiens
ggaacctcagcctggccagacac

SEQ ID NO: 2435498 - DNA, 13 bp, Homo sapiens
ggaactcagatcc

SEQ ID NO: 2435499 - DNA, 17 bp, Homo sapiens
ggaactcagatccaggg

SEQ ID NO: 2435500 - DNA, 20 bp, Homo sapiens
ggaactgaagggggcggcct

SEQ ID NO: 2435501 - DNA, 16 bp, Homo sapiens
ggaactgctgccactg

SEQ ID NO: 2435502 - DNA, 17 bp, Homo sapiens
ggaactgctgccactga

SEQ ID NO: 2435503 - DNA, 21 bp, Homo sapiens
ggaactgctgccactgagggg

SEQ ID NO: 2435504 - DNA, 17 bp, Homo sapiens
ggaactggaatcctttc

SEQ ID NO: 2435505 - DNA, 15 bp, Homo sapiens
ggaactggaggcagg

SEQ ID NO: 2435506 - DNA, 14 bp, Homo sapiens
ggaactggccaagc

SEQ ID NO: 2435507 - DNA, 16 bp, Homo sapiens
ggaactggccaagctg

SEQ ID NO: 2435508 - DNA, 17 bp, Homo sapiens
ggaactggccaagctga

SEQ ID NO: 2435509 - DNA, 19 bp, Homo sapiens
ggaactggccaagctgagg

SEQ ID NO: 2435510 - DNA, 22 bp, Homo sapiens
ggaacttggggagttaagacct

SEQ ID NO: 2435511 - DNA, 20 bp, Homo sapiens
ggaagacccattccttccca

SEQ ID NO: 2435512 - DNA, 21 bp, Homo sapiens
ggaagagagcctgcaggatct

SEQ ID NO: 2435513 - DNA, 22 bp, Homo sapiens
ggaagagcagcacctcctcagc

SEQ ID NO: 2435514 - DNA, 15 bp, Homo sapiens
ggaagagggacagat

SEQ ID NO: 2435515 - DNA, 18 bp, Homo sapiens
ggaagatggggaccagca

SEQ ID NO: 2435516 - DNA, 12 bp, Homo sapiens
ggaagcagcagc

SEQ ID NO: 2435517 - DNA, 14 bp, Homo sapiens
ggaagcagcagcct

SEQ ID NO: 2435518 - DNA, 22 bp, Homo sapiens
ggaagccaaaatgtaggcttag

SEQ ID NO: 2435519 - DNA, 17 bp, Homo sapiens
ggaagcccatcctgacc

SEQ ID NO: 2435520 - DNA, 15 bp, Homo sapiens
ggaagccgtcctggc

SEQ ID NO: 2435521 - DNA, 20 bp, Homo sapiens
ggaagccgtgctcgccccag

SEQ ID NO: 2435522 - DNA, 14 bp, Homo sapiens
ggaagcctgcagtc

SEQ ID NO: 2435523 - DNA, 20 bp, Homo sapiens
ggaagcgcgagggcctcaaa

SEQ ID NO: 2435524 - DNA, 19 bp, Homo sapiens
ggaagctagacacatgaag

SEQ ID NO: 2435525 - DNA, 12 bp, Homo sapiens
ggaaggagctgc

SEQ ID NO: 2435526 - DNA, 13 bp, Homo sapiens
ggaaggagctgcc

SEQ ID NO: 2435527 - DNA, 14 bp, Homo sapiens
ggagagggggctgg

SEQ ID NO: 2435528 - DNA, 18 bp, Homo sapiens
ggagagggggctggtggg

SEQ ID NO: 2435529 - DNA, 21 bp, Homo sapiens
ggagagggggctggtgggtgc

SEQ ID NO: 2435530 - DNA, 13 bp, Homo sapiens
ggagagtgggggt

SEQ ID NO: 2435531 - DNA, 13 bp, Homo sapiens
ggagatcctcctg

SEQ ID NO: 2435532 - DNA, 15 bp, Homo sapiens
ggagatgctccttgg

SEQ ID NO: 2435533 - DNA, 15 bp, Homo sapiens
ggagattgacctgga

SEQ ID NO: 2435534 - DNA, 23 bp, Homo sapiens
ggagcacggctctgtccccagcc

SEQ ID NO: 2435535 - DNA, 19 bp, Homo sapiens
ggagcagaggggcagaggc

SEQ ID NO: 2435536 - DNA, 19 bp, Homo sapiens
ggagcagcaggagggggga

SEQ ID NO: 2435537 - DNA, 21 bp, Homo sapiens
ggagccactcctctgactcag

SEQ ID NO: 2435538 - DNA, 21 bp, Homo sapiens
ggagcccacgacactgcagcc

SEQ ID NO: 2435539 - DNA, 14 bp, Homo sapiens
ggagcccactgtcc

SEQ ID NO: 2435540 - DNA, 14 bp, Homo sapiens
ggagcccaggccag

SEQ ID NO: 2435541 - DNA, 15 bp, Homo sapiens
ggagcccaggccagg

SEQ ID NO: 2435542 - DNA, 16 bp, Homo sapiens
ggagcccaggccagga

SEQ ID NO: 2435543 - DNA, 14 bp, Homo sapiens
ggagcccccaccct

SEQ ID NO: 2435544 - DNA, 22 bp, Homo sapiens
ggagcccccaccctgttcctgc

SEQ ID NO: 2435545 - DNA, 15 bp, Homo sapiens
ggagcccccagcctg

SEQ ID NO: 2435546 - DNA, 18 bp, Homo sapiens
ggagcccccagcctgtca

SEQ ID NO: 2435547 - DNA, 19 bp, Homo sapiens
ggagccccttctgctcagc

SEQ ID NO: 2435548 - DNA, 21 bp, Homo sapiens
ggagccgaggcctaccccgca

SEQ ID NO: 2435549 - DNA, 18 bp, Homo sapiens
ggagcctcgcaacccgtg

SEQ ID NO: 2435550 - DNA, 10 bp, Homo sapiens
ggagcctgtc

SEQ ID NO: 2435551 - DNA, 13 bp, Homo sapiens
ggagcctgtcctg

SEQ ID NO: 2435552 - DNA, 14 bp, Homo sapiens
ggagcctgtcctgc

SEQ ID NO: 2435553 - DNA, 18 bp, Homo sapiens
ggagcctgtgaacccagg

SEQ ID NO: 2435554 - DNA, 20 bp, Homo sapiens
ggagcgggtctgctcccaag

SEQ ID NO: 2435555 - DNA, 12 bp, Homo sapiens
ggagctaaggct

SEQ ID NO: 2435556 - DNA, 14 bp, Homo sapiens
ggagctacctgtgt

SEQ ID NO: 2435557 - DNA, 17 bp, Homo sapiens
ggagctccactctgctt

SEQ ID NO: 2435558 - DNA, 20 bp, Homo sapiens
ggagctccagtgtcctgagc

SEQ ID NO: 2435559 - DNA, 16 bp, Homo sapiens
ggagctcccctcccca

SEQ ID NO: 2435560 - DNA, 11 bp, Homo sapiens
ggagctgcctg

SEQ ID NO: 2435561 - DNA, 15 bp, Homo sapiens
ggagctgcctggacc

SEQ ID NO: 2435562 - DNA, 16 bp, Homo sapiens
ggagctgcctggaccc

SEQ ID NO: 2435563 - DNA, 14 bp, Homo sapiens
ggagctgggcctgg

SEQ ID NO: 2435564 - DNA, 17 bp, Homo sapiens
ggagctggggatccctc

SEQ ID NO: 2435565 - DNA, 15 bp, Homo sapiens
ggaggacctgagcct

SEQ ID NO: 2435566 - DNA, 13 bp, Homo sapiens
ggaggagcccagg

SEQ ID NO: 2435567 - DNA, 12 bp, Homo sapiens
ggaggagcctgt

SEQ ID NO: 2435568 - DNA, 18 bp, Homo sapiens
ggaggcaggggcttcctg

SEQ ID NO: 2435569 - DNA, 19 bp, Homo sapiens
ggaggcaggggcttcctgg

SEQ ID NO: 2435570 - DNA, 13 bp, Homo sapiens
ggaggcccagttc

SEQ ID NO: 2435571 - DNA, 12 bp, Homo sapiens
ggaggccgaagc

SEQ ID NO: 2435572 - DNA, 15 bp, Homo sapiens
ggaggctcaggtccc

SEQ ID NO: 2435573 - DNA, 18 bp, Homo sapiens
ggaggctccagagggcac

SEQ ID NO: 2435574 - DNA, 22 bp, Homo sapiens
ggaggctgctcggggtgcacag

SEQ ID NO: 2435575 - DNA, 13 bp, Homo sapiens
ggaggctggtcct

SEQ ID NO: 2435576 - DNA, 16 bp, Homo sapiens
ggagggaagggagcca

SEQ ID NO: 2435577 - DNA, 21 bp, Homo sapiens
ggagggaagggagccaaggga

SEQ ID NO: 2435578 - DNA, 23 bp, Homo sapiens
ggagggaagggagccaagggatg

SEQ ID NO: 2435579 - DNA, 17 bp, Homo sapiens
ggagggacaaaggagcc

SEQ ID NO: 2435580 - DNA, 21 bp, Homo sapiens
ggagggacaaaggagcctgtg

SEQ ID NO: 2435581 - DNA, 18 bp, Homo sapiens
ggagggaggccgggcggt

SEQ ID NO: 2435582 - DNA, 15 bp, Homo sapiens
ggagggaggctcagg

SEQ ID NO: 2435583 - DNA, 17 bp, Homo sapiens
ggagggcagagctggtg

SEQ ID NO: 2435584 - DNA, 19 bp, Homo sapiens
ggagggcagagctggtgcg

SEQ ID NO: 2435585 - DNA, 13 bp, Homo sapiens
ggagggcagcagg

SEQ ID NO: 2435586 - DNA, 15 bp, Homo sapiens
ggagggcagcagggc

SEQ ID NO: 2435587 - DNA, 17 bp, Homo sapiens
ggagggcagcagggcta

SEQ ID NO: 2435588 - DNA, 20 bp, Homo sapiens
ggagggcggcaggggcctgg

SEQ ID NO: 2435589 - DNA, 21 bp, Homo sapiens
ggagggcggcaggggcctgga

SEQ ID NO: 2435590 - DNA, 16 bp, Homo sapiens
ggaggggaagaggcct

SEQ ID NO: 2435591 - DNA, 13 bp, Homo sapiens
ggaggggaggggg

SEQ ID NO: 2435592 - DNA, 14 bp, Homo sapiens
ggagggggaatggc

SEQ ID NO: 2435593 - DNA, 19 bp, Homo sapiens
ggagggggaatggcagcag

SEQ ID NO: 2435594 - DNA, 13 bp, Homo sapiens
ggagggtaggcag

SEQ ID NO: 2435595 - DNA, 13 bp, Homo sapiens
ggagggtgggaag

SEQ ID NO: 2435596 - DNA, 14 bp, Homo sapiens
ggagggtgggaagg

SEQ ID NO: 2435597 - DNA, 19 bp, Homo sapiens
ggaggtgggccgtggccct

SEQ ID NO: 2435598 - DNA, 16 bp, Homo sapiens
ggaggtgtctcaggct

SEQ ID NO: 2435599 - DNA, 18 bp, Homo sapiens
ggaggtgtctcaggctgc

SEQ ID NO: 2435600 - DNA, 20 bp, Homo sapiens
ggaggtgtctcaggctgcct

SEQ ID NO: 2435601 - DNA, 22 bp, Homo sapiens
ggaggtgtctcaggctgcctga

SEQ ID NO: 2435602 - DNA, 18 bp, Homo sapiens
ggaggtgtggagccgagg

SEQ ID NO: 2435603 - DNA, 23 bp, Homo sapiens
ggaggttctaaggcctaggattc

SEQ ID NO: 2435604 - DNA, 14 bp, Homo sapiens
ggagtagctgagct

SEQ ID NO: 2435605 - DNA, 13 bp, Homo sapiens
ggagtcccctcac

SEQ ID NO: 2435606 - DNA, 16 bp, Homo sapiens
ggagtctgaggtcctg

SEQ ID NO: 2435607 - DNA, 15 bp, Homo sapiens
ggagtctgccagggc

SEQ ID NO: 2435608 - DNA, 20 bp, Homo sapiens
ggagtctgccagggcccctc

SEQ ID NO: 2435609 - DNA, 15 bp, Homo sapiens
ggagtgagtggccct

SEQ ID NO: 2435610 - DNA, 18 bp, Homo sapiens
ggagtgcggaccaccctc

SEQ ID NO: 2435611 - DNA, 19 bp, Homo sapiens
ggagtggcagcccagccag

SEQ ID NO: 2435612 - DNA, 16 bp, Homo sapiens
ggagttaagacctggc

SEQ ID NO: 2435613 - DNA, 18 bp, Homo sapiens
ggagttaagacctggcag

SEQ ID NO: 2435614 - DNA, 13 bp, Homo sapiens
ggagttagggact

SEQ ID NO: 2435615 - DNA, 19 bp, Homo sapiens
ggagttagggactgaccag

SEQ ID NO: 2435616 - DNA, 23 bp, Homo sapiens
ggagttgaggtgtcagagaaaat

SEQ ID NO: 2435617 - DNA, 23 bp, Homo sapiens
ggagttgatcgcctttcccaggt

SEQ ID NO: 2435618 - DNA, 21 bp, Homo sapiens
ggagttgatctggaacccaga

SEQ ID NO: 2435619 - DNA, 14 bp, Homo sapiens
ggataggccagccg

SEQ ID NO: 2435620 - DNA, 15 bp, Homo sapiens
ggataggccagccgc

SEQ ID NO: 2435621 - DNA, 13 bp, Homo sapiens
ggatcagcgtggc

SEQ ID NO: 2435622 - DNA, 16 bp, Homo sapiens
ggatcagcgtggcctt

SEQ ID NO: 2435623 - DNA, 18 bp, Homo sapiens
ggatcagcgtggccttgt

SEQ ID NO: 2435624 - DNA, 19 bp, Homo sapiens
ggatcagcgtggccttgtt

SEQ ID NO: 2435625 - DNA, 22 bp, Homo sapiens
ggatccctcatctgtccctccg

SEQ ID NO: 2435626 - DNA, 17 bp, Homo sapiens
ggatccctcccccccat

SEQ ID NO: 2435627 - DNA, 17 bp, Homo sapiens
ggatccgactgctttgg

SEQ ID NO: 2435628 - DNA, 21 bp, Homo sapiens
ggatccgactgctttggacct

SEQ ID NO: 2435629 - DNA, 16 bp, Homo sapiens
ggatcctgtgtggaga

SEQ ID NO: 2435630 - DNA, 21 bp, Homo sapiens
ggatgagctcccacaagcctg

SEQ ID NO: 2435631 - DNA, 22 bp, Homo sapiens
ggatgcagaggcctgcagggcc

SEQ ID NO: 2435632 - DNA, 23 bp, Homo sapiens
ggccctggggcctgtactgcctg

SEQ ID NO: 2435633 - DNA, 13 bp, Homo sapiens
ggccgagtccaag

SEQ ID NO: 2435634 - DNA, 15 bp, Homo sapiens
ggccgatgcccagag

SEQ ID NO: 2435635 - DNA, 14 bp, Homo sapiens
ggccgctgtgccag

SEQ ID NO: 2435636 - DNA, 16 bp, Homo sapiens
ggccggacgcatctca

SEQ ID NO: 2435637 - DNA, 16 bp, Homo sapiens
ggccgtgacgtctggg

SEQ ID NO: 2435638 - DNA, 21 bp, Homo sapiens
ggccgtgacgtctgggtggcc

SEQ ID NO: 2435639 - DNA, 15 bp, Homo sapiens
ggccgtggctgctgt

SEQ ID NO: 2435640 - DNA, 15 bp, Homo sapiens
ggcctaagaggctgc

SEQ ID NO: 2435641 - DNA, 20 bp, Homo sapiens
ggcctaagaggctgccctcc

SEQ ID NO: 2435642 - DNA, 16 bp, Homo sapiens
ggcctaccccgcagac

SEQ ID NO: 2435643 - DNA, 13 bp, Homo sapiens
ggcctaggattct

SEQ ID NO: 2435644 - DNA, 17 bp, Homo sapiens
ggcctatggagagccct

SEQ ID NO: 2435645 - DNA, 18 bp, Homo sapiens
ggcctatggagagccctg

SEQ ID NO: 2435646 - DNA, 19 bp, Homo sapiens
ggcctcaaaggcccgctct

SEQ ID NO: 2435647 - DNA, 20 bp, Homo sapiens
ggcctcaaaggcccgctcta

SEQ ID NO: 2435648 - DNA, 11 bp, Homo sapiens
ggcctcagggc

SEQ ID NO: 2435649 - DNA, 15 bp, Homo sapiens
ggcctcatgtggctg

SEQ ID NO: 2435650 - DNA, 19 bp, Homo sapiens
ggcctccatgggccccagg

SEQ ID NO: 2435651 - DNA, 16 bp, Homo sapiens
ggcctcccaaagtgct

SEQ ID NO: 2435652 - DNA, 13 bp, Homo sapiens
ggcctcccccact

SEQ ID NO: 2435653 - DNA, 17 bp, Homo sapiens
ggcctcccctgccacca

SEQ ID NO: 2435654 - DNA, 13 bp, Homo sapiens
ggcctcctgcctc

SEQ ID NO: 2435655 - DNA, 14 bp, Homo sapiens
ggcctcctgcctct

SEQ ID NO: 2435656 - DNA, 13 bp, Homo sapiens
ggcctctctatcc

SEQ ID NO: 2435657 - DNA, 20 bp, Homo sapiens
ggcctgaccaaacagccaac

SEQ ID NO: 2435658 - DNA, 17 bp, Homo sapiens
ggcctgagcagtccttg

SEQ ID NO: 2435659 - DNA, 15 bp, Homo sapiens
ggcctgatcagacca

SEQ ID NO: 2435660 - DNA, 18 bp, Homo sapiens
ggcctgatcagaccacgg

SEQ ID NO: 2435661 - DNA, 18 bp, Homo sapiens
ggcctgcaaactgggaac

SEQ ID NO: 2435662 - DNA, 13 bp, Homo sapiens
ggcctgcagggcc

SEQ ID NO: 2435663 - DNA, 18 bp, Homo sapiens
ggcctgccacctggaccc

SEQ ID NO: 2435664 - DNA, 22 bp, Homo sapiens
ggcctgccacctggacccctgc

SEQ ID NO: 2435665 - DNA, 16 bp, Homo sapiens
ggcctgctccagacct

SEQ ID NO: 2435666 - DNA, 13 bp, Homo sapiens
ggcctgctgctga

SEQ ID NO: 2435667 - DNA, 23 bp, Homo sapiens
ggcctgctgctgagaacctggcc

SEQ ID NO: 2435668 - DNA, 20 bp, Homo sapiens
ggcctggagatcctcctgca

SEQ ID NO: 2435669 - DNA, 19 bp, Homo sapiens
ggcctggccagtgccctga

SEQ ID NO: 2435670 - DNA, 20 bp, Homo sapiens
ggcctggccagtgccctgat

SEQ ID NO: 2435671 - DNA, 14 bp, Homo sapiens
ggcctggctggctg

SEQ ID NO: 2435672 - DNA, 21 bp, Homo sapiens
ggcctgggacaactgctccca

SEQ ID NO: 2435673 - DNA, 15 bp, Homo sapiens
ggcctgggccgctgc

SEQ ID NO: 2435674 - DNA, 14 bp, Homo sapiens
ggcctgggctcctg

SEQ ID NO: 2435675 - DNA, 17 bp, Homo sapiens
ggcctgggctcctggac

SEQ ID NO: 2435676 - DNA, 21 bp, Homo sapiens
ggcctggggtgacccggcacc

SEQ ID NO: 2435677 - DNA, 22 bp, Homo sapiens
ggcctggttaaataaggcaggg

SEQ ID NO: 2435678 - DNA, 17 bp, Homo sapiens
ggcctgtactgcctgct

SEQ ID NO: 2435679 - DNA, 18 bp, Homo sapiens
ggcctgtccaacacatct

SEQ ID NO: 2435680 - DNA, 15 bp, Homo sapiens
ggcctgtccacaggc

SEQ ID NO: 2435681 - DNA, 22 bp, Homo sapiens
ggcctgtccacaggcttctgag

SEQ ID NO: 2435682 - DNA, 17 bp, Homo sapiens
ggcctgtgtagctgtga

SEQ ID NO: 2435683 - DNA, 23 bp, Homo sapiens
ggcctgtgtagctgtgacctgct

SEQ ID NO: 2435684 - DNA, 19 bp, Homo sapiens
ggcctgtgttcttcctggc

SEQ ID NO: 2435685 - DNA, 12 bp, Homo sapiens
ggccttcacaat

SEQ ID NO: 2435686 - DNA, 17 bp, Homo sapiens
ggccttgcggctcctca

SEQ ID NO: 2435687 - DNA, 19 bp, Homo sapiens
ggccttgcggctcctcagg

SEQ ID NO: 2435688 - DNA, 14 bp, Homo sapiens
ggccttggcctgga

SEQ ID NO: 2435689 - DNA, 15 bp, Homo sapiens
ggccttggcctggag

SEQ ID NO: 2435690 - DNA, 16 bp, Homo sapiens
ggccttgttctgtcac

SEQ ID NO: 2435691 - DNA, 23 bp, Homo sapiens
ggcctttgcgctcctggcccagc

SEQ ID NO: 2435692 - DNA, 18 bp, Homo sapiens
ggcgatccacctgtctca

SEQ ID NO: 2435693 - DNA, 17 bp, Homo sapiens
ggcgatgccagccaagc

SEQ ID NO: 2435694 - DNA, 18 bp, Homo sapiens
ggcgatgccagccaagct

SEQ ID NO: 2435695 - DNA, 23 bp, Homo sapiens
ggcgccccaacccgtggaggctg

SEQ ID NO: 2435696 - DNA, 21 bp, Homo sapiens
ggcgccgtctccaggggctgc

SEQ ID NO: 2435697 - DNA, 15 bp, Homo sapiens
ggcgcctgtggttct

SEQ ID NO: 2435698 - DNA, 16 bp, Homo sapiens
ggcgcctgtggttctg

SEQ ID NO: 2435699 - DNA, 18 bp, Homo sapiens
ggcggctcggaggaagcc

SEQ ID NO: 2435700 - DNA, 24 bp, Homo sapiens
ggcggctggggtcccagcagctgc

SEQ ID NO: 2435701 - DNA, 19 bp, Homo sapiens
ggcgggggtggcggcggcc

SEQ ID NO: 2435702 - DNA, 23 bp, Homo sapiens
ggcggtcacagcatggaggagga

SEQ ID NO: 2435703 - DNA, 14 bp, Homo sapiens
ggcgtaagtacaga

SEQ ID NO: 2435704 - DNA, 18 bp, Homo sapiens
ggcgtaagtacagagaag

SEQ ID NO: 2435705 - DNA, 20 bp, Homo sapiens
ggcgtaagtacagagaagcc

SEQ ID NO: 2435706 - DNA, 22 bp, Homo sapiens
ggcgtaagtacagagaagccat

SEQ ID NO: 2435707 - DNA, 21 bp, Homo sapiens
ggcgtaggctacagagaagcc

SEQ ID NO: 2435708 - DNA, 22 bp, Homo sapiens
ggcgtaggctacagagaagcct

SEQ ID NO: 2435709 - DNA, 17 bp, Homo sapiens
ggcgtgagccacctcgc

SEQ ID NO: 2435710 - DNA, 13 bp, Homo sapiens
ggctaatttttgt

SEQ ID NO: 2435711 - DNA, 14 bp, Homo sapiens
ggctacagagaagc

SEQ ID NO: 2435712 - DNA, 17 bp, Homo sapiens
ggctacagagaagcctt

SEQ ID NO: 2435713 - DNA, 19 bp, Homo sapiens
ggctactctgtgccagagc

SEQ ID NO: 2435714 - DNA, 18 bp, Homo sapiens
ggctacttcggggctggg

SEQ ID NO: 2435715 - DNA, 20 bp, Homo sapiens
ggctagagtgcggtggcgcg

SEQ ID NO: 2435716 - DNA, 17 bp, Homo sapiens
ggctatagatgtctttt

SEQ ID NO: 2435717 - DNA, 19 bp, Homo sapiens
ggctatagatgtcttttcc

SEQ ID NO: 2435718 - DNA, 19 bp, Homo sapiens
ggctcaagcgattctcctg

SEQ ID NO: 2435719 - DNA, 16 bp, Homo sapiens
ggctcactcagcactt

SEQ ID NO: 2435720 - DNA, 18 bp, Homo sapiens
ggctcagagccggggtgg

SEQ ID NO: 2435721 - DNA, 21 bp, Homo sapiens
ggctcagatcggccacagggc

SEQ ID NO: 2435722 - DNA, 17 bp, Homo sapiens
ggctcaggcaggggcct

SEQ ID NO: 2435723 - DNA, 21 bp, Homo sapiens
ggctcaggcaggggcctccat

SEQ ID NO: 2435724 - DNA, 20 bp, Homo sapiens
ggctcagtgaagttgctgct

SEQ ID NO: 2435725 - DNA, 16 bp, Homo sapiens
ggctccagatgcaggg

SEQ ID NO: 2435726 - DNA, 13 bp, Homo sapiens
ggctcccaggggc

SEQ ID NO: 2435727 - DNA, 15 bp, Homo sapiens
ggctcccggaattcc

SEQ ID NO: 2435728 - DNA, 17 bp, Homo sapiens
ggctccctccgccccca

SEQ ID NO: 2435729 - DNA, 16 bp, Homo sapiens
ggctccctggggggag

SEQ ID NO: 2435730 - DNA, 12 bp, Homo sapiens
ggctcctggacc

SEQ ID NO: 2435731 - DNA, 10 bp, Homo sapiens
ggctcctggt

SEQ ID NO: 2435732 - DNA, 15 bp, Homo sapiens
ggctcctgttttgca

SEQ ID NO: 2435733 - DNA, 16 bp, Homo sapiens
ggctccttgtgccaga

SEQ ID NO: 2435734 - DNA, 17 bp, Homo sapiens
ggctccttgtgggcctg

SEQ ID NO: 2435735 - DNA, 20 bp, Homo sapiens
ggctccttgtgggcctgggc

SEQ ID NO: 2435736 - DNA, 14 bp, Homo sapiens
gggagactgggctg

SEQ ID NO: 2435737 - DNA, 19 bp, Homo sapiens
gggagactgggctgaggga

SEQ ID NO: 2435738 - DNA, 16 bp, Homo sapiens
gggagagcccaggagc

SEQ ID NO: 2435739 - DNA, 17 bp, Homo sapiens
gggagagcccaggagct

SEQ ID NO: 2435740 - DNA, 18 bp, Homo sapiens
gggagagggtgaaggagg

SEQ ID NO: 2435741 - DNA, 19 bp, Homo sapiens
gggagcaaactgcatgccc

SEQ ID NO: 2435742 - DNA, 11 bp, Homo sapiens
gggagccaagg

SEQ ID NO: 2435743 - DNA, 15 bp, Homo sapiens
gggagccatttgaga

SEQ ID NO: 2435744 - DNA, 20 bp, Homo sapiens
gggagcccactgtcctgggc

SEQ ID NO: 2435745 - DNA, 17 bp, Homo sapiens
gggagcccccagcctgt

SEQ ID NO: 2435746 - DNA, 21 bp, Homo sapiens
gggagcccccagcctgtcaga

SEQ ID NO: 2435747 - DNA, 17 bp, Homo sapiens
gggagctgggcctggtc

SEQ ID NO: 2435748 - DNA, 15 bp, Homo sapiens
gggagggctctgagg

SEQ ID NO: 2435749 - DNA, 18 bp, Homo sapiens
gggagggctctgaggcgc

SEQ ID NO: 2435750 - DNA, 23 bp, Homo sapiens
gggagtgactcaagaagtgaaga

SEQ ID NO: 2435751 - DNA, 13 bp, Homo sapiens
gggagtgtgtgcc

SEQ ID NO: 2435752 - DNA, 16 bp, Homo sapiens
gggagttaagacctgg

SEQ ID NO: 2435753 - DNA, 15 bp, Homo sapiens
gggataggccagccg

SEQ ID NO: 2435754 - DNA, 18 bp, Homo sapiens
gggatcaggggtaggaat

SEQ ID NO: 2435755 - DNA, 14 bp, Homo sapiens
gggatggtagtttt

SEQ ID NO: 2435756 - DNA, 18 bp, Homo sapiens
gggatggtggagggccac

SEQ ID NO: 2435757 - DNA, 18 bp, Homo sapiens
gggatgtgtcctgacact

SEQ ID NO: 2435758 - DNA, 22 bp, Homo sapiens
gggatgttcagcactgtccctt

SEQ ID NO: 2435759 - DNA, 16 bp, Homo sapiens
gggattaacctctgca

SEQ ID NO: 2435760 - DNA, 19 bp, Homo sapiens
gggattctggttccagggt

SEQ ID NO: 2435761 - DNA, 14 bp, Homo sapiens
gggcaattgtctga

SEQ ID NO: 2435762 - DNA, 16 bp, Homo sapiens
gggcacaagactgacg

SEQ ID NO: 2435763 - DNA, 14 bp, Homo sapiens
gggcacccccagcc

SEQ ID NO: 2435764 - DNA, 16 bp, Homo sapiens
gggcacccccagcctg

SEQ ID NO: 2435765 - DNA, 21 bp, Homo sapiens
gggcacccccagcctgggcct

SEQ ID NO: 2435766 - DNA, 13 bp, Homo sapiens
gggcagagctggt

SEQ ID NO: 2435767 - DNA, 15 bp, Homo sapiens
gggcagagctggtgc

SEQ ID NO: 2435768 - DNA, 17 bp, Homo sapiens
gggcagagtgagaccca

SEQ ID NO: 2435769 - DNA, 15 bp, Homo sapiens
gggcagcacaggagg

SEQ ID NO: 2435770 - DNA, 14 bp, Homo sapiens
gggcagcagccagc

SEQ ID NO: 2435771 - DNA, 18 bp, Homo sapiens
gggcagcagccagccctg

SEQ ID NO: 2435772 - DNA, 14 bp, Homo sapiens
gggcagccagggag

SEQ ID NO: 2435773 - DNA, 13 bp, Homo sapiens
gggcagccccagg

SEQ ID NO: 2435774 - DNA, 14 bp, Homo sapiens
gggcagctcctctg

SEQ ID NO: 2435775 - DNA, 15 bp, Homo sapiens
gggcaggagtagctg

SEQ ID NO: 2435776 - DNA, 15 bp, Homo sapiens
gggcaggctgggcca

SEQ ID NO: 2435777 - DNA, 14 bp, Homo sapiens
gggcagggtgaccc

SEQ ID NO: 2435778 - DNA, 17 bp, Homo sapiens
gggcagttcgcagccac

SEQ ID NO: 2435779 - DNA, 19 bp, Homo sapiens
gggcagttcgcagccaccc

SEQ ID NO: 2435780 - DNA, 22 bp, Homo sapiens
gggcagttcgcagccaccctga

SEQ ID NO: 2435781 - DNA, 22 bp, Homo sapiens
gggcatgaggggttcctcccct

SEQ ID NO: 2435782 - DNA, 15 bp, Homo sapiens
gggccaaggacctga

SEQ ID NO: 2435783 - DNA, 11 bp, Homo sapiens
gggccagagcc

SEQ ID NO: 2435784 - DNA, 18 bp, Homo sapiens
gggccagatccagcctgg

SEQ ID NO: 2435785 - DNA, 19 bp, Homo sapiens
gggccagatccagcctggg

SEQ ID NO: 2435786 - DNA, 12 bp, Homo sapiens
gggccagcctct

SEQ ID NO: 2435787 - DNA, 22 bp, Homo sapiens
gggccagtctgtggatcagaga

SEQ ID NO: 2435788 - DNA, 17 bp, Homo sapiens
gggccatgctgaggcct

SEQ ID NO: 2435789 - DNA, 14 bp, Homo sapiens
gggccatgtccaaa

SEQ ID NO: 2435790 - DNA, 23 bp, Homo sapiens
gggccatgtccaaagaggctgcc

SEQ ID NO: 2435791 - DNA, 16 bp, Homo sapiens
gggccattctccacag

SEQ ID NO: 2435792 - DNA, 18 bp, Homo sapiens
gggcccacacctccttcc

SEQ ID NO: 2435793 - DNA, 12 bp, Homo sapiens
gggcccagagcc

SEQ ID NO: 2435794 - DNA, 17 bp, Homo sapiens
gggcccctctcagccct

SEQ ID NO: 2435795 - DNA, 21 bp, Homo sapiens
gggcccctctccccagggaag

SEQ ID NO: 2435796 - DNA, 14 bp, Homo sapiens
gggccctgggctgg

SEQ ID NO: 2435797 - DNA, 12 bp, Homo sapiens
gggccctggggc

SEQ ID NO: 2435798 - DNA, 14 bp, Homo sapiens
gggccctggggcct

SEQ ID NO: 2435799 - DNA, 20 bp, Homo sapiens
gggccctggggcctgtactg

SEQ ID NO: 2435800 - DNA, 12 bp, Homo sapiens
gggccgctgcca

SEQ ID NO: 2435801 - DNA, 19 bp, Homo sapiens
gggccggggaactggccaa

SEQ ID NO: 2435802 - DNA, 16 bp, Homo sapiens
gggcctatggagagcc

SEQ ID NO: 2435803 - DNA, 18 bp, Homo sapiens
gggcctatggagagccct

SEQ ID NO: 2435804 - DNA, 19 bp, Homo sapiens
gggcctcaaaggcccgctc

SEQ ID NO: 2435805 - DNA, 20 bp, Homo sapiens
gggcctcaaaggcccgctct

SEQ ID NO: 2435806 - DNA, 13 bp, Homo sapiens
gggcctgccacct

SEQ ID NO: 2435807 - DNA, 13 bp, Homo sapiens
gggcctgctgctg

SEQ ID NO: 2435808 - DNA, 15 bp, Homo sapiens
gggcctgctgctgag

SEQ ID NO: 2435809 - DNA, 20 bp, Homo sapiens
gggcctgctgctgagaacct

SEQ ID NO: 2435810 - DNA, 12 bp, Homo sapiens
gggcctggagat

SEQ ID NO: 2435811 - DNA, 15 bp, Homo sapiens
gggcctggctggctg

SEQ ID NO: 2435812 - DNA, 21 bp, Homo sapiens
gggcctggctggctgagggca

SEQ ID NO: 2435813 - DNA, 23 bp, Homo sapiens
gggcctggctggctgagggcagt

SEQ ID NO: 2435814 - DNA, 18 bp, Homo sapiens
gggccttaggaagagcct

SEQ ID NO: 2435815 - DNA, 20 bp, Homo sapiens
gggcggtcacagcatggagg

SEQ ID NO: 2435816 - DNA, 19 bp, Homo sapiens
gggctaccctgagctgagg

SEQ ID NO: 2435817 - DNA, 18 bp, Homo sapiens
gggctccgtgtgggagac

SEQ ID NO: 2435818 - DNA, 13 bp, Homo sapiens
gggctcctggacc

SEQ ID NO: 2435819 - DNA, 20 bp, Homo sapiens
gggctccttgtgggcctggg

SEQ ID NO: 2435820 - DNA, 22 bp, Homo sapiens
gggctccttgtgggcctgggct

SEQ ID NO: 2435821 - DNA, 23 bp, Homo sapiens
gggctccttgtgggcctgggctc

SEQ ID NO: 2435822 - DNA, 16 bp, Homo sapiens
gggctctaacgcctga

SEQ ID NO: 2435823 - DNA, 23 bp, Homo sapiens
gggctctaacgcctgagcccagg

SEQ ID NO: 2435824 - DNA, 21 bp, Homo sapiens
gggctctgcaattcccctctg

SEQ ID NO: 2435825 - DNA, 23 bp, Homo sapiens
gggctgagctggggacctggtac

SEQ ID NO: 2435826 - DNA, 18 bp, Homo sapiens
gggctgaggagcagcagg

SEQ ID NO: 2435827 - DNA, 13 bp, Homo sapiens
gggctgagggagc

SEQ ID NO: 2435828 - DNA, 19 bp, Homo sapiens
gggctgcagttcgactctg

SEQ ID NO: 2435829 - DNA, 12 bp, Homo sapiens
gggctgcttcct

SEQ ID NO: 2435830 - DNA, 18 bp, Homo sapiens
gggctgcttcctcctgga

SEQ ID NO: 2435831 - DNA, 13 bp, Homo sapiens
gggctggaggagc

SEQ ID NO: 2435832 - DNA, 15 bp, Homo sapiens
gggctggaggcccag

SEQ ID NO: 2435833 - DNA, 22 bp, Homo sapiens
gggctggccgctgtgccaggcg

SEQ ID NO: 2435834 - DNA, 19 bp, Homo sapiens
gggctggtgggtgcctagg

SEQ ID NO: 2435835 - DNA, 18 bp, Homo sapiens
gggctgtaactgccaggc

SEQ ID NO: 2435836 - DNA, 16 bp, Homo sapiens
gggctgtcatctgtgc

SEQ ID NO: 2435837 - DNA, 17 bp, Homo sapiens
gggctgtcatctgtgca

SEQ ID NO: 2435838 - DNA, 13 bp, Homo sapiens
gggcttcccaagg

SEQ ID NO: 2435839 - DNA, 16 bp, Homo sapiens
gggcttcccaagggct

SEQ ID NO: 2435840 - DNA, 15 bp, Homo sapiens
gggcttcctggagca

SEQ ID NO: 2435841 - DNA, 18 bp, Homo sapiens
ggtccacaggtctagact

SEQ ID NO: 2435842 - DNA, 11 bp, Homo sapiens
ggtccagctct

SEQ ID NO: 2435843 - DNA, 15 bp, Homo sapiens
ggtccagctctggag

SEQ ID NO: 2435844 - DNA, 22 bp, Homo sapiens
ggtccagctctggaggggaggg

SEQ ID NO: 2435845 - DNA, 13 bp, Homo sapiens
ggtccatgggcag

SEQ ID NO: 2435846 - DNA, 18 bp, Homo sapiens
ggtccatgggcagagccc

SEQ ID NO: 2435847 - DNA, 14 bp, Homo sapiens
ggtcccacagccac

SEQ ID NO: 2435848 - DNA, 19 bp, Homo sapiens
ggtcccacatccctgggcc

SEQ ID NO: 2435849 - DNA, 14 bp, Homo sapiens
ggtcccagcagctg

SEQ ID NO: 2435850 - DNA, 19 bp, Homo sapiens
ggtcccttgtatcccctgc

SEQ ID NO: 2435851 - DNA, 17 bp, Homo sapiens
ggtccggtgttctaaga

SEQ ID NO: 2435852 - DNA, 13 bp, Homo sapiens
ggtccgtgggacg

SEQ ID NO: 2435853 - DNA, 19 bp, Homo sapiens
ggtcctcctccagggacag

SEQ ID NO: 2435854 - DNA, 15 bp, Homo sapiens
ggtcctgagcactgc

SEQ ID NO: 2435855 - DNA, 21 bp, Homo sapiens
ggtcctgagcactgccaggag

SEQ ID NO: 2435856 - DNA, 16 bp, Homo sapiens
ggtcgaggagtaacaa

SEQ ID NO: 2435857 - DNA, 22 bp, Homo sapiens
ggtcgaggagtaacaatacaaa

SEQ ID NO: 2435858 - DNA, 20 bp, Homo sapiens
ggtcggtaggttcagccaag

SEQ ID NO: 2435859 - DNA, 19 bp, Homo sapiens
ggtcgtggagagctaggag

SEQ ID NO: 2435860 - DNA, 14 bp, Homo sapiens
ggtcgtttttttca

SEQ ID NO: 2435861 - DNA, 16 bp, Homo sapiens
ggtctgagctccagct

SEQ ID NO: 2435862 - DNA, 12 bp, Homo sapiens
ggtctgctccca

SEQ ID NO: 2435863 - DNA, 14 bp, Homo sapiens
ggtctgctcccaag

SEQ ID NO: 2435864 - DNA, 23 bp, Homo sapiens
ggtctgctcccaaggggcctgag

SEQ ID NO: 2435865 - DNA, 19 bp, Homo sapiens
ggtctgctctttctctgcc

SEQ ID NO: 2435866 - DNA, 14 bp, Homo sapiens
ggtctggctggtgt

SEQ ID NO: 2435867 - DNA, 20 bp, Homo sapiens
ggtctgggggcacaagactg

SEQ ID NO: 2435868 - DNA, 14 bp, Homo sapiens
ggtctgtagggatt

SEQ ID NO: 2435869 - DNA, 15 bp, Homo sapiens
ggtctgtaggttgca

SEQ ID NO: 2435870 - DNA, 19 bp, Homo sapiens
ggtctgtaggttgcacact

SEQ ID NO: 2435871 - DNA, 18 bp, Homo sapiens
ggtctgttggcaggctgg

SEQ ID NO: 2435872 - DNA, 17 bp, Homo sapiens
ggtcttggaacttgcct

SEQ ID NO: 2435873 - DNA, 18 bp, Homo sapiens
ggtgaacaaagcagccac

SEQ ID NO: 2435874 - DNA, 21 bp, Homo sapiens
ggtgaaggaggtcaggcccca

SEQ ID NO: 2435875 - DNA, 18 bp, Homo sapiens
ggtgacatcaggtttttc

SEQ ID NO: 2435876 - DNA, 17 bp, Homo sapiens
ggtgacatcggaaaaat

SEQ ID NO: 2435877 - DNA, 18 bp, Homo sapiens
ggtgacatcggaaaaata

SEQ ID NO: 2435878 - DNA, 23 bp, Homo sapiens
ggtgacccggcaccccctgcagc

SEQ ID NO: 2435879 - DNA, 21 bp, Homo sapiens
ggtgactgtctggggagcggg

SEQ ID NO: 2435880 - DNA, 16 bp, Homo sapiens
ggtgaggtcagcacat

SEQ ID NO: 2435881 - DNA, 23 bp, Homo sapiens
ggtgaggtctgttccttttatat

SEQ ID NO: 2435882 - DNA, 13 bp, Homo sapiens
ggtgatgagggca

SEQ ID NO: 2435883 - DNA, 22 bp, Homo sapiens
ggtgatgagggcagcagccagc

SEQ ID NO: 2435884 - DNA, 22 bp, Homo sapiens
ggtgcaatgtgtgtatatggac

SEQ ID NO: 2435885 - DNA, 18 bp, Homo sapiens
ggtgcccaagccagaggc

SEQ ID NO: 2435886 - DNA, 14 bp, Homo sapiens
ggtgcccacaggcc

SEQ ID NO: 2435887 - DNA, 17 bp, Homo sapiens
ggtgccccaggaccagc

SEQ ID NO: 2435888 - DNA, 20 bp, Homo sapiens
ggtgccccaggaccagctca

SEQ ID NO: 2435889 - DNA, 22 bp, Homo sapiens
ggtgccccaggaccagctcagg

SEQ ID NO: 2435890 - DNA, 23 bp, Homo sapiens
ggtgccccaggaccagctcagga

SEQ ID NO: 2435891 - DNA, 16 bp, Homo sapiens
ggtgcctaggcctggg

SEQ ID NO: 2435892 - DNA, 17 bp, Homo sapiens
ggtgcctgtcccacccc

SEQ ID NO: 2435893 - DNA, 17 bp, Homo sapiens
ggtgcctttatttccac

SEQ ID NO: 2435894 - DNA, 22 bp, Homo sapiens
ggtgctacacccttttccagct

SEQ ID NO: 2435895 - DNA, 16 bp, Homo sapiens
ggtgctctctttctgt

SEQ ID NO: 2435896 - DNA, 17 bp, Homo sapiens
ggtgctgacggccaggg

SEQ ID NO: 2435897 - DNA, 20 bp, Homo sapiens
ggtgctgacggccagggaga

SEQ ID NO: 2435898 - DNA, 17 bp, Homo sapiens
ggtgctgcctctacctg

SEQ ID NO: 2435899 - DNA, 16 bp, Homo sapiens
ggtgctggggcctggt

SEQ ID NO: 2435900 - DNA, 15 bp, Homo sapiens
ggtggccctctcccc

SEQ ID NO: 2435901 - DNA, 23 bp, Homo sapiens
ggtggcccttatgactgccaaga

SEQ ID NO: 2435902 - DNA, 16 bp, Homo sapiens
ggtggctgcagcctca

SEQ ID NO: 2435903 - DNA, 14 bp, Homo sapiens
ggtggcttttgcgg

SEQ ID NO: 2435904 - DNA, 17 bp, Homo sapiens
ggtgggtccatgggcag

SEQ ID NO: 2435905 - DNA, 16 bp, Homo sapiens
ggtggtctgttggcag

SEQ ID NO: 2435906 - DNA, 16 bp, Homo sapiens
ggtgtagctacagaga

SEQ ID NO: 2435907 - DNA, 13 bp, Homo sapiens
ggtgtccccaaca

SEQ ID NO: 2435908 - DNA, 20 bp, Homo sapiens
ggtgtccccaacagcgccca

SEQ ID NO: 2435909 - DNA, 16 bp, Homo sapiens
ggtgtcctacagaaaa

SEQ ID NO: 2435910 - DNA, 18 bp, Homo sapiens
ggtgtctcaggctgcctg

SEQ ID NO: 2435911 - DNA, 15 bp, Homo sapiens
ggtgtgatcgtctga

SEQ ID NO: 2435912 - DNA, 17 bp, Homo sapiens
ggtgtggtacagagaag

SEQ ID NO: 2435913 - DNA, 19 bp, Homo sapiens
ggtgtggtacagagaagcc

SEQ ID NO: 2435914 - DNA, 23 bp, Homo sapiens
ggtgtggtacagagaagccagct

SEQ ID NO: 2435915 - DNA, 14 bp, Homo sapiens
ggtgttaatttttg

SEQ ID NO: 2435916 - DNA, 21 bp, Homo sapiens
ggtgttatcaccgtgggctcc

SEQ ID NO: 2435917 - DNA, 14 bp, Homo sapiens
ggttagacctacag

SEQ ID NO: 2435918 - DNA, 23 bp, Homo sapiens
ggttagacctacagggggtctgg

SEQ ID NO: 2435919 - DNA, 23 bp, Homo sapiens
ggttattttgatgtaaagatgtt

SEQ ID NO: 2435920 - DNA, 23 bp, Homo sapiens
ggttcaacaaagaaacaaagatg

SEQ ID NO: 2435921 - DNA, 12 bp, Homo sapiens
ggttcaggcccg

SEQ ID NO: 2435922 - DNA, 13 bp, Homo sapiens
ggttcccaagctc

SEQ ID NO: 2435923 - DNA, 16 bp, Homo sapiens
ggttcccaagctcaga

SEQ ID NO: 2435924 - DNA, 19 bp, Homo sapiens
ggttccgtgtccaccccca

SEQ ID NO: 2435925 - DNA, 11 bp, Homo sapiens
ggttctaaagt

SEQ ID NO: 2435926 - DNA, 12 bp, Homo sapiens
ggttctaaagtt

SEQ ID NO: 2435927 - DNA, 14 bp, Homo sapiens
ggttctaaagttct

SEQ ID NO: 2435928 - DNA, 11 bp, Homo sapiens
ggttctaaggc

SEQ ID NO: 2435929 - DNA, 21 bp, Homo sapiens
ggttctccgttagctcctgtg

SEQ ID NO: 2435930 - DNA, 22 bp, Homo sapiens
ggttcttgaggggaccaggagt

SEQ ID NO: 2435931 - DNA, 22 bp, Homo sapiens
ggttgaactctggtggcacagg

SEQ ID NO: 2435932 - DNA, 16 bp, Homo sapiens
ggttgaccccagagga

SEQ ID NO: 2435933 - DNA, 16 bp, Homo sapiens
ggttgctccgcctggc

SEQ ID NO: 2435934 - DNA, 16 bp, Homo sapiens
ggttggtagggtggga

SEQ ID NO: 2435935 - DNA, 12 bp, Homo sapiens
ggttgtttctgt

SEQ ID NO: 2435936 - DNA, 20 bp, Homo sapiens
ggtttcaaagatgctgtgag

SEQ ID NO: 2435937 - DNA, 19 bp, Homo sapiens
ggtttcaccatgttgccca

SEQ ID NO: 2435938 - DNA, 13 bp, Homo sapiens
ggttttcgagatt

SEQ ID NO: 2435939 - DNA, 20 bp, Homo sapiens
ggttttgccccaagtcctca

SEQ ID NO: 2435940 - DNA, 14 bp, Homo sapiens
ggttttttagttga

SEQ ID NO: 2435941 - DNA, 13 bp, Homo sapiens
ggtttttttcctt

SEQ ID NO: 2435942 - DNA, 22 bp, Homo sapiens
ggttttttttcagttgttcttt

SEQ ID NO: 2435943 - DNA, 18 bp, Homo sapiens
gtaaaacatttattttga

SEQ ID NO: 2435944 - DNA, 12 bp, Homo sapiens
gtaaaagcaaaa

SEQ ID NO: 2435945 - DNA, 21 bp, Homo sapiens
gtagccagcacacagggcagt

SEQ ID NO: 2435946 - DNA, 11 bp, Homo sapiens
gtagccagccg

SEQ ID NO: 2435947 - DNA, 22 bp, Homo sapiens
gtagcctcaatcgagtgagaca

SEQ ID NO: 2435948 - DNA, 17 bp, Homo sapiens
gtagcgtctttcttttt

SEQ ID NO: 2435949 - DNA, 14 bp, Homo sapiens
gtagctacagagaa

SEQ ID NO: 2435950 - DNA, 13 bp, Homo sapiens
gtagctcctcccc

SEQ ID NO: 2435951 - DNA, 12 bp, Homo sapiens
gtagctgagctc

SEQ ID NO: 2435952 - DNA, 13 bp, Homo sapiens
gtagctgagctca

SEQ ID NO: 2435953 - DNA, 12 bp, Homo sapiens
gtagctggggct

SEQ ID NO: 2435954 - DNA, 23 bp, Homo sapiens
gtagctggggctttgatgttcct

SEQ ID NO: 2435955 - DNA, 15 bp, Homo sapiens
gtagctgtgacctgc

SEQ ID NO: 2435956 - DNA, 16 bp, Homo sapiens
gtagctgtgacctgct

SEQ ID NO: 2435957 - DNA, 17 bp, Homo sapiens
gtagctgtgacctgctg

SEQ ID NO: 2435958 - DNA, 19 bp, Homo sapiens
gtagctgtgacctgctgag

SEQ ID NO: 2435959 - DNA, 21 bp, Homo sapiens
gtagctgtgacctgctgagct

SEQ ID NO: 2435960 - DNA, 14 bp, Homo sapiens
gtaggatttttgtt

SEQ ID NO: 2435961 - DNA, 13 bp, Homo sapiens
gtaggcaggattg

SEQ ID NO: 2435962 - DNA, 14 bp, Homo sapiens
gtaggcatttccta

SEQ ID NO: 2435963 - DNA, 13 bp, Homo sapiens
gtaggctacagag

SEQ ID NO: 2435964 - DNA, 21 bp, Homo sapiens
gtaggctacagagaagccttc

SEQ ID NO: 2435965 - DNA, 15 bp, Homo sapiens
gtaggggctgggaac

SEQ ID NO: 2435966 - DNA, 16 bp, Homo sapiens
gtaggggctgggaaca

SEQ ID NO: 2435967 - DNA, 19 bp, Homo sapiens
gtagggggctggaggagcc

SEQ ID NO: 2435968 - DNA, 21 bp, Homo sapiens
gtagggggctggaggagccca

SEQ ID NO: 2435969 - DNA, 22 bp, Homo sapiens
gtagggtaaatcagtaagaggt

SEQ ID NO: 2435970 - DNA, 15 bp, Homo sapiens
gtagtaaataatgct

SEQ ID NO: 2435971 - DNA, 15 bp, Homo sapiens
gtagtaattgacatg

SEQ ID NO: 2435972 - DNA, 20 bp, Homo sapiens
gtagtatggcctgtgtcact

SEQ ID NO: 2435973 - DNA, 12 bp, Homo sapiens
gtagtcctgtga

SEQ ID NO: 2435974 - DNA, 13 bp, Homo sapiens
gtagtgctttgag

SEQ ID NO: 2435975 - DNA, 15 bp, Homo sapiens
gtagttcatgtaaat

SEQ ID NO: 2435976 - DNA, 22 bp, Homo sapiens
gtagttccacttatagcctctg

SEQ ID NO: 2435977 - DNA, 23 bp, Homo sapiens
gtagttccacttatagcctctgt

SEQ ID NO: 2435978 - DNA, 20 bp, Homo sapiens
gtagtttttatatgttgtaa

SEQ ID NO: 2435979 - DNA, 14 bp, Homo sapiens
gtagttttttcatc

SEQ ID NO: 2435980 - DNA, 17 bp, Homo sapiens
gtagttttttcatcttc

SEQ ID NO: 2435981 - DNA, 19 bp, Homo sapiens
gtataaaaataaaaaagat

SEQ ID NO: 2435982 - DNA, 18 bp, Homo sapiens
gtataaaactttcctcgc

SEQ ID NO: 2435983 - DNA, 16 bp, Homo sapiens
gtataaacaagaaaaa

SEQ ID NO: 2435984 - DNA, 18 bp, Homo sapiens
gtataaatgtctttaatg

SEQ ID NO: 2435985 - DNA, 19 bp, Homo sapiens
gtatattgtgtttgtgtat

SEQ ID NO: 2435986 - DNA, 15 bp, Homo sapiens
gtatattttcctata

SEQ ID NO: 2435987 - DNA, 14 bp, Homo sapiens
gtatcaaatacatt

SEQ ID NO: 2435988 - DNA, 20 bp, Homo sapiens
gtatccaggttccctcccag

SEQ ID NO: 2435989 - DNA, 17 bp, Homo sapiens
gtatccccccatcttgc

SEQ ID NO: 2435990 - DNA, 14 bp, Homo sapiens
gtatctcagaaagt

SEQ ID NO: 2435991 - DNA, 24 bp, Homo sapiens
gtatgataggttattttgatgtaa

SEQ ID NO: 2435992 - DNA, 21 bp, Homo sapiens
gtatgattactggcctttttc

SEQ ID NO: 2435993 - DNA, 14 bp, Homo sapiens
gtatggcctgtgtc

SEQ ID NO: 2435994 - DNA, 15 bp, Homo sapiens
gtatggcctgtgtca

SEQ ID NO: 2435995 - DNA, 18 bp, Homo sapiens
gtatggcgtaagtacaga

SEQ ID NO: 2435996 - DNA, 17 bp, Homo sapiens
gtatgtctggttctcaa

SEQ ID NO: 2435997 - DNA, 22 bp, Homo sapiens
gtatgtctggttctcaattcca

SEQ ID NO: 2435998 - DNA, 22 bp, Homo sapiens
gtatgttcaactaggatcagaa

SEQ ID NO: 2435999 - DNA, 19 bp, Homo sapiens
gtatgttctaacctttaca

SEQ ID NO: 2436000 - DNA, 12 bp, Homo sapiens
gtattaagaaag

SEQ ID NO: 2436001 - DNA, 16 bp, Homo sapiens
gtattatttacattta

SEQ ID NO: 2436002 - DNA, 22 bp, Homo sapiens
gtattcatccaagttaaatgta

SEQ ID NO: 2436003 - DNA, 12 bp, Homo sapiens
gtattctctgag

SEQ ID NO: 2436004 - DNA, 13 bp, Homo sapiens
gtattctctgagc

SEQ ID NO: 2436005 - DNA, 16 bp, Homo sapiens
gtattcttctcttcct

SEQ ID NO: 2436006 - DNA, 16 bp, Homo sapiens
gtattgcacattgtaa

SEQ ID NO: 2436007 - DNA, 16 bp, Homo sapiens
gtattgttgaaaaagt

SEQ ID NO: 2436008 - DNA, 19 bp, Homo sapiens
gtatttaacagaaattgta

SEQ ID NO: 2436009 - DNA, 16 bp, Homo sapiens
gtatttacgctttgat

SEQ ID NO: 2436010 - DNA, 17 bp, Homo sapiens
gtatttacgctttgatt

SEQ ID NO: 2436011 - DNA, 13 bp, Homo sapiens
gtatttcaaattg

SEQ ID NO: 2436012 - DNA, 12 bp, Homo sapiens
gtatttgctttt

SEQ ID NO: 2436013 - DNA, 19 bp, Homo sapiens
gtatttggaaataaagtca

SEQ ID NO: 2436014 - DNA, 19 bp, Homo sapiens
gtattttagtgaacttgaa

SEQ ID NO: 2436015 - DNA, 17 bp, Homo sapiens
gtattttatgttatata

SEQ ID NO: 2436016 - DNA, 22 bp, Homo sapiens
gtattttatgttatatataaat

SEQ ID NO: 2436017 - DNA, 13 bp, Homo sapiens
gtattttcaatag

SEQ ID NO: 2436018 - DNA, 13 bp, Homo sapiens
gtcaacagtaaac

SEQ ID NO: 2436019 - DNA, 14 bp, Homo sapiens
gtcaacagttttcc

SEQ ID NO: 2436020 - DNA, 21 bp, Homo sapiens
gtcaacagttttcctatgctt

SEQ ID NO: 2436021 - DNA, 14 bp, Homo sapiens
gtcaacctgggcaa

SEQ ID NO: 2436022 - DNA, 20 bp, Homo sapiens
gtcaacttgagcatgttact

SEQ ID NO: 2436023 - DNA, 19 bp, Homo sapiens
gtcaagagtgaattccctc

SEQ ID NO: 2436024 - DNA, 18 bp, Homo sapiens
gtcaagttattaatttct

SEQ ID NO: 2436025 - DNA, 18 bp, Homo sapiens
gtcaatcaagtctgttta

SEQ ID NO: 2436026 - DNA, 14 bp, Homo sapiens
gtcaatgcagttgt

SEQ ID NO: 2436027 - DNA, 22 bp, Homo sapiens
gtcaatgcagttgtctctgttt

SEQ ID NO: 2436028 - DNA, 12 bp, Homo sapiens
gtcaattgtacg

SEQ ID NO: 2436029 - DNA, 17 bp, Homo sapiens
gtcaatttctgtgttgc

SEQ ID NO: 2436030 - DNA, 20 bp, Homo sapiens
gtcacacagtgttggaggtt

SEQ ID NO: 2436031 - DNA, 15 bp, Homo sapiens
gtcacaggaaaaagt

SEQ ID NO: 2436032 - DNA, 11 bp, Homo sapiens
gtcacagggca

SEQ ID NO: 2436033 - DNA, 13 bp, Homo sapiens
gtcacagggcagt

SEQ ID NO: 2436034 - DNA, 23 bp, Homo sapiens
gtcacagggcagtacctgagggt

SEQ ID NO: 2436035 - DNA, 17 bp, Homo sapiens
gtcaccaccctgctcat

SEQ ID NO: 2436036 - DNA, 20 bp, Homo sapiens
gtcacccaggctggagtgca

SEQ ID NO: 2436037 - DNA, 19 bp, Homo sapiens
gtcacctaggaagcctcag

SEQ ID NO: 2436038 - DNA, 20 bp, Homo sapiens
gtcacggctgcgcactgtgt

SEQ ID NO: 2436039 - DNA, 22 bp, Homo sapiens
gtcactaaagcaggccttttga

SEQ ID NO: 2436040 - DNA, 18 bp, Homo sapiens
gtcacttaggtagtacca

SEQ ID NO: 2436041 - DNA, 18 bp, Homo sapiens
gtcactttttgaggcaaa

SEQ ID NO: 2436042 - DNA, 17 bp, Homo sapiens
gtcagacgcctgaggaa

SEQ ID NO: 2436043 - DNA, 17 bp, Homo sapiens
gtcagatccaggagctc

SEQ ID NO: 2436044 - DNA, 13 bp, Homo sapiens
gtcagccctaggg

SEQ ID NO: 2436045 - DNA, 18 bp, Homo sapiens
gtcaggattgcgagagat

SEQ ID NO: 2436046 - DNA, 22 bp, Homo sapiens
gtcaggattgcgagagatgtgt

SEQ ID NO: 2436047 - DNA, 23 bp, Homo sapiens
gtcagtgctgtgctgtgctatgg

SEQ ID NO: 2436048 - DNA, 12 bp, Homo sapiens
gtcatacagaga

SEQ ID NO: 2436049 - DNA, 15 bp, Homo sapiens
gtctcaaactcctga

SEQ ID NO: 2436050 - DNA, 16 bp, Homo sapiens
gtctcaaactcctggg

SEQ ID NO: 2436051 - DNA, 20 bp, Homo sapiens
gtctcaaactcctgggctca

SEQ ID NO: 2436052 - DNA, 15 bp, Homo sapiens
gtctcaccctggagg

SEQ ID NO: 2436053 - DNA, 20 bp, Homo sapiens
gtctcaccctggaggcacct

SEQ ID NO: 2436054 - DNA, 19 bp, Homo sapiens
gtctcacctggacttaagc

SEQ ID NO: 2436055 - DNA, 18 bp, Homo sapiens
gtctcagtttgtgtgtct

SEQ ID NO: 2436056 - DNA, 15 bp, Homo sapiens
gtctcatccatcatc

SEQ ID NO: 2436057 - DNA, 16 bp, Homo sapiens
gtctcatccatcatca

SEQ ID NO: 2436058 - DNA, 12 bp, Homo sapiens
gtctcatctctt

SEQ ID NO: 2436059 - DNA, 14 bp, Homo sapiens
gtctcatctcttca

SEQ ID NO: 2436060 - DNA, 15 bp, Homo sapiens
gtctcatctcttcag

SEQ ID NO: 2436061 - DNA, 19 bp, Homo sapiens
gtctcatctcttcaggttc

SEQ ID NO: 2436062 - DNA, 23 bp, Homo sapiens
gtctcatgccagtaacaggctca

SEQ ID NO: 2436063 - DNA, 20 bp, Homo sapiens
gtctccagaaagccccaccc

SEQ ID NO: 2436064 - DNA, 19 bp, Homo sapiens
gtctccaggggctgcttcc

SEQ ID NO: 2436065 - DNA, 17 bp, Homo sapiens
gtctcctaagcacctgt

SEQ ID NO: 2436066 - DNA, 13 bp, Homo sapiens
gtctcgagcgccc

SEQ ID NO: 2436067 - DNA, 14 bp, Homo sapiens
gtctctcttctctc

SEQ ID NO: 2436068 - DNA, 19 bp, Homo sapiens
gtctctcttctctccagct

SEQ ID NO: 2436069 - DNA, 15 bp, Homo sapiens
gtctctgatgcagct

SEQ ID NO: 2436070 - DNA, 15 bp, Homo sapiens
gtctcttatggatgt

SEQ ID NO: 2436071 - DNA, 19 bp, Homo sapiens
gtctcttgcctgccactgt

SEQ ID NO: 2436072 - DNA, 20 bp, Homo sapiens
gtctcttgcctgccactgtg

SEQ ID NO: 2436073 - DNA, 14 bp, Homo sapiens
gtctcttttaccct

SEQ ID NO: 2436074 - DNA, 20 bp, Homo sapiens
gtctcttttaccctggcccc

SEQ ID NO: 2436075 - DNA, 13 bp, Homo sapiens
gtctgaaattttt

SEQ ID NO: 2436076 - DNA, 15 bp, Homo sapiens
gtctgaacagctgta

SEQ ID NO: 2436077 - DNA, 17 bp, Homo sapiens
gtctgaggtcctgagca

SEQ ID NO: 2436078 - DNA, 17 bp, Homo sapiens
gtctgccctctgcatcc

SEQ ID NO: 2436079 - DNA, 21 bp, Homo sapiens
gtctgccctctgcatcctctg

SEQ ID NO: 2436080 - DNA, 12 bp, Homo sapiens
gtctgctcccaa

SEQ ID NO: 2436081 - DNA, 19 bp, Homo sapiens
gtctgctcccaaggggcct

SEQ ID NO: 2436082 - DNA, 17 bp, Homo sapiens
gtctgctctttctctgc

SEQ ID NO: 2436083 - DNA, 16 bp, Homo sapiens
gtctggataacttcca

SEQ ID NO: 2436084 - DNA, 20 bp, Homo sapiens
gtctggataacttccacagg

SEQ ID NO: 2436085 - DNA, 15 bp, Homo sapiens
gtctggcaatgccac

SEQ ID NO: 2436086 - DNA, 16 bp, Homo sapiens
gtctggcaatgccaca

SEQ ID NO: 2436087 - DNA, 17 bp, Homo sapiens
gtctggcccccctggtc

SEQ ID NO: 2436088 - DNA, 13 bp, Homo sapiens
gtctggctggtgt

SEQ ID NO: 2436089 - DNA, 15 bp, Homo sapiens
gtctggctggtgtta

SEQ ID NO: 2436090 - DNA, 22 bp, Homo sapiens
gtctggggagcgggtctgctcc

SEQ ID NO: 2436091 - DNA, 14 bp, Homo sapiens
gtctgggggcacaa

SEQ ID NO: 2436092 - DNA, 16 bp, Homo sapiens
gtctgtaggttgcaca

SEQ ID NO: 2436093 - DNA, 13 bp, Homo sapiens
gtctgttgattaa

SEQ ID NO: 2436094 - DNA, 22 bp, Homo sapiens
gtctgttggcaggctggccagt

SEQ ID NO: 2436095 - DNA, 15 bp, Homo sapiens
gtcttccatttgcaa

SEQ ID NO: 2436096 - DNA, 19 bp, Homo sapiens
gtcttcctgagtggtgcca

SEQ ID NO: 2436097 - DNA, 23 bp, Homo sapiens
gtcttctaaacttccccatcttc

SEQ ID NO: 2436098 - DNA, 20 bp, Homo sapiens
gtcttcttacttggaactga

SEQ ID NO: 2436099 - DNA, 16 bp, Homo sapiens
gtcttggaacttgcct

SEQ ID NO: 2436100 - DNA, 20 bp, Homo sapiens
gtcttgggcagagctggctc

SEQ ID NO: 2436101 - DNA, 22 bp, Homo sapiens
gtcttgggcagagctggctctg

SEQ ID NO: 2436102 - DNA, 23 bp, Homo sapiens
gtcttgtgtttccacagcctgca

SEQ ID NO: 2436103 - DNA, 20 bp, Homo sapiens
gtctttcccatggggaggga

SEQ ID NO: 2436104 - DNA, 16 bp, Homo sapiens
gtctttcctggcacta

SEQ ID NO: 2436105 - DNA, 14 bp, Homo sapiens
gtctttctctttcc

SEQ ID NO: 2436106 - DNA, 16 bp, Homo sapiens
gtctttctctttccct

SEQ ID NO: 2436107 - DNA, 18 bp, Homo sapiens
gtctttggagaaatgctt

SEQ ID NO: 2436108 - DNA, 19 bp, Homo sapiens
gtctttgttaagactgctg

SEQ ID NO: 2436109 - DNA, 16 bp, Homo sapiens
gtcttttcccatttat

SEQ ID NO: 2436110 - DNA, 13 bp, Homo sapiens
gtcttttgctttt

SEQ ID NO: 2436111 - DNA, 12 bp, Homo sapiens
gtcttttggagg

SEQ ID NO: 2436112 - DNA, 14 bp, Homo sapiens
gtcttttggaggac

SEQ ID NO: 2436113 - DNA, 16 bp, Homo sapiens
gtctttttagatgccc

SEQ ID NO: 2436114 - DNA, 16 bp, Homo sapiens
gtctttttttgtatag

SEQ ID NO: 2436115 - DNA, 17 bp, Homo sapiens
gtctttttttgtatagt

SEQ ID NO: 2436116 - DNA, 17 bp, Homo sapiens
gtgaaaatggtccagga

SEQ ID NO: 2436117 - DNA, 17 bp, Homo sapiens
gtgaacaaagcagccac

SEQ ID NO: 2436118 - DNA, 15 bp, Homo sapiens
gtgaacccaggacaa

SEQ ID NO: 2436119 - DNA, 17 bp, Homo sapiens
gtgaacccaggacaagc

SEQ ID NO: 2436120 - DNA, 12 bp, Homo sapiens
gtgaaggaccct

SEQ ID NO: 2436121 - DNA, 22 bp, Homo sapiens
gtgaaggcttctctctgtggga

SEQ ID NO: 2436122 - DNA, 19 bp, Homo sapiens
gtgaatagccatatttgta

SEQ ID NO: 2436123 - DNA, 23 bp, Homo sapiens
gtgaatagccatatttgtaaaat

SEQ ID NO: 2436124 - DNA, 17 bp, Homo sapiens
gtgaatcaagggtcagg

SEQ ID NO: 2436125 - DNA, 13 bp, Homo sapiens
gtgaatgctggga

SEQ ID NO: 2436126 - DNA, 18 bp, Homo sapiens
gtgaattaggctgtaact

SEQ ID NO: 2436127 - DNA, 13 bp, Homo sapiens
gtgaattccctca

SEQ ID NO: 2436128 - DNA, 14 bp, Homo sapiens
gtgacacaaacaca

SEQ ID NO: 2436129 - DNA, 14 bp, Homo sapiens
gtgacatccaggag

SEQ ID NO: 2436130 - DNA, 16 bp, Homo sapiens
gtgaccaatgtcttga

SEQ ID NO: 2436131 - DNA, 17 bp, Homo sapiens
gtgaccaggcatcctcc

SEQ ID NO: 2436132 - DNA, 15 bp, Homo sapiens
gtgaccccagggcac

SEQ ID NO: 2436133 - DNA, 22 bp, Homo sapiens
gtgaccccagggcacaggagct

SEQ ID NO: 2436134 - DNA, 16 bp, Homo sapiens
gtgacccccagctccg

SEQ ID NO: 2436135 - DNA, 17 bp, Homo sapiens
gtgacccccagctccgg

SEQ ID NO: 2436136 - DNA, 22 bp, Homo sapiens
gtgacccggcaccccctgcagc

SEQ ID NO: 2436137 - DNA, 16 bp, Homo sapiens
gtgaccctggctcctt

SEQ ID NO: 2436138 - DNA, 19 bp, Homo sapiens
gtgaccggacttttctgca

SEQ ID NO: 2436139 - DNA, 14 bp, Homo sapiens
gtgacctgctgagc

SEQ ID NO: 2436140 - DNA, 15 bp, Homo sapiens
gtgacctgctgagct

SEQ ID NO: 2436141 - DNA, 16 bp, Homo sapiens
gtgacgtctgggtggc

SEQ ID NO: 2436142 - DNA, 19 bp, Homo sapiens
gtgacgtctgggtggccct

SEQ ID NO: 2436143 - DNA, 21 bp, Homo sapiens
gtgacgtctgggtggccctta

SEQ ID NO: 2436144 - DNA, 23 bp, Homo sapiens
gtgactaactagacaccaaagtt

SEQ ID NO: 2436145 - DNA, 16 bp, Homo sapiens
gtgactgtctggggag

SEQ ID NO: 2436146 - DNA, 13 bp, Homo sapiens
gtgacttctgaga

SEQ ID NO: 2436147 - DNA, 17 bp, Homo sapiens
gtgacttgtgtcccatg

SEQ ID NO: 2436148 - DNA, 20 bp, Homo sapiens
gtgagacccagccctcatcc

SEQ ID NO: 2436149 - DNA, 14 bp, Homo sapiens
gtgagcacagccta

SEQ ID NO: 2436150 - DNA, 13 bp, Homo sapiens
gtgagctgagcag

SEQ ID NO: 2436151 - DNA, 16 bp, Homo sapiens
gtgagctgagcaggcc

SEQ ID NO: 2436152 - DNA, 13 bp, Homo sapiens
gtgaggagctggg

SEQ ID NO: 2436153 - DNA, 14 bp, Homo sapiens
gtgaggctgtcctg

SEQ ID NO: 2436154 - DNA, 12 bp, Homo sapiens
gtggagggccac

SEQ ID NO: 2436155 - DNA, 17 bp, Homo sapiens
gtggagtctgccaccca

SEQ ID NO: 2436156 - DNA, 16 bp, Homo sapiens
gtggatatttgtataa

SEQ ID NO: 2436157 - DNA, 23 bp, Homo sapiens
gtggatcacaaagtggaacgaaa

SEQ ID NO: 2436158 - DNA, 21 bp, Homo sapiens
gtggatcagagatgcaccacc

SEQ ID NO: 2436159 - DNA, 15 bp, Homo sapiens
gtggatggccccagc

SEQ ID NO: 2436160 - DNA, 22 bp, Homo sapiens
gtggcactcagtctctcttctc

SEQ ID NO: 2436161 - DNA, 15 bp, Homo sapiens
gtggcagcccagcca

SEQ ID NO: 2436162 - DNA, 24 bp, Homo sapiens
gtggcaggcagaggcccaggctgc

SEQ ID NO: 2436163 - DNA, 23 bp, Homo sapiens
gtggccaagaagcagtggcctta

SEQ ID NO: 2436164 - DNA, 13 bp, Homo sapiens
gtggccaccagta

SEQ ID NO: 2436165 - DNA, 12 bp, Homo sapiens
gtggccaggagg

SEQ ID NO: 2436166 - DNA, 18 bp, Homo sapiens
gtggccatgaccctgcct

SEQ ID NO: 2436167 - DNA, 21 bp, Homo sapiens
gtggccatgaccctgcctctc

SEQ ID NO: 2436168 - DNA, 15 bp, Homo sapiens
gtggccccaccctgg

SEQ ID NO: 2436169 - DNA, 21 bp, Homo sapiens
gtggccccaccctgggccctg

SEQ ID NO: 2436170 - DNA, 16 bp, Homo sapiens
gtggccccgtttctgg

SEQ ID NO: 2436171 - DNA, 17 bp, Homo sapiens
gtggccctctcccctgc

SEQ ID NO: 2436172 - DNA, 19 bp, Homo sapiens
gtggccctctcccctgccc

SEQ ID NO: 2436173 - DNA, 20 bp, Homo sapiens
gtggcccttatgactgccaa

SEQ ID NO: 2436174 - DNA, 14 bp, Homo sapiens
gtggcccttcctgg

SEQ ID NO: 2436175 - DNA, 17 bp, Homo sapiens
gtggcccttcctggaca

SEQ ID NO: 2436176 - DNA, 17 bp, Homo sapiens
gtggcctttgcgctcct

SEQ ID NO: 2436177 - DNA, 21 bp, Homo sapiens
gtggcgccgtctccaggggct

SEQ ID NO: 2436178 - DNA, 16 bp, Homo sapiens
gtggcgtttgtaatga

SEQ ID NO: 2436179 - DNA, 18 bp, Homo sapiens
gtggctactctgtgccag

SEQ ID NO: 2436180 - DNA, 22 bp, Homo sapiens
gtggctcactcagcacttggcc

SEQ ID NO: 2436181 - DNA, 15 bp, Homo sapiens
gtggctcagccagca

SEQ ID NO: 2436182 - DNA, 13 bp, Homo sapiens
gtggctccttccc

SEQ ID NO: 2436183 - DNA, 21 bp, Homo sapiens
gtggctctgaggtgcctgtcc

SEQ ID NO: 2436184 - DNA, 20 bp, Homo sapiens
gtggctggaagatcctgcgg

SEQ ID NO: 2436185 - DNA, 17 bp, Homo sapiens
gtggctggtccagggct

SEQ ID NO: 2436186 - DNA, 19 bp, Homo sapiens
gtgggacggtgcccaagcc

SEQ ID NO: 2436187 - DNA, 16 bp, Homo sapiens
gtgggccagtctgtgg

SEQ ID NO: 2436188 - DNA, 17 bp, Homo sapiens
gtgggccagtctgtgga

SEQ ID NO: 2436189 - DNA, 17 bp, Homo sapiens
gtgggctggccgctgtg

SEQ ID NO: 2436190 - DNA, 19 bp, Homo sapiens
gtgggctggccgctgtgcc

SEQ ID NO: 2436191 - DNA, 17 bp, Homo sapiens
gtggggagactgggctg

SEQ ID NO: 2436192 - DNA, 19 bp, Homo sapiens
gtggggataggccagccgc

SEQ ID NO: 2436193 - DNA, 17 bp, Homo sapiens
gtggggcagctcctctg

SEQ ID NO: 2436194 - DNA, 12 bp, Homo sapiens
gtggggcctggg

SEQ ID NO: 2436195 - DNA, 18 bp, Homo sapiens
gtggggtggctgcagcct

SEQ ID NO: 2436196 - DNA, 20 bp, Homo sapiens
gtgggtccatgggcagagcc

SEQ ID NO: 2436197 - DNA, 21 bp, Homo sapiens
gtggtaagcaacatggctttg

SEQ ID NO: 2436198 - DNA, 13 bp, Homo sapiens
gtggtacagagaa

SEQ ID NO: 2436199 - DNA, 23 bp, Homo sapiens
gtggtacagagaagccagcttgt

SEQ ID NO: 2436200 - DNA, 14 bp, Homo sapiens
gtggtattttcaat

SEQ ID NO: 2436201 - DNA, 22 bp, Homo sapiens
gtggtcacagcggaggtgtgga

SEQ ID NO: 2436202 - DNA, 22 bp, Homo sapiens
gtggtccacaagcttctgtcct

SEQ ID NO: 2436203 - DNA, 13 bp, Homo sapiens
gtggtctgttggc

SEQ ID NO: 2436204 - DNA, 20 bp, Homo sapiens
gtggtctgttggcaggctgg

SEQ ID NO: 2436205 - DNA, 22 bp, Homo sapiens
gtggtctgttggcaggctggcc

SEQ ID NO: 2436206 - DNA, 22 bp, Homo sapiens
gtggtggaaacttttcttaaaa

SEQ ID NO: 2436207 - DNA, 18 bp, Homo sapiens
gtggtttaggctatttgt

SEQ ID NO: 2436208 - DNA, 14 bp, Homo sapiens
gtggtttcatgtta

SEQ ID NO: 2436209 - DNA, 20 bp, Homo sapiens
gtgtaccgcgtctaccctgg

SEQ ID NO: 2436210 - DNA, 22 bp, Homo sapiens
gtgtaccgcgtctaccctggga

SEQ ID NO: 2436211 - DNA, 11 bp, Homo sapiens
gtgtagccttt

SEQ ID NO: 2436212 - DNA, 12 bp, Homo sapiens
gtgtagcctttt

SEQ ID NO: 2436213 - DNA, 17 bp, Homo sapiens
gtgtagctacagagaaa

SEQ ID NO: 2436214 - DNA, 18 bp, Homo sapiens
gtgtagctacagagaaac

SEQ ID NO: 2436215 - DNA, 21 bp, Homo sapiens
gtgtagctgtgacctgctgag

SEQ ID NO: 2436216 - DNA, 14 bp, Homo sapiens
gtgtataaaaataa

SEQ ID NO: 2436217 - DNA, 12 bp, Homo sapiens
gtgtataaacaa

SEQ ID NO: 2436218 - DNA, 19 bp, Homo sapiens
gtgtataaacaagaaaaat

SEQ ID NO: 2436219 - DNA, 17 bp, Homo sapiens
gtgtatgcacatgaact

SEQ ID NO: 2436220 - DNA, 21 bp, Homo sapiens
gtgtatttacgctttgattca

SEQ ID NO: 2436221 - DNA, 15 bp, Homo sapiens
gtgtcacggccaggc

SEQ ID NO: 2436222 - DNA, 20 bp, Homo sapiens
gtgtccaaaaccgccagctc

SEQ ID NO: 2436223 - DNA, 22 bp, Homo sapiens
gtgtccaaaaccgccagctctg

SEQ ID NO: 2436224 - DNA, 11 bp, Homo sapiens
gtgtccacccc

SEQ ID NO: 2436225 - DNA, 12 bp, Homo sapiens
gtgtccaccccc

SEQ ID NO: 2436226 - DNA, 21 bp, Homo sapiens
gtgtccatgcgctcagggcca

SEQ ID NO: 2436227 - DNA, 19 bp, Homo sapiens
gtgtccccaacagcgccca

SEQ ID NO: 2436228 - DNA, 14 bp, Homo sapiens
gtgtccccctctgt

SEQ ID NO: 2436229 - DNA, 14 bp, Homo sapiens
gtgtccctaatgtg

SEQ ID NO: 2436230 - DNA, 13 bp, Homo sapiens
gtgtcctacagaa

SEQ ID NO: 2436231 - DNA, 14 bp, Homo sapiens
gtgtcctacagaaa

SEQ ID NO: 2436232 - DNA, 13 bp, Homo sapiens
gtgtcctgagctc

SEQ ID NO: 2436233 - DNA, 18 bp, Homo sapiens
gtgtctaagattctagat

SEQ ID NO: 2436234 - DNA, 15 bp, Homo sapiens
gtgtctcaggctgcc

SEQ ID NO: 2436235 - DNA, 16 bp, Homo sapiens
gtgtctcaggctgcct

SEQ ID NO: 2436236 - DNA, 20 bp, Homo sapiens
gtgtctcaggctgcctgagt

SEQ ID NO: 2436237 - DNA, 23 bp, Homo sapiens
gtgtcttgggcagagctggctct

SEQ ID NO: 2436238 - DNA, 17 bp, Homo sapiens
gtgtgcaaggcagccgt

SEQ ID NO: 2436239 - DNA, 19 bp, Homo sapiens
gtgtgcacgcgtgtgcagg

SEQ ID NO: 2436240 - DNA, 22 bp, Homo sapiens
gtgtgccctctgggctctgagt

SEQ ID NO: 2436241 - DNA, 22 bp, Homo sapiens
gtgtgctctccattctgctcct

SEQ ID NO: 2436242 - DNA, 16 bp, Homo sapiens
gtgtgctttttttgtg

SEQ ID NO: 2436243 - DNA, 14 bp, Homo sapiens
gtgtggctccttcc

SEQ ID NO: 2436244 - DNA, 15 bp, Homo sapiens
gtgtggtacagagaa

SEQ ID NO: 2436245 - DNA, 16 bp, Homo sapiens
gtgtggtacagagaag

SEQ ID NO: 2436246 - DNA, 19 bp, Homo sapiens
gtgtggtacagagaagcca

SEQ ID NO: 2436247 - DNA, 20 bp, Homo sapiens
gtgtggtacagagaagccag

SEQ ID NO: 2436248 - DNA, 19 bp, Homo sapiens
gtgtgtccaaaactgcctc

SEQ ID NO: 2436249 - DNA, 16 bp, Homo sapiens
gtgtgtccccctctgt

SEQ ID NO: 2436250 - DNA, 17 bp, Homo sapiens
gtgtgtccccctctgtc

SEQ ID NO: 2436251 - DNA, 17 bp, Homo sapiens
gtgtgtgaatgaacact

SEQ ID NO: 2436252 - DNA, 17 bp, Homo sapiens
gtgtgtgccctctgggc

SEQ ID NO: 2436253 - DNA, 19 bp, Homo sapiens
gtgtgtgccctctgggctc

SEQ ID NO: 2436254 - DNA, 21 bp, Homo sapiens
gtgtgtgccctctgggctctg

SEQ ID NO: 2436255 - DNA, 12 bp, Homo sapiens
gtgtgtgtgtgt

SEQ ID NO: 2436256 - DNA, 14 bp, Homo sapiens
gtgtgtgtgtgtgt

SEQ ID NO: 2436257 - DNA, 14 bp, Homo sapiens
gtgtgttgatactg

SEQ ID NO: 2436258 - DNA, 17 bp, Homo sapiens
gttctaagattctaatg

SEQ ID NO: 2436259 - DNA, 21 bp, Homo sapiens
gttctaaggcctaggattcta

SEQ ID NO: 2436260 - DNA, 19 bp, Homo sapiens
gttctaagtctttccattg

SEQ ID NO: 2436261 - DNA, 14 bp, Homo sapiens
gttctaagtttcta

SEQ ID NO: 2436262 - DNA, 22 bp, Homo sapiens
gttctaagtttctaagattcta

SEQ ID NO: 2436263 - DNA, 21 bp, Homo sapiens
gttctagaaaaacaggcactt

SEQ ID NO: 2436264 - DNA, 21 bp, Homo sapiens
gttctagacatggaggttcta

SEQ ID NO: 2436265 - DNA, 12 bp, Homo sapiens
gttctaggaaaa

SEQ ID NO: 2436266 - DNA, 22 bp, Homo sapiens
gttctaggcactgtagttctaa

SEQ ID NO: 2436267 - DNA, 23 bp, Homo sapiens
gttctaggcactgtagttctaag

SEQ ID NO: 2436268 - DNA, 16 bp, Homo sapiens
gttctaggtttcaaag

SEQ ID NO: 2436269 - DNA, 22 bp, Homo sapiens
gttctaggtttcaaagatgctg

SEQ ID NO: 2436270 - DNA, 14 bp, Homo sapiens
gttctagtttttta

SEQ ID NO: 2436271 - DNA, 14 bp, Homo sapiens
gttctcaattccaa

SEQ ID NO: 2436272 - DNA, 18 bp, Homo sapiens
gttctccgttagctcctg

SEQ ID NO: 2436273 - DNA, 21 bp, Homo sapiens
gttctccgttagctcctgtgg

SEQ ID NO: 2436274 - DNA, 23 bp, Homo sapiens
gttctccgttagctcctgtggcc

SEQ ID NO: 2436275 - DNA, 22 bp, Homo sapiens
gttctgcctgccagctgcactg

SEQ ID NO: 2436276 - DNA, 16 bp, Homo sapiens
gttctgctccagacag

SEQ ID NO: 2436277 - DNA, 17 bp, Homo sapiens
gttctgctccagacagg

SEQ ID NO: 2436278 - DNA, 17 bp, Homo sapiens
gttctggtcctttttgg

SEQ ID NO: 2436279 - DNA, 18 bp, Homo sapiens
gttctgtcccttgccccc

SEQ ID NO: 2436280 - DNA, 18 bp, Homo sapiens
gttctgttaactgaatac

SEQ ID NO: 2436281 - DNA, 19 bp, Homo sapiens
gttctgttaactgaatacc

SEQ ID NO: 2436282 - DNA, 16 bp, Homo sapiens
gttcttcctcagccag

SEQ ID NO: 2436283 - DNA, 17 bp, Homo sapiens
gttcttcctcagccagc

SEQ ID NO: 2436284 - DNA, 23 bp, Homo sapiens
gttcttgaggggaccaggagtgg

SEQ ID NO: 2436285 - DNA, 13 bp, Homo sapiens
gttcttgtaattt

SEQ ID NO: 2436286 - DNA, 15 bp, Homo sapiens
gttcttgttggtgca

SEQ ID NO: 2436287 - DNA, 16 bp, Homo sapiens
gttctttgggccagac

SEQ ID NO: 2436288 - DNA, 17 bp, Homo sapiens
gttctttgggccagaca

SEQ ID NO: 2436289 - DNA, 14 bp, Homo sapiens
gttgaaaggttttt

SEQ ID NO: 2436290 - DNA, 20 bp, Homo sapiens
gttgaaaggttttttttcag

SEQ ID NO: 2436291 - DNA, 16 bp, Homo sapiens
gttgaaatatgatgtt

SEQ ID NO: 2436292 - DNA, 13 bp, Homo sapiens
gttgaatactttt

SEQ ID NO: 2436293 - DNA, 20 bp, Homo sapiens
gttgaattttttttaacatt

SEQ ID NO: 2436294 - DNA, 17 bp, Homo sapiens
gttgacattctgaatgc

SEQ ID NO: 2436295 - DNA, 18 bp, Homo sapiens
gttgacattctgaatgct

SEQ ID NO: 2436296 - DNA, 16 bp, Homo sapiens
gttgagcatctgtccc

SEQ ID NO: 2436297 - DNA, 15 bp, Homo sapiens
gttgagcccctggag

SEQ ID NO: 2436298 - DNA, 19 bp, Homo sapiens
gttgaggccactgtgttcc

SEQ ID NO: 2436299 - DNA, 12 bp, Homo sapiens
gttgatactgtt

SEQ ID NO: 2436300 - DNA, 19 bp, Homo sapiens
gttgatactgttgcacgtg

SEQ ID NO: 2436301 - DNA, 23 bp, Homo sapiens
gttgattcggtatccccccatct

SEQ ID NO: 2436302 - DNA, 20 bp, Homo sapiens
gttgcagctgttttgttgac

SEQ ID NO: 2436303 - DNA, 23 bp, Homo sapiens
gttgcagctgttttgttgacatt

SEQ ID NO: 2436304 - DNA, 23 bp, Homo sapiens
gttgcatttgttttgtttacaga

SEQ ID NO: 2436305 - DNA, 19 bp, Homo sapiens
gttgccaaatatgtcctgg

SEQ ID NO: 2436306 - DNA, 21 bp, Homo sapiens
gttgccaaatatgtcctgggg

SEQ ID NO: 2436307 - DNA, 15 bp, Homo sapiens
gttgccaagctccaa

SEQ ID NO: 2436308 - DNA, 23 bp, Homo sapiens
gttgccatcctaccgtcttttcc

SEQ ID NO: 2436309 - DNA, 22 bp, Homo sapiens
gttgctccgcctggcctggcca

SEQ ID NO: 2436310 - DNA, 22 bp, Homo sapiens
gttggaatggatttttctttaa

SEQ ID NO: 2436311 - DNA, 21 bp, Homo sapiens
gttggacacctttaggttctt

SEQ ID NO: 2436312 - DNA, 15 bp, Homo sapiens
gttggagctcattct

SEQ ID NO: 2436313 - DNA, 13 bp, Homo sapiens
gttggagctccag

SEQ ID NO: 2436314 - DNA, 22 bp, Homo sapiens
gttggccatatttacctcagcc

SEQ ID NO: 2436315 - DNA, 18 bp, Homo sapiens
gttggcgtaggctacaga

SEQ ID NO: 2436316 - DNA, 23 bp, Homo sapiens
gttggcgtaggctacagagaagc

SEQ ID NO: 2436317 - DNA, 18 bp, Homo sapiens
gttggggaagggcctgcc

SEQ ID NO: 2436318 - DNA, 16 bp, Homo sapiens
gttggtcggtgggttg

SEQ ID NO: 2436319 - DNA, 12 bp, Homo sapiens
gttggttttctt

SEQ ID NO: 2436320 - DNA, 22 bp, Homo sapiens
gttgtaaattggcatggaaatt

SEQ ID NO: 2436321 - DNA, 14 bp, Homo sapiens
gttgtaacctgctg

SEQ ID NO: 2436322 - DNA, 18 bp, Homo sapiens
gttgtactttggaattct

SEQ ID NO: 2436323 - DNA, 17 bp, Homo sapiens
gttgtcaagtctctgct

SEQ ID NO: 2436324 - DNA, 22 bp, Homo sapiens
gttgtcaagtctctgctggccc

SEQ ID NO: 2436325 - DNA, 14 bp, Homo sapiens
gttgtccttttcat

SEQ ID NO: 2436326 - DNA, 15 bp, Homo sapiens
gttgtccttttcata

SEQ ID NO: 2436327 - DNA, 18 bp, Homo sapiens
gttgtctaagaaattgaa

SEQ ID NO: 2436328 - DNA, 21 bp, Homo sapiens
gttgtctaagaaattgaatac

SEQ ID NO: 2436329 - DNA, 20 bp, Homo sapiens
gttgtctctgatgcagctta

SEQ ID NO: 2436330 - DNA, 13 bp, Homo sapiens
gttgtctctgttt

SEQ ID NO: 2436331 - DNA, 14 bp, Homo sapiens
gttgtctggcaagg

SEQ ID NO: 2436332 - DNA, 16 bp, Homo sapiens
gttgtctggcaaggac

SEQ ID NO: 2436333 - DNA, 24 bp, Homo sapiens
gttgtggcctttgcgctcctggcc

SEQ ID NO: 2436334 - DNA, 17 bp, Homo sapiens
gttgttatgtgatcatg

SEQ ID NO: 2436335 - DNA, 12 bp, Homo sapiens
gttgttctgtta

SEQ ID NO: 2436336 - DNA, 19 bp, Homo sapiens
gtttaaaagacacacttgt

SEQ ID NO: 2436337 - DNA, 13 bp, Homo sapiens
gtttaaagaaagt

SEQ ID NO: 2436338 - DNA, 14 bp, Homo sapiens
gtttaaagagtcta

SEQ ID NO: 2436339 - DNA, 14 bp, Homo sapiens
gtttaaatgaacaa

SEQ ID NO: 2436340 - DNA, 20 bp, Homo sapiens
gtttaatttttatttcttcc

SEQ ID NO: 2436341 - DNA, 12 bp, Homo sapiens
gtttaccttgta

SEQ ID NO: 2436342 - DNA, 15 bp, Homo sapiens
gtttagctctgagaa

SEQ ID NO: 2436343 - DNA, 16 bp, Homo sapiens
gtttagctctgagaac

SEQ ID NO: 2436344 - DNA, 15 bp, Homo sapiens
gtttaggctatttgt

SEQ ID NO: 2436345 - DNA, 22 bp, Homo sapiens
gtttaggctatttgtaaatctg

SEQ ID NO: 2436346 - DNA, 17 bp, Homo sapiens
gtttagggaacaatttg

SEQ ID NO: 2436347 - DNA, 15 bp, Homo sapiens
gtttatacactgtgt

SEQ ID NO: 2436348 - DNA, 19 bp, Homo sapiens
gtttatacactgtgtaaat

SEQ ID NO: 2436349 - DNA, 14 bp, Homo sapiens
gtttatcattcaag

SEQ ID NO: 2436350 - DNA, 15 bp, Homo sapiens
gtttatcattcaagt

SEQ ID NO: 2436351 - DNA, 15 bp, Homo sapiens
gtttatcctttcata

SEQ ID NO: 2436352 - DNA, 18 bp, Homo sapiens
gtttatgaaaaagaagaa

SEQ ID NO: 2436353 - DNA, 15 bp, Homo sapiens
gtttatgtaatttca

SEQ ID NO: 2436354 - DNA, 14 bp, Homo sapiens
gtttattaatctta

SEQ ID NO: 2436355 - DNA, 18 bp, Homo sapiens
gtttattaatcttagtgt

SEQ ID NO: 2436356 - DNA, 20 bp, Homo sapiens
gtttattaatcttagtgtat

SEQ ID NO: 2436357 - DNA, 23 bp, Homo sapiens
gtttattaatcttagtgtatgat

SEQ ID NO: 2436358 - DNA, 13 bp, Homo sapiens
gtttattacgtat

SEQ ID NO: 2436359 - DNA, 19 bp, Homo sapiens
gtttattcttctagagttc

SEQ ID NO: 2436360 - DNA, 19 bp, Homo sapiens
gtttcaaagatgctgtgag

SEQ ID NO: 2436361 - DNA, 18 bp, Homo sapiens
taaaatgtaaagccatgc

SEQ ID NO: 2436362 - DNA, 20 bp, Homo sapiens
taaaatgtgatgttctaagg

SEQ ID NO: 2436363 - DNA, 21 bp, Homo sapiens
taaaatgtgatgttctaaggc

SEQ ID NO: 2436364 - DNA, 23 bp, Homo sapiens
taaaatgtgttgttccaaatact

SEQ ID NO: 2436365 - DNA, 17 bp, Homo sapiens
taaaatgttcacttttg

SEQ ID NO: 2436366 - DNA, 22 bp, Homo sapiens
taaaatgttcacttttgacaaa

SEQ ID NO: 2436367 - DNA, 15 bp, Homo sapiens
taaaattatttcatg

SEQ ID NO: 2436368 - DNA, 18 bp, Homo sapiens
taaacaaactgtgtaact

SEQ ID NO: 2436369 - DNA, 13 bp, Homo sapiens
taaacaagaaaaa

SEQ ID NO: 2436370 - DNA, 14 bp, Homo sapiens
taaacaagaaaaat

SEQ ID NO: 2436371 - DNA, 17 bp, Homo sapiens
taaacaagaaaaataaa

SEQ ID NO: 2436372 - DNA, 20 bp, Homo sapiens
taaacacaagattggtgttt

SEQ ID NO: 2436373 - DNA, 16 bp, Homo sapiens
taaacacttgcaacct

SEQ ID NO: 2436374 - DNA, 15 bp, Homo sapiens
taaacatcaatcttt

SEQ ID NO: 2436375 - DNA, 18 bp, Homo sapiens
taaacatcaatctttaaa

SEQ ID NO: 2436376 - DNA, 20 bp, Homo sapiens
taaacattaatagcagcctt

SEQ ID NO: 2436377 - DNA, 17 bp, Homo sapiens
taaaccgctaaaagaaa

SEQ ID NO: 2436378 - DNA, 17 bp, Homo sapiens
taaacgatttttaaaat

SEQ ID NO: 2436379 - DNA, 13 bp, Homo sapiens
taaactaaacacg

SEQ ID NO: 2436380 - DNA, 17 bp, Homo sapiens
taaactaataattgcag

SEQ ID NO: 2436381 - DNA, 14 bp, Homo sapiens
taaactgtacagtg

SEQ ID NO: 2436382 - DNA, 15 bp, Homo sapiens
taaactgtacagtgt

SEQ ID NO: 2436383 - DNA, 20 bp, Homo sapiens
taaactgtacagtgtctttt

SEQ ID NO: 2436384 - DNA, 16 bp, Homo sapiens
taaacttttaattcat

SEQ ID NO: 2436385 - DNA, 17 bp, Homo sapiens
taaactttttgttctgg

SEQ ID NO: 2436386 - DNA, 20 bp, Homo sapiens
taaactttttttctgtacca

SEQ ID NO: 2436387 - DNA, 11 bp, Homo sapiens
taaagaaaaaa

SEQ ID NO: 2436388 - DNA, 12 bp, Homo sapiens
taaagaaaaaaa

SEQ ID NO: 2436389 - DNA, 20 bp, Homo sapiens
taaagaaaaaaattgaaatg

SEQ ID NO: 2436390 - DNA, 13 bp, Homo sapiens
taaagaaaagatg

SEQ ID NO: 2436391 - DNA, 13 bp, Homo sapiens
taaagaattattt

SEQ ID NO: 2436392 - DNA, 21 bp, Homo sapiens
taaagacgttttataagcatc

SEQ ID NO: 2436393 - DNA, 23 bp, Homo sapiens
taaagacgttttataagcatcat

SEQ ID NO: 2436394 - DNA, 20 bp, Homo sapiens
taaagactggcttttattaa

SEQ ID NO: 2436395 - DNA, 19 bp, Homo sapiens
taaagagtctagattcaaa

SEQ ID NO: 2436396 - DNA, 23 bp, Homo sapiens
taaagatacagaactctttcaaa

SEQ ID NO: 2436397 - DNA, 19 bp, Homo sapiens
taaagattctatagttcta

SEQ ID NO: 2436398 - DNA, 12 bp, Homo sapiens
taaagatttttt

SEQ ID NO: 2436399 - DNA, 16 bp, Homo sapiens
taaagattttttaata

SEQ ID NO: 2436400 - DNA, 18 bp, Homo sapiens
taaagcaggccttttgat

SEQ ID NO: 2436401 - DNA, 19 bp, Homo sapiens
taaagcaggccttttgata

SEQ ID NO: 2436402 - DNA, 20 bp, Homo sapiens
taaagcatttaacccccctg

SEQ ID NO: 2436403 - DNA, 23 bp, Homo sapiens
taaagctttcagaatatgtcagt

SEQ ID NO: 2436404 - DNA, 19 bp, Homo sapiens
taaaggtccacaggtctag

SEQ ID NO: 2436405 - DNA, 21 bp, Homo sapiens
taaaggtccacaggtctagac

SEQ ID NO: 2436406 - DNA, 17 bp, Homo sapiens
taaagtagtcctgtgaa

SEQ ID NO: 2436407 - DNA, 15 bp, Homo sapiens
taaagtcagatggaa

SEQ ID NO: 2436408 - DNA, 22 bp, Homo sapiens
taaagtctgttgattaaagatg

SEQ ID NO: 2436409 - DNA, 15 bp, Homo sapiens
taaagtgccagtatt

SEQ ID NO: 2436410 - DNA, 18 bp, Homo sapiens
taaagtgccagtatttta

SEQ ID NO: 2436411 - DNA, 23 bp, Homo sapiens
taaagtgccagtattttaaaata

SEQ ID NO: 2436412 - DNA, 15 bp, Homo sapiens
taaagtgctaaggtt

SEQ ID NO: 2436413 - DNA, 16 bp, Homo sapiens
taaagtgctaaggttc

SEQ ID NO: 2436414 - DNA, 13 bp, Homo sapiens
taaagttctaaga

SEQ ID NO: 2436415 - DNA, 19 bp, Homo sapiens
taaagttctaagattctga

SEQ ID NO: 2436416 - DNA, 22 bp, Homo sapiens
taaagttctaagattctgattt

SEQ ID NO: 2436417 - DNA, 16 bp, Homo sapiens
taaagttgataaagat

SEQ ID NO: 2436418 - DNA, 19 bp, Homo sapiens
taaagttttatatattata

SEQ ID NO: 2436419 - DNA, 17 bp, Homo sapiens
taaataaaaagaaaggc

SEQ ID NO: 2436420 - DNA, 23 bp, Homo sapiens
taaataaaatgctaggttctacc

SEQ ID NO: 2436421 - DNA, 14 bp, Homo sapiens
taaataaaatttgt

SEQ ID NO: 2436422 - DNA, 11 bp, Homo sapiens
taaataagaaa

SEQ ID NO: 2436423 - DNA, 21 bp, Homo sapiens
taaataagaaacaactctttg

SEQ ID NO: 2436424 - DNA, 13 bp, Homo sapiens
taaataagaaact

SEQ ID NO: 2436425 - DNA, 15 bp, Homo sapiens
taaataagaaacttt

SEQ ID NO: 2436426 - DNA, 15 bp, Homo sapiens
taaataagattctaa

SEQ ID NO: 2436427 - DNA, 18 bp, Homo sapiens
taaataagattctaacgg

SEQ ID NO: 2436428 - DNA, 14 bp, Homo sapiens
taaatacaggaaac

SEQ ID NO: 2436429 - DNA, 15 bp, Homo sapiens
taaatacaggaaaca

SEQ ID NO: 2436430 - DNA, 16 bp, Homo sapiens
taaatacaggaaacag

SEQ ID NO: 2436431 - DNA, 20 bp, Homo sapiens
taaatacagtcttccatttg

SEQ ID NO: 2436432 - DNA, 13 bp, Homo sapiens
taaatactgcaaa

SEQ ID NO: 2436433 - DNA, 17 bp, Homo sapiens
taaatactgcaaatcag

SEQ ID NO: 2436434 - DNA, 12 bp, Homo sapiens
taaatagtattt

SEQ ID NO: 2436435 - DNA, 12 bp, Homo sapiens
taaatataaaga

SEQ ID NO: 2436436 - DNA, 17 bp, Homo sapiens
taaatataaagacgttt

SEQ ID NO: 2436437 - DNA, 14 bp, Homo sapiens
taaatatatctacc

SEQ ID NO: 2436438 - DNA, 20 bp, Homo sapiens
taaatatatctaccccagac

SEQ ID NO: 2436439 - DNA, 20 bp, Homo sapiens
taaatatattattacttgta

SEQ ID NO: 2436440 - DNA, 17 bp, Homo sapiens
taaatatggactgctca

SEQ ID NO: 2436441 - DNA, 23 bp, Homo sapiens
taaatatggactgctcaggaaac

SEQ ID NO: 2436442 - DNA, 15 bp, Homo sapiens
taaatattttaaaga

SEQ ID NO: 2436443 - DNA, 18 bp, Homo sapiens
taaatcacgctttttgaa

SEQ ID NO: 2436444 - DNA, 21 bp, Homo sapiens
taaatcacgctttttgaaaaa

SEQ ID NO: 2436445 - DNA, 20 bp, Homo sapiens
taaatctgctggagtttcat

SEQ ID NO: 2436446 - DNA, 13 bp, Homo sapiens
taaatgaacaaga

SEQ ID NO: 2436447 - DNA, 16 bp, Homo sapiens
taaatgaacaagagaa

SEQ ID NO: 2436448 - DNA, 17 bp, Homo sapiens
taaatgaacaagagaag

SEQ ID NO: 2436449 - DNA, 17 bp, Homo sapiens
taaatgattcttagtga

SEQ ID NO: 2436450 - DNA, 15 bp, Homo sapiens
taaatgcaaataaca

SEQ ID NO: 2436451 - DNA, 13 bp, Homo sapiens
taaatgccctgct

SEQ ID NO: 2436452 - DNA, 17 bp, Homo sapiens
taaatgtagagttttta

SEQ ID NO: 2436453 - DNA, 21 bp, Homo sapiens
taaatgtcactttttgaggca

SEQ ID NO: 2436454 - DNA, 18 bp, Homo sapiens
taaatgtctttaatgcaa

SEQ ID NO: 2436455 - DNA, 20 bp, Homo sapiens
taaatgtctttaatgcaata

SEQ ID NO: 2436456 - DNA, 22 bp, Homo sapiens
taaattatcaggcaaatttgca

SEQ ID NO: 2436457 - DNA, 18 bp, Homo sapiens
taaattcccgttttgtca

SEQ ID NO: 2436458 - DNA, 19 bp, Homo sapiens
taaattcccgttttgtcac

SEQ ID NO: 2436459 - DNA, 19 bp, Homo sapiens
taaatttgtactatttaac

SEQ ID NO: 2436460 - DNA, 20 bp, Homo sapiens
taaatttgtactatttaact

SEQ ID NO: 2436461 - DNA, 18 bp, Homo sapiens
taaattttcctgtcctct

SEQ ID NO: 2436462 - DNA, 16 bp, Homo sapiens
taaattttttgttgac

SEQ ID NO: 2436463 - DNA, 20 bp, Homo sapiens
taaattttttgttgacatta

SEQ ID NO: 2436464 - DNA, 16 bp, Homo sapiens
taacaaaatgtatgtc

SEQ ID NO: 2436465 - DNA, 20 bp, Homo sapiens
taagcttttcttttctttgt

SEQ ID NO: 2436466 - DNA, 21 bp, Homo sapiens
taaggacctgaaattccaaag

SEQ ID NO: 2436467 - DNA, 16 bp, Homo sapiens
taaggcctaggattct

SEQ ID NO: 2436468 - DNA, 18 bp, Homo sapiens
taaggcctaggattctaa

SEQ ID NO: 2436469 - DNA, 19 bp, Homo sapiens
taaggcctaggattctaaa

SEQ ID NO: 2436470 - DNA, 21 bp, Homo sapiens
taaggcctaggattctaaaat

SEQ ID NO: 2436471 - DNA, 22 bp, Homo sapiens
taaggctctgagagtctagatt

SEQ ID NO: 2436472 - DNA, 17 bp, Homo sapiens
taagggtcgaaagctct

SEQ ID NO: 2436473 - DNA, 20 bp, Homo sapiens
taaggtccggtgttctaaga

SEQ ID NO: 2436474 - DNA, 12 bp, Homo sapiens
taagtacagaga

SEQ ID NO: 2436475 - DNA, 13 bp, Homo sapiens
taagtacagagaa

SEQ ID NO: 2436476 - DNA, 13 bp, Homo sapiens
taagtatttcaaa

SEQ ID NO: 2436477 - DNA, 21 bp, Homo sapiens
taagtattttcctgttgtcaa

SEQ ID NO: 2436478 - DNA, 14 bp, Homo sapiens
taagtcaacagtaa

SEQ ID NO: 2436479 - DNA, 15 bp, Homo sapiens
taagtcaacagtaaa

SEQ ID NO: 2436480 - DNA, 17 bp, Homo sapiens
taagtcaacctgcctga

SEQ ID NO: 2436481 - DNA, 17 bp, Homo sapiens
taagttagttccactga

SEQ ID NO: 2436482 - DNA, 18 bp, Homo sapiens
taagttatagtgaatact

SEQ ID NO: 2436483 - DNA, 12 bp, Homo sapiens
taagttattgca

SEQ ID NO: 2436484 - DNA, 20 bp, Homo sapiens
taagttgagatagttttcat

SEQ ID NO: 2436485 - DNA, 18 bp, Homo sapiens
taagttgggcttgctatt

SEQ ID NO: 2436486 - DNA, 22 bp, Homo sapiens
taagttgggcttgctattctgt

SEQ ID NO: 2436487 - DNA, 15 bp, Homo sapiens
taagtttctaagatt

SEQ ID NO: 2436488 - DNA, 17 bp, Homo sapiens
taagtttctctgcagaa

SEQ ID NO: 2436489 - DNA, 14 bp, Homo sapiens
taataaaagaaaat

SEQ ID NO: 2436490 - DNA, 16 bp, Homo sapiens
taataataaagaatag

SEQ ID NO: 2436491 - DNA, 14 bp, Homo sapiens
taataatttctaat

SEQ ID NO: 2436492 - DNA, 16 bp, Homo sapiens
taataatttctaatgt

SEQ ID NO: 2436493 - DNA, 15 bp, Homo sapiens
taatacaaactatat

SEQ ID NO: 2436494 - DNA, 17 bp, Homo sapiens
taatacattatatttct

SEQ ID NO: 2436495 - DNA, 14 bp, Homo sapiens
taatactaccttga

SEQ ID NO: 2436496 - DNA, 16 bp, Homo sapiens
taatactcaaatgagt

SEQ ID NO: 2436497 - DNA, 19 bp, Homo sapiens
taatactgctgagatacat

SEQ ID NO: 2436498 - DNA, 17 bp, Homo sapiens
taatacttcttgtgtgt

SEQ ID NO: 2436499 - DNA, 17 bp, Homo sapiens
taatagaaaagtatgtt

SEQ ID NO: 2436500 - DNA, 16 bp, Homo sapiens
taatagaataaaggca

SEQ ID NO: 2436501 - DNA, 12 bp, Homo sapiens
taatagattctc

SEQ ID NO: 2436502 - DNA, 21 bp, Homo sapiens
taatagcagcctttctctctt

SEQ ID NO: 2436503 - DNA, 11 bp, Homo sapiens
taatagctgta

SEQ ID NO: 2436504 - DNA, 13 bp, Homo sapiens
taatagttcctgc

SEQ ID NO: 2436505 - DNA, 20 bp, Homo sapiens
taatataaagttttatatat

SEQ ID NO: 2436506 - DNA, 14 bp, Homo sapiens
taatataaatgcaa

SEQ ID NO: 2436507 - DNA, 16 bp, Homo sapiens
taatataaatgcaaat

SEQ ID NO: 2436508 - DNA, 17 bp, Homo sapiens
taatatatttaaaaata

SEQ ID NO: 2436509 - DNA, 17 bp, Homo sapiens
taatatccctacatgta

SEQ ID NO: 2436510 - DNA, 14 bp, Homo sapiens
taatatcctaaaca

SEQ ID NO: 2436511 - DNA, 18 bp, Homo sapiens
taatatgcttaaaataag

SEQ ID NO: 2436512 - DNA, 21 bp, Homo sapiens
taatattttcctcctgagtgc

SEQ ID NO: 2436513 - DNA, 18 bp, Homo sapiens
taatcaatgtttcttcta

SEQ ID NO: 2436514 - DNA, 19 bp, Homo sapiens
taatcagggaggtcatttt

SEQ ID NO: 2436515 - DNA, 23 bp, Homo sapiens
taatcagttcattagaaatattt

SEQ ID NO: 2436516 - DNA, 22 bp, Homo sapiens
taatcatcaagagaatttgggg

SEQ ID NO: 2436517 - DNA, 18 bp, Homo sapiens
taatcatcaagtaataca

SEQ ID NO: 2436518 - DNA, 17 bp, Homo sapiens
taatccaggcagatcca

SEQ ID NO: 2436519 - DNA, 18 bp, Homo sapiens
taatccaggcagatccag

SEQ ID NO: 2436520 - DNA, 13 bp, Homo sapiens
taatccctgcttt

SEQ ID NO: 2436521 - DNA, 14 bp, Homo sapiens
taatccctgctttt

SEQ ID NO: 2436522 - DNA, 19 bp, Homo sapiens
taatccgaatctctttttg

SEQ ID NO: 2436523 - DNA, 16 bp, Homo sapiens
taatccgccaatatta

SEQ ID NO: 2436524 - DNA, 13 bp, Homo sapiens
taatctgcctccc

SEQ ID NO: 2436525 - DNA, 15 bp, Homo sapiens
taatcttagtgtatg

SEQ ID NO: 2436526 - DNA, 15 bp, Homo sapiens
taatcttataattgt

SEQ ID NO: 2436527 - DNA, 22 bp, Homo sapiens
taatcttgaattgtaactgttc

SEQ ID NO: 2436528 - DNA, 14 bp, Homo sapiens
taatcttgctttct

SEQ ID NO: 2436529 - DNA, 13 bp, Homo sapiens
taatgaaacaaag

SEQ ID NO: 2436530 - DNA, 23 bp, Homo sapiens
taatgaaataaaactgtttttga

SEQ ID NO: 2436531 - DNA, 23 bp, Homo sapiens
taatgaagaaagtggaaaacaag

SEQ ID NO: 2436532 - DNA, 13 bp, Homo sapiens
taatgaagatcta

SEQ ID NO: 2436533 - DNA, 14 bp, Homo sapiens
taatgaagatctaa

SEQ ID NO: 2436534 - DNA, 17 bp, Homo sapiens
taatgaagatctaaata

SEQ ID NO: 2436535 - DNA, 15 bp, Homo sapiens
taatgaatttagtga

SEQ ID NO: 2436536 - DNA, 16 bp, Homo sapiens
taatgatatgcttgta

SEQ ID NO: 2436537 - DNA, 19 bp, Homo sapiens
taatgcattcttctctgtt

SEQ ID NO: 2436538 - DNA, 21 bp, Homo sapiens
taatggcagttatattttgca

SEQ ID NO: 2436539 - DNA, 19 bp, Homo sapiens
taatggtactgactttgct

SEQ ID NO: 2436540 - DNA, 15 bp, Homo sapiens
taatgtacatctggc

SEQ ID NO: 2436541 - DNA, 21 bp, Homo sapiens
taatgtgaaaatggtccagga

SEQ ID NO: 2436542 - DNA, 19 bp, Homo sapiens
taatgtgtagttcatgtaa

SEQ ID NO: 2436543 - DNA, 13 bp, Homo sapiens
taatgttaatatt

SEQ ID NO: 2436544 - DNA, 22 bp, Homo sapiens
taatgtttctggatttcatact

SEQ ID NO: 2436545 - DNA, 22 bp, Homo sapiens
taatgttttttgccacagcttt

SEQ ID NO: 2436546 - DNA, 18 bp, Homo sapiens
taattaaaagcaaatcat

SEQ ID NO: 2436547 - DNA, 21 bp, Homo sapiens
taattaattgggccagctttt

SEQ ID NO: 2436548 - DNA, 14 bp, Homo sapiens
taattagtgccact

SEQ ID NO: 2436549 - DNA, 19 bp, Homo sapiens
taattagtgccacttaatg

SEQ ID NO: 2436550 - DNA, 21 bp, Homo sapiens
taattagtgccacttaatgta

SEQ ID NO: 2436551 - DNA, 17 bp, Homo sapiens
taattatataactgtat

SEQ ID NO: 2436552 - DNA, 20 bp, Homo sapiens
taattatataactgtatttg

SEQ ID NO: 2436553 - DNA, 15 bp, Homo sapiens
taattatatgttgta

SEQ ID NO: 2436554 - DNA, 22 bp, Homo sapiens
taattatggagtcatttttaca

SEQ ID NO: 2436555 - DNA, 15 bp, Homo sapiens
taattatgtagctct

SEQ ID NO: 2436556 - DNA, 14 bp, Homo sapiens
taattattatttat

SEQ ID NO: 2436557 - DNA, 14 bp, Homo sapiens
taattattatttgt

SEQ ID NO: 2436558 - DNA, 17 bp, Homo sapiens
taattattatttgtgtt

SEQ ID NO: 2436559 - DNA, 18 bp, Homo sapiens
taattcaaggaatttctt

SEQ ID NO: 2436560 - DNA, 21 bp, Homo sapiens
taattcacagtgctcttttct

SEQ ID NO: 2436561 - DNA, 16 bp, Homo sapiens
taattcaggtttttcc

SEQ ID NO: 2436562 - DNA, 21 bp, Homo sapiens
taattcaggtttttccttttt

SEQ ID NO: 2436563 - DNA, 17 bp, Homo sapiens
taattccacacctttta

SEQ ID NO: 2436564 - DNA, 18 bp, Homo sapiens
taattctcattaaaagaa

SEQ ID NO: 2436565 - DNA, 17 bp, Homo sapiens
taattctgagttttgtg

SEQ ID NO: 2436566 - DNA, 18 bp, Homo sapiens
taattctttcaatacaga

SEQ ID NO: 2436567 - DNA, 22 bp, Homo sapiens
taattgccaaaaagtgaaataa

SEQ ID NO: 2436568 - DNA, 11 bp, Homo sapiens
taattgccatg

SEQ ID NO: 2436569 - DNA, 17 bp, Homo sapiens
taccactctgtaattgc

SEQ ID NO: 2436570 - DNA, 18 bp, Homo sapiens
taccactctgtaattgca

SEQ ID NO: 2436571 - DNA, 13 bp, Homo sapiens
taccagaaagcag

SEQ ID NO: 2436572 - DNA, 14 bp, Homo sapiens
taccagataacttt

SEQ ID NO: 2436573 - DNA, 17 bp, Homo sapiens
taccaggcaccaaaaga

SEQ ID NO: 2436574 - DNA, 18 bp, Homo sapiens
taccagtatttagaagcc

SEQ ID NO: 2436575 - DNA, 14 bp, Homo sapiens
taccagttgccttt

SEQ ID NO: 2436576 - DNA, 17 bp, Homo sapiens
taccatcactgagtttt

SEQ ID NO: 2436577 - DNA, 18 bp, Homo sapiens
taccatgcttcacaatgt

SEQ ID NO: 2436578 - DNA, 16 bp, Homo sapiens
taccattaaaccatct

SEQ ID NO: 2436579 - DNA, 22 bp, Homo sapiens
taccattaaaccatctccctgg

SEQ ID NO: 2436580 - DNA, 16 bp, Homo sapiens
taccattttctggttc

SEQ ID NO: 2436581 - DNA, 15 bp, Homo sapiens
tacccaaactgcttt

SEQ ID NO: 2436582 - DNA, 15 bp, Homo sapiens
tacccaggtctgggt

SEQ ID NO: 2436583 - DNA, 21 bp, Homo sapiens
taccccagactagatgtagta

SEQ ID NO: 2436584 - DNA, 20 bp, Homo sapiens
taccccatggagctgggcta

SEQ ID NO: 2436585 - DNA, 15 bp, Homo sapiens
tacccccctctgtct

SEQ ID NO: 2436586 - DNA, 18 bp, Homo sapiens
taccctcctttttttccc

SEQ ID NO: 2436587 - DNA, 13 bp, Homo sapiens
taccctctcagct

SEQ ID NO: 2436588 - DNA, 21 bp, Homo sapiens
taccctctcagctccaggtgg

SEQ ID NO: 2436589 - DNA, 22 bp, Homo sapiens
taccctctggaggggtgtggct

SEQ ID NO: 2436590 - DNA, 13 bp, Homo sapiens
taccctgacctgg

SEQ ID NO: 2436591 - DNA, 16 bp, Homo sapiens
taccctgagctgaggc

SEQ ID NO: 2436592 - DNA, 17 bp, Homo sapiens
taccctgagctgaggca

SEQ ID NO: 2436593 - DNA, 13 bp, Homo sapiens
taccctggcccct

SEQ ID NO: 2436594 - DNA, 14 bp, Homo sapiens
taccctggcccctc

SEQ ID NO: 2436595 - DNA, 21 bp, Homo sapiens
taccctggcccctctcccttg

SEQ ID NO: 2436596 - DNA, 18 bp, Homo sapiens
taccctttttctccagct

SEQ ID NO: 2436597 - DNA, 19 bp, Homo sapiens
taccctttttctccagctg

SEQ ID NO: 2436598 - DNA, 17 bp, Homo sapiens
taccgaatgtgtcttta

SEQ ID NO: 2436599 - DNA, 19 bp, Homo sapiens
taccgcgtctaccctggga

SEQ ID NO: 2436600 - DNA, 19 bp, Homo sapiens
tacctaaaaggaaatctca

SEQ ID NO: 2436601 - DNA, 22 bp, Homo sapiens
tacctaagattacaaatcagaa

SEQ ID NO: 2436602 - DNA, 21 bp, Homo sapiens
tacctatcccacctccatccc

SEQ ID NO: 2436603 - DNA, 14 bp, Homo sapiens
tacctcagcctggg

SEQ ID NO: 2436604 - DNA, 13 bp, Homo sapiens
tacctcctgagaa

SEQ ID NO: 2436605 - DNA, 13 bp, Homo sapiens
tacctgaaaacac

SEQ ID NO: 2436606 - DNA, 21 bp, Homo sapiens
tacctgaaaacactgtgcaca

SEQ ID NO: 2436607 - DNA, 21 bp, Homo sapiens
tacctgctcacgtcaaatgca

SEQ ID NO: 2436608 - DNA, 19 bp, Homo sapiens
tacctgtagattcaggtaa

SEQ ID NO: 2436609 - DNA, 16 bp, Homo sapiens
tacctgtgtggacagg

SEQ ID NO: 2436610 - DNA, 14 bp, Homo sapiens
tacctgttgagcat

SEQ ID NO: 2436611 - DNA, 16 bp, Homo sapiens
taccttatagttactg

SEQ ID NO: 2436612 - DNA, 23 bp, Homo sapiens
taccttctccccagctcccagga

SEQ ID NO: 2436613 - DNA, 22 bp, Homo sapiens
taccttggttcccccactgatc

SEQ ID NO: 2436614 - DNA, 17 bp, Homo sapiens
tacgaaataattgttgt

SEQ ID NO: 2436615 - DNA, 22 bp, Homo sapiens
tacgaaataattgttgttctgt

SEQ ID NO: 2436616 - DNA, 12 bp, Homo sapiens
tacgcgccaccg

SEQ ID NO: 2436617 - DNA, 12 bp, Homo sapiens
tacggtgggggt

SEQ ID NO: 2436618 - DNA, 13 bp, Homo sapiens
tacggtgggggta

SEQ ID NO: 2436619 - DNA, 19 bp, Homo sapiens
tacgtaataaggttttaat

SEQ ID NO: 2436620 - DNA, 14 bp, Homo sapiens
tacgtatgtctggt

SEQ ID NO: 2436621 - DNA, 19 bp, Homo sapiens
tacgtgggcattgtctttt

SEQ ID NO: 2436622 - DNA, 16 bp, Homo sapiens
tactaaaaaaaagatg

SEQ ID NO: 2436623 - DNA, 14 bp, Homo sapiens
tactaccttgaaaa

SEQ ID NO: 2436624 - DNA, 21 bp, Homo sapiens
tactagggatccctcatctgt

SEQ ID NO: 2436625 - DNA, 17 bp, Homo sapiens
tactataagaactttga

SEQ ID NO: 2436626 - DNA, 19 bp, Homo sapiens
tactatgtggatgtgacag

SEQ ID NO: 2436627 - DNA, 12 bp, Homo sapiens
tactattaaaaa

SEQ ID NO: 2436628 - DNA, 15 bp, Homo sapiens
tactattgttacatt

SEQ ID NO: 2436629 - DNA, 11 bp, Homo sapiens
tactatttaaa

SEQ ID NO: 2436630 - DNA, 19 bp, Homo sapiens
tactatttaaagcctcctc

SEQ ID NO: 2436631 - DNA, 13 bp, Homo sapiens
tactatttaactg

SEQ ID NO: 2436632 - DNA, 14 bp, Homo sapiens
tactatttaactga

SEQ ID NO: 2436633 - DNA, 21 bp, Homo sapiens
tactcacacaggcatttcctg

SEQ ID NO: 2436634 - DNA, 17 bp, Homo sapiens
tactcacttttcccact

SEQ ID NO: 2436635 - DNA, 18 bp, Homo sapiens
tactcacttttcccactc

SEQ ID NO: 2436636 - DNA, 16 bp, Homo sapiens
tactcagataaggtaa

SEQ ID NO: 2436637 - DNA, 14 bp, Homo sapiens
tactcatttttcat

SEQ ID NO: 2436638 - DNA, 15 bp, Homo sapiens
tactctaagatctta

SEQ ID NO: 2436639 - DNA, 22 bp, Homo sapiens
tactctccccacgagggctggc

SEQ ID NO: 2436640 - DNA, 14 bp, Homo sapiens
tactctgtgccaga

SEQ ID NO: 2436641 - DNA, 15 bp, Homo sapiens
tactctgtgccagag

SEQ ID NO: 2436642 - DNA, 16 bp, Homo sapiens
tactctgtgccagagc

SEQ ID NO: 2436643 - DNA, 21 bp, Homo sapiens
tactctgtgccagagcctggg

SEQ ID NO: 2436644 - DNA, 19 bp, Homo sapiens
tactgaacatctgagtcct

SEQ ID NO: 2436645 - DNA, 13 bp, Homo sapiens
tactgaatctgct

SEQ ID NO: 2436646 - DNA, 13 bp, Homo sapiens
tactgacatgtgg

SEQ ID NO: 2436647 - DNA, 20 bp, Homo sapiens
tactgacatgtggggccagg

SEQ ID NO: 2436648 - DNA, 19 bp, Homo sapiens
tactgagccttgtaattct

SEQ ID NO: 2436649 - DNA, 23 bp, Homo sapiens
tactgagccttgtaattctaaat

SEQ ID NO: 2436650 - DNA, 23 bp, Homo sapiens
tactgcaaatcaggcttttgttt

SEQ ID NO: 2436651 - DNA, 10 bp, Homo sapiens
tactgcctgc

SEQ ID NO: 2436652 - DNA, 16 bp, Homo sapiens
tactgcctgcttgggg

SEQ ID NO: 2436653 - DNA, 12 bp, Homo sapiens
tactgcgacttt

SEQ ID NO: 2436654 - DNA, 18 bp, Homo sapiens
tactgcgactttctgcct

SEQ ID NO: 2436655 - DNA, 19 bp, Homo sapiens
tactgcgactttctgcctg

SEQ ID NO: 2436656 - DNA, 21 bp, Homo sapiens
tactgcgactttctgcctgga

SEQ ID NO: 2436657 - DNA, 14 bp, Homo sapiens
tactgctctgagaa

SEQ ID NO: 2436658 - DNA, 20 bp, Homo sapiens
tactgctgagatacatacag

SEQ ID NO: 2436659 - DNA, 24 bp, Homo sapiens
tactgcttggagctgagcaaatca

SEQ ID NO: 2436660 - DNA, 13 bp, Homo sapiens
tactggtctctct

SEQ ID NO: 2436661 - DNA, 15 bp, Homo sapiens
tactgtatattcagg

SEQ ID NO: 2436662 - DNA, 23 bp, Homo sapiens
tactgtcatcctcaaagaaagtg

SEQ ID NO: 2436663 - DNA, 14 bp, Homo sapiens
tactgtgtaattag

SEQ ID NO: 2436664 - DNA, 21 bp, Homo sapiens
tactgtgtgtgtgaatgaaca

SEQ ID NO: 2436665 - DNA, 23 bp, Homo sapiens
tactgtgtgtgtgaatgaacact

SEQ ID NO: 2436666 - DNA, 16 bp, Homo sapiens
tactgtgttatgcaaa

SEQ ID NO: 2436667 - DNA, 22 bp, Homo sapiens
tactgtgttatgcaaaagcaag

SEQ ID NO: 2436668 - DNA, 13 bp, Homo sapiens
tactgttctaaag

SEQ ID NO: 2436669 - DNA, 14 bp, Homo sapiens
tactgttctaaagc

SEQ ID NO: 2436670 - DNA, 15 bp, Homo sapiens
tactgttctaaagct

SEQ ID NO: 2436671 - DNA, 17 bp, Homo sapiens
tactgttctaaagctct

SEQ ID NO: 2436672 - DNA, 16 bp, Homo sapiens
tactgttctgtgtctt

SEQ ID NO: 2436673 - DNA, 16 bp, Homo sapiens
tagcctgtcctgtcat

SEQ ID NO: 2436674 - DNA, 20 bp, Homo sapiens
tagcctgtcctgtcatcatc

SEQ ID NO: 2436675 - DNA, 15 bp, Homo sapiens
tagcctttttgtata

SEQ ID NO: 2436676 - DNA, 19 bp, Homo sapiens
tagccttttttccccagac

SEQ ID NO: 2436677 - DNA, 22 bp, Homo sapiens
tagccttttttccccagacttg

SEQ ID NO: 2436678 - DNA, 21 bp, Homo sapiens
tagcgttcttgtaattttaca

SEQ ID NO: 2436679 - DNA, 17 bp, Homo sapiens
tagctacagagaaacca

SEQ ID NO: 2436680 - DNA, 20 bp, Homo sapiens
tagctacagagaaaccagct

SEQ ID NO: 2436681 - DNA, 22 bp, Homo sapiens
tagctacagagaaaccagcttc

SEQ ID NO: 2436682 - DNA, 23 bp, Homo sapiens
tagctacagagaaaccagcttcc

SEQ ID NO: 2436683 - DNA, 12 bp, Homo sapiens
tagctcctgtgg

SEQ ID NO: 2436684 - DNA, 13 bp, Homo sapiens
tagctcctgtggc

SEQ ID NO: 2436685 - DNA, 14 bp, Homo sapiens
tagctcctgtggcc

SEQ ID NO: 2436686 - DNA, 16 bp, Homo sapiens
tagctcctgtggcccc

SEQ ID NO: 2436687 - DNA, 11 bp, Homo sapiens
tagctctgggg

SEQ ID NO: 2436688 - DNA, 13 bp, Homo sapiens
tagctctttgtca

SEQ ID NO: 2436689 - DNA, 19 bp, Homo sapiens
tagctctttgtcagggagt

SEQ ID NO: 2436690 - DNA, 18 bp, Homo sapiens
tagctgaatgtttttcta

SEQ ID NO: 2436691 - DNA, 11 bp, Homo sapiens
tagctgagctc

SEQ ID NO: 2436692 - DNA, 14 bp, Homo sapiens
tagctgggactaca

SEQ ID NO: 2436693 - DNA, 13 bp, Homo sapiens
tagctgtgacctg

SEQ ID NO: 2436694 - DNA, 10 bp, Homo sapiens
tagctgtggg

SEQ ID NO: 2436695 - DNA, 13 bp, Homo sapiens
tagctgtgggggt

SEQ ID NO: 2436696 - DNA, 14 bp, Homo sapiens
tagctgtgggggtg

SEQ ID NO: 2436697 - DNA, 16 bp, Homo sapiens
tagctttaacttaaat

SEQ ID NO: 2436698 - DNA, 23 bp, Homo sapiens
tagctttaatgatatgcttgtaa

SEQ ID NO: 2436699 - DNA, 12 bp, Homo sapiens
tagcttttgtgg

SEQ ID NO: 2436700 - DNA, 20 bp, Homo sapiens
tagcttttgtgggggactgt

SEQ ID NO: 2436701 - DNA, 21 bp, Homo sapiens
taggaaatgtttttaataaaa

SEQ ID NO: 2436702 - DNA, 12 bp, Homo sapiens
taggaagaaaga

SEQ ID NO: 2436703 - DNA, 16 bp, Homo sapiens
taggaatggaaaggat

SEQ ID NO: 2436704 - DNA, 17 bp, Homo sapiens
taggaccaagcatcttg

SEQ ID NO: 2436705 - DNA, 14 bp, Homo sapiens
taggagctaaggct

SEQ ID NO: 2436706 - DNA, 16 bp, Homo sapiens
taggagctaaggctct

SEQ ID NO: 2436707 - DNA, 17 bp, Homo sapiens
taggagctaaggctcta

SEQ ID NO: 2436708 - DNA, 19 bp, Homo sapiens
taggagctttgactcagga

SEQ ID NO: 2436709 - DNA, 16 bp, Homo sapiens
taggagggtgggaagg

SEQ ID NO: 2436710 - DNA, 23 bp, Homo sapiens
taggagtttagggaacaatttgg

SEQ ID NO: 2436711 - DNA, 12 bp, Homo sapiens
taggattctaaa

SEQ ID NO: 2436712 - DNA, 14 bp, Homo sapiens
taggattctaaaat

SEQ ID NO: 2436713 - DNA, 16 bp, Homo sapiens
taggatttatttaaaa

SEQ ID NO: 2436714 - DNA, 21 bp, Homo sapiens
taggatttatttaaaatagca

SEQ ID NO: 2436715 - DNA, 12 bp, Homo sapiens
taggcaacatag

SEQ ID NO: 2436716 - DNA, 18 bp, Homo sapiens
taggcactgtagttctaa

SEQ ID NO: 2436717 - DNA, 21 bp, Homo sapiens
taggcactgtagttctaagac

SEQ ID NO: 2436718 - DNA, 21 bp, Homo sapiens
taggcatttttaccatcactg

SEQ ID NO: 2436719 - DNA, 21 bp, Homo sapiens
taggccaaggtgtcctacaga

SEQ ID NO: 2436720 - DNA, 23 bp, Homo sapiens
taggccaaggtgtcctacagaaa

SEQ ID NO: 2436721 - DNA, 13 bp, Homo sapiens
taggccagcaagc

SEQ ID NO: 2436722 - DNA, 22 bp, Homo sapiens
taggccagccgcgcatcagact

SEQ ID NO: 2436723 - DNA, 24 bp, Homo sapiens
taggccttgcggctcctcagggac

SEQ ID NO: 2436724 - DNA, 22 bp, Homo sapiens
taggcggggcttgccttctggt

SEQ ID NO: 2436725 - DNA, 16 bp, Homo sapiens
taggctatttgtaaat

SEQ ID NO: 2436726 - DNA, 18 bp, Homo sapiens
taggctatttgtaaatct

SEQ ID NO: 2436727 - DNA, 23 bp, Homo sapiens
taggctgacacctaactcttctt

SEQ ID NO: 2436728 - DNA, 21 bp, Homo sapiens
taggctgtaactactttataa

SEQ ID NO: 2436729 - DNA, 14 bp, Homo sapiens
tagggaacaatttg

SEQ ID NO: 2436730 - DNA, 15 bp, Homo sapiens
tagggatgcctcctt

SEQ ID NO: 2436731 - DNA, 21 bp, Homo sapiens
taggggaggggctcctttcca

SEQ ID NO: 2436732 - DNA, 15 bp, Homo sapiens
tagggggctggagga

SEQ ID NO: 2436733 - DNA, 18 bp, Homo sapiens
tagggggctggaggagcc

SEQ ID NO: 2436734 - DNA, 12 bp, Homo sapiens
tagggtaaatca

SEQ ID NO: 2436735 - DNA, 13 bp, Homo sapiens
tagggtaaatcag

SEQ ID NO: 2436736 - DNA, 17 bp, Homo sapiens
taggtctcatctcttca

SEQ ID NO: 2436737 - DNA, 19 bp, Homo sapiens
taggtgatccatgtaactg

SEQ ID NO: 2436738 - DNA, 21 bp, Homo sapiens
taggtgatccatgtaactgcc

SEQ ID NO: 2436739 - DNA, 22 bp, Homo sapiens
taggtgcaatttcaaggttcta

SEQ ID NO: 2436740 - DNA, 14 bp, Homo sapiens
taggttcagccaag

SEQ ID NO: 2436741 - DNA, 18 bp, Homo sapiens
taggttctaaagttctaa

SEQ ID NO: 2436742 - DNA, 21 bp, Homo sapiens
taggttctaaagttctaagat

SEQ ID NO: 2436743 - DNA, 22 bp, Homo sapiens
taggttctaaagttctaagatt

SEQ ID NO: 2436744 - DNA, 12 bp, Homo sapiens
taggttgcacac

SEQ ID NO: 2436745 - DNA, 11 bp, Homo sapiens
tagtaaaccaa

SEQ ID NO: 2436746 - DNA, 12 bp, Homo sapiens
tagtaaaccaat

SEQ ID NO: 2436747 - DNA, 22 bp, Homo sapiens
tagtaaaccaatcctatgcatg

SEQ ID NO: 2436748 - DNA, 15 bp, Homo sapiens
tagtaaataatgctt

SEQ ID NO: 2436749 - DNA, 16 bp, Homo sapiens
tagtaaataatgcttt

SEQ ID NO: 2436750 - DNA, 19 bp, Homo sapiens
tagtaaataatgctttgaa

SEQ ID NO: 2436751 - DNA, 22 bp, Homo sapiens
tagtaaatcacgctttttgaaa

SEQ ID NO: 2436752 - DNA, 17 bp, Homo sapiens
tagtaatctgcattatt

SEQ ID NO: 2436753 - DNA, 14 bp, Homo sapiens
tagtaattgacatg

SEQ ID NO: 2436754 - DNA, 16 bp, Homo sapiens
tagtaccaatcatttt

SEQ ID NO: 2436755 - DNA, 23 bp, Homo sapiens
tagtaccaatcattttaattatt

SEQ ID NO: 2436756 - DNA, 16 bp, Homo sapiens
tagtatggcctgtgtc

SEQ ID NO: 2436757 - DNA, 19 bp, Homo sapiens
tagtatggcctgtgtcact

SEQ ID NO: 2436758 - DNA, 13 bp, Homo sapiens
tagtattgttgtc

SEQ ID NO: 2436759 - DNA, 17 bp, Homo sapiens
tagtattgttgtccttt

SEQ ID NO: 2436760 - DNA, 18 bp, Homo sapiens
tagtattttttgtataat

SEQ ID NO: 2436761 - DNA, 19 bp, Homo sapiens
tagtcaatgacatgaattt

SEQ ID NO: 2436762 - DNA, 14 bp, Homo sapiens
tagtcttttgcttt

SEQ ID NO: 2436763 - DNA, 15 bp, Homo sapiens
tagtcttttgctttt

SEQ ID NO: 2436764 - DNA, 19 bp, Homo sapiens
tagtgaaggcttctctctg

SEQ ID NO: 2436765 - DNA, 15 bp, Homo sapiens
tagtggaaaaggcac

SEQ ID NO: 2436766 - DNA, 19 bp, Homo sapiens
tagtgtatgattactggcc

SEQ ID NO: 2436767 - DNA, 21 bp, Homo sapiens
tagttaagacatgatttcctt

SEQ ID NO: 2436768 - DNA, 23 bp, Homo sapiens
tagttaagacatgatttccttga

SEQ ID NO: 2436769 - DNA, 14 bp, Homo sapiens
tagttaccttatag

SEQ ID NO: 2436770 - DNA, 17 bp, Homo sapiens
tagttactgtgtaatta

SEQ ID NO: 2436771 - DNA, 19 bp, Homo sapiens
tagttatacttatttgtat

SEQ ID NO: 2436772 - DNA, 22 bp, Homo sapiens
tagttcatgtaaataatacatt

SEQ ID NO: 2436773 - DNA, 14 bp, Homo sapiens
tagttccactgaga

SEQ ID NO: 2436774 - DNA, 13 bp, Homo sapiens
tagttctaagact

SEQ ID NO: 2436775 - DNA, 15 bp, Homo sapiens
tagttctgctccaga

SEQ ID NO: 2436776 - DNA, 23 bp, Homo sapiens
tagttgaattttttttaacattc

SEQ ID NO: 2436777 - DNA, 22 bp, Homo sapiens
gagcccactccatctggtagaa

SEQ ID NO: 2436778 - DNA, 21 bp, Homo sapiens
gagcccagctctgaaaccagt

SEQ ID NO: 2436779 - DNA, 21 bp, Homo sapiens
gagcccagctgggtcaggcag

SEQ ID NO: 2436780 - DNA, 22 bp, Homo sapiens
gagcccagctgggtcaggcagg

SEQ ID NO: 2436781 - DNA, 13 bp, Homo sapiens
gagcccaggagct

SEQ ID NO: 2436782 - DNA, 17 bp, Homo sapiens
gagcccaggagctcccc

SEQ ID NO: 2436783 - DNA, 16 bp, Homo sapiens
gagcccaggccaggac

SEQ ID NO: 2436784 - DNA, 21 bp, Homo sapiens
gagcccaggccaggactctgc

SEQ ID NO: 2436785 - DNA, 11 bp, Homo sapiens
gagcccaggct

SEQ ID NO: 2436786 - DNA, 12 bp, Homo sapiens
gagcccaggctc

SEQ ID NO: 2436787 - DNA, 11 bp, Homo sapiens
gagcccaggga

SEQ ID NO: 2436788 - DNA, 20 bp, Homo sapiens
gagcccagggaggccgaagc

SEQ ID NO: 2436789 - DNA, 23 bp, Homo sapiens
gagccccagggagagggggctgg

SEQ ID NO: 2436790 - DNA, 14 bp, Homo sapiens
gagcccccagcctg

SEQ ID NO: 2436791 - DNA, 16 bp, Homo sapiens
gagcccccagcctgtc

SEQ ID NO: 2436792 - DNA, 12 bp, Homo sapiens
gagcccctccta

SEQ ID NO: 2436793 - DNA, 23 bp, Homo sapiens
gagccggccccaggctcgtggac

SEQ ID NO: 2436794 - DNA, 20 bp, Homo sapiens
gagccgggtggatcgcctga

SEQ ID NO: 2436795 - DNA, 19 bp, Homo sapiens
gagccgggtgtccccaaca

SEQ ID NO: 2436796 - DNA, 17 bp, Homo sapiens
gagccgtggtcctttgg

SEQ ID NO: 2436797 - DNA, 19 bp, Homo sapiens
gagcctcgcaacccgtgcc

SEQ ID NO: 2436798 - DNA, 23 bp, Homo sapiens
gagcctcgcaacccgtgccaagt

SEQ ID NO: 2436799 - DNA, 13 bp, Homo sapiens
gagcctgccgagc

SEQ ID NO: 2436800 - DNA, 11 bp, Homo sapiens
gagcctggggc

SEQ ID NO: 2436801 - DNA, 13 bp, Homo sapiens
gagcctggggctc

SEQ ID NO: 2436802 - DNA, 15 bp, Homo sapiens
gagcctgtaaacttt

SEQ ID NO: 2436803 - DNA, 15 bp, Homo sapiens
gagcctgtcctgcct

SEQ ID NO: 2436804 - DNA, 17 bp, Homo sapiens
gagcctgtgaacccagg

SEQ ID NO: 2436805 - DNA, 23 bp, Homo sapiens
gagcctgtgaacccaggacaagc

SEQ ID NO: 2436806 - DNA, 23 bp, Homo sapiens
gagcctgtgacataccccctccc

SEQ ID NO: 2436807 - DNA, 23 bp, Homo sapiens
gagccttttccctctttggctcc

SEQ ID NO: 2436808 - DNA, 19 bp, Homo sapiens
gagcgagagatcaaagatg

SEQ ID NO: 2436809 - DNA, 18 bp, Homo sapiens
gagcgaggagatgctcct

SEQ ID NO: 2436810 - DNA, 21 bp, Homo sapiens
gagcgaggagatgctccttgg

SEQ ID NO: 2436811 - DNA, 23 bp, Homo sapiens
gagcgagtggagtctgccaccca

SEQ ID NO: 2436812 - DNA, 13 bp, Homo sapiens
gaggccagcctgg

SEQ ID NO: 2436813 - DNA, 15 bp, Homo sapiens
gaggccagcctggcc

SEQ ID NO: 2436814 - DNA, 18 bp, Homo sapiens
gaggccagcctggcctcc

SEQ ID NO: 2436815 - DNA, 19 bp, Homo sapiens
gaggccatggactctgtcc

SEQ ID NO: 2436816 - DNA, 18 bp, Homo sapiens
gaggcccacattggaaga

SEQ ID NO: 2436817 - DNA, 17 bp, Homo sapiens
gaggcccaggctgccgt

SEQ ID NO: 2436818 - DNA, 23 bp, Homo sapiens
gaggcccaggctgggaactcatc

SEQ ID NO: 2436819 - DNA, 13 bp, Homo sapiens
gaggcccagttca

SEQ ID NO: 2436820 - DNA, 23 bp, Homo sapiens
gaggccccagcctccctgaagcc

SEQ ID NO: 2436821 - DNA, 19 bp, Homo sapiens
gaggcccccagcccagggc

SEQ ID NO: 2436822 - DNA, 20 bp, Homo sapiens
gaggcccccagcccagggct

SEQ ID NO: 2436823 - DNA, 21 bp, Homo sapiens
gaggcccccagcccagggctc

SEQ ID NO: 2436824 - DNA, 12 bp, Homo sapiens
gaggccctccac

SEQ ID NO: 2436825 - DNA, 17 bp, Homo sapiens
gaggccctccacacctg

SEQ ID NO: 2436826 - DNA, 19 bp, Homo sapiens
gaggccctccacacctgcg

SEQ ID NO: 2436827 - DNA, 14 bp, Homo sapiens
gaggccctggatca

SEQ ID NO: 2436828 - DNA, 16 bp, Homo sapiens
gaggcccttggcgggc

SEQ ID NO: 2436829 - DNA, 14 bp, Homo sapiens
gaggccgtggctgc

SEQ ID NO: 2436830 - DNA, 18 bp, Homo sapiens
gaggcctaggagggtcct

SEQ ID NO: 2436831 - DNA, 14 bp, Homo sapiens
gaggcctgcagggc

SEQ ID NO: 2436832 - DNA, 15 bp, Homo sapiens
gaggcctgcagggcc

SEQ ID NO: 2436833 - DNA, 16 bp, Homo sapiens
gaggcctgcagggcct

SEQ ID NO: 2436834 - DNA, 18 bp, Homo sapiens
gaggcctggactttcctg

SEQ ID NO: 2436835 - DNA, 19 bp, Homo sapiens
gaggcctggactttcctgc

SEQ ID NO: 2436836 - DNA, 14 bp, Homo sapiens
gaggcctgggccgc

SEQ ID NO: 2436837 - DNA, 20 bp, Homo sapiens
gaggcctgggccgctgccac

SEQ ID NO: 2436838 - DNA, 22 bp, Homo sapiens
gaggcctgggccgctgccacgt

SEQ ID NO: 2436839 - DNA, 13 bp, Homo sapiens
gaggcctgggctg

SEQ ID NO: 2436840 - DNA, 19 bp, Homo sapiens
gaggcctgtttggcctctc

SEQ ID NO: 2436841 - DNA, 17 bp, Homo sapiens
gaggctccagagggcac

SEQ ID NO: 2436842 - DNA, 19 bp, Homo sapiens
gaggctgaggcctggactt

SEQ ID NO: 2436843 - DNA, 15 bp, Homo sapiens
gaggctgaggctggc

SEQ ID NO: 2436844 - DNA, 16 bp, Homo sapiens
gaggctgaggctggca

SEQ ID NO: 2436845 - DNA, 21 bp, Homo sapiens
gaggctgctcggggtgcacag

SEQ ID NO: 2436846 - DNA, 24 bp, Homo sapiens
gaggctgctcggggtgcacaggag

SEQ ID NO: 2436847 - DNA, 15 bp, Homo sapiens
gaggctggtcctatg

SEQ ID NO: 2436848 - DNA, 12 bp, Homo sapiens
gaggctgtcctg

SEQ ID NO: 2436849 - DNA, 14 bp, Homo sapiens
gaggctttggattt

SEQ ID NO: 2436850 - DNA, 14 bp, Homo sapiens
gagggaagggagcc

SEQ ID NO: 2436851 - DNA, 20 bp, Homo sapiens
gagggaagggagccaaggga

SEQ ID NO: 2436852 - DNA, 14 bp, Homo sapiens
gagggaatgtgaaa

SEQ ID NO: 2436853 - DNA, 16 bp, Homo sapiens
gagggacaaaggagcc

SEQ ID NO: 2436854 - DNA, 22 bp, Homo sapiens
gagggacaaaggagcctgtgaa

SEQ ID NO: 2436855 - DNA, 23 bp, Homo sapiens
gagggacatgcttagcagtcccc

SEQ ID NO: 2436856 - DNA, 16 bp, Homo sapiens
gagggacgcctggggg

SEQ ID NO: 2436857 - DNA, 23 bp, Homo sapiens
gagggactgtcgctgcttcgtgg

SEQ ID NO: 2436858 - DNA, 18 bp, Homo sapiens
gagggattctggttccag

SEQ ID NO: 2436859 - DNA, 14 bp, Homo sapiens
gagggcagagctgg

SEQ ID NO: 2436860 - DNA, 16 bp, Homo sapiens
gagggcagagctggtg

SEQ ID NO: 2436861 - DNA, 13 bp, Homo sapiens
gagggcagcagcc

SEQ ID NO: 2436862 - DNA, 21 bp, Homo sapiens
gagggcagcagccagccctgc

SEQ ID NO: 2436863 - DNA, 23 bp, Homo sapiens
gagggcagttcgcagccaccctg

SEQ ID NO: 2436864 - DNA, 22 bp, Homo sapiens
gagggcctcaaaggcccgctct

SEQ ID NO: 2436865 - DNA, 13 bp, Homo sapiens
gagggcggcaggg

SEQ ID NO: 2436866 - DNA, 23 bp, Homo sapiens
gagggcggcaggggcctggagat

SEQ ID NO: 2436867 - DNA, 11 bp, Homo sapiens
gagggctctga

SEQ ID NO: 2436868 - DNA, 20 bp, Homo sapiens
gagggctggaggcccaggct

SEQ ID NO: 2436869 - DNA, 10 bp, Homo sapiens
gagggctggc

SEQ ID NO: 2436870 - DNA, 13 bp, Homo sapiens
gagggctggctgg

SEQ ID NO: 2436871 - DNA, 18 bp, Homo sapiens
gagggctggctggcctca

SEQ ID NO: 2436872 - DNA, 16 bp, Homo sapiens
gaggggaagaggcctg

SEQ ID NO: 2436873 - DNA, 14 bp, Homo sapiens
gaggggaccaggag

SEQ ID NO: 2436874 - DNA, 17 bp, Homo sapiens
gaggggaccaggagtgg

SEQ ID NO: 2436875 - DNA, 11 bp, Homo sapiens
gaggggagggg

SEQ ID NO: 2436876 - DNA, 13 bp, Homo sapiens
gaggggcctgcca

SEQ ID NO: 2436877 - DNA, 21 bp, Homo sapiens
gaggggcctgccacctggacc

SEQ ID NO: 2436878 - DNA, 17 bp, Homo sapiens
gagggggaatggcagca

SEQ ID NO: 2436879 - DNA, 18 bp, Homo sapiens
gagggggtcgtggagagc

SEQ ID NO: 2436880 - DNA, 14 bp, Homo sapiens
gagggtaggcagga

SEQ ID NO: 2436881 - DNA, 16 bp, Homo sapiens
gagggtgagttggctt

SEQ ID NO: 2436882 - DNA, 20 bp, Homo sapiens
gagggtggttcaacaaagaa

SEQ ID NO: 2436883 - DNA, 21 bp, Homo sapiens
gaggtcagcacatctcaacag

SEQ ID NO: 2436884 - DNA, 18 bp, Homo sapiens
gaggtccctgctgccagc

SEQ ID NO: 2436885 - DNA, 12 bp, Homo sapiens
gaggtcctgagc

SEQ ID NO: 2436886 - DNA, 16 bp, Homo sapiens
gaggtcctgagcactg

SEQ ID NO: 2436887 - DNA, 21 bp, Homo sapiens
gaggtcggtaggttcagccaa

SEQ ID NO: 2436888 - DNA, 22 bp, Homo sapiens
gaggtcggtaggttcagccaag

SEQ ID NO: 2436889 - DNA, 15 bp, Homo sapiens
gaggtgaccccaggg

SEQ ID NO: 2436890 - DNA, 22 bp, Homo sapiens
gaggtgaccccagggcacagga

SEQ ID NO: 2436891 - DNA, 16 bp, Homo sapiens
gaggtgcccaggagaa

SEQ ID NO: 2436892 - DNA, 21 bp, Homo sapiens
gaggtgcctgtcccaccccca

SEQ ID NO: 2436893 - DNA, 17 bp, Homo sapiens
gaggtgggccagtctgt

SEQ ID NO: 2436894 - DNA, 21 bp, Homo sapiens
gaggtgggccagtctgtggat

SEQ ID NO: 2436895 - DNA, 20 bp, Homo sapiens
gaggtgtctcaggctgcctg

SEQ ID NO: 2436896 - DNA, 16 bp, Homo sapiens
gaggtgtggagccgag

SEQ ID NO: 2436897 - DNA, 21 bp, Homo sapiens
gaggttttatttcatttttca

SEQ ID NO: 2436898 - DNA, 17 bp, Homo sapiens
gagtaacatttgctgtt

SEQ ID NO: 2436899 - DNA, 13 bp, Homo sapiens
gagtaatcaatct

SEQ ID NO: 2436900 - DNA, 14 bp, Homo sapiens
gagtaatggtgtag

SEQ ID NO: 2436901 - DNA, 17 bp, Homo sapiens
gagtaatggtgtagaac

SEQ ID NO: 2436902 - DNA, 22 bp, Homo sapiens
gagtaatggtgtagaacactaa

SEQ ID NO: 2436903 - DNA, 17 bp, Homo sapiens
gagtaattttggatttt

SEQ ID NO: 2436904 - DNA, 22 bp, Homo sapiens
gagtacccctgctttgggcttg

SEQ ID NO: 2436905 - DNA, 17 bp, Homo sapiens
gagtactccacactgca

SEQ ID NO: 2436906 - DNA, 20 bp, Homo sapiens
gagtactccacactgcacaa

SEQ ID NO: 2436907 - DNA, 13 bp, Homo sapiens
gagtagctgagct

SEQ ID NO: 2436908 - DNA, 22 bp, Homo sapiens
gagtattaaaatgtatgcatgt

SEQ ID NO: 2436909 - DNA, 20 bp, Homo sapiens
gagtcaaaacacttgtaatt

SEQ ID NO: 2436910 - DNA, 19 bp, Homo sapiens
gagtcaaatggtaggcatt

SEQ ID NO: 2436911 - DNA, 12 bp, Homo sapiens
gagtcacacagt

SEQ ID NO: 2436912 - DNA, 18 bp, Homo sapiens
gagtcattcgttctgtgg

SEQ ID NO: 2436913 - DNA, 12 bp, Homo sapiens
gagtccaagctg

SEQ ID NO: 2436914 - DNA, 18 bp, Homo sapiens
gagtcccaggttggctct

SEQ ID NO: 2436915 - DNA, 22 bp, Homo sapiens
gagtcccaggttggctctgcca

SEQ ID NO: 2436916 - DNA, 14 bp, Homo sapiens
gatctggaacccag

SEQ ID NO: 2436917 - DNA, 17 bp, Homo sapiens
gatctggaacccagact

SEQ ID NO: 2436918 - DNA, 18 bp, Homo sapiens
gatctggaacccagactc

SEQ ID NO: 2436919 - DNA, 12 bp, Homo sapiens
gatctggcatgt

SEQ ID NO: 2436920 - DNA, 14 bp, Homo sapiens
gatctgtcctcagc

SEQ ID NO: 2436921 - DNA, 17 bp, Homo sapiens
gatctgtcctcagcctt

SEQ ID NO: 2436922 - DNA, 18 bp, Homo sapiens
gatctgtcctcagccttg

SEQ ID NO: 2436923 - DNA, 13 bp, Homo sapiens
gatcttagattct

SEQ ID NO: 2436924 - DNA, 19 bp, Homo sapiens
gatcttggcttactgcagc

SEQ ID NO: 2436925 - DNA, 15 bp, Homo sapiens
gatcttttattttgc

SEQ ID NO: 2436926 - DNA, 20 bp, Homo sapiens
gatgaaaaattgctgactgt

SEQ ID NO: 2436927 - DNA, 21 bp, Homo sapiens
gatgaaaagtatattgataac

SEQ ID NO: 2436928 - DNA, 17 bp, Homo sapiens
gatgacccttttcatga

SEQ ID NO: 2436929 - DNA, 21 bp, Homo sapiens
gatgacctcgtactcaggagc

SEQ ID NO: 2436930 - DNA, 21 bp, Homo sapiens
gatgagctcccacaagcctga

SEQ ID NO: 2436931 - DNA, 13 bp, Homo sapiens
gatgaggcaaccc

SEQ ID NO: 2436932 - DNA, 19 bp, Homo sapiens
gatgaggccctccacacct

SEQ ID NO: 2436933 - DNA, 20 bp, Homo sapiens
gatgaggccctccacacctg

SEQ ID NO: 2436934 - DNA, 22 bp, Homo sapiens
gatgaggccctccacacctgcg

SEQ ID NO: 2436935 - DNA, 20 bp, Homo sapiens
gatgagggcagcagccagcc

SEQ ID NO: 2436936 - DNA, 19 bp, Homo sapiens
gatgataaagagacagtga

SEQ ID NO: 2436937 - DNA, 18 bp, Homo sapiens
gatgatacatccaaagca

SEQ ID NO: 2436938 - DNA, 20 bp, Homo sapiens
gatgatcaattatagtttct

SEQ ID NO: 2436939 - DNA, 23 bp, Homo sapiens
gatgattaaataagattctaacg

SEQ ID NO: 2436940 - DNA, 19 bp, Homo sapiens
gatgatttcagttctagga

SEQ ID NO: 2436941 - DNA, 15 bp, Homo sapiens
gatgcacttcaaatt

SEQ ID NO: 2436942 - DNA, 22 bp, Homo sapiens
gatgcacttcaaattcaaataa

SEQ ID NO: 2436943 - DNA, 23 bp, Homo sapiens
gatgcactttgctttaatataaa

SEQ ID NO: 2436944 - DNA, 14 bp, Homo sapiens
gatgcagctcaaga

SEQ ID NO: 2436945 - DNA, 15 bp, Homo sapiens
gatgcagcttatacg

SEQ ID NO: 2436946 - DNA, 16 bp, Homo sapiens
gatgcatttgggtcca

SEQ ID NO: 2436947 - DNA, 11 bp, Homo sapiens
gatgcccagag

SEQ ID NO: 2436948 - DNA, 16 bp, Homo sapiens
gatgcctccttcctct

SEQ ID NO: 2436949 - DNA, 19 bp, Homo sapiens
gatgctccaagattctaga

SEQ ID NO: 2436950 - DNA, 22 bp, Homo sapiens
gatgctccaagattctagatga

SEQ ID NO: 2436951 - DNA, 16 bp, Homo sapiens
gatgctccttgggccc

SEQ ID NO: 2436952 - DNA, 13 bp, Homo sapiens
gatgctgcccctc

SEQ ID NO: 2436953 - DNA, 12 bp, Homo sapiens
gatgctggccca

SEQ ID NO: 2436954 - DNA, 14 bp, Homo sapiens
gatgctggcccagg

SEQ ID NO: 2436955 - DNA, 16 bp, Homo sapiens
gatgctggcccagggc

SEQ ID NO: 2436956 - DNA, 16 bp, Homo sapiens
gatgcttgggaagact

SEQ ID NO: 2436957 - DNA, 13 bp, Homo sapiens
gatggacatcttg

SEQ ID NO: 2436958 - DNA, 15 bp, Homo sapiens
gatggagtttctaag

SEQ ID NO: 2436959 - DNA, 17 bp, Homo sapiens
gatggcagcttttaaaa

SEQ ID NO: 2436960 - DNA, 18 bp, Homo sapiens
gatggcagcttttaaaag

SEQ ID NO: 2436961 - DNA, 14 bp, Homo sapiens
gatggccagcccct

SEQ ID NO: 2436962 - DNA, 14 bp, Homo sapiens
gatggccccagcac

SEQ ID NO: 2436963 - DNA, 23 bp, Homo sapiens
gatggctcccaggggctccctcc

SEQ ID NO: 2436964 - DNA, 20 bp, Homo sapiens
gatgggagggaggctcaggt

SEQ ID NO: 2436965 - DNA, 20 bp, Homo sapiens
gatgggatggtggagggcca

SEQ ID NO: 2436966 - DNA, 20 bp, Homo sapiens
gatgggcatggtgttctcct

SEQ ID NO: 2436967 - DNA, 23 bp, Homo sapiens
gatggggcaggccacctggctct

SEQ ID NO: 2436968 - DNA, 19 bp, Homo sapiens
gatgggggaactcagatcc

SEQ ID NO: 2436969 - DNA, 21 bp, Homo sapiens
gatggtcttacagcaggcagt

SEQ ID NO: 2436970 - DNA, 14 bp, Homo sapiens
gatggtggagggcc

SEQ ID NO: 2436971 - DNA, 21 bp, Homo sapiens
gatggtgtctcttctttagaa

SEQ ID NO: 2436972 - DNA, 20 bp, Homo sapiens
gatgtaaaatcttgtcatgt

SEQ ID NO: 2436973 - DNA, 17 bp, Homo sapiens
gatgtaaggatgggcat

SEQ ID NO: 2436974 - DNA, 14 bp, Homo sapiens
gatgtaatacttct

SEQ ID NO: 2436975 - DNA, 13 bp, Homo sapiens
gatgtagtatttt

SEQ ID NO: 2436976 - DNA, 15 bp, Homo sapiens
gatgtcaatttctgt

SEQ ID NO: 2436977 - DNA, 15 bp, Homo sapiens
gatgtcatacagaga

SEQ ID NO: 2436978 - DNA, 16 bp, Homo sapiens
gatgtcatacagagaa

SEQ ID NO: 2436979 - DNA, 11 bp, Homo sapiens
gatgtccccag

SEQ ID NO: 2436980 - DNA, 13 bp, Homo sapiens
gatgtgaagccaa

SEQ ID NO: 2436981 - DNA, 18 bp, Homo sapiens
gatgtgatatataagtgt

SEQ ID NO: 2436982 - DNA, 15 bp, Homo sapiens
gatgtgattgtggaa

SEQ ID NO: 2436983 - DNA, 16 bp, Homo sapiens
gatgtgggttccacag

SEQ ID NO: 2436984 - DNA, 11 bp, Homo sapiens
gatgtgtcctg

SEQ ID NO: 2436985 - DNA, 17 bp, Homo sapiens
gatgtgtcctgacactg

SEQ ID NO: 2436986 - DNA, 22 bp, Homo sapiens
gatgtgtgttgatactgttgca

SEQ ID NO: 2436987 - DNA, 22 bp, Homo sapiens
gatgttaaaaaaataagaagaa

SEQ ID NO: 2436988 - DNA, 22 bp, Homo sapiens
gatgttctattttttgttttgt

SEQ ID NO: 2436989 - DNA, 18 bp, Homo sapiens
gatgttctggataccatt

SEQ ID NO: 2436990 - DNA, 14 bp, Homo sapiens
gatgtttattcttc

SEQ ID NO: 2436991 - DNA, 16 bp, Homo sapiens
gattacaaatcagaag

SEQ ID NO: 2436992 - DNA, 19 bp, Homo sapiens
gattacaaatcagaagtca

SEQ ID NO: 2436993 - DNA, 23 bp, Homo sapiens
gattacaaatcagaagtcatctt

SEQ ID NO: 2436994 - DNA, 14 bp, Homo sapiens
gattacaggcgtga

SEQ ID NO: 2436995 - DNA, 14 bp, Homo sapiens
gattacattttaaa

SEQ ID NO: 2436996 - DNA, 14 bp, Homo sapiens
gattacctcctgag

SEQ ID NO: 2436997 - DNA, 22 bp, Homo sapiens
gattactggcctttttcattta

SEQ ID NO: 2436998 - DNA, 15 bp, Homo sapiens
gattagaaattacct

SEQ ID NO: 2436999 - DNA, 14 bp, Homo sapiens
gattagacagaaca

SEQ ID NO: 2437000 - DNA, 18 bp, Homo sapiens
gattatagattctaaaga

SEQ ID NO: 2437001 - DNA, 20 bp, Homo sapiens
gattatcgttttcttaaagt

SEQ ID NO: 2437002 - DNA, 21 bp, Homo sapiens
gattatcgttttcttaaagtg

SEQ ID NO: 2437003 - DNA, 14 bp, Homo sapiens
gattatgggtcaca

SEQ ID NO: 2437004 - DNA, 17 bp, Homo sapiens
gattatgggtcacagga

SEQ ID NO: 2437005 - DNA, 14 bp, Homo sapiens
gattattcagtgtc

SEQ ID NO: 2437006 - DNA, 18 bp, Homo sapiens
gattcaaaggttctaggt

SEQ ID NO: 2437007 - DNA, 20 bp, Homo sapiens
gattcaggaaaaggcctggg

SEQ ID NO: 2437008 - DNA, 22 bp, Homo sapiens
gattcaggaaaaggcctggggt

SEQ ID NO: 2437009 - DNA, 15 bp, Homo sapiens
gattcagggaaagtg

SEQ ID NO: 2437010 - DNA, 20 bp, Homo sapiens
gattcagtgttaaatgtgat

SEQ ID NO: 2437011 - DNA, 19 bp, Homo sapiens
gattcatagtaacttctta

SEQ ID NO: 2437012 - DNA, 23 bp, Homo sapiens
gattccaaagagtagaattgcat

SEQ ID NO: 2437013 - DNA, 20 bp, Homo sapiens
gattccccatctcaggccag

SEQ ID NO: 2437014 - DNA, 22 bp, Homo sapiens
gattccggatcctaagcatcta

SEQ ID NO: 2437015 - DNA, 13 bp, Homo sapiens
gattccttcccat

SEQ ID NO: 2437016 - DNA, 13 bp, Homo sapiens
gattcctttaaca

SEQ ID NO: 2437017 - DNA, 11 bp, Homo sapiens
gattctaaaat

SEQ ID NO: 2437018 - DNA, 12 bp, Homo sapiens
gattctaaagat

SEQ ID NO: 2437019 - DNA, 13 bp, Homo sapiens
gattctaaagatt

SEQ ID NO: 2437020 - DNA, 21 bp, Homo sapiens
gcacactttggtaccagataa

SEQ ID NO: 2437021 - DNA, 19 bp, Homo sapiens
gcacagatggccagcccct

SEQ ID NO: 2437022 - DNA, 15 bp, Homo sapiens
gcacagcagcctggg

SEQ ID NO: 2437023 - DNA, 22 bp, Homo sapiens
gcacagcagcctggggctggcc

SEQ ID NO: 2437024 - DNA, 21 bp, Homo sapiens
gcacagcttgacctgaggctg

SEQ ID NO: 2437025 - DNA, 22 bp, Homo sapiens
gcacaggacatgcggtagccag

SEQ ID NO: 2437026 - DNA, 20 bp, Homo sapiens
gcacaggagctacctgtgtg

SEQ ID NO: 2437027 - DNA, 12 bp, Homo sapiens
gcacaggagggg

SEQ ID NO: 2437028 - DNA, 23 bp, Homo sapiens
gcacaggagggggtcgtggagag

SEQ ID NO: 2437029 - DNA, 12 bp, Homo sapiens
gcacagggtctg

SEQ ID NO: 2437030 - DNA, 15 bp, Homo sapiens
gcacagtatttgtaa

SEQ ID NO: 2437031 - DNA, 19 bp, Homo sapiens
gcacagtgacttctgagat

SEQ ID NO: 2437032 - DNA, 21 bp, Homo sapiens
gcacatctcaacaggcctcag

SEQ ID NO: 2437033 - DNA, 18 bp, Homo sapiens
gcacatctgtgtcttgtt

SEQ ID NO: 2437034 - DNA, 16 bp, Homo sapiens
gcacatgaacttagat

SEQ ID NO: 2437035 - DNA, 13 bp, Homo sapiens
gcacatgactcgg

SEQ ID NO: 2437036 - DNA, 12 bp, Homo sapiens
gcacatgtttcc

SEQ ID NO: 2437037 - DNA, 20 bp, Homo sapiens
gcaccaaatcaaaatctctc

SEQ ID NO: 2437038 - DNA, 22 bp, Homo sapiens
gcaccaaatcaaaatctctcca

SEQ ID NO: 2437039 - DNA, 17 bp, Homo sapiens
gcaccaccaagccaagg

SEQ ID NO: 2437040 - DNA, 19 bp, Homo sapiens
gcaccaccatgccaggcta

SEQ ID NO: 2437041 - DNA, 18 bp, Homo sapiens
gcaccagacacccaggac

SEQ ID NO: 2437042 - DNA, 21 bp, Homo sapiens
gcaccagacacccaggactta

SEQ ID NO: 2437043 - DNA, 18 bp, Homo sapiens
gcaccaggaagccgtcct

SEQ ID NO: 2437044 - DNA, 19 bp, Homo sapiens
gcaccaggggtttctcgca

SEQ ID NO: 2437045 - DNA, 16 bp, Homo sapiens
gcaccatgctgctggg

SEQ ID NO: 2437046 - DNA, 15 bp, Homo sapiens
gcaccattctgactc

SEQ ID NO: 2437047 - DNA, 17 bp, Homo sapiens
gcaccattctgactcgg

SEQ ID NO: 2437048 - DNA, 12 bp, Homo sapiens
gcacccccagcc

SEQ ID NO: 2437049 - DNA, 15 bp, Homo sapiens
gcacccccagcctgg

SEQ ID NO: 2437050 - DNA, 19 bp, Homo sapiens
gcacccccagcctgggcct

SEQ ID NO: 2437051 - DNA, 21 bp, Homo sapiens
gcacccccagcctgggcctat

SEQ ID NO: 2437052 - DNA, 13 bp, Homo sapiens
gcaccccctgcag

SEQ ID NO: 2437053 - DNA, 24 bp, Homo sapiens
gcaccccctgcagcttgtagccag

SEQ ID NO: 2437054 - DNA, 21 bp, Homo sapiens
gcaccctagttctacctcagg

SEQ ID NO: 2437055 - DNA, 23 bp, Homo sapiens
gcaccgaagcccagagggtctgg

SEQ ID NO: 2437056 - DNA, 14 bp, Homo sapiens
gcaccggaccagcc

SEQ ID NO: 2437057 - DNA, 16 bp, Homo sapiens
gcaccggaccagcctg

SEQ ID NO: 2437058 - DNA, 22 bp, Homo sapiens
gcacctaatccaggcagatcca

SEQ ID NO: 2437059 - DNA, 23 bp, Homo sapiens
gcacctaatccaggcagatccag

SEQ ID NO: 2437060 - DNA, 15 bp, Homo sapiens
gcacctcccttgggc

SEQ ID NO: 2437061 - DNA, 12 bp, Homo sapiens
gcacctcctcag

SEQ ID NO: 2437062 - DNA, 14 bp, Homo sapiens
gcacctcctcagcc

SEQ ID NO: 2437063 - DNA, 15 bp, Homo sapiens
gcacctcctcagcct

SEQ ID NO: 2437064 - DNA, 17 bp, Homo sapiens
gcacctcctcagcctga

SEQ ID NO: 2437065 - DNA, 18 bp, Homo sapiens
gcacctgggccctggggc

SEQ ID NO: 2437066 - DNA, 20 bp, Homo sapiens
gcacctgggccctggggcct

SEQ ID NO: 2437067 - DNA, 16 bp, Homo sapiens
gcacgaccgccccagt

SEQ ID NO: 2437068 - DNA, 18 bp, Homo sapiens
gcacggagccgcgggaca

SEQ ID NO: 2437069 - DNA, 18 bp, Homo sapiens
gcacggctctgtccccag

SEQ ID NO: 2437070 - DNA, 19 bp, Homo sapiens
gcacggctctgtccccagc

SEQ ID NO: 2437071 - DNA, 18 bp, Homo sapiens
gcacgggtgtcacggcca

SEQ ID NO: 2437072 - DNA, 23 bp, Homo sapiens
gcacgggtgtcacggccaggcag

SEQ ID NO: 2437073 - DNA, 21 bp, Homo sapiens
gcacgtaaagtacttgtagtt

SEQ ID NO: 2437074 - DNA, 14 bp, Homo sapiens
gcacgtggcctctt

SEQ ID NO: 2437075 - DNA, 19 bp, Homo sapiens
gcacgtggcctcttgagca

SEQ ID NO: 2437076 - DNA, 19 bp, Homo sapiens
gcactaacgttgagcccct

SEQ ID NO: 2437077 - DNA, 18 bp, Homo sapiens
gcactagccaaacctcac

SEQ ID NO: 2437078 - DNA, 18 bp, Homo sapiens
gcactatctttcagctcc

SEQ ID NO: 2437079 - DNA, 19 bp, Homo sapiens
gcactatctttcagctcca

SEQ ID NO: 2437080 - DNA, 22 bp, Homo sapiens
gcactcccacctgacacaccag

SEQ ID NO: 2437081 - DNA, 22 bp, Homo sapiens
gcactgaaagtcacggctgcgc

SEQ ID NO: 2437082 - DNA, 21 bp, Homo sapiens
gcactgaataaattgtacagc

SEQ ID NO: 2437083 - DNA, 18 bp, Homo sapiens
gcactgatgctgcccctc

SEQ ID NO: 2437084 - DNA, 17 bp, Homo sapiens
gcactgcacctgcctcc

SEQ ID NO: 2437085 - DNA, 21 bp, Homo sapiens
gcactgcacctgcctccagcc

SEQ ID NO: 2437086 - DNA, 23 bp, Homo sapiens
gcactgcacctgcctccagccgc

SEQ ID NO: 2437087 - DNA, 21 bp, Homo sapiens
gcactgcccatggacaggctg

SEQ ID NO: 2437088 - DNA, 12 bp, Homo sapiens
gcactgccctgg

SEQ ID NO: 2437089 - DNA, 19 bp, Homo sapiens
gcactgccctggtggccct

SEQ ID NO: 2437090 - DNA, 18 bp, Homo sapiens
gcactgggaggctcccct

SEQ ID NO: 2437091 - DNA, 19 bp, Homo sapiens
gcactggggagcccgtctc

SEQ ID NO: 2437092 - DNA, 22 bp, Homo sapiens
gcactggggagcccgtctcagt

SEQ ID NO: 2437093 - DNA, 17 bp, Homo sapiens
gcactgtcccttgcctc

SEQ ID NO: 2437094 - DNA, 14 bp, Homo sapiens
gcactgtgaaggac

SEQ ID NO: 2437095 - DNA, 17 bp, Homo sapiens
gcactgtgaaggaccct

SEQ ID NO: 2437096 - DNA, 19 bp, Homo sapiens
gcactgttccccctgtgca

SEQ ID NO: 2437097 - DNA, 20 bp, Homo sapiens
gcactgttccccctgtgcag

SEQ ID NO: 2437098 - DNA, 22 bp, Homo sapiens
gcacttgcggttccggcatgga

SEQ ID NO: 2437099 - DNA, 21 bp, Homo sapiens
gcacttggggcaccttgctcc

SEQ ID NO: 2437100 - DNA, 17 bp, Homo sapiens
gcactttgctttaatat

SEQ ID NO: 2437101 - DNA, 21 bp, Homo sapiens
gcactttgctttaatataaat

SEQ ID NO: 2437102 - DNA, 13 bp, Homo sapiens
gcagaaagtgcct

SEQ ID NO: 2437103 - DNA, 20 bp, Homo sapiens
gcagaaagtgcctttcagga

SEQ ID NO: 2437104 - DNA, 19 bp, Homo sapiens
gcagaaccggagagccagc

SEQ ID NO: 2437105 - DNA, 16 bp, Homo sapiens
gcagaagcagcaactt

SEQ ID NO: 2437106 - DNA, 23 bp, Homo sapiens
gcagaagggggtctcttcttcca

SEQ ID NO: 2437107 - DNA, 22 bp, Homo sapiens
gcagacagagccaggagaagct

SEQ ID NO: 2437108 - DNA, 14 bp, Homo sapiens
gcagaccctgccct

SEQ ID NO: 2437109 - DNA, 14 bp, Homo sapiens
gcagacgtccatca

SEQ ID NO: 2437110 - DNA, 16 bp, Homo sapiens
gcagacttcccagcta

SEQ ID NO: 2437111 - DNA, 13 bp, Homo sapiens
gcagagctggctc

SEQ ID NO: 2437112 - DNA, 23 bp, Homo sapiens
gcagagctggctctgagcgcctc

SEQ ID NO: 2437113 - DNA, 12 bp, Homo sapiens
gcagagctggtg

SEQ ID NO: 2437114 - DNA, 13 bp, Homo sapiens
gcagagctggtgc

SEQ ID NO: 2437115 - DNA, 21 bp, Homo sapiens
gcagagctggtgcggctggcc

SEQ ID NO: 2437116 - DNA, 20 bp, Homo sapiens
gcagaggcccaggctgccgt

SEQ ID NO: 2437117 - DNA, 18 bp, Homo sapiens
gcagaggcctgcagggcc

SEQ ID NO: 2437118 - DNA, 23 bp, Homo sapiens
gcagaggcctgcagggcctctgt

SEQ ID NO: 2437119 - DNA, 14 bp, Homo sapiens
gcagaggcctgggc

SEQ ID NO: 2437120 - DNA, 20 bp, Homo sapiens
gcagaggcctgggctgggaa

SEQ ID NO: 2437121 - DNA, 19 bp, Homo sapiens
gcagagggctggaggccca

SEQ ID NO: 2437122 - DNA, 24 bp, Homo sapiens
gcagagggctggaggcccaggctg

SEQ ID NO: 2437123 - DNA, 19 bp, Homo sapiens
gcataggtgatccatgtaa

SEQ ID NO: 2437124 - DNA, 19 bp, Homo sapiens
gcatatgagtaagggcact

SEQ ID NO: 2437125 - DNA, 19 bp, Homo sapiens
gcatatgttgaatactttt

SEQ ID NO: 2437126 - DNA, 21 bp, Homo sapiens
gcatatgttgaatacttttta

SEQ ID NO: 2437127 - DNA, 23 bp, Homo sapiens
gcatcacttaacggaccaaagca

SEQ ID NO: 2437128 - DNA, 13 bp, Homo sapiens
gcatcagaaagag

SEQ ID NO: 2437129 - DNA, 18 bp, Homo sapiens
gcatcagaaagggagggc

SEQ ID NO: 2437130 - DNA, 18 bp, Homo sapiens
gcatcatgcctctgaggc

SEQ ID NO: 2437131 - DNA, 20 bp, Homo sapiens
gcatcatgcctctgaggcca

SEQ ID NO: 2437132 - DNA, 19 bp, Homo sapiens
gcatcattatttatgtatt

SEQ ID NO: 2437133 - DNA, 17 bp, Homo sapiens
gcatccgcaggtgctgg

SEQ ID NO: 2437134 - DNA, 20 bp, Homo sapiens
gcatccgcaggtgctggtcc

SEQ ID NO: 2437135 - DNA, 18 bp, Homo sapiens
gcatcctccacaatagca

SEQ ID NO: 2437136 - DNA, 13 bp, Homo sapiens
gcatcctccagcc

SEQ ID NO: 2437137 - DNA, 21 bp, Homo sapiens
gcatctcaaaacagagggctg

SEQ ID NO: 2437138 - DNA, 17 bp, Homo sapiens
gcatctcagtatgaatt

SEQ ID NO: 2437139 - DNA, 12 bp, Homo sapiens
gcatctcccaga

SEQ ID NO: 2437140 - DNA, 13 bp, Homo sapiens
gcatctcccagat

SEQ ID NO: 2437141 - DNA, 21 bp, Homo sapiens
gcatctcccagataatgtgaa

SEQ ID NO: 2437142 - DNA, 18 bp, Homo sapiens
gcatctctaccttctccc

SEQ ID NO: 2437143 - DNA, 16 bp, Homo sapiens
gcatctctgggctgga

SEQ ID NO: 2437144 - DNA, 15 bp, Homo sapiens
gcatctggagagaac

SEQ ID NO: 2437145 - DNA, 15 bp, Homo sapiens
gcatctggcctggcc

SEQ ID NO: 2437146 - DNA, 18 bp, Homo sapiens
gcatctggcctggccagt

SEQ ID NO: 2437147 - DNA, 19 bp, Homo sapiens
gcatctggcctggccagtg

SEQ ID NO: 2437148 - DNA, 23 bp, Homo sapiens
gcatcttttgtattaagaaagga

SEQ ID NO: 2437149 - DNA, 22 bp, Homo sapiens
gcatgcactgttccccctgtgc

SEQ ID NO: 2437150 - DNA, 19 bp, Homo sapiens
gcatgcccagagacccagc

SEQ ID NO: 2437151 - DNA, 20 bp, Homo sapiens
gcatgcccagagacccagcg

SEQ ID NO: 2437152 - DNA, 19 bp, Homo sapiens
gcatggaaatttaaagcag

SEQ ID NO: 2437153 - DNA, 16 bp, Homo sapiens
gcatggaacacttcga

SEQ ID NO: 2437154 - DNA, 19 bp, Homo sapiens
gcatggaggaggagggagg

SEQ ID NO: 2437155 - DNA, 20 bp, Homo sapiens
gcatggcagggggctgctgc

SEQ ID NO: 2437156 - DNA, 18 bp, Homo sapiens
gcatggcatcctccagcc

SEQ ID NO: 2437157 - DNA, 16 bp, Homo sapiens
gcatggcgtggaggag

SEQ ID NO: 2437158 - DNA, 19 bp, Homo sapiens
gcatggtcccacatccctg

SEQ ID NO: 2437159 - DNA, 20 bp, Homo sapiens
gcatggtcccacatccctgg

SEQ ID NO: 2437160 - DNA, 15 bp, Homo sapiens
gcatggtgccccagg

SEQ ID NO: 2437161 - DNA, 16 bp, Homo sapiens
gcatggtgccccagga

SEQ ID NO: 2437162 - DNA, 21 bp, Homo sapiens
gcatggtgccccaggaccagc

SEQ ID NO: 2437163 - DNA, 14 bp, Homo sapiens
gcatggtttcagca

SEQ ID NO: 2437164 - DNA, 17 bp, Homo sapiens
gcatggtttcagcacta

SEQ ID NO: 2437165 - DNA, 21 bp, Homo sapiens
gcatgtaacgcaagttcccag

SEQ ID NO: 2437166 - DNA, 16 bp, Homo sapiens
gcatgtagtaacacta

SEQ ID NO: 2437167 - DNA, 22 bp, Homo sapiens
gcatgtagtaacactaatatat

SEQ ID NO: 2437168 - DNA, 15 bp, Homo sapiens
gcattagaattattt

SEQ ID NO: 2437169 - DNA, 18 bp, Homo sapiens
gcattatgcaatttttat

SEQ ID NO: 2437170 - DNA, 12 bp, Homo sapiens
gcattccagccc

SEQ ID NO: 2437171 - DNA, 15 bp, Homo sapiens
gcattccagcccctc

SEQ ID NO: 2437172 - DNA, 12 bp, Homo sapiens
gcattcccaggt

SEQ ID NO: 2437173 - DNA, 20 bp, Homo sapiens
gcattctgcctctctaggac

SEQ ID NO: 2437174 - DNA, 16 bp, Homo sapiens
gcattctggacctctg

SEQ ID NO: 2437175 - DNA, 16 bp, Homo sapiens
gcattgaaaagagctg

SEQ ID NO: 2437176 - DNA, 12 bp, Homo sapiens
gcattgaacaca

SEQ ID NO: 2437177 - DNA, 22 bp, Homo sapiens
gcattgaacacaaactgtaaat

SEQ ID NO: 2437178 - DNA, 21 bp, Homo sapiens
gcattgaatggctatgttttt

SEQ ID NO: 2437179 - DNA, 16 bp, Homo sapiens
gcattgactttcccca

SEQ ID NO: 2437180 - DNA, 16 bp, Homo sapiens
gcattggaactggagg

SEQ ID NO: 2437181 - DNA, 17 bp, Homo sapiens
gcattgtgattggcctg

SEQ ID NO: 2437182 - DNA, 13 bp, Homo sapiens
gcatttcctgggt

SEQ ID NO: 2437183 - DNA, 22 bp, Homo sapiens
gcatttgtttctttctctgagg

SEQ ID NO: 2437184 - DNA, 17 bp, Homo sapiens
gcatttgttttgtttac

SEQ ID NO: 2437185 - DNA, 23 bp, Homo sapiens
gcattttggagagtttcctgaaa

SEQ ID NO: 2437186 - DNA, 16 bp, Homo sapiens
gccaaaaaaaaataca

SEQ ID NO: 2437187 - DNA, 23 bp, Homo sapiens
gccaaacaaaaaggttctcaggt

SEQ ID NO: 2437188 - DNA, 15 bp, Homo sapiens
gccaaaccctgtctg

SEQ ID NO: 2437189 - DNA, 17 bp, Homo sapiens
gccaaacctcaccaact

SEQ ID NO: 2437190 - DNA, 16 bp, Homo sapiens
gccaaaggatgtgata

SEQ ID NO: 2437191 - DNA, 17 bp, Homo sapiens
gccaaaggatgtgatat

SEQ ID NO: 2437192 - DNA, 18 bp, Homo sapiens
gccaaaggggacctggaa

SEQ ID NO: 2437193 - DNA, 20 bp, Homo sapiens
gccaaaggggacctggaagg

SEQ ID NO: 2437194 - DNA, 15 bp, Homo sapiens
gccaaatatgtcctg

SEQ ID NO: 2437195 - DNA, 17 bp, Homo sapiens
gccaaatatgtcctggg

SEQ ID NO: 2437196 - DNA, 12 bp, Homo sapiens
gccaaattaaaa

SEQ ID NO: 2437197 - DNA, 16 bp, Homo sapiens
gccaaattaaaaaaga

SEQ ID NO: 2437198 - DNA, 18 bp, Homo sapiens
gccaactatgattattaa

SEQ ID NO: 2437199 - DNA, 21 bp, Homo sapiens
gccaagaaacgtcttctaaac

SEQ ID NO: 2437200 - DNA, 15 bp, Homo sapiens
gccaagaagcagtgg

SEQ ID NO: 2437201 - DNA, 16 bp, Homo sapiens
gccaagaagcagtggc

SEQ ID NO: 2437202 - DNA, 19 bp, Homo sapiens
gccaagaagcagtggcctt

SEQ ID NO: 2437203 - DNA, 14 bp, Homo sapiens
gccaagactgctgt

SEQ ID NO: 2437204 - DNA, 22 bp, Homo sapiens
gccaagactgctgtggccagga

SEQ ID NO: 2437205 - DNA, 15 bp, Homo sapiens
gccaagctgaggtgc

SEQ ID NO: 2437206 - DNA, 15 bp, Homo sapiens
gccaaggacctgaga

SEQ ID NO: 2437207 - DNA, 15 bp, Homo sapiens
gccaaggcagaggcc

SEQ ID NO: 2437208 - DNA, 18 bp, Homo sapiens
gccaagggaacctgtgtc

SEQ ID NO: 2437209 - DNA, 19 bp, Homo sapiens
gccaagggaacctgtgtcc

SEQ ID NO: 2437210 - DNA, 21 bp, Homo sapiens
gccaagggccgactaagagaa

SEQ ID NO: 2437211 - DNA, 13 bp, Homo sapiens
gccaaggtgtcct

SEQ ID NO: 2437212 - DNA, 18 bp, Homo sapiens
gccaaggtgtcctacaga

SEQ ID NO: 2437213 - DNA, 20 bp, Homo sapiens
gccaaggtgtcctacagaaa

SEQ ID NO: 2437214 - DNA, 23 bp, Homo sapiens
gccaaggtgtcctacagaaaaac

SEQ ID NO: 2437215 - DNA, 18 bp, Homo sapiens
gccaagtccaggtcctgg

SEQ ID NO: 2437216 - DNA, 18 bp, Homo sapiens
gccaatattaaatctgct

SEQ ID NO: 2437217 - DNA, 22 bp, Homo sapiens
gccaatattagtaggatttttg

SEQ ID NO: 2437218 - DNA, 15 bp, Homo sapiens
gccaattcagacagg

SEQ ID NO: 2437219 - DNA, 21 bp, Homo sapiens
gccacaatgaacatccctttt

SEQ ID NO: 2437220 - DNA, 14 bp, Homo sapiens
gccacacagctgcc

SEQ ID NO: 2437221 - DNA, 19 bp, Homo sapiens
gccacactcagcacaaggc

SEQ ID NO: 2437222 - DNA, 23 bp, Homo sapiens
gccacacttctcaggacacaggc

SEQ ID NO: 2437223 - DNA, 14 bp, Homo sapiens
gccacagccctgtc

SEQ ID NO: 2437224 - DNA, 13 bp, Homo sapiens
gccacagcttttg

SEQ ID NO: 2437225 - DNA, 14 bp, Homo sapiens
gccacatttggaat

SEQ ID NO: 2437226 - DNA, 14 bp, Homo sapiens
gccaccaagaggga

SEQ ID NO: 2437227 - DNA, 14 bp, Homo sapiens
gccatcacctcaga

SEQ ID NO: 2437228 - DNA, 16 bp, Homo sapiens
gccatctgctcctgga

SEQ ID NO: 2437229 - DNA, 23 bp, Homo sapiens
gccatgacaacttctaattgcca

SEQ ID NO: 2437230 - DNA, 14 bp, Homo sapiens
gccatgaccctgcc

SEQ ID NO: 2437231 - DNA, 22 bp, Homo sapiens
gccatgaccctgcctctcccag

SEQ ID NO: 2437232 - DNA, 23 bp, Homo sapiens
gccatgaccctgcctctcccagg

SEQ ID NO: 2437233 - DNA, 23 bp, Homo sapiens
gccatgagatgatacatccaaag

SEQ ID NO: 2437234 - DNA, 13 bp, Homo sapiens
gccatgatgcctc

SEQ ID NO: 2437235 - DNA, 16 bp, Homo sapiens
gccatgctcctcttcc

SEQ ID NO: 2437236 - DNA, 20 bp, Homo sapiens
gccatgctgaggcctgggcc

SEQ ID NO: 2437237 - DNA, 19 bp, Homo sapiens
gccatggactctgtcctga

SEQ ID NO: 2437238 - DNA, 14 bp, Homo sapiens
gccatggagaaagc

SEQ ID NO: 2437239 - DNA, 16 bp, Homo sapiens
gccatggagaaagctg

SEQ ID NO: 2437240 - DNA, 23 bp, Homo sapiens
gccatggcctgcaaactgggaac

SEQ ID NO: 2437241 - DNA, 14 bp, Homo sapiens
gccatgtccaaaga

SEQ ID NO: 2437242 - DNA, 19 bp, Homo sapiens
gccatgtccaaagaggctg

SEQ ID NO: 2437243 - DNA, 22 bp, Homo sapiens
gccatgtcttctccctggaatg

SEQ ID NO: 2437244 - DNA, 15 bp, Homo sapiens
gcccaaaggacgcac

SEQ ID NO: 2437245 - DNA, 19 bp, Homo sapiens
gcccaaaggacgcactgag

SEQ ID NO: 2437246 - DNA, 15 bp, Homo sapiens
gcccaagccagaggc

SEQ ID NO: 2437247 - DNA, 17 bp, Homo sapiens
gcccaagccagaggctg

SEQ ID NO: 2437248 - DNA, 15 bp, Homo sapiens
gcccaaggctcccgg

SEQ ID NO: 2437249 - DNA, 19 bp, Homo sapiens
gcccaagtgaggcagccga

SEQ ID NO: 2437250 - DNA, 13 bp, Homo sapiens
gcccacacctcct

SEQ ID NO: 2437251 - DNA, 22 bp, Homo sapiens
gcccaccccacccacttctgca

SEQ ID NO: 2437252 - DNA, 16 bp, Homo sapiens
gcccacccccggcagc

SEQ ID NO: 2437253 - DNA, 19 bp, Homo sapiens
gcccacgtacccaggtctg

SEQ ID NO: 2437254 - DNA, 20 bp, Homo sapiens
gcccactgtgcctcagagac

SEQ ID NO: 2437255 - DNA, 16 bp, Homo sapiens
gcccagaataagttat

SEQ ID NO: 2437256 - DNA, 20 bp, Homo sapiens
gcccagagacatacttgaag

SEQ ID NO: 2437257 - DNA, 23 bp, Homo sapiens
gcccagagacatacttgaagggc

SEQ ID NO: 2437258 - DNA, 23 bp, Homo sapiens
gcccagagacccagcggacacac

SEQ ID NO: 2437259 - DNA, 16 bp, Homo sapiens
gcccagagcccagctc

SEQ ID NO: 2437260 - DNA, 17 bp, Homo sapiens
gcccagagcccagctcc

SEQ ID NO: 2437261 - DNA, 19 bp, Homo sapiens
gcccagcacatgtgctgcc

SEQ ID NO: 2437262 - DNA, 21 bp, Homo sapiens
gcccagccaaaccctgtctga

SEQ ID NO: 2437263 - DNA, 17 bp, Homo sapiens
gcccagccccactcctc

SEQ ID NO: 2437264 - DNA, 19 bp, Homo sapiens
gcccagccgaccccctctc

SEQ ID NO: 2437265 - DNA, 21 bp, Homo sapiens
gcccagcggcttgcctgcctg

SEQ ID NO: 2437266 - DNA, 23 bp, Homo sapiens
gcccagctcctgacactgctgga

SEQ ID NO: 2437267 - DNA, 15 bp, Homo sapiens
gcccaggcactgcaa

SEQ ID NO: 2437268 - DNA, 19 bp, Homo sapiens
gcccaggccaggactctgc

SEQ ID NO: 2437269 - DNA, 20 bp, Homo sapiens
gcccaggccaggactctgca

SEQ ID NO: 2437270 - DNA, 22 bp, Homo sapiens
gcccaggccaggactctgcagc

SEQ ID NO: 2437271 - DNA, 23 bp, Homo sapiens
gcccaggccaggactctgcagcc

SEQ ID NO: 2437272 - DNA, 22 bp, Homo sapiens
gcccaggcccggatgcagaggc

SEQ ID NO: 2437273 - DNA, 12 bp, Homo sapiens
gcccaggcctca

SEQ ID NO: 2437274 - DNA, 20 bp, Homo sapiens
gcccaggctcggcctgcccc

SEQ ID NO: 2437275 - DNA, 16 bp, Homo sapiens
gcccaggctgccgtcc

SEQ ID NO: 2437276 - DNA, 18 bp, Homo sapiens
gcccaggctgccgtcccc

SEQ ID NO: 2437277 - DNA, 19 bp, Homo sapiens
gcccaggctggagtgcagt

SEQ ID NO: 2437278 - DNA, 15 bp, Homo sapiens
gcccaggctgggaac

SEQ ID NO: 2437279 - DNA, 21 bp, Homo sapiens
gcccagggaggccgaagctaa

SEQ ID NO: 2437280 - DNA, 20 bp, Homo sapiens
gcccagggctgggaggaagg

SEQ ID NO: 2437281 - DNA, 17 bp, Homo sapiens
gcccagtagaccttgtt

SEQ ID NO: 2437282 - DNA, 14 bp, Homo sapiens
gcccagttaatctt

SEQ ID NO: 2437283 - DNA, 23 bp, Homo sapiens
gcccatatgctaccaccagctgt

SEQ ID NO: 2437284 - DNA, 18 bp, Homo sapiens
gcccatccccaggcacct

SEQ ID NO: 2437285 - DNA, 22 bp, Homo sapiens
gcccatctgggggcctcttctg

SEQ ID NO: 2437286 - DNA, 23 bp, Homo sapiens
gcccatggacaggctggctccag

SEQ ID NO: 2437287 - DNA, 13 bp, Homo sapiens
gcccatggagatt

SEQ ID NO: 2437288 - DNA, 22 bp, Homo sapiens
gcccatggagattgacctggat

SEQ ID NO: 2437289 - DNA, 17 bp, Homo sapiens
gccccaacccgtggagg

SEQ ID NO: 2437290 - DNA, 21 bp, Homo sapiens
gccccaacccgtggaggctgc

SEQ ID NO: 2437291 - DNA, 20 bp, Homo sapiens
gccccaactccttccagcta

SEQ ID NO: 2437292 - DNA, 22 bp, Homo sapiens
gccccacaccagggccagcctc

SEQ ID NO: 2437293 - DNA, 18 bp, Homo sapiens
gccccaccccagggcagc

SEQ ID NO: 2437294 - DNA, 15 bp, Homo sapiens
gccccaccctgggcc

SEQ ID NO: 2437295 - DNA, 19 bp, Homo sapiens
gccccaccctgggccctgg

SEQ ID NO: 2437296 - DNA, 20 bp, Homo sapiens
gccccaccctgggccctggg

SEQ ID NO: 2437297 - DNA, 20 bp, Homo sapiens
gccccactcctctgctgacc

SEQ ID NO: 2437298 - DNA, 19 bp, Homo sapiens
gccccagcccagccccact

SEQ ID NO: 2437299 - DNA, 23 bp, Homo sapiens
gccccagcccagccccactcctc

SEQ ID NO: 2437300 - DNA, 16 bp, Homo sapiens
gccccagcctccctga

SEQ ID NO: 2437301 - DNA, 22 bp, Homo sapiens
gccccaggaaaggcccagccac

SEQ ID NO: 2437302 - DNA, 24 bp, Homo sapiens
gccccaggaccagctcaggacaga

SEQ ID NO: 2437303 - DNA, 20 bp, Homo sapiens
gccccaggacctggctgcca

SEQ ID NO: 2437304 - DNA, 14 bp, Homo sapiens
gccccatgacctcc

SEQ ID NO: 2437305 - DNA, 21 bp, Homo sapiens
gcccccaaccatttcctcaga

SEQ ID NO: 2437306 - DNA, 22 bp, Homo sapiens
gcccccaaccatttcctcagac

SEQ ID NO: 2437307 - DNA, 21 bp, Homo sapiens
gcccccaaggaggcagcctgg

SEQ ID NO: 2437308 - DNA, 18 bp, Homo sapiens
gcccccaccctgttcctg

SEQ ID NO: 2437309 - DNA, 18 bp, Homo sapiens
gcccccaccgtgggcagg

SEQ ID NO: 2437310 - DNA, 12 bp, Homo sapiens
gcccccactgac

SEQ ID NO: 2437311 - DNA, 14 bp, Homo sapiens
gcccccacttgcct

SEQ ID NO: 2437312 - DNA, 17 bp, Homo sapiens
gcccccacttgcctctt

SEQ ID NO: 2437313 - DNA, 11 bp, Homo sapiens
gcccccagagc

SEQ ID NO: 2437314 - DNA, 16 bp, Homo sapiens
gcccccagagcccagg

SEQ ID NO: 2437315 - DNA, 17 bp, Homo sapiens
gcccccagcccagggct

SEQ ID NO: 2437316 - DNA, 18 bp, Homo sapiens
gcccccagcccagggctc

SEQ ID NO: 2437317 - DNA, 21 bp, Homo sapiens
gcccccagcccagggctcctg

SEQ ID NO: 2437318 - DNA, 15 bp, Homo sapiens
gcccccagccccctc

SEQ ID NO: 2437319 - DNA, 12 bp, Homo sapiens
gcccccagcctg

SEQ ID NO: 2437320 - DNA, 13 bp, Homo sapiens
gcccccagcctgt

SEQ ID NO: 2437321 - DNA, 14 bp, Homo sapiens
gcccccagcctgtc

SEQ ID NO: 2437322 - DNA, 21 bp, Homo sapiens
gcccccagctaagaacctgga

SEQ ID NO: 2437323 - DNA, 23 bp, Homo sapiens
gcccccagctaagaacctggaac

SEQ ID NO: 2437324 - DNA, 19 bp, Homo sapiens
gcccccagggtcctgggag

SEQ ID NO: 2437325 - DNA, 14 bp, Homo sapiens
gcccccaggtaggg

SEQ ID NO: 2437326 - DNA, 18 bp, Homo sapiens
gcccccatcatcctctgg

SEQ ID NO: 2437327 - DNA, 19 bp, Homo sapiens
gcccccatcatcctctggc

SEQ ID NO: 2437328 - DNA, 16 bp, Homo sapiens
gccccccagcctctgg

SEQ ID NO: 2437329 - DNA, 12 bp, Homo sapiens
gcccccctggcc

SEQ ID NO: 2437330 - DNA, 20 bp, Homo sapiens
gccgtgctcgccccagcagg

SEQ ID NO: 2437331 - DNA, 21 bp, Homo sapiens
gccgtggattgcacgtggcct

SEQ ID NO: 2437332 - DNA, 23 bp, Homo sapiens
gccgtggggccgccgcctctttc

SEQ ID NO: 2437333 - DNA, 13 bp, Homo sapiens
gcctaagaggctg

SEQ ID NO: 2437334 - DNA, 16 bp, Homo sapiens
gcctagaaacaacact

SEQ ID NO: 2437335 - DNA, 18 bp, Homo sapiens
gcctagaaacaacactgt

SEQ ID NO: 2437336 - DNA, 15 bp, Homo sapiens
gcctaggagggtcct

SEQ ID NO: 2437337 - DNA, 13 bp, Homo sapiens
gcctaggattcta

SEQ ID NO: 2437338 - DNA, 14 bp, Homo sapiens
gcctaggattctaa

SEQ ID NO: 2437339 - DNA, 19 bp, Homo sapiens
gcctagtgaaggcttctct

SEQ ID NO: 2437340 - DNA, 17 bp, Homo sapiens
gcctatggagagccctg

SEQ ID NO: 2437341 - DNA, 18 bp, Homo sapiens
gcctatggagagccctgg

SEQ ID NO: 2437342 - DNA, 21 bp, Homo sapiens
gcctattatctgtcagctgca

SEQ ID NO: 2437343 - DNA, 19 bp, Homo sapiens
gcctattgctagagctcct

SEQ ID NO: 2437344 - DNA, 23 bp, Homo sapiens
gcctattgctagagctcctccct

SEQ ID NO: 2437345 - DNA, 22 bp, Homo sapiens
gcctcaaggttttaggttctaa

SEQ ID NO: 2437346 - DNA, 13 bp, Homo sapiens
gcctcagaagtgc

SEQ ID NO: 2437347 - DNA, 15 bp, Homo sapiens
gcctcagagaccagg

SEQ ID NO: 2437348 - DNA, 17 bp, Homo sapiens
gcctcagagaccagggc

SEQ ID NO: 2437349 - DNA, 18 bp, Homo sapiens
gcctcagagaccagggct

SEQ ID NO: 2437350 - DNA, 16 bp, Homo sapiens
gcctcagcctcccaag

SEQ ID NO: 2437351 - DNA, 15 bp, Homo sapiens
gcctcaggactggga

SEQ ID NO: 2437352 - DNA, 14 bp, Homo sapiens
gcctcagggctcct

SEQ ID NO: 2437353 - DNA, 20 bp, Homo sapiens
gcctcagtgaccctggctcc

SEQ ID NO: 2437354 - DNA, 19 bp, Homo sapiens
gcctcatgtcaaatattta

SEQ ID NO: 2437355 - DNA, 19 bp, Homo sapiens
gcctcatttttttccttgc

SEQ ID NO: 2437356 - DNA, 21 bp, Homo sapiens
gcctccagccgccggctgtgc

SEQ ID NO: 2437357 - DNA, 16 bp, Homo sapiens
gcctcccaaagtgctg

SEQ ID NO: 2437358 - DNA, 15 bp, Homo sapiens
gcctcccaaatgagc

SEQ ID NO: 2437359 - DNA, 15 bp, Homo sapiens
gcctcccatccaggg

SEQ ID NO: 2437360 - DNA, 20 bp, Homo sapiens
gcctcccccactttctttct

SEQ ID NO: 2437361 - DNA, 18 bp, Homo sapiens
gcctcccctctccttcct

SEQ ID NO: 2437362 - DNA, 15 bp, Homo sapiens
gcctcccctgccacc

SEQ ID NO: 2437363 - DNA, 16 bp, Homo sapiens
gcctcccctgccacca

SEQ ID NO: 2437364 - DNA, 19 bp, Homo sapiens
gcctcccctgccaccaggc

SEQ ID NO: 2437365 - DNA, 21 bp, Homo sapiens
gcctccccttaaaggggagac

SEQ ID NO: 2437366 - DNA, 15 bp, Homo sapiens
gcctccctctgctgt

SEQ ID NO: 2437367 - DNA, 12 bp, Homo sapiens
gcctccctgagc

SEQ ID NO: 2437368 - DNA, 14 bp, Homo sapiens
gcctcctccctccc

SEQ ID NO: 2437369 - DNA, 12 bp, Homo sapiens
gcctcctgcctc

SEQ ID NO: 2437370 - DNA, 14 bp, Homo sapiens
gcctccttcctctt

SEQ ID NO: 2437371 - DNA, 12 bp, Homo sapiens
gcctccttctga

SEQ ID NO: 2437372 - DNA, 18 bp, Homo sapiens
gcctccttctgagctcct

SEQ ID NO: 2437373 - DNA, 18 bp, Homo sapiens
gcctcgcaacccgtgcca

SEQ ID NO: 2437374 - DNA, 20 bp, Homo sapiens
gcctcgcaacccgtgccaag

SEQ ID NO: 2437375 - DNA, 13 bp, Homo sapiens
gcctcgcccctgg

SEQ ID NO: 2437376 - DNA, 18 bp, Homo sapiens
gcctcgcccctggcagag

SEQ ID NO: 2437377 - DNA, 16 bp, Homo sapiens
gcctcgctccccactc

SEQ ID NO: 2437378 - DNA, 18 bp, Homo sapiens
gcctcgctccccactctg

SEQ ID NO: 2437379 - DNA, 19 bp, Homo sapiens
gcctcgctccccactctgc

SEQ ID NO: 2437380 - DNA, 16 bp, Homo sapiens
gcctctactgggaagg

SEQ ID NO: 2437381 - DNA, 17 bp, Homo sapiens
gcctctactgggaaggc

SEQ ID NO: 2437382 - DNA, 23 bp, Homo sapiens
gcctctccccaggtccagctctg

SEQ ID NO: 2437383 - DNA, 14 bp, Homo sapiens
gcctctctacagtc

SEQ ID NO: 2437384 - DNA, 21 bp, Homo sapiens
gcctctctatcctctcttcct

SEQ ID NO: 2437385 - DNA, 12 bp, Homo sapiens
gcctctgaggcc

SEQ ID NO: 2437386 - DNA, 13 bp, Homo sapiens
gcctctgaggcca

SEQ ID NO: 2437387 - DNA, 15 bp, Homo sapiens
gcctctgaggccagc

SEQ ID NO: 2437388 - DNA, 17 bp, Homo sapiens
gcctctggggggtggcc

SEQ ID NO: 2437389 - DNA, 11 bp, Homo sapiens
gcctctgtgct

SEQ ID NO: 2437390 - DNA, 17 bp, Homo sapiens
gcctctgtgctgtgtgt

SEQ ID NO: 2437391 - DNA, 18 bp, Homo sapiens
gcctcttctgggagggca

SEQ ID NO: 2437392 - DNA, 15 bp, Homo sapiens
gcctcttgaccaggc

SEQ ID NO: 2437393 - DNA, 22 bp, Homo sapiens
gcctcttgaccaggctgcctcc

SEQ ID NO: 2437394 - DNA, 21 bp, Homo sapiens
gcctcttgagcagtggctggt

SEQ ID NO: 2437395 - DNA, 21 bp, Homo sapiens
gcctgacaaccactggtctgt

SEQ ID NO: 2437396 - DNA, 15 bp, Homo sapiens
gcctgacacactaac

SEQ ID NO: 2437397 - DNA, 16 bp, Homo sapiens
gcctgagcagtccttg

SEQ ID NO: 2437398 - DNA, 23 bp, Homo sapiens
gcctgagcagtccttggcctgct

SEQ ID NO: 2437399 - DNA, 13 bp, Homo sapiens
gcctgagcccagg

SEQ ID NO: 2437400 - DNA, 14 bp, Homo sapiens
gcctgagcccaggg

SEQ ID NO: 2437401 - DNA, 16 bp, Homo sapiens
gcctgagcccagggag

SEQ ID NO: 2437402 - DNA, 13 bp, Homo sapiens
gcctgagtcacct

SEQ ID NO: 2437403 - DNA, 20 bp, Homo sapiens
gcctgagtcgtgacctgcta

SEQ ID NO: 2437404 - DNA, 22 bp, Homo sapiens
gcctgagtcgtgacctgctagg

SEQ ID NO: 2437405 - DNA, 13 bp, Homo sapiens
gcctgcaaactgg

SEQ ID NO: 2437406 - DNA, 16 bp, Homo sapiens
gcctgcaaactgggaa

SEQ ID NO: 2437407 - DNA, 17 bp, Homo sapiens
gcctgcaaactgggaac

SEQ ID NO: 2437408 - DNA, 23 bp, Homo sapiens
gcctgcaaactgggaaccccttt

SEQ ID NO: 2437409 - DNA, 16 bp, Homo sapiens
gcctgcagaatttggg

SEQ ID NO: 2437410 - DNA, 16 bp, Homo sapiens
gcctgcaggatctcac

SEQ ID NO: 2437411 - DNA, 14 bp, Homo sapiens
gcctgcagggcctc

SEQ ID NO: 2437412 - DNA, 18 bp, Homo sapiens
gcctgcagggcctctgtc

SEQ ID NO: 2437413 - DNA, 23 bp, Homo sapiens
gcctgcataggagtttggaggaa

SEQ ID NO: 2437414 - DNA, 13 bp, Homo sapiens
gcctgccacctcc

SEQ ID NO: 2437415 - DNA, 12 bp, Homo sapiens
gcctgccacctg

SEQ ID NO: 2437416 - DNA, 15 bp, Homo sapiens
gcctgccacctggac

SEQ ID NO: 2437417 - DNA, 17 bp, Homo sapiens
gcctgccacctggaccc

SEQ ID NO: 2437418 - DNA, 15 bp, Homo sapiens
gcctgccagctgcac

SEQ ID NO: 2437419 - DNA, 21 bp, Homo sapiens
gcctgccaggaggacccaggg

SEQ ID NO: 2437420 - DNA, 12 bp, Homo sapiens
gcctgcccccac

SEQ ID NO: 2437421 - DNA, 21 bp, Homo sapiens
gcctgccctcatggcccctct

SEQ ID NO: 2437422 - DNA, 12 bp, Homo sapiens
gcctgccctggt

SEQ ID NO: 2437423 - DNA, 12 bp, Homo sapiens
gcctgcctcacc

SEQ ID NO: 2437424 - DNA, 14 bp, Homo sapiens
gcctgcctttccat

SEQ ID NO: 2437425 - DNA, 17 bp, Homo sapiens
gcctgctccagacctga

SEQ ID NO: 2437426 - DNA, 23 bp, Homo sapiens
gcctgctgctgagaacctggcct

SEQ ID NO: 2437427 - DNA, 20 bp, Homo sapiens
gcctggacctctgacagcag

SEQ ID NO: 2437428 - DNA, 21 bp, Homo sapiens
gcctggacctctgacagcagc

SEQ ID NO: 2437429 - DNA, 22 bp, Homo sapiens
gcctggacctctgacagcagca

SEQ ID NO: 2437430 - DNA, 17 bp, Homo sapiens
gcctggagacttagggc

SEQ ID NO: 2437431 - DNA, 19 bp, Homo sapiens
gcctggagacttagggcac

SEQ ID NO: 2437432 - DNA, 16 bp, Homo sapiens
gcctggagatcctcct

SEQ ID NO: 2437433 - DNA, 19 bp, Homo sapiens
gcctggagatcctcctgca

SEQ ID NO: 2437434 - DNA, 16 bp, Homo sapiens
aacaatacaaatggat

SEQ ID NO: 2437435 - DNA, 17 bp, Homo sapiens
aacaatgacaaagcaga

SEQ ID NO: 2437436 - DNA, 18 bp, Homo sapiens
aacaatgacaaagcagat

SEQ ID NO: 2437437 - DNA, 19 bp, Homo sapiens
aacaattctaaaatgattg

SEQ ID NO: 2437438 - DNA, 22 bp, Homo sapiens
aacaattgtgtagcctttttgt

SEQ ID NO: 2437439 - DNA, 18 bp, Homo sapiens
aacacaagattggtgttt

SEQ ID NO: 2437440 - DNA, 21 bp, Homo sapiens
aacacacaggtgcaacagact

SEQ ID NO: 2437441 - DNA, 19 bp, Homo sapiens
aacacactaccgaatgtgt

SEQ ID NO: 2437442 - DNA, 19 bp, Homo sapiens
aacacagaaacctttttaa

SEQ ID NO: 2437443 - DNA, 21 bp, Homo sapiens
aacacatttgctttttgtgat

SEQ ID NO: 2437444 - DNA, 14 bp, Homo sapiens
aacaccaagcacag

SEQ ID NO: 2437445 - DNA, 21 bp, Homo sapiens
aacaccaagcacagcagcctg

SEQ ID NO: 2437446 - DNA, 17 bp, Homo sapiens
aacaccttccagctcct

SEQ ID NO: 2437447 - DNA, 19 bp, Homo sapiens
aacacgcacctgcctcagg

SEQ ID NO: 2437448 - DNA, 13 bp, Homo sapiens
aacacggccacat

SEQ ID NO: 2437449 - DNA, 21 bp, Homo sapiens
aacacggccacatcaaagagg

SEQ ID NO: 2437450 - DNA, 18 bp, Homo sapiens
aacactaacatataatgt

SEQ ID NO: 2437451 - DNA, 23 bp, Homo sapiens
aacactaatatatttaaaaataa

SEQ ID NO: 2437452 - DNA, 17 bp, Homo sapiens
aacactaattcataatc

SEQ ID NO: 2437453 - DNA, 24 bp, Homo sapiens
aacactcagtggcccatggcattt

SEQ ID NO: 2437454 - DNA, 12 bp, Homo sapiens
aacactcttttg

SEQ ID NO: 2437455 - DNA, 16 bp, Homo sapiens
aacactcttttgcttt

SEQ ID NO: 2437456 - DNA, 23 bp, Homo sapiens
aacagaaaaatatgtaccaagaa

SEQ ID NO: 2437457 - DNA, 15 bp, Homo sapiens
aacagaaattgtata

SEQ ID NO: 2437458 - DNA, 18 bp, Homo sapiens
aacagaaattgtatattg

SEQ ID NO: 2437459 - DNA, 21 bp, Homo sapiens
aacagaagggagggcagagct

SEQ ID NO: 2437460 - DNA, 22 bp, Homo sapiens
aacagaagggagggcagagctg

SEQ ID NO: 2437461 - DNA, 19 bp, Homo sapiens
aacagagggctgcattcga

SEQ ID NO: 2437462 - DNA, 21 bp, Homo sapiens
aacagatctggaacctcagcc

SEQ ID NO: 2437463 - DNA, 19 bp, Homo sapiens
aacagcatctccaagcagc

SEQ ID NO: 2437464 - DNA, 19 bp, Homo sapiens
aacagccaactagcccctg

SEQ ID NO: 2437465 - DNA, 18 bp, Homo sapiens
aacagcctgacaacattt

SEQ ID NO: 2437466 - DNA, 13 bp, Homo sapiens
aacagcgcccaaa

SEQ ID NO: 2437467 - DNA, 19 bp, Homo sapiens
aacagcgttcctagagaag

SEQ ID NO: 2437468 - DNA, 16 bp, Homo sapiens
aacagctggtgtagct

SEQ ID NO: 2437469 - DNA, 17 bp, Homo sapiens
aacagctggtgtagcta

SEQ ID NO: 2437470 - DNA, 18 bp, Homo sapiens
aacaggcactgccctggt

SEQ ID NO: 2437471 - DNA, 13 bp, Homo sapiens
aacaggcacttgg

SEQ ID NO: 2437472 - DNA, 15 bp, Homo sapiens
aacaggcctcagggc

SEQ ID NO: 2437473 - DNA, 20 bp, Homo sapiens
aacaggcctcagggctcctt

SEQ ID NO: 2437474 - DNA, 15 bp, Homo sapiens
aacagggaaggcagg

SEQ ID NO: 2437475 - DNA, 18 bp, Homo sapiens
aacaggtatatactttga

SEQ ID NO: 2437476 - DNA, 14 bp, Homo sapiens
aacagttgcatgta

SEQ ID NO: 2437477 - DNA, 18 bp, Homo sapiens
aacagttgcatgtagtaa

SEQ ID NO: 2437478 - DNA, 20 bp, Homo sapiens
aacagttgcatgtagtaaca

SEQ ID NO: 2437479 - DNA, 22 bp, Homo sapiens
aacagttggtaacttttgtgaa

SEQ ID NO: 2437480 - DNA, 13 bp, Homo sapiens
aacagttgtattt

SEQ ID NO: 2437481 - DNA, 23 bp, Homo sapiens
aacagttgtatttaacagaaatt

SEQ ID NO: 2437482 - DNA, 21 bp, Homo sapiens
aacagttttttatgctaatca

SEQ ID NO: 2437483 - DNA, 21 bp, Homo sapiens
aacataccccttacaaatgaa

SEQ ID NO: 2437484 - DNA, 21 bp, Homo sapiens
aacatagacagaagaaacaag

SEQ ID NO: 2437485 - DNA, 21 bp, Homo sapiens
aacatctttgaaattatgtaa

SEQ ID NO: 2437486 - DNA, 15 bp, Homo sapiens
aacatgtaggaagta

SEQ ID NO: 2437487 - DNA, 19 bp, Homo sapiens
aacattcctcatgaatgta

SEQ ID NO: 2437488 - DNA, 21 bp, Homo sapiens
aacattggaatgttctcagat

SEQ ID NO: 2437489 - DNA, 14 bp, Homo sapiens
aacattgtagcctc

SEQ ID NO: 2437490 - DNA, 17 bp, Homo sapiens
aacatttattttgacat

SEQ ID NO: 2437491 - DNA, 19 bp, Homo sapiens
aacatttattttgacataa

SEQ ID NO: 2437492 - DNA, 16 bp, Homo sapiens
aacatttctcaataat

SEQ ID NO: 2437493 - DNA, 15 bp, Homo sapiens
aacatttgctgtttt

SEQ ID NO: 2437494 - DNA, 16 bp, Homo sapiens
aaccaacttttctatt

SEQ ID NO: 2437495 - DNA, 19 bp, Homo sapiens
aaccaagctgagtttccta

SEQ ID NO: 2437496 - DNA, 20 bp, Homo sapiens
aaccaatcctatgcatggtt

SEQ ID NO: 2437497 - DNA, 14 bp, Homo sapiens
aaccacatggcaca

SEQ ID NO: 2437498 - DNA, 17 bp, Homo sapiens
aaccacatggcacagag

SEQ ID NO: 2437499 - DNA, 20 bp, Homo sapiens
aaccactgaaaaaatatatg

SEQ ID NO: 2437500 - DNA, 20 bp, Homo sapiens
aaccactgcttccatttaat

SEQ ID NO: 2437501 - DNA, 23 bp, Homo sapiens
aaccagcacagcttagatttcat

SEQ ID NO: 2437502 - DNA, 17 bp, Homo sapiens
aaccagctcagcactgc

SEQ ID NO: 2437503 - DNA, 19 bp, Homo sapiens
aaccagcttccttcagaga

SEQ ID NO: 2437504 - DNA, 21 bp, Homo sapiens
aaccagcttccttcagagagc

SEQ ID NO: 2437505 - DNA, 22 bp, Homo sapiens
aaccagcttccttcagagagca

SEQ ID NO: 2437506 - DNA, 18 bp, Homo sapiens
aaccagtccccccaccct

SEQ ID NO: 2437507 - DNA, 22 bp, Homo sapiens
aaccagtccccccaccctcatt

SEQ ID NO: 2437508 - DNA, 14 bp, Homo sapiens
aaccatctccctgg

SEQ ID NO: 2437509 - DNA, 17 bp, Homo sapiens
aaccatgtagaaaattt

SEQ ID NO: 2437510 - DNA, 14 bp, Homo sapiens
aacccaatccaaat

SEQ ID NO: 2437511 - DNA, 23 bp, Homo sapiens
aacccagacctgttagcagacag

SEQ ID NO: 2437512 - DNA, 16 bp, Homo sapiens
aacccagcccaccccc

SEQ ID NO: 2437513 - DNA, 17 bp, Homo sapiens
aacccatattgtaaaac

SEQ ID NO: 2437514 - DNA, 14 bp, Homo sapiens
aaccccccagatat

SEQ ID NO: 2437515 - DNA, 16 bp, Homo sapiens
aaccccccagatatca

SEQ ID NO: 2437516 - DNA, 20 bp, Homo sapiens
aaccccggggtgcccacagg

SEQ ID NO: 2437517 - DNA, 21 bp, Homo sapiens
aacccctcccctccatccctg

SEQ ID NO: 2437518 - DNA, 23 bp, Homo sapiens
aacccgagtcattcgttctgtgg

SEQ ID NO: 2437519 - DNA, 13 bp, Homo sapiens
aacccgtggaggc

SEQ ID NO: 2437520 - DNA, 14 bp, Homo sapiens
aacccgtggaggct

SEQ ID NO: 2437521 - DNA, 19 bp, Homo sapiens
aaccctagccttgcttgtt

SEQ ID NO: 2437522 - DNA, 21 bp, Homo sapiens
aaccctatactgtagtattct

SEQ ID NO: 2437523 - DNA, 17 bp, Homo sapiens
aaggttttaggttctaa

SEQ ID NO: 2437524 - DNA, 19 bp, Homo sapiens
aaggttttaggttctaaag

SEQ ID NO: 2437525 - DNA, 23 bp, Homo sapiens
aaggttttaggttctaaagttct

SEQ ID NO: 2437526 - DNA, 13 bp, Homo sapiens
aagtaaaagcaaa

SEQ ID NO: 2437527 - DNA, 13 bp, Homo sapiens
aagtaaatacaat

SEQ ID NO: 2437528 - DNA, 17 bp, Homo sapiens
aagtacttgtagttcca

SEQ ID NO: 2437529 - DNA, 18 bp, Homo sapiens
aagtagaaacaaaataca

SEQ ID NO: 2437530 - DNA, 15 bp, Homo sapiens
aagtagatgcatttg

SEQ ID NO: 2437531 - DNA, 22 bp, Homo sapiens
aatgtgtagttcatgtaaataa

SEQ ID NO: 2437532 - DNA, 14 bp, Homo sapiens
aatgtgtataaaca

SEQ ID NO: 2437533 - DNA, 13 bp, Homo sapiens
aatgtgtctttag

SEQ ID NO: 2437534 - DNA, 15 bp, Homo sapiens
aatgtgtgtatatgg

SEQ ID NO: 2437535 - DNA, 12 bp, Homo sapiens
aatttcaaaatg

SEQ ID NO: 2437536 - DNA, 14 bp, Homo sapiens
aatttcaaggttct

SEQ ID NO: 2437537 - DNA, 18 bp, Homo sapiens
aatttcaaggttctaacc

SEQ ID NO: 2437538 - DNA, 13 bp, Homo sapiens
aatttcagactcc

SEQ ID NO: 2437539 - DNA, 14 bp, Homo sapiens
aatttcccaggacc

SEQ ID NO: 2437540 - DNA, 21 bp, Homo sapiens
aatttcccaggaccctgaagg

SEQ ID NO: 2437541 - DNA, 16 bp, Homo sapiens
aatttgacttttctgt

SEQ ID NO: 2437542 - DNA, 12 bp, Homo sapiens
aatttgattgat

SEQ ID NO: 2437543 - DNA, 14 bp, Homo sapiens
aatttgattgattt

SEQ ID NO: 2437544 - DNA, 15 bp, Homo sapiens
aatttgattgatttg

SEQ ID NO: 2437545 - DNA, 18 bp, Homo sapiens
aatttgcacagtgtgtga

SEQ ID NO: 2437546 - DNA, 15 bp, Homo sapiens
aatttgcattaaatt

SEQ ID NO: 2437547 - DNA, 17 bp, Homo sapiens
aatttgcattaaattca

SEQ ID NO: 2437548 - DNA, 15 bp, Homo sapiens
aatttgcctgctggg

SEQ ID NO: 2437549 - DNA, 17 bp, Homo sapiens
aatttgtagggtttcta

SEQ ID NO: 2437550 - DNA, 16 bp, Homo sapiens
aatttgttcttgtatt

SEQ ID NO: 2437551 - DNA, 12 bp, Homo sapiens
aatttgttgcat

SEQ ID NO: 2437552 - DNA, 20 bp, Homo sapiens
aattttacacgcttttgtga

SEQ ID NO: 2437553 - DNA, 15 bp, Homo sapiens
aattttagcttttgt

SEQ ID NO: 2437554 - DNA, 21 bp, Homo sapiens
aattttatactttccctaccc

SEQ ID NO: 2437555 - DNA, 14 bp, Homo sapiens
aattttatccctca

SEQ ID NO: 2437556 - DNA, 23 bp, Homo sapiens
aattttcctgtcctctttcagct

SEQ ID NO: 2437557 - DNA, 20 bp, Homo sapiens
aattttgaagtgctgtttat

SEQ ID NO: 2437558 - DNA, 17 bp, Homo sapiens
aattttgagttgccaca

SEQ ID NO: 2437559 - DNA, 17 bp, Homo sapiens
aattttgcctttaacag

SEQ ID NO: 2437560 - DNA, 17 bp, Homo sapiens
aattttgtgtaagaaat

SEQ ID NO: 2437561 - DNA, 18 bp, Homo sapiens
aattttgtgtaagaaata

SEQ ID NO: 2437562 - DNA, 16 bp, Homo sapiens
aatttttacagaattg

SEQ ID NO: 2437563 - DNA, 20 bp, Homo sapiens
aatttttccaactactaata

SEQ ID NO: 2437564 - DNA, 14 bp, Homo sapiens
aatttttcttcttg

SEQ ID NO: 2437565 - DNA, 16 bp, Homo sapiens
aatttttcttcttgag

SEQ ID NO: 2437566 - DNA, 14 bp, Homo sapiens
aatttttgtaattt

SEQ ID NO: 2437567 - DNA, 15 bp, Homo sapiens
aattttttaaaaagc

SEQ ID NO: 2437568 - DNA, 17 bp, Homo sapiens
aattttttataaaagtg

SEQ ID NO: 2437569 - DNA, 17 bp, Homo sapiens
aattttttgttgacatt

SEQ ID NO: 2437570 - DNA, 22 bp, Homo sapiens
aattttttgttgacattagtct

SEQ ID NO: 2437571 - DNA, 15 bp, Homo sapiens
aattttttttaacat

SEQ ID NO: 2437572 - DNA, 19 bp, Homo sapiens
aattttttttaacattcct

SEQ ID NO: 2437573 - DNA, 23 bp, Homo sapiens
aattttttttattagtattgttg

SEQ ID NO: 2437574 - DNA, 14 bp, Homo sapiens
acaaaaaaaaattt

SEQ ID NO: 2437575 - DNA, 20 bp, Homo sapiens
acaaaaagccacaatgaaca

SEQ ID NO: 2437576 - DNA, 19 bp, Homo sapiens
acaaaaccccccagatatc

SEQ ID NO: 2437577 - DNA, 15 bp, Homo sapiens
acaaaactacatgag

SEQ ID NO: 2437578 - DNA, 16 bp, Homo sapiens
acaaaatgtatgtctg

SEQ ID NO: 2437579 - DNA, 14 bp, Homo sapiens
acaaacatgaccct

SEQ ID NO: 2437580 - DNA, 11 bp, Homo sapiens
acaaactgaag

SEQ ID NO: 2437581 - DNA, 15 bp, Homo sapiens
acaaactgtgtaact

SEQ ID NO: 2437582 - DNA, 16 bp, Homo sapiens
acaaactgtgtaactg

SEQ ID NO: 2437583 - DNA, 15 bp, Homo sapiens
acaaactttgcatct

SEQ ID NO: 2437584 - DNA, 12 bp, Homo sapiens
acaaagcagcca

SEQ ID NO: 2437585 - DNA, 14 bp, Homo sapiens
acaaaggagcctgt

SEQ ID NO: 2437586 - DNA, 16 bp, Homo sapiens
acaaaggagcctgtga

SEQ ID NO: 2437587 - DNA, 17 bp, Homo sapiens
acaaaggtttaaatgaa

SEQ ID NO: 2437588 - DNA, 16 bp, Homo sapiens
acaaatactaaaaaga

SEQ ID NO: 2437589 - DNA, 16 bp, Homo sapiens
acaaatagaaaatggt

SEQ ID NO: 2437590 - DNA, 11 bp, Homo sapiens
acaaatgaaaa

SEQ ID NO: 2437591 - DNA, 18 bp, Homo sapiens
acaaatgccaaattaaaa

SEQ ID NO: 2437592 - DNA, 22 bp, Homo sapiens
acaaatgccaaattaaaaaaga

SEQ ID NO: 2437593 - DNA, 15 bp, Homo sapiens
acaaattagttatat

SEQ ID NO: 2437594 - DNA, 13 bp, Homo sapiens
acaacacccattt

SEQ ID NO: 2437595 - DNA, 19 bp, Homo sapiens
acaacatgtttccagcatt

SEQ ID NO: 2437596 - DNA, 22 bp, Homo sapiens
acaaccatgtcatttcagaagt

SEQ ID NO: 2437597 - DNA, 18 bp, Homo sapiens
acaacgtgctctttgttt

SEQ ID NO: 2437598 - DNA, 17 bp, Homo sapiens
acaactcactcctttta

SEQ ID NO: 2437599 - DNA, 22 bp, Homo sapiens
acaactgcctcgaaacacagaa

SEQ ID NO: 2437600 - DNA, 17 bp, Homo sapiens
acaactgctcccacctc

SEQ ID NO: 2437601 - DNA, 18 bp, Homo sapiens
acaagaaaaataaagaaa

SEQ ID NO: 2437602 - DNA, 20 bp, Homo sapiens
acaagaaaaataaagaaaag

SEQ ID NO: 2437603 - DNA, 19 bp, Homo sapiens
acaagaaaataagagctca

SEQ ID NO: 2437604 - DNA, 14 bp, Homo sapiens
acaagaagaagggc

SEQ ID NO: 2437605 - DNA, 15 bp, Homo sapiens
acaagagcactacat

SEQ ID NO: 2437606 - DNA, 19 bp, Homo sapiens
acaagattggtgttttttt

SEQ ID NO: 2437607 - DNA, 23 bp, Homo sapiens
acaagattggtgtttttttctat

SEQ ID NO: 2437608 - DNA, 13 bp, Homo sapiens
acaagcctctgcc

SEQ ID NO: 2437609 - DNA, 23 bp, Homo sapiens
acaagcctgagggaaaggccagc

SEQ ID NO: 2437610 - DNA, 17 bp, Homo sapiens
acaagcttctgtcctgc

SEQ ID NO: 2437611 - DNA, 18 bp, Homo sapiens
acaagcttctgtcctgcc

SEQ ID NO: 2437612 - DNA, 17 bp, Homo sapiens
acaaggatagatgctgg

SEQ ID NO: 2437613 - DNA, 22 bp, Homo sapiens
acaaggatagatgctggcccag

SEQ ID NO: 2437614 - DNA, 15 bp, Homo sapiens
acaaggcagcaaggc

SEQ ID NO: 2437615 - DNA, 16 bp, Homo sapiens
acaaggcagcaaggcc

SEQ ID NO: 2437616 - DNA, 23 bp, Homo sapiens
acaaggtcctctgtcagtcacag

SEQ ID NO: 2437617 - DNA, 17 bp, Homo sapiens
acaagtatttgttaatt

SEQ ID NO: 2437618 - DNA, 15 bp, Homo sapiens
acaagtatttttaat

SEQ ID NO: 2437619 - DNA, 19 bp, Homo sapiens
acaagtgccctccaggctt

SEQ ID NO: 2437620 - DNA, 14 bp, Homo sapiens
acaagtgctgaaca

SEQ ID NO: 2437621 - DNA, 16 bp, Homo sapiens
acaataaaacattaat

SEQ ID NO: 2437622 - DNA, 16 bp, Homo sapiens
acaataaatggctgta

SEQ ID NO: 2437623 - DNA, 12 bp, Homo sapiens
acaatacaaatg

SEQ ID NO: 2437624 - DNA, 14 bp, Homo sapiens
acaatacaaatgga

SEQ ID NO: 2437625 - DNA, 18 bp, Homo sapiens
acaatcagctccttcctg

SEQ ID NO: 2437626 - DNA, 24 bp, Homo sapiens
acaatgaacatccctttttcaatg

SEQ ID NO: 2437627 - DNA, 16 bp, Homo sapiens
acaatgacaaagcaga

SEQ ID NO: 2437628 - DNA, 20 bp, Homo sapiens
acaatgatcctgtattcaga

SEQ ID NO: 2437629 - DNA, 17 bp, Homo sapiens
acaatgtagataagtgt

SEQ ID NO: 2437630 - DNA, 20 bp, Homo sapiens
acaatgtagataagtgttct

SEQ ID NO: 2437631 - DNA, 20 bp, Homo sapiens
acaattaattatcttttcaa

SEQ ID NO: 2437632 - DNA, 16 bp, Homo sapiens
acaattactcaggttt

SEQ ID NO: 2437633 - DNA, 16 bp, Homo sapiens
acaattgaagtaaact

SEQ ID NO: 2437634 - DNA, 23 bp, Homo sapiens
acaattgtgtagcctttttgtat

SEQ ID NO: 2437635 - DNA, 18 bp, Homo sapiens
acaattttttttattagt

SEQ ID NO: 2437636 - DNA, 22 bp, Homo sapiens
acacaagaagaagggcacccta

SEQ ID NO: 2437637 - DNA, 23 bp, Homo sapiens
aataagcaggtggatctatttca

SEQ ID NO: 2437638 - DNA, 16 bp, Homo sapiens
aataagctatttgatg

SEQ ID NO: 2437639 - DNA, 12 bp, Homo sapiens
aataaggcaggg

SEQ ID NO: 2437640 - DNA, 20 bp, Homo sapiens
aataataaagaatagcttta

SEQ ID NO: 2437641 - DNA, 12 bp, Homo sapiens
aataatgctttg

SEQ ID NO: 2437642 - DNA, 13 bp, Homo sapiens
accaccagctgtg

SEQ ID NO: 2437643 - DNA, 20 bp, Homo sapiens
accaccagggcatctctggg

SEQ ID NO: 2437644 - DNA, 18 bp, Homo sapiens
accaccccgcctgccctc

SEQ ID NO: 2437645 - DNA, 13 bp, Homo sapiens
accaccctcactg

SEQ ID NO: 2437646 - DNA, 21 bp, Homo sapiens
accaccctgagccggccccag

SEQ ID NO: 2437647 - DNA, 18 bp, Homo sapiens
acctgaaaacactgtgca

SEQ ID NO: 2437648 - DNA, 17 bp, Homo sapiens
acctgagatttattaaa

SEQ ID NO: 2437649 - DNA, 18 bp, Homo sapiens
acctgagatttattaaag

SEQ ID NO: 2437650 - DNA, 10 bp, Homo sapiens
acctgagcct

SEQ ID NO: 2437651 - DNA, 14 bp, Homo sapiens
acctgagcctgccg

SEQ ID NO: 2437652 - DNA, 22 bp, Homo sapiens
acctgcaaagatctgtcctcag

SEQ ID NO: 2437653 - DNA, 16 bp, Homo sapiens
acctgcccccaatcca

SEQ ID NO: 2437654 - DNA, 15 bp, Homo sapiens
actctaagaaagaac

SEQ ID NO: 2437655 - DNA, 21 bp, Homo sapiens
actctaagatcttagattctc

SEQ ID NO: 2437656 - DNA, 20 bp, Homo sapiens
actctagagtccaaggttta

SEQ ID NO: 2437657 - DNA, 21 bp, Homo sapiens
actctagatgaagttttacat

SEQ ID NO: 2437658 - DNA, 14 bp, Homo sapiens
actctagattccat

SEQ ID NO: 2437659 - DNA, 20 bp, Homo sapiens
actctagtcaatgacatgaa

SEQ ID NO: 2437660 - DNA, 16 bp, Homo sapiens
actctatattgttcag

SEQ ID NO: 2437661 - DNA, 11 bp, Homo sapiens
agaacacagtt

SEQ ID NO: 2437662 - DNA, 22 bp, Homo sapiens
agaacagggaaaataggcagga

SEQ ID NO: 2437663 - DNA, 21 bp, Homo sapiens
agaacatagacagaagaaaca

SEQ ID NO: 2437664 - DNA, 20 bp, Homo sapiens
agaacatctgtataccctct

SEQ ID NO: 2437665 - DNA, 22 bp, Homo sapiens
agaacatgtgagaggtttgact

SEQ ID NO: 2437666 - DNA, 13 bp, Homo sapiens
agaaccaaatctg

SEQ ID NO: 2437667 - DNA, 19 bp, Homo sapiens
agaaccagtccccccaccc

SEQ ID NO: 2437668 - DNA, 13 bp, Homo sapiens
agaacctggcctt

SEQ ID NO: 2437669 - DNA, 21 bp, Homo sapiens
agaacctgggttgcagacagg

SEQ ID NO: 2437670 - DNA, 18 bp, Homo sapiens
agaaccttctctatgggg

SEQ ID NO: 2437671 - DNA, 20 bp, Homo sapiens
agaactcaaatggggccaga

SEQ ID NO: 2437672 - DNA, 14 bp, Homo sapiens
agaactctttcaaa

SEQ ID NO: 2437673 - DNA, 12 bp, Homo sapiens
agaactgcaggc

SEQ ID NO: 2437674 - DNA, 16 bp, Homo sapiens
agaactgcaggccctg

SEQ ID NO: 2437675 - DNA, 16 bp, Homo sapiens
agaacttcagaaagac

SEQ ID NO: 2437676 - DNA, 15 bp, Homo sapiens
agaacttgaccctga

SEQ ID NO: 2437677 - DNA, 18 bp, Homo sapiens
agaacttggatgtacctg

SEQ ID NO: 2437678 - DNA, 23 bp, Homo sapiens
agaacttggatgtacctgccccc

SEQ ID NO: 2437679 - DNA, 22 bp, Homo sapiens
agaagaatctcatctcagtgaa

SEQ ID NO: 2437680 - DNA, 19 bp, Homo sapiens
agaagaatgcttaatcaga

SEQ ID NO: 2437681 - DNA, 16 bp, Homo sapiens
agaagacaaactttgc

SEQ ID NO: 2437682 - DNA, 13 bp, Homo sapiens
agaagacaggctg

SEQ ID NO: 2437683 - DNA, 17 bp, Homo sapiens
agaagacctgagaatgt

SEQ ID NO: 2437684 - DNA, 21 bp, Homo sapiens
agaagcaacctcagtaattta

SEQ ID NO: 2437685 - DNA, 18 bp, Homo sapiens
agaagccaactatgatta

SEQ ID NO: 2437686 - DNA, 13 bp, Homo sapiens
agaagccagcttg

SEQ ID NO: 2437687 - DNA, 15 bp, Homo sapiens
agaagccagcttgtt

SEQ ID NO: 2437688 - DNA, 20 bp, Homo sapiens
agaagccagcttgtttacat

SEQ ID NO: 2437689 - DNA, 13 bp, Homo sapiens
agaagccaggaat

SEQ ID NO: 2437690 - DNA, 18 bp, Homo sapiens
agaagccatcacctcaga

SEQ ID NO: 2437691 - DNA, 20 bp, Homo sapiens
agaagccatcacctcagatg

SEQ ID NO: 2437692 - DNA, 12 bp, Homo sapiens
agaagcccccag

SEQ ID NO: 2437693 - DNA, 15 bp, Homo sapiens
agaagcccggctcct

SEQ ID NO: 2437694 - DNA, 17 bp, Homo sapiens
agaagcccggctcctgg

SEQ ID NO: 2437695 - DNA, 18 bp, Homo sapiens
agaagcccggctcctggt

SEQ ID NO: 2437696 - DNA, 20 bp, Homo sapiens
agaagcccgtgtgagaagtg

SEQ ID NO: 2437697 - DNA, 21 bp, Homo sapiens
agaagcctgatgctgacattc

SEQ ID NO: 2437698 - DNA, 11 bp, Homo sapiens
agaagcctggg

SEQ ID NO: 2437699 - DNA, 14 bp, Homo sapiens
agaagcctgggggc

SEQ ID NO: 2437700 - DNA, 18 bp, Homo sapiens
agaagcctgggggcctgg

SEQ ID NO: 2437701 - DNA, 20 bp, Homo sapiens
agaagcctgggggcctggct

SEQ ID NO: 2437702 - DNA, 21 bp, Homo sapiens
agaagcctgggggcctggctg

SEQ ID NO: 2437703 - DNA, 21 bp, Homo sapiens
agaagccttaatttgcacagt

SEQ ID NO: 2437704 - DNA, 17 bp, Homo sapiens
agaagccttcaagctct

SEQ ID NO: 2437705 - DNA, 18 bp, Homo sapiens
agaagccttcaagctctg

SEQ ID NO: 2437706 - DNA, 15 bp, Homo sapiens
agaagctcccccagc

SEQ ID NO: 2437707 - DNA, 16 bp, Homo sapiens
agaagctcccccagca

SEQ ID NO: 2437708 - DNA, 14 bp, Homo sapiens
agaagctcctctcc

SEQ ID NO: 2437709 - DNA, 23 bp, Homo sapiens
agaagctcctctccccagcccag

SEQ ID NO: 2437710 - DNA, 11 bp, Homo sapiens
agaaggcaaaa

SEQ ID NO: 2437711 - DNA, 15 bp, Homo sapiens
agaaggcaaaaatgt

SEQ ID NO: 2437712 - DNA, 18 bp, Homo sapiens
agaaggcatttgcagggt

SEQ ID NO: 2437713 - DNA, 12 bp, Homo sapiens
agaagggaaagc

SEQ ID NO: 2437714 - DNA, 21 bp, Homo sapiens
agaagggagggcagagctggt

SEQ ID NO: 2437715 - DNA, 22 bp, Homo sapiens
agaagggagggcagagctggtg

SEQ ID NO: 2437716 - DNA, 17 bp, Homo sapiens
agaagtcacagggcagt

SEQ ID NO: 2437717 - DNA, 16 bp, Homo sapiens
agaagtcatcttgcta

SEQ ID NO: 2437718 - DNA, 22 bp, Homo sapiens
agaagtctcagctaagctcacg

SEQ ID NO: 2437719 - DNA, 15 bp, Homo sapiens
agaagtctcttccag

SEQ ID NO: 2437720 - DNA, 17 bp, Homo sapiens
agaagtgaatgctggga

SEQ ID NO: 2437721 - DNA, 19 bp, Homo sapiens
agaagtgaatgctgggact

SEQ ID NO: 2437722 - DNA, 22 bp, Homo sapiens
agaagtgtggggattttcactg

SEQ ID NO: 2437723 - DNA, 18 bp, Homo sapiens
agaagttagtttgtatat

SEQ ID NO: 2437724 - DNA, 19 bp, Homo sapiens
agaagttagtttgtatata

SEQ ID NO: 2437725 - DNA, 16 bp, Homo sapiens
agaagtttgcactatc

SEQ ID NO: 2437726 - DNA, 15 bp, Homo sapiens
agaataaaggcagtt

SEQ ID NO: 2437727 - DNA, 18 bp, Homo sapiens
agaataaaggcagttttc

SEQ ID NO: 2437728 - DNA, 13 bp, Homo sapiens
agaataagttatt

SEQ ID NO: 2437729 - DNA, 20 bp, Homo sapiens
agaataagttattgcagttt

SEQ ID NO: 2437730 - DNA, 15 bp, Homo sapiens
agaatacttctcatt

SEQ ID NO: 2437731 - DNA, 19 bp, Homo sapiens
agaatacttctcatttttt

SEQ ID NO: 2437732 - DNA, 20 bp, Homo sapiens
agaatagccacatttggaat

SEQ ID NO: 2437733 - DNA, 21 bp, Homo sapiens
agaatagccacatttggaata

SEQ ID NO: 2437734 - DNA, 13 bp, Homo sapiens
agaatcagagaag

SEQ ID NO: 2437735 - DNA, 23 bp, Homo sapiens
agaatcagagaaggaacataccc

SEQ ID NO: 2437736 - DNA, 19 bp, Homo sapiens
agaatccacatttctaaaa

SEQ ID NO: 2437737 - DNA, 20 bp, Homo sapiens
agaatccacatttctaaaat

SEQ ID NO: 2437738 - DNA, 22 bp, Homo sapiens
agaatccacatttctaaaatct

SEQ ID NO: 2437739 - DNA, 20 bp, Homo sapiens
agaatcccttaacagttgta

SEQ ID NO: 2437740 - DNA, 17 bp, Homo sapiens
agaatcgaggtgctgtt

SEQ ID NO: 2437741 - DNA, 13 bp, Homo sapiens
agaatgctgtaca

SEQ ID NO: 2437742 - DNA, 14 bp, Homo sapiens
agaatgctgtacat

SEQ ID NO: 2437743 - DNA, 18 bp, Homo sapiens
agaatggctttggtctct

SEQ ID NO: 2437744 - DNA, 23 bp, Homo sapiens
agaatggctttggtctcttgctt

SEQ ID NO: 2437745 - DNA, 23 bp, Homo sapiens
agaatggtgtgggagagggatga

SEQ ID NO: 2437746 - DNA, 21 bp, Homo sapiens
agaatgtatccccaaaagcgt

SEQ ID NO: 2437747 - DNA, 20 bp, Homo sapiens
agaatgtcattttggtactt

SEQ ID NO: 2437748 - DNA, 14 bp, Homo sapiens
agaattaaactttt

SEQ ID NO: 2437749 - DNA, 22 bp, Homo sapiens
agaattaaacttttaattcatt

SEQ ID NO: 2437750 - DNA, 14 bp, Homo sapiens
agaattactgtaac

SEQ ID NO: 2437751 - DNA, 14 bp, Homo sapiens
agaattatctaatt

SEQ ID NO: 2437752 - DNA, 18 bp, Homo sapiens
agaattatctaatttata

SEQ ID NO: 2437753 - DNA, 21 bp, Homo sapiens
agaattatctaatttataaaa

SEQ ID NO: 2437754 - DNA, 15 bp, Homo sapiens
agaattattttgtga

SEQ ID NO: 2437755 - DNA, 17 bp, Homo sapiens
agaattgagtaatggtg

SEQ ID NO: 2437756 - DNA, 17 bp, Homo sapiens
agaattgagtgtttaaa

SEQ ID NO: 2437757 - DNA, 12 bp, Homo sapiens
agaattgtggtt

SEQ ID NO: 2437758 - DNA, 23 bp, Homo sapiens
agaattgtggtttatatatttaa

SEQ ID NO: 2437759 - DNA, 23 bp, Homo sapiens
agaattgtgtcagactgtttagt

SEQ ID NO: 2437760 - DNA, 16 bp, Homo sapiens
agacaacgtgctcttt

SEQ ID NO: 2437761 - DNA, 18 bp, Homo sapiens
agcagcaccgttctgtgc

SEQ ID NO: 2437762 - DNA, 16 bp, Homo sapiens
agcagcacctgcccta

SEQ ID NO: 2437763 - DNA, 17 bp, Homo sapiens
agcagcacctgccctac

SEQ ID NO: 2437764 - DNA, 20 bp, Homo sapiens
agcagcacctgccctacctg

SEQ ID NO: 2437765 - DNA, 18 bp, Homo sapiens
agcagcaggaggggggag

SEQ ID NO: 2437766 - DNA, 19 bp, Homo sapiens
agcagcatctctaccttct

SEQ ID NO: 2437767 - DNA, 11 bp, Homo sapiens
agcagccagcc

SEQ ID NO: 2437768 - DNA, 15 bp, Homo sapiens
agcagccagccctgc

SEQ ID NO: 2437769 - DNA, 22 bp, Homo sapiens
agcagccagccctgcctggagg

SEQ ID NO: 2437770 - DNA, 23 bp, Homo sapiens
agcagccccacaccagggccagc

SEQ ID NO: 2437771 - DNA, 14 bp, Homo sapiens
agcagcccccagct

SEQ ID NO: 2437772 - DNA, 20 bp, Homo sapiens
agcagcccccagctcccacc

SEQ ID NO: 2437773 - DNA, 17 bp, Homo sapiens
agcagcctcgcccctgg

SEQ ID NO: 2437774 - DNA, 23 bp, Homo sapiens
agcagcctcgcccctggcagaga

SEQ ID NO: 2437775 - DNA, 15 bp, Homo sapiens
agcagcctctcccca

SEQ ID NO: 2437776 - DNA, 21 bp, Homo sapiens
agcagcctctccccaggtcca

SEQ ID NO: 2437777 - DNA, 22 bp, Homo sapiens
agcagcctttctctctttatac

SEQ ID NO: 2437778 - DNA, 14 bp, Homo sapiens
agcagcgagcctgc

SEQ ID NO: 2437779 - DNA, 15 bp, Homo sapiens
agcagcgagcctgct

SEQ ID NO: 2437780 - DNA, 14 bp, Homo sapiens
agcagctgagcagg

SEQ ID NO: 2437781 - DNA, 18 bp, Homo sapiens
agcagctgagcagggccg

SEQ ID NO: 2437782 - DNA, 21 bp, Homo sapiens
agcagctgccaggagcacggc

SEQ ID NO: 2437783 - DNA, 23 bp, Homo sapiens
agcaggactccaggcccaaggct

SEQ ID NO: 2437784 - DNA, 21 bp, Homo sapiens
agcaggaggggggagggaagg

SEQ ID NO: 2437785 - DNA, 14 bp, Homo sapiens
agcaggcagccagc

SEQ ID NO: 2437786 - DNA, 19 bp, Homo sapiens
agcagggattaacctctgc

SEQ ID NO: 2437787 - DNA, 20 bp, Homo sapiens
agcagggattaacctctgca

SEQ ID NO: 2437788 - DNA, 14 bp, Homo sapiens
agcagggccgggga

SEQ ID NO: 2437789 - DNA, 22 bp, Homo sapiens
agcagggccggggaactggcca

SEQ ID NO: 2437790 - DNA, 19 bp, Homo sapiens
agcagggtgggcttgtggg

SEQ ID NO: 2437791 - DNA, 17 bp, Homo sapiens
agcaggttcccaagctc

SEQ ID NO: 2437792 - DNA, 23 bp, Homo sapiens
agcaggttcccaagctcagaggc

SEQ ID NO: 2437793 - DNA, 16 bp, Homo sapiens
agcagtccccttccct

SEQ ID NO: 2437794 - DNA, 22 bp, Homo sapiens
agcagtcctgcctcagcctccg

SEQ ID NO: 2437795 - DNA, 12 bp, Homo sapiens
agcagtccttgg

SEQ ID NO: 2437796 - DNA, 13 bp, Homo sapiens
agcagtccttggc

SEQ ID NO: 2437797 - DNA, 17 bp, Homo sapiens
agcagtcgtgcctgtgt

SEQ ID NO: 2437798 - DNA, 22 bp, Homo sapiens
agcagtggcaggcagaggccca

SEQ ID NO: 2437799 - DNA, 12 bp, Homo sapiens
agcagtggctgg

SEQ ID NO: 2437800 - DNA, 13 bp, Homo sapiens
agcagtggctggt

SEQ ID NO: 2437801 - DNA, 22 bp, Homo sapiens
agcagtggctggtccagggcta

SEQ ID NO: 2437802 - DNA, 21 bp, Homo sapiens
agcagtgtgaggccagggcag

SEQ ID NO: 2437803 - DNA, 23 bp, Homo sapiens
agcataggtgatccatgtaactg

SEQ ID NO: 2437804 - DNA, 15 bp, Homo sapiens
agcatatagattgtc

SEQ ID NO: 2437805 - DNA, 13 bp, Homo sapiens
agcatcacagaat

SEQ ID NO: 2437806 - DNA, 13 bp, Homo sapiens
agcatcatgcctc

SEQ ID NO: 2437807 - DNA, 21 bp, Homo sapiens
agcatcatgcctctgaggcca

SEQ ID NO: 2437808 - DNA, 23 bp, Homo sapiens
agcatcatgcctctgaggccagc

SEQ ID NO: 2437809 - DNA, 22 bp, Homo sapiens
agcatcggacaagacccccagc

SEQ ID NO: 2437810 - DNA, 12 bp, Homo sapiens
agcatctaagtt

SEQ ID NO: 2437811 - DNA, 19 bp, Homo sapiens
agcatctctaccttctccc

SEQ ID NO: 2437812 - DNA, 18 bp, Homo sapiens
agcatctgggccttggcc

SEQ ID NO: 2437813 - DNA, 19 bp, Homo sapiens
agcatctgggccttggcct

SEQ ID NO: 2437814 - DNA, 19 bp, Homo sapiens
agcatcttgggggggtggc

SEQ ID NO: 2437815 - DNA, 21 bp, Homo sapiens
agcatcttgggggggtggccg

SEQ ID NO: 2437816 - DNA, 20 bp, Homo sapiens
agcatgagagggatgaggca

SEQ ID NO: 2437817 - DNA, 17 bp, Homo sapiens
agcatggaacacttcga

SEQ ID NO: 2437818 - DNA, 21 bp, Homo sapiens
agcatggaggaggagggaggc

SEQ ID NO: 2437819 - DNA, 17 bp, Homo sapiens
agcatggctattttata

SEQ ID NO: 2437820 - DNA, 21 bp, Homo sapiens
agcatgtttagactttaacat

SEQ ID NO: 2437821 - DNA, 22 bp, Homo sapiens
agcatgtttagactttaacata

SEQ ID NO: 2437822 - DNA, 24 bp, Homo sapiens
agcatgtttagactttaacataag

SEQ ID NO: 2437823 - DNA, 14 bp, Homo sapiens
agcattcagaagaa

SEQ ID NO: 2437824 - DNA, 21 bp, Homo sapiens
agcattcagaagaaaaagaag

SEQ ID NO: 2437825 - DNA, 14 bp, Homo sapiens
agcattctcattgg

SEQ ID NO: 2437826 - DNA, 14 bp, Homo sapiens
agcattgtaaaata

SEQ ID NO: 2437827 - DNA, 20 bp, Homo sapiens
agcattgtaaaataattctg

SEQ ID NO: 2437828 - DNA, 21 bp, Homo sapiens
agcatttgacccttgctgtga

SEQ ID NO: 2437829 - DNA, 15 bp, Homo sapiens
agcattttaattctc

SEQ ID NO: 2437830 - DNA, 13 bp, Homo sapiens
agcattttgtaat

SEQ ID NO: 2437831 - DNA, 14 bp, Homo sapiens
agccaaaaatagct

SEQ ID NO: 2437832 - DNA, 15 bp, Homo sapiens
agccaaaaatagcta

SEQ ID NO: 2437833 - DNA, 21 bp, Homo sapiens
agccaaacatatatatactat

SEQ ID NO: 2437834 - DNA, 12 bp, Homo sapiens
agccaaatttaa

SEQ ID NO: 2437835 - DNA, 18 bp, Homo sapiens
agccaacacgcacctgcc

SEQ ID NO: 2437836 - DNA, 19 bp, Homo sapiens
agccaacacgcacctgcct

SEQ ID NO: 2437837 - DNA, 22 bp, Homo sapiens
agccaaggttttataaggctga

SEQ ID NO: 2437838 - DNA, 12 bp, Homo sapiens
agccaatataac

SEQ ID NO: 2437839 - DNA, 23 bp, Homo sapiens
agccaatccctcaccttctgagt

SEQ ID NO: 2437840 - DNA, 16 bp, Homo sapiens
agccaattcagacagg

SEQ ID NO: 2437841 - DNA, 17 bp, Homo sapiens
agccaattcagacaggc

SEQ ID NO: 2437842 - DNA, 14 bp, Homo sapiens
agccacaccaggat

SEQ ID NO: 2437843 - DNA, 17 bp, Homo sapiens
agccacaccaggataga

SEQ ID NO: 2437844 - DNA, 24 bp, Homo sapiens
agccacaccaggatagagactgga

SEQ ID NO: 2437845 - DNA, 17 bp, Homo sapiens
agccacacttctcagga

SEQ ID NO: 2437846 - DNA, 11 bp, Homo sapiens
agccctgggac

SEQ ID NO: 2437847 - DNA, 13 bp, Homo sapiens
agccctgggaccg

SEQ ID NO: 2437848 - DNA, 15 bp, Homo sapiens
agccctgggaccgct

SEQ ID NO: 2437849 - DNA, 17 bp, Homo sapiens
agccctgtcctggtggt

SEQ ID NO: 2437850 - DNA, 23 bp, Homo sapiens
agcccttgggggtcctcctccag

SEQ ID NO: 2437851 - DNA, 15 bp, Homo sapiens
agccctttccaagct

SEQ ID NO: 2437852 - DNA, 16 bp, Homo sapiens
agccgaggtccctgct

SEQ ID NO: 2437853 - DNA, 15 bp, Homo sapiens
agccgctgagcgagg

SEQ ID NO: 2437854 - DNA, 21 bp, Homo sapiens
agccgcttggcgatgccagcc

SEQ ID NO: 2437855 - DNA, 16 bp, Homo sapiens
agccggggtggggtgg

SEQ ID NO: 2437856 - DNA, 22 bp, Homo sapiens
agccgggtctgcctcttctggg

SEQ ID NO: 2437857 - DNA, 16 bp, Homo sapiens
agccgggtgtccccaa

SEQ ID NO: 2437858 - DNA, 12 bp, Homo sapiens
agccgtcctggc

SEQ ID NO: 2437859 - DNA, 22 bp, Homo sapiens
agcctaggcctagtcctgcgaa

SEQ ID NO: 2437860 - DNA, 14 bp, Homo sapiens
agcctagtgaaggc

SEQ ID NO: 2437861 - DNA, 18 bp, Homo sapiens
agcctcaaaacaaaggcc

SEQ ID NO: 2437862 - DNA, 21 bp, Homo sapiens
agcctcaaggttttaggttct

SEQ ID NO: 2437863 - DNA, 22 bp, Homo sapiens
agcctcaaggttttaggttcta

SEQ ID NO: 2437864 - DNA, 23 bp, Homo sapiens
agcctcaaggttttaggttctaa

SEQ ID NO: 2437865 - DNA, 20 bp, Homo sapiens
agcctcagagacatcagccc

SEQ ID NO: 2437866 - DNA, 23 bp, Homo sapiens
agcctcagagacatcagcccttg

SEQ ID NO: 2437867 - DNA, 16 bp, Homo sapiens
agcctcaggactggga

SEQ ID NO: 2437868 - DNA, 13 bp, Homo sapiens
agagctcaggatg

SEQ ID NO: 2437869 - DNA, 15 bp, Homo sapiens
agagctggctctgag

SEQ ID NO: 2437870 - DNA, 16 bp, Homo sapiens
agagctggctctgagc

SEQ ID NO: 2437871 - DNA, 21 bp, Homo sapiens
agagctggtgcggctggccat

SEQ ID NO: 2437872 - DNA, 12 bp, Homo sapiens
agagcttccctg

SEQ ID NO: 2437873 - DNA, 17 bp, Homo sapiens
agagcttccctgactca

SEQ ID NO: 2437874 - DNA, 16 bp, Homo sapiens
agaggaaggggccaga

SEQ ID NO: 2437875 - DNA, 18 bp, Homo sapiens
agaggaaggggccagagg

SEQ ID NO: 2437876 - DNA, 22 bp, Homo sapiens
agaggactgtagggagggcggc

SEQ ID NO: 2437877 - DNA, 17 bp, Homo sapiens
agaggagccaccagttc

SEQ ID NO: 2437878 - DNA, 11 bp, Homo sapiens
agaggcaccag

SEQ ID NO: 2437879 - DNA, 13 bp, Homo sapiens
agaggcagcccag

SEQ ID NO: 2437880 - DNA, 21 bp, Homo sapiens
agaggcaggtagggggtccct

SEQ ID NO: 2437881 - DNA, 13 bp, Homo sapiens
agaggccccagcc

SEQ ID NO: 2437882 - DNA, 15 bp, Homo sapiens
agaggccccagcctc

SEQ ID NO: 2437883 - DNA, 14 bp, Homo sapiens
agaggcccccagcc

SEQ ID NO: 2437884 - DNA, 17 bp, Homo sapiens
agaggcccccagcccag

SEQ ID NO: 2437885 - DNA, 15 bp, Homo sapiens
agaggccctggatca

SEQ ID NO: 2437886 - DNA, 17 bp, Homo sapiens
agaggccgtggctgctg

SEQ ID NO: 2437887 - DNA, 15 bp, Homo sapiens
agaggcctgcagggc

SEQ ID NO: 2437888 - DNA, 18 bp, Homo sapiens
agaggcctgtttggcctc

SEQ ID NO: 2437889 - DNA, 10 bp, Homo sapiens
agaggctcag

SEQ ID NO: 2437890 - DNA, 21 bp, Homo sapiens
agaggctgaggctggcacagg

SEQ ID NO: 2437891 - DNA, 12 bp, Homo sapiens
agaggctgcccc

SEQ ID NO: 2437892 - DNA, 18 bp, Homo sapiens
agaggctgcccctctcac

SEQ ID NO: 2437893 - DNA, 13 bp, Homo sapiens
agagggaatgtga

SEQ ID NO: 2437894 - DNA, 14 bp, Homo sapiens
agagggaatgtgaa

SEQ ID NO: 2437895 - DNA, 13 bp, Homo sapiens
agaggggcctgcc

SEQ ID NO: 2437896 - DNA, 14 bp, Homo sapiens
agaggggcctgcca

SEQ ID NO: 2437897 - DNA, 18 bp, Homo sapiens
agagggtctgggggcaca

SEQ ID NO: 2437898 - DNA, 18 bp, Homo sapiens
agaggtgaccccagggca

SEQ ID NO: 2437899 - DNA, 24 bp, Homo sapiens
agaggtgaccccagggcacaggag

SEQ ID NO: 2437900 - DNA, 15 bp, Homo sapiens
agaggtggaaaaaca

SEQ ID NO: 2437901 - DNA, 16 bp, Homo sapiens
agagtagaattgcatt

SEQ ID NO: 2437902 - DNA, 19 bp, Homo sapiens
agagtccaaggtttaaaga

SEQ ID NO: 2437903 - DNA, 20 bp, Homo sapiens
agagtcccaggttggctctg

SEQ ID NO: 2437904 - DNA, 14 bp, Homo sapiens
agagtctaaagatg

SEQ ID NO: 2437905 - DNA, 23 bp, Homo sapiens
agagtctaaagatggagtttcta

SEQ ID NO: 2437906 - DNA, 12 bp, Homo sapiens
agagtctagatt

SEQ ID NO: 2437907 - DNA, 15 bp, Homo sapiens
agagtctagattctc

SEQ ID NO: 2437908 - DNA, 17 bp, Homo sapiens
agagtctgaacagctgt

SEQ ID NO: 2437909 - DNA, 18 bp, Homo sapiens
agagtgagactcagtctt

SEQ ID NO: 2437910 - DNA, 14 bp, Homo sapiens
agagtgtctttcca

SEQ ID NO: 2437911 - DNA, 17 bp, Homo sapiens
agagttacagttctgtg

SEQ ID NO: 2437912 - DNA, 22 bp, Homo sapiens
agagttctttttgaagtattta

SEQ ID NO: 2437913 - DNA, 13 bp, Homo sapiens
agagtttcctgaa

SEQ ID NO: 2437914 - DNA, 20 bp, Homo sapiens
agagtttgatgaggccctcc

SEQ ID NO: 2437915 - DNA, 23 bp, Homo sapiens
agagtttgatgaggccctccaca

SEQ ID NO: 2437916 - DNA, 15 bp, Homo sapiens
agataaacacaagat

SEQ ID NO: 2437917 - DNA, 12 bp, Homo sapiens
agataatgtgaa

SEQ ID NO: 2437918 - DNA, 18 bp, Homo sapiens
agataatgtgaaaatggt

SEQ ID NO: 2437919 - DNA, 16 bp, Homo sapiens
agatacatacagaatt

SEQ ID NO: 2437920 - DNA, 21 bp, Homo sapiens
agataccagcgaggaggctcc

SEQ ID NO: 2437921 - DNA, 22 bp, Homo sapiens
agataccctacgctgtccagaa

SEQ ID NO: 2437922 - DNA, 16 bp, Homo sapiens
agatagctgtgacttc

SEQ ID NO: 2437923 - DNA, 17 bp, Homo sapiens
agatagttttcatccat

SEQ ID NO: 2437924 - DNA, 16 bp, Homo sapiens
agatatcgacttgttt

SEQ ID NO: 2437925 - DNA, 11 bp, Homo sapiens
agatattaatg

SEQ ID NO: 2437926 - DNA, 18 bp, Homo sapiens
agatattcctattgtgca

SEQ ID NO: 2437927 - DNA, 14 bp, Homo sapiens
agatattggacaaa

SEQ ID NO: 2437928 - DNA, 22 bp, Homo sapiens
agatcagatgctccaagattct

SEQ ID NO: 2437929 - DNA, 23 bp, Homo sapiens
agatcagatgctccaagattcta

SEQ ID NO: 2437930 - DNA, 20 bp, Homo sapiens
agatcagcaaaccggggcct

SEQ ID NO: 2437931 - DNA, 15 bp, Homo sapiens
agatcagtaaagaac

SEQ ID NO: 2437932 - DNA, 21 bp, Homo sapiens
agatccaaaagaagcccccag

SEQ ID NO: 2437933 - DNA, 15 bp, Homo sapiens
agatccaggagctcc

SEQ ID NO: 2437934 - DNA, 19 bp, Homo sapiens
agatccagggacagaggcc

SEQ ID NO: 2437935 - DNA, 23 bp, Homo sapiens
agatcctaagggtcgaaagctct

SEQ ID NO: 2437936 - DNA, 18 bp, Homo sapiens
agatcctagatcctaagg

SEQ ID NO: 2437937 - DNA, 15 bp, Homo sapiens
agatcctcctcattc

SEQ ID NO: 2437938 - DNA, 19 bp, Homo sapiens
agatctggaacctcagcct

SEQ ID NO: 2437939 - DNA, 14 bp, Homo sapiens
agatctgtcctcag

SEQ ID NO: 2437940 - DNA, 14 bp, Homo sapiens
agatgaaagagcag

SEQ ID NO: 2437941 - DNA, 19 bp, Homo sapiens
agatgaagttttacattgt

SEQ ID NO: 2437942 - DNA, 14 bp, Homo sapiens
agatgactgagggt

SEQ ID NO: 2437943 - DNA, 16 bp, Homo sapiens
agatgataaagagaca

SEQ ID NO: 2437944 - DNA, 20 bp, Homo sapiens
agatgatacatccaaagcag

SEQ ID NO: 2437945 - DNA, 16 bp, Homo sapiens
agatgatggatgccaa

SEQ ID NO: 2437946 - DNA, 18 bp, Homo sapiens
agatgattaaataagatt

SEQ ID NO: 2437947 - DNA, 18 bp, Homo sapiens
agatgcaccaccaagcca

SEQ ID NO: 2437948 - DNA, 15 bp, Homo sapiens
agatgcactttgctt

SEQ ID NO: 2437949 - DNA, 18 bp, Homo sapiens
agatgcatttgggtccag

SEQ ID NO: 2437950 - DNA, 22 bp, Homo sapiens
agatgcatttgggtccaggagg

SEQ ID NO: 2437951 - DNA, 13 bp, Homo sapiens
agatgcctccctg

SEQ ID NO: 2437952 - DNA, 13 bp, Homo sapiens
agatgctccaaga

SEQ ID NO: 2437953 - DNA, 20 bp, Homo sapiens
agatgctccttgggcccttt

SEQ ID NO: 2437954 - DNA, 19 bp, Homo sapiens
agatgctggcccagggccc

SEQ ID NO: 2437955 - DNA, 16 bp, Homo sapiens
agatgctgtgagtctt

SEQ ID NO: 2437956 - DNA, 18 bp, Homo sapiens
agatgcttttaacagagt

SEQ ID NO: 2437957 - DNA, 16 bp, Homo sapiens
agatggagtttctaag

SEQ ID NO: 2437958 - DNA, 12 bp, Homo sapiens
agcttccttcag

SEQ ID NO: 2437959 - DNA, 20 bp, Homo sapiens
agcttccttcagagagcagt

SEQ ID NO: 2437960 - DNA, 19 bp, Homo sapiens
agcttctgagacgtcatga

SEQ ID NO: 2437961 - DNA, 19 bp, Homo sapiens
agcttctgccccctgcaga

SEQ ID NO: 2437962 - DNA, 17 bp, Homo sapiens
agcttctgtcctgcccc

SEQ ID NO: 2437963 - DNA, 20 bp, Homo sapiens
agcttgggaaaggtggtgtt

SEQ ID NO: 2437964 - DNA, 14 bp, Homo sapiens
agcttgtagccagc

SEQ ID NO: 2437965 - DNA, 16 bp, Homo sapiens
agcttgtagccagccg

SEQ ID NO: 2437966 - DNA, 19 bp, Homo sapiens
agcttgtttacatgcttat

SEQ ID NO: 2437967 - DNA, 22 bp, Homo sapiens
agctttcatgtaaactgtgcac

SEQ ID NO: 2437968 - DNA, 13 bp, Homo sapiens
agctttcctgccc

SEQ ID NO: 2437969 - DNA, 19 bp, Homo sapiens
agctttctgaacagctggt

SEQ ID NO: 2437970 - DNA, 15 bp, Homo sapiens
agctttgactcagga

SEQ ID NO: 2437971 - DNA, 22 bp, Homo sapiens
agctttggaagtttagctctga

SEQ ID NO: 2437972 - DNA, 17 bp, Homo sapiens
agcttttctattttaat

SEQ ID NO: 2437973 - DNA, 14 bp, Homo sapiens
aggaaaaacaggtc

SEQ ID NO: 2437974 - DNA, 22 bp, Homo sapiens
aggaaaaagcaagttcgtctgt

SEQ ID NO: 2437975 - DNA, 15 bp, Homo sapiens
aggaaaaggcctggg

SEQ ID NO: 2437976 - DNA, 18 bp, Homo sapiens
aggaaaaggcctggggtg

SEQ ID NO: 2437977 - DNA, 16 bp, Homo sapiens
aggaaaattgaatgca

SEQ ID NO: 2437978 - DNA, 13 bp, Homo sapiens
aggaaagcaagaa

SEQ ID NO: 2437979 - DNA, 18 bp, Homo sapiens
aggaaatcccttcatact

SEQ ID NO: 2437980 - DNA, 22 bp, Homo sapiens
aggaaatcccttcatacttgaa

SEQ ID NO: 2437981 - DNA, 22 bp, Homo sapiens
aggaaattctttcccagtctgt

SEQ ID NO: 2437982 - DNA, 17 bp, Homo sapiens
aggaagagccttccacc

SEQ ID NO: 2437983 - DNA, 19 bp, Homo sapiens
aggaagagccttccaccca

SEQ ID NO: 2437984 - DNA, 14 bp, Homo sapiens
aggaagagggacag

SEQ ID NO: 2437985 - DNA, 17 bp, Homo sapiens
aggaagcattgtaaaat

SEQ ID NO: 2437986 - DNA, 13 bp, Homo sapiens
aggaagcctcaga

SEQ ID NO: 2437987 - DNA, 23 bp, Homo sapiens
aggaagctttggtgagaacctgg

SEQ ID NO: 2437988 - DNA, 15 bp, Homo sapiens
aggaaggagctgcct

SEQ ID NO: 2437989 - DNA, 17 bp, Homo sapiens
aggaaggagctgcctgg

SEQ ID NO: 2437990 - DNA, 19 bp, Homo sapiens
aggaaggagctgcctggac

SEQ ID NO: 2437991 - DNA, 20 bp, Homo sapiens
aggaaggagctgcctggacc

SEQ ID NO: 2437992 - DNA, 22 bp, Homo sapiens
aggaaggagctgcctggacccg

SEQ ID NO: 2437993 - DNA, 20 bp, Homo sapiens
aggaaggggttggattgcaa

SEQ ID NO: 2437994 - DNA, 14 bp, Homo sapiens
aggaagtagaaaca

SEQ ID NO: 2437995 - DNA, 14 bp, Homo sapiens
aggaagtaggaagt

SEQ ID NO: 2437996 - DNA, 15 bp, Homo sapiens
aggaagtaggaagta

SEQ ID NO: 2437997 - DNA, 20 bp, Homo sapiens
aggaagtctcatctggggag

SEQ ID NO: 2437998 - DNA, 17 bp, Homo sapiens
aggaatactgaacatct

SEQ ID NO: 2437999 - DNA, 16 bp, Homo sapiens
aggaatattttccaaa

SEQ ID NO: 2438000 - DNA, 20 bp, Homo sapiens
aggaatattttccaaagagt

SEQ ID NO: 2438001 - DNA, 16 bp, Homo sapiens
aggaatctttaaaaga

SEQ ID NO: 2438002 - DNA, 15 bp, Homo sapiens
aggaatttcccagga

SEQ ID NO: 2438003 - DNA, 15 bp, Homo sapiens
aggacacaggcctgt

SEQ ID NO: 2438004 - DNA, 18 bp, Homo sapiens
aggacacgggcctgtcca

SEQ ID NO: 2438005 - DNA, 23 bp, Homo sapiens
aggacacgggcctgtccacaggc

SEQ ID NO: 2438006 - DNA, 20 bp, Homo sapiens
aggacatgcggtagccagca

SEQ ID NO: 2438007 - DNA, 14 bp, Homo sapiens
aggaccacaggctc

SEQ ID NO: 2438008 - DNA, 16 bp, Homo sapiens
aggaccagaagctccc

SEQ ID NO: 2438009 - DNA, 14 bp, Homo sapiens
aggaccagctcagg

SEQ ID NO: 2438010 - DNA, 23 bp, Homo sapiens
aggaccagctcaggacagatgcc

SEQ ID NO: 2438011 - DNA, 12 bp, Homo sapiens
aggacccagggc

SEQ ID NO: 2438012 - DNA, 15 bp, Homo sapiens
aggaccctgaagggg

SEQ ID NO: 2438013 - DNA, 17 bp, Homo sapiens
aggacctgaaattccaa

SEQ ID NO: 2438014 - DNA, 16 bp, Homo sapiens
aggacctgagacctga

SEQ ID NO: 2438015 - DNA, 15 bp, Homo sapiens
aggacctgagcctgc

SEQ ID NO: 2438016 - DNA, 16 bp, Homo sapiens
aggacctgagcctgcc

SEQ ID NO: 2438017 - DNA, 21 bp, Homo sapiens
aggacctgagcctgccgagca

SEQ ID NO: 2438018 - DNA, 16 bp, Homo sapiens
aggacctggctgccat

SEQ ID NO: 2438019 - DNA, 17 bp, Homo sapiens
aggactaacactcagaa

SEQ ID NO: 2438020 - DNA, 21 bp, Homo sapiens
aggactaacactcagaagcct

SEQ ID NO: 2438021 - DNA, 14 bp, Homo sapiens
aggactaaccatgt

SEQ ID NO: 2438022 - DNA, 17 bp, Homo sapiens
aggactcaccactgccc

SEQ ID NO: 2438023 - DNA, 23 bp, Homo sapiens
aggactccaggcccaaggctccc

SEQ ID NO: 2438024 - DNA, 14 bp, Homo sapiens
aggactctgcagcc

SEQ ID NO: 2438025 - DNA, 15 bp, Homo sapiens
aggactctgcagcct

SEQ ID NO: 2438026 - DNA, 16 bp, Homo sapiens
aggactctgcagcctc

SEQ ID NO: 2438027 - DNA, 19 bp, Homo sapiens
aggactctgcagcctcaga

SEQ ID NO: 2438028 - DNA, 16 bp, Homo sapiens
aggactgatgtctcct

SEQ ID NO: 2438029 - DNA, 20 bp, Homo sapiens
aggactgctggtttgtagtt

SEQ ID NO: 2438030 - DNA, 19 bp, Homo sapiens
aggactgggagcccccagc

SEQ ID NO: 2438031 - DNA, 19 bp, Homo sapiens
aggacttatttaaactctg

SEQ ID NO: 2438032 - DNA, 13 bp, Homo sapiens
aggacttgccctc

SEQ ID NO: 2438033 - DNA, 11 bp, Homo sapiens
aggagaagcca

SEQ ID NO: 2438034 - DNA, 12 bp, Homo sapiens
aggagaagccag

SEQ ID NO: 2438035 - DNA, 13 bp, Homo sapiens
aggagaagctcag

SEQ ID NO: 2438036 - DNA, 15 bp, Homo sapiens
aggagaagctcagct

SEQ ID NO: 2438037 - DNA, 17 bp, Homo sapiens
aggagctttgactcagg

SEQ ID NO: 2438038 - DNA, 14 bp, Homo sapiens
aggaggaatactga

SEQ ID NO: 2438039 - DNA, 14 bp, Homo sapiens
aggaggagggaggc

SEQ ID NO: 2438040 - DNA, 22 bp, Homo sapiens
aggaggagggaggcgctgctgg

SEQ ID NO: 2438041 - DNA, 18 bp, Homo sapiens
aggaggcacctacactca

SEQ ID NO: 2438042 - DNA, 19 bp, Homo sapiens
aggaggctccagagggcac

SEQ ID NO: 2438043 - DNA, 19 bp, Homo sapiens
aggagggactgtcgctgct

SEQ ID NO: 2438044 - DNA, 16 bp, Homo sapiens
aggagggagacactgg

SEQ ID NO: 2438045 - DNA, 16 bp, Homo sapiens
aggaggggaagaggcc

SEQ ID NO: 2438046 - DNA, 14 bp, Homo sapiens
aggaggggggaggg

SEQ ID NO: 2438047 - DNA, 21 bp, Homo sapiens
aggagggtcggtgccttcaag

SEQ ID NO: 2438048 - DNA, 23 bp, Homo sapiens
aggaggtgtctcaggctgcctga

SEQ ID NO: 2438049 - DNA, 13 bp, Homo sapiens
aggagtctgaggt

SEQ ID NO: 2438050 - DNA, 19 bp, Homo sapiens
aggagtctgaggtcctgag

SEQ ID NO: 2438051 - DNA, 20 bp, Homo sapiens
aggagtctgaggtcctgagc

SEQ ID NO: 2438052 - DNA, 21 bp, Homo sapiens
aggagtctgaggtcctgagca

SEQ ID NO: 2438053 - DNA, 23 bp, Homo sapiens
aggagtctgaggtcctgagcact

SEQ ID NO: 2438054 - DNA, 14 bp, Homo sapiens
aggagtgtcctctt

SEQ ID NO: 2438055 - DNA, 12 bp, Homo sapiens
aggataaaataa

SEQ ID NO: 2438056 - DNA, 14 bp, Homo sapiens
aggatagatgctgg

SEQ ID NO: 2438057 - DNA, 18 bp, Homo sapiens
aggatagatgctggccca

SEQ ID NO: 2438058 - DNA, 19 bp, Homo sapiens
aggatagatgctggcccag

SEQ ID NO: 2438059 - DNA, 22 bp, Homo sapiens
aggatagatgctggcccagggc

SEQ ID NO: 2438060 - DNA, 21 bp, Homo sapiens
aggatatcggcatttgtttct

SEQ ID NO: 2438061 - DNA, 19 bp, Homo sapiens
aggatctatttttggaggt

SEQ ID NO: 2438062 - DNA, 21 bp, Homo sapiens
aggatctatttttggaggttt

SEQ ID NO: 2438063 - DNA, 17 bp, Homo sapiens
aggatctcaccaggcag

SEQ ID NO: 2438064 - DNA, 23 bp, Homo sapiens
aggatctcaccaggcagcctctg

SEQ ID NO: 2438065 - DNA, 18 bp, Homo sapiens
aggatgaagggcccgaga

SEQ ID NO: 2438066 - DNA, 13 bp, Homo sapiens
aggatgcttggga

SEQ ID NO: 2438067 - DNA, 19 bp, Homo sapiens
aggatgtaaagatcaataa

SEQ ID NO: 2438068 - DNA, 20 bp, Homo sapiens
aggatgtgattgtggaatgg

SEQ ID NO: 2438069 - DNA, 21 bp, Homo sapiens
aggatgtgtcccatctaggga

SEQ ID NO: 2438070 - DNA, 18 bp, Homo sapiens
aggatgtgtttgctttct

SEQ ID NO: 2438071 - DNA, 13 bp, Homo sapiens
aggattctgctgg

SEQ ID NO: 2438072 - DNA, 20 bp, Homo sapiens
aggattctgctggcctctgc

SEQ ID NO: 2438073 - DNA, 16 bp, Homo sapiens
aggattgcgagagatg

SEQ ID NO: 2438074 - DNA, 23 bp, Homo sapiens
aggattgcgagagatgtgtgttg

SEQ ID NO: 2438075 - DNA, 17 bp, Homo sapiens
aggatttatttaaaata

SEQ ID NO: 2438076 - DNA, 21 bp, Homo sapiens
aggattttttttaatgtttaa

SEQ ID NO: 2438077 - DNA, 13 bp, Homo sapiens
aggcaaaattgca

SEQ ID NO: 2438078 - DNA, 20 bp, Homo sapiens
aggcaccaaaagaagtaaaa

SEQ ID NO: 2438079 - DNA, 11 bp, Homo sapiens
aggcaccagga

SEQ ID NO: 2438080 - DNA, 17 bp, Homo sapiens
aggcactctagattcca

SEQ ID NO: 2438081 - DNA, 23 bp, Homo sapiens
aggcactgagataccagcgagga

SEQ ID NO: 2438082 - DNA, 13 bp, Homo sapiens
aggcactgccctg

SEQ ID NO: 2438083 - DNA, 13 bp, Homo sapiens
aggcactgggcat

SEQ ID NO: 2438084 - DNA, 16 bp, Homo sapiens
aggcactgtagttcta

SEQ ID NO: 2438085 - DNA, 19 bp, Homo sapiens
aggcactgtagttctaaga

SEQ ID NO: 2438086 - DNA, 20 bp, Homo sapiens
aggcagactctttatgcttg

SEQ ID NO: 2438087 - DNA, 22 bp, Homo sapiens
aggcagactctttatgcttgca

SEQ ID NO: 2438088 - DNA, 20 bp, Homo sapiens
aggcagaggcccaggctgcc

SEQ ID NO: 2438089 - DNA, 15 bp, Homo sapiens
aggcagcaaggcccg

SEQ ID NO: 2438090 - DNA, 23 bp, Homo sapiens
aggcagcaaggcccgagcagctg

SEQ ID NO: 2438091 - DNA, 23 bp, Homo sapiens
aggcagcagtgtgaggccagggc

SEQ ID NO: 2438092 - DNA, 17 bp, Homo sapiens
aggcagcccaggaagtc

SEQ ID NO: 2438093 - DNA, 15 bp, Homo sapiens
aggcagcctctgggg

SEQ ID NO: 2438094 - DNA, 15 bp, Homo sapiens
aggcagcctggacca

SEQ ID NO: 2438095 - DNA, 13 bp, Homo sapiens
aggcaggaagccc

SEQ ID NO: 2438096 - DNA, 22 bp, Homo sapiens
aggcaggaccttcgggctgtgc

SEQ ID NO: 2438097 - DNA, 16 bp, Homo sapiens
aggcaggattggggaa

SEQ ID NO: 2438098 - DNA, 20 bp, Homo sapiens
aggcaggattggggaagaga

SEQ ID NO: 2438099 - DNA, 23 bp, Homo sapiens
aggcaggattggggaagagagcc

SEQ ID NO: 2438100 - DNA, 13 bp, Homo sapiens
aggcaggcagggc

SEQ ID NO: 2438101 - DNA, 15 bp, Homo sapiens
aggcaggcagggctc

SEQ ID NO: 2438102 - DNA, 13 bp, Homo sapiens
aggcagggctctc

SEQ ID NO: 2438103 - DNA, 22 bp, Homo sapiens
aggcagggctctcctggcttcc

SEQ ID NO: 2438104 - DNA, 17 bp, Homo sapiens
aggcaggggcttcctgg

SEQ ID NO: 2438105 - DNA, 21 bp, Homo sapiens
aggcagttaccattaaaccat

SEQ ID NO: 2438106 - DNA, 22 bp, Homo sapiens
aggcagttaccattaaaccatc

SEQ ID NO: 2438107 - DNA, 14 bp, Homo sapiens
aggcagttttctaa

SEQ ID NO: 2438108 - DNA, 20 bp, Homo sapiens
aggcatacgagagcagaggt

SEQ ID NO: 2438109 - DNA, 12 bp, Homo sapiens
aggcatggtgga

SEQ ID NO: 2438110 - DNA, 15 bp, Homo sapiens
aggcattctggacct

SEQ ID NO: 2438111 - DNA, 16 bp, Homo sapiens
aggcattgccaagggc

SEQ ID NO: 2438112 - DNA, 20 bp, Homo sapiens
aggcattgccaagggctttg

SEQ ID NO: 2438113 - DNA, 15 bp, Homo sapiens
aggcatttcctgggt

SEQ ID NO: 2438114 - DNA, 20 bp, Homo sapiens
aggcatttcctgggtggcta

SEQ ID NO: 2438115 - DNA, 19 bp, Homo sapiens
aggctgttaaatacaggaa

SEQ ID NO: 2438116 - DNA, 15 bp, Homo sapiens
aggcttctgagcagc

SEQ ID NO: 2438117 - DNA, 14 bp, Homo sapiens
aggcttctgctggg

SEQ ID NO: 2438118 - DNA, 19 bp, Homo sapiens
aggcttggttccttcccaa

SEQ ID NO: 2438119 - DNA, 22 bp, Homo sapiens
aggctttatgataatagattct

SEQ ID NO: 2438120 - DNA, 19 bp, Homo sapiens
aggctttggatttgacatt

SEQ ID NO: 2438121 - DNA, 18 bp, Homo sapiens
agggaaaataggcaggaa

SEQ ID NO: 2438122 - DNA, 17 bp, Homo sapiens
agggaaggaggagcctg

SEQ ID NO: 2438123 - DNA, 19 bp, Homo sapiens
agggaaggaggagcctgtc

SEQ ID NO: 2438124 - DNA, 14 bp, Homo sapiens
agggaagggagcca

SEQ ID NO: 2438125 - DNA, 18 bp, Homo sapiens
agggaagggcctgccaca

SEQ ID NO: 2438126 - DNA, 13 bp, Homo sapiens
agggaatgtgaaa

SEQ ID NO: 2438127 - DNA, 15 bp, Homo sapiens
agggacaaaggagcc

SEQ ID NO: 2438128 - DNA, 16 bp, Homo sapiens
agggacaaaggagcct

SEQ ID NO: 2438129 - DNA, 17 bp, Homo sapiens
agggacaaaggagcctg

SEQ ID NO: 2438130 - DNA, 21 bp, Homo sapiens
agggacaaaggagcctgtgaa

SEQ ID NO: 2438131 - DNA, 21 bp, Homo sapiens
agggacacctgggagaaatct

SEQ ID NO: 2438132 - DNA, 16 bp, Homo sapiens
agggacagaggcccca

SEQ ID NO: 2438133 - DNA, 20 bp, Homo sapiens
agggacagaggccccagcct

SEQ ID NO: 2438134 - DNA, 21 bp, Homo sapiens
agggacagaggccccagcctc

SEQ ID NO: 2438135 - DNA, 19 bp, Homo sapiens
agggacatgcttagcagtc

SEQ ID NO: 2438136 - DNA, 12 bp, Homo sapiens
agggagagccca

SEQ ID NO: 2438137 - DNA, 12 bp, Homo sapiens
agggagccaagg

SEQ ID NO: 2438138 - DNA, 14 bp, Homo sapiens
agggagccaaggga

SEQ ID NO: 2438139 - DNA, 15 bp, Homo sapiens
agggagccaagggat

SEQ ID NO: 2438140 - DNA, 16 bp, Homo sapiens
agggagccaagggatg

SEQ ID NO: 2438141 - DNA, 17 bp, Homo sapiens
agggagccatttgagag

SEQ ID NO: 2438142 - DNA, 17 bp, Homo sapiens
agggaggccaggcgggc

SEQ ID NO: 2438143 - DNA, 16 bp, Homo sapiens
agggaggccgggcggt

SEQ ID NO: 2438144 - DNA, 22 bp, Homo sapiens
agggaggctgctgctgctcttg

SEQ ID NO: 2438145 - DNA, 19 bp, Homo sapiens
ttctccgttagctcctgtg

SEQ ID NO: 2438146 - DNA, 20 bp, Homo sapiens
ttctccgttagctcctgtgg

SEQ ID NO: 2438147 - DNA, 21 bp, Homo sapiens
ttctcctgaggatgtgtccca

SEQ ID NO: 2438148 - DNA, 16 bp, Homo sapiens
ttctcctgctgctccc

SEQ ID NO: 2438149 - DNA, 22 bp, Homo sapiens
ttctcctgctgctccctcagac

SEQ ID NO: 2438150 - DNA, 15 bp, Homo sapiens
ttctctcaacaccat

SEQ ID NO: 2438151 - DNA, 20 bp, Homo sapiens
ttctctcaacaccatgattc

SEQ ID NO: 2438152 - DNA, 18 bp, Homo sapiens
ttctctctttatacagct

SEQ ID NO: 2438153 - DNA, 14 bp, Homo sapiens
aaaattatttgcat

SEQ ID NO: 2438154 - DNA, 14 bp, Homo sapiens
aaaattctgtgcct

SEQ ID NO: 2438155 - DNA, 23 bp, Homo sapiens
aaaattctgtgccttgttttttg

SEQ ID NO: 2438156 - DNA, 21 bp, Homo sapiens
aaaattgaaatgtaaggctgt

SEQ ID NO: 2438157 - DNA, 12 bp, Homo sapiens
aaaattgaatgc

SEQ ID NO: 2438158 - DNA, 15 bp, Homo sapiens
aaaattgatttttct

SEQ ID NO: 2438159 - DNA, 19 bp, Homo sapiens
aaaattgatttttctcttc

SEQ ID NO: 2438160 - DNA, 12 bp, Homo sapiens
aaaatttataac

SEQ ID NO: 2438161 - DNA, 14 bp, Homo sapiens
aaaatttgttgcat

SEQ ID NO: 2438162 - DNA, 20 bp, Homo sapiens
aaacaaaggcctaattctat

SEQ ID NO: 2438163 - DNA, 22 bp, Homo sapiens
aaacaacaatttctactttgaa

SEQ ID NO: 2438164 - DNA, 13 bp, Homo sapiens
aaacaagaaaaat

SEQ ID NO: 2438165 - DNA, 18 bp, Homo sapiens
aaacaagaaaaataaaga

SEQ ID NO: 2438166 - DNA, 19 bp, Homo sapiens
aaacaagaaaaataaagaa

SEQ ID NO: 2438167 - DNA, 23 bp, Homo sapiens
aaacaagtatttgttaatttaga

SEQ ID NO: 2438168 - DNA, 14 bp, Homo sapiens
aaacaatgtttaaa

SEQ ID NO: 2438169 - DNA, 15 bp, Homo sapiens
aaacacaagattggt

SEQ ID NO: 2438170 - DNA, 13 bp, Homo sapiens
aaacagaacactt

SEQ ID NO: 2438171 - DNA, 17 bp, Homo sapiens
aaacagatttggaaaga

SEQ ID NO: 2438172 - DNA, 15 bp, Homo sapiens
aaacaggcacttggc

SEQ ID NO: 2438173 - DNA, 23 bp, Homo sapiens
aaacaggcacttggcagccttgt

SEQ ID NO: 2438174 - DNA, 21 bp, Homo sapiens
aaacaggtatatactttgaaa

SEQ ID NO: 2438175 - DNA, 18 bp, Homo sapiens
aaacagttgcatgtagta

SEQ ID NO: 2438176 - DNA, 16 bp, Homo sapiens
aaacagttggtaactt

SEQ ID NO: 2438177 - DNA, 19 bp, Homo sapiens
aaacagttggtaacttttg

SEQ ID NO: 2438178 - DNA, 22 bp, Homo sapiens
aaacagttggtaacttttgtga

SEQ ID NO: 2438179 - DNA, 19 bp, Homo sapiens
aaacatcattcatttttgt

SEQ ID NO: 2438180 - DNA, 16 bp, Homo sapiens
aaacatctttgaaatt

SEQ ID NO: 2438181 - DNA, 17 bp, Homo sapiens
aaacatctttgaaatta

SEQ ID NO: 2438182 - DNA, 22 bp, Homo sapiens
aaacatctttgaaattatgtaa

SEQ ID NO: 2438183 - DNA, 21 bp, Homo sapiens
aaacattaatagcagcctttc

SEQ ID NO: 2438184 - DNA, 21 bp, Homo sapiens
aaacatttattttgacataaa

SEQ ID NO: 2438185 - DNA, 12 bp, Homo sapiens
aaaccagcttcc

SEQ ID NO: 2438186 - DNA, 13 bp, Homo sapiens
aaaccagcttcct

SEQ ID NO: 2438187 - DNA, 22 bp, Homo sapiens
aaaccaggtccaatgagctttc

SEQ ID NO: 2438188 - DNA, 13 bp, Homo sapiens
aaaccatctccct

SEQ ID NO: 2438189 - DNA, 18 bp, Homo sapiens
aaacccacctgctagtgt

SEQ ID NO: 2438190 - DNA, 20 bp, Homo sapiens
aaaccccacctttattcctt

SEQ ID NO: 2438191 - DNA, 18 bp, Homo sapiens
aaacccctgtaggcctca

SEQ ID NO: 2438192 - DNA, 14 bp, Homo sapiens
aaaccctagccttg

SEQ ID NO: 2438193 - DNA, 17 bp, Homo sapiens
aaaccctagccttgctt

SEQ ID NO: 2438194 - DNA, 18 bp, Homo sapiens
aaaccgccagctctgttc

SEQ ID NO: 2438195 - DNA, 15 bp, Homo sapiens
aaaccgctaaaagaa

SEQ ID NO: 2438196 - DNA, 16 bp, Homo sapiens
aaacctgagatttatt

SEQ ID NO: 2438197 - DNA, 14 bp, Homo sapiens
aaactaaaaactag

SEQ ID NO: 2438198 - DNA, 21 bp, Homo sapiens
aaactcattcattagtcatgt

SEQ ID NO: 2438199 - DNA, 14 bp, Homo sapiens
aaactcctgtgacc

SEQ ID NO: 2438200 - DNA, 16 bp, Homo sapiens
aaactcgttttttaca

SEQ ID NO: 2438201 - DNA, 18 bp, Homo sapiens
aaactctgttacactttt

SEQ ID NO: 2438202 - DNA, 20 bp, Homo sapiens
aaactctttggtcgtttttt

SEQ ID NO: 2438203 - DNA, 22 bp, Homo sapiens
aaactgatccagtataagacta

SEQ ID NO: 2438204 - DNA, 11 bp, Homo sapiens
aaactggagac

SEQ ID NO: 2438205 - DNA, 12 bp, Homo sapiens
aaactgtacagt

SEQ ID NO: 2438206 - DNA, 18 bp, Homo sapiens
aaactgtacagtgtcttt

SEQ ID NO: 2438207 - DNA, 14 bp, Homo sapiens
aaactgtgtaactg

SEQ ID NO: 2438208 - DNA, 17 bp, Homo sapiens
aaactgtgtaactgccc

SEQ ID NO: 2438209 - DNA, 19 bp, Homo sapiens
aaactgttggaatggattt

SEQ ID NO: 2438210 - DNA, 13 bp, Homo sapiens
aaacttggatact

SEQ ID NO: 2438211 - DNA, 18 bp, Homo sapiens
aaacttggatacttggat

SEQ ID NO: 2438212 - DNA, 19 bp, Homo sapiens
aaacttggatacttggatt

SEQ ID NO: 2438213 - DNA, 20 bp, Homo sapiens
aaacttgtaatttttttaat

SEQ ID NO: 2438214 - DNA, 18 bp, Homo sapiens
aaactttcctcgcctgac

SEQ ID NO: 2438215 - DNA, 16 bp, Homo sapiens
aaactttgaagttagc

SEQ ID NO: 2438216 - DNA, 11 bp, Homo sapiens
aaagaaaaaaa

SEQ ID NO: 2438217 - DNA, 17 bp, Homo sapiens
aaagaaaaaaatgtatt

SEQ ID NO: 2438218 - DNA, 15 bp, Homo sapiens
aaagaaaaaaattga

SEQ ID NO: 2438219 - DNA, 13 bp, Homo sapiens
aaagaaaagatgc

SEQ ID NO: 2438220 - DNA, 14 bp, Homo sapiens
aaagaaaagatgca

SEQ ID NO: 2438221 - DNA, 17 bp, Homo sapiens
aaagaaaagatgcactt

SEQ ID NO: 2438222 - DNA, 18 bp, Homo sapiens
aaagaaaatgatacagca

SEQ ID NO: 2438223 - DNA, 13 bp, Homo sapiens
aaagaaaattaca

SEQ ID NO: 2438224 - DNA, 12 bp, Homo sapiens
aaagaaactttc

SEQ ID NO: 2438225 - DNA, 13 bp, Homo sapiens
aaagaaagtgtat

SEQ ID NO: 2438226 - DNA, 15 bp, Homo sapiens
aaagaaatataccta

SEQ ID NO: 2438227 - DNA, 15 bp, Homo sapiens
aaagaacgctgattt

SEQ ID NO: 2438228 - DNA, 14 bp, Homo sapiens
aaagaagacctgag

SEQ ID NO: 2438229 - DNA, 20 bp, Homo sapiens
aaagaagacctgagaatgta

SEQ ID NO: 2438230 - DNA, 16 bp, Homo sapiens
aaagacatgaagccac

SEQ ID NO: 2438231 - DNA, 14 bp, Homo sapiens
aaagaccaggccaa

SEQ ID NO: 2438232 - DNA, 23 bp, Homo sapiens
aaagacgcactttggcttataat

SEQ ID NO: 2438233 - DNA, 10 bp, Homo sapiens
aaagactcat

SEQ ID NO: 2438234 - DNA, 15 bp, Homo sapiens
aaagactcatccgtc

SEQ ID NO: 2438235 - DNA, 12 bp, Homo sapiens
aaagacttaagc

SEQ ID NO: 2438236 - DNA, 14 bp, Homo sapiens
aaagaggctgcccc

SEQ ID NO: 2438237 - DNA, 22 bp, Homo sapiens
aaagaggctgcccctctcacca

SEQ ID NO: 2438238 - DNA, 23 bp, Homo sapiens
aaagaggctgcccctctcaccaa

SEQ ID NO: 2438239 - DNA, 19 bp, Homo sapiens
aaagaggtgaccccagggc

SEQ ID NO: 2438240 - DNA, 20 bp, Homo sapiens
aaagaggtgaccccagggca

SEQ ID NO: 2438241 - DNA, 21 bp, Homo sapiens
aaagaggtgaccccagggcac

SEQ ID NO: 2438242 - DNA, 18 bp, Homo sapiens
aaagagtagaattgcatt

SEQ ID NO: 2438243 - DNA, 21 bp, Homo sapiens
aaagagtctagattcaaaggt

SEQ ID NO: 2438244 - DNA, 21 bp, Homo sapiens
aaagatacagaactctttcaa

SEQ ID NO: 2438245 - DNA, 19 bp, Homo sapiens
aaagatctgtcctcagcct

SEQ ID NO: 2438246 - DNA, 21 bp, Homo sapiens
aaagatctgtcctcagccttg

SEQ ID NO: 2438247 - DNA, 16 bp, Homo sapiens
aaagatctgttttgaa

SEQ ID NO: 2438248 - DNA, 21 bp, Homo sapiens
aaagatgcactttgctttaat

SEQ ID NO: 2438249 - DNA, 14 bp, Homo sapiens
aaagatgccacatt

SEQ ID NO: 2438250 - DNA, 16 bp, Homo sapiens
aaagatggagtttcta

SEQ ID NO: 2438251 - DNA, 18 bp, Homo sapiens
aaagatggagtttctaag

SEQ ID NO: 2438252 - DNA, 21 bp, Homo sapiens
aaagatggagtttctaaggtc

SEQ ID NO: 2438253 - DNA, 22 bp, Homo sapiens
aaagattttttaataatttaga

SEQ ID NO: 2438254 - DNA, 21 bp, Homo sapiens
aaagcaaaaaagaaaaccttt

SEQ ID NO: 2438255 - DNA, 17 bp, Homo sapiens
aaagcaaagcacagaga

SEQ ID NO: 2438256 - DNA, 22 bp, Homo sapiens
aaagcaagcattcagaagaaaa

SEQ ID NO: 2438257 - DNA, 14 bp, Homo sapiens
aacatgcactgatg

SEQ ID NO: 2438258 - DNA, 13 bp, Homo sapiens
aacatggctttga

SEQ ID NO: 2438259 - DNA, 23 bp, Homo sapiens
aacatggttaccatgtctttctc

SEQ ID NO: 2438260 - DNA, 20 bp, Homo sapiens
aacatgtcctgcctattatc

SEQ ID NO: 2438261 - DNA, 11 bp, Homo sapiens
aacatgtttcc

SEQ ID NO: 2438262 - DNA, 13 bp, Homo sapiens
aacattaaaatat

SEQ ID NO: 2438263 - DNA, 19 bp, Homo sapiens
aacattaatagcagccttt

SEQ ID NO: 2438264 - DNA, 20 bp, Homo sapiens
aacattaatagcagcctttc

SEQ ID NO: 2438265 - DNA, 16 bp, Homo sapiens
aacattcatagtcttt

SEQ ID NO: 2438266 - DNA, 15 bp, Homo sapiens
aacattggaatgttc

SEQ ID NO: 2438267 - DNA, 16 bp, Homo sapiens
aacattggaatgttct

SEQ ID NO: 2438268 - DNA, 15 bp, Homo sapiens
aacatttattttgac

SEQ ID NO: 2438269 - DNA, 16 bp, Homo sapiens
aacatttgctgtttta

SEQ ID NO: 2438270 - DNA, 15 bp, Homo sapiens
aaccaaatctggaag

SEQ ID NO: 2438271 - DNA, 14 bp, Homo sapiens
aaccaattattttc

SEQ ID NO: 2438272 - DNA, 17 bp, Homo sapiens
aaccacacccacactca

SEQ ID NO: 2438273 - DNA, 13 bp, Homo sapiens
aaccactgaaaaa

SEQ ID NO: 2438274 - DNA, 22 bp, Homo sapiens
aaccactttcttatttttttct

SEQ ID NO: 2438275 - DNA, 16 bp, Homo sapiens
aaccagatatatattc

SEQ ID NO: 2438276 - DNA, 22 bp, Homo sapiens
aaccagctcagcactgcctgct

SEQ ID NO: 2438277 - DNA, 13 bp, Homo sapiens
aaccagcttcctt

SEQ ID NO: 2438278 - DNA, 21 bp, Homo sapiens
aaagttctaataatttctaat

SEQ ID NO: 2438279 - DNA, 17 bp, Homo sapiens
aaagttgataaagattt

SEQ ID NO: 2438280 - DNA, 23 bp, Homo sapiens
aaagttgataaagattttttaat

SEQ ID NO: 2438281 - DNA, 18 bp, Homo sapiens
aaagttgcagctgttttg

SEQ ID NO: 2438282 - DNA, 19 bp, Homo sapiens
aaagttgcagctgttttgt

SEQ ID NO: 2438283 - DNA, 13 bp, Homo sapiens
aaagttttatata

SEQ ID NO: 2438284 - DNA, 14 bp, Homo sapiens
aaagttttatatat

SEQ ID NO: 2438285 - DNA, 18 bp, Homo sapiens
aaagttttatatattata

SEQ ID NO: 2438286 - DNA, 22 bp, Homo sapiens
aaagttttatatattatatgga

SEQ ID NO: 2438287 - DNA, 13 bp, Homo sapiens
aaataaaaagaaa

SEQ ID NO: 2438288 - DNA, 20 bp, Homo sapiens
aaataaaaagaaaggctgtt

SEQ ID NO: 2438289 - DNA, 16 bp, Homo sapiens
aaataaaaagtgcttt

SEQ ID NO: 2438290 - DNA, 17 bp, Homo sapiens
aaataaaaggaagccaa

SEQ ID NO: 2438291 - DNA, 13 bp, Homo sapiens
aaataaaatgcta

SEQ ID NO: 2438292 - DNA, 17 bp, Homo sapiens
aaataaaatgctaggtt

SEQ ID NO: 2438293 - DNA, 15 bp, Homo sapiens
aaataaaatttgttg

SEQ ID NO: 2438294 - DNA, 15 bp, Homo sapiens
aaataaagaaaagat

SEQ ID NO: 2438295 - DNA, 20 bp, Homo sapiens
aaataaagcttgcaacaaaa

SEQ ID NO: 2438296 - DNA, 23 bp, Homo sapiens
aaataaaggatgtgattgtggaa

SEQ ID NO: 2438297 - DNA, 14 bp, Homo sapiens
aaataaatttgact

SEQ ID NO: 2438298 - DNA, 15 bp, Homo sapiens
aaataagaaactttt

SEQ ID NO: 2438299 - DNA, 21 bp, Homo sapiens
aaataagaaacttttttattt

SEQ ID NO: 2438300 - DNA, 15 bp, Homo sapiens
aaataagattctaac

SEQ ID NO: 2438301 - DNA, 15 bp, Homo sapiens
aaataagcaggtgga

SEQ ID NO: 2438302 - DNA, 16 bp, Homo sapiens
aaataagtttttgttt

SEQ ID NO: 2438303 - DNA, 15 bp, Homo sapiens
aagagtttaaaatca

SEQ ID NO: 2438304 - DNA, 13 bp, Homo sapiens
aagagttttggga

SEQ ID NO: 2438305 - DNA, 23 bp, Homo sapiens
aagagttttgggagttgtagtta

SEQ ID NO: 2438306 - DNA, 17 bp, Homo sapiens
aagataaacacaagatt

SEQ ID NO: 2438307 - DNA, 20 bp, Homo sapiens
aagatacagaactctttcaa

SEQ ID NO: 2438308 - DNA, 17 bp, Homo sapiens
aagatacttaagtgctg

SEQ ID NO: 2438309 - DNA, 14 bp, Homo sapiens
aagatagctgtgac

SEQ ID NO: 2438310 - DNA, 15 bp, Homo sapiens
aagatagctgtgact

SEQ ID NO: 2438311 - DNA, 19 bp, Homo sapiens
aagatctgtcctcagcctt

SEQ ID NO: 2438312 - DNA, 23 bp, Homo sapiens
aagatcttagattctctgtgtct

SEQ ID NO: 2438313 - DNA, 17 bp, Homo sapiens
aagatcttttattttgc

SEQ ID NO: 2438314 - DNA, 18 bp, Homo sapiens
aagatcttttattttgcc

SEQ ID NO: 2438315 - DNA, 11 bp, Homo sapiens
aagatgaatga

SEQ ID NO: 2438316 - DNA, 13 bp, Homo sapiens
aagatgactgagg

SEQ ID NO: 2438317 - DNA, 16 bp, Homo sapiens
aagatgcactttgctt

SEQ ID NO: 2438318 - DNA, 20 bp, Homo sapiens
aagatggaatttatcaaacc

SEQ ID NO: 2438319 - DNA, 14 bp, Homo sapiens
aagatggagtttct

SEQ ID NO: 2438320 - DNA, 17 bp, Homo sapiens
aagatggagtttctaag

SEQ ID NO: 2438321 - DNA, 18 bp, Homo sapiens
aagatggagtttctaagg

SEQ ID NO: 2438322 - DNA, 19 bp, Homo sapiens
aagatggcataacctgtct

SEQ ID NO: 2438323 - DNA, 20 bp, Homo sapiens
aagatggggaccagcagccc

SEQ ID NO: 2438324 - DNA, 16 bp, Homo sapiens
aagatgtgatattcta

SEQ ID NO: 2438325 - DNA, 17 bp, Homo sapiens
aagatgtgatattctaa

SEQ ID NO: 2438326 - DNA, 21 bp, Homo sapiens
aagatgtgatattctaagact

SEQ ID NO: 2438327 - DNA, 20 bp, Homo sapiens
aagattatagattctaaaga

SEQ ID NO: 2438328 - DNA, 20 bp, Homo sapiens
aagattctagatcagatgct

SEQ ID NO: 2438329 - DNA, 13 bp, Homo sapiens
aagattctagatg

SEQ ID NO: 2438330 - DNA, 19 bp, Homo sapiens
aagattctatagttctaga

SEQ ID NO: 2438331 - DNA, 13 bp, Homo sapiens
aagattctttccc

SEQ ID NO: 2438332 - DNA, 19 bp, Homo sapiens
aagattgagctctctgccc

SEQ ID NO: 2438333 - DNA, 21 bp, Homo sapiens
aagattggtgtttttttctat

SEQ ID NO: 2438334 - DNA, 16 bp, Homo sapiens
aagatttgtttttaaa

SEQ ID NO: 2438335 - DNA, 17 bp, Homo sapiens
aagatttgtttttaaac

SEQ ID NO: 2438336 - DNA, 22 bp, Homo sapiens
aagatttgtttttaaactgtac

SEQ ID NO: 2438337 - DNA, 13 bp, Homo sapiens
aagattttttaat

SEQ ID NO: 2438338 - DNA, 17 bp, Homo sapiens
aagattttttaataatt

SEQ ID NO: 2438339 - DNA, 22 bp, Homo sapiens
aagcaaaattatagaagtttag

SEQ ID NO: 2438340 - DNA, 17 bp, Homo sapiens
aagcaaagcacagagag

SEQ ID NO: 2438341 - DNA, 21 bp, Homo sapiens
aagcaaatgtcatgctgcctt

SEQ ID NO: 2438342 - DNA, 22 bp, Homo sapiens
aagcaaatgtcatgctgcctta

SEQ ID NO: 2438343 - DNA, 15 bp, Homo sapiens
aagcaacatggcttt

SEQ ID NO: 2438344 - DNA, 15 bp, Homo sapiens
aagcaacctcagtaa

SEQ ID NO: 2438345 - DNA, 19 bp, Homo sapiens
aagcaacctcagtaattta

SEQ ID NO: 2438346 - DNA, 17 bp, Homo sapiens
aagcaagaatcagagaa

SEQ ID NO: 2438347 - DNA, 13 bp, Homo sapiens
aagcaatatgcat

SEQ ID NO: 2438348 - DNA, 13 bp, Homo sapiens
aagcacagccctt

SEQ ID NO: 2438349 - DNA, 22 bp, Homo sapiens
aagcactgactgggaccaggca

SEQ ID NO: 2438350 - DNA, 15 bp, Homo sapiens
aagcagaaagtgcct

SEQ ID NO: 2438351 - DNA, 23 bp, Homo sapiens
aagcagaaagtgcctttcaggat

SEQ ID NO: 2438352 - DNA, 16 bp, Homo sapiens
aagcagaaatccaagc

SEQ ID NO: 2438353 - DNA, 12 bp, Homo sapiens
aagcagacagct

SEQ ID NO: 2438354 - DNA, 19 bp, Homo sapiens
aagcagcaacttgtcctag

SEQ ID NO: 2438355 - DNA, 16 bp, Homo sapiens
aagcagcacttataaa

SEQ ID NO: 2438356 - DNA, 16 bp, Homo sapiens
aagcagcagcctcgcc

SEQ ID NO: 2438357 - DNA, 16 bp, Homo sapiens
aagcagcctctcccca

SEQ ID NO: 2438358 - DNA, 18 bp, Homo sapiens
aagcaggttcccaagctc

SEQ ID NO: 2438359 - DNA, 14 bp, Homo sapiens
aagcaggttcttgt

SEQ ID NO: 2438360 - DNA, 18 bp, Homo sapiens
aagcagtcgtgcctgtgt

SEQ ID NO: 2438361 - DNA, 13 bp, Homo sapiens
aagcatcagaaag

SEQ ID NO: 2438362 - DNA, 14 bp, Homo sapiens
aagcatcattattt

SEQ ID NO: 2438363 - DNA, 15 bp, Homo sapiens
aagcatcattattta

SEQ ID NO: 2438364 - DNA, 13 bp, Homo sapiens
aagcatctaagtt

SEQ ID NO: 2438365 - DNA, 17 bp, Homo sapiens
aagcatctggctctaat

SEQ ID NO: 2438366 - DNA, 17 bp, Homo sapiens
aagcatggtcccacatc

SEQ ID NO: 2438367 - DNA, 22 bp, Homo sapiens
aagcatggtcccacatccctgg

SEQ ID NO: 2438368 - DNA, 12 bp, Homo sapiens
aagcattcacaa

SEQ ID NO: 2438369 - DNA, 21 bp, Homo sapiens
aagcattcagaagaaaaagaa

SEQ ID NO: 2438370 - DNA, 17 bp, Homo sapiens
aagcattctcattggaa

SEQ ID NO: 2438371 - DNA, 22 bp, Homo sapiens
aagcattctcattggaaattta

SEQ ID NO: 2438372 - DNA, 13 bp, Homo sapiens
aagcattgaatgg

SEQ ID NO: 2438373 - DNA, 21 bp, Homo sapiens
aagcatttaacccccctgtac

SEQ ID NO: 2438374 - DNA, 23 bp, Homo sapiens
aagcattttgtaagttgaagcaa

SEQ ID NO: 2438375 - DNA, 14 bp, Homo sapiens
aagcattttgtaat

SEQ ID NO: 2438376 - DNA, 12 bp, Homo sapiens
aagccaaaacaa

SEQ ID NO: 2438377 - DNA, 18 bp, Homo sapiens
aagccaagggaacctgtg

SEQ ID NO: 2438378 - DNA, 16 bp, Homo sapiens
aagccagaggctgggt

SEQ ID NO: 2438379 - DNA, 19 bp, Homo sapiens
aagccagcgtcctcctctg

SEQ ID NO: 2438380 - DNA, 12 bp, Homo sapiens
aagccagcttgt

SEQ ID NO: 2438381 - DNA, 14 bp, Homo sapiens
aagccagcttgttt

SEQ ID NO: 2438382 - DNA, 21 bp, Homo sapiens
aagccagcttgtttacatgct

SEQ ID NO: 2438383 - DNA, 21 bp, Homo sapiens
aagccaggaatttcccaggac

SEQ ID NO: 2438384 - DNA, 13 bp, Homo sapiens
aagccaggtccct

SEQ ID NO: 2438385 - DNA, 16 bp, Homo sapiens
aagccaggtccctctc

SEQ ID NO: 2438386 - DNA, 20 bp, Homo sapiens
aagccatcttgagtggtcat

SEQ ID NO: 2438387 - DNA, 18 bp, Homo sapiens
aagcccagagggtctggg

SEQ ID NO: 2438388 - DNA, 15 bp, Homo sapiens
aagcccatcctgacc

SEQ ID NO: 2438389 - DNA, 18 bp, Homo sapiens
aagcccatcctgaccagc

SEQ ID NO: 2438390 - DNA, 18 bp, Homo sapiens
aagcccccagagcccagg

SEQ ID NO: 2438391 - DNA, 18 bp, Homo sapiens
aagcccctgcccctcctc

SEQ ID NO: 2438392 - DNA, 15 bp, Homo sapiens
aagcccggctcctgg

SEQ ID NO: 2438393 - DNA, 20 bp, Homo sapiens
aagccctcccaggtgttaac

SEQ ID NO: 2438394 - DNA, 13 bp, Homo sapiens
aagccgtcctggc

SEQ ID NO: 2438395 - DNA, 20 bp, Homo sapiens
aatggctatgtttttaatgt

SEQ ID NO: 2438396 - DNA, 18 bp, Homo sapiens
aatggctgataattttaa

SEQ ID NO: 2438397 - DNA, 19 bp, Homo sapiens
aatgggcacttaaagcttt

SEQ ID NO: 2438398 - DNA, 20 bp, Homo sapiens
aatggtactccacatatttc

SEQ ID NO: 2438399 - DNA, 14 bp, Homo sapiens
aatggtccaggaga

SEQ ID NO: 2438400 - DNA, 15 bp, Homo sapiens
aatggttcagaatta

SEQ ID NO: 2438401 - DNA, 22 bp, Homo sapiens
aatggttcagaattaaactttt

SEQ ID NO: 2438402 - DNA, 20 bp, Homo sapiens
aatgtaaaggagtcaaaact

SEQ ID NO: 2438403 - DNA, 21 bp, Homo sapiens
aatgtaaaggagtcaaaacta

SEQ ID NO: 2438404 - DNA, 16 bp, Homo sapiens
aatgtaaatattttaa

SEQ ID NO: 2438405 - DNA, 19 bp, Homo sapiens
aatgtaaatattttaaaga

SEQ ID NO: 2438406 - DNA, 20 bp, Homo sapiens
aatgtaaatattttaaagaa

SEQ ID NO: 2438407 - DNA, 21 bp, Homo sapiens
aatgtaaatattttaaagaat

SEQ ID NO: 2438408 - DNA, 12 bp, Homo sapiens
aatgtaaatttg

SEQ ID NO: 2438409 - DNA, 13 bp, Homo sapiens
aatgtaaatttgt

SEQ ID NO: 2438410 - DNA, 16 bp, Homo sapiens
aatgtaaatttgtact

SEQ ID NO: 2438411 - DNA, 18 bp, Homo sapiens
aatgtaaatttgtactat

SEQ ID NO: 2438412 - DNA, 20 bp, Homo sapiens
aatgtaagattatagattct

SEQ ID NO: 2438413 - DNA, 21 bp, Homo sapiens
aatgtaagattatagattcta

SEQ ID NO: 2438414 - DNA, 23 bp, Homo sapiens
aatgtaagattatagattctaaa

SEQ ID NO: 2438415 - DNA, 13 bp, Homo sapiens
aatgtaaggctgt

SEQ ID NO: 2438416 - DNA, 17 bp, Homo sapiens
aatgtaaggctgtgtaa

SEQ ID NO: 2438417 - DNA, 19 bp, Homo sapiens
aatgtaatcaatgtttctt

SEQ ID NO: 2438418 - DNA, 12 bp, Homo sapiens
aatgtaattatt

SEQ ID NO: 2438419 - DNA, 18 bp, Homo sapiens
aatgtacccaccgggcca

SEQ ID NO: 2438420 - DNA, 21 bp, Homo sapiens
aatgtagagtttttaaacatc

SEQ ID NO: 2438421 - DNA, 14 bp, Homo sapiens
aatgtagataagtg

SEQ ID NO: 2438422 - DNA, 16 bp, Homo sapiens
aatgtaggcttagttt

SEQ ID NO: 2438423 - DNA, 13 bp, Homo sapiens
aatgtatatgcac

SEQ ID NO: 2438424 - DNA, 18 bp, Homo sapiens
aatgtatcaaatacattt

SEQ ID NO: 2438425 - DNA, 13 bp, Homo sapiens
aatgtatgttacc

SEQ ID NO: 2438426 - DNA, 17 bp, Homo sapiens
aatgtatgttaccaaaa

SEQ ID NO: 2438427 - DNA, 21 bp, Homo sapiens
aatgtatgttaccaaaaataa

SEQ ID NO: 2438428 - DNA, 19 bp, Homo sapiens
aatgtcattttggtacttt

SEQ ID NO: 2438429 - DNA, 14 bp, Homo sapiens
aatgtctggagacc

SEQ ID NO: 2438430 - DNA, 14 bp, Homo sapiens
aatgtcttgagctc

SEQ ID NO: 2438431 - DNA, 15 bp, Homo sapiens
aatgtcttgagctct

SEQ ID NO: 2438432 - DNA, 13 bp, Homo sapiens
aatgtgaagcctt

SEQ ID NO: 2438433 - DNA, 15 bp, Homo sapiens
aatgtgaagccttcc

SEQ ID NO: 2438434 - DNA, 17 bp, Homo sapiens
aatgtgatgttctaagg

SEQ ID NO: 2438435 - DNA, 17 bp, Homo sapiens
aatgtgcaatagaaggt

SEQ ID NO: 2438436 - DNA, 21 bp, Homo sapiens
aatgtggcttgagaaatatgg

SEQ ID NO: 2438437 - DNA, 17 bp, Homo sapiens
aatgtgtctttagatag

SEQ ID NO: 2438438 - DNA, 23 bp, Homo sapiens
aatgtgtctttagatagccctgt

SEQ ID NO: 2438439 - DNA, 12 bp, Homo sapiens
aatgttaaaatg

SEQ ID NO: 2438440 - DNA, 16 bp, Homo sapiens
aatgttacattattat

SEQ ID NO: 2438441 - DNA, 16 bp, Homo sapiens
aatgttatcttctcaa

SEQ ID NO: 2438442 - DNA, 21 bp, Homo sapiens
aatgttattttttaattatta

SEQ ID NO: 2438443 - DNA, 14 bp, Homo sapiens
aatgttctaagttt

SEQ ID NO: 2438444 - DNA, 16 bp, Homo sapiens
aatgttctaagtttct

SEQ ID NO: 2438445 - DNA, 21 bp, Homo sapiens
aatgttctaagtttctaagat

SEQ ID NO: 2438446 - DNA, 23 bp, Homo sapiens
aatgttctaagtttctaagattc

SEQ ID NO: 2438447 - DNA, 22 bp, Homo sapiens
aatgttgaaatatgatgttaaa

SEQ ID NO: 2438448 - DNA, 18 bp, Homo sapiens
aatgttgagaatcccaaa

SEQ ID NO: 2438449 - DNA, 14 bp, Homo sapiens
aatgttgctgaaaa

SEQ ID NO: 2438450 - DNA, 23 bp, Homo sapiens
aatgtttacactctttgtaagag

SEQ ID NO: 2438451 - DNA, 14 bp, Homo sapiens
aatgtttttctaaa

SEQ ID NO: 2438452 - DNA, 13 bp, Homo sapiens
aattaaaaaagat

SEQ ID NO: 2438453 - DNA, 16 bp, Homo sapiens
aattaaaaaagataaa

SEQ ID NO: 2438454 - DNA, 18 bp, Homo sapiens
aattaaaaaagataaaca

SEQ ID NO: 2438455 - DNA, 19 bp, Homo sapiens
aattaaaaaagataaacac

SEQ ID NO: 2438456 - DNA, 16 bp, Homo sapiens
aattaaaagcaaatca

SEQ ID NO: 2438457 - DNA, 18 bp, Homo sapiens
aattaaaagcaaatcatt

SEQ ID NO: 2438458 - DNA, 20 bp, Homo sapiens
aattaaaagcaaatcatttg

SEQ ID NO: 2438459 - DNA, 14 bp, Homo sapiens
aattaaagtacttt

SEQ ID NO: 2438460 - DNA, 18 bp, Homo sapiens
aattaactgggtaatgaa

SEQ ID NO: 2438461 - DNA, 19 bp, Homo sapiens
aattaatatccctacatgt

SEQ ID NO: 2438462 - DNA, 23 bp, Homo sapiens
aattaattcctgtttgtctacat

SEQ ID NO: 2438463 - DNA, 12 bp, Homo sapiens
aattaattgtaa

SEQ ID NO: 2438464 - DNA, 15 bp, Homo sapiens
aattaattgtaatct

SEQ ID NO: 2438465 - DNA, 22 bp, Homo sapiens
aattacagaaatttaattcaga

SEQ ID NO: 2438466 - DNA, 21 bp, Homo sapiens
aattagactgtgattcagaaa

SEQ ID NO: 2438467 - DNA, 21 bp, Homo sapiens
aattaggctgtaactacttta

SEQ ID NO: 2438468 - DNA, 17 bp, Homo sapiens
aattagtaacatgtgtt

SEQ ID NO: 2438469 - DNA, 15 bp, Homo sapiens
aattagtgccactta

SEQ ID NO: 2438470 - DNA, 14 bp, Homo sapiens
aattagttatatat

SEQ ID NO: 2438471 - DNA, 18 bp, Homo sapiens
aattataactggaaagaa

SEQ ID NO: 2438472 - DNA, 20 bp, Homo sapiens
aattataactgtaaagatgt

SEQ ID NO: 2438473 - DNA, 13 bp, Homo sapiens
aattatagtttct

SEQ ID NO: 2438474 - DNA, 14 bp, Homo sapiens
aattatagtttctg

SEQ ID NO: 2438475 - DNA, 15 bp, Homo sapiens
aattatagtttctga

SEQ ID NO: 2438476 - DNA, 17 bp, Homo sapiens
aattatataactgtatt

SEQ ID NO: 2438477 - DNA, 22 bp, Homo sapiens
aattatcaggcaaatttgcatt

SEQ ID NO: 2438478 - DNA, 18 bp, Homo sapiens
aattatctaatttataaa

SEQ ID NO: 2438479 - DNA, 19 bp, Homo sapiens
aattatctaatttataaaa

SEQ ID NO: 2438480 - DNA, 16 bp, Homo sapiens
aattatgtagctcttt

SEQ ID NO: 2438481 - DNA, 17 bp, Homo sapiens
aattattaatgaaaata

SEQ ID NO: 2438482 - DNA, 23 bp, Homo sapiens
aattattacagtgtttatccttt

SEQ ID NO: 2438483 - DNA, 21 bp, Homo sapiens
aattattattcttcataacaa

SEQ ID NO: 2438484 - DNA, 11 bp, Homo sapiens
aattattattt

SEQ ID NO: 2438485 - DNA, 12 bp, Homo sapiens
aattattatttg

SEQ ID NO: 2438486 - DNA, 16 bp, Homo sapiens
aattattatttgtgtt

SEQ ID NO: 2438487 - DNA, 19 bp, Homo sapiens
aattattttttttctttta

SEQ ID NO: 2438488 - DNA, 19 bp, Homo sapiens
aattcacaaacttttatac

SEQ ID NO: 2438489 - DNA, 21 bp, Homo sapiens
aattcacatctaacctcatct

SEQ ID NO: 2438490 - DNA, 21 bp, Homo sapiens
aattcagacatctgaggtttt

SEQ ID NO: 2438491 - DNA, 14 bp, Homo sapiens
aattcagtttcata

SEQ ID NO: 2438492 - DNA, 18 bp, Homo sapiens
aattcattttttaaattc

SEQ ID NO: 2438493 - DNA, 20 bp, Homo sapiens
aattccacaccttttattga

SEQ ID NO: 2438494 - DNA, 20 bp, Homo sapiens
aattcccgttttgtcacttt

SEQ ID NO: 2438495 - DNA, 13 bp, Homo sapiens
aattcgtgtgttt

SEQ ID NO: 2438496 - DNA, 15 bp, Homo sapiens
aattctatgcctgtc

SEQ ID NO: 2438497 - DNA, 23 bp, Homo sapiens
aattctctccccctatttattga

SEQ ID NO: 2438498 - DNA, 19 bp, Homo sapiens
aattctttcaatacagata

SEQ ID NO: 2438499 - DNA, 20 bp, Homo sapiens
aattctttcaatacagatat

SEQ ID NO: 2438500 - DNA, 21 bp, Homo sapiens
aattctttcaatacagatata

SEQ ID NO: 2438501 - DNA, 16 bp, Homo sapiens
aattgaaatgtaaggc

SEQ ID NO: 2438502 - DNA, 23 bp, Homo sapiens
aattgaacctttgtgccctatca

SEQ ID NO: 2438503 - DNA, 21 bp, Homo sapiens
aattgaatactttgaatgtgt

SEQ ID NO: 2438504 - DNA, 22 bp, Homo sapiens
aattgatttgcattgaacacaa

SEQ ID NO: 2438505 - DNA, 23 bp, Homo sapiens
aattgatttttctcttcattttt

SEQ ID NO: 2438506 - DNA, 20 bp, Homo sapiens
aattgcacaccttggaattc

SEQ ID NO: 2438507 - DNA, 22 bp, Homo sapiens
aattgcacgcggagtgagtttt

SEQ ID NO: 2438508 - DNA, 18 bp, Homo sapiens
aattgctgactgtagctt

SEQ ID NO: 2438509 - DNA, 13 bp, Homo sapiens
aattgctgctact

SEQ ID NO: 2438510 - DNA, 13 bp, Homo sapiens
aattgcttattta

SEQ ID NO: 2438511 - DNA, 22 bp, Homo sapiens
aattgcttatttattgtattct

SEQ ID NO: 2438512 - DNA, 11 bp, Homo sapiens
aattggatttc

SEQ ID NO: 2438513 - DNA, 23 bp, Homo sapiens
aattggcatggaaatttaaagca

SEQ ID NO: 2438514 - DNA, 20 bp, Homo sapiens
aattgggccagcttttcaaa

SEQ ID NO: 2438515 - DNA, 13 bp, Homo sapiens
aattgtaatctga

SEQ ID NO: 2438516 - DNA, 14 bp, Homo sapiens
aattgtatattgta

SEQ ID NO: 2438517 - DNA, 21 bp, Homo sapiens
aattgtgattagacagaacac

SEQ ID NO: 2438518 - DNA, 17 bp, Homo sapiens
aattgtggtttatatat

SEQ ID NO: 2438519 - DNA, 16 bp, Homo sapiens
aattgtgtagcctttt

SEQ ID NO: 2438520 - DNA, 17 bp, Homo sapiens
aattgttgagatacttt

SEQ ID NO: 2438521 - DNA, 16 bp, Homo sapiens
aattgttgttctgtta

SEQ ID NO: 2438522 - DNA, 23 bp, Homo sapiens
aattgttgttctgttaactgaat

SEQ ID NO: 2438523 - DNA, 19 bp, Homo sapiens
aattgttttatctgaattt

SEQ ID NO: 2438524 - DNA, 12 bp, Homo sapiens
aatttaaagcag

SEQ ID NO: 2438525 - DNA, 13 bp, Homo sapiens
aatttacctaaga

SEQ ID NO: 2438526 - DNA, 18 bp, Homo sapiens
aatttacctaagattaca

SEQ ID NO: 2438527 - DNA, 15 bp, Homo sapiens
aatttagaaaacttt

SEQ ID NO: 2438528 - DNA, 15 bp, Homo sapiens
aatttagaaatcatt

SEQ ID NO: 2438529 - DNA, 16 bp, Homo sapiens
aatttataaaaaggtg

SEQ ID NO: 2438530 - DNA, 16 bp, Homo sapiens
aatttcaaaatgcttt

SEQ ID NO: 2438531 - DNA, 15 bp, Homo sapiens
aatttcaaggttcta

SEQ ID NO: 2438532 - DNA, 16 bp, Homo sapiens
aatttcaaggttctaa

SEQ ID NO: 2438533 - DNA, 23 bp, Homo sapiens
aatttcactgtctttaattctgt

SEQ ID NO: 2438534 - DNA, 21 bp, Homo sapiens
aatttcaggaggaatactgaa

SEQ ID NO: 2438535 - DNA, 15 bp, Homo sapiens
aatttcccaggaccc

SEQ ID NO: 2438536 - DNA, 16 bp, Homo sapiens
aatttcccaggaccct

SEQ ID NO: 2438537 - DNA, 22 bp, Homo sapiens
aatttcccaggaccctgaaggg

SEQ ID NO: 2438538 - DNA, 16 bp, Homo sapiens
aatttctactttgaag

SEQ ID NO: 2438539 - DNA, 17 bp, Homo sapiens
aatttctactttgaagt

SEQ ID NO: 2438540 - DNA, 12 bp, Homo sapiens
aatttcttaact

SEQ ID NO: 2438541 - DNA, 15 bp, Homo sapiens
aatttcttaacttct

SEQ ID NO: 2438542 - DNA, 16 bp, Homo sapiens
aatttcttaacttctt

SEQ ID NO: 2438543 - DNA, 18 bp, Homo sapiens
aatttgacttttctgtaa

SEQ ID NO: 2438544 - DNA, 19 bp, Homo sapiens
aatttgacttttctgtaat

SEQ ID NO: 2438545 - DNA, 13 bp, Homo sapiens
aatttgagtgctc

SEQ ID NO: 2438546 - DNA, 16 bp, Homo sapiens
aatttgattgatttga

SEQ ID NO: 2438547 - DNA, 23 bp, Homo sapiens
aatttgcattaaattcacaaact

SEQ ID NO: 2438548 - DNA, 12 bp, Homo sapiens
aatttggattta

SEQ ID NO: 2438549 - DNA, 15 bp, Homo sapiens
aatttggcaattttg

SEQ ID NO: 2438550 - DNA, 18 bp, Homo sapiens
aatttgtaatgtcttgag

SEQ ID NO: 2438551 - DNA, 15 bp, Homo sapiens
aatttgttcttgtat

SEQ ID NO: 2438552 - DNA, 17 bp, Homo sapiens
aatttgttttggatata

SEQ ID NO: 2438553 - DNA, 15 bp, Homo sapiens
aattttataatctgc

SEQ ID NO: 2438554 - DNA, 20 bp, Homo sapiens
aattttatactttccctacc

SEQ ID NO: 2438555 - DNA, 18 bp, Homo sapiens
aattttcatctaggattt

SEQ ID NO: 2438556 - DNA, 14 bp, Homo sapiens
aattttgaagtgct

SEQ ID NO: 2438557 - DNA, 18 bp, Homo sapiens
aattttgtggttttcgag

SEQ ID NO: 2438558 - DNA, 15 bp, Homo sapiens
aatttttaaacaagt

SEQ ID NO: 2438559 - DNA, 19 bp, Homo sapiens
aatttttaaacaagtattt

SEQ ID NO: 2438560 - DNA, 14 bp, Homo sapiens
aatttttacagaat

SEQ ID NO: 2438561 - DNA, 15 bp, Homo sapiens
aatttttatttcttc

SEQ ID NO: 2438562 - DNA, 13 bp, Homo sapiens
aatttttcttctt

SEQ ID NO: 2438563 - DNA, 21 bp, Homo sapiens
aattttttaagtgaaaatata

SEQ ID NO: 2438564 - DNA, 19 bp, Homo sapiens
aatttttttaatttacaaa

SEQ ID NO: 2438565 - DNA, 18 bp, Homo sapiens
aatttttttgtattttag

SEQ ID NO: 2438566 - DNA, 22 bp, Homo sapiens
aattttttttattagtattgtt

SEQ ID NO: 2438567 - DNA, 19 bp, Homo sapiens
acaaaaagctaataccagt

SEQ ID NO: 2438568 - DNA, 20 bp, Homo sapiens
acaaaaaggttctcaggtgt

SEQ ID NO: 2438569 - DNA, 13 bp, Homo sapiens
acaaaacaaactc

SEQ ID NO: 2438570 - DNA, 20 bp, Homo sapiens
acaaaatcaggtaactaact

SEQ ID NO: 2438571 - DNA, 13 bp, Homo sapiens
acaaacaatgaaa

SEQ ID NO: 2438572 - DNA, 21 bp, Homo sapiens
acaaactcgttttttacaaag

SEQ ID NO: 2438573 - DNA, 13 bp, Homo sapiens
acaaactgtaaat

SEQ ID NO: 2438574 - DNA, 19 bp, Homo sapiens
acaaactgtaatacaatga

SEQ ID NO: 2438575 - DNA, 12 bp, Homo sapiens
acaaagaacctt

SEQ ID NO: 2438576 - DNA, 15 bp, Homo sapiens
acaaagaccctggct

SEQ ID NO: 2438577 - DNA, 16 bp, Homo sapiens
acaaagagttcaagaa

SEQ ID NO: 2438578 - DNA, 21 bp, Homo sapiens
acaaagagttcaagaaataag

SEQ ID NO: 2438579 - DNA, 22 bp, Homo sapiens
acaaagagttcaagaaataagt

SEQ ID NO: 2438580 - DNA, 13 bp, Homo sapiens
acaaagcagccac

SEQ ID NO: 2438581 - DNA, 16 bp, Homo sapiens
acaaagcccttttata

SEQ ID NO: 2438582 - DNA, 13 bp, Homo sapiens
acaaaggagcctg

SEQ ID NO: 2438583 - DNA, 23 bp, Homo sapiens
acaaaggagcctgtgaacccagg

SEQ ID NO: 2438584 - DNA, 11 bp, Homo sapiens
acaaaggcaag

SEQ ID NO: 2438585 - DNA, 15 bp, Homo sapiens
acaaaggtttaaatg

SEQ ID NO: 2438586 - DNA, 19 bp, Homo sapiens
acaaaggtttaaatgaaca

SEQ ID NO: 2438587 - DNA, 22 bp, Homo sapiens
acaaaggtttaaatgaacaaga

SEQ ID NO: 2438588 - DNA, 23 bp, Homo sapiens
acaaaggtttaaatgaacaagag

SEQ ID NO: 2438589 - DNA, 15 bp, Homo sapiens
acaaatcagaagtca

SEQ ID NO: 2438590 - DNA, 16 bp, Homo sapiens
acaaatcagaagtcat

SEQ ID NO: 2438591 - DNA, 20 bp, Homo sapiens
acaaatcagaagtcatcttg

SEQ ID NO: 2438592 - DNA, 20 bp, Homo sapiens
acaacatttctatagccaaa

SEQ ID NO: 2438593 - DNA, 16 bp, Homo sapiens
acaaccaatggaatgt

SEQ ID NO: 2438594 - DNA, 15 bp, Homo sapiens
acaactattttcaga

SEQ ID NO: 2438595 - DNA, 20 bp, Homo sapiens
acaactattttcagatgtga

SEQ ID NO: 2438596 - DNA, 16 bp, Homo sapiens
acaactcactcctttt

SEQ ID NO: 2438597 - DNA, 21 bp, Homo sapiens
acaactcactccttttaaaga

SEQ ID NO: 2438598 - DNA, 17 bp, Homo sapiens
acaacttctaattgcca

SEQ ID NO: 2438599 - DNA, 23 bp, Homo sapiens
acaagaaaaataaagaaaagatg

SEQ ID NO: 2438600 - DNA, 15 bp, Homo sapiens
acaagaagcattttg

SEQ ID NO: 2438601 - DNA, 13 bp, Homo sapiens
acaagaatggatc

SEQ ID NO: 2438602 - DNA, 14 bp, Homo sapiens
acaagaatggatca

SEQ ID NO: 2438603 - DNA, 23 bp, Homo sapiens
acaagaatggatcacaagatgga

SEQ ID NO: 2438604 - DNA, 15 bp, Homo sapiens
acaagacccccagca

SEQ ID NO: 2438605 - DNA, 14 bp, Homo sapiens
acaagagaagcatt

SEQ ID NO: 2438606 - DNA, 19 bp, Homo sapiens
acaagagaagcattctcat

SEQ ID NO: 2438607 - DNA, 24 bp, Homo sapiens
acaagattggtgtttttttctatg

SEQ ID NO: 2438608 - DNA, 22 bp, Homo sapiens
acaagccagaacttgaccctga

SEQ ID NO: 2438609 - DNA, 11 bp, Homo sapiens
acaagcctctg

SEQ ID NO: 2438610 - DNA, 18 bp, Homo sapiens
acaagcctctgcccaggc

SEQ ID NO: 2438611 - DNA, 12 bp, Homo sapiens
acaagcctgagg

SEQ ID NO: 2438612 - DNA, 15 bp, Homo sapiens
acaagcttctgagac

SEQ ID NO: 2438613 - DNA, 16 bp, Homo sapiens
acaagcttctgtcctg

SEQ ID NO: 2438614 - DNA, 18 bp, Homo sapiens
acaaggatagatgctggc

SEQ ID NO: 2438615 - DNA, 16 bp, Homo sapiens
acaaggtctttaaagt

SEQ ID NO: 2438616 - DNA, 14 bp, Homo sapiens
acaagtatttgtta

SEQ ID NO: 2438617 - DNA, 20 bp, Homo sapiens
acaagtatttgttaatttag

SEQ ID NO: 2438618 - DNA, 12 bp, Homo sapiens
acaagtattttt

SEQ ID NO: 2438619 - DNA, 14 bp, Homo sapiens
acaagtgccctcca

SEQ ID NO: 2438620 - DNA, 19 bp, Homo sapiens
acaagtggactcagggcag

SEQ ID NO: 2438621 - DNA, 17 bp, Homo sapiens
acaagttggagtcactc

SEQ ID NO: 2438622 - DNA, 18 bp, Homo sapiens
acaagttggagtcactct

SEQ ID NO: 2438623 - DNA, 12 bp, Homo sapiens
acaataaaacat

SEQ ID NO: 2438624 - DNA, 13 bp, Homo sapiens
acaatacaaatgg

SEQ ID NO: 2438625 - DNA, 16 bp, Homo sapiens
acaatacaaatggatt

SEQ ID NO: 2438626 - DNA, 19 bp, Homo sapiens
acaatcagccacattctag

SEQ ID NO: 2438627 - DNA, 22 bp, Homo sapiens
acaatcagctccttcctggaga

SEQ ID NO: 2438628 - DNA, 22 bp, Homo sapiens
acaatgatcctgtattcagaca

SEQ ID NO: 2438629 - DNA, 12 bp, Homo sapiens
acaatgtaatta

SEQ ID NO: 2438630 - DNA, 18 bp, Homo sapiens
acaatgtaattatttatg

SEQ ID NO: 2438631 - DNA, 21 bp, Homo sapiens
acaatgtagataagtgttctg

SEQ ID NO: 2438632 - DNA, 13 bp, Homo sapiens
acaattgaagtaa

SEQ ID NO: 2438633 - DNA, 20 bp, Homo sapiens
acaatttggcaattttgtgg

SEQ ID NO: 2438634 - DNA, 17 bp, Homo sapiens
acaattttttttattag

SEQ ID NO: 2438635 - DNA, 14 bp, Homo sapiens
acacaaacacacac

SEQ ID NO: 2438636 - DNA, 14 bp, Homo sapiens
acacaaactgtaaa

SEQ ID NO: 2438637 - DNA, 13 bp, Homo sapiens
acacaactcactc

SEQ ID NO: 2438638 - DNA, 18 bp, Homo sapiens
acacaagattggtgtttt

SEQ ID NO: 2438639 - DNA, 19 bp, Homo sapiens
acacaagattggtgttttt

SEQ ID NO: 2438640 - DNA, 20 bp, Homo sapiens
acacaagattggtgtttttt

SEQ ID NO: 2438641 - DNA, 23 bp, Homo sapiens
acacaagattggtgtttttttct

SEQ ID NO: 2438642 - DNA, 12 bp, Homo sapiens
acacacagtacg

SEQ ID NO: 2438643 - DNA, 19 bp, Homo sapiens
acacacatacgtgcacagg

SEQ ID NO: 2438644 - DNA, 23 bp, Homo sapiens
acacacattgctgtgaacaggaa

SEQ ID NO: 2438645 - DNA, 20 bp, Homo sapiens
acacacctgtagcacttact

SEQ ID NO: 2438646 - DNA, 20 bp, Homo sapiens
acacactaccgaatgtgtct

SEQ ID NO: 2438647 - DNA, 22 bp, Homo sapiens
acacactaccgaatgtgtcttt

SEQ ID NO: 2438648 - DNA, 13 bp, Homo sapiens
acacactgatgct

SEQ ID NO: 2438649 - DNA, 17 bp, Homo sapiens
acacactgatgcttaga

SEQ ID NO: 2438650 - DNA, 18 bp, Homo sapiens
acacagaaacctttttaa

SEQ ID NO: 2438651 - DNA, 21 bp, Homo sapiens
acacagaaacctttttaaaaa

SEQ ID NO: 2438652 - DNA, 11 bp, Homo sapiens
acacagctgcc

SEQ ID NO: 2438653 - DNA, 16 bp, Homo sapiens
acacaggcatttcctg

SEQ ID NO: 2438654 - DNA, 13 bp, Homo sapiens
acacaggcctgtg

SEQ ID NO: 2438655 - DNA, 16 bp, Homo sapiens
acacaggcctgtgtag

SEQ ID NO: 2438656 - DNA, 22 bp, Homo sapiens
acacaggggcttgactttttca

SEQ ID NO: 2438657 - DNA, 18 bp, Homo sapiens
acacatacgtgcacaggg

SEQ ID NO: 2438658 - DNA, 14 bp, Homo sapiens
acacatttgctttt

SEQ ID NO: 2438659 - DNA, 14 bp, Homo sapiens
acaccaagcacagc

SEQ ID NO: 2438660 - DNA, 13 bp, Homo sapiens
acaccactagcct

SEQ ID NO: 2438661 - DNA, 20 bp, Homo sapiens
acaccactctggcagccaca

SEQ ID NO: 2438662 - DNA, 22 bp, Homo sapiens
acaccaggatagagactggaac

SEQ ID NO: 2438663 - DNA, 17 bp, Homo sapiens
acaccagggccagcctc

SEQ ID NO: 2438664 - DNA, 16 bp, Homo sapiens
acacccatttttcctt

SEQ ID NO: 2438665 - DNA, 13 bp, Homo sapiens
acaccctgtactg

SEQ ID NO: 2438666 - DNA, 22 bp, Homo sapiens
acaccctgtactgttctgtgtc

SEQ ID NO: 2438667 - DNA, 17 bp, Homo sapiens
acacccttctcccactc

SEQ ID NO: 2438668 - DNA, 21 bp, Homo sapiens
acacccttctcccactctcct

SEQ ID NO: 2438669 - DNA, 20 bp, Homo sapiens
acacctattatcccagctgc

SEQ ID NO: 2438670 - DNA, 11 bp, Homo sapiens
acacctccttc

SEQ ID NO: 2438671 - DNA, 19 bp, Homo sapiens
acacctccttccctctctg

SEQ ID NO: 2438672 - DNA, 22 bp, Homo sapiens
acacctccttccctctctggag

SEQ ID NO: 2438673 - DNA, 14 bp, Homo sapiens
acaccttccagctc

SEQ ID NO: 2438674 - DNA, 16 bp, Homo sapiens
acacgcacctgcctca

SEQ ID NO: 2438675 - DNA, 17 bp, Homo sapiens
acacgcttttgtgatgg

SEQ ID NO: 2438676 - DNA, 14 bp, Homo sapiens
acacggccacatca

SEQ ID NO: 2438677 - DNA, 13 bp, Homo sapiens
acactaatatatt

SEQ ID NO: 2438678 - DNA, 21 bp, Homo sapiens
acactaccgaatgtgtcttta

SEQ ID NO: 2438679 - DNA, 23 bp, Homo sapiens
acactagccttggcctctttcct

SEQ ID NO: 2438680 - DNA, 15 bp, Homo sapiens
acactcagaagcctg

SEQ ID NO: 2438681 - DNA, 16 bp, Homo sapiens
acactcagaagcctgg

SEQ ID NO: 2438682 - DNA, 17 bp, Homo sapiens
acactcagaagcctggg

SEQ ID NO: 2438683 - DNA, 19 bp, Homo sapiens
acactcagacctgaattct

SEQ ID NO: 2438684 - DNA, 19 bp, Homo sapiens
acactcagatcctcctcat

SEQ ID NO: 2438685 - DNA, 23 bp, Homo sapiens
acactcagtggcccatggcattt

SEQ ID NO: 2438686 - DNA, 15 bp, Homo sapiens
acactccccgaagtc

SEQ ID NO: 2438687 - DNA, 14 bp, Homo sapiens
acactcccttgggc

SEQ ID NO: 2438688 - DNA, 17 bp, Homo sapiens
acactcgtatgatactt

SEQ ID NO: 2438689 - DNA, 16 bp, Homo sapiens
acactctgctgtttga

SEQ ID NO: 2438690 - DNA, 17 bp, Homo sapiens
acactctgctgtttgac

SEQ ID NO: 2438691 - DNA, 12 bp, Homo sapiens
acactctttgta

SEQ ID NO: 2438692 - DNA, 23 bp, Homo sapiens
acactgaaaaatctaagtgatat

SEQ ID NO: 2438693 - DNA, 19 bp, Homo sapiens
acactgctctaacagccct

SEQ ID NO: 2438694 - DNA, 20 bp, Homo sapiens
acactgctctaacagccctc

SEQ ID NO: 2438695 - DNA, 13 bp, Homo sapiens
acactggcccctc

SEQ ID NO: 2438696 - DNA, 14 bp, Homo sapiens
acactggcccctca

SEQ ID NO: 2438697 - DNA, 23 bp, Homo sapiens
acactgggtggtggcctggtccc

SEQ ID NO: 2438698 - DNA, 12 bp, Homo sapiens
acactgttctta

SEQ ID NO: 2438699 - DNA, 15 bp, Homo sapiens
acactgttcttagct

SEQ ID NO: 2438700 - DNA, 22 bp, Homo sapiens
acactgttcttagctcaatgag

SEQ ID NO: 2438701 - DNA, 14 bp, Homo sapiens
acacttaatactac

SEQ ID NO: 2438702 - DNA, 16 bp, Homo sapiens
acacttctcaggacac

SEQ ID NO: 2438703 - DNA, 19 bp, Homo sapiens
aagggctgccggggcagcc

SEQ ID NO: 2438704 - DNA, 16 bp, Homo sapiens
aagggctgcttccctg

SEQ ID NO: 2438705 - DNA, 15 bp, Homo sapiens
aaggggcctgagcag

SEQ ID NO: 2438706 - DNA, 22 bp, Homo sapiens
aaggggcttcaggtccaggctg

SEQ ID NO: 2438707 - DNA, 16 bp, Homo sapiens
aaggggttggattgca

SEQ ID NO: 2438708 - DNA, 13 bp, Homo sapiens
aagggtaaacaat

SEQ ID NO: 2438709 - DNA, 11 bp, Homo sapiens
aagggtcaggc

SEQ ID NO: 2438710 - DNA, 12 bp, Homo sapiens
aagggtcaggcc

SEQ ID NO: 2438711 - DNA, 22 bp, Homo sapiens
acctagctgaatgtttttctaa

SEQ ID NO: 2438712 - DNA, 18 bp, Homo sapiens
acctatacctgtgtttct

SEQ ID NO: 2438713 - DNA, 17 bp, Homo sapiens
acctatcccacctccat

SEQ ID NO: 2438714 - DNA, 15 bp, Homo sapiens
acctcaaaatttaac

SEQ ID NO: 2438715 - DNA, 19 bp, Homo sapiens
acctcaagtgatctgccca

SEQ ID NO: 2438716 - DNA, 23 bp, Homo sapiens
acctcaagtgatctgcccacctc

SEQ ID NO: 2438717 - DNA, 16 bp, Homo sapiens
acctcagatggcagct

SEQ ID NO: 2438718 - DNA, 18 bp, Homo sapiens
acctcagatggcagcttt

SEQ ID NO: 2438719 - DNA, 19 bp, Homo sapiens
acctcagatggcagctttt

SEQ ID NO: 2438720 - DNA, 21 bp, Homo sapiens
acctcagatggcagcttttaa

SEQ ID NO: 2438721 - DNA, 12 bp, Homo sapiens
acctcagcctgg

SEQ ID NO: 2438722 - DNA, 12 bp, Homo sapiens
acctcaggcagc

SEQ ID NO: 2438723 - DNA, 15 bp, Homo sapiens
acctcagtaatttag

SEQ ID NO: 2438724 - DNA, 20 bp, Homo sapiens
aatggcgtctggaagtccaa

SEQ ID NO: 2438725 - DNA, 14 bp, Homo sapiens
aatggctatgtttt

SEQ ID NO: 2438726 - DNA, 17 bp, Homo sapiens
agacttctctttgcctc

SEQ ID NO: 2438727 - DNA, 12 bp, Homo sapiens
agactttaacat

SEQ ID NO: 2438728 - DNA, 21 bp, Homo sapiens
agactttaacataagctattt

SEQ ID NO: 2438729 - DNA, 14 bp, Homo sapiens
agagaaaaaagcca

SEQ ID NO: 2438730 - DNA, 18 bp, Homo sapiens
agagaaaccagcttcctt

SEQ ID NO: 2438731 - DNA, 21 bp, Homo sapiens
agagaaaggggagcccactgt

SEQ ID NO: 2438732 - DNA, 13 bp, Homo sapiens
agagaaccaggct

SEQ ID NO: 2438733 - DNA, 15 bp, Homo sapiens
agagaacccagccca

SEQ ID NO: 2438734 - DNA, 23 bp, Homo sapiens
agagaagcattctcattggaaat

SEQ ID NO: 2438735 - DNA, 12 bp, Homo sapiens
agagaagccagc

SEQ ID NO: 2438736 - DNA, 13 bp, Homo sapiens
agagaagccagct

SEQ ID NO: 2438737 - DNA, 16 bp, Homo sapiens
agagaagccagcttgt

SEQ ID NO: 2438738 - DNA, 13 bp, Homo sapiens
agagaagccatca

SEQ ID NO: 2438739 - DNA, 12 bp, Homo sapiens
agagaagccttc

SEQ ID NO: 2438740 - DNA, 13 bp, Homo sapiens
agagaagccttca

SEQ ID NO: 2438741 - DNA, 21 bp, Homo sapiens
agagaagccttcaagctctga

SEQ ID NO: 2438742 - DNA, 17 bp, Homo sapiens
agagacatacttgaagg

SEQ ID NO: 2438743 - DNA, 23 bp, Homo sapiens
agagacatacttgaagggccaga

SEQ ID NO: 2438744 - DNA, 13 bp, Homo sapiens
agagacatcagcc

SEQ ID NO: 2438745 - DNA, 13 bp, Homo sapiens
agagaccagggct

SEQ ID NO: 2438746 - DNA, 12 bp, Homo sapiens
agagacttgttt

SEQ ID NO: 2438747 - DNA, 15 bp, Homo sapiens
agagagaaaggactc

SEQ ID NO: 2438748 - DNA, 13 bp, Homo sapiens
agagagcccgagg

SEQ ID NO: 2438749 - DNA, 18 bp, Homo sapiens
agagagcctgcaggatct

SEQ ID NO: 2438750 - DNA, 18 bp, Homo sapiens
agagatccaaaagaagcc

SEQ ID NO: 2438751 - DNA, 18 bp, Homo sapiens
agagatgcctccctgagc

SEQ ID NO: 2438752 - DNA, 14 bp, Homo sapiens
agagatgtgtgttg

SEQ ID NO: 2438753 - DNA, 21 bp, Homo sapiens
agagatgtgtgttgatactgt

SEQ ID NO: 2438754 - DNA, 22 bp, Homo sapiens
agagatgtgtgttgatactgtt

SEQ ID NO: 2438755 - DNA, 19 bp, Homo sapiens
agagattacctcctgagaa

SEQ ID NO: 2438756 - DNA, 20 bp, Homo sapiens
agagattacctcctgagaaa

SEQ ID NO: 2438757 - DNA, 23 bp, Homo sapiens
agagattgggtttttggacttct

SEQ ID NO: 2438758 - DNA, 17 bp, Homo sapiens
agagcacctgctgtctg

SEQ ID NO: 2438759 - DNA, 12 bp, Homo sapiens
agagcactgcca

SEQ ID NO: 2438760 - DNA, 18 bp, Homo sapiens
agagcactgccaccagta

SEQ ID NO: 2438761 - DNA, 12 bp, Homo sapiens
agagcagaggtc

SEQ ID NO: 2438762 - DNA, 12 bp, Homo sapiens
agagcagcacct

SEQ ID NO: 2438763 - DNA, 23 bp, Homo sapiens
agagcagcacctcctcagcctga

SEQ ID NO: 2438764 - DNA, 14 bp, Homo sapiens
agagcaggaatggg

SEQ ID NO: 2438765 - DNA, 13 bp, Homo sapiens
agagcaggactcc

SEQ ID NO: 2438766 - DNA, 15 bp, Homo sapiens
agagcaggactccag

SEQ ID NO: 2438767 - DNA, 17 bp, Homo sapiens
agagcaggactccaggc

SEQ ID NO: 2438768 - DNA, 24 bp, Homo sapiens
agagcagggattaacctctgcact

SEQ ID NO: 2438769 - DNA, 17 bp, Homo sapiens
agagcaggtgagatggg

SEQ ID NO: 2438770 - DNA, 13 bp, Homo sapiens
agagcatagggtc

SEQ ID NO: 2438771 - DNA, 15 bp, Homo sapiens
agagcatcatgcctc

SEQ ID NO: 2438772 - DNA, 18 bp, Homo sapiens
agagcatcatgcctctga

SEQ ID NO: 2438773 - DNA, 19 bp, Homo sapiens
agagcatcatgcctctgag

SEQ ID NO: 2438774 - DNA, 20 bp, Homo sapiens
agagcatcatgcctctgagg

SEQ ID NO: 2438775 - DNA, 22 bp, Homo sapiens
agagcatcatgcctctgaggcc

SEQ ID NO: 2438776 - DNA, 19 bp, Homo sapiens
agagccaccaagagggacg

SEQ ID NO: 2438777 - DNA, 13 bp, Homo sapiens
agagccaggagaa

SEQ ID NO: 2438778 - DNA, 16 bp, Homo sapiens
agagccaggagaagct

SEQ ID NO: 2438779 - DNA, 22 bp, Homo sapiens
agagccaggggggtgaggagct

SEQ ID NO: 2438780 - DNA, 23 bp, Homo sapiens
agagcccactccatctggtagaa

SEQ ID NO: 2438781 - DNA, 12 bp, Homo sapiens
agagcccagctc

SEQ ID NO: 2438782 - DNA, 17 bp, Homo sapiens
agagcccaggagctccc

SEQ ID NO: 2438783 - DNA, 12 bp, Homo sapiens
agagccctggga

SEQ ID NO: 2438784 - DNA, 18 bp, Homo sapiens
agagccgggtgtccccaa

SEQ ID NO: 2438785 - DNA, 14 bp, Homo sapiens
agagcctgcaggat

SEQ ID NO: 2438786 - DNA, 17 bp, Homo sapiens
agagcctgcaggatctc

SEQ ID NO: 2438787 - DNA, 10 bp, Homo sapiens
agagcctggg

SEQ ID NO: 2438788 - DNA, 14 bp, Homo sapiens
agagctacataatt

SEQ ID NO: 2438789 - DNA, 18 bp, Homo sapiens
agagctacataatttagt

SEQ ID NO: 2438790 - DNA, 16 bp, Homo sapiens
agagctacgtatttaa

SEQ ID NO: 2438791 - DNA, 17 bp, Homo sapiens
agagctacgtatttaat

SEQ ID NO: 2438792 - DNA, 12 bp, Homo sapiens
agagctcaggat

SEQ ID NO: 2438793 - DNA, 23 bp, Homo sapiens
agagctgaaggttgtggcctttg

SEQ ID NO: 2438794 - DNA, 20 bp, Homo sapiens
agaataaaggcagttttcta

SEQ ID NO: 2438795 - DNA, 17 bp, Homo sapiens
agaataagttattgcag

SEQ ID NO: 2438796 - DNA, 19 bp, Homo sapiens
agaatagccacatttggaa

SEQ ID NO: 2438797 - DNA, 19 bp, Homo sapiens
agaatcccaaatttgattg

SEQ ID NO: 2438798 - DNA, 21 bp, Homo sapiens
agaatcccagccccctgacca

SEQ ID NO: 2438799 - DNA, 17 bp, Homo sapiens
agaatctgcaattcaaa

SEQ ID NO: 2438800 - DNA, 20 bp, Homo sapiens
agaatcttggtttgccttcc

SEQ ID NO: 2438801 - DNA, 14 bp, Homo sapiens
agaatgcttaatca

SEQ ID NO: 2438802 - DNA, 20 bp, Homo sapiens
agaatgcttaatcagataga

SEQ ID NO: 2438803 - DNA, 20 bp, Homo sapiens
agaatggatcacaagatgga

SEQ ID NO: 2438804 - DNA, 23 bp, Homo sapiens
agaatgtcattttggtactttgg

SEQ ID NO: 2438805 - DNA, 15 bp, Homo sapiens
agaattaaactttta

SEQ ID NO: 2438806 - DNA, 21 bp, Homo sapiens
agaattaaacttttaattcat

SEQ ID NO: 2438807 - DNA, 13 bp, Homo sapiens
agaattactgtaa

SEQ ID NO: 2438808 - DNA, 20 bp, Homo sapiens
agaattatctaatttataaa

SEQ ID NO: 2438809 - DNA, 11 bp, Homo sapiens
agaattattta

SEQ ID NO: 2438810 - DNA, 13 bp, Homo sapiens
agaattattttgt

SEQ ID NO: 2438811 - DNA, 13 bp, Homo sapiens
agaattcagacat

SEQ ID NO: 2438812 - DNA, 16 bp, Homo sapiens
agaattgttgagatac

SEQ ID NO: 2438813 - DNA, 17 bp, Homo sapiens
agaattgttgagatact

SEQ ID NO: 2438814 - DNA, 14 bp, Homo sapiens
agaatttagtgtat

SEQ ID NO: 2438815 - DNA, 17 bp, Homo sapiens
agaatttgagtgctctg

SEQ ID NO: 2438816 - DNA, 18 bp, Homo sapiens
agaatttgagtgctctga

SEQ ID NO: 2438817 - DNA, 19 bp, Homo sapiens
agacaaaaaactatatgta

SEQ ID NO: 2438818 - DNA, 20 bp, Homo sapiens
agacaacgtgctctttgttt

SEQ ID NO: 2438819 - DNA, 21 bp, Homo sapiens
agacaacgtgctctttgtttt

SEQ ID NO: 2438820 - DNA, 23 bp, Homo sapiens
agacaacgtgctctttgttttgt

SEQ ID NO: 2438821 - DNA, 17 bp, Homo sapiens
agacaagccagaacttg

SEQ ID NO: 2438822 - DNA, 16 bp, Homo sapiens
agacaattgacaacag

SEQ ID NO: 2438823 - DNA, 12 bp, Homo sapiens
agacacatgaag

SEQ ID NO: 2438824 - DNA, 20 bp, Homo sapiens
agacacatgaaggtaaataa

SEQ ID NO: 2438825 - DNA, 23 bp, Homo sapiens
agacacatgaaggtaaataaaaa

SEQ ID NO: 2438826 - DNA, 13 bp, Homo sapiens
agacaccaaagtt

SEQ ID NO: 2438827 - DNA, 15 bp, Homo sapiens
agacaccaaagttct

SEQ ID NO: 2438828 - DNA, 17 bp, Homo sapiens
agacaccaaagttctaa

SEQ ID NO: 2438829 - DNA, 22 bp, Homo sapiens
agacaccttggacatcctcctc

SEQ ID NO: 2438830 - DNA, 15 bp, Homo sapiens
agacactggcccctc

SEQ ID NO: 2438831 - DNA, 15 bp, Homo sapiens
agacagaaccacagg

SEQ ID NO: 2438832 - DNA, 12 bp, Homo sapiens
agacagaagaaa

SEQ ID NO: 2438833 - DNA, 14 bp, Homo sapiens
agacagaagaaaca

SEQ ID NO: 2438834 - DNA, 15 bp, Homo sapiens
agacagaagaaacaa

SEQ ID NO: 2438835 - DNA, 14 bp, Homo sapiens
agacagactagaag

SEQ ID NO: 2438836 - DNA, 20 bp, Homo sapiens
agacagagccaggagaagct

SEQ ID NO: 2438837 - DNA, 21 bp, Homo sapiens
agacagctccaccctggccga

SEQ ID NO: 2438838 - DNA, 22 bp, Homo sapiens
agacaggctggaagatagctgt

SEQ ID NO: 2438839 - DNA, 21 bp, Homo sapiens
agacagggaattaggccccca

SEQ ID NO: 2438840 - DNA, 22 bp, Homo sapiens
agacaggtccctccccttctct

SEQ ID NO: 2438841 - DNA, 13 bp, Homo sapiens
agacagtgatatt

SEQ ID NO: 2438842 - DNA, 23 bp, Homo sapiens
agacatacttgaagggccagagc

SEQ ID NO: 2438843 - DNA, 13 bp, Homo sapiens
agacatgaagcca

SEQ ID NO: 2438844 - DNA, 22 bp, Homo sapiens
agacatgatttccttgaatgtg

SEQ ID NO: 2438845 - DNA, 21 bp, Homo sapiens
agacatggaggttctaaggcc

SEQ ID NO: 2438846 - DNA, 12 bp, Homo sapiens
agacatgtgaca

SEQ ID NO: 2438847 - DNA, 16 bp, Homo sapiens
agacatgtgacattta

SEQ ID NO: 2438848 - DNA, 17 bp, Homo sapiens
agacatgtgacatttat

SEQ ID NO: 2438849 - DNA, 14 bp, Homo sapiens
agaccacatgcccc

SEQ ID NO: 2438850 - DNA, 16 bp, Homo sapiens
agaccaccccgcctgc

SEQ ID NO: 2438851 - DNA, 19 bp, Homo sapiens
agaccacgcccgtcctgcc

SEQ ID NO: 2438852 - DNA, 23 bp, Homo sapiens
agaccacgcccgtcctgcctgtg

SEQ ID NO: 2438853 - DNA, 16 bp, Homo sapiens
agaccagcagacagag

SEQ ID NO: 2438854 - DNA, 18 bp, Homo sapiens
agaccagggctccagccc

SEQ ID NO: 2438855 - DNA, 17 bp, Homo sapiens
agaccatccaccaggcc

SEQ ID NO: 2438856 - DNA, 17 bp, Homo sapiens
agacccagccctcatcc

SEQ ID NO: 2438857 - DNA, 18 bp, Homo sapiens
agacccagccctcatccc

SEQ ID NO: 2438858 - DNA, 14 bp, Homo sapiens
agacccagcggaca

SEQ ID NO: 2438859 - DNA, 17 bp, Homo sapiens
agacccattccttccca

SEQ ID NO: 2438860 - DNA, 14 bp, Homo sapiens
agacccccagcact

SEQ ID NO: 2438861 - DNA, 17 bp, Homo sapiens
agaccctaaacatccat

SEQ ID NO: 2438862 - DNA, 18 bp, Homo sapiens
agacccttgacacctgct

SEQ ID NO: 2438863 - DNA, 17 bp, Homo sapiens
agacccttttgggtttc

SEQ ID NO: 2438864 - DNA, 17 bp, Homo sapiens
agaccggcctgccagga

SEQ ID NO: 2438865 - DNA, 18 bp, Homo sapiens
agaccggcctgccaggag

SEQ ID NO: 2438866 - DNA, 14 bp, Homo sapiens
agacctacaggggg

SEQ ID NO: 2438867 - DNA, 19 bp, Homo sapiens
agacctacagggggtctgg

SEQ ID NO: 2438868 - DNA, 21 bp, Homo sapiens
agacctactgttctaaagctc

SEQ ID NO: 2438869 - DNA, 14 bp, Homo sapiens
agacctcagaagta

SEQ ID NO: 2438870 - DNA, 16 bp, Homo sapiens
agacctgagaatgtat

SEQ ID NO: 2438871 - DNA, 11 bp, Homo sapiens
agacctggcag

SEQ ID NO: 2438872 - DNA, 18 bp, Homo sapiens
agacctggcagctctgga

SEQ ID NO: 2438873 - DNA, 19 bp, Homo sapiens
agaccttgttacttctgag

SEQ ID NO: 2438874 - DNA, 15 bp, Homo sapiens
agacgcctgaggaac

SEQ ID NO: 2438875 - DNA, 18 bp, Homo sapiens
agacggaagggtaaacaa

SEQ ID NO: 2438876 - DNA, 19 bp, Homo sapiens
agacgtgatgccaggacca

SEQ ID NO: 2438877 - DNA, 16 bp, Homo sapiens
agactacagctggggt

SEQ ID NO: 2438878 - DNA, 21 bp, Homo sapiens
agactacagctggggtgcagg

SEQ ID NO: 2438879 - DNA, 13 bp, Homo sapiens
agactagatgtag

SEQ ID NO: 2438880 - DNA, 17 bp, Homo sapiens
agactatcttactattt

SEQ ID NO: 2438881 - DNA, 15 bp, Homo sapiens
agactatgaaaatgc

SEQ ID NO: 2438882 - DNA, 21 bp, Homo sapiens
agactatttttagattttctt

SEQ ID NO: 2438883 - DNA, 15 bp, Homo sapiens
agactcaaatgttct

SEQ ID NO: 2438884 - DNA, 17 bp, Homo sapiens
agactcaaatgttctaa

SEQ ID NO: 2438885 - DNA, 17 bp, Homo sapiens
agactcttgcctgtttc

SEQ ID NO: 2438886 - DNA, 21 bp, Homo sapiens
agactcttttccttccctttt

SEQ ID NO: 2438887 - DNA, 22 bp, Homo sapiens
agactgaatagatatgaaagct

SEQ ID NO: 2438888 - DNA, 17 bp, Homo sapiens
agactgctgtggccagg

SEQ ID NO: 2438889 - DNA, 15 bp, Homo sapiens
agactggaacactag

SEQ ID NO: 2438890 - DNA, 20 bp, Homo sapiens
agactggaagctaatttgca

SEQ ID NO: 2438891 - DNA, 18 bp, Homo sapiens
agactggcttttattaat

SEQ ID NO: 2438892 - DNA, 23 bp, Homo sapiens
agactgggaaggcttgggatttg

SEQ ID NO: 2438893 - DNA, 12 bp, Homo sapiens
agactgggctga

SEQ ID NO: 2438894 - DNA, 14 bp, Homo sapiens
agactgggctgagg

SEQ ID NO: 2438895 - DNA, 16 bp, Homo sapiens
agactgggctgaggga

SEQ ID NO: 2438896 - DNA, 20 bp, Homo sapiens
agactgggctgagggagcct

SEQ ID NO: 2438897 - DNA, 23 bp, Homo sapiens
agactgtgtgtgccctctgggct

SEQ ID NO: 2438898 - DNA, 22 bp, Homo sapiens
agacttcaagcatggctatttt

SEQ ID NO: 2438899 - DNA, 22 bp, Homo sapiens
aggagtgggtggggagtggggg

SEQ ID NO: 2438900 - DNA, 14 bp, Homo sapiens
aggatccggaaaga

SEQ ID NO: 2438901 - DNA, 20 bp, Homo sapiens
aggatctatttttggaggtt

SEQ ID NO: 2438902 - DNA, 18 bp, Homo sapiens
aggatctcaccaggcagc

SEQ ID NO: 2438903 - DNA, 22 bp, Homo sapiens
aggatgctaacatctaaaaata

SEQ ID NO: 2438904 - DNA, 18 bp, Homo sapiens
aggatggtcttacagcag

SEQ ID NO: 2438905 - DNA, 14 bp, Homo sapiens
aggatgtgatatat

SEQ ID NO: 2438906 - DNA, 18 bp, Homo sapiens
aggatgtgatatataagt

SEQ ID NO: 2438907 - DNA, 21 bp, Homo sapiens
aggattctgctggcctctgcg

SEQ ID NO: 2438908 - DNA, 18 bp, Homo sapiens
aggattgcgagagatgtg

SEQ ID NO: 2438909 - DNA, 12 bp, Homo sapiens
aggattggggaa

SEQ ID NO: 2438910 - DNA, 21 bp, Homo sapiens
aggattggggaagagagcctg

SEQ ID NO: 2438911 - DNA, 16 bp, Homo sapiens
aggcaacatccaaaat

SEQ ID NO: 2438912 - DNA, 21 bp, Homo sapiens
aggcaattagacactttggaa

SEQ ID NO: 2438913 - DNA, 11 bp, Homo sapiens
aggcacacagc

SEQ ID NO: 2438914 - DNA, 13 bp, Homo sapiens
aggcacacagcta

SEQ ID NO: 2438915 - DNA, 12 bp, Homo sapiens
aggcaccaggaa

SEQ ID NO: 2438916 - DNA, 20 bp, Homo sapiens
aggcacctggtggccatgct

SEQ ID NO: 2438917 - DNA, 21 bp, Homo sapiens
aggcacctggtggccatgctc

SEQ ID NO: 2438918 - DNA, 14 bp, Homo sapiens
aggcactctagatt

SEQ ID NO: 2438919 - DNA, 15 bp, Homo sapiens
aggcacttggcagcc

SEQ ID NO: 2438920 - DNA, 17 bp, Homo sapiens
aggcacttggcagcctt

SEQ ID NO: 2438921 - DNA, 22 bp, Homo sapiens
aggcagaggcccaggctgccgt

SEQ ID NO: 2438922 - DNA, 22 bp, Homo sapiens
aggcagaggcctgggctgggaa

SEQ ID NO: 2438923 - DNA, 23 bp, Homo sapiens
aggcagatgacctcgtactcagg

SEQ ID NO: 2438924 - DNA, 15 bp, Homo sapiens
aggcagccagcatct

SEQ ID NO: 2438925 - DNA, 16 bp, Homo sapiens
aggcagccagcatctg

SEQ ID NO: 2438926 - DNA, 18 bp, Homo sapiens
aggcagccagtgccctga

SEQ ID NO: 2438927 - DNA, 19 bp, Homo sapiens
aggcagccagtgccctgag

SEQ ID NO: 2438928 - DNA, 20 bp, Homo sapiens
aggcagccagtgccctgagc

SEQ ID NO: 2438929 - DNA, 15 bp, Homo sapiens
aggcagcccaggaag

SEQ ID NO: 2438930 - DNA, 19 bp, Homo sapiens
aggcagccgaggtccctgc

SEQ ID NO: 2438931 - DNA, 20 bp, Homo sapiens
aggcagccgaggtccctgct

SEQ ID NO: 2438932 - DNA, 23 bp, Homo sapiens
aggcaggaccttcgggctgtgcc

SEQ ID NO: 2438933 - DNA, 19 bp, Homo sapiens
aggcaggattggggaagag

SEQ ID NO: 2438934 - DNA, 23 bp, Homo sapiens
aggcagggaacatggggaggagg

SEQ ID NO: 2438935 - DNA, 12 bp, Homo sapiens
aggcagggctct

SEQ ID NO: 2438936 - DNA, 15 bp, Homo sapiens
aggcaggggcctcca

SEQ ID NO: 2438937 - DNA, 16 bp, Homo sapiens
aggcaggggcctccat

SEQ ID NO: 2438938 - DNA, 16 bp, Homo sapiens
aggcaggggcttcctg

SEQ ID NO: 2438939 - DNA, 18 bp, Homo sapiens
aggcaggggcttcctggt

SEQ ID NO: 2438940 - DNA, 16 bp, Homo sapiens
aggcaggtagggggtc

SEQ ID NO: 2438941 - DNA, 12 bp, Homo sapiens
aggcagttttct

SEQ ID NO: 2438942 - DNA, 13 bp, Homo sapiens
aggcagttttcta

SEQ ID NO: 2438943 - DNA, 21 bp, Homo sapiens
aggcatacgagagcagaggtc

SEQ ID NO: 2438944 - DNA, 21 bp, Homo sapiens
aggcatggctcagatcggcca

SEQ ID NO: 2438945 - DNA, 22 bp, Homo sapiens
agcctggccagacacaggccct

SEQ ID NO: 2438946 - DNA, 16 bp, Homo sapiens
agcctggccccatggt

SEQ ID NO: 2438947 - DNA, 19 bp, Homo sapiens
agcctgggaaagcccctgc

SEQ ID NO: 2438948 - DNA, 12 bp, Homo sapiens
agcctgggccta

SEQ ID NO: 2438949 - DNA, 18 bp, Homo sapiens
agcctgggcgctggtcct

SEQ ID NO: 2438950 - DNA, 16 bp, Homo sapiens
agcctggggctctaac

SEQ ID NO: 2438951 - DNA, 20 bp, Homo sapiens
agcctgggggcctggctggc

SEQ ID NO: 2438952 - DNA, 22 bp, Homo sapiens
agcctgtaaactttatcactta

SEQ ID NO: 2438953 - DNA, 14 bp, Homo sapiens
agcctgtcctgcct

SEQ ID NO: 2438954 - DNA, 15 bp, Homo sapiens
agcctgtcctgcctg

SEQ ID NO: 2438955 - DNA, 16 bp, Homo sapiens
agcctgtcctgcctgt

SEQ ID NO: 2438956 - DNA, 12 bp, Homo sapiens
agcctgtcctgt

SEQ ID NO: 2438957 - DNA, 13 bp, Homo sapiens
agcctgtcctgtc

SEQ ID NO: 2438958 - DNA, 14 bp, Homo sapiens
agcctgtcctgtca

SEQ ID NO: 2438959 - DNA, 18 bp, Homo sapiens
agcctgtgaacccaggac

SEQ ID NO: 2438960 - DNA, 19 bp, Homo sapiens
agcctgtgaacccaggaca

SEQ ID NO: 2438961 - DNA, 17 bp, Homo sapiens
agcctgttcatggcaga

SEQ ID NO: 2438962 - DNA, 17 bp, Homo sapiens
agccttaatttgcacag

SEQ ID NO: 2438963 - DNA, 13 bp, Homo sapiens
agccttcaagctc

SEQ ID NO: 2438964 - DNA, 14 bp, Homo sapiens
agccttcaagctct

SEQ ID NO: 2438965 - DNA, 16 bp, Homo sapiens
agccttcaagctctga

SEQ ID NO: 2438966 - DNA, 19 bp, Homo sapiens
agccttcaagctctgaggg

SEQ ID NO: 2438967 - DNA, 23 bp, Homo sapiens
agccttcaagctctgagggaaag

SEQ ID NO: 2438968 - DNA, 14 bp, Homo sapiens
agccttccacccag

SEQ ID NO: 2438969 - DNA, 15 bp, Homo sapiens
agccttgccagagat

SEQ ID NO: 2438970 - DNA, 19 bp, Homo sapiens
agccttggcctctttcctc

SEQ ID NO: 2438971 - DNA, 16 bp, Homo sapiens
agccttgtaattctaa

SEQ ID NO: 2438972 - DNA, 18 bp, Homo sapiens
agccttgtaattctaaat

SEQ ID NO: 2438973 - DNA, 21 bp, Homo sapiens
agccttgtgatgtcatacaga

SEQ ID NO: 2438974 - DNA, 22 bp, Homo sapiens
agccttgtgatgtcatacagag

SEQ ID NO: 2438975 - DNA, 20 bp, Homo sapiens
agcctttgttccccactgga

SEQ ID NO: 2438976 - DNA, 22 bp, Homo sapiens
agcctttgttccccactggagc

SEQ ID NO: 2438977 - DNA, 18 bp, Homo sapiens
agcctttttgtttcaatg

SEQ ID NO: 2438978 - DNA, 23 bp, Homo sapiens
agcgaaaaaatcaggtggctttt

SEQ ID NO: 2438979 - DNA, 15 bp, Homo sapiens
agcgaccgccccctc

SEQ ID NO: 2438980 - DNA, 22 bp, Homo sapiens
agcgaccttcctcatccacccc

SEQ ID NO: 2438981 - DNA, 16 bp, Homo sapiens
agcgactccgttggcc

SEQ ID NO: 2438982 - DNA, 17 bp, Homo sapiens
agcgactccgttggcca

SEQ ID NO: 2438983 - DNA, 19 bp, Homo sapiens
agcgactccgttggccact

SEQ ID NO: 2438984 - DNA, 20 bp, Homo sapiens
agcgactccgttggccactc

SEQ ID NO: 2438985 - DNA, 21 bp, Homo sapiens
agcgactccgttggccactcc

SEQ ID NO: 2438986 - DNA, 19 bp, Homo sapiens
agcgagcgcccagctcctg

SEQ ID NO: 2438987 - DNA, 19 bp, Homo sapiens
agcgagtggagtctgccac

SEQ ID NO: 2438988 - DNA, 22 bp, Homo sapiens
agcgattccctctcccaggccc

SEQ ID NO: 2438989 - DNA, 14 bp, Homo sapiens
agcgcagttttttt

SEQ ID NO: 2438990 - DNA, 16 bp, Homo sapiens
agcgcccagctcctga

SEQ ID NO: 2438991 - DNA, 12 bp, Homo sapiens
agcgccctgcag

SEQ ID NO: 2438992 - DNA, 14 bp, Homo sapiens
agcgccctgcagac

SEQ ID NO: 2438993 - DNA, 19 bp, Homo sapiens
agcgccctgcagaccctgc

SEQ ID NO: 2438994 - DNA, 23 bp, Homo sapiens
agcgccctgcagaccctgccctt

SEQ ID NO: 2438995 - DNA, 20 bp, Homo sapiens
agcgcctccatccaaggcca

SEQ ID NO: 2438996 - DNA, 13 bp, Homo sapiens
agcgcggaggagg

SEQ ID NO: 2438997 - DNA, 21 bp, Homo sapiens
agcgctgtcaggattgcgaga

SEQ ID NO: 2438998 - DNA, 20 bp, Homo sapiens
agcggcttgcctgcctgctc

SEQ ID NO: 2438999 - DNA, 23 bp, Homo sapiens
aggacttgccctcgtggtggaaa

SEQ ID NO: 2439000 - DNA, 13 bp, Homo sapiens
aggactttgtaca

SEQ ID NO: 2439001 - DNA, 19 bp, Homo sapiens
aggagaaccaaatctggaa

SEQ ID NO: 2439002 - DNA, 22 bp, Homo sapiens
aggagaaccaaatctggaagcc

SEQ ID NO: 2439003 - DNA, 13 bp, Homo sapiens
aggagaagccagg

SEQ ID NO: 2439004 - DNA, 12 bp, Homo sapiens
aggagaagctca

SEQ ID NO: 2439005 - DNA, 14 bp, Homo sapiens
aggagaagctcagc

SEQ ID NO: 2439006 - DNA, 14 bp, Homo sapiens
aggagagacactgg

SEQ ID NO: 2439007 - DNA, 20 bp, Homo sapiens
aggagaggcaacatccaaaa

SEQ ID NO: 2439008 - DNA, 17 bp, Homo sapiens
aggagatgctccttggg

SEQ ID NO: 2439009 - DNA, 16 bp, Homo sapiens
aggagcacggctctgt

SEQ ID NO: 2439010 - DNA, 16 bp, Homo sapiens
aggagcccaggccagg

SEQ ID NO: 2439011 - DNA, 18 bp, Homo sapiens
aggagcccaggccaggac

SEQ ID NO: 2439012 - DNA, 22 bp, Homo sapiens
aggagcccaggccaggactctg

SEQ ID NO: 2439013 - DNA, 15 bp, Homo sapiens
aggagccccattcct

SEQ ID NO: 2439014 - DNA, 19 bp, Homo sapiens
aggagcccccaccctgttc

SEQ ID NO: 2439015 - DNA, 22 bp, Homo sapiens
aggagcccccaccctgttcctg

SEQ ID NO: 2439016 - DNA, 21 bp, Homo sapiens
aggagcctgtgaacccaggac

SEQ ID NO: 2439017 - DNA, 14 bp, Homo sapiens
aggagcctgtgaca

SEQ ID NO: 2439018 - DNA, 12 bp, Homo sapiens
aggagctaaggc

SEQ ID NO: 2439019 - DNA, 13 bp, Homo sapiens
aggagctaaggct

SEQ ID NO: 2439020 - DNA, 15 bp, Homo sapiens
aggagctacctgtgt

SEQ ID NO: 2439021 - DNA, 17 bp, Homo sapiens
aggagctacctgtgtgg

SEQ ID NO: 2439022 - DNA, 22 bp, Homo sapiens
aggagctacctgtgtggacagg

SEQ ID NO: 2439023 - DNA, 14 bp, Homo sapiens
aggagctccagtgt

SEQ ID NO: 2439024 - DNA, 15 bp, Homo sapiens
aggagctgatacttt

SEQ ID NO: 2439025 - DNA, 14 bp, Homo sapiens
aggagctgcctgga

SEQ ID NO: 2439026 - DNA, 18 bp, Homo sapiens
aggagctttgactcagga

SEQ ID NO: 2439027 - DNA, 17 bp, Homo sapiens
aggaggaaatcccttca

SEQ ID NO: 2439028 - DNA, 21 bp, Homo sapiens
aggaggaataagctcccaggg

SEQ ID NO: 2439029 - DNA, 18 bp, Homo sapiens
aggaggaatactgaacat

SEQ ID NO: 2439030 - DNA, 13 bp, Homo sapiens
aggaggagcctgt

SEQ ID NO: 2439031 - DNA, 20 bp, Homo sapiens
aggaggagcctgtcctgcct

SEQ ID NO: 2439032 - DNA, 23 bp, Homo sapiens
aggaggagggtcggtgccttcaa

SEQ ID NO: 2439033 - DNA, 16 bp, Homo sapiens
aggaggctccagaggg

SEQ ID NO: 2439034 - DNA, 18 bp, Homo sapiens
aggaggctccagagggca

SEQ ID NO: 2439035 - DNA, 14 bp, Homo sapiens
aggagggacaaagg

SEQ ID NO: 2439036 - DNA, 19 bp, Homo sapiens
aggagggacaaaggagcct

SEQ ID NO: 2439037 - DNA, 20 bp, Homo sapiens
aggagggacaaaggagcctg

SEQ ID NO: 2439038 - DNA, 22 bp, Homo sapiens
aggagggacaaaggagcctgtg

SEQ ID NO: 2439039 - DNA, 23 bp, Homo sapiens
aggagggacaaaggagcctgtga

SEQ ID NO: 2439040 - DNA, 15 bp, Homo sapiens
aggaggggaagaggc

SEQ ID NO: 2439041 - DNA, 21 bp, Homo sapiens
aggaggggggagggaagggag

SEQ ID NO: 2439042 - DNA, 23 bp, Homo sapiens
aggaggggggagggaagggagcc

SEQ ID NO: 2439043 - DNA, 16 bp, Homo sapiens
aggagggtcggtgcct

SEQ ID NO: 2439044 - DNA, 15 bp, Homo sapiens
aggagggtgggaagg

SEQ ID NO: 2439045 - DNA, 14 bp, Homo sapiens
aggaggtgccactg

SEQ ID NO: 2439046 - DNA, 15 bp, Homo sapiens
aggaggtgtctcagg

SEQ ID NO: 2439047 - DNA, 11 bp, Homo sapiens
aggagtaacaa

SEQ ID NO: 2439048 - DNA, 13 bp, Homo sapiens
aggagtagctgag

SEQ ID NO: 2439049 - DNA, 15 bp, Homo sapiens
aggagtagctgagct

SEQ ID NO: 2439050 - DNA, 15 bp, Homo sapiens
aggagtctgaggtcc

SEQ ID NO: 2439051 - DNA, 18 bp, Homo sapiens
aggagtctgaggtcctga

SEQ ID NO: 2439052 - DNA, 15 bp, Homo sapiens
aggagtgggtgggga

SEQ ID NO: 2439053 - DNA, 22 bp, Homo sapiens
atactgaacatctgagtcctgg

SEQ ID NO: 2439054 - DNA, 19 bp, Homo sapiens
atactgctacagcaatttc

SEQ ID NO: 2439055 - DNA, 22 bp, Homo sapiens
atactgctacagcaatttctaa

SEQ ID NO: 2439056 - DNA, 14 bp, Homo sapiens
atactggcctggac

SEQ ID NO: 2439057 - DNA, 12 bp, Homo sapiens
atactgttgcac

SEQ ID NO: 2439058 - DNA, 15 bp, Homo sapiens
atactgttgcacgtg

SEQ ID NO: 2439059 - DNA, 15 bp, Homo sapiens
atacttcttgtgtgt

SEQ ID NO: 2439060 - DNA, 18 bp, Homo sapiens
atacttcttgtgtgtatg

SEQ ID NO: 2439061 - DNA, 20 bp, Homo sapiens
atacttcttgtgtgtatgca

SEQ ID NO: 2439062 - DNA, 17 bp, Homo sapiens
atacttgaagggccaga

SEQ ID NO: 2439063 - DNA, 17 bp, Homo sapiens
atacttggagggcccag

SEQ ID NO: 2439064 - DNA, 12 bp, Homo sapiens
atacttggattt

SEQ ID NO: 2439065 - DNA, 16 bp, Homo sapiens
atacttggatttagtt

SEQ ID NO: 2439066 - DNA, 17 bp, Homo sapiens
atacttggatttagttt

SEQ ID NO: 2439067 - DNA, 22 bp, Homo sapiens
atacttggatttagtttcagta

SEQ ID NO: 2439068 - DNA, 15 bp, Homo sapiens
atacttgtaattatg

SEQ ID NO: 2439069 - DNA, 21 bp, Homo sapiens
atacttgtaattatggagtca

SEQ ID NO: 2439070 - DNA, 23 bp, Homo sapiens
atactttccctaccctctagaga

SEQ ID NO: 2439071 - DNA, 23 bp, Homo sapiens
atactttgaaaggagatgtcttg

SEQ ID NO: 2439072 - DNA, 17 bp, Homo sapiens
atactttgaatgtgttt

SEQ ID NO: 2439073 - DNA, 19 bp, Homo sapiens
atactttgaatgtgtttca

SEQ ID NO: 2439074 - DNA, 20 bp, Homo sapiens
atactttgaatgtgtttcac

SEQ ID NO: 2439075 - DNA, 17 bp, Homo sapiens
atacttttactctgcct

SEQ ID NO: 2439076 - DNA, 16 bp, Homo sapiens
atatgtacatttctca

SEQ ID NO: 2439077 - DNA, 18 bp, Homo sapiens
atatgtacatttctcagg

SEQ ID NO: 2439078 - DNA, 14 bp, Homo sapiens
atatgtaccatgta

SEQ ID NO: 2439079 - DNA, 12 bp, Homo sapiens
atatgtatgggt

SEQ ID NO: 2439080 - DNA, 18 bp, Homo sapiens
atatgtcagtgctgatgt

SEQ ID NO: 2439081 - DNA, 21 bp, Homo sapiens
atatgttgtaatatttcttca

SEQ ID NO: 2439082 - DNA, 13 bp, Homo sapiens
atattaaatctgc

SEQ ID NO: 2439083 - DNA, 16 bp, Homo sapiens
atattatacttgtaat

SEQ ID NO: 2439084 - DNA, 13 bp, Homo sapiens
atattatatggaa

SEQ ID NO: 2439085 - DNA, 21 bp, Homo sapiens
atattattataatcttataat

SEQ ID NO: 2439086 - DNA, 23 bp, Homo sapiens
atattccctagaaacttccaaat

SEQ ID NO: 2439087 - DNA, 17 bp, Homo sapiens
atattcctattgtgcaa

SEQ ID NO: 2439088 - DNA, 14 bp, Homo sapiens
atattctaagactt

SEQ ID NO: 2439089 - DNA, 16 bp, Homo sapiens
atattgaaaaaataga

SEQ ID NO: 2439090 - DNA, 14 bp, Homo sapiens
atattgacttgtat

SEQ ID NO: 2439091 - DNA, 18 bp, Homo sapiens
atattgataagatctttt

SEQ ID NO: 2439092 - DNA, 15 bp, Homo sapiens
atattgatttattaa

SEQ ID NO: 2439093 - DNA, 21 bp, Homo sapiens
atattggccaaggaaaggcac

SEQ ID NO: 2439094 - DNA, 13 bp, Homo sapiens
atattgtgtttgt

SEQ ID NO: 2439095 - DNA, 19 bp, Homo sapiens
atatttaactctctttatg

SEQ ID NO: 2439096 - DNA, 15 bp, Homo sapiens
atatttacctcagcc

SEQ ID NO: 2439097 - DNA, 13 bp, Homo sapiens
atatttctatttt

SEQ ID NO: 2439098 - DNA, 15 bp, Homo sapiens
atatttctattttat

SEQ ID NO: 2439099 - DNA, 21 bp, Homo sapiens
atatttctattttattatgaa

SEQ ID NO: 2439100 - DNA, 23 bp, Homo sapiens
atatttctattttattatgaaga

SEQ ID NO: 2439101 - DNA, 19 bp, Homo sapiens
atatttgtaaaatgacaat

SEQ ID NO: 2439102 - DNA, 15 bp, Homo sapiens
atattttaaagaatt

SEQ ID NO: 2439103 - DNA, 22 bp, Homo sapiens
atattttagcattttaattctc

SEQ ID NO: 2439104 - DNA, 13 bp, Homo sapiens
atattttcctcct

SEQ ID NO: 2439105 - DNA, 12 bp, Homo sapiens
atattttctttc

SEQ ID NO: 2439106 - DNA, 13 bp, Homo sapiens
atattttctttct

SEQ ID NO: 2439107 - DNA, 14 bp, Homo sapiens
atattttgaatcaa

SEQ ID NO: 2439108 - DNA, 12 bp, Homo sapiens
atattttgcagt

SEQ ID NO: 2439109 - DNA, 18 bp, Homo sapiens
atatttttttttaagctc

SEQ ID NO: 2439110 - DNA, 23 bp, Homo sapiens
atatttttttttaagctctgagc

SEQ ID NO: 2439111 - DNA, 21 bp, Homo sapiens
atcaaaactttcttttctgga

SEQ ID NO: 2439112 - DNA, 16 bp, Homo sapiens
atcaaaatctctccac

SEQ ID NO: 2439113 - DNA, 13 bp, Homo sapiens
atcaaaatgcttt

SEQ ID NO: 2439114 - DNA, 22 bp, Homo sapiens
atcaaaatgctttttatttctg

SEQ ID NO: 2439115 - DNA, 22 bp, Homo sapiens
atcaaaccctagccttgcttgt

SEQ ID NO: 2439116 - DNA, 18 bp, Homo sapiens
atcaaagcatcttgcatt

SEQ ID NO: 2439117 - DNA, 21 bp, Homo sapiens
atcaaatttgtagggtttcta

SEQ ID NO: 2439118 - DNA, 14 bp, Homo sapiens
atcaactttactgt

SEQ ID NO: 2439119 - DNA, 22 bp, Homo sapiens
atcaaggccttattggaaagca

SEQ ID NO: 2439120 - DNA, 15 bp, Homo sapiens
atcaagggtcaggcc

SEQ ID NO: 2439121 - DNA, 15 bp, Homo sapiens
atcaagtaatacaaa

SEQ ID NO: 2439122 - DNA, 18 bp, Homo sapiens
atcaataatatattttct

SEQ ID NO: 2439123 - DNA, 17 bp, Homo sapiens
atcaatcttgcatgtaa

SEQ ID NO: 2439124 - DNA, 18 bp, Homo sapiens
atcaatcttgcatgtaac

SEQ ID NO: 2439125 - DNA, 22 bp, Homo sapiens
atcaatctttaaaccaattgct

SEQ ID NO: 2439126 - DNA, 16 bp, Homo sapiens
atcacagcccagcccg

SEQ ID NO: 2439127 - DNA, 15 bp, Homo sapiens
atcacccagacataa

SEQ ID NO: 2439128 - DNA, 22 bp, Homo sapiens
atcaccgtgggctccctgactg

SEQ ID NO: 2439129 - DNA, 15 bp, Homo sapiens
atcacctcagatggc

SEQ ID NO: 2439130 - DNA, 19 bp, Homo sapiens
atcacctcagatggcagct

SEQ ID NO: 2439131 - DNA, 20 bp, Homo sapiens
atcactctaattaattgtaa

SEQ ID NO: 2439132 - DNA, 18 bp, Homo sapiens
atcactgagttttccatg

SEQ ID NO: 2439133 - DNA, 15 bp, Homo sapiens
atcagaaagggaggg

SEQ ID NO: 2439134 - DNA, 22 bp, Homo sapiens
atcagaaagggagggctctgag

SEQ ID NO: 2439135 - DNA, 18 bp, Homo sapiens
atcagaagtcatcttgct

SEQ ID NO: 2439136 - DNA, 19 bp, Homo sapiens
atcagaagtcatcttgcta

SEQ ID NO: 2439137 - DNA, 22 bp, Homo sapiens
atcagaatagccacatttggaa

SEQ ID NO: 2439138 - DNA, 19 bp, Homo sapiens
atcagactaagccagcacc

SEQ ID NO: 2439139 - DNA, 20 bp, Homo sapiens
atcagatgctccaagattct

SEQ ID NO: 2439140 - DNA, 21 bp, Homo sapiens
atcagcaaaccggggcctact

SEQ ID NO: 2439141 - DNA, 15 bp, Homo sapiens
atcagccccaccctg

SEQ ID NO: 2439142 - DNA, 16 bp, Homo sapiens
atcagccccaccctgg

SEQ ID NO: 2439143 - DNA, 17 bp, Homo sapiens
atcagccccaccctggc

SEQ ID NO: 2439144 - DNA, 16 bp, Homo sapiens
atcagcccttgggggt

SEQ ID NO: 2439145 - DNA, 12 bp, Homo sapiens
atcagcgtggcc

SEQ ID NO: 2439146 - DNA, 22 bp, Homo sapiens
atcaggaatattttccaaagag

SEQ ID NO: 2439147 - DNA, 23 bp, Homo sapiens
atcaggtaactaactgcatacac

SEQ ID NO: 2439148 - DNA, 14 bp, Homo sapiens
atcaggtttttccc

SEQ ID NO: 2439149 - DNA, 17 bp, Homo sapiens
atcagtaagaggtgtta

SEQ ID NO: 2439150 - DNA, 23 bp, Homo sapiens
atcagtaagaggtgttatttgga

SEQ ID NO: 2439151 - DNA, 22 bp, Homo sapiens
atcagttaagaaatttcacata

SEQ ID NO: 2439152 - DNA, 17 bp, Homo sapiens
atcagttcattagaaat

SEQ ID NO: 2439153 - DNA, 18 bp, Homo sapiens
atcagttcattagaaata

SEQ ID NO: 2439154 - DNA, 16 bp, Homo sapiens
atcatcaagtaataca

SEQ ID NO: 2439155 - DNA, 20 bp, Homo sapiens
atcatcagaaaggaaaaaca

SEQ ID NO: 2439156 - DNA, 13 bp, Homo sapiens
atcatccacacat

SEQ ID NO: 2439157 - DNA, 14 bp, Homo sapiens
atcatccacacatg

SEQ ID NO: 2439158 - DNA, 20 bp, Homo sapiens
atcatctcctgccttcctcc

SEQ ID NO: 2439159 - DNA, 12 bp, Homo sapiens
atcatgccctgt

SEQ ID NO: 2439160 - DNA, 14 bp, Homo sapiens
atcatgcctctgag

SEQ ID NO: 2439161 - DNA, 15 bp, Homo sapiens
atcatgcctctgagg

SEQ ID NO: 2439162 - DNA, 13 bp, Homo sapiens
atcatggccagct

SEQ ID NO: 2439163 - DNA, 12 bp, Homo sapiens
atcattctctgt

SEQ ID NO: 2439164 - DNA, 13 bp, Homo sapiens
atcattgtatgtg

SEQ ID NO: 2439165 - DNA, 18 bp, Homo sapiens
atcatttctattaaatga

SEQ ID NO: 2439166 - DNA, 23 bp, Homo sapiens
atcatttctttttgggagagact

SEQ ID NO: 2439167 - DNA, 13 bp, Homo sapiens
atcatttgtttaa

SEQ ID NO: 2439168 - DNA, 18 bp, Homo sapiens
atcatttgtttaaaaagg

SEQ ID NO: 2439169 - DNA, 15 bp, Homo sapiens
atcattttaattatt

SEQ ID NO: 2439170 - DNA, 19 bp, Homo sapiens
atccaaaagaagcccccag

SEQ ID NO: 2439171 - DNA, 13 bp, Homo sapiens
atccaatcaatct

SEQ ID NO: 2439172 - DNA, 18 bp, Homo sapiens
atccaatcaatcttgcat

SEQ ID NO: 2439173 - DNA, 14 bp, Homo sapiens
atccacacatgaat

SEQ ID NO: 2439174 - DNA, 22 bp, Homo sapiens
atccacataccctgacctggcc

SEQ ID NO: 2439175 - DNA, 23 bp, Homo sapiens
atccaccccaatcctcccagaaa

SEQ ID NO: 2439176 - DNA, 15 bp, Homo sapiens
atccagctatgttat

SEQ ID NO: 2439177 - DNA, 21 bp, Homo sapiens
atccaggagctccagtgtcct

SEQ ID NO: 2439178 - DNA, 15 bp, Homo sapiens
atccaggcagatcca

SEQ ID NO: 2439179 - DNA, 15 bp, Homo sapiens
atccaggttccctcc

SEQ ID NO: 2439180 - DNA, 18 bp, Homo sapiens
atctgctaccaaaacagt

SEQ ID NO: 2439181 - DNA, 18 bp, Homo sapiens
atctgctggagtttcatg

SEQ ID NO: 2439182 - DNA, 16 bp, Homo sapiens
atctggaacccagact

SEQ ID NO: 2439183 - DNA, 18 bp, Homo sapiens
atctggaacctcagcctg

SEQ ID NO: 2439184 - DNA, 22 bp, Homo sapiens
atctggaacctcagcctggcca

SEQ ID NO: 2439185 - DNA, 21 bp, Homo sapiens
atctggaagccaaaatgtagg

SEQ ID NO: 2439186 - DNA, 14 bp, Homo sapiens
atctgggcttcctg

SEQ ID NO: 2439187 - DNA, 18 bp, Homo sapiens
atctgggcttcctggagc

SEQ ID NO: 2439188 - DNA, 23 bp, Homo sapiens
atctggggagcaggcagccagca

SEQ ID NO: 2439189 - DNA, 18 bp, Homo sapiens
atctgggggcctcttctg

SEQ ID NO: 2439190 - DNA, 23 bp, Homo sapiens
atctggtagaagggaaagcccat

SEQ ID NO: 2439191 - DNA, 15 bp, Homo sapiens
atctgtaaatctaca

SEQ ID NO: 2439192 - DNA, 16 bp, Homo sapiens
atctgtaaatctacac

SEQ ID NO: 2439193 - DNA, 18 bp, Homo sapiens
atctgtaatggtactgac

SEQ ID NO: 2439194 - DNA, 18 bp, Homo sapiens
atctgtcctcagccttgc

SEQ ID NO: 2439195 - DNA, 23 bp, Homo sapiens
atctgtctgccaacctaaaactc

SEQ ID NO: 2439196 - DNA, 15 bp, Homo sapiens
atctgtgtgaaactt

SEQ ID NO: 2439197 - DNA, 19 bp, Homo sapiens
atctgttttgaaggcaaaa

SEQ ID NO: 2439198 - DNA, 16 bp, Homo sapiens
atcttactatttcaca

SEQ ID NO: 2439199 - DNA, 14 bp, Homo sapiens
atcttataattgtt

SEQ ID NO: 2439200 - DNA, 14 bp, Homo sapiens
atcttcagttgtct

SEQ ID NO: 2439201 - DNA, 17 bp, Homo sapiens
atcttcagttgtctctg

SEQ ID NO: 2439202 - DNA, 18 bp, Homo sapiens
atcttcagttgtctctga

SEQ ID NO: 2439203 - DNA, 21 bp, Homo sapiens
atcttctaaacccaatccaaa

SEQ ID NO: 2439204 - DNA, 15 bp, Homo sapiens
atcttctcaagttct

SEQ ID NO: 2439205 - DNA, 20 bp, Homo sapiens
atcttctcaagttctaagat

SEQ ID NO: 2439206 - DNA, 16 bp, Homo sapiens
atcttgaattgtaact

SEQ ID NO: 2439207 - DNA, 17 bp, Homo sapiens
atcttgactacagtcag

SEQ ID NO: 2439208 - DNA, 17 bp, Homo sapiens
atcttgatgtctttgtt

SEQ ID NO: 2439209 - DNA, 24 bp, Homo sapiens
atcttgcaccccaaagctttcctg

SEQ ID NO: 2439210 - DNA, 18 bp, Homo sapiens
atcttgcattatgcaatt

SEQ ID NO: 2439211 - DNA, 14 bp, Homo sapiens
atcttgcttcccta

SEQ ID NO: 2439212 - DNA, 15 bp, Homo sapiens
atcttgcttccctaa

SEQ ID NO: 2439213 - DNA, 22 bp, Homo sapiens
atcttggacaaatcacatattt

SEQ ID NO: 2439214 - DNA, 16 bp, Homo sapiens
atcttgggggggtggc

SEQ ID NO: 2439215 - DNA, 14 bp, Homo sapiens
atcttggtttgcct

SEQ ID NO: 2439216 - DNA, 20 bp, Homo sapiens
atcttggtttgccttccaga

SEQ ID NO: 2439217 - DNA, 15 bp, Homo sapiens
atcttgtcatgtgta

SEQ ID NO: 2439218 - DNA, 15 bp, Homo sapiens
atctttataaatgta

SEQ ID NO: 2439219 - DNA, 17 bp, Homo sapiens
atctttgaaattatgta

SEQ ID NO: 2439220 - DNA, 19 bp, Homo sapiens
atcttttcaaaggtacttg

SEQ ID NO: 2439221 - DNA, 19 bp, Homo sapiens
atctttttacctttcatac

SEQ ID NO: 2439222 - DNA, 17 bp, Homo sapiens
atgaaaaagaagaatct

SEQ ID NO: 2439223 - DNA, 16 bp, Homo sapiens
atgaaaactctttgct

SEQ ID NO: 2439224 - DNA, 14 bp, Homo sapiens
atgaacatcccttt

SEQ ID NO: 2439225 - DNA, 19 bp, Homo sapiens
atgaacttagattttacat

SEQ ID NO: 2439226 - DNA, 13 bp, Homo sapiens
atgaagctgttgt

SEQ ID NO: 2439227 - DNA, 16 bp, Homo sapiens
atgaagttttacattg

SEQ ID NO: 2439228 - DNA, 21 bp, Homo sapiens
atgaatactgtattttgtatt

SEQ ID NO: 2439229 - DNA, 12 bp, Homo sapiens
atgaatactttg

SEQ ID NO: 2439230 - DNA, 18 bp, Homo sapiens
atgaatgtgaagccttcc

SEQ ID NO: 2439231 - DNA, 14 bp, Homo sapiens
atgaattttagctt

SEQ ID NO: 2439232 - DNA, 16 bp, Homo sapiens
atgaattttagctttt

SEQ ID NO: 2439233 - DNA, 17 bp, Homo sapiens
atgaattttagcttttg

SEQ ID NO: 2439234 - DNA, 20 bp, Homo sapiens
atgacaaagcagattcagaa

SEQ ID NO: 2439235 - DNA, 16 bp, Homo sapiens
atgacaacttctaatt

SEQ ID NO: 2439236 - DNA, 23 bp, Homo sapiens
atgacactcatataattatatgt

SEQ ID NO: 2439237 - DNA, 16 bp, Homo sapiens
atgacacttgtacaat

SEQ ID NO: 2439238 - DNA, 18 bp, Homo sapiens
atgacatttatttttcat

SEQ ID NO: 2439239 - DNA, 23 bp, Homo sapiens
atgaccctgcctctcccaggcag

SEQ ID NO: 2439240 - DNA, 14 bp, Homo sapiens
atgacccttttcat

SEQ ID NO: 2439241 - DNA, 12 bp, Homo sapiens
atgacctccagc

SEQ ID NO: 2439242 - DNA, 13 bp, Homo sapiens
atgacctccagct

SEQ ID NO: 2439243 - DNA, 19 bp, Homo sapiens
atgacctccagctttcctg

SEQ ID NO: 2439244 - DNA, 18 bp, Homo sapiens
atgacctcgtactcagga

SEQ ID NO: 2439245 - DNA, 20 bp, Homo sapiens
atgacctcgtactcaggagc

SEQ ID NO: 2439246 - DNA, 16 bp, Homo sapiens
atgactcgggggtggg

SEQ ID NO: 2439247 - DNA, 21 bp, Homo sapiens
atgactgccaagactgctgtg

SEQ ID NO: 2439248 - DNA, 18 bp, Homo sapiens
atgacttgggcaccccca

SEQ ID NO: 2439249 - DNA, 21 bp, Homo sapiens
atgacttgggcacccccagcc

SEQ ID NO: 2439250 - DNA, 21 bp, Homo sapiens
atgactttctttttgtagctg

SEQ ID NO: 2439251 - DNA, 20 bp, Homo sapiens
atgagaaacttaaatgttat

SEQ ID NO: 2439252 - DNA, 21 bp, Homo sapiens
atgagaaacttaaatgttatt

SEQ ID NO: 2439253 - DNA, 15 bp, Homo sapiens
atgagaaatacaaaa

SEQ ID NO: 2439254 - DNA, 22 bp, Homo sapiens
atgagaaatacaaaaatactca

SEQ ID NO: 2439255 - DNA, 14 bp, Homo sapiens
atgagatgctggct

SEQ ID NO: 2439256 - DNA, 21 bp, Homo sapiens
atgagcatgtttagactttaa

SEQ ID NO: 2439257 - DNA, 22 bp, Homo sapiens
atgagctcccacaagcctgagg

SEQ ID NO: 2439258 - DNA, 14 bp, Homo sapiens
atgagctttctgaa

SEQ ID NO: 2439259 - DNA, 15 bp, Homo sapiens
atgagctttctgaac

SEQ ID NO: 2439260 - DNA, 22 bp, Homo sapiens
atgagctttctgaacagctggt

SEQ ID NO: 2439261 - DNA, 19 bp, Homo sapiens
atgaggactctattcttta

SEQ ID NO: 2439262 - DNA, 20 bp, Homo sapiens
atgaggccctccacacctgc

SEQ ID NO: 2439263 - DNA, 13 bp, Homo sapiens
atgagggaaaaga

SEQ ID NO: 2439264 - DNA, 15 bp, Homo sapiens
atgagggcagcagcc

SEQ ID NO: 2439265 - DNA, 18 bp, Homo sapiens
atgagggcagcagccagc

SEQ ID NO: 2439266 - DNA, 13 bp, Homo sapiens
agtactttgtgca

SEQ ID NO: 2439267 - DNA, 16 bp, Homo sapiens
agtactttgtgcattc

SEQ ID NO: 2439268 - DNA, 14 bp, Homo sapiens
agtagaattgcatt

SEQ ID NO: 2439269 - DNA, 13 bp, Homo sapiens
agtagagacaggg

SEQ ID NO: 2439270 - DNA, 21 bp, Homo sapiens
agtagatgcatttgggtccag

SEQ ID NO: 2439271 - DNA, 20 bp, Homo sapiens
agtagattgcagaaaattct

SEQ ID NO: 2439272 - DNA, 22 bp, Homo sapiens
agtagcagtgattgtcttaata

SEQ ID NO: 2439273 - DNA, 13 bp, Homo sapiens
agtagtcctgtga

SEQ ID NO: 2439274 - DNA, 14 bp, Homo sapiens
agtagtcctgtgaa

SEQ ID NO: 2439275 - DNA, 19 bp, Homo sapiens
agtataagactactgaatc

SEQ ID NO: 2439276 - DNA, 21 bp, Homo sapiens
agtatattgataaccttgaaa

SEQ ID NO: 2439277 - DNA, 19 bp, Homo sapiens
agtatcatgccctgtgcaa

SEQ ID NO: 2439278 - DNA, 12 bp, Homo sapiens
agtatcttttga

SEQ ID NO: 2439279 - DNA, 15 bp, Homo sapiens
agtatggcctgtgtc

SEQ ID NO: 2439280 - DNA, 19 bp, Homo sapiens
agtatgggggttgtaaatt

SEQ ID NO: 2439281 - DNA, 18 bp, Homo sapiens
agtatgttctaaccttta

SEQ ID NO: 2439282 - DNA, 18 bp, Homo sapiens
agtattaaaatgtatgca

SEQ ID NO: 2439283 - DNA, 14 bp, Homo sapiens
agtattcttctctt

SEQ ID NO: 2439284 - DNA, 12 bp, Homo sapiens
agtatttaacta

SEQ ID NO: 2439285 - DNA, 17 bp, Homo sapiens
agtatttgggaagtgaa

SEQ ID NO: 2439286 - DNA, 15 bp, Homo sapiens
agtatttgttaattt

SEQ ID NO: 2439287 - DNA, 18 bp, Homo sapiens
agtatttgttaatttaga

SEQ ID NO: 2439288 - DNA, 17 bp, Homo sapiens
agtattttaaaatagcg

SEQ ID NO: 2439289 - DNA, 20 bp, Homo sapiens
agtattttagtgaacttgaa

SEQ ID NO: 2439290 - DNA, 13 bp, Homo sapiens
agtattttttgta

SEQ ID NO: 2439291 - DNA, 12 bp, Homo sapiens
agtcaaaaagaa

SEQ ID NO: 2439292 - DNA, 14 bp, Homo sapiens
agtcaaaaagaacc

SEQ ID NO: 2439293 - DNA, 17 bp, Homo sapiens
agtcaaaactacaaatc

SEQ ID NO: 2439294 - DNA, 14 bp, Homo sapiens
agtcaacagtaaac

SEQ ID NO: 2439295 - DNA, 17 bp, Homo sapiens
agtcaacagtaaaccac

SEQ ID NO: 2439296 - DNA, 20 bp, Homo sapiens
agtcaacagtaaaccactga

SEQ ID NO: 2439297 - DNA, 21 bp, Homo sapiens
agtcaacagtaaaccactgaa

SEQ ID NO: 2439298 - DNA, 16 bp, Homo sapiens
agtgctctgatccctc

SEQ ID NO: 2439299 - DNA, 16 bp, Homo sapiens
agtgctgaacagtgga

SEQ ID NO: 2439300 - DNA, 12 bp, Homo sapiens
agtgctgtgctg

SEQ ID NO: 2439301 - DNA, 17 bp, Homo sapiens
agtgctgtgctgtgcta

SEQ ID NO: 2439302 - DNA, 19 bp, Homo sapiens
agtgctgttttgttatata

SEQ ID NO: 2439303 - DNA, 17 bp, Homo sapiens
agtgcttgcttttcatg

SEQ ID NO: 2439304 - DNA, 14 bp, Homo sapiens
agtgctttgagaga

SEQ ID NO: 2439305 - DNA, 19 bp, Homo sapiens
agtgcttttaagtgaaaat

SEQ ID NO: 2439306 - DNA, 14 bp, Homo sapiens
agtggaaaaggcac

SEQ ID NO: 2439307 - DNA, 19 bp, Homo sapiens
agtggacaaattttgagtt

SEQ ID NO: 2439308 - DNA, 22 bp, Homo sapiens
agtggactggcctcaaagcaag

SEQ ID NO: 2439309 - DNA, 17 bp, Homo sapiens
agtggagtctgccaccc

SEQ ID NO: 2439310 - DNA, 16 bp, Homo sapiens
agtggatgctgggtcc

SEQ ID NO: 2439311 - DNA, 15 bp, Homo sapiens
agtggcagcccagcc

SEQ ID NO: 2439312 - DNA, 16 bp, Homo sapiens
agtggcagcccagcca

SEQ ID NO: 2439313 - DNA, 17 bp, Homo sapiens
agtggcagcccagccag

SEQ ID NO: 2439314 - DNA, 21 bp, Homo sapiens
agtggcagcccagccagcgtc

SEQ ID NO: 2439315 - DNA, 18 bp, Homo sapiens
agtggcaggggacaggag

SEQ ID NO: 2439316 - DNA, 15 bp, Homo sapiens
agtggctggtccagg

SEQ ID NO: 2439317 - DNA, 17 bp, Homo sapiens
agtggctggtccagggc

SEQ ID NO: 2439318 - DNA, 21 bp, Homo sapiens
agtgggaagcccatcctgacc

SEQ ID NO: 2439319 - DNA, 12 bp, Homo sapiens
agtgggggtggg

SEQ ID NO: 2439320 - DNA, 20 bp, Homo sapiens
agtggggtggtgtcagaccc

SEQ ID NO: 2439321 - DNA, 22 bp, Homo sapiens
agtgggtacccccaggaccaga

SEQ ID NO: 2439322 - DNA, 18 bp, Homo sapiens
agtgtaaaatattttgaa

SEQ ID NO: 2439323 - DNA, 22 bp, Homo sapiens
agtgtaacaattgtgtagcctt

SEQ ID NO: 2439324 - DNA, 23 bp, Homo sapiens
agtgtaacaattgtgtagccttt

SEQ ID NO: 2439325 - DNA, 16 bp, Homo sapiens
agtgtaccatttgcct

SEQ ID NO: 2439326 - DNA, 23 bp, Homo sapiens
agtgtaccgcgtctaccctggga

SEQ ID NO: 2439327 - DNA, 20 bp, Homo sapiens
agtgtagaacctaattcaat

SEQ ID NO: 2439328 - DNA, 14 bp, Homo sapiens
agtgtatggggcag

SEQ ID NO: 2439329 - DNA, 23 bp, Homo sapiens
agtgtatttggaaataaagtcag

SEQ ID NO: 2439330 - DNA, 22 bp, Homo sapiens
agtgtattttttaaaattgatt

SEQ ID NO: 2439331 - DNA, 16 bp, Homo sapiens
agtgtcactcaaggcg

SEQ ID NO: 2439332 - DNA, 14 bp, Homo sapiens
agtgtcaggcactg

SEQ ID NO: 2439333 - DNA, 20 bp, Homo sapiens
agtgtcatttctcatccaca

SEQ ID NO: 2439334 - DNA, 15 bp, Homo sapiens
agtgtcctgagctca

SEQ ID NO: 2439335 - DNA, 21 bp, Homo sapiens
agtgtcctgagctcagcgtgg

SEQ ID NO: 2439336 - DNA, 22 bp, Homo sapiens
agtgtctgtgttttgaaagaat

SEQ ID NO: 2439337 - DNA, 20 bp, Homo sapiens
agtgtgaattgcaaaaccca

SEQ ID NO: 2439338 - DNA, 14 bp, Homo sapiens
agtgtgaccaggca

SEQ ID NO: 2439339 - DNA, 18 bp, Homo sapiens
agtgtgaggccagggcag

SEQ ID NO: 2439340 - DNA, 20 bp, Homo sapiens
agtgtgcgtggtggtccctg

SEQ ID NO: 2439341 - DNA, 23 bp, Homo sapiens
agtgtgcgtggtggtccctgggt

SEQ ID NO: 2439342 - DNA, 23 bp, Homo sapiens
agtgttagccttttttccccaga

SEQ ID NO: 2439343 - DNA, 18 bp, Homo sapiens
agtgttagggaagggcct

SEQ ID NO: 2439344 - DNA, 23 bp, Homo sapiens
agtgttagggaagggcctgccac

SEQ ID NO: 2439345 - DNA, 14 bp, Homo sapiens
agtgttccctatcc

SEQ ID NO: 2439346 - DNA, 15 bp, Homo sapiens
agtgttccctatcca

SEQ ID NO: 2439347 - DNA, 22 bp, Homo sapiens
agtgttccctatccaatcaatc

SEQ ID NO: 2439348 - DNA, 18 bp, Homo sapiens
agtgttttatgagaaagc

SEQ ID NO: 2439349 - DNA, 19 bp, Homo sapiens
agttaagacatgatttcct

SEQ ID NO: 2439350 - DNA, 15 bp, Homo sapiens
agttaatcatcaaga

SEQ ID NO: 2439351 - DNA, 14 bp, Homo sapiens
agttaatcttgctt

SEQ ID NO: 2439352 - DNA, 15 bp, Homo sapiens
agttaatcttgcttt

SEQ ID NO: 2439353 - DNA, 15 bp, Homo sapiens
agttaatttttccaa

SEQ ID NO: 2439354 - DNA, 15 bp, Homo sapiens
agttacagttctgtg

SEQ ID NO: 2439355 - DNA, 22 bp, Homo sapiens
agttacataattcactctgagt

SEQ ID NO: 2439356 - DNA, 15 bp, Homo sapiens
agttaccagtgcctt

SEQ ID NO: 2439357 - DNA, 16 bp, Homo sapiens
agttaccagtgcctta

SEQ ID NO: 2439358 - DNA, 17 bp, Homo sapiens
agttaccattaaaccat

SEQ ID NO: 2439359 - DNA, 17 bp, Homo sapiens
agttaccttatagttac

SEQ ID NO: 2439360 - DNA, 20 bp, Homo sapiens
agttaccttatagttactgt

SEQ ID NO: 2439361 - DNA, 21 bp, Homo sapiens
agttaccttatagttactgtg

SEQ ID NO: 2439362 - DNA, 21 bp, Homo sapiens
agttagctttaacttaaatag

SEQ ID NO: 2439363 - DNA, 20 bp, Homo sapiens
agttagtatcttttgatatg

SEQ ID NO: 2439364 - DNA, 19 bp, Homo sapiens
agttagttccactgagacc

SEQ ID NO: 2439365 - DNA, 14 bp, Homo sapiens
agttagtttgtata

SEQ ID NO: 2439366 - DNA, 20 bp, Homo sapiens
agttatagtgaatactgcta

SEQ ID NO: 2439367 - DNA, 14 bp, Homo sapiens
agttatattttgca

SEQ ID NO: 2439368 - DNA, 16 bp, Homo sapiens
agttatattttgcagt

SEQ ID NO: 2439369 - DNA, 19 bp, Homo sapiens
agttattaagttctttaaa

SEQ ID NO: 2439370 - DNA, 13 bp, Homo sapiens
agttattgcagtt

SEQ ID NO: 2439371 - DNA, 16 bp, Homo sapiens
agttattgcagtttat

SEQ ID NO: 2439372 - DNA, 17 bp, Homo sapiens
atgagtctagatgttta

SEQ ID NO: 2439373 - DNA, 15 bp, Homo sapiens
atgagtgaataaatg

SEQ ID NO: 2439374 - DNA, 16 bp, Homo sapiens
atgagtgaataaatgt

SEQ ID NO: 2439375 - DNA, 17 bp, Homo sapiens
atgagtgaataaatgtc

SEQ ID NO: 2439376 - DNA, 14 bp, Homo sapiens
atgataaagagaca

SEQ ID NO: 2439377 - DNA, 15 bp, Homo sapiens
atgataatgaacaga

SEQ ID NO: 2439378 - DNA, 17 bp, Homo sapiens
atgataccacctttact

SEQ ID NO: 2439379 - DNA, 19 bp, Homo sapiens
atgataccacctttactgt

SEQ ID NO: 2439380 - DNA, 16 bp, Homo sapiens
atgatacttcgacact

SEQ ID NO: 2439381 - DNA, 23 bp, Homo sapiens
atgatacttcgacactgttctta

SEQ ID NO: 2439382 - DNA, 13 bp, Homo sapiens
atgatccctgtgt

SEQ ID NO: 2439383 - DNA, 17 bp, Homo sapiens
atgatcggcaggacacc

SEQ ID NO: 2439384 - DNA, 23 bp, Homo sapiens
atgatgcttctataattttgcct

SEQ ID NO: 2439385 - DNA, 14 bp, Homo sapiens
atgatgttaaaaaa

SEQ ID NO: 2439386 - DNA, 17 bp, Homo sapiens
atgattaaataagattc

SEQ ID NO: 2439387 - DNA, 18 bp, Homo sapiens
atgattaaataagattct

SEQ ID NO: 2439388 - DNA, 17 bp, Homo sapiens
caatgcagttgtctctg

SEQ ID NO: 2439389 - DNA, 19 bp, Homo sapiens
caatgcagttgtctctgtt

SEQ ID NO: 2439390 - DNA, 20 bp, Homo sapiens
caatgcagttgtctctgttt

SEQ ID NO: 2439391 - DNA, 15 bp, Homo sapiens
caatgccacagccct

SEQ ID NO: 2439392 - DNA, 17 bp, Homo sapiens
caatgccacagccctgt

SEQ ID NO: 2439393 - DNA, 19 bp, Homo sapiens
caatgccacagccctgtca

SEQ ID NO: 2439394 - DNA, 22 bp, Homo sapiens
caatgccacagccctgtcagca

SEQ ID NO: 2439395 - DNA, 23 bp, Homo sapiens
caatgggagctgaggccacactc

SEQ ID NO: 2439396 - DNA, 15 bp, Homo sapiens
caatggggccagtca

SEQ ID NO: 2439397 - DNA, 13 bp, Homo sapiens
agttcaagaaata

SEQ ID NO: 2439398 - DNA, 19 bp, Homo sapiens
agttcaagaaataagtttt

SEQ ID NO: 2439399 - DNA, 15 bp, Homo sapiens
agttcagaatttagt

SEQ ID NO: 2439400 - DNA, 21 bp, Homo sapiens
agttcagcgctgtcaggattg

SEQ ID NO: 2439401 - DNA, 22 bp, Homo sapiens
agttcatatgtaccatgtacat

SEQ ID NO: 2439402 - DNA, 22 bp, Homo sapiens
agttcatgcagctgtggcagag

SEQ ID NO: 2439403 - DNA, 14 bp, Homo sapiens
agttcatgtaaata

SEQ ID NO: 2439404 - DNA, 16 bp, Homo sapiens
agttcatgtaaataat

SEQ ID NO: 2439405 - DNA, 13 bp, Homo sapiens
agttccaagagtc

SEQ ID NO: 2439406 - DNA, 20 bp, Homo sapiens
agttccaagagtctaaagat

SEQ ID NO: 2439407 - DNA, 20 bp, Homo sapiens
agttccacttatagcctctg

SEQ ID NO: 2439408 - DNA, 14 bp, Homo sapiens
agttccagaagtgt

SEQ ID NO: 2439409 - DNA, 17 bp, Homo sapiens
agttcccacattaaaga

SEQ ID NO: 2439410 - DNA, 22 bp, Homo sapiens
agttcccacattaaagaagacc

SEQ ID NO: 2439411 - DNA, 19 bp, Homo sapiens
agttcccagttggagctcc

SEQ ID NO: 2439412 - DNA, 14 bp, Homo sapiens
agttcgcagccacc

SEQ ID NO: 2439413 - DNA, 21 bp, Homo sapiens
agttcgcagccaccctgagga

SEQ ID NO: 2439414 - DNA, 15 bp, Homo sapiens
agttctaagattctg

SEQ ID NO: 2439415 - DNA, 16 bp, Homo sapiens
agttctaagattctga

SEQ ID NO: 2439416 - DNA, 17 bp, Homo sapiens
agttctaataatttcta

SEQ ID NO: 2439417 - DNA, 21 bp, Homo sapiens
agttctagacatggaggttct

SEQ ID NO: 2439418 - DNA, 13 bp, Homo sapiens
agttctaggaaaa

SEQ ID NO: 2439419 - DNA, 19 bp, Homo sapiens
agttctgctccagacaggg

SEQ ID NO: 2439420 - DNA, 23 bp, Homo sapiens
agttctgtactcaaatgtagcca

SEQ ID NO: 2439421 - DNA, 16 bp, Homo sapiens
agttctgtggtttcat

SEQ ID NO: 2439422 - DNA, 15 bp, Homo sapiens
cactccttttaaaga

SEQ ID NO: 2439423 - DNA, 13 bp, Homo sapiens
cactcgacatgaa

SEQ ID NO: 2439424 - DNA, 20 bp, Homo sapiens
cactcgctagcagtggcagg

SEQ ID NO: 2439425 - DNA, 13 bp, Homo sapiens
cactctaaagcaa

SEQ ID NO: 2439426 - DNA, 11 bp, Homo sapiens
cactctagatt

SEQ ID NO: 2439427 - DNA, 18 bp, Homo sapiens
cactctagtcaatgacat

SEQ ID NO: 2439428 - DNA, 19 bp, Homo sapiens
cactctagtcaatgacatg

SEQ ID NO: 2439429 - DNA, 16 bp, Homo sapiens
cactctgagtgtttta

SEQ ID NO: 2439430 - DNA, 14 bp, Homo sapiens
cactctgctctgat

SEQ ID NO: 2439431 - DNA, 17 bp, Homo sapiens
cactctgctctgatgca

SEQ ID NO: 2439432 - DNA, 18 bp, Homo sapiens
cactctgcttctctgact

SEQ ID NO: 2439433 - DNA, 15 bp, Homo sapiens
cactctggcagccac

SEQ ID NO: 2439434 - DNA, 18 bp, Homo sapiens
cactctggcagccacact

SEQ ID NO: 2439435 - DNA, 20 bp, Homo sapiens
cactctgtaattgcaaaaaa

SEQ ID NO: 2439436 - DNA, 18 bp, Homo sapiens
cactcttatgctgtaccc

SEQ ID NO: 2439437 - DNA, 21 bp, Homo sapiens
cactcttatgctgtacccagt

SEQ ID NO: 2439438 - DNA, 16 bp, Homo sapiens
cactgacagcctccca

SEQ ID NO: 2439439 - DNA, 17 bp, Homo sapiens
cactgacagcctcccac

SEQ ID NO: 2439440 - DNA, 20 bp, Homo sapiens
cactgactgggaccaggcac

SEQ ID NO: 2439441 - DNA, 21 bp, Homo sapiens
cactgagaggacagagagaaa

SEQ ID NO: 2439442 - DNA, 19 bp, Homo sapiens
cactgagataccagcgagg

SEQ ID NO: 2439443 - DNA, 23 bp, Homo sapiens
cactgagataccagcgaggaggc

SEQ ID NO: 2439444 - DNA, 19 bp, Homo sapiens
cactgatgctgcccctcat

SEQ ID NO: 2439445 - DNA, 18 bp, Homo sapiens
ccaggctgaccacagcac

SEQ ID NO: 2439446 - DNA, 20 bp, Homo sapiens
ccaggctgaccacagcacag

SEQ ID NO: 2439447 - DNA, 15 bp, Homo sapiens
ccaggctgaggtcct

SEQ ID NO: 2439448 - DNA, 23 bp, Homo sapiens
ccaggctgtgtttggctttcagg

SEQ ID NO: 2439449 - DNA, 18 bp, Homo sapiens
ccaggcttctgctggggc

SEQ ID NO: 2439450 - DNA, 20 bp, Homo sapiens
ccaggcttctgctggggcct

SEQ ID NO: 2439451 - DNA, 14 bp, Homo sapiens
ccagggaagcagca

SEQ ID NO: 2439452 - DNA, 16 bp, Homo sapiens
ccagggaagcagcagc

SEQ ID NO: 2439453 - DNA, 17 bp, Homo sapiens
ccagggaagctgtccct

SEQ ID NO: 2439454 - DNA, 18 bp, Homo sapiens
ccagggacacctgggaga

SEQ ID NO: 2439455 - DNA, 21 bp, Homo sapiens
ccagggacagaggccccagcc

SEQ ID NO: 2439456 - DNA, 14 bp, Homo sapiens
ccagggagaagctc

SEQ ID NO: 2439457 - DNA, 15 bp, Homo sapiens
ccagggagaagctcc

SEQ ID NO: 2439458 - DNA, 17 bp, Homo sapiens
ccagggagagcccagga

SEQ ID NO: 2439459 - DNA, 19 bp, Homo sapiens
ccagggagagcccaggagc

SEQ ID NO: 2439460 - DNA, 10 bp, Homo sapiens
ccagggcaca

SEQ ID NO: 2439461 - DNA, 13 bp, Homo sapiens
ccagggcacagga

SEQ ID NO: 2439462 - DNA, 16 bp, Homo sapiens
ccagggcacaggagct

SEQ ID NO: 2439463 - DNA, 15 bp, Homo sapiens
ccagggcagccaggg

SEQ ID NO: 2439464 - DNA, 18 bp, Homo sapiens
ccagggcatctctgggct

SEQ ID NO: 2439465 - DNA, 18 bp, Homo sapiens
ccagggccacgctccagc

SEQ ID NO: 2439466 - DNA, 14 bp, Homo sapiens
ccagggccagcctc

SEQ ID NO: 2439467 - DNA, 14 bp, Homo sapiens
ccagggcccagagc

SEQ ID NO: 2439468 - DNA, 17 bp, Homo sapiens
ccagggcccccatctca

SEQ ID NO: 2439469 - DNA, 21 bp, Homo sapiens
ccagggcccctcaccctgcct

SEQ ID NO: 2439470 - DNA, 24 bp, Homo sapiens
ccagggcccctctccccagggaag

SEQ ID NO: 2439471 - DNA, 12 bp, Homo sapiens
ccagggctcctg

SEQ ID NO: 2439472 - DNA, 14 bp, Homo sapiens
ccagggctcctgca

SEQ ID NO: 2439473 - DNA, 18 bp, Homo sapiens
ccagggctgggaggaagg

SEQ ID NO: 2439474 - DNA, 19 bp, Homo sapiens
ccagggctgggaggaagga

SEQ ID NO: 2439475 - DNA, 16 bp, Homo sapiens
ccaggggcagccccag

SEQ ID NO: 2439476 - DNA, 19 bp, Homo sapiens
ccaggggcagccccaggcc

SEQ ID NO: 2439477 - DNA, 15 bp, Homo sapiens
ccaggggctccctcc

SEQ ID NO: 2439478 - DNA, 22 bp, Homo sapiens
ccaggggctccctccgccccca

SEQ ID NO: 2439479 - DNA, 21 bp, Homo sapiens
ccaggggctgcttcctcctgg

SEQ ID NO: 2439480 - DNA, 23 bp, Homo sapiens
ccagggggagctgggcctggtct

SEQ ID NO: 2439481 - DNA, 17 bp, Homo sapiens
ccaggggggtgaggagc

SEQ ID NO: 2439482 - DNA, 13 bp, Homo sapiens
ccaggggtttctc

SEQ ID NO: 2439483 - DNA, 17 bp, Homo sapiens
ccagggtatgaagagtg

SEQ ID NO: 2439484 - DNA, 14 bp, Homo sapiens
ccagggtcctggga

SEQ ID NO: 2439485 - DNA, 15 bp, Homo sapiens
ccagggtctccagaa

SEQ ID NO: 2439486 - DNA, 16 bp, Homo sapiens
ccagggttgaccccag

SEQ ID NO: 2439487 - DNA, 13 bp, Homo sapiens
ccagggttttgcc

SEQ ID NO: 2439488 - DNA, 13 bp, Homo sapiens
ccaggtccagctc

SEQ ID NO: 2439489 - DNA, 15 bp, Homo sapiens
ccaggtccagctctg

SEQ ID NO: 2439490 - DNA, 18 bp, Homo sapiens
ccaggtccagctctggag

SEQ ID NO: 2439491 - DNA, 12 bp, Homo sapiens
ccaggtccctct

SEQ ID NO: 2439492 - DNA, 12 bp, Homo sapiens
ccaggtcctggt

SEQ ID NO: 2439493 - DNA, 13 bp, Homo sapiens
ccaggtcctggtg

SEQ ID NO: 2439494 - DNA, 19 bp, Homo sapiens
ccaggtcctggtggggcag

SEQ ID NO: 2439495 - DNA, 13 bp, Homo sapiens
ccaggtctccctg

SEQ ID NO: 2439496 - DNA, 22 bp, Homo sapiens
ccaggtgctacacccttttcca

SEQ ID NO: 2439497 - DNA, 19 bp, Homo sapiens
ccaggtgttaacattccaa

SEQ ID NO: 2439498 - DNA, 17 bp, Homo sapiens
ccaggtgttactgtaat

SEQ ID NO: 2439499 - DNA, 21 bp, Homo sapiens
ccaggtgttactgtaattcct

SEQ ID NO: 2439500 - DNA, 18 bp, Homo sapiens
ccaggttccacagaggac

SEQ ID NO: 2439501 - DNA, 23 bp, Homo sapiens
ccaggttctccgttagctcctgt

SEQ ID NO: 2439502 - DNA, 19 bp, Homo sapiens
ccaggttggctctgccagt

SEQ ID NO: 2439503 - DNA, 19 bp, Homo sapiens
ccagtaacgcgtcttcctg

SEQ ID NO: 2439504 - DNA, 17 bp, Homo sapiens
ccagtatttagaagcca

SEQ ID NO: 2439505 - DNA, 18 bp, Homo sapiens
ccagtatttagaagccaa

SEQ ID NO: 2439506 - DNA, 14 bp, Homo sapiens
ccagtcaggcccag

SEQ ID NO: 2439507 - DNA, 17 bp, Homo sapiens
ccagtccacctgaggaa

SEQ ID NO: 2439508 - DNA, 16 bp, Homo sapiens
ccagtccaggctgccg

SEQ ID NO: 2439509 - DNA, 17 bp, Homo sapiens
ccagtccccccaccctc

SEQ ID NO: 2439510 - DNA, 21 bp, Homo sapiens
ccagtcctatctgggcttcct

SEQ ID NO: 2439511 - DNA, 13 bp, Homo sapiens
ccagtctgtggat

SEQ ID NO: 2439512 - DNA, 21 bp, Homo sapiens
ccagtctgtggatcagagatg

SEQ ID NO: 2439513 - DNA, 22 bp, Homo sapiens
ccagtgaagagccactgccatt

SEQ ID NO: 2439514 - DNA, 17 bp, Homo sapiens
ccagtgacagacaggct

SEQ ID NO: 2439515 - DNA, 18 bp, Homo sapiens
ccagtgacagacaggctc

SEQ ID NO: 2439516 - DNA, 14 bp, Homo sapiens
ccagtgcactgaaa

SEQ ID NO: 2439517 - DNA, 14 bp, Homo sapiens
ccagtgcccccact

SEQ ID NO: 2439518 - DNA, 17 bp, Homo sapiens
ccagtgccctgatccca

SEQ ID NO: 2439519 - DNA, 14 bp, Homo sapiens
ccagtggattccca

SEQ ID NO: 2439520 - DNA, 19 bp, Homo sapiens
ccagtgtcctgagccccag

SEQ ID NO: 2439521 - DNA, 22 bp, Homo sapiens
ccagtgtcctgagccccaggga

SEQ ID NO: 2439522 - DNA, 22 bp, Homo sapiens
ccagtgtcctgagctcagcgtg

SEQ ID NO: 2439523 - DNA, 20 bp, Homo sapiens
ccagtgttagggaagggcct

SEQ ID NO: 2439524 - DNA, 13 bp, Homo sapiens
ccagtgtttaaaa

SEQ ID NO: 2439525 - DNA, 17 bp, Homo sapiens
ccagttaatcttgcttt

SEQ ID NO: 2439526 - DNA, 13 bp, Homo sapiens
ccagttcaccctg

SEQ ID NO: 2439527 - DNA, 18 bp, Homo sapiens
ccagttgcactcaggtga

SEQ ID NO: 2439528 - DNA, 19 bp, Homo sapiens
ccagttgcagtcactctag

SEQ ID NO: 2439529 - DNA, 14 bp, Homo sapiens
ccagttgcctttta

SEQ ID NO: 2439530 - DNA, 15 bp, Homo sapiens
ccagttggagttttt

SEQ ID NO: 2439531 - DNA, 22 bp, Homo sapiens
ccagttgtcccgattgtaactc

SEQ ID NO: 2439532 - DNA, 21 bp, Homo sapiens
ccagtttctaaactggagact

SEQ ID NO: 2439533 - DNA, 20 bp, Homo sapiens
ccagtttgggtaaaatactt

SEQ ID NO: 2439534 - DNA, 22 bp, Homo sapiens
ccagtttgggtaaaatactttt

SEQ ID NO: 2439535 - DNA, 18 bp, Homo sapiens
ccatagtcttaactggtc

SEQ ID NO: 2439536 - DNA, 21 bp, Homo sapiens
ccatatcacacacattgctgt

SEQ ID NO: 2439537 - DNA, 23 bp, Homo sapiens
ccatattaaattttttgttgaca

SEQ ID NO: 2439538 - DNA, 17 bp, Homo sapiens
ccatatttacctcagcc

SEQ ID NO: 2439539 - DNA, 15 bp, Homo sapiens
ccatatttgtaaaat

SEQ ID NO: 2439540 - DNA, 17 bp, Homo sapiens
ccatcaacaaaaattgt

SEQ ID NO: 2439541 - DNA, 19 bp, Homo sapiens
ccatcacctactcacacag

SEQ ID NO: 2439542 - DNA, 21 bp, Homo sapiens
ccatcacctactcacacaggc

SEQ ID NO: 2439543 - DNA, 16 bp, Homo sapiens
ccatcacctcagatgg

SEQ ID NO: 2439544 - DNA, 20 bp, Homo sapiens
ccatcagggtaggctggagt

SEQ ID NO: 2439545 - DNA, 16 bp, Homo sapiens
ccatcatcctctggct

SEQ ID NO: 2439546 - DNA, 13 bp, Homo sapiens
ccatcatctcctg

SEQ ID NO: 2439547 - DNA, 23 bp, Homo sapiens
ccatccccttgaggtctcagccc

SEQ ID NO: 2439548 - DNA, 17 bp, Homo sapiens
ccatccctgtggtctac

SEQ ID NO: 2439549 - DNA, 18 bp, Homo sapiens
ccatctcaggccagagcc

SEQ ID NO: 2439550 - DNA, 22 bp, Homo sapiens
catctttgaaattatgtaaatt

SEQ ID NO: 2439551 - DNA, 13 bp, Homo sapiens
catcttttgtatt

SEQ ID NO: 2439552 - DNA, 18 bp, Homo sapiens
catcttttgtattaagaa

SEQ ID NO: 2439553 - DNA, 21 bp, Homo sapiens
catgaaaaatcatgggccaga

SEQ ID NO: 2439554 - DNA, 18 bp, Homo sapiens
catgaagattctttccca

SEQ ID NO: 2439555 - DNA, 21 bp, Homo sapiens
catgaagccacgggtgccaga

SEQ ID NO: 2439556 - DNA, 22 bp, Homo sapiens
catgaagccacgggtgccagaa

SEQ ID NO: 2439557 - DNA, 19 bp, Homo sapiens
catgaatctgcacatctgt

SEQ ID NO: 2439558 - DNA, 13 bp, Homo sapiens
catgaatgtaaat

SEQ ID NO: 2439559 - DNA, 17 bp, Homo sapiens
catgaattattacagtg

SEQ ID NO: 2439560 - DNA, 18 bp, Homo sapiens
catgaattttagcttttg

SEQ ID NO: 2439561 - DNA, 20 bp, Homo sapiens
catgaattttagcttttgtg

SEQ ID NO: 2439562 - DNA, 16 bp, Homo sapiens
catgacaacttctaat

SEQ ID NO: 2439563 - DNA, 15 bp, Homo sapiens
catgacctccagctt

SEQ ID NO: 2439564 - DNA, 12 bp, Homo sapiens
catgactgcttg

SEQ ID NO: 2439565 - DNA, 21 bp, Homo sapiens
catgactgcttgccctaagca

SEQ ID NO: 2439566 - DNA, 23 bp, Homo sapiens
catgaggagattctgcctttgcc

SEQ ID NO: 2439567 - DNA, 23 bp, Homo sapiens
catgagttggggtctggcagcct

SEQ ID NO: 2439568 - DNA, 16 bp, Homo sapiens
catgatatcttcaagc

SEQ ID NO: 2439569 - DNA, 17 bp, Homo sapiens
catgatgcctctgtctt

SEQ ID NO: 2439570 - DNA, 22 bp, Homo sapiens
catgatgcctctgtcttctgga

SEQ ID NO: 2439571 - DNA, 20 bp, Homo sapiens
catgatggcaacagatctgg

SEQ ID NO: 2439572 - DNA, 16 bp, Homo sapiens
catgattcctttaaca

SEQ ID NO: 2439573 - DNA, 17 bp, Homo sapiens
catgattcctttaacaa

SEQ ID NO: 2439574 - DNA, 14 bp, Homo sapiens
catgattctattta

SEQ ID NO: 2439575 - DNA, 12 bp, Homo sapiens
catgatttcctt

SEQ ID NO: 2439576 - DNA, 18 bp, Homo sapiens
catgatttccttgaatgt

SEQ ID NO: 2439577 - DNA, 22 bp, Homo sapiens
catgattttaagtttctctgca

SEQ ID NO: 2439578 - DNA, 24 bp, Homo sapiens
catgattttaagtttctctgcaga

SEQ ID NO: 2439579 - DNA, 14 bp, Homo sapiens
catgcacagtattt

SEQ ID NO: 2439580 - DNA, 18 bp, Homo sapiens
catgcacagtatttgtaa

SEQ ID NO: 2439581 - DNA, 13 bp, Homo sapiens
catgcactgtgaa

SEQ ID NO: 2439582 - DNA, 18 bp, Homo sapiens
catgcactgtgaaggacc

SEQ ID NO: 2439583 - DNA, 19 bp, Homo sapiens
catgcactgttccccctgt

SEQ ID NO: 2439584 - DNA, 23 bp, Homo sapiens
catgcactgttccccctgtgcag

SEQ ID NO: 2439585 - DNA, 13 bp, Homo sapiens
catgcatctgttt

SEQ ID NO: 2439586 - DNA, 17 bp, Homo sapiens
catgccacaaggacttc

SEQ ID NO: 2439587 - DNA, 17 bp, Homo sapiens
catgccagtaacaggct

SEQ ID NO: 2439588 - DNA, 18 bp, Homo sapiens
catgccatttgtactgac

SEQ ID NO: 2439589 - DNA, 19 bp, Homo sapiens
catgccatttgtactgacc

SEQ ID NO: 2439590 - DNA, 14 bp, Homo sapiens
catgcccagagacc

SEQ ID NO: 2439591 - DNA, 19 bp, Homo sapiens
catattgtaaaacaggtag

SEQ ID NO: 2439592 - DNA, 16 bp, Homo sapiens
catatttgtaaaatga

SEQ ID NO: 2439593 - DNA, 19 bp, Homo sapiens
catatttgtaaaatgacaa

SEQ ID NO: 2439594 - DNA, 16 bp, Homo sapiens
catattttaaacagag

SEQ ID NO: 2439595 - DNA, 21 bp, Homo sapiens
catcaaaaaaggcagttacca

SEQ ID NO: 2439596 - DNA, 15 bp, Homo sapiens
catcaaaatgctttt

SEQ ID NO: 2439597 - DNA, 13 bp, Homo sapiens
catcaacaaaaat

SEQ ID NO: 2439598 - DNA, 22 bp, Homo sapiens
catcaagactttgctaaagaca

SEQ ID NO: 2439599 - DNA, 12 bp, Homo sapiens
catcaagagaat

SEQ ID NO: 2439600 - DNA, 22 bp, Homo sapiens
catcaatggggccagtcaggcc

SEQ ID NO: 2439601 - DNA, 12 bp, Homo sapiens
catcacagaatg

SEQ ID NO: 2439602 - DNA, 20 bp, Homo sapiens
catcacctactcacacaggc

SEQ ID NO: 2439603 - DNA, 17 bp, Homo sapiens
catcacctcagatggca

SEQ ID NO: 2439604 - DNA, 22 bp, Homo sapiens
catcacttaacggaccaaagca

SEQ ID NO: 2439605 - DNA, 12 bp, Homo sapiens
catcagaaaggg

SEQ ID NO: 2439606 - DNA, 17 bp, Homo sapiens
catcagaaagggagggc

SEQ ID NO: 2439607 - DNA, 15 bp, Homo sapiens
catcagtgctccctc

SEQ ID NO: 2439608 - DNA, 24 bp, Homo sapiens
catcatcatggccagctggaggca

SEQ ID NO: 2439609 - DNA, 14 bp, Homo sapiens
catcatcctctggc

SEQ ID NO: 2439610 - DNA, 13 bp, Homo sapiens
catcatctcctgc

SEQ ID NO: 2439611 - DNA, 21 bp, Homo sapiens
catcatctcctgccttcctcc

SEQ ID NO: 2439612 - DNA, 15 bp, Homo sapiens
catcatgcctctgag

SEQ ID NO: 2439613 - DNA, 17 bp, Homo sapiens
catcatgcctctgaggc

SEQ ID NO: 2439614 - DNA, 22 bp, Homo sapiens
catcatgcctctgaggccagcc

SEQ ID NO: 2439615 - DNA, 14 bp, Homo sapiens
catcatggccagct

SEQ ID NO: 2439616 - DNA, 15 bp, Homo sapiens
catcattatttatgt

SEQ ID NO: 2439617 - DNA, 14 bp, Homo sapiens
catcattctctgtc

SEQ ID NO: 2439618 - DNA, 12 bp, Homo sapiens
catcatttcact

SEQ ID NO: 2439619 - DNA, 15 bp, Homo sapiens
catcatttcacttgt

SEQ ID NO: 2439620 - DNA, 21 bp, Homo sapiens
catccaaagcagacagctcca

SEQ ID NO: 2439621 - DNA, 14 bp, Homo sapiens
catccaccccatcc

SEQ ID NO: 2439622 - DNA, 14 bp, Homo sapiens
catccagtctattc

SEQ ID NO: 2439623 - DNA, 15 bp, Homo sapiens
catccatgcctcaga

SEQ ID NO: 2439624 - DNA, 15 bp, Homo sapiens
catccatggccagca

SEQ ID NO: 2439625 - DNA, 18 bp, Homo sapiens
catccatgtccaaccccc

SEQ ID NO: 2439626 - DNA, 21 bp, Homo sapiens
catcccagacaggtccctccc

SEQ ID NO: 2439627 - DNA, 18 bp, Homo sapiens
catcccgtcttctccaac

SEQ ID NO: 2439628 - DNA, 14 bp, Homo sapiens
catcccgtgttctc

SEQ ID NO: 2439629 - DNA, 13 bp, Homo sapiens
catccctccccag

SEQ ID NO: 2439630 - DNA, 15 bp, Homo sapiens
cagtgacagacaggc

SEQ ID NO: 2439631 - DNA, 13 bp, Homo sapiens
cagtgacttctga

SEQ ID NO: 2439632 - DNA, 15 bp, Homo sapiens
cagtgcaacactggt

SEQ ID NO: 2439633 - DNA, 21 bp, Homo sapiens
cagtgcccccactgaccagaa

SEQ ID NO: 2439634 - DNA, 22 bp, Homo sapiens
cagtgccctctcccctcagcct

SEQ ID NO: 2439635 - DNA, 15 bp, Homo sapiens
cagtgccctgatccc

SEQ ID NO: 2439636 - DNA, 19 bp, Homo sapiens
cagtgctgtgctgtgctat

SEQ ID NO: 2439637 - DNA, 21 bp, Homo sapiens
cagtgcttttggcggggagga

SEQ ID NO: 2439638 - DNA, 13 bp, Homo sapiens
cagtggcaggcag

SEQ ID NO: 2439639 - DNA, 21 bp, Homo sapiens
cagtggcaggcagaggcccag

SEQ ID NO: 2439640 - DNA, 16 bp, Homo sapiens
cagtggcccatggcat

SEQ ID NO: 2439641 - DNA, 19 bp, Homo sapiens
cagtggctggtccagggct

SEQ ID NO: 2439642 - DNA, 13 bp, Homo sapiens
cagtggtaagcta

SEQ ID NO: 2439643 - DNA, 19 bp, Homo sapiens
cagtgtatggggcagcttc

SEQ ID NO: 2439644 - DNA, 16 bp, Homo sapiens
cagtgtcaggcactgg

SEQ ID NO: 2439645 - DNA, 13 bp, Homo sapiens
cagtgtcctgagc

SEQ ID NO: 2439646 - DNA, 22 bp, Homo sapiens
cagtgtcctgagctcagcgtgg

SEQ ID NO: 2439647 - DNA, 13 bp, Homo sapiens
cagtgtctgtgtt

SEQ ID NO: 2439648 - DNA, 23 bp, Homo sapiens
cagtgtctgtgttttgaaagaat

SEQ ID NO: 2439649 - DNA, 16 bp, Homo sapiens
cagtgtgaggccaggg

SEQ ID NO: 2439650 - DNA, 14 bp, Homo sapiens
cagtgtgtgactta

SEQ ID NO: 2439651 - DNA, 18 bp, Homo sapiens
cagtgttggggatgcctt

SEQ ID NO: 2439652 - DNA, 20 bp, Homo sapiens
cagtgttgtcaccagatctg

SEQ ID NO: 2439653 - DNA, 16 bp, Homo sapiens
cagttaagaaatttca

SEQ ID NO: 2439654 - DNA, 12 bp, Homo sapiens
cagttaatcttg

SEQ ID NO: 2439655 - DNA, 13 bp, Homo sapiens
cagttaatttttc

SEQ ID NO: 2439656 - DNA, 18 bp, Homo sapiens
cagttaccattaaaccat

SEQ ID NO: 2439657 - DNA, 19 bp, Homo sapiens
cagttaccattaaaccatc

SEQ ID NO: 2439658 - DNA, 18 bp, Homo sapiens
cagttcattgcactttga

SEQ ID NO: 2439659 - DNA, 14 bp, Homo sapiens
cagttcgcagccac

SEQ ID NO: 2439660 - DNA, 21 bp, Homo sapiens
cagttcgcagccaccctgagg

SEQ ID NO: 2439661 - DNA, 15 bp, Homo sapiens
cagttctaacctcct

SEQ ID NO: 2439662 - DNA, 15 bp, Homo sapiens
cagttctaggaaaat

SEQ ID NO: 2439663 - DNA, 17 bp, Homo sapiens
cagttctttgggccaga

SEQ ID NO: 2439664 - DNA, 19 bp, Homo sapiens
cagttctttgggccagaca

SEQ ID NO: 2439665 - DNA, 23 bp, Homo sapiens
ctctccaggcaggtctgaagctc

SEQ ID NO: 2439666 - DNA, 14 bp, Homo sapiens
ctctcccaactctt

SEQ ID NO: 2439667 - DNA, 14 bp, Homo sapiens
ctctcccaggcccc

SEQ ID NO: 2439668 - DNA, 18 bp, Homo sapiens
ctctccccacgagggctg

SEQ ID NO: 2439669 - DNA, 19 bp, Homo sapiens
ctctccccacgagggctgg

SEQ ID NO: 2439670 - DNA, 20 bp, Homo sapiens
ctctccccagcccagagaca

SEQ ID NO: 2439671 - DNA, 22 bp, Homo sapiens
ctctccccagggaagcagcagc

SEQ ID NO: 2439672 - DNA, 24 bp, Homo sapiens
ctctccccagggaagcagcagcct

SEQ ID NO: 2439673 - DNA, 15 bp, Homo sapiens
ctctccccaggtcca

SEQ ID NO: 2439674 - DNA, 16 bp, Homo sapiens
ctctccccaggtccag

SEQ ID NO: 2439675 - DNA, 15 bp, Homo sapiens
ctctcccctgacctg

SEQ ID NO: 2439676 - DNA, 20 bp, Homo sapiens
ctctcccctgccccctgcag

SEQ ID NO: 2439677 - DNA, 22 bp, Homo sapiens
ctctcccctgccccctgcagga

SEQ ID NO: 2439678 - DNA, 14 bp, Homo sapiens
ctctccctgcatgg

SEQ ID NO: 2439679 - DNA, 14 bp, Homo sapiens
ctctcccttgggct

SEQ ID NO: 2439680 - DNA, 23 bp, Homo sapiens
ctctcccttgggctctgatgaaa

SEQ ID NO: 2439681 - DNA, 13 bp, Homo sapiens
ctctcctggcttc

SEQ ID NO: 2439682 - DNA, 17 bp, Homo sapiens
ctctcctggcttcccat

SEQ ID NO: 2439683 - DNA, 15 bp, Homo sapiens
ctctcgcacacctct

SEQ ID NO: 2439684 - DNA, 14 bp, Homo sapiens
ctctcggctcccca

SEQ ID NO: 2439685 - DNA, 14 bp, Homo sapiens
ctctctacagtctc

SEQ ID NO: 2439686 - DNA, 18 bp, Homo sapiens
ctctctacagtctcgtct

SEQ ID NO: 2439687 - DNA, 14 bp, Homo sapiens
ctctctatcctctc

SEQ ID NO: 2439688 - DNA, 18 bp, Homo sapiens
ctctctttatacagctgt

SEQ ID NO: 2439689 - DNA, 12 bp, Homo sapiens
ctctgaaaccag

SEQ ID NO: 2439690 - DNA, 17 bp, Homo sapiens
ctctgaaaccagtgtta

SEQ ID NO: 2439691 - DNA, 12 bp, Homo sapiens
ctctgacagcag

SEQ ID NO: 2439692 - DNA, 13 bp, Homo sapiens
ctctgacagcagc

SEQ ID NO: 2439693 - DNA, 23 bp, Homo sapiens
ctctgacattatgtggttttaga

SEQ ID NO: 2439694 - DNA, 14 bp, Homo sapiens
ctctgacctgcact

SEQ ID NO: 2439695 - DNA, 15 bp, Homo sapiens
ctctgacctgcactg

SEQ ID NO: 2439696 - DNA, 20 bp, Homo sapiens
ctctgactcagggctcctgg

SEQ ID NO: 2439697 - DNA, 13 bp, Homo sapiens
ctctgacttctgc

SEQ ID NO: 2439698 - DNA, 14 bp, Homo sapiens
ctctgacttctgcc

SEQ ID NO: 2439699 - DNA, 19 bp, Homo sapiens
ctctgacttctgcctggag

SEQ ID NO: 2439700 - DNA, 21 bp, Homo sapiens
ctctgacttctgcctggagac

SEQ ID NO: 2439701 - DNA, 10 bp, Homo sapiens
ctctgagaac

SEQ ID NO: 2439702 - DNA, 14 bp, Homo sapiens
ctctgagactccag

SEQ ID NO: 2439703 - DNA, 23 bp, Homo sapiens
ctctgagactccagacctgaggc

SEQ ID NO: 2439704 - DNA, 13 bp, Homo sapiens
ctctgagaggccc

SEQ ID NO: 2439705 - DNA, 16 bp, Homo sapiens
ctctgagaggccctgg

SEQ ID NO: 2439706 - DNA, 18 bp, Homo sapiens
ctctgagagtctagattc

SEQ ID NO: 2439707 - DNA, 19 bp, Homo sapiens
ctctgagagtctagattct

SEQ ID NO: 2439708 - DNA, 13 bp, Homo sapiens
ctctgagcagtga

SEQ ID NO: 2439709 - DNA, 15 bp, Homo sapiens
ctctgagctgtcaac

SEQ ID NO: 2439710 - DNA, 17 bp, Homo sapiens
ctctgaggccagcctgg

SEQ ID NO: 2439711 - DNA, 20 bp, Homo sapiens
ctctgaggccagcctggcct

SEQ ID NO: 2439712 - DNA, 23 bp, Homo sapiens
ctctgaggcgccccaacccgtgg

SEQ ID NO: 2439713 - DNA, 22 bp, Homo sapiens
ctctgatccctctacagagctt

SEQ ID NO: 2439714 - DNA, 15 bp, Homo sapiens
ctctgatgcatcaga

SEQ ID NO: 2439715 - DNA, 15 bp, Homo sapiens
ctctgcaattcccct

SEQ ID NO: 2439716 - DNA, 20 bp, Homo sapiens
ctctgcaattcccctctgct

SEQ ID NO: 2439717 - DNA, 22 bp, Homo sapiens
ctctgcaattcccctctgctgc

SEQ ID NO: 2439718 - DNA, 18 bp, Homo sapiens
ctctgcagaaactactga

SEQ ID NO: 2439719 - DNA, 19 bp, Homo sapiens
ctctgcagacttcccagct

SEQ ID NO: 2439720 - DNA, 22 bp, Homo sapiens
ctctgcagacttcccagctagg

SEQ ID NO: 2439721 - DNA, 14 bp, Homo sapiens
ctctgcagcctcag

SEQ ID NO: 2439722 - DNA, 14 bp, Homo sapiens
ctctgcattctagt

SEQ ID NO: 2439723 - DNA, 14 bp, Homo sapiens
ctctgccagtcctg

SEQ ID NO: 2439724 - DNA, 15 bp, Homo sapiens
ctctgccagtcctgt

SEQ ID NO: 2439725 - DNA, 17 bp, Homo sapiens
ctctgccagtcctgtcc

SEQ ID NO: 2439726 - DNA, 20 bp, Homo sapiens
ctctgcccaacccttccctc

SEQ ID NO: 2439727 - DNA, 12 bp, Homo sapiens
ctctgcttctct

SEQ ID NO: 2439728 - DNA, 13 bp, Homo sapiens
ctctgcttctctg

SEQ ID NO: 2439729 - DNA, 16 bp, Homo sapiens
ctctgcttctctgact

SEQ ID NO: 2439730 - DNA, 17 bp, Homo sapiens
ctctgcttctctgactt

SEQ ID NO: 2439731 - DNA, 21 bp, Homo sapiens
ctctgcttctctgacttctgc

SEQ ID NO: 2439732 - DNA, 21 bp, Homo sapiens
ctctggagaaagggccctggg

SEQ ID NO: 2439733 - DNA, 16 bp, Homo sapiens
ctctggaggggagggg

SEQ ID NO: 2439734 - DNA, 19 bp, Homo sapiens
ctctggaggggtgtggctc

SEQ ID NO: 2439735 - DNA, 20 bp, Homo sapiens
ctctggaggggtgtggctcc

SEQ ID NO: 2439736 - DNA, 21 bp, Homo sapiens
ctctggaggggtgtggctcct

SEQ ID NO: 2439737 - DNA, 20 bp, Homo sapiens
ctctggcattagaattattt

SEQ ID NO: 2439738 - DNA, 22 bp, Homo sapiens
ctctggctgtaaggctctagat

SEQ ID NO: 2439739 - DNA, 22 bp, Homo sapiens
ctctggcttggccacagccagg

SEQ ID NO: 2439740 - DNA, 15 bp, Homo sapiens
ctctgggctggatga

SEQ ID NO: 2439741 - DNA, 16 bp, Homo sapiens
ctctggggggtggcca

SEQ ID NO: 2439742 - DNA, 19 bp, Homo sapiens
ctctggggggtggccaggc

SEQ ID NO: 2439743 - DNA, 17 bp, Homo sapiens
ctctggtaatattgact

SEQ ID NO: 2439744 - DNA, 20 bp, Homo sapiens
ctctggtcgctcctgcccac

SEQ ID NO: 2439745 - DNA, 18 bp, Homo sapiens
ctctggtgcctccagagg

SEQ ID NO: 2439746 - DNA, 20 bp, Homo sapiens
ctctgtcactcctcatgcct

SEQ ID NO: 2439747 - DNA, 19 bp, Homo sapiens
ctctgtcagtcacagccac

SEQ ID NO: 2439748 - DNA, 12 bp, Homo sapiens
ctctgtccccag

SEQ ID NO: 2439749 - DNA, 12 bp, Homo sapiens
ctctgtcctgaa

SEQ ID NO: 2439750 - DNA, 17 bp, Homo sapiens
ctctgtcctgaaggcct

SEQ ID NO: 2439751 - DNA, 18 bp, Homo sapiens
ctctgtcgcccatgctgg

SEQ ID NO: 2439752 - DNA, 13 bp, Homo sapiens
ctctgtctcgagc

SEQ ID NO: 2439753 - DNA, 20 bp, Homo sapiens
ctctgtctcgagcgccctgc

SEQ ID NO: 2439754 - DNA, 22 bp, Homo sapiens
ctctgtctcgagcgccctgcag

SEQ ID NO: 2439755 - DNA, 13 bp, Homo sapiens
ctctgtcttctgg

SEQ ID NO: 2439756 - DNA, 17 bp, Homo sapiens
ctcagccttcagacaga

SEQ ID NO: 2439757 - DNA, 16 bp, Homo sapiens
ctcagccttgccagag

SEQ ID NO: 2439758 - DNA, 19 bp, Homo sapiens
ctcagccttgccagagatc

SEQ ID NO: 2439759 - DNA, 11 bp, Homo sapiens
ctcagctgcat

SEQ ID NO: 2439760 - DNA, 17 bp, Homo sapiens
ctcaggacacaggcctg

SEQ ID NO: 2439761 - DNA, 18 bp, Homo sapiens
ctccaggggctgcttcct

SEQ ID NO: 2439762 - DNA, 21 bp, Homo sapiens
ctccaggggctgcttcctcct

SEQ ID NO: 2439763 - DNA, 23 bp, Homo sapiens
ctccaggggctgcttcctcctgg

SEQ ID NO: 2439764 - DNA, 16 bp, Homo sapiens
ctccagtgtcctgagc

SEQ ID NO: 2439765 - DNA, 17 bp, Homo sapiens
ctccagtgtcctgagct

SEQ ID NO: 2439766 - DNA, 21 bp, Homo sapiens
ctccagtgtcctgagctcagc

SEQ ID NO: 2439767 - DNA, 12 bp, Homo sapiens
ctccatccaagg

SEQ ID NO: 2439768 - DNA, 14 bp, Homo sapiens
ctccatccaaggcc

SEQ ID NO: 2439769 - DNA, 20 bp, Homo sapiens
ctccatccacatgggagccg

SEQ ID NO: 2439770 - DNA, 19 bp, Homo sapiens
ctccatccctggccccctc

SEQ ID NO: 2439771 - DNA, 15 bp, Homo sapiens
ctccatctggtagaa

SEQ ID NO: 2439772 - DNA, 20 bp, Homo sapiens
ctcccaaagtgctgagatta

SEQ ID NO: 2439773 - DNA, 21 bp, Homo sapiens
ctcccaatttcagactcccat

SEQ ID NO: 2439774 - DNA, 16 bp, Homo sapiens
ctcccacaagcctgag

SEQ ID NO: 2439775 - DNA, 22 bp, Homo sapiens
ctcccacatgggcccaggcctc

SEQ ID NO: 2439776 - DNA, 23 bp, Homo sapiens
ctcccacatgggcccaggcctca

SEQ ID NO: 2439777 - DNA, 15 bp, Homo sapiens
ctcccacccccatct

SEQ ID NO: 2439778 - DNA, 17 bp, Homo sapiens
ctcccacccggctgcag

SEQ ID NO: 2439779 - DNA, 12 bp, Homo sapiens
ctcccaccctct

SEQ ID NO: 2439780 - DNA, 16 bp, Homo sapiens
ctcccaccctcttcct

SEQ ID NO: 2439781 - DNA, 21 bp, Homo sapiens
ctcccaccctcttcctactgg

SEQ ID NO: 2439782 - DNA, 18 bp, Homo sapiens
ctcccacctagcagcacc

SEQ ID NO: 2439783 - DNA, 14 bp, Homo sapiens
ctcccacctcctga

SEQ ID NO: 2439784 - DNA, 15 bp, Homo sapiens
ctcccacctcctgac

SEQ ID NO: 2439785 - DNA, 20 bp, Homo sapiens
ctcccacctgacacaccagg

SEQ ID NO: 2439786 - DNA, 21 bp, Homo sapiens
ctcccacctgacacaccaggc

SEQ ID NO: 2439787 - DNA, 20 bp, Homo sapiens
ctcccagagcacctgctgtc

SEQ ID NO: 2439788 - DNA, 17 bp, Homo sapiens
ctcccaggcaaggctgt

SEQ ID NO: 2439789 - DNA, 17 bp, Homo sapiens
ctcccaggcactgtctt

SEQ ID NO: 2439790 - DNA, 22 bp, Homo sapiens
ctcccaggggctccctccgccc

SEQ ID NO: 2439791 - DNA, 12 bp, Homo sapiens
ctcccagggttt

SEQ ID NO: 2439792 - DNA, 21 bp, Homo sapiens
ctcccaggtgttaacattcca

SEQ ID NO: 2439793 - DNA, 22 bp, Homo sapiens
ctcccaggtgttaacattccaa

SEQ ID NO: 2439794 - DNA, 19 bp, Homo sapiens
ctcccatcctgtgtgttaa

SEQ ID NO: 2439795 - DNA, 16 bp, Homo sapiens
ctcccattcctgaaga

SEQ ID NO: 2439796 - DNA, 23 bp, Homo sapiens
ctccccaactgaccacctttgtt

SEQ ID NO: 2439797 - DNA, 18 bp, Homo sapiens
ctccccacgagggctggc

SEQ ID NO: 2439798 - DNA, 14 bp, Homo sapiens
ctccccactctgct

SEQ ID NO: 2439799 - DNA, 20 bp, Homo sapiens
ctccccactctgctctgatg

SEQ ID NO: 2439800 - DNA, 21 bp, Homo sapiens
ctccccagcattccagcccct

SEQ ID NO: 2439801 - DNA, 23 bp, Homo sapiens
ctccccagcattccagcccctct

SEQ ID NO: 2439802 - DNA, 13 bp, Homo sapiens
ctccccagcccag

SEQ ID NO: 2439803 - DNA, 17 bp, Homo sapiens
ctccccagcccagagac

SEQ ID NO: 2439804 - DNA, 15 bp, Homo sapiens
ctccccagctcccag

SEQ ID NO: 2439805 - DNA, 21 bp, Homo sapiens
ctcccccagcaaagcccccag

SEQ ID NO: 2439806 - DNA, 20 bp, Homo sapiens
ctcccccaggggctgtcccg

SEQ ID NO: 2439807 - DNA, 21 bp, Homo sapiens
ctcccccccatgcactgtgaa

SEQ ID NO: 2439808 - DNA, 17 bp, Homo sapiens
ctccccgataaagaatg

SEQ ID NO: 2439809 - DNA, 16 bp, Homo sapiens
ctcccctcagcctctc

SEQ ID NO: 2439810 - DNA, 16 bp, Homo sapiens
ctcccctccccaactg

SEQ ID NO: 2439811 - DNA, 12 bp, Homo sapiens
ctcccctgcact

SEQ ID NO: 2439812 - DNA, 16 bp, Homo sapiens
ctcccctgcactgtaa

SEQ ID NO: 2439813 - DNA, 19 bp, Homo sapiens
ctcccctgcactgtaaaat

SEQ ID NO: 2439814 - DNA, 12 bp, Homo sapiens
ctcccctgccac

SEQ ID NO: 2439815 - DNA, 16 bp, Homo sapiens
ctcccctgccagggca

SEQ ID NO: 2439816 - DNA, 19 bp, Homo sapiens
ctcccgagctcctcttcca

SEQ ID NO: 2439817 - DNA, 22 bp, Homo sapiens
ctcccggaattccgtcaccacg

SEQ ID NO: 2439818 - DNA, 19 bp, Homo sapiens
ctcccggaggttgggtggg

SEQ ID NO: 2439819 - DNA, 19 bp, Homo sapiens
ctccctattaacctagaga

SEQ ID NO: 2439820 - DNA, 23 bp, Homo sapiens
ctccctcatcaaggacacgggcc

SEQ ID NO: 2439821 - DNA, 20 bp, Homo sapiens
ctccctcccagagcacctgc

SEQ ID NO: 2439822 - DNA, 21 bp, Homo sapiens
ctccctcccagagcacctgct

SEQ ID NO: 2439823 - DNA, 15 bp, Homo sapiens
ctccctcccctgcca

SEQ ID NO: 2439824 - DNA, 17 bp, Homo sapiens
ctccctccccttgcctg

SEQ ID NO: 2439825 - DNA, 15 bp, Homo sapiens
ctccctccgccccca

SEQ ID NO: 2439826 - DNA, 11 bp, Homo sapiens
ctccctctccg

SEQ ID NO: 2439827 - DNA, 22 bp, Homo sapiens
ctccctgcatggcatcctccag

SEQ ID NO: 2439828 - DNA, 23 bp, Homo sapiens
ctccctgcatggcatcctccagc

SEQ ID NO: 2439829 - DNA, 14 bp, Homo sapiens
ctccctgcctcctg

SEQ ID NO: 2439830 - DNA, 18 bp, Homo sapiens
ctccctggatcagaacag

SEQ ID NO: 2439831 - DNA, 23 bp, Homo sapiens
ctccctggatcagaacaggagct

SEQ ID NO: 2439832 - DNA, 11 bp, Homo sapiens
ctccctggggg

SEQ ID NO: 2439833 - DNA, 22 bp, Homo sapiens
ctccctggtgcttatgctctta

SEQ ID NO: 2439834 - DNA, 18 bp, Homo sapiens
ctccctgtacagtgttac

SEQ ID NO: 2439835 - DNA, 19 bp, Homo sapiens
ctccctgtgcccccagggt

SEQ ID NO: 2439836 - DNA, 16 bp, Homo sapiens
ctccctgttccccaga

SEQ ID NO: 2439837 - DNA, 16 bp, Homo sapiens
ctcccttgggctctga

SEQ ID NO: 2439838 - DNA, 17 bp, Homo sapiens
ctcccttgggctctgat

SEQ ID NO: 2439839 - DNA, 18 bp, Homo sapiens
ctcccttgggctctgatg

SEQ ID NO: 2439840 - DNA, 19 bp, Homo sapiens
ctcccttgggctctgatga

SEQ ID NO: 2439841 - DNA, 15 bp, Homo sapiens
ctccgagaggtgggc

SEQ ID NO: 2439842 - DNA, 22 bp, Homo sapiens
ctccgagaggtgggccagtctg

SEQ ID NO: 2439843 - DNA, 13 bp, Homo sapiens
ctccgccatccac

SEQ ID NO: 2439844 - DNA, 16 bp, Homo sapiens
ctccgcctggcctggc

SEQ ID NO: 2439845 - DNA, 14 bp, Homo sapiens
ctcctagttctaga

SEQ ID NO: 2439846 - DNA, 21 bp, Homo sapiens
ctcctagttcttcatcccact

SEQ ID NO: 2439847 - DNA, 16 bp, Homo sapiens
ctcctatgatctgagt

SEQ ID NO: 2439848 - DNA, 22 bp, Homo sapiens
ctcctatgggttgtcaccaagc

SEQ ID NO: 2439849 - DNA, 18 bp, Homo sapiens
ctcctatgtttggctgct

SEQ ID NO: 2439850 - DNA, 15 bp, Homo sapiens
ctcctcaacccctcc

SEQ ID NO: 2439851 - DNA, 20 bp, Homo sapiens
ctcctcaacccctcccctcc

SEQ ID NO: 2439852 - DNA, 18 bp, Homo sapiens
ctcctcattcacatcgca

SEQ ID NO: 2439853 - DNA, 16 bp, Homo sapiens
ctcctccaggaagcct

SEQ ID NO: 2439854 - DNA, 13 bp, Homo sapiens
ctcctccagggac

SEQ ID NO: 2439855 - DNA, 23 bp, Homo sapiens
cgaagcccagagggtctgggggc

SEQ ID NO: 2439856 - DNA, 22 bp, Homo sapiens
cgaagctaacagggaaggcagg

SEQ ID NO: 2439857 - DNA, 19 bp, Homo sapiens
cgaatacttttgccctttg

SEQ ID NO: 2439858 - DNA, 15 bp, Homo sapiens
cgaatgtgtctttag

SEQ ID NO: 2439859 - DNA, 12 bp, Homo sapiens
cgacaagtgctg

SEQ ID NO: 2439860 - DNA, 16 bp, Homo sapiens
cgacacggtcggggca

SEQ ID NO: 2439861 - DNA, 13 bp, Homo sapiens
cgaccatctgatt

SEQ ID NO: 2439862 - DNA, 19 bp, Homo sapiens
cgactccgttggccactcc

SEQ ID NO: 2439863 - DNA, 16 bp, Homo sapiens
cgtgctctttgttttg

SEQ ID NO: 2439864 - DNA, 17 bp, Homo sapiens
cgtgctctttgttttgt

SEQ ID NO: 2439865 - DNA, 22 bp, Homo sapiens
cgtgctctttgttttgtgtctc

SEQ ID NO: 2439866 - DNA, 20 bp, Homo sapiens
cctctgtccaggcactgaga

SEQ ID NO: 2439867 - DNA, 16 bp, Homo sapiens
cctctgtcttctggac

SEQ ID NO: 2439868 - DNA, 21 bp, Homo sapiens
cctctgtgaccaatgtcttga

SEQ ID NO: 2439869 - DNA, 13 bp, Homo sapiens
cctctgtgctgtg

SEQ ID NO: 2439870 - DNA, 16 bp, Homo sapiens
cctctgttccttccct

SEQ ID NO: 2439871 - DNA, 14 bp, Homo sapiens
cctcttcagaggcc

SEQ ID NO: 2439872 - DNA, 18 bp, Homo sapiens
cctcttcatggatggggg

SEQ ID NO: 2439873 - DNA, 21 bp, Homo sapiens
cctcttctactcacttttccc

SEQ ID NO: 2439874 - DNA, 23 bp, Homo sapiens
cctcttctactcacttttcccac

SEQ ID NO: 2439875 - DNA, 17 bp, Homo sapiens
cctcttctgggagggca

SEQ ID NO: 2439876 - DNA, 19 bp, Homo sapiens
cctcttgagcagtggctgg

SEQ ID NO: 2439877 - DNA, 21 bp, Homo sapiens
cctcttggagaagtctcagct

SEQ ID NO: 2439878 - DNA, 15 bp, Homo sapiens
cctctttcagctcct

SEQ ID NO: 2439879 - DNA, 17 bp, Homo sapiens
cctctttcttcccatga

SEQ ID NO: 2439880 - DNA, 20 bp, Homo sapiens
cctctttggctcccctgtac

SEQ ID NO: 2439881 - DNA, 13 bp, Homo sapiens
cctcttttttcgt

SEQ ID NO: 2439882 - DNA, 21 bp, Homo sapiens
cctgaaaaaaaacctgagatt

SEQ ID NO: 2439883 - DNA, 14 bp, Homo sapiens
cctgaaattccaaa

SEQ ID NO: 2439884 - DNA, 15 bp, Homo sapiens
cctgaaattccaaag

SEQ ID NO: 2439885 - DNA, 16 bp, Homo sapiens
cctgaaattccaaagt

SEQ ID NO: 2439886 - DNA, 20 bp, Homo sapiens
cctgaaggggccatgatggc

SEQ ID NO: 2439887 - DNA, 15 bp, Homo sapiens
ccaagctctgcagtc

SEQ ID NO: 2439888 - DNA, 13 bp, Homo sapiens
ccaagctgaggtg

SEQ ID NO: 2439889 - DNA, 22 bp, Homo sapiens
ccaagctgaggtgcccaggaga

SEQ ID NO: 2439890 - DNA, 17 bp, Homo sapiens
ccaaggaggcagcctgg

SEQ ID NO: 2439891 - DNA, 15 bp, Homo sapiens
ccaaggcagaggcct

SEQ ID NO: 2439892 - DNA, 16 bp, Homo sapiens
ccaaggcagaggcctg

SEQ ID NO: 2439893 - DNA, 18 bp, Homo sapiens
ccaagggaacctgtgtcc

SEQ ID NO: 2439894 - DNA, 19 bp, Homo sapiens
ccaagggaacctgtgtccg

SEQ ID NO: 2439895 - DNA, 21 bp, Homo sapiens
ccaagggctttgttttgcaca

SEQ ID NO: 2439896 - DNA, 19 bp, Homo sapiens
ccaaggggaatcagaactc

SEQ ID NO: 2439897 - DNA, 20 bp, Homo sapiens
ccaaggtttaaagagtctag

SEQ ID NO: 2439898 - DNA, 22 bp, Homo sapiens
ccaaggtttaaagagtctagat

SEQ ID NO: 2439899 - DNA, 16 bp, Homo sapiens
ccaagtccaggtcctg

SEQ ID NO: 2439900 - DNA, 19 bp, Homo sapiens
ccaagtccaggtcctggtg

SEQ ID NO: 2439901 - DNA, 14 bp, Homo sapiens
ccaagtgaggcagc

SEQ ID NO: 2439902 - DNA, 22 bp, Homo sapiens
ccaatcaatcttgcatgtaacg

SEQ ID NO: 2439903 - DNA, 14 bp, Homo sapiens
ccaatcattttaat

SEQ ID NO: 2439904 - DNA, 23 bp, Homo sapiens
ccaatcctatgcatggtttcagc

SEQ ID NO: 2439905 - DNA, 23 bp, Homo sapiens
ccaatgaaaaaatgtatatgcac

SEQ ID NO: 2439906 - DNA, 18 bp, Homo sapiens
ccaatgagctttctgaac

SEQ ID NO: 2439907 - DNA, 18 bp, Homo sapiens
ccaatgcacctaaagaaa

SEQ ID NO: 2439908 - DNA, 15 bp, Homo sapiens
ccaatgtacccaccg

SEQ ID NO: 2439909 - DNA, 14 bp, Homo sapiens
ccaatgtctggaga

SEQ ID NO: 2439910 - DNA, 16 bp, Homo sapiens
ccaatgtctggagacc

SEQ ID NO: 2439911 - DNA, 12 bp, Homo sapiens
ccaatgtcttga

SEQ ID NO: 2439912 - DNA, 22 bp, Homo sapiens
ccaattattttcatccttgtct

SEQ ID NO: 2439913 - DNA, 16 bp, Homo sapiens
ccaattcagacaggca

SEQ ID NO: 2439914 - DNA, 20 bp, Homo sapiens
ccaatttcggattttttcca

SEQ ID NO: 2439915 - DNA, 13 bp, Homo sapiens
ccacaaaaacagg

SEQ ID NO: 2439916 - DNA, 12 bp, Homo sapiens
ccacaagcctct

SEQ ID NO: 2439917 - DNA, 16 bp, Homo sapiens
ccacaagcttctgtcc

SEQ ID NO: 2439918 - DNA, 18 bp, Homo sapiens
ccacaagcttctgtcctg

SEQ ID NO: 2439919 - DNA, 20 bp, Homo sapiens
ccacacagtgctcaaggcca

SEQ ID NO: 2439920 - DNA, 20 bp, Homo sapiens
ccacaccagggccagcctct

SEQ ID NO: 2439921 - DNA, 16 bp, Homo sapiens
ccacacccacactcag

SEQ ID NO: 2439922 - DNA, 23 bp, Homo sapiens
ccacaccctgtactgttctgtgt

SEQ ID NO: 2439923 - DNA, 21 bp, Homo sapiens
ccacactcagatcctcctcat

SEQ ID NO: 2439924 - DNA, 14 bp, Homo sapiens
ccacacttcaaact

SEQ ID NO: 2439925 - DNA, 14 bp, Homo sapiens
ccacacttctcagg

SEQ ID NO: 2439926 - DNA, 21 bp, Homo sapiens
ccacacttctcaggacacagg

SEQ ID NO: 2439927 - DNA, 22 bp, Homo sapiens
ccacacttctcaggacacaggc

SEQ ID NO: 2439928 - DNA, 23 bp, Homo sapiens
ccacacttctcaggacacaggcc

SEQ ID NO: 2439929 - DNA, 18 bp, Homo sapiens
ccacagacggaagggtaa

SEQ ID NO: 2439930 - DNA, 13 bp, Homo sapiens
ccacagaggacac

SEQ ID NO: 2439931 - DNA, 15 bp, Homo sapiens
ccacagccagcacct

SEQ ID NO: 2439932 - DNA, 11 bp, Homo sapiens
ccacagccagg

SEQ ID NO: 2439933 - DNA, 12 bp, Homo sapiens
ccacagccctgt

SEQ ID NO: 2439934 - DNA, 15 bp, Homo sapiens
ccacagccctgtcag

SEQ ID NO: 2439935 - DNA, 16 bp, Homo sapiens
ccacagccctgtcagc

SEQ ID NO: 2439936 - DNA, 15 bp, Homo sapiens
ccacaggctcaggca

SEQ ID NO: 2439937 - DNA, 16 bp, Homo sapiens
ccacaggctcaggcag

SEQ ID NO: 2439938 - DNA, 19 bp, Homo sapiens
ccacaggcttctgagcagc

SEQ ID NO: 2439939 - DNA, 15 bp, Homo sapiens
ccacaggtctagact

SEQ ID NO: 2439940 - DNA, 15 bp, Homo sapiens
ccacataccctgacc

SEQ ID NO: 2439941 - DNA, 14 bp, Homo sapiens
ccacatcaaagagg

SEQ ID NO: 2439942 - DNA, 16 bp, Homo sapiens
ccacatcccatcgtct

SEQ ID NO: 2439943 - DNA, 18 bp, Homo sapiens
ccacatccctgggcctgc

SEQ ID NO: 2439944 - DNA, 23 bp, Homo sapiens
ccacatccctgggcctgctgctg

SEQ ID NO: 2439945 - DNA, 14 bp, Homo sapiens
ccacatgccccatc

SEQ ID NO: 2439946 - DNA, 20 bp, Homo sapiens
ccacattaaagaagacctga

SEQ ID NO: 2439947 - DNA, 14 bp, Homo sapiens
ccacattggaagag

SEQ ID NO: 2439948 - DNA, 13 bp, Homo sapiens
ccacatttggaat

SEQ ID NO: 2439949 - DNA, 15 bp, Homo sapiens
ccaccaaaactgctc

SEQ ID NO: 2439950 - DNA, 13 bp, Homo sapiens
ccaccaaccctca

SEQ ID NO: 2439951 - DNA, 18 bp, Homo sapiens
ccaccaaccctcagggca

SEQ ID NO: 2439952 - DNA, 17 bp, Homo sapiens
ccaccaagagggacgcc

SEQ ID NO: 2439953 - DNA, 21 bp, Homo sapiens
ccaccaagagggacgcctggg

SEQ ID NO: 2439954 - DNA, 20 bp, Homo sapiens
ccaccacagccagcacctgg

SEQ ID NO: 2439955 - DNA, 13 bp, Homo sapiens
ccaccagatgctg

SEQ ID NO: 2439956 - DNA, 15 bp, Homo sapiens
ccaccagctgtgtcc

SEQ ID NO: 2439957 - DNA, 16 bp, Homo sapiens
ccaccagctgtgtcca

SEQ ID NO: 2439958 - DNA, 20 bp, Homo sapiens
ccaccagggcatctctgggc

SEQ ID NO: 2439959 - DNA, 17 bp, Homo sapiens
ccacccagaggcagcag

SEQ ID NO: 2439960 - DNA, 12 bp, Homo sapiens
ccacccaggcca

SEQ ID NO: 2439961 - DNA, 17 bp, Homo sapiens
ccacccaggggcagccc

SEQ ID NO: 2439962 - DNA, 16 bp, Homo sapiens
ccaccccaacctgctc

SEQ ID NO: 2439963 - DNA, 22 bp, Homo sapiens
ccaccccaacctgctctcctct

SEQ ID NO: 2439964 - DNA, 18 bp, Homo sapiens
ccaccccagggcagccag

SEQ ID NO: 2439965 - DNA, 16 bp, Homo sapiens
ccaccccattcccgca

SEQ ID NO: 2439966 - DNA, 23 bp, Homo sapiens
ccacccctttctagaccaataaa

SEQ ID NO: 2439967 - DNA, 14 bp, Homo sapiens
ccaccctcactggc

SEQ ID NO: 2439968 - DNA, 17 bp, Homo sapiens
ccaccctcactggctct

SEQ ID NO: 2439969 - DNA, 20 bp, Homo sapiens
ccaccctcggggatgtgtcc

SEQ ID NO: 2439970 - DNA, 15 bp, Homo sapiens
ccaccctgaggagtc

SEQ ID NO: 2439971 - DNA, 21 bp, Homo sapiens
ccaccctgagttgcttttcag

SEQ ID NO: 2439972 - DNA, 20 bp, Homo sapiens
ccaccctggccgagtccaag

SEQ ID NO: 2439973 - DNA, 22 bp, Homo sapiens
ccaccctggccgagtccaagct

SEQ ID NO: 2439974 - DNA, 12 bp, Homo sapiens
ccaccctgggcc

SEQ ID NO: 2439975 - DNA, 15 bp, Homo sapiens
ccaccctgggccctg

SEQ ID NO: 2439976 - DNA, 17 bp, Homo sapiens
ccaccctgttcctgctg

SEQ ID NO: 2439977 - DNA, 13 bp, Homo sapiens
ccaccgggccact

SEQ ID NO: 2439978 - DNA, 19 bp, Homo sapiens
ccaccgggccactccttcc

SEQ ID NO: 2439979 - DNA, 21 bp, Homo sapiens
ccaccgggccactccttcctg

SEQ ID NO: 2439980 - DNA, 19 bp, Homo sapiens
ccaccgttgtctcatgcca

SEQ ID NO: 2439981 - DNA, 14 bp, Homo sapiens
ccaccgtttcttcc

SEQ ID NO: 2439982 - DNA, 21 bp, Homo sapiens
ccaccgtttcttcctgccagc

SEQ ID NO: 2439983 - DNA, 14 bp, Homo sapiens
ccacctagcagcac

SEQ ID NO: 2439984 - DNA, 16 bp, Homo sapiens
ccacctccccccacaa

SEQ ID NO: 2439985 - DNA, 19 bp, Homo sapiens
ccacctcctgacacccttc

SEQ ID NO: 2439986 - DNA, 17 bp, Homo sapiens
ccacctctgctgcctcc

SEQ ID NO: 2439987 - DNA, 16 bp, Homo sapiens
ccacctgacacaccag

SEQ ID NO: 2439988 - DNA, 20 bp, Homo sapiens
ccacctgacacaccaggcgc

SEQ ID NO: 2439989 - DNA, 22 bp, Homo sapiens
ccacctgctagtgtgaattaaa

SEQ ID NO: 2439990 - DNA, 21 bp, Homo sapiens
ccacctggacccctgcattgg

SEQ ID NO: 2439991 - DNA, 20 bp, Homo sapiens
ccattaaagaatatgaaaca

SEQ ID NO: 2439992 - DNA, 17 bp, Homo sapiens
ccattaatcagttcatt

SEQ ID NO: 2439993 - DNA, 13 bp, Homo sapiens
ccattccttccca

SEQ ID NO: 2439994 - DNA, 12 bp, Homo sapiens
ccattctgactc

SEQ ID NO: 2439995 - DNA, 20 bp, Homo sapiens
ccattctgactcggtttctc

SEQ ID NO: 2439996 - DNA, 11 bp, Homo sapiens
ccattgaaggc

SEQ ID NO: 2439997 - DNA, 19 bp, Homo sapiens
ccattgtagcgtctttctt

SEQ ID NO: 2439998 - DNA, 19 bp, Homo sapiens
ccattgtccaatcctatgt

SEQ ID NO: 2439999 - DNA, 20 bp, Homo sapiens
ccattgtggcctaagaggct

SEQ ID NO: 2440000 - DNA, 20 bp, Homo sapiens
ccatttacatgttttaaaga

SEQ ID NO: 2440001 - DNA, 11 bp, Homo sapiens
ccatttctaat

SEQ ID NO: 2440002 - DNA, 23 bp, Homo sapiens
ccatttctaattatgtagctctt

SEQ ID NO: 2440003 - DNA, 22 bp, Homo sapiens
ccattttaaagttagtatcttt

SEQ ID NO: 2440004 - DNA, 18 bp, Homo sapiens
ccattttgttattgacta

SEQ ID NO: 2440005 - DNA, 16 bp, Homo sapiens
cccaaacaccttccag

SEQ ID NO: 2440006 - DNA, 19 bp, Homo sapiens
cccaaacaccttccagctc

SEQ ID NO: 2440007 - DNA, 16 bp, Homo sapiens
cccaaacgccctttcc

SEQ ID NO: 2440008 - DNA, 21 bp, Homo sapiens
cccaaagcaagcaagaggccg

SEQ ID NO: 2440009 - DNA, 14 bp, Homo sapiens
cccaaagctttcct

SEQ ID NO: 2440010 - DNA, 16 bp, Homo sapiens
cccaaagctttcctgc

SEQ ID NO: 2440011 - DNA, 15 bp, Homo sapiens
cccaaaggacgcact

SEQ ID NO: 2440012 - DNA, 20 bp, Homo sapiens
cccaaagtgctgagattaca

SEQ ID NO: 2440013 - DNA, 23 bp, Homo sapiens
cccaacccgtggaggctgctcgg

SEQ ID NO: 2440014 - DNA, 13 bp, Homo sapiens
cccaacctgctct

SEQ ID NO: 2440015 - DNA, 14 bp, Homo sapiens
cccaacctgctctc

SEQ ID NO: 2440016 - DNA, 17 bp, Homo sapiens
cccaacctgctctcctc

SEQ ID NO: 2440017 - DNA, 19 bp, Homo sapiens
cccaacctgctctcctctt

SEQ ID NO: 2440018 - DNA, 21 bp, Homo sapiens
cccaacctgctctcctcttct

SEQ ID NO: 2440019 - DNA, 23 bp, Homo sapiens
cccaactacccccagctgtgctt

SEQ ID NO: 2440020 - DNA, 15 bp, Homo sapiens
cccaactccttccag

SEQ ID NO: 2440021 - DNA, 18 bp, Homo sapiens
cccaactccttccagcta

SEQ ID NO: 2440022 - DNA, 15 bp, Homo sapiens
cccaactctcccctg

SEQ ID NO: 2440023 - DNA, 21 bp, Homo sapiens
cccaagagcatcatgcctctg

SEQ ID NO: 2440024 - DNA, 23 bp, Homo sapiens
cccaagagctacgtatttaatag

SEQ ID NO: 2440025 - DNA, 22 bp, Homo sapiens
cccaagatgggcatcttttgta

SEQ ID NO: 2440026 - DNA, 14 bp, Homo sapiens
cccaagtgaggcag

SEQ ID NO: 2440027 - DNA, 19 bp, Homo sapiens
cccaagttcatgcagctgt

SEQ ID NO: 2440028 - DNA, 17 bp, Homo sapiens
cccaatcctcccagaaa

SEQ ID NO: 2440029 - DNA, 15 bp, Homo sapiens
cccaatttcagactc

SEQ ID NO: 2440030 - DNA, 15 bp, Homo sapiens
cccacaagcctgagg

SEQ ID NO: 2440031 - DNA, 22 bp, Homo sapiens
cccacactcagatcctcctcat

SEQ ID NO: 2440032 - DNA, 15 bp, Homo sapiens
cccacatccctgggc

SEQ ID NO: 2440033 - DNA, 23 bp, Homo sapiens
cccacatccctgggcctgctgct

SEQ ID NO: 2440034 - DNA, 17 bp, Homo sapiens
cccaccaaccctcaggg

SEQ ID NO: 2440035 - DNA, 18 bp, Homo sapiens
cccaccaaccctcagggc

SEQ ID NO: 2440036 - DNA, 16 bp, Homo sapiens
cccaccagatgctgaa

SEQ ID NO: 2440037 - DNA, 20 bp, Homo sapiens
cccaccatttggcatccctg

SEQ ID NO: 2440038 - DNA, 23 bp, Homo sapiens
cccacccagatgcccctttctgg

SEQ ID NO: 2440039 - DNA, 15 bp, Homo sapiens
cccacccaggccagg

SEQ ID NO: 2440040 - DNA, 18 bp, Homo sapiens
cccaccccaacctgctct

SEQ ID NO: 2440041 - DNA, 13 bp, Homo sapiens
cccaccccattcc

SEQ ID NO: 2440042 - DNA, 13 bp, Homo sapiens
cccacccccaagg

SEQ ID NO: 2440043 - DNA, 13 bp, Homo sapiens
cccacccccagct

SEQ ID NO: 2440044 - DNA, 12 bp, Homo sapiens
cccacccctgca

SEQ ID NO: 2440045 - DNA, 21 bp, Homo sapiens
cccaccctcggggatgtgtcc

SEQ ID NO: 2440046 - DNA, 13 bp, Homo sapiens
cccaccctcttcc

SEQ ID NO: 2440047 - DNA, 16 bp, Homo sapiens
cccaccctgttcctgc

SEQ ID NO: 2440048 - DNA, 18 bp, Homo sapiens
cccaccctgttcctgctg

SEQ ID NO: 2440049 - DNA, 17 bp, Homo sapiens
cccaccgggccactcct

SEQ ID NO: 2440050 - DNA, 15 bp, Homo sapiens
cccaccgtgggcagg

SEQ ID NO: 2440051 - DNA, 18 bp, Homo sapiens
cccacctcagcctcccaa

SEQ ID NO: 2440052 - DNA, 15 bp, Homo sapiens
cattgtaaaagcatt

SEQ ID NO: 2440053 - DNA, 15 bp, Homo sapiens
cattgtaaaataatt

SEQ ID NO: 2440054 - DNA, 16 bp, Homo sapiens
cattgtaaaataattc

SEQ ID NO: 2440055 - DNA, 19 bp, Homo sapiens
cattgtagcgtctttcttt

SEQ ID NO: 2440056 - DNA, 24 bp, Homo sapiens
cattgtagtgctttgagagagaaa

SEQ ID NO: 2440057 - DNA, 19 bp, Homo sapiens
cattgtccaatcctatgtt

SEQ ID NO: 2440058 - DNA, 14 bp, Homo sapiens
cattgtctttttag

SEQ ID NO: 2440059 - DNA, 18 bp, Homo sapiens
cattgtgattggcctgta

SEQ ID NO: 2440060 - DNA, 20 bp, Homo sapiens
cattgttgagctattgctgt

SEQ ID NO: 2440061 - DNA, 16 bp, Homo sapiens
catttacatgttttaa

SEQ ID NO: 2440062 - DNA, 15 bp, Homo sapiens
catttagtcatgtga

SEQ ID NO: 2440063 - DNA, 17 bp, Homo sapiens
catttagtcatgtgacc

SEQ ID NO: 2440064 - DNA, 17 bp, Homo sapiens
catttagtttgattatt

SEQ ID NO: 2440065 - DNA, 21 bp, Homo sapiens
catttatattgataagatctt

SEQ ID NO: 2440066 - DNA, 15 bp, Homo sapiens
catttcaactgtttg

SEQ ID NO: 2440067 - DNA, 19 bp, Homo sapiens
catttcacttgtcaggagt

SEQ ID NO: 2440068 - DNA, 21 bp, Homo sapiens
catttcagaagttagtttgta

SEQ ID NO: 2440069 - DNA, 12 bp, Homo sapiens
catttctaaaat

SEQ ID NO: 2440070 - DNA, 12 bp, Homo sapiens
catttctattaa

SEQ ID NO: 2440071 - DNA, 13 bp, Homo sapiens
catttctcaggct

SEQ ID NO: 2440072 - DNA, 19 bp, Homo sapiens
catttctcaggctaggcca

SEQ ID NO: 2440073 - DNA, 23 bp, Homo sapiens
catttcttctacaactcatacac

SEQ ID NO: 2440074 - DNA, 19 bp, Homo sapiens
catttgacccttgctgtga

SEQ ID NO: 2440075 - DNA, 20 bp, Homo sapiens
catttgcagggtcctcttct

SEQ ID NO: 2440076 - DNA, 14 bp, Homo sapiens
catttgcatttgtt

SEQ ID NO: 2440077 - DNA, 15 bp, Homo sapiens
catttgctgttttaa

SEQ ID NO: 2440078 - DNA, 19 bp, Homo sapiens
catttgctttttgtgatat

SEQ ID NO: 2440079 - DNA, 23 bp, Homo sapiens
catttggagtgttccccttccac

SEQ ID NO: 2440080 - DNA, 20 bp, Homo sapiens
catttggcaatgccatcatc

SEQ ID NO: 2440081 - DNA, 16 bp, Homo sapiens
catttggcatccctgg

SEQ ID NO: 2440082 - DNA, 17 bp, Homo sapiens
catttgggtccaggagg

SEQ ID NO: 2440083 - DNA, 20 bp, Homo sapiens
catttggttcattaattcta

SEQ ID NO: 2440084 - DNA, 19 bp, Homo sapiens
catttgtgtacacagtcag

SEQ ID NO: 2440085 - DNA, 20 bp, Homo sapiens
catttgtttatgtaatttca

SEQ ID NO: 2440086 - DNA, 20 bp, Homo sapiens
cattttggagagtttcctga

SEQ ID NO: 2440087 - DNA, 22 bp, Homo sapiens
cattttggagagtttcctgaaa

SEQ ID NO: 2440088 - DNA, 14 bp, Homo sapiens
cattttttaggaaa

SEQ ID NO: 2440089 - DNA, 21 bp, Homo sapiens
cattttttttctttgaataaa

SEQ ID NO: 2440090 - DNA, 22 bp, Homo sapiens
cattttttttctttgaataaat

SEQ ID NO: 2440091 - DNA, 23 bp, Homo sapiens
cattttttttctttgaataaatg

SEQ ID NO: 2440092 - DNA, 22 bp, Homo sapiens
catttttttttcaatcaacttt

SEQ ID NO: 2440093 - DNA, 19 bp, Homo sapiens
ccaaaaaaaaatacatgct

SEQ ID NO: 2440094 - DNA, 16 bp, Homo sapiens
ccaaaaataaatatat

SEQ ID NO: 2440095 - DNA, 14 bp, Homo sapiens
ccaaaacaatgttt

SEQ ID NO: 2440096 - DNA, 18 bp, Homo sapiens
ccctctacagagcttccc

SEQ ID NO: 2440097 - DNA, 12 bp, Homo sapiens
ccctctcagccc

SEQ ID NO: 2440098 - DNA, 18 bp, Homo sapiens
ccctctcccaccctcttc

SEQ ID NO: 2440099 - DNA, 22 bp, Homo sapiens
ccctctccccagggaagcagca

SEQ ID NO: 2440100 - DNA, 11 bp, Homo sapiens
ccctctccctg

SEQ ID NO: 2440101 - DNA, 14 bp, Homo sapiens
ccctctccctgcat

SEQ ID NO: 2440102 - DNA, 16 bp, Homo sapiens
ccctctccctgcatgg

SEQ ID NO: 2440103 - DNA, 17 bp, Homo sapiens
ccctctccctgcatggc

SEQ ID NO: 2440104 - DNA, 14 bp, Homo sapiens
ccctctccttcctg

SEQ ID NO: 2440105 - DNA, 14 bp, Homo sapiens
ccctctctggagaa

SEQ ID NO: 2440106 - DNA, 13 bp, Homo sapiens
ccctctgaaatac

SEQ ID NO: 2440107 - DNA, 17 bp, Homo sapiens
ccctctgacctgcactg

SEQ ID NO: 2440108 - DNA, 11 bp, Homo sapiens
ccctctgggct

SEQ ID NO: 2440109 - DNA, 19 bp, Homo sapiens
ccctctggtcgctcctgcc

SEQ ID NO: 2440110 - DNA, 20 bp, Homo sapiens
ccctctggtcgctcctgccc

SEQ ID NO: 2440111 - DNA, 22 bp, Homo sapiens
ccctcttcctactggtctctct

SEQ ID NO: 2440112 - DNA, 15 bp, Homo sapiens
ccctcttggagaagt

SEQ ID NO: 2440113 - DNA, 21 bp, Homo sapiens
ccctctttggctcccctgtac

SEQ ID NO: 2440114 - DNA, 19 bp, Homo sapiens
ccctgaccactcagagaca

SEQ ID NO: 2440115 - DNA, 16 bp, Homo sapiens
ccctgacctgtgagcc

SEQ ID NO: 2440116 - DNA, 15 bp, Homo sapiens
ccctgactcattctg

SEQ ID NO: 2440117 - DNA, 21 bp, Homo sapiens
ccctgagccagggtctccaga

SEQ ID NO: 2440118 - DNA, 14 bp, Homo sapiens
ccctgagctgaggc

SEQ ID NO: 2440119 - DNA, 16 bp, Homo sapiens
ccctgagctgaggcag

SEQ ID NO: 2440120 - DNA, 17 bp, Homo sapiens
ccctgagctgaggcagc

SEQ ID NO: 2440121 - DNA, 18 bp, Homo sapiens
ccctgaggagtctgaggt

SEQ ID NO: 2440122 - DNA, 21 bp, Homo sapiens
ccctgaggagtctgaggtcct

SEQ ID NO: 2440123 - DNA, 22 bp, Homo sapiens
ccctgagttggagctcattctg

SEQ ID NO: 2440124 - DNA, 23 bp, Homo sapiens
ccctgatttaggagaagccagga

SEQ ID NO: 2440125 - DNA, 20 bp, Homo sapiens
ccctgcaaaaggactctcag

SEQ ID NO: 2440126 - DNA, 20 bp, Homo sapiens
ccctgcacagtgacttctga

SEQ ID NO: 2440127 - DNA, 13 bp, Homo sapiens
ccctgcacagttg

SEQ ID NO: 2440128 - DNA, 23 bp, Homo sapiens
ccctgcaccatgctgctggggaa

SEQ ID NO: 2440129 - DNA, 13 bp, Homo sapiens
ccctgcagaccct

SEQ ID NO: 2440130 - DNA, 17 bp, Homo sapiens
ccctgcagaccctgccc

SEQ ID NO: 2440131 - DNA, 21 bp, Homo sapiens
ccctgcagcttgtagccagcc

SEQ ID NO: 2440132 - DNA, 14 bp, Homo sapiens
ccctgccaccaggc

SEQ ID NO: 2440133 - DNA, 13 bp, Homo sapiens
ccctgccactcac

SEQ ID NO: 2440134 - DNA, 19 bp, Homo sapiens
ccctgccactcactaggcc

SEQ ID NO: 2440135 - DNA, 13 bp, Homo sapiens
ccctgcccatgct

SEQ ID NO: 2440136 - DNA, 14 bp, Homo sapiens
ccctgccccctgca

SEQ ID NO: 2440137 - DNA, 15 bp, Homo sapiens
ccctgccccctgcag

SEQ ID NO: 2440138 - DNA, 18 bp, Homo sapiens
ccctgccccctgcaggaa

SEQ ID NO: 2440139 - DNA, 19 bp, Homo sapiens
ccctgcccctcctctccct

SEQ ID NO: 2440140 - DNA, 14 bp, Homo sapiens
ccctgcctctccca

SEQ ID NO: 2440141 - DNA, 15 bp, Homo sapiens
ccctgcctctcccag

SEQ ID NO: 2440142 - DNA, 10 bp, Homo sapiens
ccctgcctgg

SEQ ID NO: 2440143 - DNA, 11 bp, Homo sapiens
ccctgcctgga

SEQ ID NO: 2440144 - DNA, 15 bp, Homo sapiens
ccctgcctggaggac

SEQ ID NO: 2440145 - DNA, 17 bp, Homo sapiens
ccctgcctggaggacct

SEQ ID NO: 2440146 - DNA, 22 bp, Homo sapiens
ccctgcctggaggacctgagcc

SEQ ID NO: 2440147 - DNA, 24 bp, Homo sapiens
ccctgcctggaggacctgagcctg

SEQ ID NO: 2440148 - DNA, 17 bp, Homo sapiens
ccctgcggtagatggga

SEQ ID NO: 2440149 - DNA, 16 bp, Homo sapiens
ccctgcttcctgcttg

SEQ ID NO: 2440150 - DNA, 17 bp, Homo sapiens
ccctgctttgggcttgg

SEQ ID NO: 2440151 - DNA, 18 bp, Homo sapiens
ccctggacccagccagaa

SEQ ID NO: 2440152 - DNA, 15 bp, Homo sapiens
ccctggaggcacctg

SEQ ID NO: 2440153 - DNA, 16 bp, Homo sapiens
ccctggatcagcgtgg

SEQ ID NO: 2440154 - DNA, 19 bp, Homo sapiens
ccctggatcagcgtggcct

SEQ ID NO: 2440155 - DNA, 12 bp, Homo sapiens
ccctggcagaga

SEQ ID NO: 2440156 - DNA, 20 bp, Homo sapiens
ccctggcatgtcaacagcgt

SEQ ID NO: 2440157 - DNA, 14 bp, Homo sapiens
ccctggccccagga

SEQ ID NO: 2440158 - DNA, 11 bp, Homo sapiens
ccctggcccct

SEQ ID NO: 2440159 - DNA, 18 bp, Homo sapiens
ccctggcccctctccctt

SEQ ID NO: 2440160 - DNA, 16 bp, Homo sapiens
ccctggcctagaccag

SEQ ID NO: 2440161 - DNA, 20 bp, Homo sapiens
ccctggcctcccctgccacc

SEQ ID NO: 2440162 - DNA, 10 bp, Homo sapiens
ccctggcttt

SEQ ID NO: 2440163 - DNA, 18 bp, Homo sapiens
ccctgggagggacatgct

SEQ ID NO: 2440164 - DNA, 17 bp, Homo sapiens
ccctgggattcaggaaa

SEQ ID NO: 2440165 - DNA, 13 bp, Homo sapiens
ccctgggccctgg

SEQ ID NO: 2440166 - DNA, 13 bp, Homo sapiens
ccctgggcctgcc

SEQ ID NO: 2440167 - DNA, 13 bp, Homo sapiens
ccctgggcctgct

SEQ ID NO: 2440168 - DNA, 14 bp, Homo sapiens
ccctgggcctgctg

SEQ ID NO: 2440169 - DNA, 15 bp, Homo sapiens
ccctgggcctgctgc

SEQ ID NO: 2440170 - DNA, 16 bp, Homo sapiens
ccctgggcctgctgct

SEQ ID NO: 2440171 - DNA, 19 bp, Homo sapiens
ccctgggcctgctgctgag

SEQ ID NO: 2440172 - DNA, 20 bp, Homo sapiens
ccctgggcctgctgctgaga

SEQ ID NO: 2440173 - DNA, 18 bp, Homo sapiens
ccctgggccttgggctcc

SEQ ID NO: 2440174 - DNA, 14 bp, Homo sapiens
ccctgggctggaat

SEQ ID NO: 2440175 - DNA, 18 bp, Homo sapiens
ccctggggcctgtactgc

SEQ ID NO: 2440176 - DNA, 17 bp, Homo sapiens
ccctggggtggccacca

SEQ ID NO: 2440177 - DNA, 23 bp, Homo sapiens
ccctgggtagcgggggagggtag

SEQ ID NO: 2440178 - DNA, 16 bp, Homo sapiens
ccctggtaatagctgt

SEQ ID NO: 2440179 - DNA, 21 bp, Homo sapiens
ccctggtcccctccttcccaa

SEQ ID NO: 2440180 - DNA, 14 bp, Homo sapiens
ccctggtcccttgt

SEQ ID NO: 2440181 - DNA, 21 bp, Homo sapiens
ccctggtggccctctcccctg

SEQ ID NO: 2440182 - DNA, 16 bp, Homo sapiens
ccctggtgggccaaca

SEQ ID NO: 2440183 - DNA, 13 bp, Homo sapiens
ccctgtacagtgt

SEQ ID NO: 2440184 - DNA, 15 bp, Homo sapiens
ccctgtcagcatgaa

SEQ ID NO: 2440185 - DNA, 18 bp, Homo sapiens
ccctgtcagcatgaattt

SEQ ID NO: 2440186 - DNA, 12 bp, Homo sapiens
ccctgtgccccc

SEQ ID NO: 2440187 - DNA, 13 bp, Homo sapiens
ccctgtgccccca

SEQ ID NO: 2440188 - DNA, 19 bp, Homo sapiens
ccctgtgcccccagggtcc

SEQ ID NO: 2440189 - DNA, 21 bp, Homo sapiens
ccctgtgttgtctctagagca

SEQ ID NO: 2440190 - DNA, 17 bp, Homo sapiens
ccctgttccccagagaa

SEQ ID NO: 2440191 - DNA, 15 bp, Homo sapiens
ccctgttcctgctgc

SEQ ID NO: 2440192 - DNA, 16 bp, Homo sapiens
ccctgtttcagaggct

SEQ ID NO: 2440193 - DNA, 19 bp, Homo sapiens
ccctgtttcagaggctcag

SEQ ID NO: 2440194 - DNA, 21 bp, Homo sapiens
cccttagacagaggccctcaa

SEQ ID NO: 2440195 - DNA, 21 bp, Homo sapiens
cccttatcctccctgtaactt

SEQ ID NO: 2440196 - DNA, 17 bp, Homo sapiens
cccttatgactgccaag

SEQ ID NO: 2440197 - DNA, 19 bp, Homo sapiens
cccttcagtaccctctcag

SEQ ID NO: 2440198 - DNA, 21 bp, Homo sapiens
cccttcagtaccctctcagct

SEQ ID NO: 2440199 - DNA, 16 bp, Homo sapiens
cccttccgccactggg

SEQ ID NO: 2440200 - DNA, 13 bp, Homo sapiens
cccttcctggaca

SEQ ID NO: 2440201 - DNA, 14 bp, Homo sapiens
cccttcctggacag

SEQ ID NO: 2440202 - DNA, 16 bp, Homo sapiens
cctaatccccttctcc

SEQ ID NO: 2440203 - DNA, 17 bp, Homo sapiens
cctacagaaaaaccttg

SEQ ID NO: 2440204 - DNA, 19 bp, Homo sapiens
cctacagggggtctggctg

SEQ ID NO: 2440205 - DNA, 20 bp, Homo sapiens
cctaccccgcagacaccttg

SEQ ID NO: 2440206 - DNA, 13 bp, Homo sapiens
cctacctgcccca

SEQ ID NO: 2440207 - DNA, 15 bp, Homo sapiens
cctactcacacaggc

SEQ ID NO: 2440208 - DNA, 23 bp, Homo sapiens
cctactcacacaggcatttcctg

SEQ ID NO: 2440209 - DNA, 19 bp, Homo sapiens
cctactgttctaaagctct

SEQ ID NO: 2440210 - DNA, 22 bp, Homo sapiens
cctactgttctaaagctctgac

SEQ ID NO: 2440211 - DNA, 16 bp, Homo sapiens
cctagaaacaacactg

SEQ ID NO: 2440212 - DNA, 19 bp, Homo sapiens
cctagaaacaacactgtag

SEQ ID NO: 2440213 - DNA, 21 bp, Homo sapiens
cctagatgtataactaggagc

SEQ ID NO: 2440214 - DNA, 15 bp, Homo sapiens
cctagcacagatggc

SEQ ID NO: 2440215 - DNA, 23 bp, Homo sapiens
cctagcagcaccgttctgtgcac

SEQ ID NO: 2440216 - DNA, 20 bp, Homo sapiens
cctagcgggatggggctccc

SEQ ID NO: 2440217 - DNA, 19 bp, Homo sapiens
cctagctgtcctttttcct

SEQ ID NO: 2440218 - DNA, 22 bp, Homo sapiens
cctagctgtcctttttcctctc

SEQ ID NO: 2440219 - DNA, 15 bp, Homo sapiens
cctaggagggtcctc

SEQ ID NO: 2440220 - DNA, 11 bp, Homo sapiens
cctaggctgca

SEQ ID NO: 2440221 - DNA, 23 bp, Homo sapiens
cctagggaggcatggtctgccct

SEQ ID NO: 2440222 - DNA, 17 bp, Homo sapiens
cctaggtgttttgttca

SEQ ID NO: 2440223 - DNA, 20 bp, Homo sapiens
cctaggttttggagagtttg

SEQ ID NO: 2440224 - DNA, 18 bp, Homo sapiens
cctagtgaaggcttctct

SEQ ID NO: 2440225 - DNA, 19 bp, Homo sapiens
cctagtgaaggcttctctc

SEQ ID NO: 2440226 - DNA, 23 bp, Homo sapiens
cctagtgaaggcttctctctgtg

SEQ ID NO: 2440227 - DNA, 15 bp, Homo sapiens
cctagttctagaaaa

SEQ ID NO: 2440228 - DNA, 16 bp, Homo sapiens
cctataagaagcctta

SEQ ID NO: 2440229 - DNA, 13 bp, Homo sapiens
cctatactgcttg

SEQ ID NO: 2440230 - DNA, 22 bp, Homo sapiens
gctcctcaacccctcccctcca

SEQ ID NO: 2440231 - DNA, 18 bp, Homo sapiens
gctcctcagggactcagg

SEQ ID NO: 2440232 - DNA, 19 bp, Homo sapiens
gctcctcagggactcaggt

SEQ ID NO: 2440233 - DNA, 11 bp, Homo sapiens
gctcctcccac

SEQ ID NO: 2440234 - DNA, 15 bp, Homo sapiens
gctcctcccctggag

SEQ ID NO: 2440235 - DNA, 21 bp, Homo sapiens
gctcctctccccagcccagag

SEQ ID NO: 2440236 - DNA, 22 bp, Homo sapiens
gctcctctgtctcgagcgccct

SEQ ID NO: 2440237 - DNA, 16 bp, Homo sapiens
gctcctcttccccaga

SEQ ID NO: 2440238 - DNA, 18 bp, Homo sapiens
gctcctgacactgctgga

SEQ ID NO: 2440239 - DNA, 15 bp, Homo sapiens
gctcctgaccagttg

SEQ ID NO: 2440240 - DNA, 22 bp, Homo sapiens
gctcctgctaacggtgctcagg

SEQ ID NO: 2440241 - DNA, 16 bp, Homo sapiens
gctcctggcccagcct

SEQ ID NO: 2440242 - DNA, 19 bp, Homo sapiens
gctcctggcccagcctttg

SEQ ID NO: 2440243 - DNA, 19 bp, Homo sapiens
gctcctgtcccctgctaca

SEQ ID NO: 2440244 - DNA, 21 bp, Homo sapiens
gctcctgtggccccaccctgg

SEQ ID NO: 2440245 - DNA, 14 bp, Homo sapiens
gctccttcctggag

SEQ ID NO: 2440246 - DNA, 23 bp, Homo sapiens
gctccttcctggagactgcccag

SEQ ID NO: 2440247 - DNA, 17 bp, Homo sapiens
gctccttgggccctttg

SEQ ID NO: 2440248 - DNA, 19 bp, Homo sapiens
gctccttgggccctttgag

SEQ ID NO: 2440249 - DNA, 16 bp, Homo sapiens
gctccttgtgggcctg

SEQ ID NO: 2440250 - DNA, 17 bp, Homo sapiens
gctccttgtgggcctgg

SEQ ID NO: 2440251 - DNA, 21 bp, Homo sapiens
gctccttgtgggcctgggctc

SEQ ID NO: 2440252 - DNA, 15 bp, Homo sapiens
gctcgaatctctgtg

SEQ ID NO: 2440253 - DNA, 17 bp, Homo sapiens
gctcggcctgcccccac

SEQ ID NO: 2440254 - DNA, 19 bp, Homo sapiens
gctcggggtgcacaggagg

SEQ ID NO: 2440255 - DNA, 22 bp, Homo sapiens
gctcgtggactgagtgggaagc

SEQ ID NO: 2440256 - DNA, 16 bp, Homo sapiens
gctctaacgcctgagc

SEQ ID NO: 2440257 - DNA, 12 bp, Homo sapiens
gctctaatacat

SEQ ID NO: 2440258 - DNA, 15 bp, Homo sapiens
gctctaattcacagt

SEQ ID NO: 2440259 - DNA, 19 bp, Homo sapiens
gctctaattcacagtgctc

SEQ ID NO: 2440260 - DNA, 18 bp, Homo sapiens
gctctacatcttctgcct

SEQ ID NO: 2440261 - DNA, 16 bp, Homo sapiens
gctctacttccccatg

SEQ ID NO: 2440262 - DNA, 19 bp, Homo sapiens
gctctaggtacgatgacag

SEQ ID NO: 2440263 - DNA, 14 bp, Homo sapiens
gctctatgagtcta

SEQ ID NO: 2440264 - DNA, 18 bp, Homo sapiens
gctctattatgaatgtga

SEQ ID NO: 2440265 - DNA, 22 bp, Homo sapiens
gctctattatgaatgtgaagcc

SEQ ID NO: 2440266 - DNA, 12 bp, Homo sapiens
gctctcagttct

SEQ ID NO: 2440267 - DNA, 12 bp, Homo sapiens
gctctccattct

SEQ ID NO: 2440268 - DNA, 19 bp, Homo sapiens
gctctccattctgctcctt

SEQ ID NO: 2440269 - DNA, 20 bp, Homo sapiens
gctctccattctgctccttc

SEQ ID NO: 2440270 - DNA, 23 bp, Homo sapiens
gctctcctcttctactcactttt

SEQ ID NO: 2440271 - DNA, 12 bp, Homo sapiens
gctctcctggct

SEQ ID NO: 2440272 - DNA, 13 bp, Homo sapiens
gctctcctggctt

SEQ ID NO: 2440273 - DNA, 23 bp, Homo sapiens
gctctcctggcttcccatcccca

SEQ ID NO: 2440274 - DNA, 15 bp, Homo sapiens
gctctctttctgtct

SEQ ID NO: 2440275 - DNA, 11 bp, Homo sapiens
gctctgagaac

SEQ ID NO: 2440276 - DNA, 18 bp, Homo sapiens
gctctgagaggccctgga

SEQ ID NO: 2440277 - DNA, 21 bp, Homo sapiens
gctctgagagtctagattctc

SEQ ID NO: 2440278 - DNA, 18 bp, Homo sapiens
gctctgagcgcctccatc

SEQ ID NO: 2440279 - DNA, 13 bp, Homo sapiens
gctctgagggaaa

SEQ ID NO: 2440280 - DNA, 17 bp, Homo sapiens
gctctgagggaaagggc

SEQ ID NO: 2440281 - DNA, 22 bp, Homo sapiens
gctctgatccctctacagagct

SEQ ID NO: 2440282 - DNA, 23 bp, Homo sapiens
gctctgatgaaaaattgctgact

SEQ ID NO: 2440283 - DNA, 11 bp, Homo sapiens
gctctgatgca

SEQ ID NO: 2440284 - DNA, 20 bp, Homo sapiens
gctctgatgcatcagaaagg

SEQ ID NO: 2440285 - DNA, 17 bp, Homo sapiens
gctctgcgtgtcacctg

SEQ ID NO: 2440286 - DNA, 13 bp, Homo sapiens
gctctggagggga

SEQ ID NO: 2440287 - DNA, 19 bp, Homo sapiens
gctctggggtgggcagttt

SEQ ID NO: 2440288 - DNA, 23 bp, Homo sapiens
gctctgtaagtagatgcatttgg

SEQ ID NO: 2440289 - DNA, 19 bp, Homo sapiens
gctctgtatcaggacccag

SEQ ID NO: 2440290 - DNA, 14 bp, Homo sapiens
gctctgtccccagc

SEQ ID NO: 2440291 - DNA, 21 bp, Homo sapiens
gctctgtctacttgctcaggt

SEQ ID NO: 2440292 - DNA, 14 bp, Homo sapiens
gctctgttcttcct

SEQ ID NO: 2440293 - DNA, 23 bp, Homo sapiens
gctctgttcttcctcagccagcc

SEQ ID NO: 2440294 - DNA, 14 bp, Homo sapiens
gctcttaattgcca

SEQ ID NO: 2440295 - DNA, 18 bp, Homo sapiens
gctcttagcagcttccag

SEQ ID NO: 2440296 - DNA, 19 bp, Homo sapiens
gctcttagcagcttccaga

SEQ ID NO: 2440297 - DNA, 19 bp, Homo sapiens
gctcttgatacccccctct

SEQ ID NO: 2440298 - DNA, 20 bp, Homo sapiens
gctcttgatacccccctctg

SEQ ID NO: 2440299 - DNA, 15 bp, Homo sapiens
gctcttggctggacc

SEQ ID NO: 2440300 - DNA, 21 bp, Homo sapiens
gctctttctctgccagtgaca

SEQ ID NO: 2440301 - DNA, 15 bp, Homo sapiens
gctctttgtcaggga

SEQ ID NO: 2440302 - DNA, 16 bp, Homo sapiens
gctctttgtcagggag

SEQ ID NO: 2440303 - DNA, 18 bp, Homo sapiens
gctctttgtcagggagtg

SEQ ID NO: 2440304 - DNA, 14 bp, Homo sapiens
gctgaaattctcct

SEQ ID NO: 2440305 - DNA, 16 bp, Homo sapiens
gctgaaattctcctgg

SEQ ID NO: 2440306 - DNA, 16 bp, Homo sapiens
gctgaatagcttctcc

SEQ ID NO: 2440307 - DNA, 13 bp, Homo sapiens
gctgaatgttttt

SEQ ID NO: 2440308 - DNA, 16 bp, Homo sapiens
gctgacacctaactct

SEQ ID NO: 2440309 - DNA, 16 bp, Homo sapiens
gctgaccacagcacag

SEQ ID NO: 2440310 - DNA, 21 bp, Homo sapiens
gctgaccagccgtgagcatgt

SEQ ID NO: 2440311 - DNA, 15 bp, Homo sapiens
gctgacggccaggga

SEQ ID NO: 2440312 - DNA, 24 bp, Homo sapiens
gctgacttcatctcccacctagca

SEQ ID NO: 2440313 - DNA, 14 bp, Homo sapiens
gctgacttggctgg

SEQ ID NO: 2440314 - DNA, 15 bp, Homo sapiens
gctgacttggctggt

SEQ ID NO: 2440315 - DNA, 15 bp, Homo sapiens
gctgagaacctggcc

SEQ ID NO: 2440316 - DNA, 12 bp, Homo sapiens
gctgagcaggcc

SEQ ID NO: 2440317 - DNA, 14 bp, Homo sapiens
gctgagcagggccg

SEQ ID NO: 2440318 - DNA, 22 bp, Homo sapiens
gctgagctcacaaggcagcaag

SEQ ID NO: 2440319 - DNA, 20 bp, Homo sapiens
gctgagctctgagaggccct

SEQ ID NO: 2440320 - DNA, 22 bp, Homo sapiens
gctgagctctgagaggccctgg

SEQ ID NO: 2440321 - DNA, 16 bp, Homo sapiens
gctgaggagcagcagg

SEQ ID NO: 2440322 - DNA, 15 bp, Homo sapiens
gcctgggtctcctaa

SEQ ID NO: 2440323 - DNA, 19 bp, Homo sapiens
gcctgggtttggtgtatgg

SEQ ID NO: 2440324 - DNA, 20 bp, Homo sapiens
gcctgggtttggtgtatggt

SEQ ID NO: 2440325 - DNA, 21 bp, Homo sapiens
gcctggttaaataaggcaggg

SEQ ID NO: 2440326 - DNA, 13 bp, Homo sapiens
gcctgtaaacttt

SEQ ID NO: 2440327 - DNA, 19 bp, Homo sapiens
gcctgtactgcctgcttgg

SEQ ID NO: 2440328 - DNA, 17 bp, Homo sapiens
gcctgtagagttgctga

SEQ ID NO: 2440329 - DNA, 19 bp, Homo sapiens
gcctgtagagttgctgaga

SEQ ID NO: 2440330 - DNA, 18 bp, Homo sapiens
gcctgtcagatccaggag

SEQ ID NO: 2440331 - DNA, 20 bp, Homo sapiens
gcctgtcagatccaggagct

SEQ ID NO: 2440332 - DNA, 22 bp, Homo sapiens
gcctgtcctccaacaccaagca

SEQ ID NO: 2440333 - DNA, 15 bp, Homo sapiens
gcctgtcctgcctgt

SEQ ID NO: 2440334 - DNA, 14 bp, Homo sapiens
gcctgtgaacccag

SEQ ID NO: 2440335 - DNA, 13 bp, Homo sapiens
gcctgtgccaggt

SEQ ID NO: 2440336 - DNA, 15 bp, Homo sapiens
gcctgtgccaggtga

SEQ ID NO: 2440337 - DNA, 22 bp, Homo sapiens
gcctgtggccatgaccctgcct

SEQ ID NO: 2440338 - DNA, 23 bp, Homo sapiens
gcctgtggccatgaccctgcctc

SEQ ID NO: 2440339 - DNA, 21 bp, Homo sapiens
gcctgtggttctgagatggct

SEQ ID NO: 2440340 - DNA, 18 bp, Homo sapiens
gcctgtgttcttcctggc

SEQ ID NO: 2440341 - DNA, 15 bp, Homo sapiens
gcctgttcatggcag

SEQ ID NO: 2440342 - DNA, 15 bp, Homo sapiens
gccttagtctcagtt

SEQ ID NO: 2440343 - DNA, 18 bp, Homo sapiens
gccttagtctcagtttgt

SEQ ID NO: 2440344 - DNA, 22 bp, Homo sapiens
gccttatcttgcaccccaaagc

SEQ ID NO: 2440345 - DNA, 22 bp, Homo sapiens
gccttattggaaagcagtcccc

SEQ ID NO: 2440346 - DNA, 22 bp, Homo sapiens
gccttcaagaaaacaggcactg

SEQ ID NO: 2440347 - DNA, 11 bp, Homo sapiens
gccttcaagct

SEQ ID NO: 2440348 - DNA, 19 bp, Homo sapiens
gccttcaagctctgaggga

SEQ ID NO: 2440349 - DNA, 22 bp, Homo sapiens
gccttcacaatctgtcagttct

SEQ ID NO: 2440350 - DNA, 23 bp, Homo sapiens
gccttcagacagagaggactgta

SEQ ID NO: 2440351 - DNA, 17 bp, Homo sapiens
gccttccacccaggggc

SEQ ID NO: 2440352 - DNA, 12 bp, Homo sapiens
gccttccccacc

SEQ ID NO: 2440353 - DNA, 16 bp, Homo sapiens
gccttcctcctgggcc

SEQ ID NO: 2440354 - DNA, 22 bp, Homo sapiens
gccttcgcttcttgcctctgtg

SEQ ID NO: 2440355 - DNA, 14 bp, Homo sapiens
gccttgccagagat

SEQ ID NO: 2440356 - DNA, 11 bp, Homo sapiens
gccttgcttgt

SEQ ID NO: 2440357 - DNA, 13 bp, Homo sapiens
gccttggcctgga

SEQ ID NO: 2440358 - DNA, 16 bp, Homo sapiens
gcctttgccaggtgac

SEQ ID NO: 2440359 - DNA, 19 bp, Homo sapiens
gcctttgcgctcctggccc

SEQ ID NO: 2440360 - DNA, 22 bp, Homo sapiens
gcctttgttccccactggagca

SEQ ID NO: 2440361 - DNA, 13 bp, Homo sapiens
gccttttccctct

SEQ ID NO: 2440362 - DNA, 18 bp, Homo sapiens
gccttttgcaaccaggaa

SEQ ID NO: 2440363 - DNA, 22 bp, Homo sapiens
gcctttttcatttatctataat

SEQ ID NO: 2440364 - DNA, 16 bp, Homo sapiens
gccttttttccccaga

SEQ ID NO: 2440365 - DNA, 17 bp, Homo sapiens
gccttttttccccagac

SEQ ID NO: 2440366 - DNA, 19 bp, Homo sapiens
gccttttttccccagactt

SEQ ID NO: 2440367 - DNA, 15 bp, Homo sapiens
gccttttttctgtat

SEQ ID NO: 2440368 - DNA, 15 bp, Homo sapiens
gcgaccgccccctcc

SEQ ID NO: 2440369 - DNA, 15 bp, Homo sapiens
gcgaccttcctcatc

SEQ ID NO: 2440370 - DNA, 23 bp, Homo sapiens
gcgaccttcctcatccaccccat

SEQ ID NO: 2440371 - DNA, 12 bp, Homo sapiens
gcgactttctgc

SEQ ID NO: 2440372 - DNA, 16 bp, Homo sapiens
gcgactttctgcctgg

SEQ ID NO: 2440373 - DNA, 14 bp, Homo sapiens
gcgagagatgtgtg

SEQ ID NO: 2440374 - DNA, 16 bp, Homo sapiens
gcgagagatgtgtgtt

SEQ ID NO: 2440375 - DNA, 13 bp, Homo sapiens
gcgagcacacaca

SEQ ID NO: 2440376 - DNA, 13 bp, Homo sapiens
gcgagcctgctag

SEQ ID NO: 2440377 - DNA, 20 bp, Homo sapiens
gcgaggagatgctccttggg

SEQ ID NO: 2440378 - DNA, 15 bp, Homo sapiens
gcgaggaggctccag

SEQ ID NO: 2440379 - DNA, 17 bp, Homo sapiens
gcgaggaggctccagag

SEQ ID NO: 2440380 - DNA, 13 bp, Homo sapiens
gcgatgtggaact

SEQ ID NO: 2440381 - DNA, 19 bp, Homo sapiens
gcgatgtggaactgctgcc

SEQ ID NO: 2440382 - DNA, 18 bp, Homo sapiens
gcgattccctctcccagg

SEQ ID NO: 2440383 - DNA, 19 bp, Homo sapiens
gcgattccctctcccaggc

SEQ ID NO: 2440384 - DNA, 17 bp, Homo sapiens
gcgattctcctgcctca

SEQ ID NO: 2440385 - DNA, 18 bp, Homo sapiens
gcgattctcttgcctcaa

SEQ ID NO: 2440386 - DNA, 22 bp, Homo sapiens
gcgcagttttttttttcttgtc

SEQ ID NO: 2440387 - DNA, 22 bp, Homo sapiens
gcgccaggatggaacacggcca

SEQ ID NO: 2440388 - DNA, 18 bp, Homo sapiens
gcgccccaacccgtggag

SEQ ID NO: 2440389 - DNA, 14 bp, Homo sapiens
gcgccctgcagacc

SEQ ID NO: 2440390 - DNA, 13 bp, Homo sapiens
gcgccgtctccag

SEQ ID NO: 2440391 - DNA, 15 bp, Homo sapiens
gcgccgtctccaggg

SEQ ID NO: 2440392 - DNA, 17 bp, Homo sapiens
gcggaccaccctcactg

SEQ ID NO: 2440393 - DNA, 18 bp, Homo sapiens
gcggaggaggagggaggc

SEQ ID NO: 2440394 - DNA, 13 bp, Homo sapiens
gcggccctgtcat

SEQ ID NO: 2440395 - DNA, 18 bp, Homo sapiens
gcggcctatgacttgggc

SEQ ID NO: 2440396 - DNA, 19 bp, Homo sapiens
gcggcctccttctgagctc

SEQ ID NO: 2440397 - DNA, 16 bp, Homo sapiens
gcggctggccatggag

SEQ ID NO: 2440398 - DNA, 17 bp, Homo sapiens
gcggctggggtcccagc

SEQ ID NO: 2440399 - DNA, 18 bp, Homo sapiens
gcggctggggtcccagca

SEQ ID NO: 2440400 - DNA, 22 bp, Homo sapiens
gcggctggggtcccagcagctg

SEQ ID NO: 2440401 - DNA, 20 bp, Homo sapiens
gcgggcacgggtgtcacggc

SEQ ID NO: 2440402 - DNA, 14 bp, Homo sapiens
gcggggaggaggaa

SEQ ID NO: 2440403 - DNA, 15 bp, Homo sapiens
gcggtagccagcaca

SEQ ID NO: 2440404 - DNA, 22 bp, Homo sapiens
gcggtagccagcacacagggca

SEQ ID NO: 2440405 - DNA, 21 bp, Homo sapiens
gcggtgtctctcctgcccctt

SEQ ID NO: 2440406 - DNA, 22 bp, Homo sapiens
gcggttataaaaaatggttcag

SEQ ID NO: 2440407 - DNA, 18 bp, Homo sapiens
gcggttccggcatggaca

SEQ ID NO: 2440408 - DNA, 18 bp, Homo sapiens
gcgtaagtacagagaagc

SEQ ID NO: 2440409 - DNA, 20 bp, Homo sapiens
gcgtaagtacagagaagcca

SEQ ID NO: 2440410 - DNA, 16 bp, Homo sapiens
gcgtaggctacagaga

SEQ ID NO: 2440411 - DNA, 19 bp, Homo sapiens
gcgtaggctacagagaagc

SEQ ID NO: 2440412 - DNA, 21 bp, Homo sapiens
gcgtctggaagtccaatgtgg

SEQ ID NO: 2440413 - DNA, 12 bp, Homo sapiens
gcgtgagcttaa

SEQ ID NO: 2440414 - DNA, 23 bp, Homo sapiens
gcgtgagcttaaaatacaagact

SEQ ID NO: 2440415 - DNA, 15 bp, Homo sapiens
gcgtgtgcaggagcg

SEQ ID NO: 2440416 - DNA, 14 bp, Homo sapiens
gcgttcttgtaatt

SEQ ID NO: 2440417 - DNA, 15 bp, Homo sapiens
gcgttcttgtaattt

SEQ ID NO: 2440418 - DNA, 16 bp, Homo sapiens
gcgttcttgtaatttt

SEQ ID NO: 2440419 - DNA, 12 bp, Homo sapiens
gctaaaagaaac

SEQ ID NO: 2440420 - DNA, 19 bp, Homo sapiens
gctaaataaaatttgttgc

SEQ ID NO: 2440421 - DNA, 20 bp, Homo sapiens
gctaaataaaatttgttgca

SEQ ID NO: 2440422 - DNA, 21 bp, Homo sapiens
gctaaataaaatttgttgcat

SEQ ID NO: 2440423 - DNA, 16 bp, Homo sapiens
gctaacagggaaggca

SEQ ID NO: 2440424 - DNA, 16 bp, Homo sapiens
gctaaggttctaaggc

SEQ ID NO: 2440425 - DNA, 22 bp, Homo sapiens
gctcccccagcaaagcccccag

SEQ ID NO: 2440426 - DNA, 22 bp, Homo sapiens
gctccctcagactggggcaatg

SEQ ID NO: 2440427 - DNA, 18 bp, Homo sapiens
gctccctccgcccccagg

SEQ ID NO: 2440428 - DNA, 12 bp, Homo sapiens
gctccctggggg

SEQ ID NO: 2440429 - DNA, 21 bp, Homo sapiens
gctccctgtaacctcttcaga

SEQ ID NO: 2440430 - DNA, 16 bp, Homo sapiens
gctccctgtgccccca

SEQ ID NO: 2440431 - DNA, 18 bp, Homo sapiens
gcccctctccccagggaa

SEQ ID NO: 2440432 - DNA, 14 bp, Homo sapiens
gcccctctggtcgc

SEQ ID NO: 2440433 - DNA, 18 bp, Homo sapiens
gcccctctggtcgctcct

SEQ ID NO: 2440434 - DNA, 22 bp, Homo sapiens
gcccctctggtcgctcctgccc

SEQ ID NO: 2440435 - DNA, 17 bp, Homo sapiens
gcccctcttggagaagt

SEQ ID NO: 2440436 - DNA, 21 bp, Homo sapiens
gcccctggcagagatgcctcc

SEQ ID NO: 2440437 - DNA, 14 bp, Homo sapiens
gcccctggccccag

SEQ ID NO: 2440438 - DNA, 22 bp, Homo sapiens
gccccttagacagaggccctca

SEQ ID NO: 2440439 - DNA, 17 bp, Homo sapiens
gccccttctgctcagct

SEQ ID NO: 2440440 - DNA, 20 bp, Homo sapiens
gccccttctgctcagctctg

SEQ ID NO: 2440441 - DNA, 23 bp, Homo sapiens
gccccttctgctcagctctgggc

SEQ ID NO: 2440442 - DNA, 12 bp, Homo sapiens
gcccctttataa

SEQ ID NO: 2440443 - DNA, 13 bp, Homo sapiens
gcccctttataaa

SEQ ID NO: 2440444 - DNA, 20 bp, Homo sapiens
gcccgagcagctgagcaggg

SEQ ID NO: 2440445 - DNA, 22 bp, Homo sapiens
gcccgagcagctgagcagggcc

SEQ ID NO: 2440446 - DNA, 23 bp, Homo sapiens
gcccgagcagctgagcagggccg

SEQ ID NO: 2440447 - DNA, 19 bp, Homo sapiens
gcccgaggaggtgtctcag

SEQ ID NO: 2440448 - DNA, 23 bp, Homo sapiens
gcccgaggaggtgtctcaggctg

SEQ ID NO: 2440449 - DNA, 23 bp, Homo sapiens
gcccggatgcagaggcctgcagg

SEQ ID NO: 2440450 - DNA, 17 bp, Homo sapiens
gcccggcagggcgggca

SEQ ID NO: 2440451 - DNA, 13 bp, Homo sapiens
gcccggctcctgg

SEQ ID NO: 2440452 - DNA, 17 bp, Homo sapiens
gcccgtcctgcctgtgg

SEQ ID NO: 2440453 - DNA, 18 bp, Homo sapiens
gcccgtcctgcctgtggc

SEQ ID NO: 2440454 - DNA, 17 bp, Homo sapiens
gccctaagcagaaagtg

SEQ ID NO: 2440455 - DNA, 18 bp, Homo sapiens
gccctaagcagaaagtgc

SEQ ID NO: 2440456 - DNA, 23 bp, Homo sapiens
gccctcaagacccttttgggttt

SEQ ID NO: 2440457 - DNA, 14 bp, Homo sapiens
gccctcaagtcttt

SEQ ID NO: 2440458 - DNA, 14 bp, Homo sapiens
gccctcacccgccc

SEQ ID NO: 2440459 - DNA, 14 bp, Homo sapiens
gccctccacacctg

SEQ ID NO: 2440460 - DNA, 18 bp, Homo sapiens
gccctccctgttccccag

SEQ ID NO: 2440461 - DNA, 21 bp, Homo sapiens
gccctccctgttccccagaga

SEQ ID NO: 2440462 - DNA, 20 bp, Homo sapiens
gccctcctgtgctcagccct

SEQ ID NO: 2440463 - DNA, 22 bp, Homo sapiens
gccctcctgtgctcagccctga

SEQ ID NO: 2440464 - DNA, 23 bp, Homo sapiens
gccctcctgtgctcagccctgag

SEQ ID NO: 2440465 - DNA, 20 bp, Homo sapiens
gccctctcccaccctcttcc

SEQ ID NO: 2440466 - DNA, 20 bp, Homo sapiens
gccctctcccctcagcctct

SEQ ID NO: 2440467 - DNA, 16 bp, Homo sapiens
gccctctctgctctgc

SEQ ID NO: 2440468 - DNA, 19 bp, Homo sapiens
gccctctgcatcctctgga

SEQ ID NO: 2440469 - DNA, 12 bp, Homo sapiens
gccctctgggct

SEQ ID NO: 2440470 - DNA, 13 bp, Homo sapiens
gccctctgggctc

SEQ ID NO: 2440471 - DNA, 17 bp, Homo sapiens
gccctctgggctctgag

SEQ ID NO: 2440472 - DNA, 23 bp, Homo sapiens
gccctgagccagggtctccagaa

SEQ ID NO: 2440473 - DNA, 15 bp, Homo sapiens
gccctgatcccagag

SEQ ID NO: 2440474 - DNA, 14 bp, Homo sapiens
gccctgcaaaagga

SEQ ID NO: 2440475 - DNA, 22 bp, Homo sapiens
gccctgcaccatgctgctgggg

SEQ ID NO: 2440476 - DNA, 14 bp, Homo sapiens
gccctgcagaccct

SEQ ID NO: 2440477 - DNA, 15 bp, Homo sapiens
gccctgcagaccctg

SEQ ID NO: 2440478 - DNA, 13 bp, Homo sapiens
gccctgccactca

SEQ ID NO: 2440479 - DNA, 18 bp, Homo sapiens
gccctgcggtagatggga

SEQ ID NO: 2440480 - DNA, 19 bp, Homo sapiens
gccctgcttcctgcttgcc

SEQ ID NO: 2440481 - DNA, 18 bp, Homo sapiens
gccctggatcagcgtggc

SEQ ID NO: 2440482 - DNA, 19 bp, Homo sapiens
gccctggatcagcgtggcc

SEQ ID NO: 2440483 - DNA, 22 bp, Homo sapiens
gccctggatcagcgtggccttg

SEQ ID NO: 2440484 - DNA, 23 bp, Homo sapiens
gccctggatcagcgtggccttgt

SEQ ID NO: 2440485 - DNA, 12 bp, Homo sapiens
gccctggcctcc

SEQ ID NO: 2440486 - DNA, 17 bp, Homo sapiens
gccctggcctcccctgc

SEQ ID NO: 2440487 - DNA, 24 bp, Homo sapiens
gccctggcctcccctgccaccagg

SEQ ID NO: 2440488 - DNA, 22 bp, Homo sapiens
gccctgggcctgcctcaccacg

SEQ ID NO: 2440489 - DNA, 13 bp, Homo sapiens
gccctgggctgga

SEQ ID NO: 2440490 - DNA, 18 bp, Homo sapiens
gccctgggctggaatcag

SEQ ID NO: 2440491 - DNA, 14 bp, Homo sapiens
gccctggggcctgt

SEQ ID NO: 2440492 - DNA, 23 bp, Homo sapiens
gccctggggcctgtactgcctgc

SEQ ID NO: 2440493 - DNA, 14 bp, Homo sapiens
gccctggtggccct

SEQ ID NO: 2440494 - DNA, 19 bp, Homo sapiens
gccctggtggccctctccc

SEQ ID NO: 2440495 - DNA, 22 bp, Homo sapiens
gccctgtcctggtggtattttc

SEQ ID NO: 2440496 - DNA, 19 bp, Homo sapiens
gccctgtgaggctgggtcc

SEQ ID NO: 2440497 - DNA, 19 bp, Homo sapiens
gcccttatgactgccaaga

SEQ ID NO: 2440498 - DNA, 14 bp, Homo sapiens
gcccttcctggaca

SEQ ID NO: 2440499 - DNA, 21 bp, Homo sapiens
gcccttcctggacagctgtgc

SEQ ID NO: 2440500 - DNA, 22 bp, Homo sapiens
gcccttcctggacagctgtgcc

SEQ ID NO: 2440501 - DNA, 23 bp, Homo sapiens
gcccttgtgaatcaagggtcagg

SEQ ID NO: 2440502 - DNA, 17 bp, Homo sapiens
gcccttgtttggggcag

SEQ ID NO: 2440503 - DNA, 22 bp, Homo sapiens
gcccttgtttggggcaggagta

SEQ ID NO: 2440504 - DNA, 23 bp, Homo sapiens
gcccttgtttggggcaggagtag

SEQ ID NO: 2440505 - DNA, 15 bp, Homo sapiens
gccctttcctcctca

SEQ ID NO: 2440506 - DNA, 22 bp, Homo sapiens
gccctttcggatccagggaggc

SEQ ID NO: 2440507 - DNA, 20 bp, Homo sapiens
gccgagcaaccgtggccctt

SEQ ID NO: 2440508 - DNA, 15 bp, Homo sapiens
gccgaggtccctgct

SEQ ID NO: 2440509 - DNA, 19 bp, Homo sapiens
gccgaggtccctgctgcca

SEQ ID NO: 2440510 - DNA, 21 bp, Homo sapiens
gccgaggtccctgctgccagc

SEQ ID NO: 2440511 - DNA, 14 bp, Homo sapiens
gccgagtccaagct

SEQ ID NO: 2440512 - DNA, 15 bp, Homo sapiens
gccgctgagcgagga

SEQ ID NO: 2440513 - DNA, 16 bp, Homo sapiens
gccgctgagtggcagg

SEQ ID NO: 2440514 - DNA, 12 bp, Homo sapiens
gccggccccagg

SEQ ID NO: 2440515 - DNA, 19 bp, Homo sapiens
gccggcttcatgccagcta

SEQ ID NO: 2440516 - DNA, 17 bp, Homo sapiens
gccggggaactggccaa

SEQ ID NO: 2440517 - DNA, 19 bp, Homo sapiens
gccggggtggggtggctgc

SEQ ID NO: 2440518 - DNA, 20 bp, Homo sapiens
gccggggtggggtggctgca

SEQ ID NO: 2440519 - DNA, 22 bp, Homo sapiens
gccggggtggggtggctgcagc

SEQ ID NO: 2440520 - DNA, 13 bp, Homo sapiens
gccgtaatttaac

SEQ ID NO: 2440521 - DNA, 14 bp, Homo sapiens
gccgtctccagggg

SEQ ID NO: 2440522 - DNA, 18 bp, Homo sapiens
gccgtgacgtctgggtgg

SEQ ID NO: 2440523 - DNA, 22 bp, Homo sapiens
gccgtgacgtctgggtggccct

SEQ ID NO: 2440524 - DNA, 21 bp, Homo sapiens
gccgtgctcgccccagcaggt

SEQ ID NO: 2440525 - DNA, 16 bp, Homo sapiens
gccgtggctgctgtgg

SEQ ID NO: 2440526 - DNA, 23 bp, Homo sapiens
gccgtgggccccaccctcgggga

SEQ ID NO: 2440527 - DNA, 20 bp, Homo sapiens
gccgtggggccgccgcctct

SEQ ID NO: 2440528 - DNA, 22 bp, Homo sapiens
gcctaaaagtgggcttgattct

SEQ ID NO: 2440529 - DNA, 12 bp, Homo sapiens
gcctaagaggct

SEQ ID NO: 2440530 - DNA, 20 bp, Homo sapiens
gcctaagaggctgccctcct

SEQ ID NO: 2440531 - DNA, 13 bp, Homo sapiens
gccatatttgtaa

SEQ ID NO: 2440532 - DNA, 14 bp, Homo sapiens
gccatatttgtaaa

SEQ ID NO: 2440533 - DNA, 16 bp, Homo sapiens
gccatcaaaatgcttt

SEQ ID NO: 2440534 - DNA, 15 bp, Homo sapiens
gccatcacctcagat

SEQ ID NO: 2440535 - DNA, 21 bp, Homo sapiens
gccatctgggctcctccaggg

SEQ ID NO: 2440536 - DNA, 17 bp, Homo sapiens
gccatgatggcaacaga

SEQ ID NO: 2440537 - DNA, 19 bp, Homo sapiens
gccatgatggcaacagatc

SEQ ID NO: 2440538 - DNA, 23 bp, Homo sapiens
gccatgatggcaacagatctgga

SEQ ID NO: 2440539 - DNA, 20 bp, Homo sapiens
gccatgcgccccctccgccc

SEQ ID NO: 2440540 - DNA, 18 bp, Homo sapiens
gccatgctgaggcctggg

SEQ ID NO: 2440541 - DNA, 16 bp, Homo sapiens
gccatggactctgtcc

SEQ ID NO: 2440542 - DNA, 17 bp, Homo sapiens
gccatggactctgtcct

SEQ ID NO: 2440543 - DNA, 17 bp, Homo sapiens
gccatggagaaagctga

SEQ ID NO: 2440544 - DNA, 20 bp, Homo sapiens
gccatggagaaagctgactt

SEQ ID NO: 2440545 - DNA, 17 bp, Homo sapiens
gccatggcctgcaaact

SEQ ID NO: 2440546 - DNA, 18 bp, Homo sapiens
gccatggcctgcaaactg

SEQ ID NO: 2440547 - DNA, 21 bp, Homo sapiens
gccatggcctgcaaactggga

SEQ ID NO: 2440548 - DNA, 15 bp, Homo sapiens
gccatgtccaaagag

SEQ ID NO: 2440549 - DNA, 22 bp, Homo sapiens
gccatgtccaaagaggctgccc

SEQ ID NO: 2440550 - DNA, 21 bp, Homo sapiens
gccatgtcttctccctggaat

SEQ ID NO: 2440551 - DNA, 14 bp, Homo sapiens
gccatgtttagtga

SEQ ID NO: 2440552 - DNA, 23 bp, Homo sapiens
gccatgtttagtgaatgactttt

SEQ ID NO: 2440553 - DNA, 14 bp, Homo sapiens
gcccaaggctcccg

SEQ ID NO: 2440554 - DNA, 20 bp, Homo sapiens
gcccaagtgaggcagccgag

SEQ ID NO: 2440555 - DNA, 20 bp, Homo sapiens
gcccaagttcatgcagctgt

SEQ ID NO: 2440556 - DNA, 16 bp, Homo sapiens
gcccaccccacccact
